United States Patent 7,314,974 (EXPRESSION OF MICROBIAL PROTEINS IN PLANTS FOR PRODUCTION OF PLANTS WITH IMPROVED PROPERTIES) - sequence listing, part 9

SEQ ID NO: 27984 - DNA, 1221 bp, Burkholderia fungorum
cgcttccactatggctggctgaccgtcgcggtggtgtttctggtgttgctggcagcggccggcacgcgcgccacgccgagcgtgatgatggtgccgctcgagcatcaattcggctggagccgcgcaacgatctcactggcgatttcggtgaatatcgcgctgtacggcctgatgggcccgttcgcggctgcggccatgcagcgtttcggcgtgcggcccacgctgctggccgcgctcggcacgatggccgcaggcgtggcgctctcctcgctgatgacgcatccgtggcaaatggtgctgatctggggcgtgatggtcggcggttcgacgggcgtcgcggcgctgtcgttgtcggcgaccgtggtgacgcgctggttcacgacgcggcgcggcctcgtcatgggcattctcacggccagttcggcgaccggccaactggtgttcctgccgatgctcgccgccatcgccgagcatgacggctggcggcaggtggtgtggaccgtcgccattgctgccgccatcgtgattccgctggtggcgtttctgttgcccgaacgtccgtccgacatgaagctgcgtccctacggcgaaccgcacgatacgcccatcaacggcacggtcaccagacagaatccgttggccatcgccttcggcacgctcgcgatggcgagcaagacccgtgacttctggctgctgtttttcagtttttttatctgtggcgcgagcaccaacggctacgtcggcacccatctgatcgcgatgtgcggcgactatggcatgacggaagtgcagggcgcttcgctgctcgccgctatgggcatcttcgatctgttcggcacgacgctctcgggctggttgtcggaccgcttcaatagccgtgtgctgctgttctggtactacggtctgcgcggtttgtcgctgatgtatctgccacacgcgttcggcatcgactttttcggtctgccgctgttcgccgtgttctacggtctcgactggatcgcgaccgtgccgcccacggtgcgcctcgctaccgacgtctacggcaaggaggcggcgccggtggtgttcggctgggtggtcgccggccaccagctcggcgcggcgttcgcggcgctcggcgcggggatgctacgggcgagcctcggcacctacacggtggcgtcgatgatttcgggcggcttgtgcctcgtggcggcggtgatcgtgttgcggatcaaccgg

SEQ ID NO: 27985 - DNA, 864 bp, Burkholderia fungorum
cggcgcgtctatatgcaggaggtgggtacgcgcgacggcttccagtcggaagggatcttcgtcgagacacgggacaagatcgcgctgattgacatgctttcgaagacaggcatggcgaaaatcgaggtgaccgcgttcgtgtcgccgcaggcgatacccgcgttacgcgatgccgagattgtgctgcgcgagatcgaacgcaatccaggtgttatctacacggcgctggttccaaacgtgcgtggtgccgaacgcgcgatcgacgcgcatgcggacgagctgaacctggtgatgtcggcgagtgaaagccacaatctgtccaatctgagaatgacacgcgaccagtcatttaatgcgctgaagcaggtcgcggccattgctcgcgatgctggcctccctgttaacatctctctgtcttgtgcattcgggtgcccaatggaaggtgatgtgtctgcgagcaccgttctcgagtgggcggaacgcttcgtcgaggagatcggctcacggggtgtcactttgtgcgacacgacgggtatggcgtatccgcggcaggttgcggagctgacgtcacaatgtgtcgagcgctggccccagactgaactcacgctgcacttccacaacacgcgcggcatgggcctcgccaacgtactcgccgcaatcgatgccggcgccaaccgcttcgacgcatcactgggtgggatcggtggatgcccgtacgcgccaggcgcgagcggcaacgtgtgcagcgaggagatcgtgcacgcgttggagttgatgggctacgacactggcgttgatctcgacgcgctgatcgccgctgcgaggtgccttccgccgctgattggtcatgatacgcccagccag

SEQ ID NO: 27986 - DNA, 2066 bp, Burkholderia fungorum
atggaacctgcgacttcaccccgtacgctgctcgacaagctgtggcaaagccacgtcgtcgcggaaacgcccaacggcccaacgctgctttatgttgaccgccatctcgtttacgaggtgacaagcccacaagcgttcgaggcgattcgcctgtcgggccgcaaaccctggcggcctgaaacagtactcgcggtcgctgaccataacgtaccgacgatcgccgcggagcgcacgagcatggacgcgatcgctgacccactctcgcgcattcaggtcgcgcagctcgacaaaaattgcaaggagtttggtatcaagtcgtacggtatccggaacccgcagcaaggaatcatccacgtagtcggcccggaactcggggcgacgttgccgggcatgacggtcgtggcgggagactcgcacacgagtacccacggtgcgttcgccgcactggcgttcggggtgggcacgtcggaagtcgagcacgtgctggcaacccaatgcctgtcggttgggaaaatgaagtcgatgctcgtgaacgttgagggcgtactgccggtgggcgtcacggccaaggacgtgattctcgcgatcatccgcaggaccggtaccgccggcggcaccggttacgcaatggaattcgcgggcagcacgatccgcacgctgtcgatggagggtcgcatgaccctgtgcaacatggcgatcgaggcgggcgcccgggtggggctgatcggcgtcgacgatgtcacgatcgactatgtgaaggggcgtcccttcgcgcccgcagaagcacactgggatgcggcggtcgcctattggcgcacgctggtcagcgatgcggacgcccggttcgacaagatcgtcaacatcgacgcaacgcagctacggccgatggttacctggggcacgtcgcccgaaatggtggtcacggtcgacgacgctgtaccgaatccgttggacgatcccgatcccgttcgccgcgccaccatggccggcgcgcttacgtatatgggacttgagccaggtacgtcgctcaagagcatttcactcgacaagattttcatcggctcctgcacgaatgcacgcatcgaggatctgcgtgcagccgccgcgatcgtcaagggcaggcacgtcgcgccgaccgtccagcttgcgctggtggtgcccggctcgggtctcgtcaaggcacaggccgaggccgaggggctggacgccatattcaaggaggccggctttgaatggcgcgaaccgggttgttcgatgtgcctcggcatgaacgacgaccgcctgcgtccgggggagcggtgtgcgtctacatctaaccgaaattttgaaggccgtcaggggcctggtggccgcagccacctcgtcagtcctgcgatggcagccgcggcagcgattgcaggtcacttcgttgacgtttcccacggaggcttctagtgcaaccctttacgaaactggaggcgctggtggtgccgctcgaccgcgtgaatgtcgacaccgacgcgatcatccccaagcagtttatgaaatcggtgcaacgtaacggcttcggcatcaatctgttcgatgaatggcgctacttcgatcacggagagccgggacaggatccgtcgacccgtcggttgaatcccgatttcgtactcaatcaaccacgtttcgcgggtgcggagattctcctcacgcgcgacaacttcgggtgtggatcgagtcgcgagcatgcagcgtgggcgttgtgggacttcggtatccgagcgctgatcgcaccaggctttgccgacatcttctacggcaactgcttcaagaacggcatgctgccgatcaagctcgatgaacgtatcgttcagcagttgttcgatctcgttgggcgtactcccggcctgaggctagcaatcgatctggaggctcagcgcattcaaccaccagccggtgatgcgattccgttcgacgtcgagcccgagcgcaaacgccgcttgctcaatgggctggacgacgtcgctctgacattgcagcaaaccgatcagatccgtgcgtatgaacgcaatcgccgcgcccatgagccctggcttttc

SEQ ID NO: 27987 - DNA, 1041 bp, Burkholderia fungorum
tggagtgacatcgttcaccgtctgacgccatatgtgcctggcgagcagcccgtggttacgcatccggtgaagctgaataccaacgagaatccgtatccgccgtcgcctcgtgtgctcgaagcgatccggcaggaactgggcgacgcagccgaatcgctgcgccgctaccccgatccgacggcgcaaaagctccgcgaaacggttgccgcgtaccacggcatccgcgccgagcaggtctttgcgggcaacggctcggacgaagtgctcgcgctcacgttccaggcactgctcaagcacgacaagccgctgctgtttccggacgtcacctacagcttctatccgacgtacgcgcggctgttcgaagtcgactaccggactatcccgctcgacgatagcttcacgatccacgtcgacgattacatgtcgccgaacggcggcatcctgttcccgaatccgaatgcgccgaccggccgcccgctgccgcttgccgatatcgagcgcctggtggcgagcagtcccgattccgtggtggtgatcgacgaagcgtacgtggatttcggcgcgcagtcggccatcggtttgatcgatcgctatccgaatctgctggtcgttcagaccgtatcgaagtcgcgttcgctggccgggatgcgcgtcggctttgcgttcggcaatccggacctgatcggcgcgctgaaccgtgtaaaggacagcttcaactcctatccgttagaccgcctcgcgcaggctgccgccgcggcggcgtacgaagacgacgcatggtttcgcgacacgtgcgccaaggtcgtggcgagccgtgaacgactggcggccgggctgacggcgctgggcttcgaggtgctgccgtcggccgcgaatctgctgttcgcacgccacgaaggctacgacgccgcaacgctcgcattgcggttgagggacaaggaaattttcgtgcgccatttcaaggctccgcgaatcgaccagcatttgcggatctcagtcgggacggacgccgaatgcgacattcttctggacgcgctgcgg

SEQ ID NO: 27988 - DNA, 642 bp, Burkholderia fungorum
aacatgaagctctatagctatttccgtagctcggcgtcctatcgcgtgcgcattgcgctgaacgtgaagaatctgccgtacgagtacgtgccggtgcacctcgtgcgcgagggcggcgagcaactgaagccggaataccgcaaggtgaatgtggactgcgtcgtgcccacgctcgtcgaaggcaatgacgtgatgccgcagtcgctcgcgatcatcgagtatctggaagaaacgcatcccgagccgccgcttctgcccaaagcgccggtcgatcgtgcgtatgtgcgggcgctggcgttgcaggtggcgtgcgagatccatccgctgaacaatctgcgcgtgctgaagtatctgaagcacacgctgggtgtcgacgactatgcgaaggacgcgtggtaccggcactgggtggaagcggggttcgccacgttcgaagcgcatctggccggcgattcacgcaccggcaagctgtgtttcggcgatacgccgacaatcgccgatacctgtctgattccgcaggtgttcaacgcgcagcgcttcaaggtcgacacggcgaaatttccgacgatccagcgcatctacgatcacgcaatgcaactcgacgcgtttgcccgtgcggcgccagacgtgcagcccgacgcc

SEQ ID NO: 27989 - DNA, 1929 bp, Burkholderia fungorum
gttgaacttgaaatagacggcaagaaagtagaggtgcctgaaggcagcatggtgatccaggctgcgcataaggtcgacacgtacattcctcacttctgctatcacaagaagctgtcgattgcggccaactgccggatgtgtctggtcgatgtcgaaaagatgccgaaagcggtgcccgcgtgcgccacgccggtatcggccggcatgatcgtgcgcaccaagtcggacaaggcggtgaagggccagcaagccgtgatggaattcctgctgatcaaccacccgctggactgcccgatctgcgaccagggcggcgagtgccagttgcaggatctggccgtgggctacggcaaatcggcgtcgcgctatagcgaagaaaagcgcgtggtgttccacaagaacgtcggcccgctgatctcgatggaagagatgtcgcgttgcatccactgcacgcgttgtgtgcggttcggccaggaagtggccggcgtgatggaactcggcatgctgggccgcggcgagcattcggaaatcacgtcgttcgtcggcaagacggtggattcggaactgtcgggcaacatgatcgatctgtgcccggtcggtgcgctgaccagcaagccgttccgctacagcgcccgcacgtgggaactgtcgcgccgcaagtcggtgagcccgcacgattccgtcggcgccaacctcgtggtgcaagtgaagaacaaccgcgtgatgcgcgttctgccgttcgaaaacgaatccatcaacgaatgctggatttcggacaaggaccgcttctcgtatgaaggcctgaacagccccgagcgtctgactcagccgatgctcaagcaaggcggcaagtgggtcgagaccgactggcaaaccgcgctcgaatatgtggtgaagggtttgaagggcatcaagggcgaccacggcgcaaatgcgctggctgcgctcggcagcgcccacagctcggtcgaagaactgtttctgttgaagcaactggcgcaagcggtcggcacgcctaacgtcgacttccgtttgcgtcagtcggatttctccgcgccggtcaacggcgcgccgtggctcggcaccgcgatcgccgatctgtcgaacgtcgacgccgcgctggtgatcggctcggatctgcgccgcgatcatccgctgttcgccgcgcgtctgcgtcaggccgcaaagggcggcgcgaagctcacgctcgtgcaggccaccaacgacgacgcgctgattccgcaagcgcaacgcgtggtagcggcgccgtccgcatggctcgacgcgctggccggtattgccggggccgtgtcggaagccggcggtgtggcgctgccggaagctttcgccggcacgcagccttcggacgccgacaaacaggtcgcgaagtcgctcgccacgggcgaacgccgcctcgtgttgctgggcaatggcgcggtccgtcatccggatttcgcggtcatccaggccgcggcgcaatggatcgcagatgcgaccggcgcgacgcagggcttcctcacggaagcggccaacacggtcggcgcgcatctcgtgaacgcgttgccgggcgagggcggtctgaacgctcgcgaagtgttcgagcaaccgcgcaagggttatgtgctgctgaatgtcgaaccggagttcgacacggccaatccggcgcaggctttggccgcgctgaagcaggctgaaatggtggtcgtgctgtcgccgttccagaccggtgccgactacgccgacgtgctgctgccgatcgcgccgttcacggaaaccgccggcacgtttgtcaacgccgaaggtacggtgcagacgttcaacggtgtcgtgcgtccgctcggcgacacgcgtccggcctggaaggtgttgcgtgtgctgggcagtctgctgggtctgccgggcttcgaattcgagacatcggaagaagtgcgc

SEQ ID NO: 27990 - DNA, 468 bp, Burkholderia fungorum
acgatccgtgccgccacgcccgcggataccggcgcgatcttcgcgctgacgtacgagctcgcggaattcgaaagcctcacgcatgtgttcgtcgcgaccgaagaaggcctgcacgacgcgctgttcggcgcgcggccttccatcgaggcgctggtcgcggaaaacgaaagccgcatcgtcggctatgcgctgttcttccacaactactcgagtttcgtcggcaagcgcggactgtatctcgaagacgtctatgtacaaccctcgcaacgcggcagcggtctgggcaccgcattgcttcggcgcctcgccgcactggcggtggaacggcaatgcgggcggttcgaatggaccgtgctggactggaaccggcaggccatcagcttctacgaaaagatgggcgcgaccgtcatgccggactggcgcgtggtgcgcctgacgggtaacgcgctcgaacagctggcggcgggg

SEQ ID NO: 27991 - DNA, 795 bp, Burkholderia fungorum
atggatctcggactcaaggacaaggtggtgttgatcacgggcggcagcaagggaatcgggctggcctgtgcccgtgcgtttgcgctcgagggcgcgaaagtcgcgatcgtctcgcgcgatcccgccaacctcgcgcgcgcctacgaacagttgaaacacgaaggcctgcacgtgcaccggacccgcgccgatctgcacgaaccgcacagcgccgccgatatcgtcgaggaagtcagcaccgcggtcggcccgatcgatgtgctgatcaacagcgccggcgccgcgcgccgctacgacccggaaacgctcgatgccgaggcgttccgcgccacgatggaagcgaaatacttcccctacatctacccgcagcaggaagtgctgcgccgcatggccgagcgggcaaaatccgggagcgggggcgagcccggcacgatcgtcaatatcatcggcatgggcggcaagatagcgagcgatatccacattgccggcggcgccgcgaatgccgcgctgatgctcgccactgtcggccttgcgcactattacgcgcgctacggcatccgcatcaacgcgatcaatcccggcgcgacgcttaccgagcgtgtcgaggaagccgtcaaactggaggcgacgcagcaaggcatcggcagtgcggaagcgctcgcgcgcggccaggccagagtgccgcttgggcgcttcgccaaaccggaggaaatcgccgatgtcgcgctgtttctggcgagccgccgtgcaagctatgtgacgggcgcgatcgtcccgatggatggaggcagcgcg

SEQ ID NO: 27992 - DNA, 969 bp, Burkholderia fungorum
tattcccgcgtgctgggcacgggcagttatctgccgcccaaccgcgtcaccaatcaggatctggcgaaacgtctcgccgagcagggtatcgagacaagcgacgagtggatcgtcgcccgtaccggcatccacgcgcgctacttcgcggaaccggatgtcacgaccagcgatctggcgttcatcgcttcgcagcgcgcgatcgaagccgcggatatcgacccgcaatccatcgacctgatcatcgttgcaacctccacgcccgacttcgtgtttccgagcacggcgtgcctgttgcagaacaagcttggcatcaggaaccacggcgcggcgttcgacgtgcaggccgtctgttcgggttttgcctatgcggtggcgacggcggacagcttcattcgcagcggtcagcatcgtacggcgctcgtgatcggcgcggaaaccttctcgcgcattctcgacttcaaggaccggaccacctgcgtgctgttcggcgacggcgcgggcgcggtgatcctgcaggcgtccgacgaaccgggcgtgcttgccagcgcgttgcacgcggacggcagccattcgaacattctttgcacgccgggcaacgtgaacggcggtgtggtatccggcagcgcgttcctgcatatggacgggcaggccgtgttcaagctcgccgtcaacgtgctcgaaaaagtcgcggtcgaagcgctcgagaaagccaatctgtcggctgagcagatcgactggctgattccgcatcaggcgaatatccgcatcatgcaaagcacctgccgcaagctcggtttgccgcaggaacgcatgatcgtcacagtgggcgagcacggcaacacgtcggctgcgtccattccgctcgcactcgacgtcgcggtgcgcgacggccgcatcaagcgcggccagaacgtgctgatcgaaggcgtcggcggcggcttcacgtggggcgcgtcggttatccgctac

SEQ ID NO: 27993 - DNA, 891 bp, Burkholderia fungorum
atgaaatttgcgttcgtttttcctgggcaaggttcgcagtcggtcggcatgctcaacgcattcgccgatcaggcggtcgtgcgtgagacggttcaggaagcctccgatgcgctcaatcaggacctcggcaagctgatcgccgaaggccctgccgaagatctgaacctcaccaccaatacccagccggtcatgctgactgcctcgtacgccatgtatcgcgcgtggctgcaggctggcggcccgaagccggcaatcgtcgcgggccacagcctgggcgaatacaccgcgctggtcgcggcgggcgcgattgcgtttcgcgatgccgtaccgctcgtgcggtttcgcgcgcaagccatgcaaacggcggtgccggtcggtgaaggcgcaatggccgcgattctcggtctcgacgacgatacggtgcgcgcggtgtgcgctgaagcgtcggttgcgggtgtcgtcgaagcggtcaatttcaatgcgccggcgcaggtcgtgatcgcgggcaacaaggctgcggtcgaaaaggcctgcgaggtcgcgaaggcgaagggcgccaagcgcgcgttgccgttgccggtctcggcgccgttccactcgtcgctgctcaagcccgcgtcggaccagttgcgcgagtacctggcgagcgtcgacgtgcaggtgccggctattccggtcatcaacaacgtggacgtcgccgtggtcaacgaaccggccgcgatcaaagacgcactggtgcgccaggcggccggcgcggtgcgctgggtcgaaagcgttcaggccatgtcggctcaaggcgtcacgcacgtgatcgaatgtggtccgggcaaggtccttgcgggtttgaccaagcgtatcgacggcaacctggtcggtgcctcgatcttcgat

SEQ ID NO: 27994 - DNA, 744 bp, Burkholderia fungorum
atggaaaagactctcgacaagcagatcgcaatcgtgaccggcgcttcgcgcggtattgggcgagcaatcgcattggaactggcgcgccagggcgcgacggtgatcggcacggcaaccagcgaaagcggcgcggccgccatcagcgaagcatttaacgcagccggtgcgagcggccgaggcgcagtgcttaacgtgaacgacgcggccgcagcggaagcgctgatcgacggtacggtgaaggaattcggcgcgttgcatgtgctggtgaataacgccggcatcacgcaggatcaactcgccatgcgcatgaaggacgacgattgggacgcggtgatcgacaccaacctcaaatcggtgttccgcctgtcgcgcgcagtgctgcgtcccatgatgaaggcgaagggtggccgcatcatcaacatcacatccgtggtcggttcggccggcaacccggggcaagtcaattacgccgccgcgaaagcgggtgtggcgggcatgacccgcgcgcttgcacgcgagatcggcagtcgcggcatcacggtgaattgcgtcgcgccgggtttcatcgataccgacatgaccaggaccttgccggaagaacagcaaacggcgctgaagacgcagattccgctggggcgtctcggcagcccggaagacatcgcgcacgccgtggcctttctggcgtcgccgcaagccggctacatcacgggcacgacattgcatgtgaacggcggaatgtacatg

SEQ ID NO: 27995 - DNA, 234 bp, Burkholderia fungorum
atggacaatatcgaacagcgcgtcaagaagatcgtcgcagaacaactgggcgttgcagaagctgagatcaagaacgaagcttcgttcgtgaacgacctcggcgccgactcgctcgacaccgttgaactcgtgatggccctcgaagacgaattcggcatggaaattccggatgaagaagccgagaagatcactaccgttcagcaagcgatcgactacgctcgcgcaaacgtcaag

SEQ ID NO: 27996 - DNA, 1233 bp, Burkholderia fungorum
gtgagccgccgtcgtgttgttgttacaggcctggggctgatttcgcctgttggcaataatgttgccgacggctgggccaatctggtcgccggcaagtcgggtattgccaatatcacgaagttcgatgcgtcgaacttttcgactcgttttgccggcgaggtgaagggcttcaatatcgaggactacatccccggtaaggaagcgcgccacatggatacgtttatccactacggcgtggctgcaggcatccaggcgatgcaggacagcggcctcgaagtcaccgacgagaattcggagcgtatcggcgtggtggttggttcgggcatcggcggcttgccgatgatcgaagtgacgcaaaccgaactgctcaatcgcggcccgcgccgtatttcgccgttcttcgtgccggcgtcgatcatcaacatgatctccggccatctgtcgatcaagttcggcatcaagggtccgaatctggctatcgtcacggcctgtaccacgggcctgcactgtatcggcgaggcgtcgcgcctgatcgaatacggcgacgcggacgtgatgatcgcgggtggtgcagaatcgaccgtatcgccgctcggcgtcggcggctttgcggcggcgcgcgcgctgtcgcaacgcaatgacgatccggccacggcgagccgtccgtgggacaaggatcgcgacggtttcgtgctgggcgagggcgccggcgtcatggtgctcgaagagtacgagcacgcgaaggcacgcggcgcgaagatttacgccgaagtcagcggctatgggatgagcggcgacgcctatcacatgaccgccccgctggaagacggcgacggcgcgcgccgctgcatgctggcggcgttgaagaacgcaggcatcaacctcgatcaggtgaattatctgaacgcgcatggcacgtccacgccgctcggcgacctggcggaaaccaccggcatcaagcgcgcctttggcgatcatgccaaagacatggtcgtgaactcgaccaagtcgatgaccgggcacctgctgggcggcgccggcggtctggagtcggtgtttaccgtgctggccgtgcatcatcaggtgtcgccgccgacgatcaacatcttcaaccaggatccggcctgtgatctggattactgcgccaataccgcgcgggagatgaagatcgacgtcgcgctgaagaactcgttcgggttcggcggcacgaacggcacgctggtcttcaaacgc

SEQ ID NO: 27997 - DNA, 1061 bp, Burkholderia fungorum
acgccgggcgcacctgcgcgaatgccgacgactactcgctgattctctacacctcgggcaccaccggcaaggccaagggcgtgccgcgccgccaccgccacgaacgcgccgccgcgctcgcacacgttgcgcagaatctgtacggccacggcgagcgcacgctcggcgtgatgccgctctatcacacgatgggcgtgcgctcgctgctctcgatggcgctggtggacggcctgttcgtctgcgtgcgccgctggaatgcgcgcttcgcactcgatgcgatcgcgcagcacaagctcacctgcctctatctggtgccgacgctgtatcacgatctgctcgccgacgcggccttcgcgtcgacggatacctcgacggtgaaaaagctcggctttgccggcgcgccgatgaacgacggtttgctcaagcgcctctcggccgcgttcgaaccggagctgttcgtcaatcactacggctcgtccgaggtctacaccttcagcatcgaccaggacgccacgaagaagccgggcagcgcggggcgcgcgggcatcaacacgcgcctgcgcgtggtcaggctcgaagcccacacgcccgaggatctggcgcaagccggagaagaagggcagatcatcgccgatctgctcggcgacgaagccttcgaaggctactggaaccgtcccgacgcgaacgcgaaatcgttgcgcgacggctggtacttcacgggcgataccggtttcttcgacgcgcaaggcgacctgtacgtgtcgggccgcgtcgacgacatgatcatcagcggcggcgagaacatttcaccggtcgatatcgagtcggtgctgtcgctgcatcccgccgtcgacgaggtcgcggtggccggcgtgaaggacgagcgctggggccagcgcgtggtcgccttcgtcaagcgccgggagtatgtggacgccgacacgctcgacgcgtattgccgcacgtcgaacctcgtcaacttcaagcgtccgcgcgaatacgtgttcgtcgacgacataccgaaatcgccggtcggcaagattttgcgccgcaagctctca

SEQ ID NO: 27998 - DNA, 1263 bp, Burkholderia fungorum
gacgagaccaacgctatgccattcgatgtcgtttccattattggacttggttacattggtttgccgaccgctgcggcatttgccgcacgccgaaagaaggttatcggcgtagacgtatcgcagcgtgcggtcgatacgattaacaaaggtgagatccatatcgtcgagccagagttggacatgctggttcacgctgccgtgacacagggatatctgcgcgcgacccaaacgccggaaccggccgacgcatttcttatcgctgttccaacaccgttttgcgacgggaataaacctgatctgagctacatagaggcggcgagtcgttcgatcgcgccagcgctcaaaaaaggcgatattgtcgtgctcgagtcgacctcgcccgtgggagcgaccgaaaagatgtccgcatggcttgccgaatgtcgccccgatctgacctttccccagcattcaggtgagcagtccgacatccgcattgcacactgtccggaacgcgtgcttccgggacacgttatccgcgagttggtacagaatgaccgtgtgatcggcggcatgactcgccgatgcggcgaattggctcgcgagctctaccagatcttcgttcagggcgactgtattctgacggacgcacgcaccgctgaaatgtgcaaactttccgaaaatgcatttcgcgacatcaacatcgcgtacgcaaatgaactgtcgatgatctgcgatcggctcgatatcaacgtgtgggagctcattcgacttgccaatcgccaccctcgcgtgagcattctccagcctggtccgggtgtcggaggacattgcattgccgtcgatccgtggttcatcgtcgactcagcgcctgaagaggccaaactgattcgggctgctcgcggcgtgaacgacggcaaacctcattacgtgatcgaccagacaaagcgtttggccgcgcgcttcaaggcgcccgtgattgcctgccttggactggcattcaaggccaatatcgacgatttgcgcgaaagcccggcaatagacatcgtcaatcaactcgccgatgagaaggtagcggatattgtcgtggtcgagcccaacgtgtcggttcttccggacgcgcttcgcggcaaagtggagctaaccagcctcgcgagcgctattgaggctgcggatatcgtcctgctcctcgtcgatcatcgcgaattcaaggatatcaaccggcgacgcttgcagtcgaagcttctggtcgatacgcgggggcttttcgcgtgacggagcata

SEQ ID NO: 27999 - DNA, 1029 bp, Burkholderia fungorum
cgcaaagcgatcatcaccggcgtatccggacaggacggcgcctatctgaccaaactgctgctcgacaagggctaccacgtgaccggcacctaccggcgcacgagttccgtcaatttctggcgtatgcgtgagctgggtgtgctcgatcatccgaatctgcgtctggtcgaacacgatctcaccgatctcggttcgacgctgcggctgctcgaaggcgcgcaggccgacgagttgtacaacctcgccgcgcaaagcttcgtgggcgtttcgttcgaccagccggtgacgaccgccgaagtaaccggcatcggcgcgctgaatctgctcgaaggcatccgcattctcaacccgaagacgcgttactaccaggcgtccacgtcggagatgttcggcctcgtgcaggccgtgccgcaacgcgaggacacgcccttctatccccgcagcccctatggcgtggccaagctgttcgcgcattggtcgacgatcaactatcgcgaatcgtatgggctctttgcgagcagcgggattctgttcaatcacgaatcgccgctgcgtgggcgtgaattcgtcacccgcaagattaccgacaccgtcgccaagatcaagctcggcaagcaggacgtgctggagctgggcaacatgagcgcgcggcgcgactggggcttcgcgctcgaatacgtggaaggcatgtggcgcatgctgcaagccgatgagccggacaccttcgtgctcgccaccggccgcaccgaaacggtccgcgatttcgtgcgcatggcgttcgccgcggcggggtatcagctcgaatggtcgggcaaggaagagcgcgaaacgggtatcgatgtcgctaccggcaagacactggtgcgcgtgaatccgaagttctatcggccggccgaagtggatctgctgatcggctgcgcggacaaggctcacgagaagctcggctggaaaccggcaaccacgctggaacagctgtgccacatgatggttcatgcggatctggggcgcaacgagcatcacgagacgttc

SEQ ID NO: 28000 - DNA, 4152 bp, Burkholderia fungorum
atgaaagctctgctcgatctattcaagcaagtccaacagcctgaagtttttgacgcgatcaagatcggtctggcttcgccggacaagatccgttcgtggtcgttcggtgaagtgaagaagccggaaaccatcaactaccggacgttcaagccggaacgcgatggtttgttctgcgcgaagatcttcgggccgatcaaagactacgaatgtctttgcggtaagtacaagcgcctgaagcatcgtggcgtgatctgcgagaagtgcggcgtcgaagtgacgctggcgaaagtgcgtcgcgaacgcatgggccacatcgaactggcctcgccggttgcgcacatctggtttttgaagtcgctgccgtcgcgtctgggcatggtgctcgacatgacgctgcgcgatatcgaacgcgtgctgtatttcgaagcatacgtggtgatcgatccgggcatgacgccgctgaaagcgcggcagatcatgacggaagaggattactacaacaaggtcgaagaatacggtgacgaattccgtgccgagatgggcgcggaaggcgtgcgcgagctgctgcgcgcgatcaacatcgacgaacaggtcgagatgctgcgcaccgaactcaagaacacgggttcggaagcgaagatcaagaagtacgcgaagcgcctgaaggtgctcgaggctttccagcgttcgggcatcaagcctgactggatggtgctcgaagtgctgccggtgctgccgccggaactgcgtccgctggtgccgctcgacggcggccgcttcgcgacgtcggacctgaacgacctgtatcgccgcgtgatcaaccgtaacaaccggttgaagcgtctgctcgaactgaaggcgcctgaaatcatcgtccgcaacgaaaagcggatgctgcaggaagccgtcgattcgctgctcgacaacggtcgccgcggtaaggccatgaccggcgcgaacaagcgtccgctgaagtcgctcgctgacatgatcaagggtaagggcggtcgtttccgtcagaacctgcttggtaagcgcgtcgactattcgggccgttcggtgatcgtggtcggcccgacgctcaagctgcatcagtgcggtctgccgaagctgatggcgctcgaactgttcaagccgttcatcttcaacaagctcgaagtgatgggtgtcgctaccaccatcaaggccgcgaagaaggaagtcgagaaccagacgccggtggtgtgggacattctcgaagaagtcattcgtgaacatccggtcatgctgaaccgtgcgcctacgcttcaccgtctcggcattcaggctttcgagccggtgctgatcgaaggtaaggctatccagttgcatccgctcgtttgcgcggcgttcaacgccgacttcgacggtgaccagatggctgttcacgtgccgctgtcgctggaagcgcagatggaagcgcgtacgttgatgctggcgtcgaacaacattctgttcccggccaacggcgatccgtcgatcgtgccgtcgcaggatatcgtgctcggtctgtactacgcgacccgtgaagcagtgaacgccaagggcgaaggtctgacgttcaccggcgtttcggaagcgttgcgtgcgtacgagaacaaggaagtcgagctggcctcgcgcgtcaacgtgcggatcacggaaatggtccataacgaagacaagtcggacggtgcgccggcgttcgtgccgaagatctcgctgtacgcgaccaccgtcggccgcgcaatcctgtcggaaatccttccgccgggcctgccgttttcggtgctcaacaagccgctgaagaagaaggaaatctcgcgcctcatcaacaccgcattccgcaagtgcggtctgcgtgaaacggtgattttcgccgaccagttgatgcagtcgggtttccgtctggcaacgcgcgctggtatctcgatctgcgtcgacgacatgctcgtgccgccgcagaaggaaaccatcgttggcgacgccgcgaagaaggtgaaggaatacgaccgtcagtacatgtcgggtctcgtcacgtcgcaagagcgctacaacaacgtggtcgacatctggtcggcaacgtcggaagcggtcggcaaggcgatgatggaacagttgtcgacggaaccggtcacggatcgcgacggcaacgaaacgcgtcaggaatcgttcaactcgatttacatgatggcggactcgggtgctcgtggttccgcggttcagattcgtcagctggccggtatgcgtggcctgatggcgaagccggacggctcgatcatcgagacgccgattacggcgaacttccgtgaaggcctgaacgtgttgcagtacttcatctcgacccacggcgcacgtaagggtctggctgatacggcactgaagacggcgaactcgggttacctgacgcgtcgtctcgtggacgtgacgcaggatctggtggtggtcgaggacgattgcggtacgtccaacggcgttgccatgaaggcgttggtcgaaggcggtgaagtcgtcgaagcgctgcgtgaccgtattctcggtcgcgtgacggtggctgacgtcgtcaatccggaatcgcaggaaaccctgtacgaaacgggcacgttgctcgacgaagatgcggtcgaagaaatcgaacgcctcggcatcgacgaagtgcgcgtgcgtacgccgctgacttgcgagacgcgttacggtctgtgcgcagcctgctacggccgcgacctgggccgcggctcgtcggtcaacgtcggtgaagcagtcggcgtgatcgctgctcagtcgatcggtgaaccgggcacgcagcttacgatgcgtacgttccacatcggtggtgcggcatcgcgtgcggcagtggcttcgtcggttgaagcgaagtcgaacggtacggtgcgtttcaccgcaaccatgcgttacgtcaccaacgcgaagggcgagcagatcgtcatctcgcgttcgggcgaagcgatgatcaccgacgaccacggtcgcgagcgcgaacgtcacaaggtgccgtacggcgcgacgctgttgcaactggacggcgcgcagatcaaggccggcacgcaactggccacgtgggacccgatgacgcgtccgatcatcaccgagtacggtggtacggtgaagttcgaaaacgtcgaagaaggcgtgacggttgccaagcagatcgacgacgtgacgggtctgtccacgctggtcgtgatcgacgtgaagcgtcgtggttcgcaagcgtcgaagacggtgcgtccgcaggtcaagctgctcgatgcgaacggcgaagaagtcaagatcccgaacaccgagcactcggtgcagatcggcttccaggtcggcgctctgatcaccgtgaaggatggtcagcaagtgcaggtcggtgaagtgctcgcacggatcccgactgaatcgcagaagacgcgtgacattaccggcggtctgccgcgtgtggcggaactgttcgaagcacgttcgccgaaggacgcaggtatcctggcggaagtcacgggtacgacgtcgttcggtaaggacacgaagggcaagcagcgtctcgttatcacggacctcgagggcaaccagcacgagttcctgatcgcgaaggaaaagcaggttctggtgcacgatggtcaggtcgtcaacaagggcgaaatgatcgtcgacgggccggcggatccgcacgacattctgcgtttgcagggcgtcgaagcgctgtcgcgttacatcgtggacgaagtgcaggacgtgtaccgtctgcaaggcgtgaagatcaacgacaagcacattgaagtgattgttcgtcagatgctgcgccgcgtgcagattacggacaacggcgatacgcgtttcatcccgggcgaacaggtcgagcggtcggatatgctcgacgagaacgaccgtatgatcgcggaagacaagcgtccggcaacgtacgaaaacgtgctgctcggtatcacgaaggcctcgttgtcgaccgattcgttcatctcggcggcgtcgttccaggaaacgacgcgcgtgctgaccgaagcggcgatcatgggcaagcgcgacgacctgcgtggtctgaaggaaaacgtgatcgtcggccgtctgattccggccggtacgggtctcgcgttccacaaggcacgcaagagcaaggaactgtccgaccgcgag

SEQ ID NO: 28001 - DNA, 1575 bp, Burkholderia fungorum
gaaatgtgcgtcggggacgcgctggatgaggcggcgcgaaagtggccggagcgcacaggttgggtttttgaggaagagcatatctcctatcagcagatgaaggagcatgtcgaccgggtcgcccgtgcgttgctcgcgagcgggatcgagcgcggcgacgtggttgcagtgtggatgccgaatcttccgcatttcgcgttcattgagctcgcctgcgcaaagattggcgcgattatcggcgcgatcaatacgcgttcgaaggtcttcgaggtcgagcattttatgaagcatagcgaggcgaagctcctcgtgatggtcgaccgttttatcaagcatgatttcgtcgcaacgctgaacgaggtttgcagaggcgaagcgaggcaaattggtggtgacgttgcggccggcggagtcgggcagttgcgcaaggtggtgagcgtgtcgtcggcgcctgatagtcgtgctcaatcgtggaccgccttcatcgcacttggggagtccgtcacggccgaggcactcgcgacgattcagcgtcagcagaacattgacgatccgattcttatccagtacacctcgggcacgacatcgcttcccaaaggtgcgctctgcaaccaccgttacgtcctgaacttcggtggggtgctgatgcagagactcggcatggaggaaggcgacgcgtttctcaatacccaaccgttttaccatgttgggggatcctgcggcgccgtgcccgctccccttacgctggggtgtacggtcgtcagcgccgaatactacgaggtcgagcgcatcctctcgctaatcgagcgtgagcgctgtgtggcccgctcggggtatggcgcgatgtatatcatggagatgaatcatccgcgttttcgcgagttcgatctgtcgagcctgaaggcaggatggtgtgtcggtacggccgagctgatgaaccgagttcgcaacgagatgaacatccctggtctgctgcagatctacggtgcgacggaggtaggcggtacgagcgcgtgggtcgatgatccgtgggagttgcgctctagcagttgcggctcgccaatctacggcaccgaattgaagatcgtcgatccggccactggcgcgacgcttgcgtccggcgagatcggcgagatctgcatgcgcggttggtggaagatgaacggctatctcaagcagccggccgagacggctagcacggtcgacgctgacggatgggtgcacactggcgatctcgggcatgtcgacgaggctggcaatctttatttttccagccggctgaaggacatgctgaagatcggtggcgagaatgtctcggcgcaggaagtggaagcggtgctactcagtcatccgcgcatcgcacaggttgcggtgatcggcgcgcccgacgagcgtctgaccgaagtggtcatggcgatcgttgagccgcgtcataacgagcaggtcacggaagaagaagtgattgcatattgcgcgcagcggatggccaacttccgcgtgccacgttatgtgcgcattacgcaaacgtggccgcttaccgatagcggaaaaattcagaaacacaagttgcgcgag

SEQ ID NO: 28002 - DNA, 711 bp, Burkholderia fungorum
gatgagggccgtctacgttatgtgacgatctgccgcgaaagccgtgccaatgcgttgtcggtcgcgatgttgggatcactcgccgatgcgattgcgtcggctggccgtgtgtccgcaatcgacgcaatcgtactccggtcgacaggtgtgaacttttgcgcgggcgctgacatgggcgaactgagaacgcatcgccggcaacaatatgacgcattgcgcacgctgatcgccgcactcgacaagcgcgcggtgccgctactgtgtgtgatgcaaggtagggcgcttggcgcggggtgcgtgttgtcagcgctcgcggatgtcgtgattgcgtccgacgaagccacgcaaggctttcccgagatgcgcttcggtatgtacccttcgctggttcatgcggtgcttgtacagaaattgcctgagccgctcgtgtatgcgctttgcgtcggcgcgcgggtgttgagcgcgcacgatgcgtggtcgctcggacttgttaccgaagtgcttcctgcggacgatttcacgaagtgcgcgcgcgaccgcgtcgagttctatgtggcgcggaccgccgcggtccgctacggccgcgagatgatggatcagtctgcgagagagatgctgctggcgcgcgtggcgaaagcggaacatatcatcgaccgtaaccttgccgatcccgaggtggaagcgatgctgtcgagctacaggaaatgacgc

SEQ ID NO: 28003 - DNA, 489 bp, Burkholderia fungorum
ctcaccctgatcgtcgctcgcgccaacaacggcgtgatcggccgcgacaaccagttgccctggcgacttcccgaagacctcgcgttcttcaagcgcaccactatgggcgcgcccatcatcatgggccgcaaaacgcatgagtcgatcggccggcccttgcctggacgccgcaacattgtcgtgacgcgcgatgccacacgccgcttccagggttgcgacacggccgcgacgctccaggaggcgctcaagctcgccgcgcaggatcaggcgcccgaagcgtttctgatcggcggcgcgcagttgtatgtggaaggcttgcggcaagcggacaagctcatcatcaccgaaatttccgccgacttcgaaggcgacgccacgttccccgaactcgacgaaaccgagtgggaagaagtcgcgcatgaaacgcaccgcgcggacgcgccgaacgatttcgactacgcgttcgtgacgtacaaacgcaagggtgcc

SEQ ID NO: 28004 - DNA, 930 bp, Burkholderia fungorum
cagccgctgtccggcaacgccatgccccgctgcggcggcatcgcaacgatgatgcggctgccgaacgtcggctccgccgaagggttcgacgcctgcttcgtcggtgtgccgttcgatctcggcacttcgaaccgcacgggcgcgcgcttcgggccgcgccagatccgcagcgagtccgtgctgctgcgtccgtacaacatggcgacgcgcgcggcaccgttcgattcgctgcgcgtggccgatctcggcgacgtcgcgatcaacccgtacaacctgcacgattcgatcgcgcgcatcgaaaccgcgtacgacgaaattctccagcacgattgcaagccgatcacgctgggcggcgatcacaccatcgcgctgccgatcctgcgcgcgatgcatcgcaagcacggcaaggtcggcctgattcacgtggacgcgcacgccgacgtcaacgacacgatgatgggcgagaagatcgcgcacggcacgccgttccgccgcgcggtggaggagggtttgctcgattgcgggcgcgtcgtgcagatcggtttgcgcggcacgggttacgcggcggaggacttcgactggtgccgcgatcagggtttcgaagtcgtgcaggccgaggcctgctggaaccagtcgctcgcgccgctgatggcgcgtgtgcgcgagcgcatgggcgacggccccgtgtacatcacgttcgacatcgacgggatcgatccggcttttgcgccgggaacgggcaccccggaaatcgcgggtttgacggtgccgcaggcgctggaaatcattcgcggctcgcgtgggctgaatatcgtcggctgcgatctggtcgaagtcgcgccaccatacgatccgttcggcacgaccgcgctgctcggcgcgaatctcgcgttcgaattgctgtgtgtgttgccgggcgtcgagtatcgg

SEQ ID NO: 28005 - DNA, 964 bp, Burkholderia fungorum
tgccgaaatgttatggtggccaagccatcggaggagacgcctgtgaaccgccacactgctcgccgaggtcatgcagacggtagggttacctgctggcgctttcaacctggtgcatggcttcggcccgaactcggctggggagttcatcaccacgcatccgggcatcaatgccatcaccttcacgggcgagtcgaagacgggcaccgccatcatgcacgccgctgcggaaggcgtgaagcccgtgtcgttcgaactgggcggcaagaacgccgccatcatcttcgccgactgcgactttgacaagaccgtggcaggcatgacgcgcgcggcattcctcaatagcggccaagtctgcctgtgctccgagcgcatattcgtcgagcggccaatctatgaccgcttcgtgaaggcacttgccgaacgcgcgaaacagatcaagctcggtgaccccaccgacgaggcgacgtgcatggggcctgtcatctctgccgcccatcgcgacaaggtgctcagctactacgcgctggcgcgcgaggaaggcgcagagttcatcacaggcggcggaacaccctctttcggcaaccagctcgatggcggcttctgggttgaaccgacactactcgccggcctgcccgacgacgcacgatgcgtcacggaagagatttttgggccgattggtcacgtcacgcccttcgactcggaggcagaagttatccagcgcgcgaacgcgacgccctatggcttggccgcgacgatctggacgagcaatgtgaacaaggctcatcgcgtcgcgcagtccatgaacgtgggcgtcgcctgggtcaatgcctggttcctgcgcgacctgcgaaccccgttcggtggcagcggcctgtcgggtatcggccgtgagggggggctccactcgctgaacttctattccgagctcacgaatgtctgcatccatgtagatgcgccggatggc

SEQ ID NO: 28006 - DNA, 897 bp, Burkholderia fungorum
caagtcaactggaaaggtgttttccccgctgtcacgaccaaactgaaggatgacggttcgctcgatcacgaagcgatcaaaagcggtttgaaccgcctgatcgagaacggtgtcggcggtgtggtgatgatgggcatggtcggtgaaaatgcccaactcaccgcggacgagaagcgtacggtgctgaaactggccgttgagaccgttgctggccgcgtgcccgtgatctcgggtctcgcagaaacgagcaccgcgctggctgtccagtttgttcaggacgccgaggcaatcggcgtgcagggtctcatggtgtttcccggcttgacgtaccgctcggatgaccgcgaaaccgtcgagttctatcgcacgatcgcacggtccaccaggcttggcctgatgatctacaacaatccgcgcggctacggtgtggacatgcgccccgatctgatggaccagctcaaagacgaagcgaacgtggtcgcgatcaaggaagaaacgtacgacaccacccgcgtgacggacctgttgaagcgtttcggcgatcgcttcgcggtgttctgcggcgttgacgacctcgtgctggaatcggcggcactgggtgtaacgggctgggtctcgggcatggcgaacgccatgccgaaggaatcggtcgagttgctgaacctggccgtggcgggtgatttcgtcaaggcgcgcgagctttatcgcgcgctgatcgacctgttccacctggatgtgcatgtgaagctggttcagtacatcaagctggcggaaaacatgacggccggctacccggaaaacgtcaaggcgccccgcctgaagctcgaaggcgaggagcgtcagaaagtcgtggcgatcgtcgaacaggccatcgccaacgtacgcgcgctgtccaac

SEQ ID NO: 28007 - DNA, 1440 bp, Burkholderia fungorum
gaaaccagtatgtcgcaatatcgcagcttcattaacggagaatggcttggtacgacgagcacattgccgaacctcaacccgtcggatctgtccgacgtcgtgggcgaggccctgctcgccgatgatgcgctggtcgccgacgcgatcgccgcggcgcgtcacgcattccgctcgtggtcgctgacgactccacaacagcgagccgacattctcgacgccgcgggaacccgaatccttcagcgcaaagaagagttagggacgttgctcgcgcgcgaggagggcaagcgtcttcccgaggcgatcggggaagtgggccgcgcgggcaacatcttcaagttttttgccggcgaagcgctgcgcattggtggcgaggtggtgtcgtcggtgcggccgggtatgacggtcgaagtgacacgggaaccgctcggtgtgatcggcatgattacaccgtggaatttcccgatcgccattcccgcatggaagatcgcgcccgcgcttgcttatggaaataccgttgttatcaagccggccgaggcagtgcctgcgtgcgccaccgaactggtgaagattctcgaagaatcgggtttgccggccggcgtggtcaatcttttgctcggaccggggcgcgtggtcggcgaagcgttggtcgcgtcaccggacatcgacgcaatcagcttcacagggtccgagagcacggggcgggcgatcgcggtgaagtgcgtgacgagcggcaagaaagtgcagcttgaaatgggcggcaagaatccactggtggtcatcgatgacgcggacctcgacgttgcggtagaggcggcccttgacggctcgttcttctcgacaggccagcgatgcacggcgtcgtcgcgtctgatcgtcacgtcggccattcacgggcaatttgtcgccgcgctgcagcgcaaggcgtccgaactggtggtgggacatgcgctggacaaggcgacgcagatcggaccggtgctggatgatcgtcaactgcaacagaacctgaagtatctgaagattgccgcagaagagggcggccaggtgctgggcggtgaacgggtcgagcgtccgacgcggggctacttcatgcgcccggcgctcgtcatcgggaccgacaatacgatgcgtatcaaccgggaagaagtattcggcccggtcgcatcggtcatcaaggtcgcagactacgaagaagcgctcgcagtgtccaacgatacgccgtacgggcttgccgccggcatctgcacgacgtcgctcaaatacgcgagccatttcaggcggcatgcggaagcgggaatggtgatggtcaatgcgccgaccgcgggtgtcgattatcacgtgccgttcggcggtcgcaagcgatcgagctacggtccgcgagagcagggcacgtatgcgcgggagttctacaccgtcgtcaaaaccgcgtacgtgaaggcg

SEQ ID NO: 28008 - DNA, 696 bp, Burkholderia fungorum
gtaggcgcgagcgcgggactgggcgcggcactcgcgcgccgttttgcgcgcgagggtttaaacgtcaccgtgacagggcgctcgcgcgagcggctcgatacggtggtcgccgaaattcagcacgccggcgggcaggccctggctttacccggcgacgtcacgagcgagagcgaccttgcggccattgcgcggcaactcgcggaacgaggcacgctcgaagtcgcgatcttcaacgccgcgggcgcgacgcgtgccccgacgctcgatctgagcgccgagcagttcgaggcggcatggcgcgtcacgacgctcggcggcttcctgttcgcccgggcggcgttgccgccgttgctggcggccggccgcggctcgctgctgttcacgggcgcaacggcttcgctgcgcggccgcccgccgtttgccgcgttcgcttccgcgaaggccggcctgcgctcgctcacgcagagcctcgcgcgcgagttcgggccacagaatatccatgttgcgcatgtggtggtggatggcggcatcgacggtgagcgcctgcgcacctccgcgccgcagcgggcggccgaacgcggcccggacggactgctcaatcccgacgagatcgccgactcgtactggcgtctccatcagcaggggcgcagcgcatggtcgcaggaaatcgacctgcggccgttcaacgaatcgttt

SEQ ID NO: 28009 - DNA, 903 bp, Burkholderia fungorum
atacggcgcgtagcggtagtgggaacgggggtgattggcgcgagctgggccgcctgttttctgtcgcgcggtctgcaggttgccgcgaccgatccttcgagcggcgcacgccagcgtctggagcacgccgtgatgcagcattggccgacgctcgtcacggccgggctcgcatccggcgcgtcgctgggcaatctcacgttccacgattcgctcgatgctgcgctggaaggtgcgcagttcgttcaggaaaatggcccggagcgcatcgacgcgaagcgtgagctgttcgccgcaatcgacgccgctacggcaagcgatgtggtaattgcatcgagctcatcgggattgctgatcagcgatgtgcaaaccgcctgccggcacccggagcgggtcgtgctcggtcatccgttcaatccaccgcatctgattccgctcgtcgaggtgatcggcggacgcttgacgtcggagaccgcgattcgcgccgcgatcgatttctatcgtgcgatcggcaagcgccccattaacccgcaaaaagaaatttccggccatatcgcgaaccggttgcaggctgcgctgtggcgggaggcgttccatctggtgtcgatcggcgctgccaccgtgcaggacatcgacgatgcgatcgcgtatgggccaggtttgcgttgggccgtgatgggaccatttgcgaatctgcatctgtcaggcggagccgagggaatgcggcacctgctcgagcatctgggcgccccgatcgagaactggtgggcgcaactgggcacgccggccatgacgcccgacttgaagcggatggtgatcgacggtgtcgatgccgcgcttgccggccgcaaggacagcgacctggctgcgcaacgcgacctgatcattctcgacgtgctacgtgcg

SEQ ID NO: 28010 - DNA, 648 bp, Burkholderia fungorum
ctgacctccatcccggtagtcgcggcggccagccgacgccagcggattgcgctgatcggccttcggggcgccggcaaatcaaccttgggcgcgctgcttgcgaaacacctcgatgtccccttcgtcgaactcgacaggatgatcgagcaggaagccggcatcgccataggcgaggtcatcacactgtatggacaggctggcatgcggcggctcgaacggcgatgcatcgagaagatcatcgaaacgcatcccgaagtggtcgtcgcaacgggcggcgggatcgtcgccgaggccgcaacctatgaactcctgcttcggaccttccgtaccatgtggctgaaagcgcggcccgagattcacttcgcgcgcgtcatggcgcaaaacgatgcgcgcatcgcaacgcagacgctgcgtaacgatgcgttggagcacatccaccgcatgctcgacgcgcgcgagcagctttaccagctcgctaacgtgacactggacacttccgatctgaccgtcgaacaggcactacaacgagcggtggagtgcatcgagctgaacgtaccggtgctgcaaacacacaagaccgcaagtctgccagtttcgatcgaagccaagtcggcacgataatcagcggccctgcgagcttcacgcaac

SEQ ID NO: 28011 - DNA, 1428 bp, Burkholderia fungorum
cagcgctgggcggaacgcgatttcatcgtccagggcgcccggcgaatcaccggcgctcagcatgcgcatgctgtcgcgcgagtggcgcgaatgcttcgcgagcatggcgtgcgcacgcgcgaccccgttgtcctgctcggctacaaccatatcgaatggctggttacattctgggcactccaggcgctaggcgcgaccgctgtcctgggcaatgcctggtggagcgataccgagacgaccacggtactcgaaacggtccgaccgacgctggtcatttctgaccgtgcacgcgaacggttcggaccgggcgacgccggcttcatctccttttcggaactgcgcccattcgtagaagcaggggaagaactaccgctcgatctgacaccagtggacgaagaatggccggcatgggtgatcttcagctctggcacgaccggccacgccaaaggcgtggtgatgagtcaccgcagcgtgattgcgaacatccagaatgtcctgacactcacaggccgtctgccaagcgaattgcccccgagccatcgaggcacggtcagtctcgtgagcatgccgctatttcatctggccggaatccagatctccctgatgagcatgctctcaggaggaaagcttgtgtttctcgctggcaaattcgacccgctcgaagtgcttcggctgatggagcgggaacgcgtgcgctcctggggcagcgtacccaccatggtttcccgggtcatccagcatccggattttggtaaatacgatacgtcaagtgtttcgagtgttcagatgggcggagccgcagttccacacgcattgcgcctggaggtccagcaggcgttcccgaatacgcgccgtcgcgttggcagcatgtatggcttgaccgaagccggtggggtactcgcggcgggctcgggcgatgatctggaaggcaaacccggttgcgtgggcaaaccgctgccgtctgtcgaaatcgtcatccgcaaccctgacgcacaaggtgtgggagagattgcagcccgagcaccgagtgcgacgagcggctatctcggcgatccgacgccgatcgcggacgcggacggctgggtcctcacgggagaccttggacgtttcgacgacgccgggtacttgtacatcgtcggtcgttcgaaggacaccatcatccgcggcggagaaaacatcgccagcgtccacgtcgaatcagtgctacgaacccatccggacgtcctcgacgtggcggtcgtaccgctgcccgatgccgatctcggtgaagaagtcgcagccgcggtcgtactaagacatggcgcagccatctcaagcgaagatctgcgcgcttacgcatcccgcgaactcggcaaatttgaagtaccgtcccgatggtggctacgccacgatccgctgccgaccaatgcgtcgggcaagacgatcaaa

SEQ ID NO: 28012 - DNA, 759 bp, Burkholderia fungorum
agacttgaaaggaaacgaacattgattactgcagcggcatcgggtatgggcgctgcgggcacgcgcctgtttgctgaacacggtgcgcgcgttgccgctctcgaccgcgacggagccgccctgcaacgcgtggtcgatgacgtaaagagtcggggaggcgaagcccggggctttgtggtcgatctgacccaccggcaggcgacgctcgacacagtgcgcgaggctgtcgaatggctcggcggaattgatgttttgtggaatcacgccgggatgcctgcaccctcgaacatcgaggacttcgaattcgaacaatacgagcgctccatcaatctgaacgtgacctcggcggtggtgatatccagtgcaatcctgccgtggatgactgcgcagaagagcggctcgattatcttcacttcgtcgacgtcggggctcgttgggtcagcgttaagcccgctctactccgctttcaaatccggcattgtcggtttgacgaagggactggccgtcagatacgcggcgcagaacgtccgcgtcaatgcattgtgtccgggcccggtgtcaacgccaatgttgcacaacgacttcatcgccggcgacgccaggttcgacaaggaagaaaacctcaagcgcgtcatctcggtcgtccccatgggacgtatgggtgagccagtcgagatcgcccatgccgcgttgtggctcgcctccgatgaatcgtcgtttgtcacgggcgtcgccttgccgatcgacggtggccagaca

SEQ ID NO: 28013 - DNA, 1308 bp, Burkholderia fungorum
ccggtgttgaatcctgcgaccggaaaggttgcggcgtccgcgccggcagcatcagtacaacagctggaacgcgcaattacggcagcgaaccgcgcttttgcgggctggcgggataccccgttcgctgagcggcgcgccatcgtgctcaaaattatcgacatcatcgcagcaaaccagggtgaactgtcgcgactgctgacgctcgagcaaggcaaaccactcgccgcggccgcgggagaagtctccgccacgatcgactatttccgctacttcacgaccctgtcgctcgcgccggaagtccggcaggataacgagacgcgctatgtcgaggtgcgccgcgatcctctgggtgtggtagccgcgatcattccgtggaattttccccttctgctcgccgccttcaaattgcctgcggccttgctagcgggcaacaccgtcgtgctcaagcccgctccgaccaccccgctcgcgacccttcatctcgggcgcctgattgccggagcggtacctgccggggtcgtcaatatcgtctcgggtggagacgaactgggacccgtactgacctcccatccggggattcgcaaggtcagtttcaccggctcgacggagacaggcaaaaaagtgatggcatctgctgcgacccatctggcgcgggtgaccctcgagctcggcggcaacgatccggccatcctgcttgacaaggtcgatctggagcatactgcaacggccatcttcgcatcggcgttcggcaatagcggacaggtctgccgcgcgatcaagcgcgtttacgtgccacggccaatctacgagcccttctgtgcagcgctcgcggaacgcgcccgcgcggcagtggtcggtgacggcctcaccgatggcgtgcaattcggccccgtacagaatgcagcacaatttgagcgtctcaaagagcttcatgccgacgcgcagcaacgcggcaccgtcatgcctggcggcggcccggtgaaaggacctggctacttcttccggccaaccattgtgaaggacatcgcgtctgacagtcgtctcgtcgtggaggagcagtttggacccatcctgccagttattgcctacgacgaactcgaagaagcagttgagatggcaaacaacagccaatacgggctggccgcgtcggtctggtcaactgattcacaggcggcttttgccgtcgcggaccggattgtcgcgggaactgtctggatcaacaaacacacggaccgtatgccagatcttccgatcgcgggtgcccgacagtccggcatgggcgtggaactcggcgaggaaggattacac

SEQ ID NO: 28014 - DNA, 1479 bp, Burkholderia fungorum
atgaacgaaacgcctgccttgccggcgtggctggacggatcgccgaagctattgctgatcgacggacaacccacgcccgcccgttccggccgcaccttcgaaacgatcaatccgactaccggcaaagcgctcgcgcaaatcgcagaagcagacgagaaagacatcgatctggccgtcgccgccgcaaggcgcgcactggatggaccgtggggcagattcaagccgttcgatcgtcaggccgttctgctcaaactcgccgacctcgtcgaaacgcatttcgacgagttggcgctgctggatacgctcgacatgggtggaccgatccgcagtaccggtgccaagcgcacgcgtgcgatcggattgttgcgcttttatgctgggctcgcgacatccattcacggaagcacgatcgacaactcgcaggcaggcgaggtcatttcgtacaccgtcaaggaacccgtcggcgtggtcgcggcgatcaatccgtggaatggtccgctcgggctcgctatctggaagatcgcgccggctctcgcagccggctgcacagtcgttcttaagcccgccgagcaggcgcctctgtcgccgttgcgtttcggcgaactctgcctcgaagccggcattccacagggcgttgtgaatgtggtgaccggtttcgcaggggcgggcgccgcgctcgccgcccatcctggcgtcgacaaggtggccttcaccggatcgacggaagtcgggcagcacatcattcgcgcgtcggcgggcaacatcaaacgcgtttcgctcgaactcggcggcaagtcacccaacatcgttttcgcggacgctaatctcgacgcggccgtgcccggcgcggcgatggccgtgtttgcgaactccggccagatttgcagcgcgggcacgcggctattcgtgcagcgttcgattcatgaggaattcgtcgagcggctatcgtcgttcgcaaagacgctcagggtcggcaatccgcttgatcccgacacgcaactggggccgctcgtcagcgaagcacaattgaaacgggtcacttcgtatctcgacaaggggcgcgaagagggcgcgcgcgcagtggcgggcggcacgcgtctgcagaacgacgaactgaagaatggctatttcgttgagccgaccgtgttcgacggtgtgaaagacgacatggcgatcgcacgcgaagaaattttcggcccggtgatttctgtgttgccattcgataccgccgaagaagccgtacagcgcggtaacgacacggagtacggccttggcagcggcgtgtggacgcgtgacatcggcaacgctcacagagtcgcgcgcggactgcgcgcgggctccgtctgggtcaattgctatcaggtaatggacccggcggttccgttcggcggctacaagatgagcggctatgggcgggagtcgggtgtcgaacacatggaagagtttctgcaaacgaaggcgatctggatcaaaacggac

SEQ ID NO: 28015 - DNA, 1593 bp, Burkholderia fungorum
tttgattacatcatcgtcggcgcgggctcggcaggatgtgtgctcgctaaccggctctcggcggatccgtctgtcaaggttgccttgatcgaggcgggtccgtcggaccgcaggttcccgacgaacatcaaatcgtcgatgcctgccggtatgctgttcctgttgccacattcgaaatacaactggcagtacacgttcacgggcggaagcggtgtcaacgggcggtcgctgctgtgtccgagaggcaaactgatgggcggcaccagttcggtcaacggcatggtctacattcgcggtcaccggctcgactacgacgactgggcagcgctcggcaacgacggctggtcatatcaggaagtgctgcccttcttcaagaagcacgaaaacaacacacagggcgaagcgccgtttcatggcgtgggcggcgaagtggaagtgagtgtgccggagaatccaaacattctttcccgcacattcattgaagcagcgcgtgaagtaggtctgccgatgaacgcggatgctaacggcaccagtcaggacggcatcggcttcaatcacgtgaatcacaaatatggcaggcgttacagcagctcgcgtgcgtttctgcacccaatcctgcatcggcgcaacctgcacgtgctgacagatacgctcgtcgaacgaattctcttttccggcgaccgggcaacaggcatttctatccttcagggtgcagccccaacgacgcttaatgccacccgtgaagtgatcctgagcggcggcgcaatcaactcaccgcaactgctgatgctgtcgggaatcggcccgcacgccgaactggcacgccttggcatcgaaacgcgagtcgatttgccgggcgtgggcgagaatctgcaggatcacccgaccgtccaggtgtcacgaagcaacccctcggccgaatcttatgcgctgacgctgcgtgcgtggccgcgcgtgctgggcacgccattcgcgtatctgttcgcaaagaaaggcatgttggccacgcacggcgcggaggccggcggtttcgtgcgcacgcttcccgaactcgacaggccggacatccagctcaccttcgtcgcgacgatcaagaagtcggtgtacaagatgccgcgcacgcacggcatgatgttgatggtgcacctgatgcgcccgcgtacgcgcggccgcatcaggttgacctcgtccagcatccaagacaaacccgagttgcatcctcgctttctcgacgatcccgaagacttgcaaacgcttttgcgcggcgtgcatcaggcgaggcgtattctcggcacgaaagcgtttgcgccctatgtcggcgaagaagtgacgcctggcgcgcaatatatgagcgacgaggatctcatcaaggcgatccgcgcacaggtcggcaccgcatatcacccggtgggaacgtgcaagatgggccccgcatcggatctgatggcggtagtcgacaacgaattgcgtgtgcgaggcgtgcgaggtttacgcgtggtggatgcatccatcatgccgaacatcgtgggcggcaacacgaatgcacctgccatgatgattggcgagcgtgcagcatcgttcattctgggtgag

SEQ ID NO: 28016 - DNA, 732 bp, Burkholderia fungorum
atgatcgtgacggaagaaaagggcgcgttgccgccggacttatcgcgcgccagaacggtaatcgtcacgggagcggctggtacgctgggccgggccgttgccaaagcattcggcggtgtgggcgcgaatctggtgctgatcgatcgcgaggaaagcgcgttgcgcagcgcgttcgataacgcaggcgagaacatgctgttatgcgcagcgcggctggatgagcccgctgcggcgatacctgtcgttgagcaggcggtcgaacgattcggcgcgatagacgtgctatgcaacgtcgcaggcggattttacgcaggcgattgcgtgcacgaaatgcgcgatgaaacctgggatctattgacgaatacgaatgctcgcaccgtattgcatatggcacaggctgtcattccaaagatgatcgccgcccggtacggcaaagtcataaacgttgctgctatggccgcgcaggccggaatggcgcatatgggcgcctattgcgcatcgaaaagcgccgtgcttcggctgactgaggctatgtcggcagagcttcgcggtcatggcatcaacgtgaactcggtcatgccgagcatcatcgacactgcgcagaatcgcaaagacatgccggacgccgatttcgcaacctgggtcaggccggtggatctcgcctgcatcattctgtttcttgcatccgatgacgcacgcgcaattcacggcgcaggaattcctgtccgcgga

SEQ ID NO: 28017 - DNA, 1419 bp, Burkholderia fungorum
agctataccgatacccgacttctgatcaacggcgaatggtgcgacgccgccagcggcaagaccctcgacgtcatcaacccggccaccggccaggccatcggcaaagtggcgcacgccggcattgccgatctggaccgggcgctcgccgccgcgcagcgcggcttcgaagcctggcgcaaagtgccggccaacgagcgcgccacgaccatgcgccgcgccgccgcgctggtgcgcgagcgggcctcggacatcggccgtctgatgacgcaggaacagggcaagccgttcgccgaagcgcgtattgaagtgctggcggcggcggacatcatcgaatggtttgccgacgaaggccgccgtgtctacggccggatcgtgccgtcgcgcaacctggcggcgcagcaactggtgctcaaggagccgatcggcccggtagcggccttcacgccgtggaatttcccggtcaaccaggtggtgcgcaagctgagcgcggcactcgcgtgcggctgctcgttcctcgtcaaggccccggaagaaacaccggcgtcgccggcagcactgctgcaggctttcgtcgaggccggcgtgccggcgggtacggtcggtctcgtgttcggcgatccggctgaaatttccggctatctgattccgcatccggtgatccgcaaggtcacgttcaccggttcgacgccggtcggcaagcaactggcggcactggccggtgcgcacatgaagcgcgcgacaatggaattgggcggtcacgctccggtcatcgtggccgaagacgccgacgtggcgctggccgtcaaggccgcgggcggcgcgaagttccgcaatgccggccaggtctgcatctcgcccacgcgcttcctggtgcacaacagcatccgcgaggagttcgccgcggcgctggtcaagcatgctgaaggcctcaagctgggcgacggcctcgccgaaggcacgaccctcgggccgctcgccaacgcccggcgtctgagcgcaatgagcaaggtgctcgacgacgcgcgtaaaaccggcgccaaggtcgaaacgggcggcgaacgcgtgggctcggaaggcaacttctttgcgcccaccgtgctgaccaacgtgtcgctcgaagccgacgtgttcaacaacgagccgttcggcccgatcgcggcgattcgcggcttcgacaagctcgaagaagcgatcgccgaagcgaaccgtctgccgtacggtctggcgggctacgcgttcacgaagtcgttcagcaacgtgcacctgctgtcgcagcaggtggaagtgggcatgctgtggatcaaccagccggctacgccgtcgccggaaatgccgttcggcggcgtgaaggattcgggttacggttcggaaggcggcccggaagcgatggaaggctacctggtcaccaaggcggtatcc

SEQ ID NO: 28018 - DNA, 1056 bp, Burkholderia fungorum
atgaatttcattcacgactatcgttccccgcgggtgatttttggacccgacagcctcgcccgattgccgcaggaactggaacgtctcggcattgaccgggcgctcgtgttgaccacgcctgagcaggcgcccctgggacggcaagtagccgagccggtcatcggccacgtggcagccttctacgatggtgcgaccatgcatgtacccgctttggtggctgaggaggcctgcaagattgcgcgcacgagtgaggctaatggcgtcattgcgattggtgggggatctactatcggactcgctaagatcgtggcgctccgtacagagttgcccatcgtcgctgtgcccacgacatatgcaggtagcgagatgacgtccatcttcggtatcacagagggtggcgtcaagaaaaccggccgcgacgcgcgtgtcatgccccgtgcagttatctacgagccccggctgaccctagagctaccccttagcatcagcgtgaccagcgcgatcaatgcaatagcccatgcagttgaaggcctgtatgcgccagatgccacgccgctgcttaccatcatggcccaggaaggaatcgcagcgacggtacgcgcgatttccagaatgtatcaatcaccaagagatcttcaggctcgcggcgacgcgctttatggcgcttggctctgcgcgagcgtgcttggcaacgtcagtatggcattgcaccacaagctgtgccacacgctgggaggaacgctcgatctccctcatgcccagacccatacggtcgtgctgccccacgcgctggcctataacgcgcgcgcggtgccagacgcaatgcgtgtgctgcgcattgccctggggcatgacgatccacccacggccttgtacgaattggctcgcgacaatggcgcacccgtggccttgcgcgatctcggaatgcgcgaggaggatattgagcatgttggcgacctggcattgcaggaccgctatcccaatccgcgggaactggatcgagacgcattgcttgcattgctgcgcgatgcgtaccacggacgcccgccttccgct

SEQ ID NO: 28019 - DNA, 1230 bp, Burkholderia fungorum
tttttcttcgatatcagcgacatcttcaccttttcgtacgcagcgccggcgctcgtcaaggaatggggactcacgatgtcgagcattgcaatgctgacgtcggcgggctttttcggcatgtttctcggcgcgacgctgggcggcatgctgtcggacaagatcggccgcaagcgcgcgttgatctgctacgtcatcgcctattcggtgttctcgctcgccaacgcgctcgcacccgacattccaatgctgatgatcacgcgcgtgctgaccggcgtcggtatttcgtcggcgacggcggtcgtgatggcgtacatcgccgaactctttcccgcgaaaacgcgcggtacgtggcagagctgggcgatggtcattgcgctgatgggcattccgatcacgagttgggtcgcgcgactggtggtgccgtccggccccgatggatggcgctggattttcgtgtggggcgcgctcggcatcgtgttcctggttttcacgaagcatttcccggaatcgccgcgctggctcgcgcgccagggccgcatggaagaagcggaccgcacgctgagcctgatcgaagccgaggtcgtgcgcacaaccggtccattgcccgaggcggtcgccattaaccggccggctgaagtgcgcgcgccctggacgtcgatgttcaaaggccagtacattggccgcacgatgacgctgtgggcgatctggatcttccagacgctcggcttttacggcttccaggcgtgggtgccgacgcttctcgtccagcacggcatcacgatcgttcacagcctcacctacatcacgctgatcaacatcggcgcggtgcccggcgcattgatcgccgtatttctcgccgaccgtttcgaacgcaagttcagcatcgcgggggcggccgcgctgatcgccgtgttcgggctgctgtacgggctgagcttccagccggtgctgatcgtgtcgttcgggttcctggtcggcatgctgatccagaccttcgccgcgctgtgctatgcgtacacgccggaacagtatccgaccgatatccgcaataccggcgccggctttgcgtatgggatggggcggctggcgaacgtcggcaactcgttcatcgtcgcggggatcttcatgaacttcggttacgtgtgggtcttcgtgtatatcgcgggcgcatggctcgcgactgccgccgttacgctgctgttcggcgcacgaacgacgggacgccggctc

SEQ ID NO: 28020 - DNA, 2013 bp, Burkholderia fungorum
cacacccctatgatgcagcagtacctacgcatcaaggcggagcatcccggcacgctggtgttctaccggatgggcgacttctacgaactctttttcgaagacgcggaaaaagccgcgcgcctgctcgatctgacactcacgcagcgcggcgcgtccgcgggcaatccgatcaaaatggccggcgtgccgcatcacgctgtcgaacaatatctggccaagctggtcaagctcggcgagtctgttgcgatttgcgagcagatcggcgacccggcaacgtcgaagggtccggtcgagcgcaaagtggtccgcgtggtcacgccgggcacgctcacggacgccgcgctgctgtccgacaagaacgacgtctacctgctggccatgtgcgtcgcgcacaatcgtcgcggtgtcgcgaccagcgtcggtctcgcatggctgaatctggcgagcggcgcgttgcgcctcgccgaactcgcgccggaccaggtggcggccgcgctcgaacgcattcgtcccgcggaagttctggtggccgacacgcccggcgacgccgcaagctggacgccgccggtcaacgcaggcgccctcacccgcgtgccggtctggcacttcgacatcgcctcgggcacgcagcgcttgtgcgatcagctggaagtggccggcctcgacggcttcggcgcgcattcgctgacctgcgcatggggcgcggccggcgcgctgctgctgtacgccgccgccacgcaaggccagcaattgcgtcatgtgcgcagcctgaaagtcgagtacgaatccgaatacatcggcctcgaccctgccacgcgccgcaatctcgaactcacggaaacgctgcgcggcacggagtcgcccacgctgtgttcgctgctcgacacctgctgcacgacaatgggcagccgtctgctgcgccactggctgcatcatccgccgcgcgaatcggcggtcgcgcaggcgcgtcagcaggcaatcggcgctttgctcgaggcaccgcctggcgcgggcgtcgactcgctgcgcggcgcgttgcggcagatctcggacatcgagcggatcaccgggcgcctcgcgctgctgtcggcacggcctcgcgatctgtcgagtttgcgcgacaccttcatcgcgttgcccgagttgcgcgcgcagctcgcggccgtttcgccgaatgcggattcgctagcccgcatcgacgcctcgctcgaaccgccgcaagcctgcgtcgaactgctcaggcgcgcggtcgccgaggagccgtcggcgatggtgcgcgacggcggcgtgatcgcgcgcggctacgacgcggaactggacgagttgcgggatatttcggagaactgcgggcagttcctgatcgacctcgaaacccgcgagcgcgcacgcacgggcatcggcaatctgcgcgtcgagtacaacaaggtgcatggcttctatatcgaagtcacgcgcggccagaccgacaaggtgccggacgactatcgccgccgccagacgctgaagaacgccgaacgctacatcacgccggaactgaaaacgttcgaggacaaagcgctgtccgcgcaggaacgcgcgctcgcccgcgaacgctcgctctacgacgcgttgctgcaggcgctgctgccctttatcccggattgccagcgggtcgcctcggcgcttgccgaactcgatctgctggcggccttcggcgagcgcgcccgcgcgctcgattgggtcgcgcccacgttctcgccggacgccggcatcgagatcgaacagggacggcatccggtcgtggaagcgcaggtcgagcagttcatcgccaacgactgctcgcttacgcccgagcgcaaactgctgctgatcaccggcccgaacatgggcggtaaatccaccttcatgcggcagaccgcgctgatcgcgctgctcgcctacgtgggcagctatgtgcccgcgcggcgcgccgccttcgggccgatcgaccgtatcttcacgcgtatcggcgcagcggacgaccttgccggcggg

SEQ ID NO: 28021 - DNA, 423 bp, Burkholderia fungorum
acacgaaaactcgaattcgacgcgggtcaccgcattcccgatcaccgcagccagtgccgtaatctgcacggtcatcgctatgtgctcgaaatcacgctgcaaggcgatctggtcgacaccgaaggcgcgcccgaccgcggcatggtgatggacttcgccgacgtgaagtcgctcgccgtcgagcatctggtcgacaagtgggatcatgcgtttctggtctatgaaggcgacacgcaggtgcgcggtttccttgaaacgatggccgggcacaagacggtcgtgctcgatcgcattcccaccgtcgaaaatctggccgccgtcgcgttcggcattctcgcgaacgtctacgatgcccactacggcgtgaatctccgtttgcacaagctgcgtctgtacgagacgccgaattgctgggccgacgtg

SEQ ID NO: 28022 - DNA, 1757 bp, Burkholderia fungorum
gagccgatttatgaaaccaaaaaccttgttgtcgacctctacacggaaaacaacgttatacgggccgtagacgaatgctcattttcgctatttgctggagagacgctggctgtcgtaggcgaaagcggtagtggcaaaacggttatgacgctcggtccgctgggcttgctccccgaaggcatcgccgttcatatgcgcggaacggcggcaacctcgagaggcgatctccttcgcttcggcggccggcgtcgtgcatctgtcagagggaacgactttggggtggtctttcaggaccccctcagtgcgctgaacccgatgcgacggatcggccctcaactggcggaacaagcgtgccgtttcgcagggatcactgctagcggtaccaaggccgatgccgtatcgaatcttcgccgcgtcggcattgcggatccagaggaccgctactggcggtatccgcatgagttctccggaggcatgcgtcagcgcgccatgatcgcactggcattggcctccaggcctaagatacttctcgcagacgagccgaccacagcactggatgcgacggttcaggcacaaattatctctcttcttaagcagattcaagccgaggacggactggccatcctcctgatcacccacgacattggagtcgtggcaggaatggccgaccgggttgcagtcatgtacgcgggacgaatcgttgaggaaggcgcggtcacggatgtgttgaagaatcccgtgcatccctatacccaggggttgctctcatcggttcctgatctcgatacgccaattggcgagaagctcactgaaatcccgggcacccccccggacctatctcgcctggaagcaggctgtcgattcgcgccgcgttgcttcgctgcgcagccatcgtgcagtctggctcgccccaccctgtcatccgtctccataacggcacccactcataaagtcgcttgcttcgtgatgcagcctaaataccaggaggttatcgggtgaatgcttcgaacaccatcgctgtgagcgacctcatggttcactttccaacttcgcgtggcgttacagtgcgtgcagtggacggcgtgaacctgcaggttcagcagggagagttccacgggattgtgggggagtccggctgcgggaaaacctcgctcgcgcgaacgatagcagggttgcagcgaccaactggcggaagcgtacttattgacggccgcgaactgaacgattggcgcggcgaccgtcttgctttcagcagacacgtccaattcatctttcaggacccgctggcatctctaagccgtcgccagacgatccaggagtcccttgaagaacccttgagaattcacggaatcggacccgcctccgagcgccgtaggcgggttgcgcaattgctgcagctagtgagcctacccgaggcgtgccttgatcggttaccgcgagcattgtctggtgggcagcgccagcgggttgcgatcgcccgcgcgttggcacttgatccgcgcattctcatttgcgacgaaccgctgagtgcccttgacgtctcgataagagcgcaaatcctcaacctgttcgctgatttacagaagaaactcgatctttcgatcgtgctaatcgcccatgatctggctatcgttcgtctcgtttgcactcgggttagtgtgatgtacctggggaagatcgttgagaccggcccggctcatgatctctttgcacagccgcgccatccgtacaccagggcattgctggatgccgcgcct

SEQ ID NO: 28023 - DNA, 789 bp, Burkholderia fungorum
atggcaacgcaagcaggcaaaggaacggcattggtgacgggggcgtcgtcgggtatcggcgcagtgtatgcagaccgcctcgcgcggcgcggctacgacctgattctcgtggcgcgcgatgcagaacggctgaacggtctggctgggcgtctgtcgagcgaaaccggcctccacgtcgaaacgatcgcggcggacctcaccgtcaaagccgatgtgcgccgcatcgaggaacggctgcgcgcggaccgcagcatcacgatgctggtcaacaacgcaggcgtcggcgcgaccgcctcactgatcgactcggacgtggacgcgctcgaaaagatgatcgacctgaacgtgacggcgctgacgcgtctgacagcggccgtcgtgccggctttggtggagcgcggcaacggcatcgtgatcaatatttcgtcgatcgtcgcgttgtcgccggaactgttgaacggcacgtatagcggcaccaaggcctacgtgctgaacctgacgcaatcgctgcatcacgaagtgagcggcaagggcgtgcagctgcaggcggtgctgccgggcgcgaccagcacggcattctggggccgcgcgggcttgccggtcgagcatctgccgtcggagatcgtgatgaccgccgaagacatggtggacgccgcgctcgccggcctcgatcagggcgaactggtgacgattccgtcgttgccggacgcggcagactgggaccgtttgaacagcgcgcgccagcagttgcagccgaacctgtcgcacaagctgccggccgcgcgctat

SEQ ID NO: 28024 - DNA, 2313 bp, Burkholderia fungorum
gaacgcattacgctcccgctgctcccgctgcgtgacgtagtcgttttcccgcacatggtgattccgctcttcgtaggccgcccgaagtcgatcaaggctctcgaagcagcgatggaaggcggcaagcacatcatgctcgtcgcccagaaaacggctgcgaaagatgagccgaccgaaaaggacatgtacgaagtaggatgcgttgctaacatcctgcaaatgctcaagctgcccgatggcaccgtcaaggtgctcgtcgaaggcttgcagcgcgcgaaaacgctttccatcgaagaacaggaaacgcagttctcgtgcgaagtcatgccgctcgaacccgaccacgccgacagcgctgaaaccgaagcgctgcgccgcgcgatcgtgtcgcagttcgaccagtatgtgaagctgaacaagaagatcccgccggagatcctgacgtcgctgtcggggatcgacgaggccgggcgtctggccgacacgatcgcggcgcatctgccgctcaagctcgaccagaagcagcacatcctcgaaatgttcccggtcatcgagcggctcgagcatctgctcgcgcaactcgaagccgagatcgacatcctgcaggtcgaaaagcgcatccgcgggcgtgtcaaacgccagatggagaagagccagcgcgagtactacctgaacgaacaggtcaaggcgattcagaaggaactcggcgaaggcgaggaaggtgcggatctcgaagaactcgagaagcgcatcacggctgcccgcatgccgaaggaagccaagaagaaggccgacgccgagctgaaaaagctcaagctgatgtcgccgatgtcggctgaagccaccgtcgtgcgcaactatatcgacacgctgatcggcttgccgtggcgcaagaagagcaaggtcaacaacgacctctcgaatgcggaacgcgtactcgacgaagaccacttcggtctcgagaaagtgaaggaacgcattctcgagtatctcgcggtccagcaacgtgtcgacaaggtcaaggcgccgatcctgtgcctcgttgggcctccgggtgtcggtaagacgtcgctgggtcagtcgatcgctcgcgccacgaatcgcaagttcgtgcgtatggcgcttggtggcgtgcgcgacgaagccgagattcgcggtcaccgtcgtacgtacattggttcgatgcccggcaagattctgcaaagcctgaccaaggtcggcgtgcgcaatccgctcttcctgctcgacgaagtcgacaagatgggccaggatttccgcggcgatccgtcttcggctctgctggaagtgctcgatccggaacagaaccatacgttcgccgatcactacgtcgaagtcgacttcgatctctcggacgtgatgttcgtggcgacgtcgaactcgctgaacattccgccgccgttgctcgaccggatggaagtgatccgtctgtcgggttacacggaagacgagaaggtcagcatcgcgcaacgttatcttttgcccaaacagaagaagaacaacggcctcaaggatggcgaggtcgatgtgacggaaaccgcgatccgcgacatcattcgctactacacgcgtgaagcgggcgtgcgttcgctcgagcgtgaaatttcgaagatctgccgcaaggtcgtgaagatgcttctgctgaagaaggcggaaggcgcggtgaaggtggacggcagcaacctcgacacgttcctcggcgtgcgcaagtacgacttcggtctggctgcgaaggaaaatcaggttggccaggtcacgggtctcgcgtggacggaagtgggcggcgatctgctgaccattgaagccgcggtgatgccgggcaagggcaacgtgatccgcacgggttcgctcggcgacgtgatgaaggaatcggtcgaggcagcacgctcggtggtccgttcgcgctcgcgtcgtctcggcatcaaggacgaagcgttcgagaagcaggacattcacatccacgtgccggaaggcgcgacgccgaaagacggcccgtctgccggtatcgcgatgacgaccgcgctggtgtcggtgctgaccggcattccggtgcgtgccgacgtcgcgatgacgggcgaaatcacgttgcgtggcgaagttctgccgatcggcggcctgaaggaaaagctgctggcggcgcatcgcggcggcatcaagctggtgctgattccggaagaaaacgtcaaggacttgacggagattccggacaacgtgaagaacgccatcgaaatcgtgccggtccgctgggtcgacaaggtgctcgaactcgcgctcgaacgtgtgccgtcggcgttg

SEQ ID NO: 28025 - DNA, 2028 bp, Burkholderia fungorum
aagatcctgattgccaaccggggcgagattgcgtgccgcgtcgccgcgacctgcaagcggctcggcatcgcgagcgtggccgtctattccgatgcggacgccaacgcgaaacacgtggccgcctgtgacgaggcggtgcatatcggcggttcgagcgcggcggaaagttatctgcgcgtcgagcgcatcatcgaggccgcacgcgccaccggcgcgcaggcggtgcatccgggctatggctttctgtcggagaatgaagatttcgcgcaagcgtgcgaggcggccggcatcgtctttatcggaccgccggtcgaagccattgccgcaatgggatcgaaggccgccgcaaaggcgctgatgcatgcggccgccgtgccgctcgtgccgggttatcacggcgacgatcaggacgcgcaactgctgcaccgcgaggcgaatgcgatcggttatccggtgctgctcaaagccagcgccggcggtggcggcaagggcatgcgggtggtggagcgcagtgaggatttcgcggcggcgctcgcgtcgtgcaagcgcgaagccgcgagcagcttcggcaatgatcgcgtgctgatcgaaaagtacctgacgcggccgcgtcacgtggaagtgcaggtgttcgcggatcgccacggcggcgcggtctatctgttcgatcgcgattgttcggtgcagcggcgtcaccagaaagtgctggaggaagcgccggcgcccggcttgtccgctgaaatcaagcgcgaaatgggcgaggccgcggtggccgccgcgcgcgcggtgaattacgtcggtgcgggcacggtcgagttcatcatgaccagcacgggcgagttctacttcatggaaatgaacacgcgcctgcaggtcgagcatccggtcacggaaatggtgaccggccaggacctggtggaatggcaactgcgtgtggccgctgatcaaccgctgccgctcacgcaggaacagttgaagatcgacgggcacgcgatcgaagcgcgtatctacgccgagcatccggcgcgcggctttctgccgtcgacgggcacgctcaaacatctgcgcatgccggaaggcgtggaattcgcaatcgatgcgtcgggcctcggcgagccgggacgcaaggcgccggtgcgtatcgacagcggcgtgcgtgaaggcgacaccatcacgccgttttacgatccgatgatcgccaagctgatcgtgcacggcgccacgcgcgaagaggcgctcgcgcgcctgagccgcgcgctgcatgcgtgcgaggtggtcggcccgcataccaacgtcgagtttctgcagagcattgttgcgagcgagccgtttgcaacgggcgatctcgacacgggcctgatcgagcgccatcacgacgccctgttcgcgccgcgcaagaagccgtacaaggaagcgctggcgctcgcctgcgcggcgctgctcacgcgcgagggcggcacggcgcacggcgcgtcgccgtgggatgcgttgtcgcactggcgtctgaatggcggctatacgcagacgctcggctggcgcgacatagacagcggcggcgagagcgcgggcctgttcacggtcacgttcgcgcgcgacggcggcacgcaaacgctcgaacacgacggcgtgcgtgaggacttcaaatggtcggacggcagcggcccgcatgaattccgcgcaacgatcgtcgacgcgcgcgcaacgggccgcgtgttcgtcgacggcgatacgttccatgtgttctgcctcggcgaagcgctggcgttcgaatggcaaaacctgctcgcccacgccgcggacgccgaaggcggcgaaggccgtttgaccgcgccgatgccgggcaaggtgatcgcggtgctggtggagccgggtaccgtggtggagaagggcacgccgctcatcgtgatggaagcgatgaagatggagcacaccattggtgcgccggctgcgggtacggtctcggaggtactgtatgcggttggcgatcaggtggccgatggcgcgcagcttctggtgctggacgtgcag

SEQ ID NO: 28026 - DNA, 1164 bp, Burkholderia fungorum
cccggtttgcaattcccgctcggcgaagaaatcgaaatgctgcgcgacagcatcgcgggattcgctgccaaagaaatcgctccgcgcgctgcggaaatcgatcgcacggatcagtttccgatggacctgtggcgcaagttcggcgatctgggcgtgctcggcatgacggtctcggaagaatacggcggcgcgaacatgggctacacggcgcacatgatcgccatggaagaaatctcgcgcgcgtccgcctcggtcggtctctcgtacggcgcgcattcgaatctgtgcgtcaaccagattcatcgcaacggcacggaagcgcagaagcagaagtacttgcccaagctggtgtcgggcgaacatgtcggcgcgcttgccatgagcgagccgaacgcgggttcggacgtggtcagcatgaagctgcgcgcggagaagaagggcgctcactatgtgctgaacggcacgaagatgtggatcaccaacggcccggattgcgacacgctggtcgtctacgccaaaaccgatcccgaagcgaattcgcgcggcattaccgcgtttatcgtcgagaagggcatgaagggtttctccgttgcgcagaaactcgacaagctcggcatgcgcggctcgcataccggcgaactggtgttccaggacgtggaagtgccggaagaaaatattctcggccagttgaacggcggtgcgaaggtgctgatgagcggcctcgactacgaacgcgccgtgctcgcgggcgggcccacgggcatcatggtcgcggtcatggacgcggtcgtgccgtatatccacgaccgcaagcagttcggccagcctatcggcgagttccagctcattcagggcaaggtcgccgatctctacaccacgttgcaggcatgccgcgcgtatctgtacgcggtgggccggcaactcgatacgctcggcaaggaacatgtgcgccaggtgcgcaaagactgcgcaggggtgattctctacacggcggaaaaagccacgtggatggcgggcgaggcgatccagattctcggcggcaatggctatatcaacgaatatccggtcggccgcttgtggcgcgacgcgaagctctatgaaatcggcgccggcacgagcgaaatccggcgcatgctgatcggccgcgaattgttcgccgaaacg

SEQ ID NO: 28027 - DNA, 813 bp, Burkholderia fungorum
tctcgtcatgcattgggcatattcggactgaataacggagagcgtcccatgtcgcgtatttttattaccggttccgccgatggcctcggtcagatggccgcgcgtctgctcgtcgacgccggacatcaggtggtgttgcacgcgcgcagcgccgcgcgcgccgagcatgcgttgcaagcggtgccgcaagccgaaacggcgctggttgccgacctgtcgagcattgccgccacggccgaactcgcgcagcaggtcaaccggctaggccgtttcgatgcggtgattcacaacgcggcggtcggttatcaggagccgcgccggatcgcgaccgtcgacggcctgtcgcatgtgttcgcggtcaacacgctggcgccgtacattctgagcgcattgatcgggaagccgaaacggctcgtctatctgagctcggcgctgcatcgcagcggcgatgcgagcctcgacgatctggcctgggagcggcgcccctggcggggcacggcggcgtactcggactcgaaactgcatgacgcgttgctggcgttcgcgctcgcgcgccgctggccgcaggtgttgtcgaacgcgctggagccgggctgggtcgcgacgaaaatgggtggaccgggcgcaccggacgatctgctggcagcgccgaaaacccaggtgtggcttgccgtcagcgacgagccggcggccaccgtcagcggcgcgtacttctaccatatgaagccgcgcgagacgcatccggcggtgcacaacgtggctgttcaggagcgtctgctcgaagcgtgcgcgggcttttccggcatccgtttg

SEQ ID NO: 28028 - DNA, 1692 bp, Burkholderia fungorum
aagaaactcatcaacgaggtttccgcggtcgttccggatatgctcgacggactcgcggcgctcaatccccatctctcgctgttgcaaggcagcacgatcatcgtgcgcgcggatgccgaggccgccgccgcgcgcggagaagtcgcgctgatctcaggcggcggctcgggccacgaacccgcgcacggcggctatgtcggccccggcatgctgagcgcggcggtcgccggtgaagtcttcacgtcgccgtccaccgacgccgtgctcgatgcgatccgcgcggtggccggcgcggccggcgcgctgctgatcgtgaagaactacaccggcgaccgcttcaacttcggcctggcggcggagattgcgcgcgccgaaggcatccccacggaaatggtgatcgtcgccgacgacgtcgcactgacggcgagcggcgaccacgcgggccgtcgcgggcttgcggggaccgtgctggttcacaagattgcgggcgcggccgcggcgtcgggccgcccgctggcggaggtcgcacagatcgcgcgcgacgtggcggcctcgctcggcacgatgggcgtggcactcaccgcgtgcacggtgccggccgcgggcaaaccgggtttcgaactggccgatggcgaggtggaatggggtctcggcattcacggcgaacccggtgtggagcgcggcgcgctggagcccgccgccgcggtcgtcgacaagctgctggagaagattgtcggcgacctgtcgttgcaggccggcgagcgggtggcgttgctggtgaacaatctgggcggcacgccgtcgagcgaattgaacattgtggccggcgccgcgctgcgttatctggcggagcgcggcatcaggacggagcgcgcgtgggccggcacattcctgagcgcgctggaaatggcgggcatttcgctgtcgctgctgcgagtggacgatcaacgtctcggttggctcgatgccgccgcgcagaccagtgcgtggccggcgctcggtggacgcatcgcgcggacctccgcgcggcccgcgccggccgaaccggatcgcgcaagcggtgcgacgctgtcgcgtgaagcgacgctgcgccgcgtcatcgaagcggtctgcgcgtgtctgctgaaagccgagccgacgctgaccgacatggatcagcgcgtcggcgacggcgatctcggcatcagcctgtcgcgcggcgcgcgcgcgatcattcaggagctcgacggctatccggctgaaacgacgccgggcgctgtcctgcgcaacatgtcggcgacgctgcggcgcgtggtcggcggcacctccggcccgctttacgcggtcatgctgctgcgcgccgcgctcgcgctcgaacaatcgggcggagcgacgccgaagcagtgggcggcggccttcagcgcgggcgtcgacggcttgatggcgctaggcggtgcgcaacctggcgatcgcacgatggtcgatgcgctgaagccggccgccgatgcattgcaagccgctctcgcacgttccgatgcgctcgacgccgcgttgaaagcggccgtcgacgcggcaaccgaaggcgccgcgcaaacggcgtcgatgcatccgcggcgcgggcgttcgagctacgtcggcgagcgtgcgctcggtcacgcggatccgggcgcgcacgcggtggcgctgtggctcgcggcgatccgcgaggcgctg

SEQ ID NO: 28029 - DNA, 930 bp, Burkholderia fungorum
aaagtttttgtcgacggacaggaaggcacgaccggcctgaagattttcgaatacctgtcgcaacgcgccgacgttgagatcctgcgtatcgaagaagcgaaacgcaaagacctcgaagagcgccgtcgtctcatcaacgcgtcggacgtcacgttcctgtgtctgcccgacgtcgcctcgcgcgagtccgcctcgctggtcgagaacgatcgcaccgtgctgatcgacgccagcaccgcgttccgcacttccgccgagtgggcctacggtctgcccgaactggcgcgctcgcaacgcgagcgtctgcgcacggcgaaacgcattgccgtgccggggtgccatgcgtcggccttcgtgctcgccatgcgtccgctggtcgaagccggcgtggtggcgcccgagttcgccgcgcacgcctactcgattaccggctacagcggcggcggcaagaaaatgattgccgactacgaagcaggcggcaacgacaggctcaagagcccgcgtccgtacgcgctcggtctcacgcacaagcatctgccggaaatggccgcgcataccggcctgaagtcggcgccggtcttcacgccgatcgtcggcgacttctacaagggcctcgcggtcacctcgttcttctcaccgaaccaactggcgaagaaggcaacgccgcaagacgtgcaggcgctattcgccgagtactacgcgggcgaagccttcgtgcacgttgcgccgttcaacgcggaagcgaacctcgacagcggcttcttcgacgtgcaggcgaacaacgacaccaaccgcgtcgacctgttcgtgttcggcaacgaagagcgcttcgtgaccgtcgcacggctggacaacctgggcaagggcgcttcgggcgcggccatccagtgcatgaacctcgcgatcggcgccaatgaagaaagcggcctg

SEQ ID NO: 28030 - DNA, 1068 bp, Burkholderia fungorum
tgggaaaacccgctcggcaccgacggtttcgagttcatcgaatacaccgcaccggatccgaaggcgctcggcaagctgttcgaacagatgggcttcaccgcgatcgcgcggcatcgtcataaggacgtgacgctgtatcgccagggggaaatcaactttatcgtcaacgcggagccggattcgttcgcgcaacgcttcgcgcgtctgcacggcccgtcgatctgcgcgatcgctttccgcgttcaggacgccgccaaggcgtaccagcaggcgctggaaaaaggcgcatggggcttcgacaacaaaaccggcccgatggaattgaacattccggcgatcaaaggtattggcgactcgctgatctatttcgtcgaccgttggcgcggcaagaacggcgccgagccgaacagcgtcggcaacatcgacatttacgacgtcgacttcgagccgattcccggtgcgaacccgaatccggtgggtcatggcctgacctacatcgaccatctgacacacaacgtgcatcgcggccgcatgcaggagtgggcggagttctacgagcgcctgttcaatttccgcgaagtgcgctatttcgacattgaaggcaaagtgacgggcgtgaagtcgaaggcgatgacctcgccatgcggcaagatccgcattccgatcaacgaggaaggttcggacaccgctggccagattcaggaatatctcgacgcgtaccgcggcgaaggcattcagcacattgcgctcggcaccaacgacatctatcgcacggtggacggcttgcgcgcggcgaacatctcgctgctcgatacgatcgacacttactatgaactggtcgatcgccgcgtgccgaatcacggcgagccgctggacgagctgcgcaagcgcaagattctgatcgacggcgcgcccgaagatctgctgctgcagatcttcaccgaaaaccagatcggcccgattttcttcgagatcattcagcgcaagggcaatcagggctttggcgaaggcaacttcaaggcgctgttcgaatcgatcgagctggatcagattcgccgtggcgtggtg

SEQ ID NO: 28031 - DNA, 1365 bp, Burkholderia fungorum
gttctgatcgctaaccgcggtgaagtggccgttcgtatcgtccgcgccgctaaatccgtaggattgcaaactgtcggaattcatactccggaggaggcgaatgccctacatgtgcgggactccgatatcgcagtagctctggcaggcgtcggaaccgccgcctacctggatattgcttcaatcattgcggcggcggttcgcacgaattgcagctttatacacccgggctacggttttctgagcgaaagtgccgcattcgcacgcgcctgtgaacaggctggggtgactttcattggcccatcaccggacacactcgacgtgttcggtgacaaagcctcgacacgtgagctcgcgatacgcctggacgtccccgttctccctgccacggcgggactcgccgacgatgcatcggcactgagtttcatgcaatcgctcgcggccccggttatcgtaaaggcggtggccggcggtggaggccggggaatgcgtatcgtcacggaccccaccgacttgcccgctgcgttgtcaaggtgccggtcagaagccgaacggggctttgggcgcgacgatgtctatgtcgagcgctacctcccgcgttcccgccacatcgaggtacaggtgatcggcgatggctcgtccgtcgtgcatctcgggacgcgcgattgcagcctccagagccgccatcaaaaggtgatcgagatcgcacctgcgccctggttgccggtcgagatcgaggaagccttgctggagcacgctctccagcttgcccgcgcggttcaataccggggagcggggacgatggaatttctgatcgacgttgacaatccctcacactactatttcatcgaggggaatccccgcttgcaggttgagcacggcattactgaactcgttaccggactggatattgtcgcgctgcaattcgcgatcgcgcgtggccggtcgctggccgacgagggcatcacccaggacaatgtcgtgacgagcggtgtggctgtcgaagcgcgagtaacgctgacaactcccggcacgattgcacggttcgttagtcccggcaagggacgcgtcgacagcggcgcgtatgacgggctcgcagtcggcagcggcttcgatccgttgcttgcgaaggtcatggtgcatgagccggattacccgcgctgcatctgtgcgctggctgattcccttggtgaactcgtcgtcgaaggtccggccactaaccgcgatggtctgctatcgctgcttgccgatcctcgcgtgcgcgcgggagacatcacgacgacgctgatcgacgatctgccggccgcgtcggcgactgcattggtcagcaaggtcgcgggttccgtcattgcggtgctcgcgcggccc

SEQ ID NO: 28032 - DNA, 1467 bp, Burkholderia fungorum
acgtactcggaatgtgtcatgcgtggtgacgaattggcccgcgcctttctcggtctcgggctcgagcgcccggctcgcgttgccctcgtgttacctaatagcgccgagttcgtcatctcgctctatgcatgcgcgcgcatcggcatcacggcagtgccaataagcacctggtccaagccgtccgaactcagacggatcttgcgcgatgcccgggtcgacctggtccttgccagggacgcctttcctggacacgcaatcgccgaatccttgcaagcggcttgtgcagacgatccatcgctggatgcgctccaggtctatgaatggtcaaggggacagggggctgccagtccggtttccgaactgctttcgcatggttctcgctgcgatgatcgcagatggtcgattgagtcgggtacttccgcgcacacggacgccgacctggtcgtcttatatacgtctggcagtactggagcgccgaagggggtgatactgccgcagtcatcggtcgcgctcaacggtgtcgccatcgccgggcggatgggtttcggtggaaacgaccggatcttttcctacttcccgttgttctttagcggagggctttgcaatgcgttgaccggagcgatttcatgcggtgccgaattggtcacgcaatcccggttcgatccggccggcgccttgtctttgatccgctccagacgatgtacaggccgcaacgtatggcatgacggcctggaaccggtcgctgccgtggagggcttccggccaggcgatttcagcaggatgcggcgcggcctccatgttgatcctgaactctatcgaaggctgagcctggctgtcgatgaaggtatcaatatgtatgggatgactgagaccgcgacggcgttcacctgcggcgactggcgcgaacccgccgatgtacggcaatcgacccacggcaagccgtttgacggctccgatctgcggatctgcaatccggacgaaacttcgccgctcggggttggtgtggagggggaaatctgtgtccgaggctacaacctgatgcgaggctacaccgacgggtcgcatgtcgagcgaatcgacgacgacggattctttcataccggtgatatcggcttcgtcgatcccgccggctatttacatttcgtcggccgccgcaagacgttgatcaaggtaaaaggtctgacggtccaacccgaagaagtcgaggcgacactgctgcgccatcctgccatctcaaaagcagtcgtcgtcggcgaaggcggtggacatgagtcgaaaggcgtggtggctctgatcgtgctgcacgaaggggaccgctgggacatgcaggcacttcgaacctattgccaggaagaactgtcgtcatacaaagtgccgcggctgctggtggtcgatgcgaatcggttcccgttgtcggcgagcctcaaaatcgatcgaatcggcgcggccaccctgctcaagcagatc

SEQ ID NO: 28033 - DNA, 1374 bp, Burkholderia fungorum
atcggcgtccgcgaccagcgcaccgttgtgctggcgctgccgggttcgccgctcaccatcgtactctggctggcgattgcgtcgaacggcgcggtcgttcaggcggtcgatccggatgcgggcgtgctgcccctttgcgccgcgatccgcgcgactcaacccgtgctagtcatcgcaaacccgggcaacgccgaagtgctgtcgaaagctcttgtgcaatcggcggtcagcgcgacaatgatcgttgttaaggacctctcgctggcgtcgccgatgtcggggatcgatggactgcgctcggccggtccacagacgccccccagcgcttttgccgaatccgtcgccggcatgttgcagacgtcaggtacatctggcgcgccgaagctcgtggaactaacgcacgccaactacattgcatctggcgaacgactagcgcgaaacagcgggcatagggcaagcgattgtttctatctttgttcgcctttttcgcataccaatgcgcagttgtactgctgcatgccggccatcgtgacaggcgggacgatcgcggtggtggaacgcttcagtgccagcctgtacttcgacagtgctcgccagatgggtgcaacggtgagttcgatggtggctccgccaatgcggatggcgcttcacaaggcgctcgagcgcggctcgcctgtcgatgcaggaagcctccgtctgattcaatacggaatgaacatgagcgacgcagattggcgtgcgtgggatcggttgttcccgcagatcgaaatgcgccaggtctatggccagaccgaatcggtgtctgccgtattgggtggtgcgccttgggaaatcgatgacaggcgcactatcggcaggccttttcttggcgttgacgcggtgcgcctcgtaggcgagaacggggaacccgtcaagccgggggaacaaggcgaattatgggtacgcggcgagcgcggccgcaccttgatgcgcggctactatcagaacgaagcggccactgcggaagcgatcgacgctgatggttggctgcacacaggcgattacatgacgcaggacgccaatgggcgctttgcatttgttggacgacgcatgcacatcattcgccgtggcggggagaatctgtcggtctatgaactcgaattgatgatgcagagttgcccgctgattgaagaggtggccatcagtgcggaaaaggatgcgttgctggatgccacgctggtcgtccacgtcattccagcaagcgggttcagcgagcaggccttcgagcaatggtgccgtgacgcgatcggtcggcgcggagtgcccgactcgattcgggtgcatcaggcatttcctcgaacgatcagcggtcgagtcatcattcgggaactgaag

SEQ ID NO: 28034 - DNA, 1596 bp, Burkholderia fungorum
atcggcgatttgctggttcgtgcagccagccgtcatcccgacagggacgcggtcgtatttcccgacgatcgctacacctatgcggaagttctcaggcgagcgatgctggtggcgcgcgggcttctgagcctcggagttcgaccgcgcgaccacgtcggcatcctctgcaccaacggcatcgagttcatcgaaggcttgttcggagtcgccctggccggggccgttgctgcgccgatcaacgccagatacaaagtgaacgaactcaaatacatcgcctcgaacgcggacctggtggctatcctgacgaccggcgacgcagacgcttacgtcgactttccagacgtatttgtccaggcctttcccgaactgtcttcgtccgaggccttggggctcgatttggaatccgctccccgattgcgcaacgtgatcctgttaagcggcagtgagcggcccgggttcatcagccgcgagcgcctcctggagcttgccgcgcgcgtgtcggaggaagacgtgcatgttgcccgcagccgcgtgcgcttgcgcgatatcggcctccttctgtacacgtccgggacgacagccaatccgaaaggctgcctgctgagtcatgaggccgtgactcgcggccccgtcgagcgggcgacgatacgcttcggcctcaaggttgcggacgtcacctggggcgccgggccgctgttccacatcggctcgctgtcgccgttcctcggctcgatcggcgcggccgggacctacgtcaccgatgcgttcttcgacgcgggccgtgcgctcgatctgttgatccgggaaaagccgacagtcatgttcccatggttcccagccatcatgcaggcgctcatgaatcacgagaaatgggaccctgcgaagctgtcgtccgttcgctccattcttctgatcggcccgcggcctttgttggataaagtgcaggcggcgcttccgcaggtggaactggtggcctcatgcggcatgaccgagacggcgggaatctatgccgtcagtgatgtttcggaaacggtcgagcaacgagcgaccggtcacggaaggccatgttcaggcatcgaggcacgcatcgttagtctttcagatggaagcgaggtgactgacagcacgccaggcgagattctcctgcgcgggtattgcgtgatggaaggttattaccgcgatcccgccaataccaggaaagcactcgatgccgagggctggctgcacaccggagatctttacagccgtactcccgatggtcgattgatgttccatgatcgcatcaaggacatgttaaaagtcggcggcgagaacgtggctccagctgaaatagaaacattcctgtgcacccatccctccgtggtcatggcgtcggtcgtgggcatcgcggacgcgcggctcgacgaggtgcctgtggcgtttgtcgaacttgccgccggcaacaccctggaagccgaatttctgatctcgttctgccggggtcagctcgccagcttcaagattcctcgccgaatacattttgttgataccggcacctggccgatgtcaacgacgaagatcgacaagcggcagttacgcgaacgggcagcaaaaatg

SEQ ID NO: 28035 - DNA, 1230 bp, Burkholderia fungorum
gcaggcaaatcggacagcgacgccaaggtgcgcgccatcgtcgagagcatcattcagcacatcgaggaaaagggcgacgaggcggttcgtgaatacagccgcaagtttgataactgggatccgggcgacttccggctatcgcgcccggaaatcgagactgcgcgcaaacagctttcagcgcgcgagatcgaagacatcgctttcgcgcaaacccaggtgcgcaacttcgcacggatccaacgcgattcaatgcgcgacgtggaaaccgagacccttcccggcgtcgtgctgggccataagcacatccccatgaacgcggtgggctgctacattcctggcggcaagtatccgttgcttgcgtccgctcatatgagcgtattgacggccaaggtcgcgggcgtagcccgggttgtgtctaccgcgccgccctatcagggcaagccgcatccggcgatcgtaacggccatggacatggcgggagccgacgaaatcctcgtactcggcggcatccaggccgtggtcgcgatggcggtgggaacgcccaccgtggcgcccgtcgacatgctcgtgggcccaggcaacatgttcgtggcagaggccaagcggcaactgtacggaagggttggcatcgaccttttcgcaggtcccacggagacacttgttattgcggacgaaagtgttgacggtgaactctgcgccgtcgatctgctcggtcaggccgagcacggcgctacgtcgccgtccattttgctgaccaacagcgaaaagcttgctcgtgatacgctcgcggaaatcgaacgccagttgaagatcttgccgaccgcctcgattgccgcgcaaagctgggctgattgtggcgaagtgatcgtgtgcgacacgtacgaagagatgctgcaagtggccgacgatattgcttcggagcatgtccaggtcatgacggaagacccagacttcttcttgaacaacatgacgaactacggtgcgctgttcctcggcccgcgcaccaacgtaagcttcggtgacaaggtcattggcaccaatcacacgctcccaaccaaccgcagcgcgcgctataccggtggactctgggtcggaaagtttttaaagacctgtacctatcagcgcgtaacgaccaacgaagccagtgccattatcggcgaatattgttctcgcctctgtcacatggaaaactttgccgggcatggggaacaggcaaacatccgcgtgcgc

SEQ ID NO: 28036 - DNA, 735 bp, Burkholderia fungorum
ttcgggctcgccagccggcgcgcgctggttacgggcggaagtagcggaatcggacttgcggcggccgctgcactcggccgtgctggcgcacacgtgacggtagctgcgcggcgacgggcagagcttgaagtagcatgcgaagcactgcgggcgacaggcgtcgcgtgcgaagcgctcgtgctcgatgtcaccgattcggcgtccgtggatcgggaggtgaactcccgggtgccgttcgacattcttgtcaacagtgccggcatgaatcggccgaagccgctgaccgacttgaccgacgacgatatcgacgccgtgcttcggctcaacgtgaaggctgctttctatctcgcccgcgcagtatcgcggcgactggtcgacgccaacctcggcggatcgatcattaacatctcctctcaaatgggacacgtcggcagcgcgcgccgctcactttattgcgcgagcaaacatgcggtcgaaggtatgacgaaagcgctcgcatgggaacttggagcggcgcggattcgagtcaacagtctttgcccgacattcatcgagaccccaatgacggcaccgatgtttgttcaaccagggtttcgcgaatgggtttgcgagcgcattgcgctggggcgcgtgggtgaaatgcacgagatcatggggccggttgtctttctcgccagtgatgcatcgagcctgatgacaggcagcgcgctgatgctcgatgggggatggacggca

SEQ ID NO: 28037 - DNA, 1509 bp, Burkholderia fungorum
agcatcgagactatcggcattgtcggaaccggcgcaatgggccgcggcatcgcacagatcgccgcgctggccggcctcactgtgcgtctgtacgacaccaaccctgctgcaatcggcgccgcgcgcgactacctcgccgagactttcgcgaagttgaccgctaaaggcaagctcgaccaggcgcgctctctcgccgcactcgcgaatgtcagcggcgcgcaggccatcggcgagttggccggttgcgatctggtcgtcgaggcgatcgtcgaaaaactcgacgtcaaacaggcgctgttccgcgaactggaaaccgttgtgagcggccgctgcatcctcgcgtctaacacgtcttcgctgtcgatcacggcaattgccgccggctgtagcgatccgtcgcgcgtggccggctatcacttcttcaatcccgtgccgttgatgaaagtcgtcgaagtgatcgacggtctgcgcagcgatcccgccgcgggcgacgcgctgatggatctcgcgcgccgcatgggtcacacgccggtgcgcgcgaaagatatgcccggcttcatcgtgaatcacgcgggccgcggcatgaataccgaaggcttgcgcgtggcgggtgaaggcgtggcgagtttcgccgacatcgactgcatcatgcgcgagcaggcgggctttcgtcttggcccattcgagctgctcgatctgacggcactggacgtctcgcatccggtgatggagtcgatctatcaccagttctatgaagagccgcgcttcacgccttcgcccatcaccggcacgcggctcgcgggcggactgctcggccgcaagacaggtgaaggcttttaccgctacgaagacggcaagcagcaggtacctgccgaggcgcccgcgccgaccggattgccggccagtgtgtgggtcagcaagcgttatccgcaagcgcatgacgccgtcgtgcaactcgtcgaaaaagccggcgtgacactcgacaacggcatcacgcccgaatcgaactcgctgatcgtcgtcacaccgttcggtcacgatgcaaccacggccgcggtcgacgaagcgctcgacgccacccgtgtcgtcgcgctcgacgcgcttttcccgctcgtcggcgcgcaacgccgcacgctgatgacgacgcccgccaccacgcgcgccgcgcgtgacatggcgcatgcgctctttgccgccgacggcgtgcccgtcaccgtgatccgcgactcgaccggcttcgtcgcgcaacgcgtggtggcgaccatcgtcaacatcggctgcgatattgcgcaaaaacagatcgccacgccggaggatatcgatctcgccgtgacgctcggcctcggctatccgcgcggcccgctcgccctcggcgacgcgctcggctcgaccactattctcgcgatcctgcgcaatatgttcagcgtgctcggcgacccgcgttatcgtccgtcgccctggctcgcgcggcgagctcaacttggcctgccgctgacccaacgcgacgca

SEQ ID NO: 28038 - DNA, 1137 bp, Burkholderia fungorum
gagcacatctatccgaacgaacaggcgttctacgcggagattgcccgcaatcgccagaacggcaacgcgtggctgcccaccgaactggtcgaacaactcaagcagaaagcgcgcgacgccggcttgtggaatctgttcctgcctgaatccgtacgcggcgccggcttgacgaacctcgaatacgcgccgctctgcgagatcatgggccgcgtgccctgggcgcccgaagtattcaattgcaacgcgcccgacaccggcaacatggaaaccatcgaacgctacggcagcgacgacaacaagcgcgagtggctcgaaccgctgctgcaagggcagatccgttcggcgtttctgatgacggagcctgaagtcgcgtcgtcggatgccaccaatattcagaccagcattgtgcgcgacggcgactactacgtgatcaacggccataaatggtggtcgtccggcgcaggcgatccgcgctgcaagatctatatcgtcatgggcaagacggatccggatgcgccacgccaccagcagcagtcgatgatcctggttcccgccgacgccaccggcatcaccgtgcaccgtccgctcaccgtcttcggttacgacgacgcgccgcacgggcatatggaaatcacgctcgaaaatgtgcgcgtacccgccaccaacatgctgctcggtgaggggcgcggcttcgagatcgcgcaaggccggctcgggccgggacgcatccatcactgcatgcgcctgatcggtctcgccgaacgcgcactcgaattgatgtcgaaacgctcgctgcaacgtgtcgcattcggcaagccggttgccgcgcaaggcgtcacgcaggagcgtatcgccgaagcccgctgcatgatcgagcaggcgcgtctgctcacgctgaaaacggcctacatgatggacaccgtcggcaacaagggggcgcgcggcgaaattgcgatgatcaaggtcgtcgcgccgaacatggcttgtcaggtaatcgactgggcgattcaggcgcacggcggcggcggtgtcagcgacgatttcccgctggcatatgcgtatgcgtccgcacgaacactgcgtttcgccgacgggcccgacgaagtgcaccgcaatgcgatcgccaagctcgaactc

SEQ ID NO: 28039 - DNA, 1119 bp, Burkholderia fungorum
atggacttcactttcaacgaagaacagcagcaatttgcggatgcgttgcgccgctatctggacaggagctatgggttcgaagcgcgccaggcgatcgtgcgatctgaacccggtgtatccgatgcgcattgggccgcgtttgccgaactgggcctgactgcgttgccggtgccggaagcgcaaggcggtttcaacggcggcccgatcgacatgcttgtcgtcatgcaggaactcggccgcgcgctggtcgtcgagccttattgggcgacggcggtcggcatcgaggcgttgcgcctcgcgggtagcgaacaaggcgaagacgcgtcgctgctcgaacgtgcggctcggggcgagatcaaactggctgtggcctttcacgaaccccacgctcgctacgaccttttctcgattgagacaaccgcgagcgggcaaggcggacagcacacattgaccggcaccaagtcggtcgtactgcacggtgcgcaggccgaccactggatcgtgccggcccggctgaacggcgagatcgcactctttgtcgtggcgcgccatgcggccggcgtcagcgtaacggactaccgcacgatcgacggccagcgtgccgccacgctagagttcaacggcacgcctgcgcgccagcttgccggccaacacgctggcgcggcggcgctcgaacatatcgccgactacggcacggtgctgctgtgcgccgaggcaatcggcgcgctcgacgccttgaacctcgccacggtggactacacgaagacgcgccagcagttcggccagccgatcgcgcgttttcaggccttgcagcatcgcatggtggagatgctgattcacgccgagcaggcgcgttccgtcacgtatctggccgccatgcgctacaccagcacggacgtcgacgaacgtcgccgcgcggtttccgccgcgaaggcgcgggtggggcaggccgcgcgcttcgtcggccagcaggcggtccagttgcatggcggcatgggcgtcacgaacgaagtagcggcggcacatctgttcaaacggcttgccatcatcgaaaccacattgggcgatgtcgatcaccatctcgcgcggttcgccgcgctgcccggcttcgtcacggcc

SEQ ID NO: 28040 - DNA, 1176 bp, Burkholderia fungorum
gacagcgcgttccgcgccgacatccgcgcctggctcgaggcaaatctgccccgggaactgagcgacaaggtactcaatcacaagcggctttcccgcgcagacttcgcaagctggcacaagctgctcggtatgcgcggctggtcggtggtcgcgtggccgaaagaatacggcggcccggattgggacgccacccaaaggcacatctgggacgaagagtgcgcgcgcatcggcgcgccgtccgtgctgcctttcggtgtctccatggtggcgcccgtgctgatgaagtacggcaacgaggcgcagaaacgccactatctgccgcgtattctcgatggtacggactggtggtgtcagggctactccgagccgggctcgggttcggatctggcgtcgctgcgcacgcgcgcggagcgcgccggcgaccattacgtggtcaatggtcagaaaacgtggaccacgctcggccagtacgccgacatgatgttctgcctggtgcgcacggacagcggcgccaaaaagcaggagggcatctcgttcctgctgatcgacatgaaaacgccgggtatcaccgtgaggccgatcatcacgctcgacgaagatcacgaagtgaacgaagttttcttcgaagacgtaaaggtgccgatcgagaatctggtcggtgaagagaatcgtggctggacttacgcgaagtatctgctcggccacgagcgcaccggcatcgcgcgggtcggccagtccaagcgcgaactcgtcttcctgaaacgccttgcactgaatcagaaaaaaaacggcaagccgctgctgcaagatccggtgtttgccgcaaaagtcgcgaacctcgaaatcgagttgatggcgctcgaagtcaccgtgcaacgcgtggtcgccaatgaaacaggcggacgcgggccgggaccggaagcgtcgatgctgaagatcaagggcacggaagtgcagcaagcgctgactgaactgatgttcgaagcagtcgggccgctcgccgcaccgttcgacataccgttcctcgaaggagagcgcgaacatagcctcgccggcgacgacgatgccgcgcctctcgccgcgtactacttcaacttccgcaagacatcgatttacggtggctcgaacgaaattcaaaagaacatcatcgcgcagatgattctcggactttgagga

SEQ ID NO: 28041 - DNA, 1168 bp, Burkholderia fungorum
  unsure (1)..(1168): unsure at all n locations
atgcatatcgaaaacgattcgtaccaggacatacgcgacgccattcgcgacctgtgcagccagtttcccgccgactatttccggcgcatcgacgaggagcgcggctatcccgagcagttcgtcgacgccctgacccgagccggctggctcgccgcgctgattccgcaggaatacggcggctcgggcctcggcctgaccgaggcttcggtcgtcatggaggaaatcaaccgttgcggcggcaactccggcgcctgccatgggcagatgtacaacatggggaccttgctgcggcacggttccgacgagcagaaaaaccgctacctgccccgcatcgcctcgggcgatctgcgactgcaatcgatgggcgtgactgaacccacaaccggcaccgacaccaccagcatcaagactaccgcgcagcgcaacggggatcgctacgtcatcaatgggcagaaagtctggatttcgcgcgtgcagcattcggacttgatgattcttctgggcgcgcaccacngccgctcgccgaggtcggcaggaagagcgagggcatgtcgatttttctcgtcgatctgcacgaagcgatcggccacggcatgacggtgcaaccgatccgcaacatggtgaatcatgagaccaatgaactgtttttcgataacctcgaaattcccgccgaaacctgatcggcgaggaaggcaaggggttcagatacatcctcgacggcctgaacgccgagcgcgccttgatcgcggcggaatgcatcggcgacggctactggttcgtcgacaaggtcaccgaatacacgaagcaacgcgtcgtgttcggccgccccatcgggcaaaaccagggcgtccagtttccgatcgcccgcgccttcgtcaatatagaagccgccagcctgatgcgctacaaggcttgcgagcgtttcgacgcgcgacagccctgcggcgcccaggccaacatggccaaactgctggccgcggacgcctcatgggaggccgccaatgcgtgcctgcagtttcacggcggtttcggtttcgctgccgaatacgacgtggaacgcaagttccgggaaacgcggttgtaccaggtcgcgcccatttcgaccaatctgattctgtcctatgtggcagagcacatattggagtttccgcgttcgttttgaaggagt

SEQ ID NO: 28042 - DNA, 993 bp, Burkholderia fungorum
accctgattccgggcgacgggatcggcccggaggtgacgcaggcgacggtcagggtgctcgaagcgctgggtgccccattcaagtgggacatccaacaggcgggcatggccggcatcgacgaatgtggcgatgcgctgccgcaagcgacgctggacagcatccgcgaaacgaagctggcgctcaaggggccgctgacgacgccgattggcgggggcttccgctccgccaatgtgcgcctgcgcgaagcgttcgaactccacgcgaacatccggccggtgcgcacgatcgtgcccggccgctacgacgatatcgatatcgtgctggtgcgcgaaaacattcaggggctctacgtcgcgcacgagcattacattccgatcggcgacgatccgcgcgccgtggccgtgctgaccggcatgaacacccgcgaagggggccgccgcattgcgcgctgcgcattcgactatgcgctcaggcacggccgcaggaagatcaccgtggtgcacaaagccaatgtactgaaggcgcttaccggcattttcctggaggcggctcgcgaggttgccgccgactacgcaggacgggtcgcgctcgacgaccgcatcgttgatgcctgtgcgatgcagttggtgctcaatccctggcagttcgacatgctgctctgcacgaacctgttcggcgacattctctccgaccagcttgccggcctggtcggcgggttggggctcgcgcccggcgccaatatcggcaaggacacggcgctgttcgaagcggtgcacggatccgctcccgatatcgccggtcgcggcatcgccaaccccgtctcacaactgctggcggcaggcctgatgctggaccacgtggggctcgacgaggacgcgaagcgcctgaggcgggcgatcgccgataccctcaacgaggacaaggtgcgcactcccgatctgggcggtcaggcgaccacgcgcacgttcaccgacgcgctgatcgaacggctc

SEQ ID NO: 28043 - DNA, 1437 bp, Burkholderia fungorum
aagctgaaagatccttccctgcttcgcacgcaggcctatgtcgatggacgatcgcagggcggcgcacaggagttcgccgtgttcgacccggcaaccggcgcagagatcgcgcgggtgcccaatctcgccgccgccgaggcacgccaggcgatcgatgcggcgaacgccgcgctacctgcctggcgggccttgacgggcaagcagcgcgccgcgatgctgcggcgctggtatgagctgatcgtcgcgcacgccgccgatctcgccgccatcatgacggccgagcagggcaagccgctggccgaggcacgcgccgaggcgctgtacggagcgtcgttcgtcgaatggttcgctgaggaggcgaagcgcgtctcgggcgacgtgctggccagtccggccgacgaccggaaaatcgtcgtcatccggcagccgattggcgtgtgcgtatcgatcacgccgtggaattttccgcttgcgatgattacccgcaaggtcgccccggcgctggccgccggttgcactatcgtcgtcaagcccgctgagcagacgccgctttccgcgctggcgctggcggagctggcgcatcgcgccggcctgccggcaggcgtactgaacgtgctgacgggcgatgccgcgaacgctatcgagatcggcaaggtcttctgcgagagcgagatcgtccggcatctgtcctttacgggctcgacgcccgtggggcgactgttgatgcagcaatgcgcgccgaccgtgaaaaaggtcgcgctggagctgggcggtcacgcgcccttcatcgtgttcgacgacgcggacgttgacgcagcggtacagggcgcgatggtctcgaagtatcgcaatgcgggccagacctgcgtatgcgccaatcgtttctacgtgcatgacgccgtctacgagcgtttcgtgcggcagttcgccgaggccagccggggcgtgaaggtcggcaatggctttctcgaaggcgtcgaccaggggccgttgatcgacgacgatgccgtcgcgaaagtgcggcagcacgtcgacgatgcactcgccaaaggcgcgcgacaggtcatgggcggcaggatcgaagggcgcttcgtcgagcctgtgctgctggccgaggtgacccacgacatgctgatcgcgcgcgaggagacctttgggccggtcgcggctgtgttccgctttcgcgacgaagcggaagtgacccgcctcgccaacgatacgcagttcggcctcgcctcctacttctacagccgcgatatcggccgcgtatggcgggtggccgaggcgctcgaatacggcatggtcggcatcaacaccggcttgatttcgaacgaggtggcgccgttcggcggcgtcaagcaatcgggtctcggccgcgaagggtcgaaatacggcatcgaagaatacctgcagatcaagtacctgtgcatgggtgtt

SEQ ID NO: 28044 - DNA, 1323 bp, Burkholderia fungorum
gcggcgagacttgaccggttaccgaattcaggttggcatattctcgttcgatgtgttgttggtgcaacggtatttttcgatgcgtttgacgccttgagtattgcactcgtgttgccggtcctctcgacaaggtggcatctgacgtccatgtcgattggcattctcattgcatccggatatgtcgggcaagctatcggcgctttactgttcggatcggtagctgagcgcattggccgcatcaagacgatatcgctcacgattgttattttcgcattcgccagcctggcatccgcgtttgcgccgaactatgcctggctttgcgcgatgcgcgtcatcggaggtattggtctcggcggagaggggcctgcggccctcgcgtatatcagtgaaatcgcacctgtagaacgtcgcggagctttcatactttcgtttcagtttatgtacgcggccggttttgtcgccgcgtcgctcatgggcgcctggattgttccgcgattcggctggcagtctatctttatcgtcgggtcgttaccgatcattcttctccctgtcctccgtcggctgtgtccggaatctccgcgctggtttgcgtcgcgaggtcgtttggaggagagcgacgcagcgttatgggaaatagaaaaacgtgtttccaaaaacggaaaagtcacgttgtcagatgtagcgccgacggctggcccggtgttgaatcgcgactcgagcgtgagggagcttttctcaccggtttacagaaaacgtaccataaatttatggatattgtgggcagcaacctactttgtcgtgtatggaatgacgaactggctgcctacgttgcttaaaacggtctaccacctccctctccaggaaaccctgaatatcgctctgttgagtgcgacgttaggtctgtgcgggaacatagcgtgcgtagcgttgatcgaccggattggaccgaaacattggttcattggggcgtttgccggggcggcggctctattttccctttggcttgcaatgggtgacggaaagctcgttccattcctcatccttgggttggcggcgttcgttctctctgtgaccgttagcttcgggctatttctgtacaccgcggagatttatccgactcgcatgcgtggtataggcgcaggctttgccagcttctggttacgcgttgcgtcggttctggcaccgatggtcatcggttatctgttaccacggcacggaatctctggcgtctttgctgtctttgctggggtctctgcaatcggattcctggctagcctgatcgggatgatcaagacgaagggtttgcggctagaggacatcgcg

SEQ ID NO: 28045 - DNA, 759 bp, Burkholderia fungorum
agcacgcccgtctgcgtgattacgggttcggcttccggcattggcgcggcgaccgcgctgcgcttcgcacaggcgggctggtcggtcgccatcggcaacttcgacgacagcacgcgcgacgcggcgtcgacggtcgaggcgttgtgccgcgacgcgggcgcacagacactgatcttcgacgcggacgtcggcaaggatgccgactgccggcacgcggtcgatatggtcgcgagccgctggcagcggatcgatgcgctgatcaattgcgcgggcaccacccgcgtgattccgcacaatgccttcgatcagatcgacgacttcgaattcgagcgtgtctatcgcgtgaatctgatcggcctttaccagatgacgcgggcggccgtaccgctgctgcgcgaatcagcgagcgcgacgcgcagtaccagtgtggtcaacgtgtcgtcgctggcggggttgaacggcacgggttcgtcgatcgcgtatgcggcttcgaaaggcgcggtgaacacgttgacgctgtcgctggcgcgcaatctcgcgccgcacattcgggtgaacgccctcgcacccggtatggttgatgacggcttgctgctgcgtgtgctcgacgccgccgcctacgacggcgtgctgtcccggatgacggagagcgcgccgctcaaacgcgtttcccggcccgcggaaatcgccgaactggcgtggttcctcacggcacacgccccggcaatcacggggcaggtgatcgcggcggaaaacggc

SEQ ID NO: 28046 - DNA, 1545 bp, Burkholderia fungorum
gccttgacggccgagccgccgccggcgcaattcaatttcgccgcgcacctgttccgcctcaacgagacacgtgccggcaagcccgcgtacatcgacgaccgcggcgtcactacctacggacaactcgaagaaaagggccgccgcttcgccgctgtgctacgcacgctcggcgtgcacgcggaagaacgtgtactgctggtgatgcaggactccgtcgaattgccaatcgcgtttctcggcgcgctgtatgccggcgtcgtcccggtggtcgccaacacgctgctcggcgcgccggactatgtctacatgctcacgcatagccacgctcgcgtcatcatcgcttcgagcgcggtgctacccgcggtcgaagaagcgcttgccgtcgccgaccatgatggctgccagttgatcgtagcgcagacggccagtagtaagacccacgtaccgctcctgagcgaactcatcgatgcggccacgcccgcgcccaaagctgttgcgagcggctgcgacgatatcgcgttctggttgtattcgtcgggctcgacgggcaagcccaagggcaccgtgcatactcatgcgaacctgtactggaccgctgaactgtacgcgaaggcgatcctcggcatcgtcgaacaggatgtggtgttttccgccgccaagctgttctttgcgtatggactgggcaacggactgaccttcccgctttcggtcggagcaactgcggtgctgatggccgaacgccctacccccgacgcgattttcgcgcgtctcacccggcacaaacccaccgttttctacggcgtgcccacgctctatgcgagcatgctggcctcgcccaatgtccccgcgcgcgaggacctcgcgctgcgcatctgtacgtcggcgggcgaagcgctgccgcgcgaaatcggcgagcgcttcaccgcgcgcttcggcgcggagattctcgatggcatcggttcgaccgagatgctgcatattttcctgtccaatcgcgccggcagtgtcgaatacggcacgacgggcactccggtgcccggctacgaggttgaactgcgcgacgagagcggacatgcggtagctgacggcgaagtgggcgatctttatatcaagggacctagcgccgcgttgatgtactggagcaatcgcgagaagtcgcgcgcaactttcctcggcgaatggatccggagcggcgacaagtatcgccggctgccaaacggctgctatgtctacgcgggacgcagcgacgacatgctgaaggtgagtgggcagtacgtctcgccggtggaagtggaaatggtgctcgtgcaacacgatgcggtactcgaagcggccgtcgtcggcgtcgatcacggcggtctcgtgaagacacgcgccttcgtcgcgctgaaaggcgagttcgtggcgtctgacgcattggcggacgaactgaaggcgttcgtcaaagggcggctcgcgccgcacaaatacccgcgcgatattgtatttgtcgacgatctgccgaaaacggcaaccggcaagattcaacgcttcaaactgcgcgaa

SEQ ID NO: 28047 - DNA, 1560 bp, Burkholderia fungorum
ctgaagaattacgtggcgggccaatgggttgccggaaatggcgaaggcagcacgttaaccgacccggtgacgggcgaagcgctggtgcgggtgtcgagccaggggctcgatcttccacgcgccttcgatttcgcccgcgagcaaggcggcgccgcgctacgcgcgctcacttatgccgagcgcgccgcgcgtcttgccgacatcgtcaggctgttggaggcgaagcgcgacgattactacgccatcgccatcgcgaactccggcaccacccgcaacgattccgcggtggatatcgacggcgggattttcacgctttcttattacgcgaaactcggcgcgacgctgggcgacgtgcacgcgctgcgcgacggccccgccacctcgctcagcaaggaccagtcgttcagcgtgcagcacgtgctcgcgcccacacgcggtgtcgccctcttcatcaacgcgttcaatttcccgtcatgggggctgtgggaaaaggccgcgccagcgttgctgtccggtgtgccggtgatcgtcaaaccggccaccgccaccgcctggctcacgcaacggatggtcgccgatgtggtcgaggcaggtatcctgccgcagggcgcgctgtcggtcatctgcggcagctccgcgggcctgctcgatcaggtgcaggccttcgacgtggtgtcgttcaccggctccgctgaaaccgccgcgatactccgcgctcacgctgcctttgttcagcgcggcgcgcgcctgaacgtcgaggccgacagcctgaacagcgcgatcctgtgcgccgacgccacacccgatacgccagccttcgaactgttcatcaaggaagtggtgcgggaaatgacggtgaagtcgggacagaaatgcacggcgatccggcgtgcgttcgtgcctgaggcctcactcgaagcggtgctcgatgcgctgaaggcaaagctcgcgaagatcaccgtcggcaatccgcgcaacgacagcgtacgcatgggctcgctcgtgtgccgcgaacagtatgagagcgtgcttgctggaatcgccgcattacgcgaggaagccgtgctcgcgtatgacggctcggccgtgccacccgtcgacgcggaccccgcgattgccgcatgcatcgcgccgcatctgttcgtggtcaacgatcccgatcgcgcgacgctgctacacgacgtcgaagtcttcggaccggtcgctacggttgccccgtacgagccggccagcgacgccagcgaactgcgcgaagcacacgccatcgcgttggcgcggcgcggccgcggctcgctcgtcgcctcggtctattcgaatgacgacgcgcacctcgcccgggtcgcgctggaactcgccgacacgcacggtcgcgtccatgcggtctcgccatcggtgcaaggcagccacaccggccacggcaacgtgatgccaatgtcgttgcacggcggtcccggccgcgcgggcggcggcgaggaactgggcggctggcgggcgctggcgttctatcatcggcgcgccgccatccaggcatcgagtaccggcatcgatgtattgacgcaa

SEQ ID NO: 28048 - DNA, 1388 bp, Burkholderia fungorum
cggacgtcgcacgctatctgttcatcgacgaaattcatacgctgatcggcgcgggcgctgcgtcgggcggcacgctggacgcgtcgaacctgctcaagccggcgttgtcgtcgggcacgctgaagtgcatcggcgcgaccacgttcacggaatatcgcggcatcttcgaaaaagacgcagccttgtcgcggcgtttccagaaggtcgacgtgaccgagccgaccgtcgaacaaacggtggcgatcctgcgtggcctgaagtcgcggttcgaagagcaccacggcgtgaagtattcgtcgggcgcgctgtcggcggcggctgagttgtcggcacgcttcatcacggatcgtcatctgccggacaaggcaatcgacgtgatcgacgaagcgggcgcggcgcaacgcatcctgccgaagtcgaaacagaagaagaccattggcaagaacgagatcgaggaaatcatctcgaagatcgcccgcgtcccgccacaaagcgtgtcgcaagacgatcgcagcaagctgcaaacgctggatcgcgatctgaagagcgtggtgttcgggcaagacccggccatcgacgcgctgtcggccgcgatcaagatggcgcgtgcgggtctcggcaagctggacaagccgatcggcgcattcctgttctccggccccacgggcgtcggcaagacggaagtggcaaagcagctggcgttcacgctgggcatcgagctgatccgcttcgacatgtcggaatacatggagcgtcatgcggtcagccggttgatcggcgcgccgccgggctatgtcggtttcgaccagggcggtctgctgaccgaggctgtcacgaagaagccgcattgcgtgctgctgctcgacgaaatcgagaaggcgcatccggacatctacaacgtgctgctgcaggtgatggaccacggcacgctgacggacaacaacggccgcaaggcggatttccgcaacgtcatcatcatcatgacgacgaacgcgggcgccgaggcaatgggcaagtcggtgatcggcttcacgaatcgtcgggaaaccggcgacgagatggtcgacatcaagcgcatgttcacgcctgagttccgtaaccgtctggatgcggtgatcagcttccgctcgctcgacgaagaaatcatcatgcgcgtggtcgacaagttcctgatgcagctggaagatcagttgcacgagaagaaggtcgatgcgctcttcaccgacgcgttgcgcaagcatctcgccaagcacggtttcgatccgctcatgggcgcgcggccgatgcagcgtctgattcaggacacgatccgtcgtgcactggccgacgaactactgttcggcaagctgatgaacggcggtcgcgtgacggtcgacgtggatgcggaa

SEQ ID NO: 28049 - DNA, 1569 bp, Burkholderia fungorum
gaattcgatgtggcgattgtcggtagcggtctggccggtttgagcgttgcgctcaatctggcggagacccggcgggttgcggtggtcgccaagcgatcgatgaccgaaggcgcgagcgactgggcacaaggcggcatcgccgcagtactggattcggcggacagcattgaaaatcacgtccgcgatacgctgattgccggcggtggcctgtgcgacgaagcggcgacgcgcttcatcgtcgaacatgggcgagccgcaatcgaatggttgatcgcgcaaggcgtgccgttcaccaaagacgacgccgccgaactcggcttccacctgacgcgcgaaggcggccatagccaccggcgcatcatccatgcggcagatgcaacaggccacgccgtggtggccacgctcagcgagcgggtgcgccgtcacccgaacatcacgctgctcgaagatcactacgcaatcgacctgatcacgtccgaccgcctcggcttgccaggacggcgttgtcacggcctgtatgcactcgacctgcaaagcggccgcaccgtcacgatcgaggcgccgcataccgtgctcgccaccggcggcgccggcaaggtttatctctacaccacgaatcccgacaccgcgaccggcgacggcattgcgatggcgtggcgggccggctgccgcgtatccaatatggaattcatccagttccatcccacctgcctgttccacccgtatgcaaagtcgtttctgatttcggaagcggtgcgcggcgaaggcggtattctcaaactgccggacggcacgcgtttcatgccgaaccacgacgaacgcgccgagctcgcgccgcgcgatatcgtcgcgcgtgcgatcgacttcgaaatcaagaagcgtggcatcgattgcgtgtatctggacatcagccatcaaccgcccgaattcctgcgtgagcacttcccgacgattctggcgcgctgtctggagttcggcatcgacatcaccaaggaagcgattccggtcgtgccggccgcgcactacacctgcggcggcgtcgtgaccgatctggcgggacgaacagacctggcaggcctctacgcggtcggtgagacgtcatgcacgggtctgcacggcgcgaaccggctcgccagcaactccctgctcgaatgcatcgttatcggacgctccgcggcgcaagcgatcgaagaagaaggttttagcgccgctgtccatgccccgctgccggattgggacgaaagccgcgtgtcggatccggacgaagaagtcgtggtcgcgcacaactgggacgaactgcgccggctgatgtggaattacgtcggtatcgtacgaacggacaagcggctcgcacgagcgaagcatcggcttgccctgctgcgcgatgaaattcacgagtattacgccaacttcaaggtgagccgcgacctgctcgaattgcgcaatctggtcgatgtggcgtcgttgatcgtcgaaggcgcgcggtcgcggcgtgagagccgtggcttgcacttcagccgtgactggccggccactttgcccaaggcgctgcccacagtgctctcaccg

SEQ ID NO: 28050 - DNA, 1530 bp, Burkholderia fungorum
acgtggcggcaactcgccatcgacgtcgagcggcacggcgcggcgttgcagtcgcttggcattattgcgggcgcgaaggtcggcattctcatgccgaacggttatgagtgggttgtatgggcttatgccgccgcaagcattggcgcggtcgtcgtcccgctcaatacgcgctttctcgccgctgagctcgcctaccagcttgccacggcggatatcgagattctggtgctttcgccgatcatcggcgacacggatttcctggccatcgttgcagcgatggttcctgcgttgagcgaagcacaaccaggcgcctggcgaagcgagacgctgcctcgcctgcgccatatcgtgacgacaggcacgagcacaactttcgtgggcgaactgagtgcggggagcctgacggcctcgcccatcgaccctgcggcaatcatccgggtgcacgaagcggcagcgaaggtgaagcctgacgatcccgtgctgatccagttcacatcgggctccactgcgctgccgaaaggcgcgatgctcagccatcaaagcacgttgcgtaacgcgcacgacgttgcggctcgccttcacatcacgcacgccgatcgcatcttcgtgccggggccgttctttcacgttggcggactgacgctcggtatgctgctgggtttgtcgaccggtgcgccgatccatacactcgcgcgcttcgatccggccgccgtcctggcgaccatcgcgcgcgagcaaatcaccgtctatagcggcgtcgattcgctattcatcacgctttacaagtatcccgggttccgtcgcgaggcgatcgcgtcggtaaccaaaggctggatcgccagcagccccgacattgtgcgcatggtgcagacggagatgggactgaccggcatcagcaacgtattcggcatcagcgaggcgtcgccgaacgtgacgatcggcgacctcgacgagccgcccgcattgcgggcagcgacttgcggccggcctcatcccgggtgcgaggtgaagatcgtcgacccggcgacaggtgaaaccgtacccgcgggcgaatccggcgaaattctctaccgtggctactcgctgatgttgggttactacaacaaccccgcggcgaccgcaaaagcgatcgatgtcgacggctggctgcacacaggcgaccggggcatcctgcgtgcgagcggtcacctcgaatatcacggtcgcatcaaggacatgctgcgtgtcggcggagagaacctggcgccggccgaggtcgaagaagcgctgtgccgccatccaaaggtgcgccaggcggctgtcatcggtttgcccgacgagcgcctcgtggaagtgcccgccgccgtcgtcgaactgaaggaaggcgaaacctgttccgcggaagagatcaccgcgtggtgcgcggcgcggcttgccgcgttcaaggtaccgcgtgtgatcgcgttcgtcgaacagatgccgatgacgggcagcggcaagatacagaagacccgaatgaaacaagaagtattcggcatctcaacctctcaa

SEQ ID NO: 28051 - DNA, 675 bp, Burkholderia fungorum
aaagtagcagtgttcacggcagccggcagcggaatgggcgctgcggcagcccgccgattcgcggctgatggcttcaaggtcggcatcctttcatcttcaggtaaaggcgaggcgctggctgcggaactgggaggtctgggagtgacgggatcgaaccggtcgaacgacgacctcgcccggctcgtcgaattggtcatttcgcgctgggggcgcatcgacgtgctagtcaacagcgcggggcacggtccgcgcgccccggttctggcactgaccgacgaggactggcatacaggcatggaaacgtacctgctcaatgttatccgtccgacacggctggtcacgccggttatgcaaaagcatggaggggtgatcgtcaacatctccacggcctgggccttcgagccgagtgagctgttcccgacttcggcggtttttcgcgcgggcctcgcggcgttcacgaagatcttttccgagagtcatgcgaaggacaatattcgcatgaacaatgtgctacctggctggatcgacagcctcccagccaccgatgagcgccggcaaagcgtgccgctgcagcgttacggaaccagcgaggaagtcgccgcgaccatcgcttttctcgcctctgaaggcgcggcctacatcactgggcaaaatattcgtgtcgatggcggtgtg

SEQ ID NO: 28052 - DNA, 780 bp, Burkholderia fungorum
attactggatcaacccgactggtggggatcgttggctcgccggtttcgcaagttgcgtcgccggccaacttcaatgcgcacttcgccacgaccggcgccgacatcgcgatgattccgctggacatcgacgctgaggccatcgacgccttcacggtgttgttgcgcggttggaagaacctgctcggctgtgtcgtgaccgtgccgtacaaacagacgctggtgcctcatctggatgcgttgagcgcgcggtctgccgcattgggtgccgtcaatgtcatccggcgcgaagcggacggacgactgatcggcgatatgacggacggcgccggttttctcgccgccgcgcaggcgcacggatttcgagccgcaggacagacggcgttgatcgccggtgcgggcggcgcgggcagtgcgatcgcctatgcgctttgcgaagcccgaatcggacatttgacgctgggcgacatcgaccgcgcgcgcgccgatttgctggcgaagcggttggggcaggcatttcccgaggtcgaaattgacgtcggcctgaccggcgcgagccacgccgatctgctcgtcaatgcgacacctgccggtatggacggcaccacggctttccctgtgcctgccggtttgctgaaggcctgtgcgccacacgtactggtggccgatgtcgtgacctcgccagtcatgacgcccttgctgttacgcgcgcaggaactgggttgcaggattcagaccgggattgaaatggctgcggcccagatgcaagcgctgggcgccttc

SEQ ID NO: 28053 - DNA, 1416 bp, Burkholderia fungorum
gaatttgacgtcgtcgtgatcggcgcaggccctggtggttatatcgccgccatccgcgcagcgcagctcggcaagaccgtcgcatgtatcgaaaaatggaagaacccggccggcgcgctgaagctcggcggcacgtgtctgaacgtgggttgcattccgtcgaaggcgctgctcgcgtcgtcggaagaatttgagaacgcgtcgcatcacctcgctgaccacggcatctccgtggaaaacgtgaaggtcgatatcgcgaagatgatggcccgcaaagaaggcatcgtcgagaagatgacgaagggcatcgaattcctgttccgcaagaacaagatcacgtggctcaagggccacggcaagttcaccggcaagacggacgccggcgtgcagatcgaagtgagcggcgagggtgaaacggaaacggtcacggcaaagaacgtgatcatcgccacgggttcgaaggcacgccatctgccgaacattccggtcgacaacaggatcgtcgccgacaacgaaggcgcgctgagcttcgaatccacgccgaaaaagctggctgtgatcggcgctggcgtgatcggtctggaactgggttcggtgtggcgccgtctgggcgcggaagtgaccgtgctcgaagcgctgccggaattcctcggcgcggccgaccaggcgctcgcgaaagaagcggccaagcagttcaagaagcagggtctggacatccacgtcggcgtgaaggtcggcgaagtgaagacgaccgacagcggcgtgacgatcgcctacacggacaaggacggcaacgcgcagacgctcgaagccgatcgcctgatcgtgtcgatcggccgcgtgccgaacaccgacaatctcggcctcgaagcgatcggcctgaaggcgaacgagcgcggcttcatcgacgtggacgagcattgcgcgacggcggtgccgaacgtgtacgcgatcggcgacgtggtgcgtggcccgatgctcgcgcacaaggcggaagacgaaggcgtactggtcgctgaaatcatcgacggtcagaagccgcatatcgactacaactgcattccgtgggtgatctacaccgaaccggaaatcgcgtgggtcggcaagacggaacagcagctgaaggctgaaggccgcgagatcaagacgggccagttcccgttcatggcgaacggccgcgcactcggcatcaacaaggcagatggtttcgtcaagatgatcgccgacgcgaagaccgacgaactgctcggcgtgcacatcatctcggcgaacgcatcggacctgatcgcggaagccgtggtggcgatggaattcaaggcggcttcggaagacatcggccgcatttgccatccgcacccgtcgctgtcggaagtcatgcgcgaggcggcactcgctgtcgacaagcgcgcgctgaac

SEQ ID NO: 28054 - DNA, 1281 bp, Burkholderia fungorum
atggctattgttgaagtcaaggtcccccagctttccgagtcggtttcggaagccaccatgctgcagtggaagaagaagcccggcgaggctgttgctcaagacgaaattctcatcgaaatcgagaccgacaaggtcgtgctcgaagtgccggcaccctcggccggcgtgctcgcgcaagtcatcgcgaacgacggcgacaccgtcacggctgatcaggtgatcgccaagatcgacaccgaaggcacggcaagcgccgctgctgtcgaagccgaagtcaagcccgctccgcaagccgcaccggcacccgccgctgcaccggctccggcggctcaagccgcatccgcaacgggtgcgaacaccgctgcttcgccggccgccggcaagctgatggccgagaagggtctgggcgcgggcgacgtcgccggcacgggccgcgacggccgcatcaccaagggcgacgtgctgaccgcgggcgcaccggctgcgaaggctgccgccccggctccggccgccgcaccgaaggcagcgaagccgtcgctgccggacgtcaaggcgccggcctcggctgagcaatggctgaaggaccgtccggaacaacgcgtgccgatgtcgcgtctgcgtgcgcgtatcgccgaacgtctgctcgagtcgcagcaaaccaacgccattctcaccacgttcaacgaagtgaacatggcgccggtcatggacctgcgcaacaagtacaaagacaagttcgaaaaggaacatggcgtgaagctcggcttcatgtcgttcttcgtgaaggcggcggtccacgcgctgaagaagttcccgctggtgaacgcgtcgatcgacggtaacgatatcgtctatcacggctacttcgacatcggtatcgctgtcggttcgccgcgcggtctggtggtgccgatcctgcgcaacgcggatcagctgagcctcgctgaaatcgagaagaagattgctgaattcggccagaaggcgaaagacggcaagctgtcgatcgaagaaatgaccggcggcacgttctcgatctcgaacggtggcgtgttcggttcgatgctgtcgaccccgatcatcaacccgccgcaatccgcgattctgggcgtgcacgccacgaaggaacgcgccgtggtcgaaaacggccagatcgtgatccgcccgatgaactatctggcgctgtcgtacgaccaccgcatcatcgacggtcgcgaagcggtgctgtcgctggtcgccatgaaggatgcgctggaagatccggctcgcctgctgctcgacctg

SEQ ID NO: 28055 - DNA, 2829 bp, Burkholderia fungorum
atgatgaagcaattccagtcgaactcttacctgttcggcggcaatgctccgtacgtagaagaaatgtacgaagcgtatctcgataatccggcgtcagtgcccgagaactggcgcagctatttcgacgcattgcagaacgtcccggcatcggatggcagcaatgccaacgacgtggcccacggcccgatcgtcgaatcgtttgctcaacgggccaaggctaatgccttcatcccgcgcggagcaggtggcggcgaagatctcgctaccgctcgcaagcaggtttatgtgcagtccctcatcggcgcatatcgcttcctcggctcgcaatgggccaatctcgatcccctgaagcgccgcgaacgtcccgccattcccgaactcgaacccgcgttctacgacttcaccgaagccgacatggaccaggagttcagcgccacgaatctgtatttcggattcgagcgcgcttcgctgcgcgagatcgtcaaggcattgcgcgacacgtactgcggcacgatcggcgccgagtacatgtacatcagcgatccggaacagaagcgctggtggaaagagaagctcgaatcgatccgttccacgccgaacttctcgaacgaaaagaaaaagcacatcctcaatcgcctgacggccgctgaaggcctcgagcgcttcctgcacaccaagtacgtcggccagaaacgcttctcgctcgaaggcggcgaaagcttcatcgcgtcgatggacgaagtcgtgcgtcacggcggcgccaacggcgttcaggaaatcgtcatcggcatggctcaccgtggccgtctgaacgtgctggtcaatacgctcggcaagatgccggccgacctgttcgccgaattcgaaggcaagcacgtcgacgacctgccggccggcgacgtgaagtaccacaagggtttctcgtcggacgtctcgaccgaaggcggcccggttcacctgtcgctcgcgttcaacccgtcgcacctcgaaatcgtcaacccggtggtcgaaggttcggccaaggcacgtatggaccgccgcggcgacgacagcggcctgcaagtgctgccggtgcagatccacggcgacgcggccttcgcgggccagggcgtggtgatggaaacgctgaacctcgcgcaaacgcgcggttacggcacgcacggcacgctgcatatcgtcatcaacaaccagatcggcttcacgacgtcggatccgcgcgactcgcgctccacgttgtattgctcggacgtcgtcaagatgatcgaagcgccggtgctgcacgtgaacggcgacgatcctgaagcggtggtgctggctacgcagctggcaatcgacttccgcatgcagttccacaaagacgtcgtcgtcgacatcgtctgcttccgcaagctgggtcacaacgagcaggacacgccggctgtcacgcagccgctgatgtacaagaccattgcgaagcacccgggcacgcgcgcgctgtacgctgaaaagctggtgcagcaaggcgtgatcacggcggccgacgcagacgaatacgtcaaggcctaccgcaaggcgatggacgaaggccatcacacggtcgacccggtgctctcgaactacaagagcaagtacgcggtggattgggtgccgttcctgaaccgcaagtggaccgacgctgccgataccgcagtgccgctcgcggaactgaagcgccttgctgaacgcatcaccacgattccggaaaacttcaaggttcaccccctggtcgagcgcgtcatcaacgaccgtcgcgcgatgggccgtggtgaagcgaagctcgactggggcatgggcgaacacctggcattcgcgtcgctggtcgcctcgggctatgcagttcgcctgaccggccaggactcgggccgcggcacgttcacgcaccgtcacgcggtgctgcacgatcagaaccgcgaacgctggaacgacggcacgtacgtgccgctgcaaaacatcgccgaaggtcaggcgaagttcacggtgatcgactcggtgctgtcggaagaagcggtgctgggcttcgaatacggttattcgaccgctgagccgaatacgttcgttgcatgggaagcgcagttcggcgacttcgtgaacggcgcgcaagtcgtgatcgaccagttcatctcgtcgggcgaagtgaagtggggccgtgtttcgggtctcaccatgctgctgccgcacggctacgaaggccagggtccggaacactcgtccgcacgtatcgagcgtttcctgcaactgtgcgcggatcacaacatgcaggtcgttcaaccgaccacgccggcgcagattttccacctgctgcgccgtcagatgatccgcctgttccgcaagccgctgatcgtcgccacgccgaagtcgctgctgcgccacaaggaagccgtgtcggatctgtcggaactggcgaagggcgcgttccagccgatcctcggcgaaatcgacgaagccatcgacgcgaagaaggtcaagcgcgtggtcgtgtgctcgggccgcgtgtactacgacctgctcgcacatcgccgtgaatcgaagtcgaacgacgtcgcgatcatccgtatcgaacagctctatccgttcgcgcacaagcagttcgaagcggaaatgaagaagtacgacaacgcgaccgaagtggtctgggtgcaggacgagccgcagaatcagggcccgtggttctacatcgagcaccacctgaaggacggcatgaaggaagggcagaagctggcatacagcggacgtccggcttcggcctcgccggcagtcggctattacgcgaagcactacgagcagcagaaggcgctggtcgaaggcgctttc

SEQ ID NO: 28056 - DNA, 1981 bp, Burkholderia fungorum
atgagaatcgacaaactcaccactaaattccaggaagcactggccgatgcccaaagtctggctgtcggccacgacaatcaatacatcgaaccggttcacgtcctgtcggcgctcgtcgcccaacaggatggctcggcgcgttcgctgctctcgcgtgccggcgtgcatgtgcaggcgctgcaaacggcgctcggcgacgccatcacgcgtctgccgcaagtgcaaggcaccgacggcaacgtgcagatcggccgcgatctgaccggcctcctgaaccaggccgacaaggaagcgcaaaaactcaacgacacgttcatcgcgagcgagatgttcctgctcgccgtcgcggacgacaaaggcgaagccggccgtctggcgcgtcagcatggcttgtcgcgcaagtcgctggaaagcgcgatcgccgcggtgcgcggcggttcgcaggtgcatagccaggacgcggaaagccagcgtgaggcgctgaagaaatacaccgtggatctgaccgagcgcgcgcgggccggcaagctcgatccggtgatcggccgcgacgacgaaatccgtcgctcgatccagatcctgcaacgccgcaccaagaacaaccctgtgctgatcggcgaaccgggcgtgggtaagaccgcgatcgtcgaaggtctggcgcagcgtatcgtcaacggcgaagtgccggagacgctcaagggcaagcgcgtgctgtcgctcgatatggcggcgttgctggccggcgccaagtatcgcggcgaattcgaagaacgcctgaaggccgtgctgaacgacatcgcgaaagacgaaggccagaccatcgtcttcatcgacgaaattcacactatggtcggtgcgggcaaggccgaaggcgcgatggacgcgggcaacatgctcaagccggcgctctcgcgcggcgagctgcattgcgtcggcgcgaccacgctcgatgaatatcgcaagtacatcgaaaaggacgccgcgctcgaacgccgcttccagaaggtgctggtcgacgaaccgacggtcgaagccaccatcgcgatcctgcgcggtctgcaggaaaagtacgagctgcaccacggcgtggatatcaccgacccggcgatcgtggcggcggctgaactgtcgcatcgctacatcacggatcggttcctgccggacaaggccatcgacctgatcgacgaagccgcttcgaagatcaagatggaaatcgattcgaagccggaagagatggatcggctcgaccgtcgtttgatccagttgaagattgagcgcgaagccgtcaagaaggaaaaagacgaagcgtcgcagaagcgtctgcaactgatcgaggaagaaatcgagcggctgaaccgcgaatattcggacctcgacgaaatctggaccgcggaaaaagccgcggtgcaaggcagcgcgcaactgaaggaagagatcgaaaaaacgcgtgcggaaatcacgcgcctgcaacgtgaaggcaagctcgagaaggtcgccgagttgcagtacggcaagctgccgggactcgaagcgcagttgaaggaagtgaccaaggccgaggcgagcgagcagaacaatccgacgcgcccgcgcctcttgcgcacgcaggtcggtgcggaagaaatcgctgaagtcgtgtcgcgcgccaccggcattcccgtgtcgcgcatgatgcagggcgagcgcgaaaagctgctgcagatcgaagagaagctgcacgcgcgcgtggtcggccaggacgaggcgatcagcgcggtggccgatgcgatccgccgctcgcgtgcgggtctgtcggatccgaaccggccgtatggttcgttcctgttcctcggcccgaccggcgtgggcaagaccgagttgtgcaaggcgctcgcgtcgttcctgttcgattcggaagatcatctgatccgtatcgacatgagcgaattcatggagaagcatagcgtcgcgcgtctgatcggtgccgccgggatacgtgctc

SEQ ID NO: 28057 - DNA, 1329 bp, Burkholderia fungorum
atggaaccgatcaaagttggactgctgggcttcggcacggtaggcagcggcaccttcacggtactgcgccgcaatcaggaagaaatcaaacgccgcgcgggccgcggcatcgagatcgcgcgcattgccgtgcgcaatcccgccaaagcgacggcggtgctcggcgccgaggcaggcaccgtggcgctgaccgatgacttcaacgcggtggtcgacgacccgtcgatcgatatcgtggccgaaatgatcggcggcacgggcgtggcgcgcgacctcgtgctgcgcgcgatccgcaaccgcaagcatgtggtgaccgccaacaaggcgctgctcgcggtgcacggcacggagattttcgaagcggcgcgcgccaacggcgtgatggtgtcgttcgaggcggcggtggcgggcgggattccgatcatcaaggcgctgcgcgaagggctcacggccaatcgcatccagtacattgcgggcatcatcaacggcaccacgaactacattctctcggaaatgcgcgaccgcgggctcgacttcgcgaccgcgctgaaagcggcgcaggacctcggttatgccgaagccgacccgaccttcgacatcgaaggcgtggacgccgcgcacaaggcgaccatcatgagcgcgatcgcgttcggcgtgccggtgcagttcgacaaggcctacgtcgaaggcatcagcaagctcgcggcgatcgacatcagatatgccgaggaactcggctaccgtatcaagctgctcggcattgcgcgccgcacagataaaggcatcgaattgcgcgtgcatcccacgctgattccggaaaagcgcctgctggcgaacgtggaaggcgcgatgaacgcagtcgtcgtgcacggcgacgcggtcggcaccacgctgtactacggcaagggcgcgggcgccgagcccacggcttccgcggtggtggccgatctggtcgacgtgacgcgtctgcacacggcggacccggagcaccgcgtgccgcatctggcgttccagccggacagcctgtcgaacaccccgatcctgccgatcgacgaagtgacgagcggctactacctgcgtctgcgggtggcggacgtgaccggcgtgctggctgacatcacgcgcattctggccgataccggcatttcgatcgacgcgctgctgcagaaggaatcggagcaggtcgacgcgaacggcaagggcgaaaccgacatcatcctgattacgcacgaaacggttgagaagaacgtcaacgccgcgatcaagacgatcgaagcgctgaagaccgttgtttcgcaagtcacgaagctgcgcatggaagcgctgaac

SEQ ID NO: 28058 - DNA, 1020 bp, Burkholderia fungorum
atgaaagcattggcaaaactcgaacgcgctccgggcctcacgcttacggacgtcaagaaacccgaagtcggccataacgacgtgatgatccgcatcacgcgcaccgcgatttgcggcacggacattcacatctggaagtgggacgactgggcgcagaaaacgattcctgtgccgatgcatgtcggccacgaatacgtgggtgaaatcgtcgaaatgggccaggaagtgcgcggctttgcgatcggcgaccgtgtgtccggcgaaggacatatcacgtgcggcttctgtcgcaattgtcgcgcgggccgcaggcatttgtgccgcaatacggtgggcgtcggcgtgaatcgtgagggggcgttcgccgagtatctggtgattccggccttcaacgcattcaagattccgcccgagatttccgacgacctcgccgctattttcgatccgttcggcaacgccacgcatactgcgctgtcgttcaatctggtcggcgaagacgtgttgattaccggcgccggccccatcggcatcatggcggtggcgatcgcgaagcacgtcggcgcgcgcaacgtggtgattaccgacgtcaacgactatcgcctcgaactcgcgcgcaagatgggcgccacgcgtgcagtcaacgtctcgcgcgaatcgttgcgcgacgtgatggcggatctgcacatggccgaaggtttcgacgtcggcctggaaatgtccggtgtgccgagcgcgttcaccggcatgctcgaagcaatgaaccacggcggcaagatcgcgctgctcggcattccgcccgcgcagaccgcgatcgactggactcaggtgatctttaaaggcctcgaaatcaagggcatttatgggcgcgagatgttcgagacctggtacaagatggtggcgatgctgcaaagcgggctggatctgtcgccgatcctcacacaccatttcaaggtcgacgactatcgggaagcgttcgccacgatgctctcaggcgagagcggcaaagtgattctcgactgg

SEQ ID NO: 28059 - DNA, 1197 bp, Burkholderia fungorum
atgcgtgacctatacctcgcccatttgcgcgataccctcgagcagattcgcgctgacggcttttacaagaacgagcgcgtgatcgccagcccgcaatcggctgacattcgtctcgccgacggcgcggccgtgctgaacttctgcgcgaacaactatctgggcctcgccgacgacgcacgcctgatcgacgcggcaaagcagggtctggatagcgacggcttcggcatggcgtcggtgcgcttcatttgcggcacgcaaaccgtgcacaaggagctggaacaagcgctcgcggcgtttctgcaaaccgacgattgcattctctactccagctgtttcgacgcaaacggcggcctgttcgaaaccctgctcgacgagaacgacgcgatcatcagcgacgaactgaaccacgcgagcatcatcgacggggtgcggctttccaaggcgaagcgctctcgctacaagaacaacgatctcgccgatctcgaagccagactgatcgaagcgcaggccgccggcgcgcgcttcaaactgatcgccaccgacggcgtgttctccatggacggcatcatcgccgacctcgccggcatttgcgacctggccgaccgttacggcgcgctcgtgatggtcgacgactcgcacgcggtaggttttgtcggcgaacacggacgcggcacgccggaacattgcggtgtgctgtcgcgcgtcgacatcatcaccggcacgctgggaaaagcactcggtggcgcgtcaggcggctatgtggccgcacgcaaggagatcgtggagttgctccggcagcgctcacgtccctatctgttttcgaacacgctgacgccgagcattgccgccgcctcgctgaaggtgctcgaactgctggccagcgaagaaggcgcgcaactgcgcgcacgcgtgcgcgaaaacggcgctcacttccgcagcaagatgagcgcgctcggctttaccctcgtgcccggcgaacatccgatcattccggtcatgcttggcgacgcgcaactcgcatcgaaaatggccgatgcgctcctgaaggaaggcgtctacgtgatcggcttctcgttcccggtggtgccgaaaggtcgcgcgcgcattcgcacgcagatgagcgccgcgcatacgcccgggcagatcgaccgcgcggtggatgccttcgcgcgcgtcggccgtgaactcggcgttatc

SEQ ID NO: 28060 - DNA, 1176 bp, Burkholderia fungorum
atgactgacgccgtaatcgtatcgaccgctcgcacaggcctcgccaaatcgtggcgcggcggtttcaacatgacgcacggcgcgacgctcggcggccatgtgacgcaggccgccgtcgaacgcgcgaagctcgacccggcgcgcgtcgaggacgtgatcatgggctgcgccaatccggaaggcgcgacgggcatgaacatcgcgcggcagatcgcgctgcgcgccggtttgccggtcagcgtgccgggcatgacggtgaaccgtttctgttcgtcgggattgcaaactatcgcgctggccgcgcaacgcgtgatcgccggtgaaggcgacgtgtatgtggcaggcggcgtggaatcgatctcgtgcgtgcagaacgagatgaaccaccacatgctgacggaaggctggctcagcgaaaacaaaccggaaatctactggtcgatgctgcagaccgcggagaacgtcgcgaaacgctattcgatctcgaaggagcgtcaggacgagtacggcgtgcgttcgcaacagcgcgcggccgccgcgctcgaagccggcaggttcaaggacgagatcgtgccgctgacggtgctcgcgggcgtcaccgataaagcgggcgggcgtcttttcacgaaggaagtgaccgtcagcggcgacgaaggcattcgcgccgacacgacgctcgaaggcgtctcgaagattcgtaccgcattgccaggcggcgtgatcaccgcgggcaatgcgagccagttctcggacggcgcgtcggcgtgcgtggtgatgaacgcgaaggtggcggagcgcgaaggcctgcagccgctcggtattttccgcggcttcgcggtggcaggttgcgagccggacgaaatggggatcggcccggtgttcgcggtgccgaagctgctcaggcaggcaggtctgaaagtcgaggacatcgacctgtgggagttgaacgaagcgttcgcggtgcaggtgctgtattgcgccgacaagctcggtattccccaggatcgtctgaacgtgaacggcggcgcgatcgcggtcgggcatccgtatggcgtgtcgggcgcgcggctgaccgggcatgcgctgatcgaaggcaagcggcgcggcgcgaagctggttgtcgtgacgatgtgtattggcggcgggcagggcgcggcggggttgttcgaagtggtg

SEQ ID NO: 28061 - DNA, 603 bp, Burkholderia fungorum
cggggcaaattcatcacgtttgagggcatcgacggggcgggcaagacaacccacctcagctggtttcgggagcgcctcgaacagaaagtcgcgagcaccgggcgctcggtcgtcatgacgcgcgaaccgggcggcacgccgctcggcgagcagattcgcgaaatcgtgctgcatcagaaaatggacctcgaaaccgaggcgctgctgatgttcgcgctgcgccgccagcatctggccgaagtgatcgagccggcgctcgcgcgcggcgactgggtgctgtcggaccgtttcaccgacgcgaccttcgcctatcagggcggcggccgcggactgccgcgcgacaagctggaaaccctggagcgctgggtgcagggcggctttcaaccggacctgacggtgctgttcgacctcgatcccgaggtcgccagcgagcggcgcagcgcggcgcgcgacccggatcgtttcgagagcgaatcggaggcgttcttcagccgtacccgcgccgaatatctgcgccgtgccgaagaagcgccgtaccggttcgctatcattgactccgcgcagagcatcgcgcagattcagaggcgacttgaagaattgatt

SEQ ID NO: 28062 - DNA, 1374 bp, Burkholderia fungorum
atggggcgattgatcgtcgtgtcgaatcgcgtcgcaacgccgacggaaaccaagggatcggccggcggcctcgcggtcggcgtattcggcgcgctgaaggatgccggaggcgtgtggttcggctggagcggcgacgtggtcagcgagaccgtcgcgaacgccggtccgacgctggagcaggacggcgcggtgaccttcgcgaccgtagggctcacgcgcaaggattacgaccagtactatcgcggcttttcgaacgcgacattgtggccggtgttccactaccgcaacgacctcgcgcgctacgagcgcgaggaatacacgggctaccggcgcgtcaacgcgtggctcgcgcacaagctgatcaagctgctcgaacccgacgacgtgatctggattcacgactaccacctgatcccgttcgccgaggcgctgcgcaacgagggtgtcacgaaccgcatcggcttcttcctgcacattccgtttcccgcgccgcagatcctgctcaacattccgccgcacgaggaactggtgaagtcgctgtcgtgctacgacctgctgggcttccagaccgccaccgacgaactcgcgttcaaggattacgtcacgcgccacgcgcgcggcacggtgagtgcggacggtctcgtcgaagcgttcggccgcaagctgcgcaccggcgtctaccggatcggcgtgttccccgacgaaatcgccgagcaggcgaagcgctacgaaagccgtcagcacgtgctcgacctgaagcagagcctggaagggcgcaagctgatcatgagcgtcgaccggctggactattcgaagggactggtcgagcggttccgggccttcgagcatctgctggagcgctcgccggaatggcgcggcaacgtcacgctggtgcagatcgcgccgcccacccgttcggacgtcgccacctatcagaagattcgccaggatctggagtacgaagcggggcgcatcaatggccgctactcgggtctcgactacacgccgatccgctatctgaatcagcagtacgaccgctggaagctgatgtcgctgtttcgcgaatcgcagatcggtttcgtcacgccgctgcacgacggtatgaatctggtcgcgaaggaatacgtcgccgcgcagaatcccgacgatcccggcgtgctggtgctgtcgattttcgcgggtgcggcggcggagctgagcggcgcgctgctcgtcaatccacatgatgcgatcggcatgtgcgaagccttgcagcgcgcgttgcagatgccgctcgacgcacgtcagcggcgccatgaaatcaacatggccgcgctgcgcaagaacgatctcggcgtgtggcgcgacacgttcctgcacgatctgcgcagcgtg

SEQ ID NO: 28063 - DNA, 969 bp, Burkholderia fungorum
atgaagattgcgcagatcgcccctttgaccgaatcggtgccgcccaagctgtacggcggaacggagcgcgtcgtgtcgtacatcaccgaggcgctggtcgatctcggccatgacgtgacgctgttcgcgagcggcgactccgtgaccaacgcgaaactcgaagccgtctggccgcgcgcgctgcgtctcgatccgggcattcgcgaccgcgtggcgccccatatgctgctcatggaactggtgcgccgtcaggcggagaatttcgacgtcctgcatttccacctggactattactcgttctcggtgttcaagcgccaggaaacgccgtttgtcacgaccatgcatggccgcctcgatctgcccgagcagcagccggtgttcgacaccttcaacaccgcgccggtgatctcgatttcgaacgcgcagcgccatccgctgccgcaggccaggtggctgaccaccgtgtatcacggcctgccggagcagctttatacgccgcagccggtcgagcagaagtatcttgcgtttctcggccggatctcgccggaaaagcgggtcgacaccgcgatcaggattgcgggccgctgcggcatgccgattcgcatcgccgccaaagtggatgccgccgatcgcgagtatttcgaacgcgacatccggccgttgctcgatttgccgtacgtggagttcatcggcgagattgcggatcatcagaaggccgaattcctgtccggggcgcacgcgttgctgtttccgatcgactggcccgagccgttcggcctcgtcatgatcgaagcgatggcatgcggcacgccggtcatcgcgttcaaccgcggctcggtgccggaagtgctggaagacggtgtgacgggctttatcgtggaagacgagatcggcgcggtggcggcggtcaatcgcctgcacaagatgccgcgagcgggcgtgcggcagcgcttcgaggagcgtttcacg

SEQ ID NO: 28064 - DNA, 2690 bp, Burkholderia fungorum
tcaaggaattcgacagcggttccggcaaaggcaagttctactccctgccgcaactcggccgcgcactggacatcaagatcgaccgcctgccggtttcgatccggatcgtgctggaatcggtgctgcgcaactacgacggcaagaagatcgccgaagaacacatcgagcaactcgccaactggaagccgacggcttcgcgcgtcgacgaaatcccgttcgtcgtgtcgcgcgtcgtgctgcaagactttaccggcgtgccgctgctcgccgacatcgccgcaatgcgcggtgtcgcgaaacacatgggtaaggatccgaagtcgatcgaaccgctggtcccggtcgatctggtggtcgatcactcggtgcagatcgatcacttccgcgaaaagaacgcgctcgacctgaacatgaaactggaattccagcgcaacaacgagcgctaccagttcatgaagtggggcatgcaggcattcgacacgttcaaggtcgtgccgccgggcgtcggtatcgttcaccaggtgaacctggaatatctcgcacgcggcgtgcacaagaaggctgaaggcgcggacacggtgtactacccggattcgctcgtcggcaccgacagccacaccaccatgatcaacggtatcggcgtggtgggctggggcgtgggcggtatcgaggcggaagccggcatgctcggccagccggtgtacttcctgacgccggacgtggtcggcgtaaacctgaagggcaagctgcgcgaaggcgtgacggcaaccgacctggtgctgaccatcaccgaactgctgcgtaaggaaaaggtcgtcggcaagttcgtcgagttcttcggcgaaggcacgcgctcgctgtcgctgccggaccgcgcaacgatcggcaacatggcgccggaatacggcgcgaccatgggcttcttcccggtcgacgaaaagacgatcgactacttcaagggcacgggccgcacggacgcagaaatctcggcgttccagaattacttcaaggcacagaacctgttcggcattccgaaggaaggcgatatcgactacaccaaggtggtcacgctggatctcggctcggtggcaccctcgctggctggcccgaagcgcccgcaggaccgtatcgaaatcggcaatgtgaaggcaacgttcagcgacctgttctccaagccggttgcggaaaacggctttgccaagaaggcggaagatctcgaagcgcaatacacgacgagcaacggcgtcgacgtgaagaacggcgacgtgctgatcgccgcgatcacgtcgtgcacgaacacgtcgaatccgagcgtgctgctggccgccggtctgctggcgaagaaggcggtggaagccggcctgacggtcgctccgcacatcaagacgtcgctggcgccgggatcgcgcatcgtcacggaatacctgacgaagaccgacttgatgaagtacctcgacaagctcggtttcacgctggccgcttacggttgcacgacttgtatcggtaacgcgggcgatctaacgccggaactgaacgaagcaatcacgaagaacgacatcgtcgcggcagcggttctgtcgggcaaccgtaacttcgaagcgcgtattcacccgaacatccgcgccaacttcctggcctcgccgccgctggtcgtcgcttacgcgatcgccggcaacatcacgcgcgatttgatgaccgaaccggtcggcaagggcaagggcggcaaggacatctacctgggcgacatctggccgaccagcgaagaagtcaatgacctgctcaagttcgcgctggatccggaagcgttccgcaagaactactcggcgctgaccaagaagggcgacctgtggagcaagatcgaaggcgaagaaggtcaagtctacgactggccgaagtcgacctacatcgcagagccgccgttcttcggcaaagacttctcgatgacgccggccgacagcatcgccgccgtgacgaatgcgcgcgcactgggcatcttcggtgattcggtcacgaccgaccacatcagcccggctggctcgatcaaggaagactcgccggcaggcaagtggctgaaggaaaacggcgtgcagaaggccgacttcaacagctacggctcgcgccgcggcaaccacgacgtgatgatgcgcggcacgttcgcgaacgtccggatcaagaacctgatgatcccgacgaaggcagacggctcgcgcgtggaaggcggcctgacgattcatcagccgagcggcgaacaactgtcgatctatgacgcggcgatgaagtacatcgaggccggcacgccgaccatcgtgttcgcgggcgaagagtacggcacgggctcgtcgcgcgactgggcagcgaagggtacgcaactgctgggcgtgaaggccgtggtcgcacgcagcttcgagcggatccaccgctcgaacctggtcggcatgggcgttctgccgctgcagttcaagggctcggatagcgtgcaatcgctcggcatcaccggcgaagaaacgtacgacatcgaaggcctcggcgcagacttcaagccgcaacaggaagtaacgctggtgattcgcggcaaggacggcaaggagaagcgcgtgcaggtgctgctgcgcatcgacacgccgatcgaagtcgattactacaagcacggcgggattctgccgttcgtgctgcgttcgctgctggctgct

SEQ ID NO: 28065 - DNA, 1998 bp, Burkholderia fungorum
acgcccgcgccgcgcccgttgcgcgcgatccagccccttcccgatcagttgatcagtcagattgccgccggcgaagtggtcgagcggcccgcttcggtcgtcaaggagctgctggaaaatgcactcgacgcgggcgcgcagtcgctgcgcatcctgctcgacgaaggcggcgtcaaacgcatctcgatcaccgacgacggctgcggcatccccgagaacgaactcgcgctggcgctgatgcgtcacgccaccagcaaaatccgctcgctcgccgaactggaagcggtcgctacgctggggttccgcggcgaggcgctggcctcgatcgcctcggtcgcgcagatgaccatcacgagccgcacggccgacgcggcgcacgcggtgcgcgtggatgcgcaaaccggcgtgctgagtcccgcggccggcacccagggcaccacgatcgaagtccgcgagttgtacttcaatacgccggcgcgccgtaaatttctgaagagcgagcagaccgaactcggccattgtctcgaacagatccgccgcgccgcgctggcgcggccggatgtcgcgatttcggtgctgcataacggcaaggcggtcgaacactggaacgccagcgagccgcccgtgcgggtcgcgaagattctcggcgacacgtttgccaccgctcatctgccgctcgacgaatccgccggaccgcttgcggtctacggttgcgcgggtctgccgaccgcgagccgcgggcgtgccgatcagcagtatttcttcgtcaacggccgcttcgtgcgcgacaagctgctcacgcacgccgtgcgcgccgcttatgaagacgtgctgcatggcgagcgctatccgtcctacgtgctgttcctcgacctgccgcctgaagcggtcgatgtgaacgtgcatccgtcgaaaatcgaggtgcgcttccgcgattcgcgctcgattcaccagttcgtcttccacgccgtgcagcgcgcgctggcgcggcatgcgggcgcatcgccggaaacgacggcgggcgggcatgcggcgcatctggcgccttccgttagcgggccggcttcgtttggcgcgacgccactgggcggcgcgggcgtcggcggcgtcggcttcggtgctggcaacggcgctggcggcatcggtggcggcttgggtggcgcatcgggcggcggcttcggatcgtcgtcgcagcagcccggcaatacctggatgcgccaggcgcgcatgacgcaaggcacgctgccggttgcccaaccgctcgcgttttacgacgcgctcttcggccgcaaagatacgaacgcgggcacggcggaaggcgccacgcttttcgaggcgcgcgattcggccgccgaagcaccgtcaccgtacaacgcgtccgcgccgtacccggcgcccgctttccatgccgccgacgagcaaccgctcggcttcgcgctcggccagatccacggcatctatgtgctggcccagaacgcgcacggtctggtgatcgtcgacatgcacgccgcgcacgagcgcattctgtacgagcagttcaagaacgcgctggccgatcgcacgatcgccgtgcaaccgctgctgatcccgcagtccatgcaggccgatccggtcgaaatcggtacggtggaagaagagcgcgacacactcgacgcactcggcttcgatctcgccgtgctgtcgccgaccacactcgccatccgcgccgtaccggcgctgctgaaagacgccgatctgcaggcgctggcgcgcgcggtcctctccgacctgcatgcattcggcggctcgcgcgtactgaccgaacgtcagcacgaactgctcggcacgctcgcctgccatcacgcggtgcgcgcgaaccggcgtctgacgctcgacgaaatgaacgcgctgctgcgtcagatggaagccaccgagcgcgccgatcaatgcaatcacggacgtcccacgtggtatcagttgacgctgtccgatctcgatcggctgttcatgcgtggtcag

SEQ ID NO: 28066 - DNA, 738 bp, Burkholderia fungorum
gtgaaactgattggaaggaccgttttgattacgggaggaagcagtggaataggcctcgagctggcgaagcaactgatcgcgcggggtaacagcgtgatagtcaccgggcgcaatcgcgccaggctggaagccgcacggcaagccgtactaggcctccacgcttttcaaagcgacgttagcgatccggcgagcatcgagttgctttatcaaaaggtgtcagccagttttcctctgttagacacccttgtgaacaacgcgggcgcgatgcgcaatatcaagcttgatcagcagtatcaattgaacgatctgacagccgagatcaacgggaatctgaacggcaccatttggatggtccaaacgtttctccccctactcttgcgtcagaagggcagcttgattgtgaatgtgtcgtctggcctcgcgtttgttccttttccggcggctccgatctacagcgcgtccaaagctgcgatccacgcatatacacggtgtctgagggcgcaactggaaggctccttcgtgtcaatcgtcgaattggcccctcccggcaccgagacaccgctgttcaggggcgagttcgccgaggaaatgaaaggggagaaaggcatggacgtcagtgtgctcgttaaacacaccatcgacggtatcgaagccgggaaacaggaagttcgtccgggcctgagcaatgtgctgaaaatcgccagccgcgttgcgccgcaattcatgtttcggcagatg

SEQ ID NO: 28067 - DNA, 738 bp, Burkholderia fungorum
atgacacagcgaattgcgtacgtaacgggcgggatgggcggcatcggcacgagcatttgccagcggctgcataaagagggcttcaaggtcgtcgcaggctgcggcccgaactcgccgcgccgggtgaagtggctcgacgagcacaaggcgctgggcttcgatttcatcgcgtccgaaggcaacgtcggtgactgggagtcgacgaggagcgcgttcgacaaggtcaaggccgaagtcggagagatcgacgtgctggtgaactacgccggcattacgcgcgacgtcgtgttccgcaagatgacgcacgaagactggacagcggtgatcgacaccaacctgaccagcctcttcaacgtcaccaagcaggtgatcgacggcatggtcgagcgcggctttggccgtatcatcaacatttcgtcggtgaatgggcagaagggccagttcggccagaccaactactcgaccgcgaaggccggcattcacggcttcacgatgtcgctggcgcaggaagtggccaccaagggcgtgacggtcaacaccgtttctcccggctacatcggcaccgacatggtcaaatcgatccgccccgacgtgctggaaaagatcattgctacgattccggtgcgccgccttggccagccgcaggaaatcggctcgatcgtggcgtggctggcatcggaagaatcgggtttcgccacaggcgctgatttttcgctgaacggcggtttgcatatgggc

SEQ ID NO: 28068 - DNA, 1176 bp, Burkholderia fungorum
atgactgatgttgtgatcgtatcggccgcccgtacggcagtgggcaaattcggtgggtcgctggcgaaaatcgccgcgcccgatctcggcgccgcggtgattcgcgccgttctcgagcgtgccggtctgaagcccgagcaggtgagcgaagtgatcctgggccaggtgctgacggcaggctcgggccagaatccggcgcgtcaatcgctgatcaaggcgggtctgccttcggcggtgccgggcatgacgatcaacaaggtctgcggctccggcctgaaggccgtgatgctcgcggccaatgccattatcgcgggcgacgcggacatcgtgatcgccggcgggcaggaaaacatgagcgccgcgccgcacgtgctgccgggctcgcgcgacggcttccgcatgggcgacgcgaagctggtcgactcgatgatcgtcgatggcctgtgggacgtctacaaccagtatcacatgggcgtgacggcggaaaacgtcgcgaaggaatacggcatcacgcgcgaacagcaggacgcgttcgcggcgttgtcgcagaacaaggcggaagccgcgcagaagtcgggccggttcgacgacgaaatcgtgccgatcgagattccgcaacgcaagggcgagccgctgcgtttcgcgaccgacgaattcgtgcgtcacggcgtgacggccgagtcgctcgcgggcctgaagccggccttctcgaaggaaggcacggtgacggcggccaatgcctccggtcttaacgacggtgctgcggccgtgctggtgatgtcggcgaagaaggccgaagcgctcggcctcacgccgctcgcgcgcatcaaggcgtatgcgaacgccggcgtggatccgaaggtgatgggcatgggcccggtgccggcttcgcgccgttgcctcgaacgcgcgggctggacgccggccgacctcgacctgatggaaatcaacgaagcgtttgccgcgcaggcgctcgccgtgcatcagcagatgggctgggacacgtcgaaggtcaacgtgaacggcggcgcgattgcgatcggccatccgatcggcgcgtccggctgccggattctcgtcacgctgctgcacgaaatgcagaagcgcgatgcgaagaagggtttggcctcgctgtgtatcggcggtggcatgggtgtggcgctggcggtcgagcgc

SEQ ID NO: 28069 - DNA, 726 bp, Burkholderia fungorum
ttcactggaaagacagcgttggtgactggcgggaatagcggcattggtttcgtcacggcaaaacttctgatcgccgaaggagcgcgggtggcgatcacgggccgcgatcgcgcgaagctcgaccaggcggtggccgaactaggagaaaacgcgctgggcgtgcaggccaatctcgacgacgaagcggcgatcggcgcgctgttcgaacagatcaaaggcgctttcgggtcgctcgacatcgtcttcgccaacgccggcatctccgggccgacgccgctcggcggcacctcggctgcggcgttcgaggcgattcttcgcaccaacctgacagcggtttttctgacggtccaggcagcgctgccgctgatgagcgcgggcggcgcggtggtgttgaacggctcggtgatgcgcgaactcggttcgccggggtcggcggcgtattccgctaccaaagccggcattacgggcatggcgaaggtgttcgcgtcggaactcgtgcagcgcggcattcgcgtgaatacggtgattcccggcggcacgcgtacgccgatctggacgcgtggcgcgcgtgaaggcgcgacgctcgacggaaccgaacaggcgtttgcgccgcgcattcctatggcccgcctcgcgaggccggaagaagtcgcggcagcggtgcttttccttgcgtccggcgacgcgtcgggaatgacgggcgccgagatcgtcgtggatggcggc

SEQ ID NO: 28070 - DNA, 1488 bp, Burkholderia fungorum
ctgatcgacggcgagtttgtcgactcggcgacgaccgaatggcgcgatgtcgtcaatccggccacgcaggaggtgcttgcgcgtgtgccgttcacgacggtcgccgaggtcgatgcggctgtcaggagcgcgcacgccgcgttcgcgacatggaagaacacggcgatcggcgcccgcctgcggatcatgctcaagttccaggcgctgatccgcgagcacatgccacgcattgcgaagacccttacggctgagcagggcaagacgcttcccgatgccgagggcgacattttccgcgggctggaagtggtcgagcacgcgtgctcgatcggtacgttgcagcaaggcggatttgcggaaaacgttgcgggcggcgtcgacacgtacaccctgcagcagccgatcggtgtgtgcgcgggcatcacgccattcaacttccccgcgatgattccgctgtggatgtttccgatggcaatcgtatgcgggaataccttcgtgctcaagccttcggagcaggatccgctttcgacgatgcaactcgtcgagctcgcactcgaagcgggcattccgaagggcgtgctcaacgtcgtgcacggcggcaaggaagtggtcgacgccatctgctcgcatccgctcgtgagggccatttcgtttgttggttcgacgaccgttggcacgcacgtctatcgcctcggcagcgaacatggtaagcgcgtgcagtcgatgatgggtgcaaagaaccatgcggtcgtcctgcccgatgctaaccgtgagcagacgatcaatgcccttgtcggtgccggcttcggcgccgcgggccagcgctgcatggcgacgtccgtcgtcgtgctggtgggcgcgtcgaaagactgggtgcctgaactggtcgagaaggcaaagacgcttaaggtcaatgccggccatgagcccaggaccgatgtggggccggtcgtttcgcgtgcggcgaagacacgtgttcttgggctcatcgaatccggggtgaagcagggtgcgacactggcgctcgatggccgcgacgtgaaagtgcctggttacgaggacggcaattttgttggcccgacgatcttcactgacgtcacgaccgatatggatatctatacgcaggaaatctttggcccggtcctcgtggtgttggccgcagccacgctcgacgaagcgatcgcgattgtcaatgcgaacccgttcggtaacggcgtgggtctcttcacgcaaagtggcgcggccgcgcgcaagttccagagcgagatcgatatcggtcaggtcggtatcaacattccgatcccggtgccggtgccgtatttcagcttcacgggttcgcgtggttcgaagctcggcgatctggggccatacggcaagcaggtcgtgcagttctacacgcagaccaagacggtgaccgcgcgctggttcgacgatgcgaccgtcaacgatggtgtgaacacgacgatcagcctgcgctgacccgccagccag

SEQ ID NO: 28071 - DNA, 1131 bp, Burkholderia fungorum
atggatgagttctataccgacgaccagcggatgatccgcgatgcggcgcgtgacctctcgacaggacgtctggcgccttatgcggctgactgggaccgtgaaggcagtctgccagacgaggtcgtttcgcaacttggcgaacttggttttctgggcatgatcgtcccacccgagctcggcggatcctatacggattacgttgcatacgccctggcgatagaggaaattgctgcgggttgcgcgtcttgcgcaacgcttgtgagcgtgcacaactcagttggttgcggacctgttctgcaatatggaagtgaagcgcaaaaggatagatggctcggcaagctcgccagtggcgaggcgatcggtgcgttttgccttaccgaaccgcaggctggctccgaggccaataatcttcgtacgcgcgcggagctgcacaacggacggtgggtgctgaatggcagcaaacagttcgtgaccaacgccgcacgtgccggtgtggcaatcgtgttcgccgttaccgacccgactgcgggcaagcgtggtttgtctgcttttattgtcccgaccgacacgccgggttttaacgtcggcccaccggaaaaaaagctcggtattcgcgcgtctgatacctgccccgttgcgctcgagaactgcgcgattcctgaggcgaatctgctcggctcacgcggcgagggtttaaagatcgcattgtcgaatcttgagggcggacgtattggcatcgccgcgcaggcgcttggtattgcgcgcgccgcgttcgaggtggcacgctcctatgcgcacgagcgggtgcagttcggtgaacctctcgtacggcatcagagcgtggccaatctgctcgccgatatggcgacacgcctgaacgccgcccgctttctcgtccatcacgcagcccggctgcgaacgcttggcaagccgtgcctgtccgaggcatcgcaggcgaagctgtatgcgtccgagatggcggaggaagtttgctcgcacgcaatccagatccacggtggctatggttacctgaacgactatccggtcgagcgtcactatcgggacgcgcgaatcacacagatctacgagggcacgagcgaggtacagcgcatggtgatcgcgcgccagctg

SEQ ID NO: 28072 - DNA, 1509 bp, Burkholderia fungorum
gacgaaatggcgcgtggcaacgacagcccggcgctgtggatcgtcgatgatcctgccagtgccggaacacggctcaccttcgcgcaaatggctgagcggtcctcgcgcgtggcaaatttcctccgggagcagggcgttgctcgaggcgaccgactgctgctgatgctgcccaatcgcgttgagttatgggaggtgatgctcgcagcgatgaagcttggcgcggttgtgctgcctgcgacaacgcagctgtcatccgatgacgtttgtgagcgggtcgaggtcggggccgtgcgattcgtcatcgtcgacgggagcgaggtagggaaatttgatgggatcgaagccactgtaaagcgcattgtggtcggcacacgagcggcggtgactcaaggctggatcgattttgccttggcctatgaagcgagcccggccttcaaaccggacggcccgacgaacgcctccgatccgctactgctgtacttcacatcgggcacgacgtccagaccgaaacttgtcgagcatacccatcagagctatccggtcggtcatctttcgacgatgtactggatcgggttgcggcccggcgacgtgcactggaacatcagttcccccggctgggcgaagcatgcgtggagctgtttttttgcgccgtggaatgcgggcgcatgcgtgttcgtctatgactacacgcgcttcgtaccgaaagatacgctgaatgtgctggtgcaatgtggcgtcacgacactctgcgcgccgcccacagtctggcggatgctggtgcaggaacccctcgcttcgtatccggtgaagttgcgggagattgtcggagcgggcgaaccgctcaatccggaaatcatcgagcgcgtgcgccacgcctggggtaccacgattcgcgatggttttggtcaaaccgaaaccacctgccagatcggcaactctccgggccagccggtcgtcgcgggatcgatggggcgcccgctgcccggctaccgtatcgagctcgtcgacgcggacgaccacgccgcaagcgagggagaaattgccctgtcgctcgcgcatcgtccgaccggtctgatgactggctatgccaataacccgcaggcaacggaatacgccatgcgcaacggcctttaccatacatccgacgtcgcgttgcggcgtgaggacggctacttcgtctacgtcggacgagcggacgacgtattcaagtcctccgactaccgcctgagccctttcgaactggagagcgtgctcatcgagcacgaggcgattgccgaggcggccgtcgtgccgagtgcggatgcggttcgtctgtcggtgccgaaagcattcgtcatcgtgcgccatggctaccagataggaccggaacttgcacgcgaggtttttcgcttctcacgcgagaaactcgcgccttataaacggatccggcgattgcagttcagcgatttgcccaagaccatctcgggcaagattcgccgcgttgaactgcggcgtcgcgaaatggaacgc

SEQ ID NO: 28073 - DNA, 903 bp, Burkholderia fungorum
gacgcacaagccgtgcgcagctggctgcaaggcctgcaaacgcagatcgcggacacgctcggcgcattcgacggcacaccgttcgcgaccgacgcctggcagcgcgcgcccggcgaaaagctgcgcggcggcggctacacgcggattctcgaaggcggcaacttcttcgagcgcgccggcatcggcttctcggacgtcgcgggcgacgcgttgccggcctcggcgagcgcggcgcgtccgcaactggccggccgcggtttcgaagcaatgggcgtgtcgctcgtgctgcacccgcacaatccgcattgcccgaccgtgcatatgaacgtgcgtctgctgatcgcgaccaaggccggcgaagagccggtgttctggttcggcggcggcatggatctgacgccgttctacggttacgaggaagacgcgcagcattttcatcgcacctgccgcgacgcgctgcagccttatggcgcggacctgtacccgagtttcaagcgctggtgcgacgagtattttttcctcaggcaccgcaacgaaccgcgcggcattggcggaattttcttcgacgatttctcggcgccgggcttcgatcaatcgttcgcgatgctcaggagcgtgggcgacgcgttcctcaaggcgtacctgccgatcatcgaaaagcgccgcaacattccgtacggtcaggccgagcgcgatttccaggcctaccggcgcgggcgctacgtcgagttcaatctggtcttcgaccgtggcacactgtttgggctgcaaagcggcggacgcaccgagtcgatcctgatgtccatgccgcctgtggtgaactggcgctacaactggcagcccgaaccgggcacgccggaagcgcgtctttatagcgattttctcgtgccgcgcgagtgggtg

SEQ ID NO: 28074 - DNA, 1584 bp, Burkholderia fungorum
aactcgctcccctcctggtcctcgctgcaaacgcattacgaaaagattcgcgatgcgcacatgcgcgactggttcgcccccgagaacgatcccgcccctacccgtgccgaacgctttgcgttcgcgggcggcggtctcgcggccgatttctcgaagaaccgcatcaccgacgaaaccctgaaactgctcgtgcaactcgcgcgcgaagccggcgtcgagaaacgccgcgacgcgatgttcgcgggtgcagtcgtcaacccgaccgaaggccgcgccgcgctgcacacggccctgcgcgccaccgacccgaaagcgccgttctacgaccaggtgcaggccgagcgcgccaggatggccgcgttcgccgaccaggtgcgcagcggcgagtggaaaggctataccggcaagcggatccgctacgtggtgaacatcggcatcggcggctcggacctcgggccgaagatggtcgtgcacgcgctgcatcatctggccacgccggagatcaccacgcatttcgtgtcgaacgtcgacggcgccgatctttacaacgtgatgcagcagatcgatcccgaagaaacgctcgcaatcatcgtctccaagactttcaccacgctcgaaaccatgaccaacgcgcgctcgctgcgtgactggttcgtcgagaaaggctgcccggaaagcgcgctggcgaaacacttcgtcggcgtgtcggccaatcccgcggaagtggtcaagttcggcatcgcgaaagaaaacgtgttcgagatgtgggactgggttggcgggcgttactcgttgtggtcggcggtgggtctgtcgatcatgatcgcggtcggaccgcagcagttcggcgaactgctcgccggcgccaatgagatggaccagcatttccgcgacgcgccgctcgagaagaatctgccggtgctgctcggcatgatcggcatctggtatcgcaacttcttcggctcgcaaagctacctggtcgcgccgtattcggaagcgctgcatttcctgccgtcgtatctgcaacagctcgaaatggagagcaacggcaagtcggcgcgtctcgacggcgtaatggtcgactatccgaccgccgccgtgacgtggggcgaaccgggcacgaacggccagcatgcgttcttccagatgctgcatcagggcccgacgatcgtgccgatcgacttcatcgccgtgttgacgccggagcatccgctcgtcagtcatcatccgaagctgctcgccaactgcttcgcgcagagtgaagcgctgatgctcggccgcacgctcgaggaagcgaagaaagtggccggcgcggacaagccggagctggcgccgcacctggtgtttccggggaatcgtcccaccagcacgctgctcgtcgacgcactgaccgcgcgttcgctcggcgctttgatcgcgctgtacgagcacaaggtgctggtgcaggcgtcggtgtgggacatcaatccgttcgatcaatggggcgtggaattgggcaagattctcggcaaagtggtcgaggccgatctgacagcgccgagcgtcgatgagaagaagcatgactcgtcgacgtcagcgttgatt

SEQ ID NO: 28075 - DNA, 627 bp, Burkholderia fungorum
gaggcccgcgagcggatggtcgaacggcagatcgctcgccgcggcgtggtcaatccccatgtactggccgcgatgcgtcgcgtgcctcgcgaggaattcgtggccgccgatctgcgggaattcgcgtacgaagatacgccgctgccgatcggcaacgaacagaccatctcgcaacccgccatcgtcgcggcgatgatcgatgccgcggaagtgagtccaggcgagcgcatcctcgacgtcggcaccggctcgggctatgccgcagcggttgccgcggcgatcgcacagcacgtggactcgatcgaacgccacgccggacttgtcgccaccgctcgcgaagtcctgcggcggctgcaaatttccaacgtgacgattcacctcggcgacggcaccgttggcctcgcggaacatgcaccgtacgacgcgatcattgcggcagccggcggcccccatgttcccgacgcgtggcgcaggcaactcgccgtcggtggccggatcgtcatgccggtgggtcgcgatccccatcatcagcggctcatcaagctcgtgcgccgcagcgaacaggattatgacgagagctggcttggcgaagtgaggtttgtaccacttgtcggcgaagatgcgtgg

SEQ ID NO: 28076 - DNA, 1098 bp, Burkholderia fungorum
atgaccgccatgatgaaagccgctgtattcatcgagccgggccgcatcgaactcgccgacaaacccgtgcccgatgtcggcgccaacgacgcgctcgtgcgcatcaccaccaccacgatctgcggcaccgacgtgcatatcctgaaaggcgaatacccggttgccaagggcttgactgtcggccacgagcccgtgggcgtgatcgaaaaactcggcagtgcggtgctcggctaccaggagggccagcgagtggtcgcgggcgctatctgccctaacttcaactcctatgccgcgcaagacggggtcccgtcgcaagacggcagttatctgattgccagaggcctgtgcggttgccacggctataaggctacggcgggctggcgctttggcaacatgatcgacggcacgcaggccgaatacgtacttgtccccgatgcgcaggccaatctggcacccgtgcccgacggattgaccgacgaacaggtgttgatgtgtcccgacatcatgtccacgggcttcaagggcgcggaaaacgccaacatccgtatcggcgacacggtcgccgtgttcgcacaagggcccatcggcctgtgtgccacggcgggcgcgcgtctgctcggcgcgagcaccatcatcgcggtggatggaaacgaccaccgtctcgagatagcccggaagatgggggccgacgtcacgctcaacttcaagaattgcgatgtggtggacgaaatcctgaagctcactggcgggcgcggcgtggattcgtcgattgaagcgctcggcacccagagtacgttcgagtcggctttgcggatcctcaaaccaggcggcacgctgtcgagcctcggtgtgtactcgtccgatctgacgattcccctcggggccttcgccgcgggtctcggcgatcataagatcaacaccgcgctgtgtcccggtggcaaggaacgtatgaggcgtttgctgaacgtcgtggaatccggacgcgtcgaccttggcgcactggtcacgcaccactacaagctggacgatatcgtcgctgcatacgacctgtttgcgaatcagcgcgacggggtgcttaaggtggcgatcaagccgcat

SEQ ID NO: 28077 - DNA, 1422 bp, Burkholderia fungorum
tttgcgaactacatcgacggacagtgggtagacggcgcgagcgtgtcccgcaacgtcaatccgtccaatctcgacgacgtgatcggcgagttcgcccaggccgacgctgagcagacgcagcgcgcgatccgcgccgcgcgcaacgcgttcgcgcaatggtcgctgtccacgccgcagcagcgtttcgatctgctcgaccaggcgggcagcacgatcctcgcgcgtaaggccgaactgggccggcttctcgcgcgtgaagagggcaagacgctgcccgaggcgattggcgaagtgggccgcgcggggcagatcttcaagttcttcgcgggcgaagcgctgcgcattggcggcgaaatcgtgccatccgtacgacccggcatgacggtggaagtgacccgggagccgctcggcgtgatcggcctcattacgccgtggaatttccccatcgcgattccggcctggaagattgcgccggcgcttgcgtacgggaacaccgtcgtcgtcaaaccggccgacctcgttccggccagcacgtgggagcttgtcaggatcatcgccgaggcgggcgcgccggcgggcgtcatcaatctcgtcatgggacagggtgccgtggttggcgaagcgctggtttcctcaccgcaggtcgacgccgtgagcttcacgggttctgtcgcgacggggcgtgccatcggagcgaaatgcttcgcctccggcaagaagttccagctggagatgggcggcaagaacccgatggtggtgctcgatgacgccgacctcgacgtcgcggtcgaagcgtgcatcaacggtgggttttattcgacgggccagcgctgcacggcgtcgagccgcttcatcgtgaccgaagggatccacgaccgcttcatcgacgcgatgaaagcgcgcatgcaagccttgaaggtgggcgatgcgcttgccgacggcacccacatcggcccggtcgtcgacgacaagcagctccagcaggatgaacgatacatcgccatcgcgcgcgaggagggcggcacgatcttcggtggggagcggatcgagcgcgatacgcgcggctatttcctcgcgccggcgctgattaccgacaccacgccggacatgcgcatcaaccgggaagaagtgttcggcccggtagcttcggtcatcaaggtcaaggactacaacgaggcgctcgcggtcgccaatgacacggagtttgggctctccgcgggtatctgcacgacgtcgctgaagtattcgagccacttccgccgccatgtgcaggcgggcatggtgatggtgaacacggcgaccgccggcgtggattaccacgtgccgtttggcggccgcaagggttcgagctacggtccgcgcgagcaaggcagctatgcccgcgagttttacaccacggtcaagacggcgtacgtgagtccg

SEQ ID NO: 28078 - DNA, 801 bp, Burkholderia fungorum
tgcgtatggccggtccatgccgagttgggcgaaggcccgctgtggcaggccggggagaacgcggtttatttcgtcgatatcaagggccgccagattcatcgtctgacggtcactaccggacaaacgcaaacgtggaaggcgcccggtcaaccgggtttcatcgcaccgcttgcgggccacggttttgtttgcgggctgccgggcggcctgtatcgcttcgatgccggcagcggacaattcagcaagctcaaggacgttgaagtgcacctgccgggcaaccgtctcaacgacggcttcgtggatgccagcgggcacttgtggttcggctcgatggacgacggcgaagagcagcccagcggcacgctgtatcgcgtcaaccatgccggcgaagcggtggcccaggacgacggctacgtgatcaccaacggacccgcctcgagcccggacgcgcgcacgctttaccacggcgacaccatgcggcgcgtggtgtatgcattcgacctgggcgaagacgggacgttgtcgcgcaaacgcatctttgccgccatttccggcgacggctaccccgatggcatggcggtcgacgccgacggattcctgtgggtcgcgcttttcggcgggtggcgtatcgagcgcttctcgcccgacggcaagcgggtcgaacaggtaccgtttccctgcgccaacgtgacgaagctcgccttcggcggcgacgatctgcagactgtttatgcgtcgaccgcatggaagggcttgtcgccggtagcgcgtcagcagcagccggatgccggcggtctgttc

SEQ ID NO: 28079 - DNA, 729 bp, Burkholderia fungorum
ctctcaggcaaaacggttgtcatcaccggcggcggcagcggcatcggcgccgcgatggtcgaagctttcgcccggcagggcgcgcgagttttcttcctcgacgtcgctgaggacgattcgctggcgttgcagcaatcgctgagcgacgcgcctcacccgccgttgttccgccgctgcgatctgcgcagcgtcgatgcgatccacagtgcgtttgccgggatcgtcgagatcgccgggccgatcgaggtactcgtcaacaacgctggcaacgacgaccggcatgaagtcgacgccatcacgccggcctattgggacgagcgcatggccgtgaacctgcggcaccagttcttctgcgcgcaggccgcagcggccggcatgcgcaagatcgggcgcggcgtgatcctgaatcttggctcggtttcctggcacctcgcgttgccgaacctcgcgatctacatgagcgcgaaggccggtatcgaagggctgacccggggcctcgcgcgcgatctcggcgccgccggcatccgcgtgaactgcattattcccggcgcggtgcggactccccgtcagatgcagctctggcagtcgcccgagagcgaagcgaagctcgtcgccagccaatgtctgcgtttgcgtatcgaacctgagcatgtcgcgcgcatggcgttgtttcttgcgtccgacgatgcgtcgcgttgctcagggcgggattatttcgtcgacgccggg

SEQ ID NO: 28080 - DNA, 2115 bp, Burkholderia fungorum
ggcctagacgttccggtgttcattctggtggagcgccacctgctccaggaaattccggtggcggtgctgggtcatgtgacgggttatatattcatcgaggaagacacgccggaattcgtcgcccgcaatctggtgagtcatctgcacagctatgccgattcgttaaagacacctttcttcggtgccatggtcgactacgcggagcaggccaaccagatgtggacctgcccaggtcacaacggcggggtgttctaccagaagagcccgattggtcgcgcgttcgtcaagcatttaggcgaggccgtattccgcaatgacctggataattcagtcatcgaactgggcgatctgctcgtgcacgaaggcccggcactggccgcacaaaaggccgccgcgcggatcttcggcgcggagcggacgtatttcgtgctcaacggcacgtcaacctcgaacaagatcgccttgaccgcgctggttgcgccgggcgacctcgtgctgttcgaccgcaataaccacaaggcggctcatcatggcgcgctgctgctcggcggcggcctaccggtttatcttcccaccgtgcgcaatgtgcacgggatgatcggcccgattgatttcgagacgctcgacgagacgcgcattcgtgacagcatccggcgcaaccccctgatcaaggacccgcaagcctggcagcggaagcggccgttccgggttgcgatcatcgagcaatgcacctacgacggcacgatctacgacgtgcagatgctcgtcgaaaagctcggtccgctgtgcgagtacatcatgttcgacgaagcatgggccggcttcatgaaattccatccactgttcaagggacacttcgcgatgggtctcgaagctctgggagcggatgcacctggcattatcgcagcacagtcgacgcacaagcagctggcgggtttttcgcaggcctcccagatccatgtgaaggatgcgcatctcgatgggcaacgcaggcaggtcagtcaccggcgtttcaacgagatgttcatgcagcattcgtcgacctcaccgttctatccgctgttcgcctcgcttgatgtcggcgcgcaaatgatgcgtggccgctccggagaggttttgtgggatgacacgatcaagctcggtatcgagatgcgcaagaagatccgcgccttgcgtcgcgaatatgaagcgacggaaacggacgtggcgcgacaatggttttttgatccgttcgtaccggatgtggtccagggacaagacaggattgaacgctgggaggacattccgaccgacgaactcgccgccagcacgcgttactgggaactggctcccgggcagaaatggcatggctatggggcactcgccccgggctacgtgatgaccgaccccaacaagctgacgctgctgacaccgggctttaaccgcgagacgggtgaatacgcggagcatggcattccggcggcggtactggccgagtttcttcgggaagtgcggatcgtcccggagaagaatgacctgaacagcatccttttcctgctgacgccggggctcgaatcgtcgaaggccggcacactgctgtcggcactggttcgcttcaagcagttacacgacgacaacgcgttgctcgaggacgtcattccctcatttgtggcagcgcatcgtgcgcgctatgcaggcgtcggcttgcggcggttgtgtgcgcagatgcatgacttttatcgggagcgaaacgtcagccgccttcagcgggaacagtttcgcgcggcgcattttcctgaagcagcgatgcccccgcagcaagcgatgcatgaactcgtgcgcaacaacgtcgagttgttgccgatcgatcagatccgcggccgcatcgcggccaccctcgcattggtctatccacccggcatcggggtcatcgtacccggtgaaagatatgacgagcgggcgttgccgatgctggattatttccgcatgttcgaggacggcggcaaccgttttccgggttttgaaaacgagattcagggcatttatcggaagaccgaaagcgatggaagcatgcgactctacacctacgtcgtgaccgaataacccatttccggagaagcaaccatgacgctaggc

SEQ ID NO: 28081 - DNA, 1203 bp, Burkholderia fungorum
gtccactcggaggccggcagactacgcaccgtcatggtgtgtgctcccggtctcgcgcaccgccgtctcacgcccgccaattgcggcgccttattgttcgacgatgtcatctgggtcgacaaggcaatcgaggaccatcagacgttcacccgcctgctgcgcgaacggggcatcgaggtgcttgaatttcatcatctgctggccgaagtctgtctgaacacaaccgcacgcgactggattctcaaccggcgcatcgtcgaggaggaagtggggacgggtatgctgcgcgagttacggctgtggctcgaggacatgcccgcgcagcaactcgctgacgtgttgatcggcggtgtggcaaaagctgaactgccattcgatgcacgggggttgttcggcggctatctggagcgctcggagttcgtaatccagccgctcgtcaacctgatgttccagcgtgatccgagcgcctggatctatggcggcgtgaccttgcatcccatgttctggccggcccgacgtaaggaaaccctgctgctcgcggcggtgtatgcgtttcatccccgctttgcgggaaaggtcagaacgtggtggggtggccccgatacaaacttcggggtcgagacgctcgaaggcggagatgtgatgccgatcggcaatggcgtcgtactgatcggcatgggcgaacgctcgagtccccaggcggtgacccaggtggcgcgagccctgtttgccggtaacggcgcgaggcgggtgattgcctgccagcttccgaaagcgagatcgtcgatgcatctcgatacggtgttctcgtttctcgatgtcgattttgtgagcgtttatccggacgtggctgacgatatccggtgtaccagtctttatccgggagatgacctcggccagattcgctatgaacgccatgaggataagtttctcgccgtcgtgtccggagcactgggcgtcggctcgctgcgtgtgctgactacggggggcgacacctacgagaccgaacgggaacaatgggacgacggcaacaacgtgctggcgctcgaccggcgggtcgtccttgcatacgaccgcaatacctacaccaaccgcaagatgcgccaggcaggcgtcgaggtcatcgaaattcccggcggcgagctcggccggggccggggcggcagccattgcctgagttgtccgatcgaacgggatgcgatt

SEQ ID NO: 28082 - DNA, 996 bp, Burkholderia fungorum
atcatgttcaacgtacacaaccgcagctacctcacgctgatcgaatatacgcctcgccagattcgctacctgctcgacctgtcccgcgatctgaagcgcgccaagtatgccggaaccgaaacgccccgcctgaacggcaagaatatcgcgctgatctttgagaagacctcgacgcgcacgcgttgtgcattcgaagtggcggcgcacgaccagggcgcccatgtcacctatatcgacccgaacggctcgcagatcggccacaaggaatcgatgaaggacaccgcccgggtgctgggccgcatgtatgacgcgatcgaatatcgtggattcggtcaggagatcgtcgaagagcttgcgaagtatgccggcgtgcctgtctacaacggcttgactgacgagttccacccgacgcagatgctggccgacgtgctaacgatgcacgagttcagcgacaggccgatccacgacatcgcctattgctacataggcgacgcgcacaacaatactggcaattcgctgatgattgtgggcgccaagctcggcatggatgtccgcctgtgtgctccgcgctgcctgtggccgcacgatgaactgatcgaacagtgccgggcaatcgcggccacgacgggcgcgcgcctgacgttgaccgaaaagccggaggaggccgtgaaaggcgtcgacttcatctataccgacgtatgggtatcgatgggcgagccgttcgagaagtggggcgcgcggatcgaggagcttttgccgtaccgggtgaatgccgcactgctggctgcaagtggtaatccgcgggtgaagttcatgcattgcctgccggcgtttcatgactcgaacacccacgtcggcaagcagattgctgaccaatatgggctcccgaacggcgtcgaggtgaccgacgacgtgttcgaatccgacgcttcgatcgtcttcgagcaggcggagaaccgccttcatacgatcaaggcgattctggtcgctacgctc

SEQ ID NO: 28083 - DNA, 771 bp, Burkholderia fungorum
atgaaaatcgctacctggaacgtcaactccctcaaagtccgtcagcaacatgtgatcgactggctcgaaaccagcggcaccgatgtgctctgcctgcaggaactgaagctgccggacgagaaattcccgcgcgccgaactcgaagagaaaggctaccggagctggttcgccgggcagaagacctataacggcgtcggcattctggtgcgcggcggcctgacggtggacgaaagcagcatcgtgcgcaacattcccggcttcgaagatccgcaacagcgcgtgattgccgcgaccatcgacggcgtgcgcattatctccgcctatttcccgaacggccaggcgccgggcaccgacaagttcgcgtacaagctgcgctggctcgccgcgctgcatgactggatcgcgagcgaaatggcgctgcatccgaagctcgcgctgctgggcgactacaacatcgcgcccgaagatcgcgacgtgcacgacccgaaagcctgggaaggccagaacctggtgtcgcccgaagagcgcgccgcgttcgtgcagctgatcgggctcggcctcgtggatgcgttccgccagttcgagcagccggagaagatctactcgtggtgggactaccggatgatggcgttccgccgcaatgcgggattgcgcatcgatcacattctgctgtcaaaagcgctggctgaaatctgctcgtcgtgcgaggtcgacaaggtgccgcgcaagtgggatcagccgtcggaccacgcgccggtggtcgcgcaactc

SEQ ID NO: 28084 - DNA, 2076 bp, Burkholderia fungorum
gacaatccgctcctcgatttctccgacctgccgcgctttggccaaatccgccccgaacacgtcacgcccgccctcgatgtgctgctcgccgatgcgtccgccgccgtcgagcgcgccgcccagcccatcacgcccgcttcatgggccgacgtggtcgagccggtcgagcgcgccaccgaaccgctgtcgcgcgcatggagcgtggtcggccatctgaacgcggtggccgatacacccgagctgcgcgccgtgtatggcgagaatctgccgcgcgtcaccgaattctggtcgagcgtcggacagaacctcgcgctgtacgagaagtacaaggcattgcacgccagcagcgatttcgaatcgctgaccggcgagcgcaagaagatcctcggcaatgcgctccgcgatttccgcctgtccggcgcggaattgccggaagaccagaagccgcatttcgccgaattgcaggaacgccaggcggcgctctcgaaagcgttttcggatcacgtgctcgacgcgaccaacgcgtatgcgtatatcgtcgaagccggcgctgaagcgcaactggccggcctgcccgaagacgtgatcgaagccgccagggaagcgaccgagcgcgaaggcaagaccggctacaaattcacgctgcacttcccgtcgtatttcccggtgatgcagtactcggaaaatcgtccgatgcgcgaggcgatgtatcgcgcctatgtcacgcgcgcctcggaactcggcccgcaatacggcaatggcaagcccgagtgggacaacaccgcggtgctcgccgagcagttgaaactgcgcgccgaagaagcgcacatgctcggctacaacaacttcgccgaagtctcgctcgcgccgaaaatggccgagtcgcccgcccaggtgatgagctttctcgaagatctcgccacgcgtgcgcgtccgcatgccgagcaggactggaaggaactgcgcgaattcgccgcgaacgaactcggcatgagcgaactgcagccgtgggacatgacctttgccgcggagcgtctgcgtcagaagcgctattcgttctccgagaacgaggtcaaacagtactttccggaagacaccgtgttcaagggtcttttcaaggtcactgaaacgctgttcggcgtgcgcatccgtcgcgacaaagcggacgtgtggcatccggacgtacgctttttccgtgtcgagaatcaggacggcggcctcgtcgcgcagttctacctcgatctgtatgcgcgcgaaggcaaacgcggcggcgcctggatggacgacgcgcgcggccgccacaggcacacgcacggcggcgtgcaaacgccggtcgcgtatctgacctgcaacttctccgcgccggtcggcggcaagcccgcctgctttacgcacgacgaagtcatcacgctgttccacgagttcggccacggcctgcaccacatgctcacgcgcgtggacgagctgggcgtgtcgggcatcaacggcgtggagtgggacgcggtcgaactgccgtcgcaattcatggagaacttctgctgggagtgggacgtgctgagcgacatgacctcgcacgtcgaaacggccaggccgttgccgcgcgaactgttcgacaagatgctcgcggcgaagaacttccagagcggtctcggcacgctgcgccagatcgtcttctcgatgttcgacatgcaactgcataccgacttcgacgcgtccggcacgaagagcgtcaccgaactcgcgagcgaaatcaacgagcgcttccacgtcgtgccgcaagcaccgttctcacgctggccgaacacgttcagccatattttcgcgggcggttatgcggcgggctactacagctacaagtgggccgaagtgctgtccgccgacgcctacgcggcgttcgaagaagccgcgcaatcggctagcggcagcgtgctcgatcaggcgaccggcatgcgttaccgcaaggagattctggaggtgggcggcagccgtccggcgatggaatcgttcaaggcattccgcggccgcgagccgaatatcgacgccttgctgcggcacaacggcatgacgccgggcgct

SEQ ID NO: 28085 - DNA, 837 bp, Burkholderia fungorum
atgactgccaaactgatcgacggccttgccctttccaagaccctgcgcgccgacgtcgccgcgcgcgctgccgccctcaccgcccgcggccatcagccgggcctcgccgtggtgctggtcggcgacaatccggccagcgaagtgtacgtgcgcaacaaggtcaaggcgtgccacgacaatggcctcggctcgtcgttcgaccgctatccggccgacctgccggaagccgaactgctcgcgcgcatcgacgaactgaaccgcgatccgcgcattcacggcattctggtgcaactgccgctgccgccgcatatcgacagccacaaggtgatcgaggcgatcgctccggaaaaggacgtggacggctttcacgtcgccaacgccggcgctttgatgaccggccagccgctgttccgtccgtgcacgccgtacggcgtgatgaaaatgctcgccgcttacgagattccgctgcaaggcgcgaacgcggtggtaatcggccgctcgaacatcgtcggcaaaccgatggcgctgctgctgctcgaagccggcgcgaccgtgacgatctgccacagcaagacgcgcgatctggctgcccacactcgcaacgccgacgtggtggtggccgccaccggcttgcgcaacattctcacggcggacatggtaaagccgggcgcggccgtgatcgacgtcggcatgaatcgcgacgaagccggcaagctgtgcggcgacgtcgacttcgcgggcgtcaaggaagtggccggctacatcacgccggtgccgggcggcgtcggcccgatgaccatcaccatgctgctcgtcaatacgatcgaagccgccgag

SEQ ID NO: 28086 - DNA, 864 bp, Burkholderia fungorum
atgagtatccagaaagtaggcgtcgtcggcgcgggaaccatgggcaacggcatcgcgcaggtctgtgcggtcgccggactgcaggtagcaatgatcgatatttccggcgctgccgtcaccgacggcctcgcaaccatcgaaagcagcctggaacggctggtccgcaaggacaagctatccgccgcggaccgggctgcggcactcgcccgggtgagtggtaacactgactacgctgcgctgaagggcgccgggttgatcatcgaggccgccaccgagaatcccgggatcaagctgcgcatcctgaggcaaatcgacgaagcagcggaagatgacgcgatcatcgcgaccaatacctcctcgatctccatcacgctgctcgcggccgtgctgaagcaaccggagcgtttcattggcatgcatttcttcaaccccgtgccgatgatggcgctgctcgaagtcattcgcggcttgcagacatcggacgaaacccacgcgaagaccctggcctttgcgcagacgatcggcaaaaccgcgatcacagccaggaacagccccggcttcgcggtgaaccgcatcctggtcccgatgatcaatgaggccatctttacgctgcaggagggcctggccacggccgacgacatcgacaccggcatgaggctcggctgcaatcaccctatcggacctctggcgctggccgatctgatcggtctggataccctgctcgcggttatgcaggttttctacgaagggttcaatgatccgaagtatcgccctgctccactgctgcgcgaaatggtggctgcgggccgcctcggacgcaagagcgggcggggtttccatagctatgcgtgacgagcgccgcta

SEQ ID NO: 28087 - DNA, 1131 bp, Burkholderia fungorum
atgaaacgcacatgtttcgacgccgggatggaacagttccgcgactcggcccgcaagttttttgccggcgagatcgcgcctcaccgggaacgttggcgcgaggccagcgtggtggaccgcgaagcattccgcaaggccggcgagatgggctacctttgcatgtggatcgacgagtgccacggcggcctcggcctgaaggacctgcgctatgagcagatcctgatcgaggagaacatcttccacggcgaccggggcttcttcttctggctgcatagccgcctggtcgcgccgtatctggaacacttcggcaccgacgagcagaaacagcgctatttccccggcatccgcagcggcgaacagatactcgcgatcgcgatgaccgagccggacgcgggttccgacctcgcgggcatgaagacacgcgccgaggaaaccggtgactactgggtgctcaacggctcgaaaacctatatctccaacggcctgaacgccgacgtcgtgctggtggcggcccgaacgcatcccaccaaggcgcacgggctgacgctcttcctcgtggagcgaggcatggagggttttgaacgcggccgcaacctcaggaagatgggcctcaagtcgcaggacacggccgaactcttcttccacgatgtaaagattccgaagagtcatgtgctaggccaggtccacgcgggcttccagcatctgatgcgcggccttgcggaagagcggctactcgccgcgatcttcaacgtcgcgtcggcgcgccttgcgatgcacctcacttgcgatttcgtgcgcgagcgcaaggtgttcggcaagccgttgagcagtttccagaacacccgcttcaagctcgccgcactcgacacggagatcgaggtggcgcaaagctgggtcgaccggctcgtggccgaacacaacgcggaccagctcgacgcggtggatgccgcgcgcgccaaactcttcaccagcgagctcaacggtcgcatggtcgacgagggtgtgcagcagcacggcggagcgggctacatggacgaatacgagatttgccgcctgtatcaggacgagcggattcaccgcatcctcgccggcacctcggaaatcatgaaagagatcgtcgcccgctcgatt

SEQ ID NO: 28088 - DNA, 1200 bp, Burkholderia fungorum
atgtcttcaccattcatctacgaccatgtgcgcacgcctcgcggccgcggcaaacccgacggagcgctgcacgaagcgacctccgtccatctggcagccacggtactgtccgccctgcgcgagcgcaccggccttgatacccgtcaggtcgaggacatcgtcttcggcgtggtcgccccggttggcgagcagggccaatgcctgccacgcgtcgcggcgctgcaggccggctatgcgcaggaggcagcgggcgtgcagatcaaccggttctgcggttcggggctggaagcctgcaacatggccgcatccaaggtgcatgccggcgcggaaggcttcgtcatcggcggcggcgcggaatcgatgtcccgcgtgccgatgttttccgacggtggcgcgtggagtgtcgatcctgtcaccgcttttgcctccaacttcattccccagggaatcagcgcggatctcctggcgacgatgtggaattacagccgtgaagaggtggatggtttcgccgtgcgcagccaccggctggctgcacaggcgtgggccgaaggacgcttcgaccgctcggtcgtgccggtcagaggcgtcctgaacgaggtactgctggcgaaagatgaaacagtgcgccccaattgcacgcctgccgacctcgccgggctcaagccctccttcgccgaactgggacgcaagggtggcttcgacgcattggcgatccagcgctatcccaccgtggagacgatccgccacgtccatcatgccggcaactcgtcgggcatcgtcgacggcgcctgcgccgtgctcatcggctccgaagcggcgggccgcgccgctggcctgacaccgcgcgcccgcatccgggccttcgccgagatcggctcggagccgaccatcatgctcaccgcgccttccttcgccgccgaacgcgcgctcaggcgcgccggcatgtccgcgtccgacatcgatctgtacgaaatcaacgaggccttcgccgccgtcgccctgcgcttcatcgatgcactgggtctggatgacggcaaggtcaacgtcaacggcggagccatcgcgatgggccatccgctcggcgctaccggcgcgatgatcctcggtaccgcgctggacgaactggagcgcaccggcaagggcacggccctggtcacgctgtgcatcggcgccggcatgggcgtggcaaccatcatcgag

SEQ ID NO: 28089 - DNA, 1461 bp, Burkholderia fungorum
gccgtcgtgtgcggcgaggagcgccttacgtggcgcgaactcgatatccgcaccaatcaggttgccaatgccatccgcgcgctgggtttcgacaagggcgacaagatcgccctcttcatgcccaattcactggccctgttcgagcttttctggggtgtggtgaaagccggctgcgtggtcgtgtgcctgaatacgatgctcgaaggctcggccctcgcgcgcatcacgaattcatcggacgcccgggcgatgtttgccggcggcagctcccggactctggtcgatgaagtgcgcgacaggctcgaaggcatcgcgccagaacatttctacagcgtcgattcgccaggcgacggatggaacagtgcgcagacactgttcgatgcggcgccgtccacgccgccgcaggtcacgatcctgccttccgattcaatgaccatcatctattcatccggaactaccggggttcccaagggcatcgagcacacacatttcggacgactgaattacccgcacggattcgccatgggcctcgcgatcaaccgttattcggtggccgtttgcgcgacgccgatctatgcgtcgggcacatggatcacaatgtttccgaccatgtatcgaggcggcaccgtcgttctgctgccgcaatactcgccagaggccttcatcgatgcagtccggcgggaacgcggcactcatagttttctggtgcccacgcagtacatcggactgctgcagcaaccgttgcagaactatgaccttggctcgctcaaggcgttggtcacggccggtcaatcactcctgcccgcgacttatgcagccctcctcagggccttcccccatgccggtatctacgaggtctacgggatgaccgagggcttctcgacacttgccataccagaggacgtagcgcgcggcaagaccggctcggttggcaagccctcttttctcgacgacgtccgcatcatcgacgagcagggccgcgagttaccgcctggagaaactggcgagatcgtcgcatatgggccaggaatgatgaagggctactacaaccgcccggacatgaccgaggcggcgacctggatcagccctgccggccgcacctacatgcgcagcggcgatctgggccagatggacgaggacggcttcctgtatgtcaacggccggctcaaggacatgatcaagtcgggtggcatcaacatctatgcagccgatctggaacaggtcgtgatagagcatccggccgtgcacgaagtcgctgtaatcggtgtacctcacgaaaagtggagcgagacacccgtcgccgtggtgttgctcaagccaggcgcgagcgcggaacccgacgtattgatgcgctgggtgaaccagcggctctcgaagtaccagcgactcagcctgctcctgatccgcgacgagctgccgcgcgccatctacggaaaggtacagaagcaggcccttcgggag

SEQ ID NO: 28090 - DNA, 723 bp, Burkholderia fungorum
ctgaagacgcgctcagccgtggttacgggcgcggcaggcgcaattggaaaagccatcgcaaaacgcctgctcgactcaggcgctgcggtgtgtttatgggacattaacgaggaggcggtaaagcagtcgtgcgccgaactcaccgaatccggtccagtcgagtgggccgtcgtggatatctgcgatcctctagcggtgtccgtagggctcgcgcgtgtcattgaaaatgtgggaagaatcgacattctcgtgaacaatgctggcgtaagtggtgcccaggtgccgttggaagaatacgatctgagcgaatggcgtcgcgtcatcgaatcgaacttgacgggcgcgtttgtatgctcacaagcagtaatcggcgccatgcgtgccggcggctacggtcggattgtgaatgtcgcctcggtcgccggaaaggagggaagtccaagattgagtgcctatagtgcagccaaagcaggaatgattgcgatgacgaagtctctaggaaaagaactggcgatgtcccccgttctcgtcaattgcgtcacgccaggaccaacccgttcgcggatgacggcagaaacgccaaaggaacagctagctttaatgctctccaaagctccgatgcaacggatgatggagcctcacgaggtcgcagctatggtggcgtggctgtgtactgaagaatgcagctacaccaccggcgcagttcatgacctctcgggcgga

SEQ ID NO: 28091 - DNA, 714 bp, Burkholderia fungorum
aacgaacttacagataccttgattgccattacaggtggtggttctggacttggcgaagcatgcgctgaactgctggcccctcgggtagccgaacttgcgttgatagatcgtgacccggactcgcttgccagtgtgcgggcgcggctgtcgggattatgcgagatatccgttcatgcttgcgacattgctaacagcgatgacgtctccacaacattcaatcggatcgagcgagagtctcgggtagtgagcacacttattaactgtgcaggaatgaacgtgaaagatcgacacttcggtgagcttactcccgacggatggaatcaggtcattgcagttaatctgtccgggatgtactactgctgtcaggcggtattgagtggtatgcggcgtcagcagcgcgggacaattatcaacgtgtcgtcttgggccggtcgacacgcgggattcttcactggacccgcttacaacgccagcaagaggggtgtcctggctttgacggagtcaattaacctggaagagggaataaacaacgtccgggcgacagcagtcgtacctgaagcaatggcgaccccgatgatccggaaaattccgaatccaccaagcgaagaggcgattgcgaaaatgatgcgacctctcgacgtggcgaggatgatcgacctgataatcagtttgccgcaggaaatgtgtgtaaacgaggttgtcatgagcccgaca

SEQ ID NO: 28092 - DNA, 1542 bp, Burkholderia fungorum
accattcctcgattgctgcgcgaactcgtggcgaaccacggcaaccgtgaggcgctcgtcgggcagggtgagcgcatgacttatcagcaactgggtgagcgcgtggaggcacttgccgcgaggctgatacgcaccggcgtcaagcggggcgaaaaggtgggcgtcctgatgggcaatcggcccgagtgggtgatcagcgccctcgcgatcacgagtatcggcgcagtgctcgtgtcactcaattcctgggccaccgcgcgcgagctggcctatctgctttcgcactcgggctgtcgtcatctgattgccaccaggcgttatctcaagtacgactatgcggtgatgctgcgagacatggatccggccatccgcggccgccttgccacggtgatcggcgtcgacgccgatctgcccgacggttggcttccgtttgacgatgccgccgacgtggcgcgcgtggaagccggcgacgcggtacgggcggcgggcgagcaggtgggcagcgacgatatcgccttcctcctctatacgtcggggtcgacgtcggcgccgaagggagtccagcttgcgcatggcgcgttgatcgtcaatggctggcacatcggcgagcggcagcgcatcgtaccgggagaccggctgtggcttgcggtttcgctcttctgggcgctcggctgcgtgaacgccatgatgaatctgctgacgcatggcggctgcatcgtattgcaggaggccttcgacgcaggcgaggcgcttcacctgattgaagccgagcggtgtacggtgttttacggaacgcccaacatggcgcaggcgctgtacgaccatcccgagcgcgaacggcacgacctgggctcgttgcgtactggtggaacgcttggttcgccggagcagatcgcacgcgtcatcaagttgggcgtgagccgtgtgtgcaacatctatgggcttacggagacctacgggaattcgcatgtcacaagtgcggacgacgacgaggcattacggcttgtgtcctgcggccagccgctacccggagtcgagcaacggatcgtcgacgcgaacgggatcgatttgcccccaggcgagattggagaaattcgcgtgaaagggcgcgttatcgacgggtactacggaaacgaggagctgacgaaagcgtcctttgacgagcagggctacttcaggaccggagatctcggctacgtcgattcgcagggttatctctactatcgtggccgttcgaaggagatgatcaagacgggcggcatcaacgtttcgcccgccgacgtcgagtccgtgctgagcgcgcatccggcgatctatctcgcctatgtcgtcggcgtgcccgacccggtgagggacgaggagatcggggctctcgtcgtcctggagaacggcgccagcatggcttccgatgaaatcctgcaatactgcagcagaatctcgccgctacaaggttccccgcggcttcgcttcgtctccgagggcgaactcccgatgaccaccaccgggaaggtacagaagaacaggctggctgaaatgttcttt

SEQ ID NO: 28093 - DNA, 723 bp, Burkholderia fungorum
atgagtctcaagggaaagattgcgatggtaaccggtgcggcgaccggcatcggcgctactctggcgcaagcgctggcgtcgagcggtgcggaagtcatcggcgtcgacatcgcatgggatggcgctcagcaggcaggctgcgtcgaacgagctcagtgcgatgtcgctgacccaatgagcgtcaagacttgtgttgccaacattgaagctgcccacgggccagtcgatatcctcatcaataatgcggcgctggcttccgagctggcgccgacgccgttcgagcacatcgcgcccgaggaatggctgcgggtaatgacaatcaacacgatggcgccgttcctatgcagtcaggcggtcgctccgcgcatgcgtgaacgcaaatgggggcgtatcgttaatctcacgtcggcgacgatttttatcggcatgccgcctatgttgcactacgtcgccagcaagggggcagtcgcaattatgacccgggggcttgcgcgcgaacttggacgcgacgggatcaccgtaaacgcgatcgcgcccggcctcaccatgaccgaaggcgttcaaaggaatgaagcctattccgatgaactgatagcccaggccatcgccgcacagagcatccccaatcgcgagcaacccgaagatctgattgccgcctgcctttatctggtcagcgacggcgcgaagatgatgacgggtcagattctcgctgtagatggcggt

SEQ ID NO: 28094 - DNA, 2445 bp, Burkholderia fungorum
aagcagaccgccgcggccacggccgcttcagcggcaggggttgtgctgccgggcgtggacgccctggctgcgtcggacagcctgacctggtcaaaggctccgtgccgattttgcgggaccggctgcggtgtcagcgtgggcgtgaagaacggcaaggttgtggcaacccagggtgacccgcaggccgaggtcaatcggggcctcaactgcgtgaaaggctacttcctgtcgaagattatgtacggccaggatcgtctgaccacaccgctgctgcgcatgaaagacggcaagtatgccaaggacggcgaattcgcgccggtctcgtgggatcaggccttcgatgtaatggccgatcacttcaagcgcaccctgaaagaaaagggcccgacagcagtgggaatgtttggctcgggacagtggacggtgtgggagggctacgctgccgtcaaacttatgaaggcgggctttcgcagcaacaatctcgaccccaacgcgcgtcactgcatggcctcggccgtcaccggcttcatgcgcacgttcggtatggacgagccaatgggctgctatgacgatatcgagcaggctgataccttcgtgctgtggggctccaacatgtcggagatgcatcccatcctgtggacccgcattaccgaccgccggctcagcacgcccacgacgcgcgtggtcgtgctctcgaccttcgagcatcgcagcttcgatctggccgaccagacgattatttttacaccgcaatcagatctggcgattctgaactacatcgcgaattacatcatccgcaacggcaacgtgaatcgcgatttcgtcaacaggcatacggttttcaagcaaggcaacgccgacatcggttatggcctgcggcccgacaacccgttgcagaaaacggccaggaatgcgggcgacccaaatggttcgcagccgattacgttcgacgaatttgcgaaattcgtctcgaagtatgacgcggcctatgtgacgaagctctcaggtgtgccgcaaaacaagctcgatcaacttgcccggctgtatgctgatccgaaggtcaaggtgatgtcgttctggaccatgggcttcaaccagcacacgcgtggcacgtgggccaacaacatggtctacaacctgcatctgctgaccggcaagatcgccacgcccggcaacagtccgttttcgctgacggggcagccgtccgcatgcggtacggcgcgcgaagtggggaccttttcgcaccggctgccggccgacatggtggtcaccaacccgaagcatcgtgaggaggccgagcatatctggaaactgccggcaggcacgattccggacaaaccgggctatcacgcagtcctgcagaaccgcatgctgcgcgacggcaagctcaacgcctactgggtgcaggtgaacaacaacgtgcaggctgctgccaatatcaatggagaagcgttgccgggttatcggaatccacaagccttcgtggtggtgtcggatgtgtatcccacagtcaccgcggtggcggcagacctgatcctgccctcggcgatgtgggttgaaaaggagggcgcgtacggcaacgccgagcggcgcacccagttctggcatcaactggtcgacgcaccggccggcgcccgctccgacctgtggcaactggtcgagttttcaaagcgcttcaaggtcgaagaagtctggcctgcggatttgctcgcgaagaagccagagtacaggggcaagacgctctacgacgtgctgtatcgtaacggccaggtcgacaggtttgcccttacggaaactgattcccactatcggaacgacgaagccaaggcgtttggtttctacattcagaagggcctgttcgaggagtacgcaagcttcggccgtggccatggccatgatctcgcgccattcgacgcgtatcacaaggcgcgcggtctgcgctggccggtggtcaacggaaaggaaacgcgctggcgctataaggaaggttccgatccttacgtgaaaacaggcaccggctggcagttctacggcaatcccgatggccgcgcggtgatctatgcgctgccttacgagccacccccagaagttccggacaaggagtatccattctggctcgctaccggtcgtgtgctggaacattggcactcgggttcgatgacgcggcgcgtgcccgagctgtaccgcgcgtttccaaatgcggtgtgcttcatgcatcccgacgacgcgaaagcaatgggtgtgcggcgcggagtagaggtcaaggtaatgtcgcggcgcggctacatcctgacgcgggtcgagacgcgcggacgtgacaagccgccgcgcgggctggtcttcgtgccatggttcgattcaagccagttgatcaacaaggtgacgctggacgcaactgacccgatctcgctacagaccgactacaagaagtgcgcggtcaagatc

SEQ ID NO: 28095 - DNA, 1029 bp, Burkholderia fungorum
gcctatgcagcgaccgacgctaccgcgccgctcgccccgttcgaaatccagcgccgcgaacttcgcgcccatgacgtgcagatggaagttctgttttgcggcgtttgccattccgatttgcatcaggcgcgcaacgaatggaagaacacggtttttccggtggtaccgggccatgaaatcgtgggccgcgtgaccgcggtcggtccggacgtgacgaagcacaaggtcggcgatctggtcggcgttggctgtctggtcgattcgtgccgtacgtgtgcgagttgcgaggaaggacttgaacagtactgcgagaacggatttgtcggcacgtataacggtgtcgaccgggtcgacggtcagatcacttacggcggctattccacgcaactcgtcgtggacgaagagttcacgctgagcgtgccggacaatctcgaccctgccggcgtggcgccgctgctgtgcgcgggcatcacgacgtattcgccgctgcgcacctggggtgcgggtcccggcaagaaggtcggcattgtcggccttggcggcctgggtcatatgggcgtgaagctcgcgcatgcgatgggtgcgcatgtcgtgctgttcaccacgtcgccctcgaagatcgaggatgcgaagcgcctgggtgcgcatgaggtggtgatttcgaagaatgccgcagaaatggaagcgcatttgaacagcttcgatttcattctgaataccgtggctgcgcagcatgatctgaatccgtttctgaatctgctcaagcgtgatgggacgatgacgctggtcggcgcgcccgagcatgatcatccgtcgccgcaggtattcaatctgattttcaagcgtcgccggctggctgggtcgctgattggcgggattgccgagacgcaggagatgctggatttttgcggtgagcatgggattacttcggatatcgaggtgattcctatgcaggggattaatgaggcttatgaacggatgctgaagagtgatgttaagtatcggtttgtgattgatctggattccttg

SEQ ID NO: 28096 - DNA, 2730 bp, Burkholderia fungorum
gatgtcaagacaaccacctgctacatgtgcgcctgtcgttgcggtatccgtgtgcatctgcgggaaggcgaggtgcgctacatcgacggcaatccggagcatccgctcaatcagggggtgatctgcgcgaagggcgcctccggcatcatgaagcagtactcgcccgcgcgcctgacgcagccgctgatgcgcaagccggacgcggagcggggcagcgcgcagttcgagccggtgtcgtgggaatacgcgttcgacgtgctcgaaaagcgtcttggtgcgattcgcgccacggacccgaagaaattcgcgctcttcaccggccgcgatcagatgcaggcgctgaccggactcttcgccaaacagttcggtacgcctaattatgcggcgcacggcggcttttgctcggccaatatggcggccggcatgatctacacgatcggcggctcgttctgggaattcggtggcccggatctcgacagcgcgaaactcttcttcatgataggtacggcggaagaccatcattcgaatccgctgaagatcgccatttcgaagttcaagcgcgcgggcggccgcttcattgcaatcaatccggtccgcaccggctacgcggcgatcgccgacgaatgggtgccgatcaaacccggcaccgacggcgcgctgttcatggcgtttctgcacgaactgattgccgccgacgcgtgggatcacgaattcgtgcgccgctataccaacgcggcggagctggtcgacctcgacgaagcgagcgaaaacttcggcctgttcgtgcgcgaccccgagcggccggtcggcaatccgctgttcccgcagaatcatctctggtgggatgcggacgccgcgcgcgccgtgccgcatcacacaccgggcgtcaatcccgcgctagacggccgctttacgctcgacgacggcacgccggtcacgccgtcgttcgccttgctgcgcgaacgcgtggccgattgcacgcccgagtgggccgctgcgatcacgggcattgcggcggacacgatccgccgcctcgccggcgaaatgatccagacgagccgcgaccaccgcatcacgttgccgatccgctggaccgacgcgtggggcgagacgcacgagacggtcaccggcaacccggtcgcctttcatgccatgcgcggcctcgcggcgcactccaacggcttccagtcgatccgcgcgctcgctgttctgatgtcgctgctcggcacgatcgaccgcccgggcggctttcgtcacaagtcgccgtttccgcgtgcggtgccgccgtcggcgaaaccgccgaacagccccgacgccgtcaagccgaacacgccgctcgccaccggcccgctcggctggcccgcggcgcccgaggacctgttcatcgacgatcagggcggcccggtgcggatcgacaaggcgttctcgtgggaatatccgctcgccgtgcatggcgtgatgcacagcgtgattaccaacgcgtggcgcggcgacccgtatccgatcgatacgttgatgatcttcatggccaacatggcgtggaattcgtcgatgaacacgatgaaagtgcgcgagatgctcgccgacaggcacgcgaacggcgagtacaagattccgtttctggtggtgtgcgacgcgttccagtcggagatgacggcattcgccgatctgatcctgcccgacacgacctatctggaaaggcacgacgcgatgtccatgctcgaccggccgatctccgaattcgatggaccggtggattcggtgcgggtaccagtcgtgccgcccaccggtgaatgcaagccgttccaggaagtgctgatcgaactggcgtcgcgtctgaagttgccggccttcacgaccgccgatggcgagcggcgctttcgcgactatcccgactttgtcgtcaatttcacgaccacaccggattccggcgtgggtttcctgatcggctggcgcggcaaggacggtgacaaggcgctggtgggcgagcctaatccgaagcaatgggagcagtacgcgaagaacaattgcgtgttccattacccgctacccgagacgctgcaatacatgcgcaactgcaacgggccatatctcgagtgggcggtcaggaacggttttcgcaagttcggcgagccgatcctgatccagctctattccgacgtgatgcagaagttcagactcgccgcgcaagggcgcacgagcggcaggcagccgccggatcacctgcgcgcgcgcgttgaaaagtacttcgatccgctgccgttctggtacgcgccgctggaaaataccgccacggacctcgtgcgttttccgcttgccgccgtgacgcagcggccgatggcgatgtaccactcgtgggactcgcagaatgcatggctgcggcagattcatggcgagaactatctctacatgaatccattgatggcggccgaaaacggcattgccgacggcagctggatctacgccgaatcgcaatggggccgcgtgcgttgcatggcgcgcttcagcgagacagttgaaccgggcaccgtatggacgtggaacgcgattggcaaggcatcgggcgcgtggaatctcggcccgggcgcgaacgaatcgcaacgcggtttcctgctcaatcacctgatcaccgacgagttgcccggccgcgatgacgacgcggcgagccgcatgtcaaattccgatccggtgacgggccaggccgcctggtacgacgtgcgcgtgcgcatc

SEQ ID NO: 28097 - DNA, 861 bp, Burkholderia fungorum
atgctaaaagttacaaaggcagtctttccggtagcaggccttggcacgcgatttctccctgccacgaaggcgagcccaaaggagatgctgccgatcgtggataagccgctcatccaatatgcggtcgaagaggctatggccgccggcatcactgaaatgattttcgtgacgggccgcagcaagcgcgcgatcgaagaccatttcgacaagtcgtatgaggtcgaggcggaactggaagcgcgcggcaaggacaagctgctgcaattggtacgcagcatcaagccgagccatgtcgactgtttttacgtgcgccaaccggaggcgctcggcctcgggcacgcggtgctatgcgcggagaagctggtaggcgacagtccgttcgccgtgattctcgcggacgacctgctatacggcagccctcctgtcatgacgcaaatgatcgaggtgttcgatcactaccatagctcggtgatcggcgttgaggaaattccggcgcaggataccaaatcgtacggcatcgtcgacggcaaggaatgggagcagtccatcatcaagatgtcgggcatcgtggaaaagcccgagccgagcgcggctccttcaaacctcggtgttgtgggtcgatatgtgctgaagccgcgcattttcaaacatctgcgcaccatcaagcccggtgccggtggcgaactccagttgacggatgcgatcgagtcgctgcttgccgatgagcaggtactggcctacaagtaccgcggcacgcgctttgattgcggcagcaaaatcggctacctgaaggccacggtggaattcgcggtgcggcatcccgaggtaggcgtcgagtttcgtgagtaccttgaggagtat

SEQ ID NO: 28098 - DNA, 1386 bp, Burkholderia fungorum
atcgatggcaaatggatcgcgccgtgcggcaccggcacgatcgacgtgatcgactcgggcacggaagagatcatgggccgcattcccgagggagtcgaggccgatgccgaaagtgcgatcgccgccgcccgcgtggccttcgacgcctgggccgcgacgcccgccgccgaacgcggcgagtatctgcgcaaggtcgcggcgaacctgaaagcgcgcacggacgaactggccggtttgatcgccggcgaagtcggcatgccgctaaaactcgcgcgtgccatccaggtgggcagcccggtctataactggggcgcgtatgcgaagctcgcgagcgagttccagtatgaggaacgcgtcggcaattcgctggtggtgcgtgagccggtcggcgtggtggcggcgatcacgccgtggaactatccgctcaatcaggtcacgctgaaggtcgcggcggcactcgccgcgggttgcacggtggtgctgaagccctcggagatcgcgccgctgaccgcgttcgtgcttgccgaggcgatccacgaggccgggctgccggccggcgtgttcaacctcgtgagcggttatgggccggtggtcggcgaagtgctggcgagccatccgtcggtggatatggtgtcgttcaccggctcgactcgcgccggcaaacgggtgtccgagctggcttcggcgacggtcaagcgcgtcgcgctcgaactcggcggcaagtcggcctcggtcattctcgacgatgcggatttcgccgcggccgtgaaaggcacggtcagcgcatgctttctgaattccggacagacgtgctccgcgcatacgcgcatgctggtgcccgaggcgcgctacgacgaagcgcgcgtgctggcgaagcaggccgccgagacttacgtggccggcgatccgcgcaacgagacgagccgtctcggcccgctggcttcggccgcgcagcaggcgcgcgtgcagcaatacatcgcgaaggggatcgaggagggcgccgaactggtgacaggcggggtgggtctgcccgatgggttgtcgaagggcttcttcgtcaagcccactgtgttcggccgcgtgcatcccaaggcgacgatcgctcaggaggaaatcttcggcccggtcctgtcgattctgacctacaaggacgaagaggaagccgttcggatcgccaacgattcaccgtatggcctgggcggcgcggtatgggccggcagcgacgagcgtgccgtcggcattgcgcggcggattcgaaccggtcaggtcgatatcaacggcggcacgtggaatatggccgcgccgttcggcggtttcaagcagtcgggattcgggcgcgaaaacggcgtctacgggctcgaagagtatttcgaactgaaatccatg

SEQ ID NO: 28099 - DNA, 1059 bp, Burkholderia fungorum
atgcctctcgtatcaatgcgtcaactgctggaccatgccgctgaaaacggctatgggcttccggcattcaacgtgaacaacctggagcaggtgcaggcgatcatggcggccgccgacaaggtcaacgcaccggtcatcatgcaggcttcggccggcgcgcgtaagtacgcgggcgaggcgttcctgcgccacctgatcgaagccgcggtcgagtcgtatccgcatattccggtcgtgatgcaccaggaccacggccagtcgccggcggtctgcatggcggcgatccgcagcggtttcaccagcgtgatgatggacggttcgctcgaagccgacggcaagacggtcgcctcgtacgagtacaacgtcgacgtgtcgcgcagggtcgtggaagcggcgcattcgatcggtatcacggtggaagcggaactgggcgtgctcggttcgctggaaaccatgaagggagacaaggaagacggccacggcgcggaaggcacgatgacgcgcgagcagttgttgaccgatccggaacaggctgccgacttcgtcaagctgacccagtgcgacgcgctggctatcgcgatcggcacctcgcacggcgcgtacaagttcagcaagaagcccacgggcgacattctgtcgatccagcgtatcaaggaaatccaccagcgcattccgaacacgcacctggtgatgcacggttcgtcgtcggtgccgcaggaactgctcgctgaaatccgcgaattcggcggcgacatgaaggaaacctacggcgtgccggtcgaggaaatccaggaaggcatcaagaacggcgtgcgcaaggtcaatatcgacaccgacctgcgtctggcgatcaccggcgcgatccgccgctacatggcgaccaacccgggcaagttcgatccgcgcgattacctgaagccggcgcgcgaagcggcgatgaagatctgtatcgagcgctacacgcaattcggttgcgaaggccaggcgggcaagatcaagccggtcacgcttgataaaatcgcggagaagtacaagtcgggcgagctcgcgcaagtcgtc

SEQ ID NO: 28100 - DNA, 2583 bp, Burkholderia fungorum
atggcgatttcacgtcaggcgcttttcggcaagcttggaaccacgctgtacagaagcatcgagtccgccacggccttttgcaagctgcgcggcaacccttatatcgagctcgtgcactggctgcatcagttgctgcaacaacccgactcggacctgcatcggctcgtgcggcattgcggtatcgagcgcgaaacactggatcgcgatatggcccgcgcgctggccgcgctgccggcaggcgccagttcgatcagcgatttctcgcatcacgtggaactggccgtcgagcgggcctgggtgctcgccacgctcagcttcaatgaccggcgtatccgcagcgcctggctcgtcgccgcactcgtgcagacgccggaattgcgccgcgtgctgctttccatctcgccggcgttcggcaagctatctgtcgtgggtctggacgaagcgctgccggcctatatggagaattcgcccgaagccgccgaggcgccctacgacaacagcaatttttcaaccgcggtgccgggcgaggcttctcacgcccttcccgcgcaatcgaaagggtcgccgctcgaacagttctgcaccgacctcaccgtgcgtgcgcacagcggcgaaatcgatccggtggtcggccgcgaactggaaattcgcaccatgatcgacgtgctgctgcgccggcgccagaacaatccgttgctgaccggcgaggccggcgtcggcaagaccgcggtcgtcgaagggctcgcctgcgcgatcgccaccggcaacgtgccgcccaggctggtgggcgtgcgcctcctgagcctcgacgtgggcgcgctgctcgccggcgccagcatgaagggcgaattcgagttgcgtttgagaggcgtgctggaagccgcgctgaagtcggccgtaccggtgatcctgttcgtcgacgaaatccatacgctgatcggcgcgggcggccaggccggcacgggcgacgcggccaatctgctgaaacccgcgctcgcgcgcggcgcgatccgcatgatcggcgcgaccacctgggcggaatacaaacggcacatcgaaaaagacgcggcgctcacgcggcgcttccaggtcctgcaggtgcggcagccgcaggaaccggcggcgatcgacatggtgcgcggcctcgcgaacacgttctcgcggcatcacggcgttgtcgtgcgtgaccaggcgatccgcgcggcggtgaggctgtcgcatcgctacattccctcccgccagttgccggacaaggcaatcagtcttctcgacacggcgtgcgcgcgcgtcgcgctttcgcagcatgcaccgccgcgagaattgcaggacgcgcgtcaacgcgtgctggccgcgcgcgtcgaaagcgagttgctcgtcgcggaatcgcgtatcgggctcgataccgcgagcgcattggcggcggcccgaacgcgcatcggcgaactggtcgctgtcgaagagcgcatcgaagcgcgctggaaagcacaactcgcggcggcgcaagccttgctcgccgcccgtgatgcggcgctcggggccgatcacggcgcgccgcacaccggcgcgaacagtgacgcatgcgcgtcgcccgattcgctcaaggatctggagcgcgccctcacgcaattgcagggcgatgcgccgctggtgtttcccgaggtgagcgaagcaatcgtcgccgaagtggtatcggattggaccggcattcccgtgggccgcatggtcaccgacgaagtggccgccgtgcaatcactgcccgccacgctcgaagcccgcgtgatcggccagcccgatgcattgcgtcagatcggcgagcgggtgcaaaccgcacgcgccgggctcacggatccgaagaagccgctcggcgtattcctgctcgcgggcccttccggtgtgggcaagaccgagacggcgctcgccctcgcggaggcgctctacggcggcgagcagaacctgatcaccgtcaatatgagcgagtaccaggaggcgcacacggtctccggactgaaaggcgccccgcccggctatgtcggctacggcgaaggcggtgtgctcacggaagccgtgcggcggcgcccctattccgtggtgctgctcgacgaaatcgagaaagcccatcgcgacgtgcacgaaatgttcttccaggtgttcgacaaaggctatatggaagacggcgacggccgctatatcgatttccgcaacaccacgatcctgctcacgagcaacgccggctcggagctgatcgcgagcctgtgcgcggacgcgccgctcccgcccgatgccgaaggtctgcgcgaagctctcacgcccgcgttgctcaacgcatttcccgcggcgtttctcggccgcgtcaccgtggtgccgtaccggccgctcgcgcatgaatcgcttgcgcgcatcgtgcggctgcatctggaccgcgtcgtcactcgcatggcgcaggttcacgacattgcgcttgcctacagcgggcaagtggtcgactacatcgttggcagatgcctggttcaggaaaccggagcccgcgtgctgattggctttatcgaacaacacgtgctgccgcgcctttccgcgttatggctc

SEQ ID NO: 28101 - DNA, 738 bp, Burkholderia fungorum
atgcagaagagagtcgtactcgtcaccggcgccgcgcgtggtctgggcgccgcgcttgccgcgcgctttcacgcggcgggctacgcggtcgcgatcggcgatattgcgttcgatgcggcacaagcccttgcgcgcgatctgagcgcagacggttccagcgcattcgccctgcatctcgacgtcaccgcgaaggccgctttcactgctgcgcgcgacgccattcttcaacgctggggccgtgtcgacgcgttggtcaacaacgcgggtgcctccaaagtcgtgtccgtgatggacattacggcggagcagttcgatcaggtcatcaacgtcaatttgcggagcgtgctgttcggctgccaggtgttcggccagcatttcgccgacacgggcatgggccgcatcgtcaacatcgcgtcgctcgcgggacagaacggcggctcggcgaccggcgcgcattacgcggcggcgaaaggcggggtgattacgctcaccaaggtattcgcgcgcgacctcggcgcggcgggcgtgaccgtcaacgccatttcgcccggcccgatggatctgccgatcgtgcatgaaagcgtggcggccgacaaactgaaggcggtgatcgcgaatattcccgcaggccgtctcggctcggcggattatgtcgccgatgttgccgtgatgctcgcggcggaaaatgctttcttcgcgaacggcgcgtgctgggatgtgaacggcgggctgttcatg

SEQ ID NO: 28102 - DNA, 978 bp, Burkholderia fungorum
tatccgcactaccgtccgcgccgcatgcgccgcgacgacttctcgcgccgcctgatgcgggaaaacatcctcaccaccaacgatctgatttatcccgtctttatcgtcgaaggcaccaacgtgcgacaagccgttccgtcgatgccgggtgtcgaacgtgtgtcggtggatctgctgatgggcgtggccgagcagtgcgtcgaactgggcgtgcccgtgctgtcgctgttcccggccatcgagccttcactgaaaacgcccgacggccgcgaagcgaccaacccggccggcctgattccgcgcgcggttcgcgaactgaaaaagaacttccccgagttgggcgtgctcaccgatgtcgcgctggacccgtacacgagccacggccaggacggcgtgctcgacgaagccggttacgtcatcaacgacgagacagtcgagatcctggtcgaacaggctcgtgctcaggctgaagcgggcgtcgatatcgtcgcgccttcggacatgatggacggccgcatcggcgcaatccgcgagatgctcgagagcgaggatcatgtgcacacccgcatcatggcttatgccgccaaattcgcgtcggcgttttacggcccgttccgcgacgccgtaggctccgccacgaacctcggcaagagcaacaagatgacctaccagatggacccggccaattcgaatgaagcgctgcgcgaagtgcaggcggacatcaacgaaggcgcggacatggtgatggtcaagccgggcatgccgtatctggatatcgtgcgccgcgtgaaggatgagtttcagttcccgacgtacgtgtaccaggtgagcggcgagtacgccatgttgaaggcggccgcacagaacggctggctcgatcacgataaagcgatgatggagtcgctgctggcgttcaagcgggccggcgcggacggtgtgctgacctatttcgcattggatgccgcgcggattttgcgc

SEQ ID NO: 28103 - DNA, 1242 bp, Burkholderia fungorum
tttgactacgtcgacggcgtgctgcatgccgaaggcgtatccgccgtttccctcgccgagcagttcggcacgccgctgtacgtgtattcgcgcgccgcgctcaccgcggcgtggaacgcttacgccggcgcttgtgccggccgccgcgcaagcgtgcacgtcgccgtcaaggccaatagcaacctcgcggtgctgaatgtgttcgcgcgcctcggcgccggcttcgacatcgtgtccggcggcgaactggcacgcgtgctggccgctggcggcaaagcggaaaacacggtgttttccggcgtcggcaagaacgcgaacgaaatgcgcgaggcgctcgccgccggcgtgaaatgcttcaacgtcgaatcgattcccgagctcgaccgcctgaatgcggtcgcggcggaaatgggcaagaaggcgcccgtctcgctgcgcgtgaatcccgacgtcgacgcaaagacgcatccgtatatctccaccggcctcaagtcgaacaagttcggcgtcgcattcgaagacgcgcgcgccacgtatcaggcggccgcgggcatggcgaatctcgaagtggtgggtatcgactgccatatcggctcgcagatcaccgaagccgccccgtatctggacgcggtcgacaaggtgctggaactggtcgaacagatcgagcaggacggcctgaagattcgccacatcgacgtaggcggcggcctcggcatcacgtacgacgacgaaacgccgccggagatcggcgagttcgtgcgcaccgtgctcgatcgcatcgaagcgcgcggtcacggccatcgtgaagtgtatttcgagccgggccgctcgctggtcggcaatgcaggcgtgctgcttacgcgcgtcgaatttctgaagccgggcgcggaaaagaatttcgccatcgtcgacgcggccatgaacgatctcgcgcgccccgccatgtatgaggcgtatcacgcaatcgatcccgtcgtgaagcgcgacgtgccggcccacgtgtacgacgtggtcggtccggtttgcgagagcggcgactggctcggccgcgaacgcctgctggcggtggaaccgggcgatctgctggcaatccgctcggccggcgcgtacggcttcgtgatgagctccaactacaacacccgtccgcgtgcggccgaggtgatggttgatggtacacaagtgcatgtggcacgcgcccgcgaagaggtcaggcaactgtttgtgggcgaaacgattttgcca

SEQ ID NO: 28104 - DNA, 429 bp, Burkholderia fungorum
atgggggcaggaaaaaccaccgtgggccgggccattgcgcgccgtctcgatcgtcccttcttcgattccgaccatgaaatcgaggcacgcacgggcgcgcgcatccctgtgatcttcgagctggagggtgaagcgggctttcgcgagcgcgaggcgaacgtgatttccgagctcaccgcgcgcgaaaatatcgtgctcgcgaccggcggcggcgcggtgctgcggccggaaaaccgcgaggcgctgcgaaatcgcggagtcgtgatttatttgcgcgccaatccgcacgacctgtggctgcgcacccgccgcgacaagaatcgcccgcttttgcagaccgaagaccccaaagcgcgtctcgaagccctctacgaagtgcgcgacccgttatatcgggagtgcgcgcatttcgtgatcgaaactggccgg

SEQ ID NO: 28105 - DNA, 1029 bp, Burkholderia fungorum
atgattaccgtcaatgtcgaactgggcgaacgcgcctaccccatccatatcggtgccgatctgatcggccagaccgcgttgttcgcgccgcatatcgccggcagttcggtcaccatcgttaccaataccactgtcgacccgctgtacggcgacaagctgcgcgccgtgctggcgccgctcggcaagcaggtgtccacggtcgtgttgccggatggcgaggcgtacaagaacctcgaaaccctgaacctgattttcgacgcgctgctcggtgcgcgggccgatcgcaagaccacgctgatcgccctgggcggcggcgtgatcggcgacatgacgggttttgcggcggcctgctatatgcgtggcgtgcccttcatccaggtgccgaccacgttgctgtcgcaggtggattcatcggtgggcggcaagacgggcatcaatcacccgctcggcaagaacatgatcggtgcgttctaccagccgcaggccgtgattgccgatatcggcgcgctgcatacgctgccggcgcgtgaactggcggcgggcgtcgccgaagtgatcaagaccggcgccattgccgacgcgggtttcttcaactggatcgaagccaatatcgaggcattgaatcgctgcgagcccgccgcactcgccgaggcggtcaagcggtcgtgcgagatcaaggcgtcggtggttgcgcaggacgagcgtgaaggcggacttcgcgccatcctcaatttcggccacaccttcggccatgcgatcgaagccggtctcggctacggcgagtggctgcatggcgaggcggtcggctgcggcatggtgatggcggcggatctgtccgtgcgcatgggttatctcgacgaagccgcgcgcaagcgtctggtcgacgtgatcgtcgccgcccatttgccgacccgggcgcccgcgctcggcgactcgcgctatgtcgaactcatgcgggtcgacaagaaggcggaagccggcgcgatcaaattcattctgctgaagcgtttcggtgagacgctgatcacc

SEQ ID NO: 28106 - DNA, 3783 bp, Burkholderia fungorum
atgcatctgttgcgcaccacgccgggcggttttgtcgacgatacgcaaggcgtgatccgcatcgatcagcagcccgccgatatcgtggtgctcagttccgccgataccacgctgtcgctgctggcgagcgtttttccgcgtctgggagagggttttccgagcgtgcggctcgcgaacgtcacgtatctgcggcaaccggcctcggtcgatttctacgtcgaagacgttttgcagcatgcgcgcgtggtggtggtcgatcatctcggcggcgaagcgtattggccttacggcatcgagcaggtggtggcgctcgccgggcgcaaacagcagatgctcgcgatgttctcgggcgatctgcaggaagatccgaacctgctcgcgcgcagcaccgccggcgccgatctgtgtcaccagctctggcgctatctgcgcgaaggcggtccgcagaatgccgaagcgttcctgcgctgtatcgcgcatcgcgcattcggctgggggcgcgagcctgcgccgccgcgcgcgttgcctgccgcgacgctctatcatcccggtcgcgacacgccgactatcgccgactggcagacgcgctggcaacagaacgcgccggttgcggcgatcctgttctacaaggcgcatctgcaggcggccaatacagcggtgttcgacgcgttgatcgacgcactggagtcgcaaggtctgaatccgctgccgatcgcgatcacctcgctcaaagatgcgctgagccgcgaagtggtgcaatcgctgtgcgctgagcacgatgtctcgctggtgctgaacacgaccgcgttcgccgcgtccgcgatcgacgaccccgagccgctcgcgctcgccggcgacgcgcccgtgttccaggtgatcctgagcggcggtaatcgcgaggattggatcaaggacaatcagggcctcaattcgcgcgatatcgccatgcatatcgcgctgccggaagtggacggccgcatcattacgcgcgcgatcagtttcaaggggctcgcataccgttgtccgcacactcaggtcgacgtggtgcgttatcagccggacgccgaacgggtggggtttcttgccgaactgagccggcgctggtgccgtctgcgttcactggataacgcggacaaaaagctcgcgctgattctcgccaactatccgatgagcgaagggcgcattggcaatggtgtgggactcgatacgccggcttcggtagtcggcattctgtcgatgctgcgcgacgaaggctatcgtctcgctgacttgcccgcgaacggcgacgcgctgctgcaaaagctcaccgaaggcgtgaccaacgatccggtagtgcgtgatctgcgtcccgccctgcaaagcctcgcgctcgacgattatctcgcgcatttcaacgctttacccgctgaggcgcggcaggcattgaacgcgcgttggggcacgcccgaacaggatcctacgctgcggcgcggccgcttcatgattgcgggttggcgttgcgggcaggtgttcgtcggcattcaaccgtcgcgttcgcgcgagcagggcgattacgccagctatcacgacgccgaactcgtgccgccgcatgcgtatctggcgttctatttctggctgcgccaccagttcggtatcgacgcaatcgtgcatgtcggcaagcacggcaatctcgaatggctgcccggcaagagtgtcgcgttgagcaacgcgtgctggcccgatctgatactcgggccgatgccgcatctgtatccgttcatcgtcaacgatccgggcgagggcagccaggcgaaacgccgcgcacaggcggtcatcatcgatcacctgatgccgccgctcacgcgcgccgaaagttatgggccgctgcaggacctggagcgtcaggtcgacgaatactatgaagcgctgatggtcgacccgcgccgctcgaagctgttgcggcgcacgattctggcgaccatcgtcgaacaccggttgcatgaggaactgagtctcgcggaaccggacggccaggacgctgaggacgcgctgctcacgcgtgtcgatgcatggctgtgcgagttgaaggaagcgcagattcgcgatggtttgcatacgttcggccaatcgcctggcggtgtgcaacggcgcgatacgctgctggcgttggggcgttttcctgtcggcgacgggcaaggcggcaaggccggcttgatcgatgcgctggcgcgcgatctgcggatggatcatctgttcgatccgttgtcggtggattggtcggcggtgtgggacggcccgcgtcccgatgtattggagcgcgtgagcgatgcgccgtggcggcactgcggcgatacgcgtgaacggctggagttgctggcggcgtcgctgttgcgcggtgtgtgcggtgatcgaccggatgcgtcggcaatgccggttgccgacggcttgccgcaaacggagcgcgtaatcgggcgattgcgtgccgacgtgctgccgcggctcgatgcctgcggcccgcaggaaatgcttcagctcaagcgtggcctcgaagggcgtttcgtgccgcctgggccgagcggttcgccctcgcgtggacggcccgacgtgctgcccaccggccgcaacttctattcggtcgacacgcgcgccattcccacgcaagccgcctggtcgctcggactgaaatccgcgcagcaactgatcgaacggcatttgcaggagaagggcgattatccgcgcgccatcggcctctccgtgtggggcaccgcgaccatgcgcacgggcggcgacgatatcgcccaggcgctcgcgctactcggcgtgcggccgaagtgggcgcccggcagtcaccgcgtgaccgatttcgaaatcatgccgatcgaggtgttcgaccggccgcgtatcgatgtcaccttgcgtgtttccggtttcttccgcgatgcgttcgccaacgtcatgcatctgttcgacgccgccgtgcaggcagtggcggaactcgacgagcccgaagacctgaacccgattcgcgcgcgcgtgctgcgtgagcgcgacgcgctcatcgcgcgcggcatggacgccgccgaagcgcgcaagcgcgccggctggcgtgtgttcagcgcgcggcccggcgcttacggcgcgggtctgcaggacatgatcgactcgcagcaatggcagaccgacgcggatctggcgaacgcctatcaggcatggggcggctacgcgtacacgcaaaagagcgcgggcgaagaagcgcgccacgcgttcggcgcgcgcctcgccgcactggacgtggtgctgcagaaccaggacaaccgcgagcacgacctgctcgattcgaacgactattaccagttccagggcggcatggtcgccgcggtgcggcatctggccggcaatcagccgagcgtgtatcacgccgatcacagcaatcccgccgcgccgcgcgtgcgcacgctacacgaggagatcgcacgcgtgatccgctcgcgcgtggtcaatccgaaatggctcgatggggtgaagcgccacggttataagggcgcggccgagatcgcggcgaccgtcgattatctgtacggttacgatgcgaccgcgcgcgtgatcgcggatcatcaatatgcgctcgtgaccgatgcgtatctgaacgacgccgacacccgcgagtttttgcagcgacacaacccacatgcgttgcattcgatttgcgagcgtctgctcgaagccatgcagcgcggattgtggcaggcgcccggcgactatcgcgcgcaggtcgaacagcatctgctcgcgagcgagcagcag

SEQ ID NO: 28107 - DNA, 1884 bp, Burkholderia fungorum
ctgacgcggccaatgaagcgtgtcgggcgcaaaggcgaggggcgctttgagccgatcggctgggacgaggcgttccagctcgcggcgcgtcgcctgtcggaaattgcacatcgcgcgccggaggcaatcctcccttacagctatgccggcacaatgggcttgattcagggcgacagcattgcacaacggttcttccacaagctcggcgcctcgcaactggatcgcacgatttgcgcggccgccggcacagccgggctgaagtacacctacggcgcgagcctcggcatgctcaccgagtttttcgacgaaagcgagctcatcctcatctggggctcgaatccgatcgcgtcgaacctccatttctggacgcgcgcccaacaggccaaacgccgcggtgcacggctgatcgcaatcgatccgtaccgctcgctgacggccgaaaaatgccatcagcacatcgctttgaaaccgggcaccgacagcgctttggcgctcggtatgatcaacgtgttgatcagggaaaatctgctcgatcacgcttacatcgaagctcatacgtcaggttttgaagcgctgaaagcccgcgcgcttagctacccgccgtcgcgcgctgcggaaatctgcggtattgacgaacgggtgatcgtcgatctcgcacgactttacggtggcaccagaaaggccgcgatccgcatgaactacggcctgcaacgcgtacgtggcggcggcaatgccgtgcgcgcgatcgcttgcctgccgtcgctcacgggtgcttggcgcgagagagcggggggcgtgttgctgtcgtcgggcggctgggcgccggtcgactcgtatgcgttgcagcgtccggacctgatgccgggttggccgaccaggacgagccgcgtcatcaacatgaacgggatcggcgacgcgctgctgcacaagggcgacgcggcgttcggtcccaaggtcgaagcgatcgtcgtctacaactcgaatccggtggctgtcgcgccagattcggagcgagtcgccgcgggtttcgcgcgcgaagatctgttcacaatcgtcctcgagcatttccagaccgacacagccgactacgccgatctgttgctgcccgcgacaactcaactcgagcacctcgacgtgcacaagtcgtacggccacacgcacgtcatggtcaacctgccggcaatcgcgccggtcggcgaagcgcttccgaacacggagattttccgcggcatcgcgcgtcatatgggcctcgacgagcccgcgctgttcgagagcgacgagaccgtcgcgcaggcggcgtttcgctggcaagacagaacgctcgaaggcgtagattgggagaccctcaagaagaccggctgggccaagctgaatctgcccgatgcgcctttcgccgaaggggggttccaaacgccgtccggcaaatgcgagttctacagcgagcgcctcgcgcaacggggactcgacccactgccggactatctgcctccctacgaatccgctgatggcgcgccggaacttgccgcccgttatccgctggcgatgatctcgccgcccgcccgcaacttcctgaacagcaccttcgtgaatatcgaaagtctgcgttcgaccgaaggcgagccgcatctcgacatgcatccggccgacgcgcaatcgcgggatatcgtcgacggcgatcaggtgcgcatttttaacgatcgcgggtcgatgcaggcgcgcgtccgcgttaccgataaagcacgcgaggggctcgtggtgggcctgtcgatctggtggaagaagcttgctccggacggccgcaacgccaatcaggtcaccagccaggcgctcaccgatctgggcggatcggcgactttttacgactgcctcgtcgaagtcgagcgc

SEQ ID NO: 28108 - DNA, 1140 bp, Burkholderia fungorum
acccgtatcgtgcgtgccgaggaccagctcacgccgggcttcgagtcgttctcgatgccggtcacgcgcgcttcgacggtcgtgttccccgatctcgcgaccatgcgcgcgctcgactggaaaaacgacgcgcaatggcgctacggcctgcatgccacgccgacttcgctcgcgctggcgcagcgtctggccaccatcgaaggcggcaatcatgcgttgttgcagccgtcggggttgtcgtcgatttcgaacgtgtatttcggcctcgtcaaggcgggcgacgacgtgctgattcccgataacgtctattcgccgaaccgcgatcacggcgactggctggcgcgcgacttcggcgtctccgtgcgctattacaatccgatgatcggcgcgggcattgccgatctgatccggccgaatacgcgtctcatctggctcgaagcacccggctcggtgacgatggaagtggccgacgtgcccgccattaccgcggtcgcgcgcgcgcacaacgtcgtcacggcaatcgacaatacgtggtccgcggggctcggtttccgtccattcgatcatggcgtcgatatctcggtgcaggcgttgaccaagtatcagtcgggcggcggcgacgtgctgatgggcgcgaccattaccgtcgatcgcgaactgcatctgaagctgaaggcggcgcgcatgcgcatgggcatcggcgtctcgtcggacgactgctcgctgattctgcgcagcctgccgaccatgcaactgcgcttcgagcagcatgaccgcgcggcgctcggattggccaggtggttgaagacgcggccggaaattgccaccgtgttgcacccggcgctgccggattgtccgggccatgagtttttcgagcgtgatttcacgggcgcgggcgggctcttttccgtcgtgttcgacggccgttacagcccggcgcaaatcgacacgttctgcgagtcgctcgaactgttctcgctcggctggagctggggcggcgcgcacagcctcgcaatgccgtacgacgtcgcgtcgatgcgcacggcggggcagtggccgcatcgcggcacgttggtgcggttctatatcggtctcgaaaccgaggcggatttgcgtgcggatatcgagcagtcgctggcg

SEQ ID NO: 28109 - DNA, 834 bp, Burkholderia fungorum
gtagttggcacgggattgatgggcgtcggcattgcgacgcaaagcgcattgcacggacacagaacgatcgtccatgacgtggattcggcgcgtctggcgagcgtcgcgtcgaaagcgcaagccgtgctcgacgaactgatcgacgccgggcgtatcgaccgggcggcgagcgaggcggcgctggctcgcatcgaaacccatgcacaactcgacatgatggcgtcggcgaaattcgtgatcgaggcgattcccgaggtactcgaactgaagcatcgcctgtatgcggcgctgaccgggttgctggctgacgacgcgattctcgcgagcaacaccagcggcttcccgcccgatcaactggtcgcgccgttgcgcgcgaaagagcgcttcgtgatcgcgcatttctggaacccgccgcatatgattccgctcgtcgaagtcgtgccgggcacggcgaccgcgccggaagtgacgcagcagagcgccgcgttgatgagcgcgatcggcatggagccggtcgtgctggcgaaagcgattccgggtttcgtcggcaaccggttgcagttcgcggtactgcgcgaggcgttgaatatcgtccgctccggcgcggcgacgcccgaggtggtcgatcgcgtgatgaaggcgtcgctcggccgtcgctgggggatcgtcgggccgttcgagggcgcggacatgggcggcctcgataccttcctcgatatctcctcgcatctgatgccggaactggccaaagacgaaggcgtgctcgacctgttgcgcgcgcaggtcgatgcggggcgcgtcggcgtgcgcagcggcgccggcttttacgaatgg

SEQ ID NO: 28110 - DNA, 2448 bp, Burkholderia fungorum
tgcatcggtcgctttgaggcgaccctgcaattcactcttgaccttcctatcatgggaaggtcaatactggcctcatgatgcggcctgatgccgccacgagccctgcctgccatgaccgaacttgccaccgccccgcgccccgcgaacaccgccgatgccgcggacatttccgcccacaccgccgaactcgacatcggcggcatgacttgcgcctcgtgtgcgatgcgcgtcgaaaaggcgctcgccaaagtgccgggtgtcgtgagtgcttcggtgaatctcgcgaccgaaacggcgaccgtcgacctgaacggcgcggccgccggcccggatgcgctgatcgccgccgtcaggaaagcgggctatgaagcggccctggtcgcaccaccggacacgcccgcctctgccaacgagtcggcccccgccgaccgcaagcgcgaccagacccgccgcgaactggcggccgtgctcgcctccgccgtgctgacgctgccgctcatcggcccaatggtcggcgaatggttcggtttccacgcgatgctgtcgccgtggctgcaattcgcgctcgcttcggtcgtgcagttcgtattcggcgcgcgcttctatcgcgcggcctttcgtgccgtgcgggcgggcgccggcaacatggacttgctggtggcgctcggcacgtcggcggcgtatggcatcagcgtctatgaactggcgacccatcccggcgacatgatgcatctgtacttcgaagcgtcggcggtcgtgattacgctggtgcgcttcggcaagtggctcgaagcgcgcgccaagcgccagaccacggacgccatccgcgccctcaacgcgctgcgccccgaccgtgcgcgcattcgtgtcggcgccggcgagcgggacgtgccgctcgcgcaagtacgggtcggcacgatcgtgatcgtgcgccccggcgaacgcgtgccggtcgacggtacggtgctcgaagggcgcacgcatatcgacgaatccctgatcaccggcgaaagtctgccggtgccgaagcaggtagccgacgcagtcaccgccggctcgatcaacggcgaaggcgcgattgccgtgacgaccacggcgatcggcgcggagacgacacttgcgcgcatcatccgcctcgtggaaagcgcgcaggccgagaaggcgccgatccagcgcctggtggaccgggtcagcgaaatcttcgtgccggcgatcctcgccattgccgcgctcacgctggccggctggctgatcgccggcgcggccggtgaaacggcgattctcaacgcggtcgccgtgctggtgatcgcctgcccatgcgcgctcggactggccacgccggcggccatcatggccggcaccggtgtcgccgcgcggcgcggcgtgctgatcaaggacgccgaggcattggaaaccgcgcatcgggtaacgattgtcgcgttcgacaagaccggcacgctgacgctcggccagccgtcggtgacggcgttcgagccgatcggcggcatcagccgcgacgaagcgctagcacttgccgcggcggtgcagcgcaacagcgatcatccgctggcacgcgcagtggtcaaggcgtatgaagcggaagcggcagcgacagcggcggcggccgaggctgccgacatgcctgcggcaatcggtgaagccgtggcctcgcccactcgaacgcgcgcgctgcacgccagcgccgcgcgcgccgtggcgggccggggcgtcgaagcggacgtcgacggccgcaccctcgcgttgggcagcggacgctggctcggcgaactcgggattgaattgccgcccgaattcgccgcgcgcgcccgcgagctcgaagccgccggcaacacggtttcctggctcatgcagcgcgctccgctagcgccggtcgcactggcattgatcgctttcggcgataccgtcaaacccacggcgcgcgcggccgtcgaacggctggcgcagatgggcattacgagcgtgctggtcaccggcgacaaccggggcagcgcggcgagcgtcgcccgggcgctcggcatcgacgaattccatgcggacgtgctgcccgaagacaaagcccgtgtcatccgtgacctgaaaattcgcagcgccggcatcgtggcgatggcgggcgacggcatcaacgacgctcccgccctcgctgccgccgacatcggcatcgcgatggcgaccggcaccgacgtcgccatgcacgcggccggcatcacgctgatgcgcggcgatccggcgctggtggccgacgccatcgacatctcgcgcagaacgtggcgcaagatccggcagaacctgttctgggccttcgtctacaacctgatcggcattccgctggccgccttcggcttgctgaacccgatgctcgccggcgcggcgatggccttttcgagcgtcagcgtggtgaccaacgcgctgctgctgcgcacctggcgc

SEQ ID NO: 28111 - DNA, 720 bp, Burkholderia fungorum
atccgttctttgcttctgctgatctacttcgttctgttcacggtgccgtacgcgactgcatgcttcatcgcatttccgttcatgcgcgccgacaagcgctactggatggccgccggctggtgtcgcgccacgctgcatacggtgcgctggctgaacggtatccgctaccggatcgagggcatggagaacctccccgacggtcccgccgtgctgctctccaagcatcaatcggcatgggaaacgctggcgtttccggcgttgatgccgcggccgctgtgctacgtgttcaagcgtgaattgctgtacgtgccgtttttcggctgggcgctcggcctgctgaagatggttcacatcgatcgcaaggaaggcaagtacgcgttcgaatccgtcattaaacaaggcaaggcgcgcatggcggaaggcgcgtgggtcatcatgtttccggaaggcacacgcacccgcaccggcacgcaaggcaagtacaaaaccggtggcgcgcgtttcgcgatagcgaccggcgcaccggtcgtgccgatcgcacacaacgcaggacgtgtgtggcctcgcaactcgtttctcaaatatgcgggtatagtcacagtgtcgatcggcaagccgatcgagacgacggggctcacgcccgatgaagtgaacacgcgcgtcgaacggtggatcgaagctgaaatgcgtcgcatcgatcctaccgcgtaccgcgcggcg

SEQ ID NO: 28112 - DNA, 438 bp, Burkholderia fungorum
atgagcaccgaaaaaatcaatctcgacattcataagattctcacgctgctgccacatcgttacccgatcctgctggtggaccgggtgctcgaactcgagccgcacaagaacatcaaagcgttgaagaacgtgtcgatcaacgaaccgtatttccagggccactttccgacccgtccggtcatgccgggcgtgctgattctcgaagcgctcgcgcaaacggcggctttgctgacgttttcggaagagccgagcgacccgtcgaacacgctgtatctgttcgtcggcatcgacaatgcacgcttcaagcgcgtggtggaaccgggcgatcagctgatcctgaactgcacgttcgagcgtcatatgcgcggcatctggaagttcaaggcgcgcgccgaagtggatggcgtagtagcggcggaagccgacctgatgtgcgcg

SEQ ID NO: 28113 - DNA, 2352 bp, Burkholderia fungorum
gtagttccgttcgagcagttgcggatgaccgacgtggaaattgtcggcggcaagaatgcgtcgcttggcgagatgatcagtcagctcgctgaagccggcgtgcgcgtgccgaccggtttcgccaccacggcgctggctttccgtgacttcctgcagcacaacaatctgaccgaacgcatcgccaaacgtctcgaaacgctcgacgtcgacgacgtgaagtcgcttgccgaagcgggcaaggagatccgtcaatggatcgtcgaggcgccgctgcagccgcagctcgaggctgatatccgcgcgggcttcgacaccctgcaaaacagctcgcctgaagagctgtcgttcgccgtgcgttcgtcagcaacggccgaagacctgccggacgcttcgtttgcggggcagcaggaaagctacctcaacgtggtcggcatcgacgacgtgctcgatcgcatgaagcacgtgttcgcgtcgctgtacaacgaccgcgccatctcgtatcgcgtccacaagggcttcacccacgctgaagtcgcgttgtcggcgggcgtgcagcgcatggtgcgctcggacgtcggcgcagccggcgtgatgttcacgctggacaccgaatcgggcttcaaggacgccgtcttcatcacgtcgagctacggtctcggtgaaaccgtggtgcaaggcgcggtgaatccggacgagttctacgtctacaagaccacgctcgcgcaaggcaagtacccgatcatccgccgctcgatcggctcgaagctgatcaagatggaattcaccaaggcgggcgaagaaggccgcgtgaagaccgtcgacgtgtcgcacgagcagcgcaaccgcttctcgatcacggacgaagacgtgatcgaactggcgaaatacgcggtcatcatcgaaaagcactacgagcgtccgatggacatcgagtggggcaaagacggtcgcgacggcaagatcttcattctgcaggcgcgtccggaaacggtgaagagccaggcggccggcaaggccgagcagcgcttcaagctgaagggtcaatcgaacgtgctggctaccggccgcgcaatcggtcagaagatcggcgcgggtccagtgcgcgtgattcacgatccgtcggaaatggaccgtgtgcagccgggcgacgtactggtcgccgacatgaccgacccgaactgggaaccggtcatgaagcgcgcgtcggcaatcgtcacgaaccgtggcgggcggacctgccacgcggcgatcatcgcgcgtgagctgggcgtgccggcggtggtcggctgcggtgacgcgaccgacgtgctgaaggaaggcgcgctggtcacggtatcgtgcgcggaaggcgacgaaggcaagatctacgacggcctgctcgaaaccgaaatcaccgaagtgcagcgcggcgaactgccaccgattccggtgaagatcatgatgaacgtcggcaacccgcagctggctttcgacttctcgcaactgccgaacgcaggcgtgggtctggcgcggctcgagttcatcatcaacaacaacatcggcgttcacccgaaggcgattctcgagtacccgaacatcgatcaggacctgaagaaggcggtggaaagcgtcgctcgcggtcacgcatcgccgcgcgcgttctacgtcgacaagctgaccgaaggtatcgccacgatcgcggcggcgttctatccgaagcccgtgatcgtgcgtctgtcggacttcaagtcgaacgagtacaagaagctgattggcggttcgcgctacgagccggacgaagaaaacccgatgctcggtttccgtggcgcgtcgcgctacattgccgacgacttcgccgaagcgttccagatggaatgcatcgcgctgaagaaggtgcgcgaagagatgggcctcgacaacgtcgagatcatggtgccgttcgtgcgtacgctgaagcaggcggaacgcgtggtcgggctgctggccaagtacggcctgaagcgcggcgaaaacggcctgcgcctgatcatgatgtgcgaagtgccgtcgaacgcgatcctcgctgaagaattcctgcaattcttcgacggtttctcgatcggctcgaacgacctgacgcagctcacgctcggcctcgaccgcgactccggcatggaactgctggcggtggatttcgacgaacgcgatccagcggtcaagttcctgttgaagcgcgcgatcgacacctgcctgcgactggacaagtacgtcggtatctgcggccagggcccgtcggatcatccggactttgcgcaatggctgaccgatgaaggcatcaagtcgatctcgctgaacccggacacgatcatcgagacgtggcagcaactggcgaag

SEQ ID NO: 28114 - DNA, 762 bp, Burkholderia fungorum
ctgacaggcaagcgcgggctggtggttggcattgcgaacgagcacagcatcgccaccggttgcgcgacgctgtttcgcgccgccggcgcggagctggctgtcacctacctgaacgacaaggccgaaccattcgtccgtccggttgcgcagacgcttcagtcacctcttgtcatgccctgcgatgtgcgcgttccgggccaactggaagcggtcttcgagcggatcacgaaagagtgggggcggctcgacttcgtacttcattcgatcgccttcgcacccgccgacgacctgcatgcgagcctggtggactgctcggccgagggtttcgcactcgcgatggacgtgtcgtgccattcgttcatccgcatgacaaggcttgcgctgccgttgatgcccgacggcggcagcctgatgaccgtgagctttctgggcgccgagcgtgcggtcgatcactacaacgtgatgggccccgtcaaggccgcgctcgaatcgagcgtgcgctatctcgccgtcgatctggcggcacgccgcgtccatgtccatgccatttcggcgggcgcagtcaaaacacgcgccgcctccggcatcgaccatttcgacgcgctgctcgacgacgtccgctcgcatacgccggcgaagcatcttgtcacgatcgaggaaatcggccgagttgcaaccgtgctcgcgagcgaggccggcatgacactgacgggatccaccatctatgcggacgcgggcttccatatcacggcatgagccgat

SEQ ID NO: 28115 - DNA, 720 bp, Burkholderia fungorum
atgacaagaacagcattgattactggcggagtaagcggaatcggggcggcaacggcgaaacagttgcaaagcggcggctattcggtgattgccaactatttcggcaacgatgccgaagcagatgcattccacaaggaaaccggcattcccatcttcggctggaacgtggccgacttcgatgccactcagcaagcggttgcgaagatcgtcgcgcaatcggggccgatcgatattctggtgaacaacgccggcatcacccgcgacagcacgctgcacaagatgacgctggagcaatggcgcagtgtcatcgacgtggatctgggcggctgcttcaatacgtgccgggctgtcatagaaagcatgcgtgagcgccgctttggacggatcgtgaatatcagttcggtgaatgcgctttccgggcaatttggccagacgaactattcagccgcaaaggcgggcctcataggtttcaccaaggcgctcgcgctcgaaggcgcgtcccgaggcattacggccaacgtgatcgccccgggttatacggatacgggcatggtgcacggtgtgccggatgagattctgaaaacgatcgtcagcggtgtaccggcgggaagactggcaactccagatgaaattgcacgcggcgtcgtcttcctcgttgccgatgaagcggcgttcatcaacggagccacgctgtcgatcaacggcggcaaatatatggcg

SEQ ID NO: 28116 - DNA, 1485 bp, Burkholderia fungorum
gcttccaccatcctcgccgacctgggcatcgcccacgcggcgcaagccggcgacatcgcggttcattcgcccattaccggcgaactcatcggccgcgtggccagcaacaccgtggcggaagtcgacacggccctcgctcaggcgaaacaggcgtacaccgcctggcgcaacgtcccggcgccgcgccgcggcgaactggtgcgtctgctcggcaaccgtctgcgtgagaagaagcaggcgctcggcagcatcatcacgctcgagaccggcaagattcttcaggaaggcatgggcgaagtgcaggaaatgatcgacatctgcgatttcgcggtcggtctgtcgcgccagttgtacggtctgacgatcgcttcggaacgtccggggcaccgcatggcggagacgtggcatcccgtgggcacttgcgtcgtgatctcggcattcaattttccggctgcggtgtggtcgtggaatgcggcgctcgcgctggtctgcggcaatgcggtgatctggaagccgtcggaaaagacgccgcttaccgcgctcgccgtcaatcagattctgagcgaggcgctgcaggagttcggcgacgcgccggccggcctcaccgcgttgatcaacggcggccgcgacgtgggcgcgaagctggtggccgacccgcgcgcgtcgattgtcagcgctacgggcagcacggaaatgggccgcacggtcggcgtggaagtggcgaagcgctttggccgctcgctgctcgaactcggtggcaacaacgcgggcatcgtcacgcaaacggcggatcacgaactcgccatgcgcggcattctgttttcggcggtgggtacggcggggcaacgttgcacgtcgctgcgccgtttgttcgtgcacgagagcgtgtacgacaaaaccatcgaacgtctgaagcagctgtacagcaaggtgccgatcggcaatccgctcgaaaagggcacgctgatggggccgctgatcgacaagcaatcgtatggccgcatgcaggaagcgctgcaacaggctacggccgaaggcggcaaggtgttcggcggcgagcgcgtcgaggtgaagggatatgaaggcggctactacgtgcgaccggcgattgtcgaaatgccgtcgcaaacgtcggtggtgctgaaggaaacgttcgcaccgattctgtacgtgctgcgctataccgatttcgccgacgcggtggaagcgaacaatgcggcggtgcatggtttgtcgtcgtgtgtattcaccaccgatctgcgcgaagcggaacgcttcctgtccgattcgggcagcgactgcggtatcgcgaacgtcaacatcgggccgagcggcgcggaaatcggcggcgcgttcggcggcgagaaagaaaccggcggcggccgcgaatcgggttcggacgcgtggaaagcctatatgcgccgcgctaccaacacggtcaattactcgtcggcattgccgctcgcgcagggtatcgacttcaat

SEQ ID NO: 28117 - DNA, 1128 bp, Burkholderia fungorum
attcgtgaagccgtacgcgatctgtgccagcagtttgccggcgagtacttccgcaagatcgacgaagcacgcggctatccggaagaattcgtcgatgcgctcaccaaggccggctggctggccgcgctgattccgcaggacttcggcgggtcggggctggggctgacggaagcgtcggtcatcatggaagaaatcaatcgtgcgggcggcaactcgggcgcgtgccacggccagatgtacaacatgggcacgctgctgcgtcacggctccgaagagcagaagcagaagtatctgccgaagatcgcctgcggcgacttgcgcctgcaatcgatgggcgtaaccgagccctccaccggcacggataccacgaagatcaagaccaccgccgagcggcgcggcgaccgctatgtgatcaacggccagaaggtgtggatctcgcgcgtgcagcattcggatctgatgattctgctcgcgcgcaccacgccgcttgcggaggtgaaaaagaaatcggagggcatgtcgatctttatcgtcgatctgcatgaagcgatcggccacggaatgaccgtgcagccgattctgaacatggtcaatcacgagaccaacgaactgttcttcgacaacctcgaaatccccgccgagaatctgatcggtgaagaagggcagggcttcagatacattctcgacggcctgaatgcggagcgcacgttgatcgccgccgaatgtatcggcgacggttactggttcgtcgacaaagtgactgagtacgcgaaagagcgcatcgtattcggccggccgatcggccagaaccagggtgtgcagtttcccatcgcgcgttcgttcatcaacgtcgaagcggccagcctgatgcgattcgaggcggcacgccgtttcgacgcgcatcagccgtgcggcgcgcaggcgaacatggcgaaactgctcgcggccgacgcatcatgggaagcggccaacgcgtgtctgcaattccacggtggtttcggttttgcctgcgagtacgacgtcgagcgcaaattccgcgagacgcgtctctatcaggtcgcgccgatttccaccaacctgattctttcgtacgtggccgagcatattctcgggctgccgcgttcgttc

SEQ ID NO: 28118 - DNA, 1143 bp, Burkholderia fungorum
ctgatgtacatcacgaaccggcccgaaatcgttttcacgcacggcaaaggctcgtggctctacgacaacaacggcaagcgatatctggacttcatccagggctgggcggtcaacagcctcggtcattgcaacgacggcatgatcgaagcgctgaacaaacaggcgcaattgctgatcaacccgtcgccggccttctacaacgagccgatggcgaaactcgccggcctgctcacgcaacacagctgtttcgacaaggtgttcttcgcgaacagcggcgccgaagccaacgaaggcgcgatcaagctcgcgcgcaagtggggcaagaagttcaaggacggcgcattcgagatcatcacgttcgatcacagcttccacggccgcacgctggccaccatgtcggccagcggcaagccgggttgggacacgatctacgcaccgcaagtgccgggctttccgaaggcggacctgaacgatatcgcgtcggtggaaaaactcatcaatgcgaagaccgtggccgtgatgctcgaaccgatccagggcgaaggcggcgtgattcccgccacgcgcgagttcatgcagcaactgcgcgcgctgacgaacaagcacaacctgctgctgatcgtcgacgaagtgcaaagcggctgcggccgcgcgggcacgctgttcgcgtacgagttatcgggtatcgaaccggacatcatgacgctcggcaagggcatcggcggtggcgtgccgctcgcggcactgctctcgaaagcggacgtcgccgtgttcgaagcgggcgaccagggcggcacctacaacggtaatccgctgatgacggcggtcggctactcggtgatctcgcaactcaccgcgccgggcttcctcgaaagcgtgcgggcgcgcggcgagtatctgcgctcgaaactgctggagttgtcggaagagcgcggcttcgtgggcgaacgcggtgaaggcctgttgcgcgcactgctgctcggcaaggacatcggcaaccagatcgtcgagaaggcgcgcgacatgcagcctgatggcctgctgctgaacgcggcgcgtccgaacctgctgcgcttcatgccggcgctgaacgtgagcaacgaagaaatcgaccagatgatggcgatgctgcgttcgattctc

SEQ ID NO: 28119 - DNA, 1350 bp, Burkholderia fungorum
ttgaatagtgcacagcagcaagacggcctgaagcgggggctcaagaatcgccacatccagctcatcgcgctgggcggcgcgatcggcacggggctctttctcggctccgccagcgtgttgcaggcagccggcccgtcgatgattctcggctacgcgatcggcggcgtcatcgccttcatgatcatgcggcagttgggcgaaatggtggcgcaggagccggtggccggttcgttcagccacttcgcgtacaagtattggggcgactttccgggctttctgtcgggctggaattactgggtgctgtatgtgctcgtgagcatggccgagctgactgctgtcggcacgtatgttcattactggtggcccggcgtgccgacgtgggtgtcggcgctggtgtgctttgccgccatcaacgcgatcaatctcgccaacgtcaaggcctatggcgaaacggagttctggttcgcgatcatcaaggttgcggcggtgatcggcatgatcgtgttcggcggctatctgctgattagcggccacggcggcccgcaagcgtcgatctccaacctctgggctcacggcggttttttcccgcacgggtttcatggtctgttcatgatgctcgcggtcatcatgttctcgttcggcgggctggagttgatcggtattacggcggcggaggccgacgagccgcagaagagcattccgaaggccgtgaatcaggtgatctaccggattctgattttctacatctgctcgctgacggtgctgctgtcgttgtacccgtggaacgaggtcgcggccggcggcagtccgttcgtgatgatcttttcgcagattggttcgacgctgaccgcgaacgtcctcaacgtggtggtgttgaccgcggcgctgtcggtgtacaacagcggcgtctatgcgaacagccgcatgctctacggtctcgcggagcagggtaacgccccgcgcgcgctgatgaaggtcgaccggcgcggcgtgccgtatatggcgatcggtttgtcggcgctcgccacgttcacgtgcgtgatcgtcaactacctgattccggccgaagcgctcggcttgctgatggcgctggtggtggcggcgctcgtgctcaactgggcgctgatcagcatcacgcatctcaagtcgcgcaaggcgatggtcgcggcaggcgagacgctcgtgttcaagtcgttctggttcccggtcagcaactggatctgcctcgcgttcatggcattgatcctcgtgattctggcaatgacgcccggtctgtccgtttcagtgtggctggtgccggcgtggctggtggtgatgtgggccggctatgtgttcaagcgccggcgcgcg

SEQ ID NO: 28120 - DNA, 1071 bp, Burkholderia fungorum
cttctgaacgatactttcctgcgcgcgctgctgcgccagccgaccgactacacgccgatctggctgatgcggcaagctggccgctacctgccggaatacaacgccacgcgcgctcgcgcgggcagcttcctgggtctggcaaaaaacccggcgttcgcaacggaagtcacgctgcaaccgctggagcgctatccgctcgacgccgcgatcctgttctccgacatcctgaccgtgcccgacgcaatgggtctgggcctcgagttcgtgactggcgagggccccaaattcgcgcgcccggtgcgcacggaagacgacgtcgcgcgcctcgcggtgccggacatcgacgccacgctgcgctacgtgaccgacgccgtgcgcgaaattcgcaccgcgcttaccgacgcgcagggccgccagcgcgtgccgctgatcggtttttcgggcagtccgtggacgctcgcgtgctacatggtcgaaggcggcggttcggcggacttccgcacggtcaagtcgatgttgtatgcgcgtccggacctcatgcatcgcattctcgacgtcaacgcgcgcgcggttgcggcctacctgaacgcgcagatcgaagccggcgcgcaagctgtgatgattttcgacacatggggtggggcgctggcggacggcgtctatcaacgcttttcgttgcactacatccagcaggtggtgagtcagctaaagcgcgaccatgacggcgaaaaagtgccggtgatcactttcaccaaaggcggcggcctgtggctcgacgagatcgccgaaaccggcgtggatgcggtcggcctcgactggaccgtgaacctgagcaaggcccgggagcgcgtgggcggcaaggtggcgctgcaaggcaatatcgatccgtcggtcctgtttgccccgccggctgcgatccgcatggaagcgcgcgccgtactggacagtttcggtaaccatccgggccatgtgttcaacctcggccacggcatttcgcagttcacgccgccggagcacgtcgccgaactggtggacgaagtgcatcgtcatagccgggcaattcgcagcggc

SEQ ID NO: 28121 - DNA, 3693 bp, Burkholderia fungorum
ttcctcgatttcgcgcaaaacgtgcaaccgcaatcggtgctgcgcgccgcgatcacggccgcttaccgtcgtcctgagccggagtgtttgccgttcctgctcggtcaggcgcgtttgccggccaacctcgcgggcgacgtgcagacgatggccggcaagctcgtcgaaacgctgcgcacgaagagcaagggcggtggcgtcgaaggtctgatccacgagttctcgctgtcgagccaggaaggcgtggcgctgatgtgtctcgccgaagcgctgctgcgcattcccgaccgcgccacgcgcgacgcgctgatccgcgacaagatcagcaagggcgactggaaatcgcacatgggccaggcgccgtcgatgttcgtcaacgccgcgacctggggcttgatgatcaccggcaagctggtgacgaccaacagcgagacgagcctctcgtcggcgctcacgcgtctgatcggcaagggcggcgagccgctgatccgcaagggcgtggatatggcaatgcgcctgatgggcgagcagttcgtcacgggtgagaacatctccgaggcgctcgccaacagccgcaagtacgaagcccgcggcttccgctactcgtacgacatgctcggcgaagcggccaccaccgaagccgacgcgcagcgctactacgcgtcgtacgaacaggcgatccacgcgatcggcaaggctgccggcggccgtggcatctacgaaggcccgggcatttcgatcaagctctccgcgctgcacgcacgctactcgcgttcgcagcaggaacgcaccatgagcgaactgctgccgcgcgtgcgctcgctggcaatcctcgcgcgccgctacgacatcggcctgaacatcgacgcggaagaagccgaccgcctcgaaatctcgctcgatctgctcgaagcgctgtgcttcgatccggagctggccggctggaacggcatcggcttcgtggtgcaggcgtatcagaagcgctgcccgttcgtgatcgaatacctgatcgatctggcgcgccgcagccgtcaccgcatcatggtgcgcctcgtgaagggcgcgtactgggacaccgaaatcaagcgcgcgcaagtggacggcctcgaaggctatccggtctacacgcgcaagatctacacagacgtgtcgtatctcgcctgcgcgaagaaactgctcagcgcgcccgacgcggtctacccgcaattcgccacgcacaacgcgcacacgctgtcggcgatctatcacctcgcgggcaacaactattaccccggccagtacgagttccagtgcctgcacggcatgggcgaaccgctgtacgaagaagtcaccggccgcgacaagctgaaccgtccgtgccgggtgtacgcgccggtcggcacgcatgaaacgctgcttgcctatctcgtgcgccgtctgctggaaaacggcgcgaacacgtcgttcgtgaatcgtattgccgatgaaaccgtcgcgatcaaggacctgatcgccgatccggtcgatgaagcctcgaagatcgtcccgctcggcgcgccgcacgcgaagattccgctgccgcgcaatctgtacggttcggaacgcctcaactcgatgggtctcgacctgtcgaacgagcatcgcctggcgtcgctgtcgtcggcgttgctggcgagcgcgcatcatccgtggcgcgccgcgccgatgctcgaagacaacgagatcgccgtgggcctcgcgcgcgacgtgcgcaatccggccgatcatcgcgacctcgtcggcacggtcgtggaaacgacgccggagcacgtgagcgccgctttggcgcacgcggtggccgccgcgccgatctggcaagccacgccggtcgatgcgcgcgccgattgcctcgcgcgtgccgccgatctgctcgaagcgcagatgcatacgctgatgggcctcgtggtgcgtgaagccggcaagtcgctggccaacgccgtcgcggaaattcgcgaagcgatcgacttcctgcgttactactccacgcagattcgcgaggagttctccaacgacacgcatcgtccgctcggcccggtggtctgtatcagcccgtggaatttcccgctggcgattttcatgggccaggtggccgcggcgctcgccgccggcaacaccgtgctcgcgaagccggccgaacagacgccgctgatcgccgcgcaagccgtgcgcattctacgcgaagccggcgtgccggcgggcgcggtgcaactgctgccgggcaacggtgaaacggtcggcgccgcattggtggccgatccgcgcacccgcgcggtgatgttcaccggctcgaccgaagtcgcacgcctcatcaacaagacgctgtcgagccgactcgatccggatggcaagccgattccgctgatcgccgaaacgggcggccagaacgcgatgatcgtcgactcgtcggcgcttgccgaacaggtggtggcggacgtgctgcaatcgtcgttcgactccgccggtcaacggtgttccgcgctgcgcgttctttgtctgcaggacgatgtcgcggaccgcacgctggaaatgctgaccggcgcgatgcgcgaactggccgtgggcaatccggaccgtctgtcggtcgacgtcggcccggtgatcgacctcgacgcgaagcgcggtatcgacgcgcacgtcgcggcgatgcgcgagaagggccgcaaggtcgagcagctgccgatgccggacggttgcgcgcaaggcaccttcgtgccgccgacgttgatcgaactcgacagcatcgacgaactgaagcgtgaagtgttcggcccggtgctgcacgtggtgcgctaccgccgcagccagctggacaaactgctggagcagatccgcgcgaccggctatggcctgacgctcggcatccatacgcgtatcgacgaaacgatcgcgcatgtgatcagccgcgcgcacgtgggcaacatctacgtgaaccggaacgtgatcggcgctgtggtcggcgtgcagccgttcggtggcgaaggtttgtcgggcacgggtccgaaagcgggcggcgcgctctatctgcagcggctcctcgccacgcgtccggccggtttgccgaagtcgcttgcgcgggctttggtcgtggatgttccgcgcgcggccgaaaacggcgacaatccgtccgctgtattgacggcttaccgcgactggctgattaccgaacgcgagccgcaactggccgcgcgctgcgacggctatctgtcgcatgtgccggcgggcgccacggcggtattgtcgggaccgaccggcgagcgcaacacgtacacgctgggcgcgcgcggcacggtgctgtgtatcgcgtcgacggcgagcggtgcgcgcgtgcagtttgccgcggcgctggctacgggaaatcgcgcgttgttcgaaggcgcggctggggaacaattggtgtcgcagttgcccgcctcgctgaagtcgcacgcaagcgtgaagaagagtgccgatacgccgttcgacgccgtgctgttcgaaggcgatagcgacgaactgctggcgctggtgaaggaagtcgcgaagcgtccaggcccgatcgtgtcggtacagggcgtcgcggcacgcgcgctggaaagcggcgacgaggactacgcgctcgagcgtctgttgacggaacgctcggtcagcgtcaatacggcagctgcaggcggtaatgcgaatttgatgacgatcggt

SEQ ID NO: 28122 - DNA, 375 bp, Burkholderia fungorum
agcatcccggccgatctgaaatacaccgaatcgcacgagtgggtccgcaccgaagcggacggcacactgacggtcggcatcaccgaccacgcgcaggaagcgctcggcgatatcgtcttcttcgaagtccaggaactgggcaagaccgtgagcgcgggcgacaccgtcgccgtgatcgaatcggtcaaggccgcttccgatatctacgcgccggtttcgggcgagatcatcgaagcgaacagcgccgtggccgatacgcctgatctggtcaacagcacaccgtacgaaagctggctcttcaagatcaagccggccgcggacgccgcgctggaccgtctgatcgacgccgacgcatacagcaagtcgatcggcgcc

SEQ ID NO: 28123 - DNA, 1995 bp, Burkholderia fungorum
ctgaaccccgctcaaaatgaagcggtccgttatctcgacggtccgtgtctcgtgctcgccggcgcaggcagcggcaagacgcgcgtgatcacgcagaaaatcgcgcacctgatcgaggccaagggcttcgagccgcgccacatcgccgccgtcacgttcacgaacaaggccgcgctggaaatgcgcgagcgcgtgggcaagctgctggaaggcaagacgctcaccacgccaggcaaggaaggccgcaaagtgcccgtcaaccagttgacggtgtgcaccttccactcgctcggcgtgcagattctgcggcaggaggcggaacacgtcggcctgaagccgcagttctcgatcatggattcggacgactgcttcggcatgatccaggagcaggtcggctcgacggacaagggtttcatccgcaagatccagtcgatcatctcgctgtggaagaatggcatgatcatgcccgagcaggcgattgcgattgcggcgaacgaggacgagcatcaggccgcgatcgtctaccgcaattacgtggccacgctgcacgcgtaccaggcggtggatttcgacgatctgatccgcctgcccgccgagctcttcgcgaagaacgagcaggtgcgcgaccgctggcagaacaagctgcgctatctgctgatcgacgagtatcaggacaccaacgcctgccagtacgaactggtgaaactgctggccggcaagcgcgctgcgttcacggcggtgggcgacgacgatcaggccatttacggctggcgcggcgcgacgctcgaaaatctcgggcagctcagcaaggactttccgaagctgcatctgatcaagctggagcagaactaccgctcgacggtgcgcattctgaccgccgcgaacaatgtgatcgcgaacaatccgaagctgttcgaaaagaagctgtggtccgaacacggcatgggcgacacgatcaccgtcacgccctgcaacgacgaagaacacgaggcggagtccgtggtgtttcgtctgtcggcgcacaagttcgagcggcgcgcgaatttccgcgactacgcgatcctctatcgcggcaatttccaggcgcgcatcttcgaacaggtgctgcggcgtgagcggattccgtatgtgctgtccggcggccagtcgttcttcgacaaggccgaaatcaaggacatctgcgcctatctgcgcctgatcgccaacgcgaacgacgaccccgcgttcatccgcgcgatcaccacgccgcgccgcggcgtcggcaatacgacgctcgaggcgctcggctcgttcgcgggtcaggccaaggtgtcgctgttcgaagccgtgtatatgggcggcatcgaggcgcgcctgtcgccgcggcagatcgaacccatgcgcgtgttctgcgacttcatgcagcgcctcaccgatcgcgccgagaaagacgccgccggcacgctgctcgacgaactgatggacgccatccactacgaagcctacctgtacgacgcgttcgacgaacgtcaggcgcagtccaagtggcagaacgtgctggagttcatggagtggttgaaacgcaaaggcaccaaggctgagccgacgggcgccgcggcgaacgaagccaccggctacgacaccgccgatggtctcggcgacaccggcaaaagtctgctgggtctgatccagaccgtcgcgctgatgtcgatgctcgaaggccgcgaggaagatcccgacgcggtgcggctctcgacggtgcacgcgtcgaaggggctcgagtatccgcacgtgtttctggtcggagtggaagaaggcatcatgccgcatcgcggcggtcccgacgacgagccgatcgacgacgcgcgcatcgaagaagagcgccggctcatgtatgtggcgatcacgcgtgcccagcgcagtttgcatctgaactggtgcaagaagcgcaaacgcgcgcgcgaaacggtggtgtgcgagccgtcgcgcttcattcccgaaatgctgctcgacgac

SEQ ID NO: 28124 - DNA, 720 bp, Burkholderia fungorum
gcactcccggctgttctgtctccaggcgagacggcatttttcttcgatttcgacggcacactcgtcgaactcgctcccacgccggacggcgtgctggtgcaacctcgcgtgatcgacttgctgagcgagttgcgcagcctgacgaacggtgccgtcgcggtggtgtcggggcgtgggatcgacagcatcgacagttttctgggtattcccgatctgccgattgccggtctgcacggcgccgaacggcgtgacgcgaacggcgacacgcaacgcatcggctttcatgacgagcggctcctgcgcatggagcaggtgctcgcgcaagtggtcaacgaaaaccccggcatgctgctcgagatcaagggcgcggccgtggcgctgcactaccggaatgcgccggaccgcgagccggtggcgcgcgaggcaaccagccggctggtcgccgattacgccggcgcctacgtgttgcagccgggcaagatggtctacgaaatcaaaccgaaagatgtcgacaagggccgcgcgctgcgcgcctttctcgacgagccgcctttcgtcggccgccagccggtctttgccggcgacgatctgaccgacgagaaaggcttcgccgtcgtcaacgaacgcggcgggctgtcgatcaaggtcggcccgggcgagacgatggcgcgaacgcgcatcgactcggtcccggcgctgctcgactggctggcatcgatc

SEQ ID NO: 28125 - DNA, 1380 bp, Burkholderia fungorum
atgggccgactgatcatcgtatcgaaccgggttgcgccgatctcggagggcggcccggcggcgggtggtctggcggtcggcgtgtacgacgcactgaaggaaaccggcggcatgtggttcggctggagcggcgacgtgctcagttcgggccagccgcagatcaaggtcgaagagcgcggcccggtgaccttcgcgacgatcgcgctgatgcgccgcgattacgatcagtactaccgtggcttctcgaacgcgacgctgtggcccgcgttccactatcgcgccgacctgctgcaatacgaccggcacgacttcgagggctactggcgcgtcaatgcctggctcgcgcaacaactcgtgccgctgttgcgcgaagacgatgtgatctgggttcacgactatcacctgattccatttgcgcaggcgctgcgtgcggcgggcgtgaagaatcgcatcggcttttttctgcacattccgtttccggcttcccaggtgctgctggcagtgccgccgcatcgcgaacttgtcgaagcgctgtgttcgttcgatctgctcggcttccagactgcgccggatttgcgcgcgttctgcgactacatcgtcaatgaggcgaacggcaccgccgacccatcggcaagcggtccgctgacgatccacgcgttcggccgcacgctgcgggcggcagcttatccgatcggcgtctatccggacgagatcgccgaactcgcgaaagcgggcgagcgcggcaaaccggtgcgcacgatgaaggcgacgctgcactcgcgcaagctgatcatgagcgtggaccggctcgattactcgaaggggctggtcgagcgttttcgcgccttcgagcgtctgctcgaacactcgaccgcgcaacgcaacaaggtgtcgttcctgcagatcgcgccgccgacgcgcgccgacatgcacgcataccaggacatccgcttgcagctcgaaggggagtcggggcgcatcaacgggcgcttcgccgaactggactggacgccgattctctacatccacaagcaatacgagcgctcggtgctggccgcgctgttccgcaccgcgcatgtcggctatgtcacgccgttgcgtgacggcatgaacctcgtcgccaaggagtacgtatcggcgcaggatccggagaatcccggcgtgctcgtgctgtcacgctttgccggcgccgcgcaggaactggacggcgcgctgatcgtcaatccggtcgacatcgacggcatggccgaggcgctcgcacgggcgctcgacatgccgctcgcggagcgtcaggcgcgtcatcgcgacatgatggtgcagttgcgcgagaacaatgtgtcggtgtggcgcgataacttcatgcgcgatctgcagggcgtc

SEQ ID NO: 28126 - DNA, 1428 bp, Burkholderia fungorum
ctgttccagtatctgagcggacattcgccgacctattactccgagaagcagccaggcatgctcgcgagccggatcacggccacctcgaacgcggtctacacagcggagaacaccaccgcctggaacgtgctgccgccgtgcattgcggtgctcggcgcgatcgtcatgatcatcgcggtgaatccgctgatggccggcggcctgatgctgtgctcggcgattctgtcggtcgtgctgtacaagctggccggccgcggctcggcgcgtcatcaccatttcgccaccagggccgcttcggtggacggcgagctggtcgacgtgatcagcaacatgggcctcgtgcgcgcgttcggcatgacgtttcgcgagcagcagcggttcggcgccacggtcaaggccgagatggacgcgcgccagcaaagcctgctgtatctggaaaagctgcgcctgctgcatgccgtgatcaccgcgctgctgtcggcgggcttgctgggctgggcgctgtggctgtgggatcagggcaaggcgacctcgggcgacatcgtgctggtcagttcgctcggcttcacgatcctgcacggcacgcgcgatctggccgtggcgctcgtcgacgtcacgcagcacgtggcgcgtctcgcggaagccgtgcgtacgctgctcgagccgcacggcatgccggaccgggacgacgcgaccgaactcgtgccgcagggcggccgcatcgatttcgaaagcgtgacgttcgcctatccgcgccggcgcccgattctcgaccatttcgacctacatatcgaaccgggccagcgggtcggcctgatcggcaagtcgggcgcgggcaaatccacggtgctcgccctgctgcagcgtttctacgagacgcagggcggcgcgatcaggatcgacggccaggacatcggcatggtcacgcaggacagcctgcgccacgccatcgcggtggtgccgcaggacatctcgctgttccatcgcacggtgtacgagaacatcgcctacgggcgtccggaggcgacccgcgaagaagtgctcgccgccgcgcgcgaggcgcgttgctcggatttcatcgaggccatgccggagggctacgacacgatcgtcggcgatcgcggcgtgaagctgtccggcgggcagcgtcagcggatcgccattgcccgcgcgatcctgaagaacgcgccgatcctgctgctcgacgaagcgacctcggcactcgacagcgcgtcggaagaagccattcagaaggcgctcgaccggctgatggtcggccgcaccgtggtcgcgattgcgcaccgcctgtcgacgctgaacaacttcgaccggatcatcgtgatgagcgccggcaaggtgatcgatgacggcagcccggaagagctgcgccagcgcccgggcctgtaccgcgatctgctctccaagcag

SEQ ID NO: 28127 - DNA, 1698 bp, Burkholderia fungorum
tggcgcatcgtcgtcatcacggcgctggtgctgctctccgcattggccgacgtgctcacgccgatgttcgcgggacacctcgtcgacgccatcgcgtccggcgcggccagcaacgccgttgcgtggcgcgcggcggtgacggctttctgcgtgctgggcgcgctcggtctcggcgccacgctgctgcggcaaggcgtgtacttcaacatcatccggctcacgctcaggatgatgagcgaaatcgccgcgaacgcgtttcatcgcgtgcagcgtttttcgaccgactggcacgccaacagcttcgccggttccacggtgcgcaagatcacgcgcggcatgtgggcgctcgacctgctcaacgacacgctgctgatcgcgctgttcccgtcgctcgtcatgctggtcggcgccacggtcctgctcggctggcgctggccgatgatgggcgcggtcgtcggcatcggctcgctgctctatatcgcggtgacggcggctatgtcgctcggtttcgtggcgccggccgcgcggctcgcgaatgcgtgggacacgcgcatgggcggcgcgctcgccgacgcggtcagctgcaacggcgtggtcaaggcgttcggcgcggaagatcgcgaagaggcgctgctcgcgcgcgtgatcggcaagtggcggcaccgcacgcgccgcacgtggatgcgcggcacgatcaacggcggcgtccagggcggcatgctggtagcgatccaggccgcgattctcggcgcggcgctgctgttgtgggcgcgcggcgaagcgagcgtcggcgacatcacgttcgcgctgaccatgttcttcatgctgcaaggctatctgcgcgacgtgggcatgcatatccgcaacctgcaacgctcggtcaacgacatggaggaactggtgtcgctggaaagccagccgctcggtatcgaggacccgcccggcgcgggcccgatcgcgatcggcaaaggcgagatccgcttcgagcacgtcaccttccattacggaacgaacggccagccgctctacgacaacttctccgtgcgcattgcgccgggcgaacgcgttggactggtcgggcattcgggttccgggaagaccacgttcatcaagctgatccagcggctctatgacatttcggaaggccggatcacgatcgacggtcaggacatcgccaaagtgcggcaggcgtcgttgcgcagccagatcgcgatcgttcagcaggagccggtgctgtttcaccgctcgctcgccgagaacatcgcgtatgcgcggcccggcgcgagccgcgccgagatcgagcacgccgccaggctcgcgagcgcgcacgatttcatcgccgcgctgcccaatggctacgacacgctggtcggtgaacgcggcgtcaaactgtcgggcggcgaacgccaacgcgtggccatcgcgcgggcgtttctcgccgacgcgccgatcctgattctggacgaagcgacgtcgagtctcgacagcgaaagcgaagtgctgatccagcaggctatggaacggctgatgatgggccgcaccacgctggtggtcgcgcaccgtctttccaccgtgcgtgcgctggaccggttactggtgctggataaaggcaaggtgatcgaggaaggcagccacgaggcgctgatcagactcgagaacggcctctatcgccggttgttcgagcggcaggcactagag

SEQ ID NO: 28128 - DNA, 777 bp, Burkholderia fungorum
ctcgagtacgtaccggtcccggcgtttgatgacaattacatctgggtcgtttccgacggacactctgcggtagtcgtcgatccgggtgaggccgcccccgtgcaagcttatctggcgaaacggggttggcggctgagcgctattttactcacgcaccatcatcaagaccacgtcggcggggtggccgatctgctgaatggccaggcggtgcccgtctacggccccgccggtgaagcgatcgagcatctcacgcaccgcctgaaaaatggcgatcacgtgtcgatcgcggcccccgcgctcgaattgagcgtgctcgacgtgcccggccatacgagcggtcacattgcctattttcaggcggcggacccgcgcggcacgccgcacgtattttgcggcgacacgctgttcgcctgcggttgcggccggctgttcgaaggcacgccgaagcagatgctcgcctcgctggatgcgctcgccgcgctgcccggcgcaaccgaggtgcattgcgcgcacgagtacacgctgtcgaatatccgcttcgcgctcgcctgcgagccggccaacgccgaactgcaagcctggcgggataaagcaggggaattgcgcgcgcgcggcgtgccgacgctgcccaccacgatcgcccacgaacgcgcggtgaatccgtttttgcgtgccggcaatccggcagtgcaggcaagcctgcgggagcagctgcacgaaaaggtgcccgatcgattgacggccttcacgttgatgcgcgaatggaaaaaccgcttc

SEQ ID NO: 28129 - DNA, 1128 bp, Burkholderia fungorum
gtgttgccgtcattttctcccgctctgctcgcgctcgccgacggcacggtctttcgtggttactcgatcggcgcccccgggcataccatcggcgaagtcgtgttcaacaccgctatcaccggctatcaggaaatcctgactgacccgagctacgcgcgccagatcgtgaccctcacgtatccgcatatcggcaacgtcggcgtgaatgccgaagacgtcgaagcggcgaaagtccatgccgccggcctgatcattcgtgatctgccggttctcgcgtcgaacttccgcatggagcgcacgctccagcaatacctgcaggacgaaggcgtggtcgccatcgccggcctcgatacccgcatgctgacccgcgttctgcgcgacaagggcgcgcagaacggcgcgatcctcgccggttcggacgatgaagctcgcgccatcgaactcgctcgctcgttcccgggcctttcgggcatggacctcgcgaaggtcgtgtcgacgaaggagtcctatgaatggacccagaccgaatggcggctgggcagcggctacggcacgcagaatgcgccgaagtaccgcgtggtggcgttcgactacggcgtcaagtacaacatcctgcgcatgctcgccgaacgcggctgtcacgtcaccgtgctgccggcggaagcttccgccgccgacgcgctggcactcaatccggacggcgtcttcctgtcgaacggcccgggcgatccggaaccgtgcgactacgcgatccgcgccacgaaggaactgatcgaccgcggcattccgaccttcggcatctgcctcggccatcagatcatgggcctcgcggtcggcgccaaaaccatgaagatgaagaccggccaccacggcgcgaaccatccggtgaaagatctggacgacggccgcgtggtgatcacgtcgcagaaccacggcttcgcggtcgatgccgacacgctgcccgccaatgcccgcgtcacgcatgtttcgctgttcgacggcacgctgcagggcttcacgctgaccgacaagccggcgttctgcttccagggtcacccggaagcgtcgcccggtccgcatgacatcgcctatctgttcgaccgcttcacggcgttgatggacacgaag

SEQ ID NO: 28130 - DNA, 3249 bp, Burkholderia fungorum
atgcccaagcggacagacatcaagagcatcctcatcatcggcgcgggtccgatcatcatcggccaggcgtgcgagttcgactactcgggcgcgcaggcatgcaaggcgctgcgtgaggaaggctacaaggtcattctcgtcaacagcaatccggcgacgatcatgaccgacccgaacacggccgacgtgacctacatcgagccgatcacgtgggaagtggtcgagcgcatcatcgcgaaggagcgcccggacgcgatcctgccgacgatgggcggccagaccgcgctgaactgcgcgctcgatctgcacgcgcacggcgtgctggagaagtacaaggtcgagctgatcggcgcctcgccggaagcgatcgacaaggcggaagaccgtcagaagttcaaggacgcgatgaccaggatcggcctcggttcggccaaatcgggcaccgcgcattccatggaagaggcgctcgccgtgcaagcggacatcgcttcgcaaacgggcagcggcggctatccggtcgtgattcgtccgtcgttcacgctgggcggctcgggcggcggcatcgcgtataaccgcgacgagttcgaagagatctgcaagcgcggtctcgacctgtcgcccacgcgcgagctgctgatcgaagagtcgctgctcggctggaaagagtacgagatggaagtggtccgcgacaaaaaggacaactgcatcatcgtctgctcgatcgaaaacctggatccgatgggcatccacacgggcgactcgatcaccgtcgcgccggcgcaaacgctcaccgacaaggaatatcaggttctgcgtaacgcatcgctcgcggtgctgcgcgagatcggtgtcgacaccggcggctcgaacgtgcagttctcgatcaatccgaaagacggccggatgatcgtgatcgaaatgaatccgcgtgtgtcgcgttcgtcggctttggcttcgaaggcaaccggcttcccgatcgccaaggtcgcggccaagcttgcggtcggctacacgctggacgagctgaagaacgaaatcaccggcggtcagaccccggcgtctttcgaaccgaccatcgactatgtcgtcaccaagattccgcgtttcgcgttcgaaaaattccgcgaagccgattcgcgtctgaccacgcagatgaagtcggtcggcgaagtgatggcgattggccgcaccttccaggagtcgttccagaaggcgctgcgcggtctggaagtcggcgtggacggtctggacgaaaagaccgataaccgcgacgagatcatccgcgagatcggcgaagccggtccggatcgcatctggtacgtgggcgacgcgttccgtgtcggcatgacggccgaagagattttcgaagaaacctcgatcgacccgtggttcctcgcgcagatcgaacagatcatcctgaaggaaaaggcgctggctggccgcacgctcgcgagcctttcgaaggaagagctgaagtatctgaagcagagcggcttctcggatcggcgtctcgcgaagttgcttggcgcgaagccggcgcaagtgcgccaacgccgtatcgagctgaacgtgcgtccggtgtacaagcgcgtcgacacctgcgcggccgagttcgccacgaaaaccgcctacatgtactcgacctacgaggaagagtgcgaagcgaacccgacgaacaacaaaaagatcatggtgctcggcggcggcccgaaccggatcggccagggcatcgagttcgactactgctgcgtgcacgccgcgctcgccatgcgcgaagacggctacgaaacgatcatggtcaactgcaaccctgaaaccgtttcgaccgactacgacacgtccgatcgtctgtacttcgaatcgctgacgctcgaagacgtgctcgaaatcgtcgacaaggaaaagccggtcggcgtgatcgtgcaatacggcggtcagacgccgctgaagctcgcgctcgatctcgaagcgaacggcgtgccgatcgtcggcacgtcgccggacatgatcgatgccgcggaagaccgcgagcgtttccagaagctgctgcaggacctcggcttgcgtcagccgccgaaccgcaccgcgcgcgccgaagacgaagcgctcaagctcgccgacgaaatcggctatccgctggtggtgcgtccgtcgtacgtgctgggcggccgcgcaatggagatcgtccacgagccgcgcgacctcgagcgctatatgcgcgaggccgtgaaggtgtcgaacgactcgccggtgctgcttgaccgcttcctgaacgacgcgatcgaatgcgacgtggattgcatctccgacggtgaagccgtgttcatcggcggcgtgatggaacacatcgaacaggccggcgtgcactcgggcgactcggcgtgctcgctgccgccgtattcgctgtcgaaggaaaccgtggctgagttgaagcgtcaaaccggcgcgatggcgaaggcgctgaacgtgatcggactgatgaacgtgcagtttgcgatccagcaggtgccgcaggcggacggttcgaaagaagacgtcatttacgtgctcgaagtgaacccgcgcgcctcgcgtacggtgccgtacgtgtcgaaggcgaccagcctgccgctcgcgaagatcgcggcgcgcgcgatggtcggccagacgctcgcgcagcaaggcgtgacgaaggaaatcgatccgccgtacttcagcgtgaaggaagccgtgttcccgttcgtcaagttcccggcagtcgatccggtgctcggaccggaaatgcgttcgaccggcgaggtgatgggcgtgggtcaaacctttggcgaagcgttgttcaaatcgcagctcgccgcgggttcgcgtttgccggagtcgggcacggtgctgctgaccgtgatggacgccgacaagccgaaggccgtcgaagtcgcgcgtatgctgcacgaactcggttatccgctcgtcgcgaccaagggcacggccgccgccatcgaagcggccggcgtgccggtcaaggtcgtcaacaaggtgaaggacggccgtccgcacatcgtcgacatgatcaagaacggggaaatcgcgctggtcttcacgaccgtcgacgaaacccgcgccgcgatcgccgactcgcgttcgatccgcatgagcgcgcaggcgaacaaggtcacgtattacacgaccatgtccggcgcgcgtgccgctgttgaaggtttgcgctatttgaaagacctggaagtctatgatttacaaggcctgcacgctcgccta

SEQ ID NO: 28131 - DNA, 1893 bp, Burkholderia fungorum
aatatgttttcgaaagcagcagtgtggctggttatcgcactggtgctgtttacggtgttcaagcagttcgacaagccccgtgtccaggaaggcgtttcctattcgcagttcatggacgacgcaaagaacggcaaagtcaagaacgtcattgtccaggggcggaacctcacggtcactccagcagacggccagaagtaccagatcgtgtcgcccggcgacatctggatggtcggcgatctgatgaagtatggcgttcaggtgagcggcaaggctgatgacgaacccaatgcgctggtgtccgcgctgtactacctcggaccgacgatcctgatcatcggtttctggttctacatgatgcgacagatgcagggaggcgggaaaggcggtgcgttctcgttcggtaaatcccgtgcacgtctgatcgacgaaaacaacaacgcaatcaatttcaccgacgtcgccggttgcgacgaggccaaggaagaagtctccgaactggtcgacttcctgcgcgatccgcagaaatttcagaaactgggcggacgtattccgcgcggcgtgctgctggttggcccgccgggaaccggtaagacgctgttggcgcgcgccatcgctggcgaggcgaaagtgccgttcttcagcatctcgggttcggacttcgtcgaaatgttcgtcggtgttggcgcggctcgggttcgcgatatgttcgaacaggccaagaagcacgcgccgtgcatcgtgttcatcgacgaaatcgacgcggtcggccgtcatcgcggcgccggcatgggcggcggtaatgacgaacgtgaacagacgctgaaccagatgctggtcgagatggacggcttcgaagcgaactcgggtgttatcgtgatcgctgcaacgaaccgttcggacgtgctcgacaaggcgctgttgcgtccgggccgtttcgaccgtcaggtgtacgtcggtctgccggatatccgcggtcgcgaacacatcatgaaagtccatctgcgcaaggtgccgatctcgaacgacgtcgacgcagcggtgatcgcgcgcggcaccccgggtttctcgggcgccgatctcgcgaacctcgtgaacgaagcggcattgttcgcggctcgccgcggcaagcggatcgtcgaaatgacggacttcgaagacgcgaaggacaagatcttcatgggtccggagcgcaagtcggccgtgatccgcgaagaatcgaagcgtgccacggcgtaccacgagtcgggtcatgcggtgatcgccaagctgttgccgaaggccgatccggtgcacaaggtcacgatcattccgcgcggtcgtgcgctgggtgtgacgtggcagttgccggagcatgacaacgaaacgtattcgaaggactacctgctggatcggcttgcgatcctgttcggtggccgcgtggcggaagaattgttcctgaacctgatcagcaccggcgcgtcggacgacttcaacaaggcgacgcaaacggcgcgtgcaatggtggctcgctttggtatgacggacgcacttggaccgatggtctacgtcgacgacgaaaacgacgcaacgccgttcgggcgtggtttcacgcgcaccatttcggaagcgacgcagcagaaggtcgacgccgaaatccgccgcgtgctggacgagcagtacaacctcgcgaagcgcctgctggacgaaaaccgcgacaaggtcgaagcaatgaccgccgcgctgatggagtgggaaacgatcgacgccgatcagatcaacgacatcatggccggccgtccgccgcgttcgccgaagagttcgacgccgtcggcaaccgacgcctcgtcgggcggcagcccgggtaccgaggtcaagcccggtagcgcaacggcgccggcctgatcggcgaccagt

SEQ ID NO: 28132 - DNA, 909 bp, Burkholderia fungorum
atgcctgaagccgccatcgaatttgacaaggttaaaaaaagctacggcgaaaaaacggtcgtcgacgggctgtcgttccatgtcgcccccggcgaatgcttcggcctgctgggcccgaacggcgcgggcaagactaccacgttgcgcatgctgctcggcatcgccgcgccggatgcgggcacgatccgcctgtgcggcgaaccgatccccagacgcgcgcgcgtggcgcgggcacgcgtcggcgtggtgccgcagttcgacaatctcgaccccgacttcacggtgcgcgagaacctgctggtgtttggccgctacttcggcatgagcgccgcgcaatgcagggcaatggtgccgccgctgctcgaattcgcgcgcctcgaaagcaaggccgacgcgcgcgtgagcgaactctccggcggcatgaaacggcgcctcacgctggcgcgcgcgctcgtcaacgaccccgacgtgctgattatggacgaaccgaccaccggtctcgatccgcaggcgcggcatctgatctgggagcggctgcgttcgttgctcgcgcgcggcaagaccattctgctgaccacgcacttcatggaagaagccgaacggctctgccaccggctatgcgtgatcgaggaaggacgcaagatcgccgaaggcgcgccgagcgcattgatcgcctccgagatcggctgcgacgtgatcgagattttcggacccgatccggttgccctgcgcgatgaactggcgccgctcgtcgagcgcaccgagatcagcggcgagacgctgttctgctacgtcatcgacgcgcagccggtgcatgcgcgcctgaaacagcgcgcggacctgcgctatctgcaccgcccggcgaatctggaagatgtgttcctgcggctcaccggccgcgagatgcag

SEQ ID NO: 28133 - DNA, 1050 bp, Burkholderia fungorum
atgcaatatcgcagccttggcgattccgatgtgcaggttagcctgatcggtctcggcaccatgacatggggcgagcagaacacggagcaggaagcgcacgcgcagatcgactacgcgctcgatcacggcgtcaatctgatcgacaccgccgaaatgtacccggtgccgccgattgccgagacgcaaggttcgacggagcgcttcatcggcacgtggctcgcgcagcatcgcagcgcgcgcgaaaaaatcgtgctcgccaccaagatcgccggcccggcgcgtcagccgcataacccgcgccatattcgtggcgaaggcaaccagttcgaccgcaagaatctcaccgaagcgctcaacgacagtctgaagcgcctgcaaacggagtacgtcgatctgtatcagctgcactggccggatcgcagcacgatgacgttcggccgcgcctcgtatccgtgggtcgacgacgcgtacacggtgccgatcgaagagacgttgtccgtactcgccgagttcgtcaaggcgggcaaggtgcgtcacatcggcgtgtcgaatgaaacgccctggggcgtcgcgcagtttctgcgcgcggccgaaaagctcggcttgccgcgcatcgtcagcatccagaatccgtacagcctggtcaatcgcacgtacgaagcgggtctgtccgagtacgcgcatcgcgacaacgtcggcctgctggcctattcgccgctggccttcggctggttgtcgggcaagtatgaaggcggcgcgcgtccggccggcgcccgcatcacgcgcttcgatcgcttccagcgctacagcaagccgcaagcggtgcaggccaccacgcgttacgtcgaactcgcgaagcgccacggtctggcgcccgcgcagttcgcgctcgcgttcgtcaatagccggccgttcgtgaccagcaatctgatcggcgcgacctcgctcgatcaattgaaggaaaacattgccagcgtcgacgtgaaactctcgccggacgtgctcgcggaaatcgacgcgctgcatgaattgcagccgaatcccgcgcct

SEQ ID NO: 28134 - DNA, 531 bp, Burkholderia fungorum
tggcatggagcgtcgctcatgagcgcggcgcgcggtgccgtgatatggatgacggggctctccggcgccggcaagtcgacgttggccaacgccttgcatctacggttgaaggaagcagggcaggccgcgatcgtgctcgacggcgatgtgctgcggcgtgggctgaacgccgacctaggcttcacgcccgaggaccgcactgaaaacctgcggcgggtcgcgcacgttgctgcgctcttcatgcagcagggcttcgtggtgatcgccgcggtgatttctccggagcatcggcaccggcgcgcggcgcgtgaaattgtcggcgaagggttcgtggaagtgttcgtgaatgctccgctacaggtctgcgaagcgcgcgacgccaaaggactctatgcgcgcgcgagacgcggcgaaattgcgcatttcaccggtatttccgatccgttcgaagcgccgctcgccgccgacctggtgattgaaactgatcgcatgccggtcaacgagggtgtagaccggctgctcgcgcatctg

SEQ ID NO: 28135 - DNA, 1419 bp, Burkholderia fungorum
aagaacctgatcgccggagagtggaccgagagcgtcagcgggaagaccttcgcgaatatcaatccggccgatacgcgcgatgtcgtcggccagtttcaggcgtcggtggtcgcggatgcgcaggcggcgatccaggccgcgtcgtccgccttcgcgcaatggcgtcgcacgccggtcacggcgcgggccaggatcgtcaacaaggcggccgactggctggagagtcacgcagataccttcgcacaggagttgacgcgcgaagagggcaagccgctcgcgcaaagccgcgacgaaattctccggtccgcccaggtcctgcgtttttatgcggtcgaggcgcagtcattcaccggcgagacgtttccgagcgacgatccggagcagcacgtgtacacgcagcgcgagccgctgggcgtggtcacggtcatcacgccgtggaatttccccatctccatcccggcgcgcaagattgcgcccgcgctgatggccgggaacacggtgattttcaagccgtcgtccgacgcgccgctgatcggctaccggttggccgaagcatttgcacaggcgggcattcctgccggcgtgctcaacttcatcacgggccgcgcgtcggatatcggtgctgcgattacagagtcgccggtcgtgcgtgccatctcgtttaccggctcgaccgccgcaggcgaacatattcaccgctccgtgccgatcacgacgcgcacgcagatggaactcggcgggaagaatccgctgatcgtgatggacgatgcggatctcgaccgcgccgtggatctcgcggttaaaggcgggttgtcgctgagcgggcaggcttgtaccggcaccagccgaatcctggtcatggagtcggtgcgcgaaacattcacggcaaaactggtcgagcgggtaaagagcctcaagatcggcagcggcgttactcccggtatggacctcggcccgcttgccaatcgcaagcagctcgaatcggtactcggatatgttgcgtccggcaaggaacagtcgacgcatctgatcggaggcgagcagctgacgggcgagggcttcgagcacggctactacgtcacgcccgcggtgttcagcgacgttcccgagagcgcgcgcatttatcgcgaggaaattttcggacccgtgctagccatcacgtccgtgacgggctacgacgacgcgatcgcgaaggcgaacgatacggagtacggcctgtcggcggcgattgccacttcgaatccacgctacatgcaccggtttgccgacgagatcgaggcggggaccgtcaagatcaatcgcaccactaccggcaatgtgatcaatgcgccgtttggcggcctgaagcgatcgagcacgtcaacgttccgcgaatcggggcgagccggactcgagttctacacgcagatcaagaccgtc

SEQ ID NO: 28136 - DNA, 2274 bp, Burkholderia fungorum
tttcgttttcccgtcgtcatcatcgacgaagatttccgctccgagaacatctcgggttccggcatccgggctctggccgaagccatcgagaaagaaggcgcggaagtgctcgggttgacgagctacggcgatctgacttcgttcgcgcagcagtcgagccgcgcctcgtgcttcatcctttcgatcgacgatgacgagctgctgccgtacgtcgataacgtggtggtggaaggcgagacgccggaactggccgccgcgatcgtcgcgctgcgcgcgttcgtgaccgaagtgcgccgccgcaacgccgacattccgatcttcctgtacggcgaaacgcgcacctcgcgccacctgccgaacgacatcctgcgcgaactgcacggcttcatccacatgttcgaggacacgccggagttcgtcgcgcgccatatcatccgcgagaccaaggtgtatctggattcgctcgcaccgccgttcttcaaggaactggtgcagtacgcggaagaaggctcgtactcgtggcactgtccgggccactcgggcggcgtcgcgttcctgaagagcccgctcggccagatgttccaccagttcttcggcgagaacatgctgcgcgcggacgtgtgcaatgccgtcgacgaacttggccagttgctggaccacacgggccctgtcgcggcttccgaacgcaatgcggcgcgcatcttcagcgcggaccacgtgttcttcgtgaccaacggcacgtccacgtcgaacaagatcgtctggcacggcacggtagcgccgggcgacatcgtgctggtggaccgcaactgccacaagtcgatcctgcacgcgatcaccatgaccggcgcgattccggtgttcctcacgccgacgcgcaacaacttcggcatcatcgggccgattccgcgcagcgagttcgagccggaaaacatcaagaagaagatcctcgcgaacccgttcgcgcgcgaagcgctcgctaagaatccggacctcaagccgcgcatcctgaccatcacgcaaagcacgtacgacggcgtaatctacaacgtcgagatgatcaaggaaatgctcggcgactggctcgacacgctgcacttcgacgaagcctggctgccgcacgctgaattccacgagttctatcaggacatgcacgcaatcggcgcgggccgtccgcgtattggtgcgatggtgttcgccacgcactccacgcacaagctgctggccggcatttcgcaggcttcgcagatcgtcgtgcaggattcgaagaacagccgcttcgacaagcatcgtttcaatgaagcgtatctgatgcacacgtcgaccagcccgcagtacgcgatcatcgcctcgtgcgacgtggccgcggccatgatggaagcgccgggcggcaccgcgctcgtcgaagagtcgatcgcggaggcgttggacttccgccgcgcaatgagcaaggtcgacgccgaatacggcgacgactggttcttcaaggtgtggggcccagaccagttcgccgaagaaggcatcggctcgcgcgaagactggatgctgcgtccgaacgatccgtggcacggtttcggaccgctcgccgacggcttcaacatgctcgacccgatcaaggcgaccatcgttacgccgggtctggatatggacggcggcttcggcgagtcgggcattccggccgcgatcgtcacgaagtatctggccgagcacggcatcatcgtcgagaagaccgggctgtattcgttcttcatcatgttcacgatcggcatcaccaagggccgctggaattcgatggtcaccgaactgcagcagttcaaggacgactacgacaacaaccagccgctgtggcgcgtgctgcccgagttcgtctcgcatcatcccatgtacgaacgtgtgggtttgcgcgatctgtgcgagcagattcacagcgtctaccgcgcgaacgacattgcgcgcctgacgaccgagatgtacctgtcgagcatggaaccggccatgaagccgtccgatgcgttcgccaagctcgcgcaccgcgagatcgaccgcgtgcctatcgacgaactggaaggccgcgtcacgtcgatcctgctgacgccgtatccgccgggcattccgctgctgatcccgggcgagcgcttcaacaggaccatcgtcaactatctgcgtttcgcgcgcgagttcaacgagcgcttcccgggtttccacacggacatccacgggctggtcggcgaaacgatcaacggacgcatcgaatacttcgtcgattgcgttcgc

SEQ ID NO: 28137 - DNA, 1398 bp, Burkholderia fungorum
ctgcttccgctgctgttgatcggcggcatggtgtggttcatgcggcgcgaaatgcgcggcggcgcgaggcttctcgacagggcgcccgcgctgcgtttcgacgacgtgatcggcgcgtctgaagcgaaggcggcactcgcggatattcgcagctatctgtccgacccgaaacagttcacgtcgatgggcgtgcgcgcgccgtgcggcattctgatggtgggcggccccggagtcggcaagacgcgcctcgctcaggcgctggcgggcgagtgcggcgcgaacttcatttctatcacgggcagctacttcagtgcgaagtactacggcgtcggcatccagaaggtcaagcatctgttcgaactggcgcgcaagaatgcgcccacggtgattttcatcgacgaagccgacggtctcgccaaacgcacggatacgggcagcggtccggtcgaagccgagagcaaccgcatcatcaatcagctgctggcggagatggatggcttcgcttcgaacgaaggggtcatcatcgtcgcggcgaccaatcatcccgacaatctggacgaggcattgcgccggcccggccgtttcgatcgcacggtgcaggtccgtttgcccgatcgcgaagaccgcgcgaagattttccgcttctatgccgcgaagctgaagtcgaagtccgcggacatcgactatgaccagctggcgagactgaccacgggcctgtcgccggcaacggtggcgatggtggtgaatcaggcggggctcgtcgcgcgcaaatccggcgacacagaaatcgcttcgaagcatttcatggaagcgatcaagattgcgcgcatcggcgacgtgagcggcgccgagcgcgcactgagcgaagacgagcgcacgcgtatcgccgtgcacgaagcgggacatggtctcgtggccgcgctgctgggtacgggggtgctcgaagaagtcacgatcctgccgcgcggcggcgcgttgggcgtcgcgctcattacgaaagcgcaagacaagcacctgtatcgcgagagcgagatccgcaatgaaatccaggtcctgctcggcggacgcaacgcggaaattatctcgttctccgaagcatcgagcggcgctgcttccgatctgcaggaggcctcgcgcatcagcctggacatggtgtcgaaattcggctttaacgccgacggcaatctgttcagccttgcggcgctgccgtcgcaatatgcagggttgcagatgaagggtgcgatcgaacacgcgaacgtgctgctcaaggaattgaacgagtcgtgccatgcgctgctgcatgcgtacgaaccggtgctgcgcgccattgctgacgaactgctcgaacaggaaaccgtgcccggagaaaccgtgtaccggttgatccgcgaacacaaa

SEQ ID NO: 28138 - DNA, 2574 bp, Burkholderia fungorum
atgaataccgcaaaccgcaaacgccttcccggcacccagctcgatttcttcgacacgcgtgccgccatcgaagccattcagcccggcgcttacgacaagttgccgtacacgtcgcgcgtgctggcagagaacctcgtgcgccgctgcgacccggtcacgctcgttgcttcgcttaaacagatcatcgaacgcaagcgcgaactggattttccgtggttcccggcgcgcgtggtctgtcatgacattctcggccagaccgctctggtcgacctcgccggtctgcgcgacgcgattgccgcgcaaggcggcgatccggcaatggtcaaccccgtggtgccgacccaactggtggtagaccattcgctcgccgtcgagtgcggcggtttcgatccggatgcgttcgcgaagaaccgcgcgatcgaggaccgccgtaatgaagaccgcttcgacttcatcaactggaccaggcgtgcgttcaggaacgtcgacgtgattccgccgggcaacggcatcctgcatcagatcaacctcgaacgcatgagcccggtggtgcaggtgaaagacggcgtggctttccccgatacgctggtcggcaccgactcccatacgccgatggtggacgcgctcggcgtgatcgccgtcggcgtgggcggactcgaagcggaaagcgtgatgctgggccgcgcgtcgtatatgcgcctgccggatatcgtcggcgtggaactgaccggcaagccgggcgaaggcattacggcgaccgatgtcgtgctctcgttgaccgaattcctgcgcaaggagaaagtggtcggcgcgtacctcgaattctttggcgccggcacggccaacctcacgctcggcgaccgcgcgaccatcgccaacatgtcgccggaattcggcgccacggccgcgatgttctatatcgacgaacagaccatcaagtacctcaagctcaccggccgcgacgacgagctcgtcaaactggtggaaacctacgcgaaggaaaccggcctgtgggcggacagcctcaagcatgcggagtacgaacgcgtgctgaagttcgacctctccaccgtggtgcgcacgctggccggtccgtccaatccgcatcgccgtttgccggtgtcggagctggcggcgcgcggcatcagcggcaaggtggagaacgagcctggcctgatgccggacggtgcggtgatcattgccgctatcacgagctgcacgaacaccaacaatccgcgcaacatgatcgcggccggtctgctggcgcgtaacgcgaaccggcgtggactgacgcgcaagccctgggcgaagacttcgctcgcgccgggctcgaaggcggtcacgctatatctggaagaagcgggactgttgcacgatctggagcaactgggctttggcgtggtcgcgtatgcgtgcacgtcgtgcaacggcatgtccggtgcgttggacccggcgatccagaaagagatcgtcgatcgcgacctgtatgcgacggccgtgctgtcgggcaaccgcaacttcgacggccgcattcatccgtacgcgaagcaggcattcctcgcgtcgccgccgctggtggtggcttatgcgattgcgggcacgatccgcttcgacatcgagaaagacgtgctcggtatcgacgccgacggtcacgccgtcacgctgaaggacatctggccgtcggacgcggagatcgatgcgatcgtggcgtcgagcgtgaaaccggagcaattccgcaaggtgtacgagccgatgttcgcggtcacggtcgacacgggcgagaaggccagcccgctctatgactggcgccccatgagcacgtacattcgccgtccgccgtattgggaaggcgcgctcgccggtgagcgcacgctcaagggcatgcgcccgctagccgtgctcggcgacaacatcacgaccgatcacctgtcgccgtccaacgcgattctgccggacagcgcgtcgggtgaatatctggcgaagatggggctgccggaagaagacttcaattcctatgcgactcaccgcggcgaccatctgacggcacagcgcgccaccttcgcgaaccccacgctgaagaacgagatggtgctcgaagacggcaaggtgaaggcgggttcgctggcgcgcatcgagcccgagggcaaggtcacgcgcatgtgggaagcgatcgaaacctacatggaacgcaagcagccgttgatcgtgattgccggcgccgattatggccagggttcgtcgcgtgactgggcggcgaagggcgtgcgtcttgccggcacggaagcgatcgtcgcggaagggttcgagcgcattcaccgcacgaatctggtgggcatgggcgtgctgccgctggagttcaagcctggagtgaaccggctcacgctcggtatcgacggcacggaaactttcgacgtgatcggcgagcgcaagccgcgcacggatctcacgctggtgattcatcgcaaaaacggtgagcgcgtggaagtgccggtcacgtgccgcctcgataccgccgaggaggtctcgatctatgaggccggcggcgtgctgcaacgctttgcacaggacttcctc

SEQ ID NO: 28139 - DNA, 1164 bp, Burkholderia fungorum
atgagcgaagcagacaacagcacgccgaacacgggcgcgttcaaaccgaaaaaatccgtcgccctgtcgggcgtgacggcgggcaacacggccctctgtacggtcggcaagaccggcaacgacctgcactatcgcggctacgacattctcgatatcgccagcgcctgcgaattcgaagaaatcgcgtacctgctggtccacgaaaagctgccgacgcaagccgaactcaccgcgtacaaaacgaagctcaaggcgctgcgcggcctgcccgcgaacgtcaaggccgcgctcgaatggatcccggccgccgcgcatccgatggacgtgatgcgcaccggcgtatcggtgctcggcaccgtgctgccggagaaagacgaccataacctgccgggcgcgcgcgacatcgccgacaggctgatggcttcgctcggttcgatgctgctgtactggtaccactactcgcacaacggcaagcgcatcgaggtggaaaccgacgacgattcgatcggcggccacttcctgcatctgctgcacggcgtggagccgtccaacgcatgggtcgacgcgatgcacgtgtcgctgaacctgtacgccgagcatgaattcaacgcgtcgaccttcacgggccgcgtgatcgcgggcacgggctcggacatctactcggcccttaccggcgcgatcggcgcgctgcgcggaccgaagcacggcggcgcgaatgaagtcgcgttcgagatccagtcgcgctaccagacgccggacgaagccgaagcggatatccgccgccgcgtcgagaacaaggaagtggtgatcggtttcggtcaccccgtgtacacgatttcggacccgcgcaacaaggtcatcaaggaagtcgcgaagaagctctcgaaggaagcgggcaacaccaggctgttcagcattgccgagcggctggagtcggtgatgtgggacgcgaagaagatgttcccgaatctggactggttcagcgcggtctcgtatcacatgatgggtgtgcccacggccatgttcacgccgctcttcgtgatcgcgcgtacggcaggctggagcgcgcacatcatcgagcagcgcatcgacaacaagatcatccgtccgagcgcgaattacaccgggcccgacgatctgccgttcgtgccgctcgcgaagcgt

SEQ ID NO: 28140 - DNA, 1473 bp, Burkholderia fungorum
gccaggtaatcaacgaaccgcgatcgaggagacgagatggaaaagtttctggttggtgacgagtggaggtccggtaacggggagtcgttcgaatcgatcaatccgatcgatggctcggtggcggcaacgcttgcgcaggcaagcgagtccgatgtcgacgacgccgtgcgggctgcgcgtcaggcactcgaaacgccggcgtggcgcgacatgaaggtccatgagcgaggcaagctgctgcacagattcgcggatcttatcgatcagaacgccgagacgctagcgcagatccagacccgcgacaacggcaagaccatcagcgaaagccgctttcagtcaaagtcggccgccgacatgttccgctacttcgcagcggtctgcgagacaacggagtcgtccgtcattccgtcgcgaggcaattacttctgtttttcgtcgttcgagccggttggcgtggtggcggccatcgcaccctggaactcgccgatcacgctcgaagcgcagaagctcgcgcccgcgctggcggccggcaacgcaatcgtgttgaagtcctctgaagtgacgccatgcattggccttcaatacggccgccttgccatggaagcgggttttccgcccggcatcctcaacgtggtgacgggcttcggagcgtccgtgggacgcgcacttgtggcgcatccgggcgtcgacatggtgacattcacgggcggcacgaagagcggcagggagatcgcgaaggtcgcgggcgagcgcctgattccctgcattctcgaactcggcggcaagtcgccgaatattgtcttcgacgacgccgatatcgagcaggcggtgaccggcatgctgttcggcatcttctcgaatgcggggcaatcgtgcattgcgggttcgcggatcctgatacaggaaggcatctacgacgctttcgtggcgcgtcttaccagtgcaacccgcgcgctcaaggtcggttcaccttacgatgcggatacagccgttgccccggtttcgagttttcatcatcgtgaccacatcgagcatttcgttgagcgggcgctcagccagggcgcagtcgcgctctgtggcgggagccggccgagcggcggcatactggacaagggcgcctatgtgcaaccaacgcttctcgaagtcaccgacgaacgcagcagcgtcgcccacgaggagatcttcggtccggtagcgtgcgtgatgaagttccaggatgaagaggacctctaccgcatcgcaaacaacacagcctacggcctcgcgtgcggcatctggacggcagactataaaaaggccttccgggcggcccgccgcatcaaggcaggcacggtatgggtcaacacctacaagatcgccgaggtcaacgtgccgttcggcggcttcaagcaaagcggtcttgggcgcgaatgcgggattgaaggcatgcgggaatatatgctggaaaaaagcacctatctcaacctggcggac

SEQ ID NO: 28141 - DNA, 1290 bp, Burkholderia fungorum
acgaatgagctgacctatcaaacggggttcggcaacgagttctcaactgaggcaatcagcggcgcattgccgattggacagaacaatccgcaaaaacccgcattcggactgtacgcggaacaattgtcgggcacgtcatttaccacggcccgcgcgacgaatctcagaacctggatgtatcggatacgaccttcggtgctgcaagggacgtatcggcttattcgcaaggactccaacgctctggcgccgctggacgttgcaccgctgcctgaagcgcagcgatggaacccgcaaccgctgccggatacgccggtcgatttcgtagacggcttaaacacgctcgcgatcagcggcgaccccgctaccctttccggcgccgccgtgcatttgtatgcggcaaccatcgacatggaccgcaaggcgttcgtgaataccgatggcgagatgcttataatcccgcagcagggaacgctatgcctcattaccgaattaggcatgctaaccgccaaaccgcgcgagatcgcggtgatcccgcggggcctgaagttcgcggttcatttgccggacggcccaagccgcggctatgtctgtgagaatcatgggagtgctttcaggctgcctgatctcggcctgatcggcgcgagcgggctggccaaccgccgcgatttcctgactccggtcgcgcgattcgaagacagtgatgccgcacacgaactcattgccaagacaggcggccaactgtggtcgacgacgctcgatcattcgccattcgatgtggtcgcctggcatggcaacgtcgcgccttacaaatacgacctcgatcgtttccagtcgatcggctcaatctcattcgaccaccccgatccgtccatttataccgtgctgacttcgccgtccgacacgcccggcacggcgaacgcggatttctgcgcgttgacgacgcgctgggcggtggcggaacacacttttcgtccgccttattttcaccgcaacgtaatgagcgaattcatgggcctgatctgcggcgcgcacgacgccaaagcaggcgggtttgttcctggcggagcaagcatccataacgcgttcaccccgcacgggcccgacgccgaaacctaccgccgcgcgcgcgataccactctcgaacctcacaagatcacggaatcgatcgcgttcatgtttgaaacgcggctgcccctgcgcctgaccgcctgggccgtgcaaacgccacaacgacaacacgactaccagcaatgctggtcggcgctcgctaaacagttcgatggagaccgc

SEQ ID NO: 28142 - DNA, 1494 bp, Burkholderia fungorum
agaaacaagcgcatgtatcccatcgatttcctgtggcgtgccgttgatcggtatccgaaccggacggctgttttcgggcctggcggcaacctcagttttcgcgaactgggaactcaggttctcgatcgcgcggccacgctgacccaaatcgatcccgtgcgcggcggccggatatgcgtgggtgcgtccaatggcatggatcatctgattgccattctggctgtgcttgcagccggaaaggtatgggtgccgctcaatccgcgcaatggcgatccagagttgcgtcgcattctcgacttcgtcgaaccgtcgttggtgctagcagatgcggagatgcaaaatcgactatccggcacgacggctgcgctgcgctcgctcgagtcactgacgcagcaggccggcgacgtcggcgcggtcgtgatgggcccgcgctcgagtggtggcgtcgcgatggataaaccgcaggcgatcaagttcaccggcggcacgaccggatttccaaaaggcgtgatccagccgttgcgggcatggaataccaatatcgccacgcagatccatgagcttggcctgaaacctgacgaccggtatctggttgccgcgccgctgtcgcatggcacatcgacgtatctgctgccattgctgggcgttggcggtgcgttgatcatccccccggagcaggcaaaggcggccgcgctgctggacgcagccgatgctcacggagcaacgattcttttcgcgccccccacgctgatcgttgcccttgcggaagagcagcgccggtcgccgcggttgctacgacgcctccgatatcttgtgtatggcggcgcgccgatgcgcgcggaacagatccgcgacgctcagtcggtgtttggcccggtgctgtgcaccacgttcgggcaaacggaagcacctcagatcattacgtttttaccgccggccgaaatgaatggcgatacgctgacttccgtgggacggccatcgctgctcaccagggtggccatcatgaacaaggacggcgagcctgttgagacaggccagcagggagagatcgcggtgcgcggcgatctggtgatgagcggctaccttaaggccgaggacgaaacacgcaagacgcttgtcgacggctggttgcgcacgggcgatgccggggtcttcgacgaacgaggctacctttttctccgcgaccgcatccgcgatgtgatcattaccggaggctttaatgtctaccccagcgacgtggaagcggtgctatcggcgcaccccgccgtggccgactgttcggtagtgggtgtcccggatgcaaagtggggcgaagcggttcatgccgcagtgcaactgcgctcgggcatgcaagtggataccgccgatctggttgccctcgtcaggcgcgagttgggcccggtcaagacgcccaggcatgtgcatctgttcgagtcgttgccgcgcagcgccgtgggcaaggttctgaagacagaagtccgtaataccatcctt

SEQ ID NO: 28143 - DNA, 1002 bp, Burkholderia fungorum
atgaatcgctgggaaatcccgtcgctgggtctcgataaacttgtgcgacgtgaagtgccccgtccggtaccgaaggcgggcgaaatcgtcgttgaagtcaacgcggtctcgctcaactatcgcgatgccgaagtggccgaaaacggcatgggcaacgcgctgagttttccattcacaccggcttccgacatggccggccgcatcgtcgcagtgggcgaaggcgtcacgcgcttcgcggtcggcgatcgggtcatttcggcctacattccgggttggatagatggtgtgccgctatcgtggacggtagcgccgacccaaggcggcccgatcccaggggtgctcgcgcaatatgtcgccgcgccggccgaatggtgtgtgcgtgccccgcgcaccttaagcgccgtcgaagccagcacgctgccggttgcggcgctgaccgcatggatggccctggttgaactgggcaacctgcatgcaggccagaccgtcgtcgtgcaaggcacgggcggcgtatcgctgtttgcggttcaattggctgcggctcacggcgcgcgggtgattgtcacgagcggcagcgacgagaagattgcccgggcgatcgccctcggcgcacgtcatgggatcaatcgcaacacgacgcccgactggcagcacgcggtgctcgaactgactggcgggcgcggcgccgaccatattctggaaatgaccggcggcgacaatgtcgagcgctccttgcaagccgtcgtgcaaggcggacgcatttcggtcatcggccttctggactcggaccggctcagcctgcccattctttcactacttgccagccgtgcctcgattgtcggcatcgccgtcggaccgcgccgcgcgctcgaggacctggtgcgtgccgtcgatctgctgggaatcaggccggtcatcgacgccacctatgcgtactcgcaggtgccggaagccttcgtgcatctgcgacgcggagcgttcggcaaaattgtggtgcagttg

SEQ ID NO: 28144 - DNA, 1374 bp, Burkholderia fungorum
gtacgaatggagcgtgacacgttcggcgaaatcgccgtgccgaacgctcgtctatggggcgcgcaaacccagcgctcgctacagaatttccgcatctccaccgagaagcaatcgcccgaactcatcaccgcgctggccgtcatcaagcgcgccgccgccgaagtcaacctgggcctcggcgtgctcgacgaaagcaaggcgaaggcgatcatcgaggccgccgacgagatcatcgccggcaagcacccggatgaatttccgcttgccgtctggcagaccggctccggcacgcagaccaacatgaacctcaacgaggtgatcgcgaatcgcgcgagcgagctgctcggcggcgagcgcggcgaagcgcgcaaggtgcatccgaacgacgacgtgaatcgcggccagtcgtccaacgacgtgttcccgaccgccatgcacgtggccgcggcctatgcgatcgtcaagcatctgctgccggcgctgaagacgctgcgcgatacgctcgacggcaaggcaaaagccttcgtcgacatcgtcaagatcggccgcacgcatttgcaggacgccacgccgctcacgctcggccaggagttttcgggctacgtcgcccaactcgaccagggcattcgtcacgtcgaatcggcgctgccgcatctgtacgaactcgcgcagggcggcaccgcggtcggcaccggtttgaacgcgcatccgcagttcgccggcaaggtggcggcggcgatcggcaaactgaccggcttgccgttcgtctcggcgccgaacaaattcgaagtgatggccgcggccgacgcactggtattcgcgcatggcgcgttgaagacggtggcggcgagcctgaacaagatcgccaacgacatccgctggctggccagcggcccgcgctgcggtctcggcgaactgtcgattccggagaacgagccgggcagctccatcatgccgggcaaggtcaatccgacccagtccgaagcgctgacaatgctctgcgcgcaggtgttcggcaacgacgtcgcggtgaatatcggcggcgcgagcggcaatttcgagctgaacgtgttccggccgatgatcgcgcacaacgtgctgcaatcggtccgtctgctggccgacggcgcgcacagtttcaacgacaactgcgcggtcggcatcgaggcgaatcacgagcgcatcgataccctgctcaacgaatcgctgatgctggtgacggcgctcaatccgcatatcggctacgacaaggccgcgaagatcgccaagaaggctcacaaggaaggcaccacgctgaaggcgtcggcgcttgcgctcggcttcgtcaccgagcagcagttcgacgaatgggtgcgcccgaaagacatggtcggg

SEQ ID NO: 28145 - DNA, 1614 bp, Burkholderia fungorum
tacgactacatcatcgtaggcgcaggctcggccggctgcgtgctggcgaatcgcctgtcggagtccccgtcgaacaaggtgttgctggtcgaggccggcgccggcgaccgacatccatacatcggcattcccaaaggcatcgcgaaactgcgcatgcatccaaagtactcatggcgcctgcccactgagccgacgctcggccgtgcgcaaggcgaattctggccacgcggccgggtgatcggcggcaccagttcgatcaacgggatgttctacatccgcgggcaacccgaagactatgacgagtgggagacgctgggcgccaaaggctggggctggaaggacatcgcgccctgcttcaggaaaatggaggatcacgaactcggcgaaacgccattgcgcggtgtcggcggcccgttgcacgtaacgctgccgtaccatgaacatccgccgctaaacgaagcgtttttgcaggctggcgagcagattggattgccgcgcaaggaggacttgaaccagggtgatcaggccggcatcggctactatccggtcaacatgtggaaaaaccggcgctggagtgcggccgacgcgcatctgcggccggcactgaagcggcccaatctgaccgtgctaaaaggcgtccatgtcgatcgcgtgctgttcgacgggcttcgcgcagtcggcattgccgcccgcatcggcgacgcacgcaaggaatttcgtagccgcggcgaaatcatcctgtcggccggcaccttgaagtcgccacaaatcctgcagttgtccggggtcgggccgggcgacgtgctgcgcgccgcaggggtgccaatagtcgcagatcgtgccgacgtgggccgcaacatgctggaacacctgagcatgacggtagtgaaccggctcgtcggtacggccggagaaaaccgcgagtaccggggctggcggctcgcgaagaacgcgctgaaatactatgtgcggcgcaacggcgtactgagttacagcacctttcccatcggcggcttcgcgcgctcgtcgcctgaactggagcgtgccgatatccagtttttccttggcggtctaagcttcgaaatgggcggcctgaaaagcgtcgcggcgcgcgtgcagaccggcaagctgccaggcctgacctgctttgcctatttcatgaagcccgaaagccggggcagcgtcgcgatcagcagcgcggatcccgacgcgccggcagtgatccggccgaactggctcgacacggagaatgaccggcaggctgcgatccgggtcgtgcgcttcatgcggcggatcgtccatgcaccagcactaaagtcgtatgtcggcgatgaggtaatgcccgggccggcgaccagcgacgacgacgacgcactacttgccgcctatacgcgtttcggtagcaccgccaaccacgcggtcggaacttgccggatgggcggcgacgcagcgtcggtggtcgacgggaggctgcgcgtacggggtgtcgagaatttacgggtggtcgactgctctgtgatccccacgccgatttccggcaacaccaacggtccggtgatggcgcttgcgtggcgcgctgcggacctgatcctgcaaggcgagcggtagcgggat

SEQ ID NO: 28146 - DNA, 1326 bp, Burkholderia fungorum
atgcaatctaccgcttacgcggccagccggctcgaccgcctacctttaagcggcttccactggcgtttgctgtgcgtcatcggcttcgggctattccttgaattttttgacctgtacacgggcggcgccattgtcggcgtattgctcaaacagggatggtcgacactgcagctcaacgcgctcttcggcacgttgacgttcgcgggcttgaccgtcggagcgatgatggcggggattatcggcgaccgttacggccgccgcctggcctatcagatcaatctcgtggtgttcggcatcgcgtcgtttgcagcggcggttgcgccggacatgtactggctcagcgcaatccgcttcatgatgggtctcggtatcggcgcagaggccgttatttcgtacggcatgcttggcgagttcgtgccgccgggctttcgtggccgcatgctggcattcctgtcggtgttcggaaattccgcggtgttcgtcggttcgctggtcaatctctgggttattccccatctgggctggcgctacgtcttcgtcatcgcgggcattctcgccatcacgctgtggatcgtgcgccgctcgattccggaatcgccgcgctggctcgagacaaaagggcgtatcgacgaggcggaggtcgttctccaacggatcgagcgcagcgtcgcgcgcggcggtgaactgccttcgtatgcacacgaagtgcccgcgccaacgccgcaagtgtccattggcgtgttattcacgccgccgatacttgtgcgtacgctcgtcggttcagccattcttgtctgcatcggcttcagcatctatgggctgatcaactggctcccgacgttcttcatccagcagggcttcgatatcgtcaagtcgctgacatggacgacggttatcacgctgggcggcccggtgggctccctgctcggcgttgcggtgtcggatcgggtcggccggcgtcccgcgatcatcgcgtcgtgcgtcgttacagcggtttgcggcctgatttaccagcaggtcgactcggctttcgcgctgatgggggtgggcttcctgctggtgtgctccatctatgtgctggtggcggttggacaaggcgcttacgtacccgagctgttctcgacttcgtaccggttgcgggggacgggcgtttgcatgaccgcgggacggctcgccagcgcaggctgccaattcttcattctctggctgttcacgaagggtggcgtactgatggtggtaggctcggtcgtcgcggctcagcttttactggcgttcgccgtgtgggcgatacggatcgagacccgtggcaagcggctcgaagatctc

SEQ ID NO: 28147 - DNA, 819 bp, Burkholderia fungorum
gcagcgcgagcacatcgtcggtgacttattaaagggagaaggagcttgctgagatttgataataaggttgtcatggtgagcggttgcggctcctcgctgccgggctggggcacgggcaaggcgatcgccgcgttgctcgcgcgccagggtgcccaggtggtgggtctcgatgtgaacgaacaggcgcttgcggacacgcgtgctgtcatcgaaggtgagggcggcaagctgaaggcgctgttatgcgacgtgaccgacccggcgagcattgaccgggtggtgcgcgagacgattgacgcgtacggccgtatcgacgtgctggtgaacaatgtcggtgtctccgcgccaggcggtgtagtcgatatgaccgaggagatatgggaccgccagttcgacatcaatctgaagagcgtattcctgatgtgcaaggcggtcttgccgctgatggacaggcaacgcggcggtaacgtcgtcaacgtgtcgtcgctttccgcgttgcgctatagcggcaaaccgcagattgcctactcggcgagcaaggcggcgctgattcaattcacccggatggcggccttgatgcacagcgaacacaatgtgcggctcaattgcgtgatcccgggcctcatcacgacgccgcttgtgcagcggctcgcgcagcagttcggcggcggcgattacgagagttatctgaagcgccgcaatgcgcaggttccgctggcgcaggagggggacgcctgggacgtcgccaatgccacggcttttctggcttccgacgaagcgcgctacatcacggcgacggaaatcctggtcgatggcggg

SEQ ID NO: 28148 - DNA, 774 bp, Burkholderia fungorum
agattgcagggaaaggtcgcgcttgtcacgggtgccggatgcatcggcccgggttggggcaacggacgcgcgatcgccgttcgctttgccgaggaaggcgcgcatgtgattgccgttgatcgtgacctggcctcgatggacgcgacgctcgaactcgtccgcgctgcgggcgggagcgtaacgccctgcctgtgcgacgtgactgacagtgcgtcggtcgagcgcctcgtcgccgacagcgtggcacgctgcggacgcgtcgatatcctcgtgaacaatgtcggcgctccgtcgccgggcggaccggttgcgcttgacgaggcgcagtgggcgatgcaactcgaactgaatctgacgacggcattcctgatgtgcaaatacgtgctgccggtgatggaacagcagggcggcggcgcgatcgtcaatatcgcctccacctcgggcatccgctggacgggcgcggcgcaggtcggctatgccgccgcgaaggccggcatgatccagatgggccgcgtcgtggccgtcgaatatgcggcgaagaacgttcgtgtcaattcggtagtgcccggtctgctgcatacgccaatggtcgatacgaagatcgcacacaaccaggccggcggcgatgtcgagttgctgctcaggaagcgccaggcgcgcattccaatgcctttcatgggagacggccgcgacacggccaatgcggcgctctttcttgcatcggatgaagcgcgttttgttaccggcaccgaaatcgtggtcgacggcgggatg

SEQ ID NO: 28149 - DNA, 1782 bp, Burkholderia fungorum
tatacggcacccatcaaggacatgctgttcgtgatgaaagaactggccggtctcgaacacatcgcgacgctgccgggcttcgaagatgcgaacctcgacaccgcgcaggccgtgctcgaagagtcggcgaaactgtgcagcgaagtgctggcgccgctgaatgtcgaaggcgatcgcaatccgagtagctggaaagacggcgtggtcaccgcaacgcctggcttcagggaagcgtttcgccagttcggcgaaggcggctggcaaggcgtgcagcatccggtccactacgaaggccagggtctgcccaagctgattgccacagcctgtatcgagatgctcaacgcgtcgaacctgtcgttcgcgctgtgcccgctgctcaccgacggcgcgatcgaggcgctcctcaccgctggcagcgaggagcagaagcagacctatgtgcccaggctgatttccggcgaatggaccggcacgatgaacctgaccgagccgcaggccggctccgatctcgcgctggtgcgcacgcgcgccgagccgcagggcgacggctcgttcaaactgttcggcacgaaaattttcatcacgtggggcgagcacgacatggcgaagaacatcgcccatctcgtgctggcgcgcacgccgaacgcacccgaaggcgtgaagggcatttcgctgttcatcgtgccgaagtttctcgtcaacgaagacggttcgctcggcgagcgcaacgacgtgcactgcgtgtcgatcgaacacaagctcggcatcaaggcgagcccgaccgcggtgctgcagttcggcgaccacggcggcgcgaccggtcatctgatcggcgaagagaatcgcggtctcgagtacatgttcatcatgatgaacgcggcgcggtttgcggtgggcatgcaaggcatcggcgtgtcggatcgtgcgtaccagaaggcggtggcatacgcgaaagaccgcgtgcaaagccgtcccgtggatggctccgcgaaacagccggtcgcgatcattcagcaccccgatgtgcgccgtatgctcgcgaccatgcgtggtctcaccgaagcatcgcgcgcgctcgcttatgtggccgcggctcattgcgatatcgcgcaccgtcacgcggacgaagccacgcgcgcccaacaccaggcgatctatgaatacctcgtgccgatcgtgaagggctggagcacggaactgtcgatcgatgtgacgagcctcggcgtgcaggtgcatggcggcatgggcttcatcgaggaaacgggcgccgcgcagtactaccgcgacgcgcgcattctgcctatctacgaaggcacgaccgcaattcaggccaacgacctgatcggccgcaagacggtgcgcgacggcggcaaggtggcgaagtcgctgctcgccggggtggctgaaacggttgaagcgctcggcgcgcagcaaggtccggcgttcgcgtcgatgaagaagtatctcgcacagggtcatcgctcgttgagcgcggtggtcgagttcgtggttgcgaatacgaagagcgatccgaatgcggtgttcgccggcagcgtgccgtatctgaagcttgccggcatcgtgctcggcggctggcagatggcgcgtgcgctgctcgtggcggcagagaagcgtgacgaagacccttcgttctacggcgccaagatcgcgaccgcgcagttctatgccgagcatgtgctgccgctggcgtcggcgctcgaagcgtcgattgtcagtgcgaagggtggcgagagcgtgctggcgctgtctgaagatcagttc

SEQ ID NO: 28150 - DNA, 825 bp, Burkholderia fungorum
cgctcgtcggtcacggccggcgacggcgtgcaattgccgctataccgctggccggccgccgcgccgacgcgcgccaccgtggcgctgatccacgggctggccgaacacgccggccgatacgcggcgctggccgggcggctgaacgcggccggcatcgaactggtggcgatcgatctgcgcggccacggccacgcgcccggcaagcgggcctacgtgaggcgcttcgacgactatctgctggacgcgcaagccttgctcgatgccgcggcgcaaagttgcgcgccgctcttcctgatgggccacagcatgggcggcgccgtggccgcgctgtatgcgatcgagcgcctcgaagcgagcggccggcgcctgaacggcctgatcctgtcgagcccggcgctggcgcccggccgcgacgtgccgcgctggatgctcaagctaagccaggtgatcagccgcctctacccgagcttcccggcgatgaaaatcgacgccgcgctgctctcgcgccttcaacccgtggtgaacgccaatcgcgccgatccgctcgtgcatcacggcgcgattcccgcgcgcaccggcgcggaactgctgctggcgatggcgcgcatcgaacgcggccgggcgggcttgcgtgtgccgctgctggtctatcacggcaccgccgacaagctcaccgaacccgaaggcagtcgcgacttcggtcagcacgcgggctcgccggacaagacgctcaccctgcacgagggcagctatcacgagacgatgaacgacatggaccgcgatcgggtgatcggggcgttgatcgagtggatcgaaaaacggctg

SEQ ID NO: 28151 - DNA, 1365 bp, Burkholderia fungorum
atgaaaatcaccattatcggcacgggctacgtgggtctcgtcactggcgcgtgtctcgccgagatcggccacgacgtcttctgtctggacgtcgatccgcgcaagatcgaaatcctcaataacggcggcgtgccgattcacgagccgggcttgcaggagatgatcgcccgcacacgcgcggcgcgccgcatcacgttttccaccgatgtcgaagccggcgtcgcgcacggcgacgtgcagttcatcgccgtcggcacgccgccggacgaagacggttcggccgatctgcaatatgtgctcgaagcggcccgcaacatcggccgcaccatgaacggcttcaaggtgatcgtcgacaaatcgacggtgccggtcggcaccgcgcagcgcgtgcgcgcggtggtcgaagaagagctggccaaacgcggacttgccggcagcgcgcaacacggcttctcggtggtgtccaatcccgaattcctgaaggaaggcgcggcggtcgacgacttcatgcgccccgaccgcatcgtgatcggcctcgacgaagacgaagccggctcgcgcgcgcgcgaactgatgaagcgtctgtacgcgccgttcaaccgcaatcacgaacgcacgctgtacatggacgtgcgctcggccgaattcacgaaatacgcggcgaatgcgatgctcgccacccgcatctcgttcatgaacgaaatgtcgaatctggcggaccgcgtcggcgcggatatcgaggcggtgcgccgcggcatcggttccgatccacggatcggctatcacttcctgtatgccggttgcggctatggcggctcgtgcttccccaaagacgtccaggcgctgatccgcacggccagcgaaagcggccacaatctgcgcattctcgaagcggtcgaagaagtgaacgacaggcagaaagacgtgctggtgcacaagatcacgagcaagctcggcaacgatctgagcggccgcacgttcgcggtgtggggtctcgcgttcaagcccaataccgacgacatgcgcgaggcgccgagccgccgcctgatcgcggaactgctggcgcgcggcgcgcatgtgcgcgcgtacgatccggtcgcggtgaccgaagcgcgccgcgtattcgccatcgacctgcatgacgcaccggagcagttcgcgcgtctcaccttcgcgaccacgcaggacgaaacgctcacgggcgccgacgccctcgtgatcgtgaccgaatggaaagaattcaagagcccggacttcgtccatctgaaatcggtgctgaaatcgccgctgattttcgacggacgcaacctgtatgaaccggacgcgatgaccgagctcggcatcgactatcactcgattggacgc

SEQ ID NO: 28152 - DNA, 1353 bp, Burkholderia fungorum
tctccccattctcaatcgctcgctgatcctttcgcgccgcccgcggactcgtcgttgtggcgcaagaactttctgctcggcgcggccacggcttcgtatcagatcgaaggcgcggtgaacgaagacggccgcctgccgtccatctgggacaccttctcggcaatacccggcaaggtgctggccggcgacaccggtgccgtggcctgcgatcactatcatcgctgggaagcggacgtggacatgctggccgggcttggcttcgaaggctaccggctctctattgcctggccgcgcgtgatggatacggccggcgtgccgaaccgcaaagggctcgagttctacaagcgcctgctggcacggctcaaggagaagggcatcgcgaccttcgtcacgctgtatcactgggacttgccgcagcatctggaagatcgcggcggctggctgaaccgcgataccgcataccgtttcgccgactacgccgacctcatgagccgcgaactggccggcagcgtggacggttggatgacgctgaacgaaccctggtgctcggcgtatctcggctacggcaacggccatcacgcgcctgggcttgccgacgcgcgctatgccacgcaggccatgcatcatttgctgctggcgcacggtctcgccatgccggtgctgcgcgccaacgatccggcttcgcagaagggcgttgtcgccaacattggacgcggcacggccaacagcgggagcgccgccgatcagcgcgcggcgcatctgttcgaggtgcagcacaacgcgtggattctcgatccgctgctggaaggccgctacccgcgggatctattcgaactgtggccgggtaccgagccgctggtgctggacggcgatatgcaaaccgttgccgcgccgctggacttcctcggcatcaactactatttccgcaccaatgttgcgagcgacggtgcgcatggtttcagggaagtgccgctccaaggcgtggagcgcacgcagatgggttgggaagtgtatccggacggcttgcgcgatctgctgatcggcttcaaggccacctaccggaatctgccgccgatctacatcaccgaaaacggcatggcatcggacgacaaggtgatcgacggccgggtggatgacatgcaacgcatttcgtttctgaagcgccatcttgccgcggtggatgaagcgatcaaggcaggcgtggagattcgcggctattttctgtggtcgctgatggataacttcgagtgggcgttcgggtacgagcggcgctttggtgtcgtgcacgtggattacgctacgcagaaacgcacggttaaacgcagtgccgaactggtgtcgaaattcctgaag

SEQ ID NO: 28153 - DNA, 1440 bp, Burkholderia fungorum
cacagacagtacattgacggccaggcggtagcagcgatggacacggttgcgaccgacatcatcaacccgtcgaaccggaaggtcgtcgcgtcggtacgtcaggccacacctgcccaggttcagcacgccgtggcgagtgcgcacgaggcttttaccggcgtgtggcaacagacctcggctgcgcgccgcggcgaactgctgaaccgtcttgccgatctgatgcaggcgcatcgcgaggaactcgcacaaatcgaaagcctctcatcgggcaagctcatcggcctgtcgcgcgcgttcgagatcgactactcgattgcgttcctgcgctattacgccggctgggcgacgaagattcatggccagacaatgaacctgtcgctgccgtcctcgaacggtgaacagtatacgggcttcacgctgcgtcagccgatcggcgtggtggccggcatcgtgccatggaatttctcgatcatgattgcggtctggaagttcgggtccgctcttgcctgcggttgcacggcggttatcaagccaagcgaattcacgccgcttacgatgctgcgggtcgcagaactcgcccttgaagcggggatcccgcccggggtgctcaacatagtgaacggcaacggcaggacggtcggcaccgcgctgattgcgcaccccaaagtcgcgaaagtcacgttcacagggtcggttccgaccggggtgggcgtcggcgtggccgcgatgcaggccggactcaagcacgtcacgcttgaactcggcggcaaaaacccggcgggcttcctgcgagattttccagtcgagcgtacggtggacggcatcatcgaggcggcctacttgcaccagggcgaagtctgcgcatcggccgaacggttctatgtgcaccgctcgcgcatcgacgacgttctggaggctctacatcacacgctcgcgaccctaaaaattggctccgcgctcgatgaaagcgcgcagttcggcccgctggccaacgccgcacacttcgccaaggtgatggcgttcttcgaaaaggcgcgcgcgcaggatggagagatcgtccacggcggcacagtcgcaccaggcgacggcttcttcgttcagcccacggcaatccctgcccgttcgcaagccgacaccatcatgaccgaggaaacgttcgggccggtcgcgagctttctcgcgtacgacgacgaagaagaaatgctgcactacatgaacgacacgcacttcggcctcacggcaagcatctggactaatgacctctccaaggcattgcgctttgtgccgcgtgtggaagcgggtacggtgtgggtcaacatgcacaactatatcgatccagccatgccgttcggaggcgtcaagtcctccggtatcggccgcgagttcggcgaggcgttcatcgagtacttcacggaattgaaatcagtgatcgtccggtat

SEQ ID NO: 28154 - DNA, 1614 bp, Burkholderia fungorum
atcggcgcttttcttgcccgtcggctcaccgaagccggtgtccgacatctgtttggcgtaccaggcgacttcaacctgtcctttctcgaacagatccaggaagcagacgggatcgagtttgttggcaactgcaacgaactgaacgctgcctatgccgccgatggctacgctcgcacgtccggcatcgcagcgctcgtcacaacatttggcgtgggcgacctgggagcgatcggcggtatcgcgggtgcctatgcggaaaacgtgcctgtcgtgcacatcaccggtacgccgccgctgcacgccgtcaacagccgggcgctcgtgcatcacacgctcgtgaatggcgactatgacaacatcgggcgctgcatgtccgaattcaccgtagcccagacgcgtatcacgcccgccaacgcagccttcgagatcgaccgcgtgctgcgctcttgctggcttgaacgccgtccggtgcacctgcaactgccttccgatgtcacgcacgtcgtcgtggaggtgcccgaagcgcctctcatgctcgccgatccctccagcgatccccaccagttgcgtgaagccacgcgacgcatcgttgaagcccttgcgtccgcacgtttccccgccatcgtcgtggacgcggacgctgaccgctttggggtcacggaactggtacagaaactcgccgagaagtgcagcatcccatgcgcgtcgctgacgccagccaagagtgcactcaacgaaacgtcccggcactacgtggggacctatgtgggcgctgccagcgctgagccggtgcgctcgatcgtcgaaaacgcggactgcctgatcggcgtgggcctgcgcttcacggacacgagtaccgcgctgttctcgcagcacttcaacccggaagccttcatcgacctgcgccggcacgacctgagtctcggaacaacccagattccaggcgtcacgctcagggacgtgctcgcccgggtggtggacgacgcacagcccgtggtccgcgaacgtgcaacccaggctctcgccgctgctagcgacgcgctacccgcctcatccggcaacgtgccgctcacgcatgccgcgctatggccgcgtatccgccgcttcctgaaacctcgcgacgtgatcctcggtgaagcgggtacctcacacgcatcgctctccgcgatgaagctgccgcccggcgcgacctacatcgcacagcccatctggggtgcaatcggctatacgctgcccgcgctgttcggctcgctggtcggtaccccttcacgccgccatttgctgttcatcggcgacggctcattccagctcacggcccaggagctgtcttccattctgcgccgcgacctgaagccggtgatctttctgctgaacaactcgggctacacgatcgagcggctgattctcggcgaacactccgcctataacgacgtcgccaactggcactacgccggactgccgcatgcgttcgaccgacgcgagcgcgcactgtctctcgtcgtcgagacggtcgcagatcttgaggcggcgctgaatcgggccgagtctgccgagcacctcgtgttcatcgaattgaagctgccgatgatggacgcaccggagtcgttgaaaaag

SEQ ID NO: 28155 - DNA, 876 bp, Burkholderia fungorum
atgtttaaagcagatacgcaagcgcagttgtgcttcaagcttggcgatgagattggctcagaaggcaagaactcggcggtttttcgcgcacgcgacctgcaactggacgcggagcttgcgataaaacaagtcaagaagtcgtcgattagcgacacggcagactatttccgtgaggccagcattctttaccttggagaccacacgaatgtggtcccgattcactatgcatgcgaggatgcggaccacgtttacctcgcgatgccgtactatccgaatggttcgctcaatcgtctaatcgaacagcgatttctcacggtccgggaagtagttcgctacggtattcagttcctcagcggtctgcacaacatacactcgaaagggctgattcatttcgacatcaagccagacaatatcctattgtctagtcggaacgaggctctcctgtctgatttcggcctcgcgcgacgaatgaatgccgacggcactgctgaaccgccgctgagctactggaagaacattccgccggaggcgctcgcaacgtcggaacatacggtcggctacgacatctaccaggtggggctcacactctaccgaatgtgctgtgggaacgacaccttctacgaacaactgaagcagttcaagacgttcgcggatttcggggccgcggtgaacaagggactctttccggaccggtcaacgtttcctgcacacattcctaacgctcttcgaacgcttgtgaagaagtgcatcaacgtagatgtcgacgcacgctacggcgcagtcatcgaggtctcgaatgcgttgggtggcatcgaaggcaatgagctggattggcagtacgaggtttatccggacggcactcgagagtggaccaag

SEQ ID NO: 28156 - DNA, 798 bp, Burkholderia fungorum
gcggcgttcacggtcgtgattacgcgaccggccggtcagtcaaacgaactgatcgcacggctcgccgccgcaggcatcgccacgctcgactttccgctgatcgacgtcgcgcccgtcacggacgaggctccattgcgcgcggcgttgagttcgctcgaacgctatgcgctcgtcgtgttcgtgtcgccgaatgccgtcgattacgccttcgcccgcagcgatacgatctggccgcatgcgctgccgatcggcgtggtcggtccgggcagcgtgcaggcgctggcgcgtcacggcgtgacctcgccggcatacaacgtgatcagcccgccgtccggcaccgacgaagaaaccgcgcgcttcgattccgaaggcctcttcgcggcgatcgacacggcgctcggcgcgacgaacctggaaggcaaacgcgtgctgatcgtgcgcggcgacggtgggcgcgagtggctggccgagcgtctgcgcgaagccggcgccgaagtcgagaccgtcgcggcgtaccggcgcctcgtgccggaaccgtcgataggcggctgggcgcgtgtgcacgaattgctcgcgggcgcgccgcacgcgtggctgctcaccagttccgaaggcgtgcgcaatctgcacgaactggcgcaagaccacctcaccgccgacgaaatctctcaactcaaacgcgccgcgctcgtcacgccgcatccccggatcgcgcagaccgcgcgggcattgggttttgatagcattacggtgtccggcgcgggcgacgagcgcattgtccgcaccctgcttgccgcc

SEQ ID NO: 28157 - DNA, 921 bp, Burkholderia fungorum
ccccacacgcttgtgattgcgtcgcgagagagccgcctggccatgtggcaagcggagcatgtgcgatgtgcgctgcacaaattatatccatcttgtgacgtaaaaatcctcggaatgacaacacgtggcgatcaaattctcgatcgcactttgtcgaaggttggcggcaagggcctcttcgtcaaggaactggaagccgcgcttgccgacggccgcgccgatctcgccgtgcattcgctcaaagacgtgccgatggcattgcccgaaggctttgcgctatccaccatcatggaacgcgaagatccgcgcgacgcactggtttccaatacgtacgactcgcttgccgcgttgccggaaggcgccgtggtcggcacctccagcctgcgccgcgaggcgatgctgcgcatgcgctatccgcatctcgaagtgcggcctttgcgcggcaatctggacacgcgcctcgccaaactcgatcgcggcgattacgcggcgatcattctggcggcggccgggctgaagcgcctgggtctcggcgagcgtatccgcgcgttgctcgatcccgaagacagcttgcccgcagcggggcaaggcgcgctcggcatcgagattcgcgccgaccgcgcggaactcgcggcatggctcgcgccgctgcatcacgaacacacggccgcagccgtcgaagcggagcgcatggtctcgcgcgcgctcggcggcagttgcgaagtgccgctcgccgcctatgccacatggcatgacggcgcgctgcatctgcgcggcatcgtggcgacgccggacggccagcgcgtgctgagcgcgcaggcgtcggcgccggcaaccagcgtcgagcaggctatcgcgctcggccaggaagtcgcgggcgcgctcgagcagcaaggcgcgatggagatcgttcgcgcactc

SEQ ID NO: 28158 - DNA, 2451 bp, Burkholderia fungorum
gtcaagacggacaaggctgtgaaggcagtcagatcggataagacgacgcaagccgcaaccacggcccaggcgcaaaaaccggccaaggccggctcctcgaagatcaagatcgttaccgccgcaccgcaggcggcgaacgcgtccgcgcggcagcccgcgtcggcgcaagcgcccgcgccgaaagccaatggccgcacgcgcgaggacaaggaccatccgctgttccaggacatccgttatctgggacgcctgctcggcgacgtgctgcgcgagcaggaaggcgacgcggtgttcgacgtggtcgaaacgatccgccagacggccgtgcgctttcgccgcgaagacgacagcgccgccgcgcagacgctcgacaagaagctgcgctcgctgagcccggaacagacggtcagcgtggtgcgcgccttcagctatttttcgcatctcgcgaacattgcggaagaccgccaccgcaatcgccgtcacaggattcacgaactggccggctcgacctcgcagccgggcacgattgcccactcgctcgaacgcctcgtcgaagccggcgcagccgccacgccggtcctgcaagagttcttcaacaacgcgctgatcgtgccggtgctcaccgcgcacccgaccgaagtgcagcgcaagagcattctcgacgcgcagcacgacgtcgcccggctgctcgcggaacgcgaccagcagttgaccgaccgcgaacgcgcgcacaacgaagcgatgctgcgcgcccgcgtcacgtcgctgtggcaaacgcgcatgctgcgcgattcgcgcctctccgtggccgacgaaatcgaaaacgcgctgtcgtactaccgcgccaccttcctcgaagaaatcccggcgctctacgccgatatcgaagaagcgctcgccgagcacggcctcgaagcgcgcctgccgccgttcttccagatgggcagctggatcggcggcgaccgcgacggcaatccgaacgtcacggccgaaacgctcgaaaacgcgatcacccgccaggccgcggtgatcttcgagcattacatggagcaggtgcacaagctgggcgccgagctgtcggtgtcgaacctgctggccggcgccagcgacgcgttgaaggaactcgcagccgtttcgcccgaccagtcgccgcatcgcacggacgagccgtatcgccgcgcgttgatcggcatgtacacgcggctcgcggcaagcgcgcgcgtgcgcctcggcgaaggcagcgtgccggtgcgcagcgcgggccgcggcgcggcgccggtgcgcgccaagccgtacgcggactccgccgaattcgtgcgcgacctgcacgtgctgatcgattcgctcgccgagcatcacggcgcgccgctcgccgcaccgcgtctgtcgccgctcgcgcgggccgctgaagtgttcggcttccatctggcgagcatcgacttgcgccagagctcggacgttcacgaggcggtgatcaccgaactgctcaggcgcgcaggcgtcgaagaaaactatgcggagctccccgaagcggacaagctcaacgtgctgctctcggaactggcgcagccgcgtccgttgcgtctgccgttcgcggagtattcggacctcgtgaagagcgagctcggcgtgctcgaagaagcgcgcgtcacgcgcgaaaagttcggcgcgcgcgcggtgcgcaactacatcatttcgcacacggagaccgtcagcgatctggtcgaagtgatgttgctgcaaaaggaaaccggcctgctgcgcggttgcctcggcaatgcgaacgatccggctcaagcgggtctgatggtgattccgctgttcgagacgattcccgacttgcgcaacgcgccgcatatcatgcgcgatctgatcgcactgccgggcgtcgatgcgctgatcgaacatcaaggcaacgagcaggaagtcatgctcggctattcggacagcaacaaggacggcggcttcctcacgtcgaactgggagttgtaccgcgccgaactcgcgctggtgtcgctgttcaacgaacgcggcgtgacgctgcgtctgtttcatggacgcggaggcaccgtgggccgtggcggcggtccgacctatcaggcgattctgtcgcagccgccgggcaccgtggacggccagatccgcttgactgagcaaggcgaagtgattgcgagcaagttcggcaatccggaaatcggccggcgcaatctggaaacggtggtcgccgcaacgctcgaagcgtcgttgctgccgcacggcatcgcgccggcgcaactgcccgcgttcgaagaaacgatgcagcagttgtccgacgcggcaatggcgtcttatcgcgcgctggtctacgaaacgcccggcttcaaggagtatttcttcgagtcgacgccgatctcggagatcgccgaattgaacatcggcagccgtccggcttcgcgcaaactgcaggatccg

SEQ ID NO: 28159 - DNA, 1374 bp, Burkholderia fungorum
gaagcctggtcggctcgcttctcggagccgatgtcggagctcgtcaaacgctacacgtcgtcggttttcttcgacaagcgattggcgctcgtcgatatcgaagggtcgctcgcgcacgcctccatgctggccgcgcagaagatcatcgccgccgacgacctcaccgcgatccaacgcggcatggcgcagatcaagggtgaaatcgagcgcggcgaattcgagtggcaactcgatctggaagacgtccacctgaatatcgaagcgcgcctgaccgcgctgatcggcgacgccggcaagcgcctgcacaccggccgctcgcgcaacgaccaggtcgcaacagacattcgcctgtggctgcgcggcgagatcgaccgcatcggcggcctgctcacggaactgcgcacggccctgctcgacatggcggagaagaacgccgcgactatcatgccgggcttcacgcacttgcaggtggcgcagccggtcacgttcggccatcacctgctcgcttacgtcgagatgttttcgcgcgacgccgagcgcatgatcgattgccgcaagcgcgtgaaccgcctgccgctcggcgcggccgcgctcgccggcaccagctatccgatcgaccgctacgcagtggcgaagacgctgggcttcgacggcatctgcgcgaactcgctggacgcggtgtccgaccgcgacttcgcgatcgaattcacggcggcgtcggcactcgtcatgacgcacatctcgcgcttctccgaagaactggtgctgtggatgagcccgcgcgtcggcttcatcgatctggccgaccgcttctgcaccggttcgtcgatcatgccgcagaagaagaacccggacgtgcccgaactcgcgcgcggcaagaccggccgcgtgaacggccatctgatcgcgctgctcacgctgatgaaaggccagccgctcgcgtacaacaaagacaatcaggaagacaaggaaccgctgttcgatactgtcgatacggtcgcggatacgctgcgcatcttcgctgaaatggtcgccggtatttcggtgaagccgcaagccatgcgcgacgctgcgttgcaaggcttctcgacggcaacggatctggccgactacctcgtcaagcgcggcctgccgttccgcgacgcgcacgaagcagtggcgctcgccgtgcgcgtatgcgcggatcgcggctgcgatctggcggatctgacgctcgaagaaatgcgcaaggaactgtcgaacgtcgcgcatctgattggcgaggacgtgttttcgtatctgacgctggaagggtcggtggcgagccgcaatcatccgggcggcacggcgccggagcaggtgctcgcagcggtgaaggcggcgcgcgaagcgttg

SEQ ID NO: 28160 - DNA, 621 bp, Burkholderia fungorum
atgtcagacgaacaacagaagaaaatcgcgttggttaccggggcgacccggggtctcggatttgagacggtgcgccaactcgcggcaagcggggtgcgtgtactgcttggtgcacgagacacccatgcgggagaagcgaaagctgcggaactgcgtgccgaggggcttgatgttcggcccatcgctatcgatttgaataatgccgctaccttcgatcaggctgccaaagaaattgatgccctgtttggccgtctggacatcctcgtgaacaatgcaggtgtgatgtccgacgcagatggttttcccagcgtcgcgaatccccaggcgatgcgtgacgttatcgaaatcaatttcatcgcaaccgtcatcgtcacgcagaacatgcttcccctgctgaggaaatcgaaacatgggcgtatcgtcaatgtttcgagcagggtcgggtcactgtggtggaatagtgatccggacaaccccgtcccggacaataaatggcttggttatgccgcatccaaggcagcggtaaacatgttgaccgtcgaacttgcctacgagttgcgcgatacccctatcaaggtgaatgccatctgcccgggctatgtgaagacagaaatgaacaag

SEQ ID NO: 28161 - DNA, 720 bp, Burkholderia fungorum
aaggtcgccatcgttaccggggcctcccgggggatcggcgcctccatcgccaaacggctggcggccgacggcttgaccgtcgtcgtcaactactcgggcagcgatgccgccgccgctgcggtcgtcgaacagattgaagaagcaagcggccgcgcgcgctcggccaaggccgatatcagcgatgccgccgctgtacgccgcatgttcgaggccgccgaaaccgcctacggcggcgtcgacgtgctcgtgaacaatgccggcatcatcggcctcaaacccatcgcgtcgatggatgacgaaaccttcgaccgcatcgtcaaggtcaacctgaagggcaccttcaacacgctgcgcgaagccgccaaccggctccgtccgggcggccgcatcgtcaacttctcgaccagcgtggtcggcctctatcagccgacctatgcgatctacgcggccaccaaagccggcgtcgaagccatgacgcacgtgctgtcgaaggaactgcgcggccgcaacatcacggtcaatgccgtggcacccggcccgacggccaccgaactgttcttcgacggcaagaccccggaagtcatcgaccacctgaccagactggcgccgctcgaacgcctgggccagccggaagacatcgccaatgcggtcgcattcctcgcgggtcccgacggcgcctggatcaacggccaggtcctgcgcgccaacggcggcatcatc

SEQ ID NO: 28162 - DNA, 651 bp, Burkholderia fungorum
atgaacatcaaaggttgtacggcactcgtcacaggtgccaatcgaggcttggggaaggttatcgtcgaccagctggcgcaggccggtgctgccagaatctacgccggtatgcgtaatccagctgtgatcgggcacgacgtcgttacgccagtcgcgctcgatgtcacggacgcggattccgtggcgcgcacggcagagaagtgcagcgatgtcgacctggtcatcaacaacgcaggcatcatgctcgcaacgccaatgcttgctgacgattcggaacaggcgctgcgccgcgaactggatgtgaatgcgtttggcccattgcgcatcgccaaggcgtttgctccgatcctggcgcgcaacggcggtggtgcgattgtcaacatgctgtcggtggtgagctggtatgtctatccgttcaacgccacctattgcgcttcgaagttcacggcactggcgatgaccgacgccatgcgcgtggaactgaaggcgcagggaacgcacgtgatgggcgtctatgccggctttatcgacacggatatggccgctcgcgtgacgggcgaaaagacctcaccggttcaggttgccgagcgaatgctggcgggcctccgggcaggaaaggatcacgtgcttgcagacgccgcggccgaggag

SEQ ID NO: 28163 - DNA, 946 bp, Burkholderia fungorum
cagcagcccatgaattcagtttggggtgaacgaaccacggcgcaggaagttgctcgaggacctgagcggcaagaccatccttatcacgggtggtcactcggggatcgggcttagatccacgcgggtgctcgctgcggcgggtgcccgaatcatcgtcggtgcgcgcgacatagccaaggcgcgtaccgccctggccggcaccagggcgttgagttgctgggcctggatctgtccgatccggcttccatcacccgtttttcgacgcaggtgctgaaggttcatgaaaagatcgatgtcttgatgaataacgccggcatcatggcgctgccgaagctgatcaaggacagtcgggggtacgagttgcagttttcgaccaatcaccttggacatttccagctcacggcgctgttatgggacgcactgaaaaagccggcggtgcgcgcgtggtgacgctctcctcgtacggtcatcgttattcgcctgtggacttcgacgatccgaatttcggttcaaggcgctacgacaaatggaaggcctatggccagtccaagacggccaacgcgcctttctcagtggagctgggcaggctcgggcagccattcggcattcgcgcctttccgtgcatccgggccggactccgtcgacagccctcaagcgctcactgacgttcaaggagttgctggccatgcccttgctgttgttcagcaaggtctatgtcaagaacatccaggagggggctgcgactcaggtgtgggcagcgttgagcagtcagctcgacggcaaggacggtgtttattgcgcaggttgcgatatctcgcctgcagttacgccggacagtccgttagccaataccgtgcgcgattatgcggttgatccggatcttgcaagaaagctttgggtgttgagcgaaaagctggtgggcttcgcgtggccgcacgagtagcga

SEQ ID NO: 28164 - DNA, 840 bp, Burkholderia fungorum
gactatgcgcgcaagctgaaagtcgccgccgacacttacagggacgacctgctgatcgtaatgcgggtctacttcgagaagccgcgcactaccgtcggctggaaaggctatatcaacgacccgcggctcgacggcagtttccgtatcaatgaaggtctgcgtctcgctcggcaattgctgctcgatatcaacggtctcggcctgtccaccgccaccgagtttctcgacctgctgagcccgcagtacatcgccgatctgatcgcgtggggcgctatcggcgcgcgcacgacggagagtcagagccatcgtcaactcgcttcgggactgagctgcccgatcggcttcaagaacggcacggacggcggcgtgcagatcgccgcggacgcgatcgtcgccgcgcgcgcgagccatgcgttcatgggcatgacgaaaatgggcatggccgcgatcttcgaaacgcgcggcaacgacgacgcgcacgtgatcctgcgcggcggcaagaaagggcctaactacgacagcgcgtcggtggacgcgacttgcgtcgcgctgaaatcagcgggactgcgcgagcaggtcatgatcgactgttcgcatgcgaactcgggcaaatcgcatttgcgtcaactcgaagtggtgcaggatatcgcgctgcagttgtcgcagcgcgagcgccgcattatcggcgtcatgctggaaagtcatctggaagaaggccgccaggatctgaagcctggtgtgccgttgcgtcacggcgtatcgatcacggatgcctgcgtcagctgggcgcagaccgagccggtgctcgaaacactcgccgaggccacccgcaaacgccgc

SEQ ID NO: 28165 - DNA, 819 bp, Burkholderia fungorum
gacgtcgtggtctcgggcgtgccgctcgatctggccaccacgtttcgctccggagcgcgcctcggacccgcggcggtgcgtgcggccagcgtgcagctgtcggaactgcatccgtatccgtggggtttcaatccgttcgacgacctcgccgtgaccgattatggcgactgctggttcgacgcgcacaatccgctcacgatcaaggcgtccatcgtcgagcatgcgcgcacgattctgcgctcgggcgcaaagatgctgacactcggcggcgatcactacatgacctatccgctgttgatcgcgcatgcggagaagtacggcagaccggtctcgctgattcatttcgacgcccattgcgatacctgggccgacgacagtcccgacagcctgaatcacggttcgatgttctacaaggcggtgaaggacggcctgatcgatccggagacctcggtgcagatcggcattcgcacgtggaatgacgatttcatgggcatcaatattctcgacgccgcctgggtgcacgagcatggcacgcgagcgacggtggagcggattgcgtcgatcgtgggggaacgtcccgcctatttgacgttcgatatcgactgtctcgatccggcgttcgcgccgggcacgggcacgccggtggcgggtggcttgtcgtcggcgcagggactggcgatcgtgcgcgcgctcggtgccttgaatctggtgggcgcggacgtcgtggaagtcgcacccgcttatgaccagagcgagatcacggcgattgccgctgcgcatatcgcgtgcgatctgttgtgcctgtggcgtcaacgcaag

SEQ ID NO: 28166 - DNA, 1476 bp, Burkholderia fungorum
ctcgccttctggcaagacaaagccgctacgctttctattgaaggccgcgcgtttatcgacggtgaataccgtgacgcggaaggcggccgcacgttcgactgcctgagtccgatcgacggcaagctgctcgccaaagtggccgacagcggcgcggccgacgtcgacgctgcggtgtcggcggcgcgccgtgcattcgactccggcgtgtggtcgggcctcaatccgcgccagcgcaaagccattctgctgcgttgggccgcgtcgatccgcgagcatatggacgagctcgcgctgctcgaaaccctcgacgcgggcaagccgatcgccgacaccaccagcgtggacgtgccgggcgcggcgtattgcgtcgagtggtttgccgaagcgatcgacaaggtgggcggcgaagtcgcgccggccgatcatcatctggtcggactcgtcacgcgcgagccgatcggcgtggtggctgcggtcgtgccgtggaatttcccgatcctgatggcgtcgtggaaattcggcccggccctggccgctggcaatagcgtggtgctcaaaccttcggagaagtcgccgctcaccgcgatccgtctcgcgcaactcgcactcgacgcaggcattcccgccggcgtattcaacgtcgtgccgggcgcgggcgagccgggcaagctgctggcattgcatcaggacgtggactgcctcgctttcacgggctcgaccaacgtcggcaagctgatcatgcagtacgccggccagtcgaatctgaaacgcgtatggctcgaactcggcggcaagtcgccgaacatcgtgatgccggattgccctgatatggaccgcgcggcgaacgcggcggccggcgcgatcttctacaacatgggcgagatgtgcacggcgggttcgcgtctgctcgtgcatcgcgacatcaaagacgtgttcctcgacaagctgatcgccgcggcacgcagctatacgccgggcaatccgctcgatccgaacacgtcgatgggcgcgatcgtcgacaaggttcagctcgaacgcgtgctcggctatatcgaagccggccgcgccgaggcaaagctgttgctgggcggcgcacgcgtgaaagaggaaacgggtggcttctatatcgagccgaccatcttcgagattccggcttcaggtgcaaaggtcgcgcgcgaggaaatcttcgggccggtgttgtcggtgatcacgttcgacacggtggaagaggcgatcaggatcgctaacgacagcgagtacggtctcgccgccgcggtctggacctcgaacctgaccatcgcgcacgaagtgtcgcgcaagctccgcgcgggcacggtatgggtcaattgctacgacgagggcggcgacatgaatttcccgttcggcggctacaagcaatcgggcaatggccgcgacaagtcgctgcacgcgctggaaaaatacaccgagctgaagtccacgctcgtgcggctgcgc

SEQ ID NO: 28167 - DNA, 1335 bp, Burkholderia fungorum
accgccgaatatcgcgcgctggacgccgcgcaccacatccacccgttttcggatatgggcgcgctcaatcgcaccggcagccgcgtgatcgtcaaggcacaaggcgtgtacctgtgggactcggacggcaacaaggtgatcgacggcatggccggcctgtggtgcgtgaacgtcgggtatggccgcaaggaactggccgacgccgcgtacaggcagatgatggagctgccctactacaacaccttcttcaagaccacgcacccgccggtgatcgaactgtcggccttgctcgcggagctcgcgcccgaaccgttcaatcacttcttctactgcaacagcggttcggaaggcaacgacacggtgctgcgtatcgtccaccattactgggcaacgcagggcaagcacgcgaagaaattcgtcatctcgcgcaagaacggctatcacggttcgacgatcgcgggcggcacgctcggcggcatgggctacatgcatgaacagatgccctcgaaagtcgagaacatcgtccatatcgaccagccgtatttcttcggcgaggcacaaggcaacctgacgccggaagagttcgcactggcgcgcgcgcagcagctggaagcgaagattctcgaaatcggcgcggacaatgtcgccgcattcattggtgagcctttccagggagcgggcggcgtgatcttccccgcttcgacgtattggccggaaatccagcgcatttgccgcaagtacgacattctgctcgtcgcggacgaagtgatcggcggtttcggccgcaccggtgaatggttcgcacaccagtacttcggattcgaaccggatctgatcacgctggccaagggcctgacgagcggttacataccgatgggcgcggtcggcctgcatgaccgcgtcgccaaagcgatcatcgaaaacggcgacttcaaccacgggctcacgtattcggggcatccggtcgccgccgccgttgcggtcgcgaacctcaagctgctgcgcgacgaaaagatcgtcgagcgcgtcaagaccgatacgggtccgtacttccagaagaagctgcgcgacacgctcggcaatcacccgatcatcggcgagatctccggcgcgggtctggtggccggcctgcaactcgcgcaagacccgaaaacacgcaagcgtttcgccaatggcggtgatgtcggcacgatctgccgcgacttctgcttcaacggcaatctcatcatgcgcgccaccggcgaccggatgctgctgtcgccgccgctggtcatcaacaagctggaaatcgacgaaatcgtttcgaaggccaaaaaagccatcgacgcgacggca

SEQ ID NO: 28168 - DNA, 1071 bp, Burkholderia fungorum
atgaagacctatcgcatcgcaaccattcccggcgacggcatcggcaaggaagtcgtgcccgcaggccggcgcgtgctggaagccatcgccgcgcgcagcgacgccttcggcttcgagttcgagaatttcgattggggcggcgactactaccgcgagcacggcgtgatgatgccggccgacggactggacgcgattcgccatcaggacgcgatcctgttcggctcggcgggcgacccgcatattcccgatcacgtcacgctgtggggactgcgcctgaaaatctgccagggtttcgatcagtacgcgaacgtgcggcccacgcgcatcctgcccggtatcgacgcgccgttgaagcgctgcgggccgcaggatctcgactgggtgatcgtgcgcgaaaactcggagggcgaatatgccggcgtgggcggccgcgttcaccagggccatccgatcgaagtcgccaccgacgtctcgatgatgacgcgcgccggtgtggagcgcattctgcgttttgcgttccggcttgcgcagtcgcggccgcgcaaactgctgaccgtgatcaccaagagcaacgcgcagcgccacgcgatggtcatgtgggacgagatcgcggtgcaggtgtcgaaggagtttccggacgtgcgctgggacaaggaactggtcgacgccgccaccgcgcgcatggtcaaccggcccgccacgctcgacacgatcgtcgcaaccaacctgcacgccgatattctcagcgatctggccgctgcgctggccggcagtctcggcattgcgccgaccgcgaatctcgaccccgagcgccgctatccgtccatgttcgagccgattcacggctccgcgttcgacatcatgggcaagggcctcgcgaatccggtcggcaccttctggtcggtggtgatgatgctggatcaccttggcgagcacgccgccgcgcggcaactgatggcggccatcgagcgcgtcacggcggacccgtcgctgcatacgggcgacctgggcggcacggcgacgaccgcgcaggtgacggacgccgtttgcgcgatcctcgcggccggctcg

SEQ ID NO: 28169 - DNA, 636 bp, Burkholderia fungorum
ctcgagtgccgtggattgagcaagacgtacggcgcaggccgcatcgtgctggcgcacctcgatttcacactcgcgccgggcgagttcgtcgcgatcatgggcgattccggcgtcggcaaatcgacgctgctcaatctggtagccggcctcgacagcgcggatagcggcgacgtgatcatcgacggcagcgtcgtctcgcgtctggacgacaacgcggccacccgcttgcgccggcagaaactcggcttcgtctttcaggcgtttcacgtgctgcctcacctgacgctcgcgcagaacgtggcgctgcccctgttgttgaacgatctgcctactgctgccgcgctcgacatgctcgcggccgtcggtctcagcggacgcggtgacgactttccacgccaactctcgggcggcgaactacagcgtgtcgcgatcgcgcgggccctcgtgcatcgcccgaaactgattctcgccgacgaacccacgggcaacctcgaccccgacaccgcccacgacgtgctcgccctgttccgcgcgcaaagcaaggcgaccggcgcggccacgatcatggtcacgcactcggaggccgccgcggccgttgccgaccgcatcctgatcctgagcgacggcggtctgcac

SEQ ID NO: 28170 - DNA, 552 bp, Burkholderia fungorum
cgagccaaactggtagtcggtaactggaagatgcacgggcgcctcgccgaaaatgccgtgctgttgcaggcggtggcgcaaggcgcgggcgaattgccggctcaagtgcgcgtcggtgtttgcgtgccgagcccgtatctcgcgcagtctcaatcgttgctggaaggcagccgggtggcgtggggcgtgcaggacgtgtcagcgttcacgcatggcgcctacaccggcgaagtggccgcgccgatggcggtggatttcggtgccacgctggcgatcgtcgggcattcggagcgccgtgcctatcatcgcgagagcgccgagctggtcgcggtgaaaacgcagcgcgtgctggaagcgggtttgacgccgatcgtctgtgtcggcgaaacgcttgaagagcgcgaagccggttcgaccgagcaggtggtcggcatgcaactggacgaagtgctggcgaaattgtcggagcaggaggcggcgcggattgtcgtcgcgtatgagccggtttgggctatcggcaccggcaagagcgcgagctctgaacaggcgcag

SEQ ID NO: 28171 - DNA, 780 bp, Burkholderia fungorum
cgcaacgcggtctgactctgcccgaaccatgaggttgcgatgacgaaagccgttctgatcaccggcggcagccgcggcattggccgcgcaaccgcgcgtttgctgggcgcgcgcggctggtccgtcggcgtgaattacgcgcgcaatctcgccgcggcacaggacaccgccgccgaagtggaacgcgccggcggccgcgcgctgacgatcgccggcgacgtcgccagcgaagccgacgtgctcgccatgttcgacgcgctccagcagaagttcgggcggctcgatgcgctcgtcaacaacgccggcatcgttgcgccgtccagccagcttgcggacatggacctcgcgcgcctgaagcgcatgttcgacgtcaacgtgctgggcgcgtatctctgcgcgcgcgaagccgcgcggcgcatgtcgaccgatcgcggcggcgcgggcggtgtgatcgtcaacgtttcgtcggcggcgtcacgtctcggttcgccgaacgaatatgtcgactatgccggctcgaaaggcgccgtcgatacaatgacgctcggcctcgccagagagctcggtccgcgcggcgtgcgcgtgaacgcggtgcgccctggtctcatcgacaccgaaatccacgcaagcggcggcaagcccgagcgcgccgcgcaactcggcgggaccacaccgctcggccgtcccggcacggccggcgaagtggccgaaaccatcgtctggttgctgagcgacgccgcctcgtatgtgacgggcgctttgctcgacgtgtcgggtggc

SEQ ID NO: 28172 - DNA, 864 bp, Burkholderia fungorum
gtcatcctcgtgacgggcgccggcacgggcatcggcaaactgaccgcgcagtcgctcgccgaagccggccacattgtctacgcgacgatgcgcgacgtagaaggacgcaacaagccgcgcgccgacgaaatgcgtgcgctcgcaaaagccaaaggcatccagctgcatccgctcgaactcgacgtgctgtcgcaagcgtcggcggatgcggcggccgcgacgatcgtccgtgaacagggacgcctcgacgtggtgatgcagaatgccgggcatctggtggtcggccccagcgaagcattcacgcccgaggaaatggtcaaggtgttcgacaccaacctgttcggcgcgcagcgcgtgaaccgcgcagtgctgccctttctgcgcgaacaggaagccggcttgatgttatggatcagcagcacgacgaccaagggtggctttccgccgttcctcggtccgtacggcgccgcgaaggccgcgatggattcgctggcggtttcgctggcctatgagatcgcgcgcttcggcatcgaaacctcgatcgtcgtgcctggcgcgttcactcgcggcacagcgcactttccgagcgccggcaaacccgccgacaccgagcgcgccgcggcctacgcacgctatgacggcgtgacggatcagatcggcgagcgcctgtccggactgacgcccgagaacgccgatccgcaagccgtggccgacgaaatcgtgcggatcgtcgggctgccttcaggcgagcggccgatgcgttcagtgatcgactttgtcggcgacggcgcgcgtgaagtgctcgaagtgtcggagcgtgtgcggatcgacttcgcgcggcgaatcggcatggccgacttactc

SEQ ID NO: 28173 - DNA, 714 bp, Burkholderia fungorum
caagtcgctatcgtcaccggcgcatcccgcggcattggcgcagcggtcgcgcaacgcctcgccaacgacggcttcgccgtcgcgatcaactacgcatccagttcgaccgaagccgatgcgctcgtcgcgaaactcacggcggccggcgccaaagccgtcgcggtgaaggccgacgtgtcgaacgccggcgacgtgcgccgcctgttcgagatcaccgaacagcagctcggcaaagtggacgtgctcgtcaacaacgccggcgtgctcaagaccacgccgctcgccgacaccagcgacgcgctgtacgaccagaccttcgacatcaacgtacgcggcaccttcaacaccttgcgcgaagcagccgcgcgcatgaacgacggcggacgcatcgtcaacttttcgagcaccacgctggcgctgaacatgccgggctacgcgatctacaacgcgaccaaggctgccgtcgaagcctttacgcatgtattcgccaaggaactgcgcggccgcaacatcaccgtcaacgccgtggcgccgggtccgatcgcgacgtcgctgttcctcgacggcaagactgaagaacagatccagaccttcgccaagatgccgccgctgcaacgtctcggccagccggacgatatcgcatccgtggtggcgttcctcgccggtccggacgcgggctgggtcaacggtcagattctgcgtgccaacggcggc

SEQ ID NO: 28174 - DNA, 876 bp, Burkholderia fungorum
atggctggaatgaaggaaattcgcggcaagatcaagagcgtgcaaaacacgcgcaagatcacgaaagcgatggagatggtggccgcatcgaagatgcgccgcgctcaggagcgcatgcgcgctgctcgcccgtatgccgacaaggtccgcgatatcgctgcacacatgagccgtgcgaacccggagtatcgtcacccgttcatggtgtcgaacgaaggcgcgaagacggccggcatcatcctcgtcacgaccgataaaggtctgtgcggcggcatgaacaccaatgtgctgcgtgcgtcgctgcagaagttcaaggaactggaaggtcagggcaagacgatcgaagcaaccgcgatcggcaccaagggtctgggtttcctgaaccgtctgcgtgccaaggtggtgtcgaacgtcgtgcatctgggcgatacgccgcatctggaaaagctgatcggcgcggtgaaggtgcagctcgacctgtactcggaaggcaaggtttcggcggtgtacctggcgtacacgcgcttcgtcaatacgatgaagcaggagccggtgatcgagcaactgctgccgctgtcggcagaccagttcgagcgcaaggaagaagacggcacgacgccgagcacgcagtgggactacatctacgagccggatgcgcaggcagtggtggacgaactgctggtgcgttatgtcgaagcgctggtctaccaggccgtcgcggaaaacatggcatcggagcagtcggcacggatggtcgcaatgaaggccgcttcggacaacgcgaagacggtgatcaacgaattgcagctcgtgtacaacaagagccgtcaggccgcgatcacgaaagaactgtcggaaatcgtcggtggcgcggcg

SEQ ID NO: 28175 - DNA, 1554 bp, Burkholderia fungorum
atgcaactcaatccctctgagatcagcgagctgatcaagagccggatccagggccttgaagcgagcgcagacgttcgcaaccagggcactgtgatctccgtgaccgacggtatcgtgcgtattcacggcctgtcggaagtgatgcagggcgaaatgctcgaatttccgggcaacaccttcggtctcgcactgaacctcgagcgcgactcggtcggcgccgtgattctgggtgagtacgaacacatttcggaaggcgacgtcgtcaagacgaccggccgcattctggaagtgccggtgggcccggaactgctcggccgcgtggtcgacgcactcggcaacccgatcgacggcaagggcccgatcaacgcgaagaagaccgacgcaatcgaaaagattgctccgggcgtgatctggcgtaagtcggtttcggaaccggtccaaaccggtctgaagtcgatcgacgcgatggtgccggttggccgtggccagcgtgagctgatcatcggcgaccgccagtgcggcaagaccgcggtcgcagtcgacacgatcatcaaccagaagggcaagaacctcttctgtatctacgtcgcgatcggccagaaggcttcgtcgatcatgaacgtggtgcgcaagctggaagaaaccggcgcgctggaatacacgatcgtcgtggccgcttcggcttcggaatcggctgccatgcagtacctggcgccgtatgcaggttgcacgatgggtgaatacttccgcgaccgcggtcaggacgcgctgatcgtttacgacgacttgaccaagcaggcttgggcgtaccgtcagatctcgctgctgctgcgccgtccgccgggccgtgaagcgtacccgggcgacgtgttctatctgcactcgcggctgttggaacgcgctgctcgcgtgtcggaagactacgtcgagaagttcacgaatggtgaagtgaagggcaagagcggttcgctgacggcactgccggtcattgaaacgcaagccggcgacgtgaccgccttcgttccgacgaacgtgatctcgattaccgacggccagatcttcctggaaaccgacctcttcaacgcaggtatccgcccggcaattaacgctggcgtgtcggtgtcgcgcgtcggtggtgcggctcagacgaaggttgtgaagaagctgtcgggcggtatccgtaccgacctcgcgcagtaccgtgaactggctgcattcgcgcagttcgcctcggacctcgacgaagcaacccgcaagcagctggaacgcggccgccgcgtgacggaactgctgaagcagccgcaatatcagccgctgcaagtgtgggagctggctgtcgcgctgttcgcagcgaacaacggttacctcgacgatctggaagttgcgcaagtgctgccgttcgaaaagggcctgcgcgactacctgaagtcgaaacacgctgacctgatcaagcgcatcgaagacaccaaggaactctcgaaggacgacgaagccctgttgcacacggcgctcaaagacttcaagaagtccggcgcttattgatccgcgagtgac

SEQ ID NO: 28176 - DNA, 1611 bp, Burkholderia fungorum
actgcccggcggctcgaaggcgagttcgactacatcatcgtgggcgcggggacggcgggatgtgtgctggccaatcgcctgagcgaagatccggacgtgcaggtgttgctgctcgaagccggcggcaaggacgattaccactggattcacgtgccggtcggctacctctattgcatcggcaatccgcgcacggactggctttacaaaacccaggccgaagccgggctcaatggccgcgcgctttcgtatccacgcggacgcgtattgggcggcagttcgtccatcaacggcatgatctacatgcgtggtcagcgcgaagactacgatgaatgggcgcgagtcaccaacgactcatcctggtcctggaactcagtgctgcccgtcttcaggcgtagcgaagatcattacgccggcgcgagcgaatctcatggcgcgggcggcccttggcgcgtcgagaaacagcggttgaaatggaaaattctcgaagagttttcgcgtgcggcgcaagaggccggcattcccgcaaccgacgacttcaaccgtggcgacaacaccggcgtcggctacttcgacgtcaatcagaaacgcggcattcgctggaacgcgtcgaaggcattcttgcgtcccgcactcaagcgtccgaatctcacggtcatcaccggcgcgcacacgcagcgcgtcgtcttcgaaggacgccgttgcacgggcgtcgaatatcgcggcaacgacacggactatctggccaaggctcgctgcgaagtgatcctgagctcgggggccgtcaactcgccgcaattgctcgaattgtccggcatcggcaatggcgcgcgtctgcagaacctgggcatcgaggtcgtcaacgatctgcgtggcgtcggagagaatctacaagaccatttgcaattgcggatggcttataaggtcgacggcgtacgcacgctcaacaccgcgtccgcgcattggtggggcaagctgatgatcggcctgcagtacgcgctgttccaaagcggccccatgtcgatgtcgccgtcgcaacttggtgcgtttgccaggtccgatccgaacgatcgctcgctcacgcggcccgacctcgaatatcacgtccagccgctctcgctcgatcgcttcggcgaaccgctgcatcggttcaatgcgttcaccgcgtcggtgtgccagttgcggcccacttcgcgcggcagcattcacatcgaatcggccaatgcttcagcgccgccgttgatcgcgccgaactatctctccaccgattacgaccggcacgtcgccgccaacgcactgcgtctcacgcggcgcattgccgcggcgccggcgcttgcacgctatcgtccgcaagagattttgcccggcactcagtaccagacggaagaggagttgcagcaggctgccggcgcggtcggcacgaccatcttccatccggtcggcacctgccgcatgggcacgaccgacgaccccggcgcggtggtcgacaaccggctacgggttatcggtgttgacggactgcgcgtggtcgatgcatccgtcatgccgaccatcacctcgggcaataccaattcgcccacgctgatgatcgcggagcgcgccagcgacatgatc

SEQ ID NO: 28177 - DNA, 1434 bp, Burkholderia fungorum
ctgacccatttcatcaacggcaagactgtcgaaggcacgagcggccgcttcggcgacgtcttcaatcctgcgcaaggcagcgtaagcgcacgcgtgccgctcgcgagcgtcgcggaagtggatgcggccgtcgctgctgccaaagacgcgtttgccgcatggagcgaaaccgcgccgatcaagcgggcgcgcgttctgttcaggttcaaggaactgctcgatcgacaccacgacgaactcgcggaactgatcacgcgtgagcacggcaaggtgttttcggacgcgaagggcgaagtgatgcgcggcatcgaaatcgtcgaattcgcatgcggcattccgaatctgctgaagaccgacttcaccgatcagatcggcggcggcatcgacaactggaacctgcgtcagccgctcggcgtggtggccggcattacgccgttcaattttccgatgatggtgccgtgctggatgttcccggtcgcgattgcgtgcggcaatacattcgtgctgaagccgtcggagcgtgatccgtcctgttcgaaccggcttgccgaattgttgaaggaggccggcttgccggatggcgttttcaacgtcgtgcatggcgacaaggtcgcggtcgatgcgctgctcgtgcatccggacgtcagcgcgttgtcgttcgtcggttcgacgccgatcgccgaatatatctacacggaaggcacgaagcacggcaagcgtgtgcaggctttgggcggtgcgaagaatcatctggtggtgatgcccgacgcgaatctcgatcaggcggtagacgcgttgatcggcgcggcctacggctccgcgggcgaacgttgcatggcgatttcggtggccgtcgccgtcgggcatatcgccgatgaactggtcgagcggctcacaccgcgcgtgaagagcctgaagattctcaacggcatggagtcggacgccgagatggggccgttggtcacggcggtgcatcgtgagaaagtggtgggctatatcgattccggcgtcgcggcgggcgcgacgctggttgtcgatgggcgaggacatcaggtcagcggtcacgagaagggtttctttctcggcggcaccttgttcgacaatgtctcgaccgacatgaagatttatcgcgaagagattttcgggcccgtgctctgtgtcgtacgcgtgccggattttgcttcggcggtggagctcatcaacgcgaatgagtttgccaacggcgtgtcgctatttacgtccgatggcggcgtcgctcgcgcattctcgcggcagatccagatcggcatggtaggcatcaacgtaccgattcccgtgccgatggcgtggcattcgtttggcggctggaagaagtccctcttcggcgaccatcacgcgtatggcgaagagggcgtgcggttctacacccgctacaagagcatcatgcagcgctgg

SEQ ID NO: 28178 - DNA, 1771 bp, Burkholderia fungorum
cgcacctcccacacctcccgctccactcgtcgcaccgcaacaattctccctcgacgttctgctcgaaaaatacgcgaaaggcgacgaacaatcggctgacgacgtattcaaacgcgtcgcgcgcggcgtcgccgaggccgaaccgccggcgctgcgcgaatcggtcgaagcgctgttcgtcgacaatctgcggcatggcgcgctcggcgccggccgcatcatgagcgcggcgggcaccggcattgcggccacgctgatcaattgcttcgtgcagccggtgggcgacgcgattcagggcgtcgacgaagaaggcctgcccggcatttacgtcgccttgctgcaagcggccgaaaccatgcgccgcggcggcggcgtcggttacaacttctcggcgatccggcccaagggcgcgcgggtccacaccaccagttcgtcggcctcaggaccgtgcagctatatggacgtgttcgacgcgtcgtgccgcaccgttgagagcgccggttcgcggcgcggcgcgcagatggccgtgctcgactgcaatcaccccgacctgctggagttcatcgaggccaagcattcgaaaggccgctggaacaacttcaacgtctcggtcggcgtgaccgacgaattcatgcgcgcggtcgaagaagatcagccctggcaactcgtgcatcgcgccgaaccgtcgccggcacagcgtgcggcagacgacgtgcggcaacgcgaagacggcctgtgggtctacagcgaacgcccggcgcgcgagatctgggaccgcatcatgcgctccacttacgacgtcgcggaacccggcatcgtgttcatctcgcgcatgaacgaggacaacaatctgcgcgcggtcgaaaccattcgcgcaaccaatccgtgcggcgaacaaccgttgccggcatacggctgctgcaacctcggcccgctgaacctcacgcgtttcgtgatcgatccgttcgcgcagatcaaaggccgcaagccgtcgttcgactgggacggcctcgcgaaacgcacgcgcacccaggtgcgctttctcgacaacgtgctcgacgtgacgctctggccgctgccgcagcagtacgaagagtcgcgcgccaagcggcgcatcggagtaggcttcaccggcctcggcgatacgctcgtcatgctcggcttgcgctacaactcgcaggaaggccgcgatttcgccgtgggcatcgcgcaactgatgcgcgacgaggcgtatcgcgcatccgtcgagctggcgcgcgaacgcggcgcgtttccgctcttcgacgccgcgcgctatctggaaaccggcacgttcgcttcgcgcctgcccgaggacatcaagcaggcgattcgccgcgacggtatccgcaacagccatctgctctccatcgcgccgaccggaaccgtgagccttgccttcgcggacaatgcgtcgaacggcatcgaaccggccttctcgtggacctacacgcgcatgaaggtgatggcggacggcagccgcgaatcgttcgatgtggaagactacgcgtatcgtctttatcgcgagctcggcggcgacgtcaaccggctgccggactatttcgtcagcgcgctggaaatgtcggcgcgcgaccatctcgacatgatggctgccgtgcagccgtatgtggacacgtcgatctcgaagaccgtgaacgtgcccgccgactatccgttcgaagcgttcgaaagcctctacctcgacgcatggaaaaacggcctcaagggtctcgccacctaccggcccaacgag

SEQ ID NO: 28179 - DNA, 1213 bp, Burkholderia fungorum
gaggcgcaccgcaagaccgacgccgcgcttcagcgcgcgagcgccgcggccgagtccgccaatcgtgccaagagccgctacgtgacgggcctgagtcacgaactgcgcacgccgctcaacagtattctcggttacgcacaactgctgctgcaaggcaccgacgaactgccgccggcgcggcgcaatgccgtggcgaccatctatcgcagcggcgagcatctgctggcgctggtggatggcctgctcgacgtcgcgcggatcgaggccggcaagctgcagttgaacgtgacggagatttcgctgccggacttcgtcgcgcaactcgctgccatgctcgaaccgcaggccaccgacaaaggattgcagttcgaattccagacgagcggccgcatggcggacgtggtgcgcatcgacgaaaaacgcgtgcggcagattctcatcaacctgatcggcaacgcgatccgcttcacctcgcacggttcggtgaaggtgcgtgccagctatgcgtgggaagccattacgtttgaaatcaccgataccgggcccggcatgccggccagcgaactggagcggctattcctgccattcgagcgcggcgcggcggcgcgcgaacacgatcatggcgcggggctgggactgaccatctgccgcctgctcacggaactgatgggcggcaacctggaagtgcaaagcgaggtgggcaaaggcacgcgctttatcgtgaagctgttcgcgcctgaagtgcgggcgccgcagttgctggcgagcggcccgctcaacgtgaagggttacgacgggccgcgccgcaccgtgctcgtggtggacgatctcgcggagcagcgccgcattgtcgtgcagacgctggcgccgctgggcttcaacgtggtggaagccgcgagcggaccggaggcgctgcaatggctcggcaccgcgtcggcggatctgatcgtgatggacgtgtcgatgccggacatggacggcttcgaggcgagccggctgattcgcgacaatcatctgtcggcggcgccggttctgatcctgtccgccaacgcattcgcggacgatcgcgacaaaggcgccgcagccggttgcgacgactacctcgccaagccgctctacattccgctcctgctcgacaaactggccgcactgctgcaactgcactggatcgtcgagccgaccgaagcggcggccgcctccgccgttgcgcgtg

SEQ ID NO: 28180 - DNA, 1203 bp, Burkholderia fungorum
ctccatcccgtcgccggcgtttcgctcggctgggcggaggcgaatatccgcaagccgaaccgcaaggacgtgctcgtcatttccgtgggcgaaggcgccacggtcggcggcgtgttcacgcagaaccgtttttgcgcggcgcccgtcaccgtgtgccgcgagaatctggaccgcgtgcgcgcgggcggcaagccgattcgcgcgctggtgatcaataccggcaacgcgaacgcgggcacgggcgaaccgggcctggtggcggcgcgcgaaacctgcgcggagctcgcgcgtctggcggacatcacgccggaacaggtgctgccgttttcgacgggcgtgattctggagccgctgccggtcgatcgtctgaaggctgggctgccggctgcgctggcgaatcgcaaggaagcgaactggtacgacgccgcgcaggcgatcatgaccacggacacgctgcccaaggccacctcgcgccaggtcacgatcgagggtcacacggtcacgctgaccggcatcagcaagggcgccggcatgatcaggccgaacatggcgaccatgctcggctttctcgcgttcgacgccgccgtcgcccagccggtgctcgatgcgctggtcaggcacgtggcagaccgctcgttcaactgcattacgatcgacggcgatacgtcgaccaatgattcgttcatcctgatcgcgtcgggcaaatcgagcctgccggcgatcacgtccaccgactcgcccgcttatgcagcgctgcgcgacgcggtgaccgaggtcgcccagaccctcgcacaactgatcgtgcgcgacggcgaaggcgcgaccaaattcatgaccgtgcatgtcgaaggcgggtcgagcgtcggcgaatgccgccagatcgcgtatgcgatcggccactcgccgctcgtgaagacggctttctatgcatcggacccgaatctcggccgcattctggcggccatcggctatgccggcgtggacgatctcgacgtcggcaagatcgatctgtatctcgacgacgtgctggttgcgactgccggcggccgcaatccggcctaccgtgaagaagacggccagcgcgtcatgaaaaagagcgagatcggcattcgtgtcgtactcgggcgcggcgatgcgcaagccacgatctggacttgcgacctgtcgcacgactacgtgagtatcaacgccgactatcgttcg

SEQ ID NO: 28181 - DNA, 939 bp, Burkholderia fungorum
atcgccgaagacatgcagcaggtcaatcgcgtcatacggcaccgccttgcgtccgacgtgatgctgatcaaccagatttcggagtacatcatcagcgccggcggcaaacgcctgcggcccgcgctgctgttgctggtggccggcgcgctgggtgaaaccacggggcaccggcacgaactggcggcggtcgtcgaattcatccatacggccacgctgctgcacgacgacgtggtcgacgaatccgacctgcggcgcggccggcagacggccaatgcgctgttcggcaacgccgcgagcgtgctggtgggcgacttcctgtactcgcgctcgttccagatgatggtcggcgtgggcaagatgcgcgtcatggaaattctgtcggaggcgaccaacatcatctccgaaggcgaagtgctgcaactcctcaacatgcacgacgccgacgtggacgaagcccgctacatgcaggtgattcgctacaagaccgccaagctgttcgaggccgcggcccaactcggcgcggtgctggccggttcggacgcgaaaaccgaagcggcggcggcggaattcggccggcgcatcggcaccgctttccagatcatggacgactggctcgactacacgggcacggccgagtcgatgggaaaaaatgccggcgacgaccttcgcgaaggcaagccaacgctcccgctgatctatctgatcgaacgcggcacgccggagcaatcggcgctggcgcgcgaagcgatcgagcaaggcggcacggatcgtttcgacaccattttcgaggcaatcacgcgttccggcgcgctggatcacacgctcgaatgcgcgaaacaggaagcccaggcggccgcggcagcaatttcttcgtttccggattccattttcaaagatagcctgctagaattatgttcttactcgacggcaagacagtct

SEQ ID NO: 28182 - DNA, 531 bp, Burkholderia fungorum
cgcgaagaagctctccacatttttagccactccgaagaaatcgtttcggccgacgacgtcaatgcgtcgatcagcggcatggcggccgccatccgcgacgagatgagcgaggacttcccgctcgtgctgtcggtcatgggcggggcggcggtcttcaccggcatgctgttgccgcacctcgatttcccgctcgagttcgactacatccatctgacccgctaccgcaacaccaccaaaggcggcaacgagatgcaatggcgcgtggcgccggcggaatcggtgaaggatcgcgtcgtgctggtgctcgacgatattctcgacgaaggcgagacgatggccgcgatccgcgaccgcattctcgcgatgggcgcgaagcgcttcctgagcgcggtgctgtgcgagaagatcattccgaaagccaagccgctgcgcccggattactgcgggttcgaagtgccggaccgttatgtgttcggctgcggcatggatgcgaagggttactggcgtaacctgcccacgattcgcgcgctg

SEQ ID NO: 28183 - DNA, 2772 bp, Burkholderia fungorum
tcaccgactggccaggcctttggccaggcacaaggcgcacaagcgctcgcgccgcaagcgaccttcgccgactacaaggtgatccgtcgtaatggcagtgtcgtgtcgttcgaaccgtcgaaaatcgccatcgccgtgacgaaggcatttctggccgtcaacggtggtcaaggcgccgcgtcggcgcgcgtgcgcgaactggtcgagcaactcacgcagaacgtggtgcgcgcactcgtgcgcagccgcccgaacggcggcacgttccatatcgaagacattcaggatcaggtcgaactcgcgctgatgcgcggcggcgagcacaacgtcgcgcgtgcatacgtgctgtatcgcgagaagcgcacgcaggcgcgcggtcatgacgatcagatcgtggcgaacacgccgggtctgaacgtgaccgacaacggcgtcacgcgtccgctggacatggctgcgctgcgcggcatcatcgaactggcctgctcgaatctgggcgatgcagtgagcgccgatccgatcatcgcggaaacggtgaagaacctgtacgacggcgtgccgatgagccaggtctacgactcggcgattctggcggcccgcacgatgatcgaaaaggacccggcttatagccaggtcaccgcgcgcatcctgctgcacaccatccgccgcgagatcctcgaagaggaagtcacgcaaacggaaatgggcgagcgctacgccgaatacttcccgcagttcatcaagcgcggcgtgcaagccgaactgctcgacgacaagctgctgcagttcgacctgaagcgcctcggcgccgcgctcgacaacaaccgcgacctgcaattcggctacctcggcctgcaaacgttgtacgaccgctacttcctgcatcacgacggcgtgcgcatcgaaatgccgcaggcattctttatgcgtgtcgcaatgggtctgtcgctgaacgagatcgaccgcgaagcgcgcgcgatcgagttttacaacgtgctgtcgaccttcgacttcatgtcgtccacgcccactttgttcaactcgggcacccgccgttcgcaactgtcgtcgtgctacctgaccacggtcgacgacgacctcgacggcatctacgaagcgctgaaggaaaacgcgctgctgtcgaagttcgccggcggtctgggcaacgactggacgcgcgtgcgtgcgctcggttcgcacatcaagggcactaacggcaagtcgcaaggcgtggtgccgttcctgaaggtggtgaacgacacggcggtcgccgtgaaccagggcggcaagcgcaagggcgcggtgtgcgcgtacctggaaacgtggcacctggacatcgaggaattcctcgaactgcgcaagaacaccggcgacgaccgccgccgtacccacgacatgaacacggcgaactggattcccgacctgttcatgaagcgcgtgatggaaggcggcgactggacgctgttctcgccgtccacctgcccggacctgcatgacaagttcggcgccgagttcgaaacggcttacacggcttacgaagacaaggttgcgcgcggcgagatcaagctgttcaagaagatcccggcggcgcaactgtggcgcaagatgctgggcatgctgttcgaaaccggccacccgtggatcacgttcaaggatccgtgcaatgtgcgctcgccgcaacagcacgtcggcgtcgtccattcgtcgaacctgtgcacggaaatcacgctgaacaccagcgacgccgaaatcgccgtctgcaacctgggctccgtgaacctcgtcgcccacctgaaggaacaggccgacggcacgctcgtgctcgaccacgacaagttgaagcgcaccgtcagcgtggcgatgcgcatgctcgacaacgtgatcgacatcaactactacgcggtcgccaaggcgcgtaactcgaacctgaagcaccgtccggtcggcatgggcatcatgggcttccaggactgcctgcatctgctgcgcacgccgtacgcgtcggaagaggcggtcaggttcgccgacacgtcgatggaagcggtctgctactacgcttactacgcgtcgacggaactggcgcaggagcgcggccgctactccagctaccgcggctcgctgtgggatcgcggcatcctcccgcaagactcggtgaagctgctcgccgaagcgcgcggcggttacgtggaagtcgattcgagcgaatcgatggactggaccgaactgcgttcgcgcatcgcccagtacggcatgcgcaattcgaactgcgtcgcgatcgcgccgacggcgacgatctcgaacatcatcggcgtgtcggcctgtatcgaaccgaccttccagaacctgtacgtgaagtcgaatctgtcgggcgaattcacggtggtcaacgactacctggtgcgcgacctgaaggcacgcggcctgtgggacgaagtgatggtcgccgacctgaagtacttcgacggcacgctctcgcgcatcgaccgcatcccggccgacctgcgcgcgatctacgccaccgcgttcgaagtcgatccgaagtggctggtcgaagcggcctcgcgtcgtcagaagtggatcgaccaggcgcagtcgctgaatatctatatgggcggcgcgtcgggtaagaagctcgacgagatctacaagctcgcctgggtgcgtggcctgaagacgacctactacctccgcacgatggcggcgacccacgtcgagaaatcgacggtggcgcacggcgcgctgaacgcggtgagctcgggtggcggcgaaggt

SEQ ID NO: 28184 - DNA, 1020 bp, Burkholderia fungorum
tcggaagcgcgggtcaacgtcgccgacaagcgcatcatcaacggccagaccgacgtcaatcagttggtgccgttcaaatacaagtgggcgtgggaaaagtatctggctggttgtgccaaccactggatgccgcaagaagtgaacatgtcgcgtgacatcgccctctggaaagacccgaacggtctgaccgaagacgagcgccgcatcgtcaagcgcaacctgggcttcttcgtgacggccgattccctcgccgccaacaatatcgtgctgggcacctaccgccacatcacggcgcccgaatgccgccagttcctgctgcgccaggcgttcgaagaggcgatccacacgcacgcctaccagtacatcgtcgaatcgctgggcctcgacgaaggcgaaatcttcaacgcgtatcacgaggtctcctcgatccgcgcgaaagacgaattcctgattccgtacatccacgtgctgaccgatccggccttcaagaccggcacgctcgaagcagaccagacgctcctgcgctcgctgatcgtgttcgcctgtgtgatggaagggctgttcttctacgtcggctttacccagatcctggcgctgggtcgccagaacaagatgacgggcgcggcggaacagtaccagtacatcctgcgcgacgagtcgatgcactgtaacttcggcatcgacctgatcaaccagatcaaactcgaaaacccgcaactctggacggctgagttccgcgcggaaatccgcgagatcttccagcaggcggtcgaactcgaatatcgttacgcagaagacacgatgccgcgcggggtgctcggcctcaatgcgtcgatgttcaagagctatctgcgcttcatctgcaaccgccgttgccagcagatcggtctcgatccgctgtacccgaacgaggaaaacccgttcccgtggatgagcgagatgatcgacctgaagaaggaacgaaacttcttcgagacgcgagtgatcgaatatcagactggcggcgcgctgacctgggag

SEQ ID NO: 28185 - DNA, 936 bp, Burkholderia fungorum
aggacgctcgccttggctacgctgatttgcggctcgctcgcctacgacaacatcatgaccttcgaaggccgcttccgggagcacatcctgccggagcaggtccacatcctgaacgtgagctttctcgtgccgaccatgcgccgcgagttcggcggctgcgcgggcaacatcgcctactcgctgcatctgctggggggcgacgcgcgcatcatgggcgcgctcggctcggtcgacgcgcaactgtacatggaccggttcaggcaactcggtctgtcgacggaaagcgtgctggtagtgcccgacgcctattcggcccaggcgatgatcaccacggatctggaaaacaatcagatcaccgcgttccacccgggcgcgatgatgcagtcgcatctgaaccgcgccgaccaggccaggggcattacgctcggcatcgtcgcacccgacggctacgacggcatgatccagcattccgagcacctcgcggccgcgggcgtgccgttcatcttcgatccgggccaggggttgccgctcttcgacggtgcgtcgctgcggcgcatgattgaactcgctacctatgtggctgtcaatgattacgaagccaaactggtgagcaacaaaacgggctggtcgatcgaagaaatcgccggcaaggtcgaagcgctgatcgtcacgctcggcgaacaaggcgcgcagatccatcacgcgggcggggtcgaagacattccggcggtcaaggcacagcaagtgctcgatcccacaggctgcggcgacgcattccgcggcggcctgctgtacggcatcgggaacaagctcggctgggccaccaccggccggctcgcgagcctgatgggcgcgctgaagatcgaacaccagggcccgcaaaactacgcgcccagccgggccgagatcaacgagcggttcaagcaggcgttcgga

SEQ ID NO: 28186 - DNA, 1344 bp, Burkholderia fungorum
atgtttgaaaaaatcctcattgccaatcgtggcgagatcgcgcttcgtatccagcgcgcctgccgcgagcttggcgtcaagaccgtcgtcgtctattcggaagccgacaaggaagccaaatacgtgaagctcgccgacgaggcggtctgtatcggcccggcgccttcgaacctgagctacctgaacatgcccgcgctgatcagcgcggcggaagtgaccgacgccgaagcgatccaccccggctacggcttcctctcggaaaacgccgacttcgccgaacgtgtcgaacagtccggcttcaccttcatcggcccgcgcccggaaaccatccggatgatgggcgacaaggtcacggccaagcagaccatgatcaagaccggcgtgccgtgcgtgccgggctcggaaggcgcgttgccggaagatccgaaagagatcgtgaagattgcccgccaggtcggctatccggtcatcatcaaggccgcgggcggcggcggcggccgcggcatgcgcgtggttcacacggaagccgcgctcgtcaacgcagtcaacatgacgcgcgaagaagccggccgcgcgttcggcaacccgcaggtctacatggagaaattcttggagaacccgcggcacatcgaaattcaggtgctggccgactcgttcaagaacgcagtctggctgggcgagcgtgactgctcgatgcagcgccgtcaccagaaagtgatcgaagaagcgccggcgccgggtatcgcgcgccgcctgatcgaccgcatcggcgatcgttgcgcggacgcctgcaagaagatgggctatctcggcgcgggcacgttcgagttcctgtatgagaacggcgagttctacttcatcgagatgaacacgcgcgtgcaggtcgagcacccggtgaccgaactgatcacgggcgtcgacatcgtgcaggaacagatccgcatcgcggccggcgaaaaactcgccttccgtcagcgcgatatcgtgttcaagggtcacgcgatcgaatgccggatcaacgcggaagatccgttcaagttcattccgtcgccgggacgcctgacgtcgtggcatatgccgggcggccccggcatccgcgtcgactcgcatgcctacaatggctacttcgtgccgccgaactacgattcgatgatcggcaagctgatcgcctacggcgcgacgcgcgagcaggcgatcaagcgcatgcgcatcgcgctgtcggaaatggtggtggaaggcattcagaccaacatcccgttgcaccgcgagctgatgctggacgcgaagttcgtcgaaggcggcaccagcattcactacctcgaaaaccggttggccgcgaagcag

SEQ ID NO: 28187 - DNA, 432 bp, Burkholderia fungorum
atgacgcgactgctggtactgcacggacccaacctcaaccttctcggcacccgggaacccgaggtctacggtcgcgtgaccttgccgcagatcgatcaggcgctggcggaccgcgcagcggacgcaggtgtcgaactcgcgtcgttccagagcaatcatgaaggcgctctggtggatcgcatccaatccgcgcggactgaaaacaccgatttcatattgatcaatcccgccgcgtacacgcacaccagcgtggccattcgggacgcactggcgggggtcggcatcccgttcgtcgagattcatctgtcgaacgtgcatcgtcgcgaaccgttccggcatcattcgtatttctccgaccaggcggagggcgtgatctgcggcctcggctggaagggctatctgtacgcgctcgaattcgcgctcgaccggctc

SEQ ID NO: 28188 - DNA, 1590 bp, Burkholderia fungorum
gccagcatgacaaaaacgtacgactatatcgttgtcgggggtggctcgtccggttgcgtggtagccacccggctggttgaagccggcttcgaggtattgctgctggaagccgggcccgtcgacaaggatatctacatccatatgcccgccggcatgagaaacgcccagaagtattcatggaattacatgagcgaagcgaaccccggctcgggcgtgcctccgatccacattcaccagggtcgtgtgctaggcggcgggagttcggtcaacggcatggtgtacgtccgcggttcggctcacgactacgacgactgggacaggatctacggctgtaccggctggagtcacaacgacgtgctgccttactttatccgctcagaaggcaacgaagtcgtgagcgggccgaagcacggtacggacgggaatctgtgggtcagcgagcaccgctaccggcatccgctgacgatggcgtatctgagggcagcgcaggaactcggctatccgtacatcaccgatatgagcggcgcgaccgagcaggagggcgtgggcttctggcagtgcacgatccacgaaggcaaacgcggtagtacggcccgggcctacctgcagcgggtcatcaaaagcgatctgctgacggtcgtgaccggagcgaccgccaggaaggtgcagatagaaaacggtcgggcctgcggggtgcgctacgctcgcaacggcaattccgttaccgatgcggttgcgacgagggaagtgattctcacggccggtgcattcgagacgcctaagctcctgatgctctccggtatcggtccggcgcagcatctgaacgagttcggcatcgggaccattgccgacagtccgcaggtcggtaagaacttccaggatcacctgatggtctccatcacggccgaaacgccgggcattcctagcttcctgcgcgaaggagagggcctgcgcaagatcgcgaatgggctggaatggctgaccttcaaccacgacggcgtggtctcttcgaacgtgctggagggcggaggctatttcgacataaacgacgatggacgaatcgatacgcagttgttcgtttttcctttctatgaaggcaagcgcgacggaaactggacgaaagccgatcagattccggacggcatggcgctcaaggtcggccacgtctatcccgagtcgcgcggagaggtgctgcttggcggaccccggcccgacgacaagatccgtctgaaaggcaattacctgtcggccgacggcgacctggacttgcaggtgaaggcgttcaagctggggctgaaatttttcgatgctccgtcgttgaagaaaattacccggaacgtggcgccgaagttctcggacgaccacgaaatagccgattacgtacgaaagaactgtacgacgatatttcatcccacttcgacttgccgtatgggaaattccccgcagagttcggtggtcgatcttacgctgcgcgtgtggggaattgccaatctccgcatcgctgatgcctccgttatgccacacatagtcagtggcaatacaaacgcaccgacgatcatgatcgcggagcgagcggcagaaatgattatt

SEQ ID NO: 28189 - DNA, 1428 bp, Burkholderia fungorum
ccgctgaagcatcccgacaaactgtatatcgacgggcagtgggtcgcagcctccaccggaaaggagttttcggtcatctcgccggatacggaaagcgtctatgtccgggtcggcgaggcaagcgaggccgatattgaaaaggcagtttcggctgcccgcaaagcgttcgatcacgggccgtggcctcggctgagccatgcggagcgaggcgcttatcttcgcgcgatggcggaaaaactgcgggcgcgctcgcacgacatggccgcgatctggccgcacgagatgggcgtcacttacgcgttcgcgcagtcgttcatgccgcgcatcgcgggcatctacgacttctacgccaatctcggcgacacgttcgctttcgaagaacggcacgccaccagctcgggaatcggcaacgggctgctcgttcgcgagcccgtaggcgtggtcggcgcgatcattccatggaatgcgcccgcgatgatcatcgcgtacaagctggcgcccgcgttgatcgccggttgtaccgtgatcctcaagtcttcgccggaagcgccgggcatggcgctgataatcgcagaggtcgcggaggaagtcggtctgccgcccggagtcgtcaacgtggtcactgccgatcggcaagcgtcggacgcgctggtgcgaaacgctgcggtcgacaaaataagctttaccggttcgagcgcggtcggcaagcatatcggcagcgtgcttgcgcagcgggtggggcgatataccctcgaactgggcggcaagtcggccgctatcgtactcgacgactacgacctggagacggcggcaaaagcgcttgcgacggcagcaagccagatgacctgccaggtttgtgcgagcctgacccgcatcatcgtcaccaaaaaccgccacgaccgcctgctcgaagcgctcgcctctgcgtattcctcggtgaaggttggcagtccgttcgatcccgccacgcaaatgggacctgtggccacgctcaggcagagagagcgtgtcgagacctatatcgcgaaaggcatgcaggccggtttcacgttagccgccggcggcaagcgtccggttcacctgccgcgtgggttctatctggagccgacggtgttcggcaacgtcagtaaccgttccgaactcgctcaggaggagatattcggtccggtgctcgccgtgattcccgccgacagcgaagagcaggcagtcgagatcgcgaacgattccatctatgggttgagcggcgcggtgttcaccaacgacgttgatcgagcctattcggtcgcccgcagggtccgcaccggcagcgtggcccataacgggttccgcaacgacttcggcatcgctttcggcggcttcaaacagtccggcatcggtcgtgagggcggtgtcgaaggcttgatgccctatctcgagaccaagaccgtg

SEQ ID NO: 28190 - DNA, 720 bp, Burkholderia fungorum
cgggtcgcattggtgaccggagcggtccgcggcattggcgccgccatcgcgcgcgaactgcatgtgggtggggcgcgggtggccgtcacggatctggatgtcgcgagcgccgaagcggtagccaaagcactcgatacgcacggcgagacggcttttgcattcgccctcgacgtgcgtgaaaagcgcgatttcggtcatgcgctggacgccgtgctggggcgatggggcaagctggatatcgtcgtgaacaacgcgggttacgcgaaacggaccccgctcgacgagatcacgccggaggaattcgacgaaatcgtgaacattaatatgcgtagcgttttcctgagctgccagacgttttcgaagcacatgaagtcggcaggctatgggcggatcgtgaacgtgacgtcgctcgcttcgcataacggcggcacggtcgcgtctgcgcactattccgcagcaaaaggcggtgcgatgacgctgacgcgttacttcgcgcggcaactggcgggcacgggcgtcacagttaacgcggtttctccagggccggtgtcgagcgcgaaggaacgtcttgcgcatctgcgcgacgagatcagcaagcaggttccggttgggcgattcgcggagccggaagagatcgcggcggccgttgcgcttctcgcttcggagcgggccggtttcatggtgggcgcgacgatcgatgtgaacggcggcctgtatatg

SEQ ID NO: 28191 - DNA, 777 bp, Burkholderia fungorum
ttaagcgaaatgaagaaaaaacagaccagtctggaagggcaggttgcggtggtcagtggtggcgctcatggcatcggactgggcattgtcgagcggctgctgcaacttggcgcgaaggtcgtggcatcggacatcgacagggacggtcttgcggtgtctcgcgagcgtctcgcgaagtcgttcggcacttcgatcgcagtgcaggcagctgacctgtcgaaggagcgcggtgcacaggccctgcatcgtgcggtggccaaacggtttgggccggcgcagatcctcgtgaactgcgcaggtggtggtgtgatccgtccttttctcgagcacacgcccgagacgctcaaggcgacgatagacaggaatctgtggacggtgatctggtgcagccgcgtatttctgcctgacatgatcggcgcgaagtacggccggatcgtgaacattggtgccgattcggtccgcaacggcttgcccgcacatgcggggtacaacgcggccaaaggcgggatgcatgggctcacgacaggccttgcgcgcgagtttgcgctgaatggcattacggtcaacaccgtggcgccatgcgcggtgaacaccgaagtctgggcgaaggtgaagaagtcgaatcccaggctcgcccaggcgttcgtggacgttattccgatggggcgcgtgggtgaaatagaggaggtcgcttcaatggtgggttacctggcattgccggaggcggcctttgtcaccggccaggtgatcagcgtcaatggtggcagtgcgatgttg

SEQ ID NO: 28192 - DNA, 639 bp, Burkholderia fungorum
gcgctgatctgcgattgcgatggtgtgctgatcgacagcgaagccgtggcggcgcgcatgctggtgcgtgaactcgaaacgcgctggcccggcacggatgtcgagccggtggtgttgccgctgctcggactgcgcatcgagaaagtgctgcaaggcaccgcggcgcaactcggcaaaagcctcacgcccgacgatatcgatgcgatccgccgcgcggttgaagccgctgcgatgcaggcgccgatggtcgaagggattgaagccgcactcgctcaggtgccgctcaccaaaggttgcgcgagcaacagcttccgcccgtatgtggaatcggtgctggcgcgcacggggctcgtgaggtttttcggcgaccgtctgttctgcgcagacgcggtgccgaatccgaagcccgcgcccgatgtctatctggccgcggcgagaggcctcggactcgcgccctcgcggtgcctcgtggtggaggacagcgtcacgggcgtgacggcggcgagcgcggcgggtatgacggtgctcggtttcatcggcggcggccatgcgagcgatgcgcagatcgacaagctgcatgcagcgggcgcgcgtcacgtgttcgacgacatgcagcagttgccggaactggtcgcgcaa

SEQ ID NO: 28193 - DNA, 1434 bp, Burkholderia fungorum
atgtatctcggcatcgacctcggcacgtccgaagtgaaagttctgctgctcgcctccaacggacgcgtgatcggcaccgcaggctcgccgtttaccgtgtcgcgccagcatcaacgctgggccgagcagaatcccgaagactggtgggcaggcacgcgcgcagcgctcgccgccctgcgcgccagatatcccgacgagttcgcgcagattcgcggcatcggcctgtcgggtcagatgcacggcgccgtgctgctggatgcgcaggaccgcgtgttgcgtcccgcgatcctgtggaacgacatgcgcagcgacaaggaatgcgctgaattgaccgaacgcgcgccggagctgcatagcgtggccggcaatctcgccatgcccggtttcaccgcgccgaagctgctgtgggtcgctcgccatgagcccgacattttcgcgcgcactgcctgcgtgctgctgccgaaggattacctgcgcctgcaactgaccggcggcaaagtgtccgatccatcggacgcggccggcacgctgtggctcgacgtcgccaaacgcgactggtccgattcgctgctcgcggcctgcaacatgtcgcgcgcgcagatgccgagcctcgccgaaggcagcgagccgtcgggcacgctactgcccgcggtggcgcgcgaattcggcctgagcgacggcgtgatcgtcgcggccggcggcggcgacaacgccaccagcgcgatcggcatcggcgcgacgcaacccggcgacggtttcgtttcgctcggcacgtcgggcgtactgtgcgtggtgggcgacagcttccggccgaatccggcttcggccgtgcatgcgttctgccacgcgattccggatcgctggcatcagatgagcgtggtgctgtccgccgcgagttgtctgcgctgggtctgcaagctcacctccaccgacgagccgaccctgctcgccgaaatcgaggcgctcccggctgacgcattgaacaccgcgccactcttcctgccctatctgtccggcgaacgcacgccgcacaacgacccgtatgcgcaaggcgtgttcttcggcatgaaccacgcaaccgatcgcgcgctgctcggctacgcagtgctcgaaggcgtcacgctcgcgctcaccgacggcctcgacgcgctgcgcgcggccggcaccgaagcgaaggcgctgtcgctgctcggcggcggcgcccgcagcgactactgggcgcagttgctcgccgactcgctcgataccgcgacgcgcaagcacggcggcggcgaaaccggcgcggcgctcggcgcggcgcggctcggctggctggcggccggcggcgatccggccacggtgctgaccaagccgccgatcgaaaaggagttcacgccgaacccgcgccgccatgccgaactgcgcgcgcggctcgaagcgtatcgcgcgctttac

SEQ ID NO: 28194 - DNA, 876 bp, Burkholderia fungorum
tgtccgtttgggcatgggagcgttgcttctcatgcggccgccccggccgctgattcaggcgacggctggcatgacgcgcagctcgatttttcggagtcgatgagttacggcgattatctgtcgctcgggacggtgctggatgcgcagcatccgttgtcgccggatcacaacgagatgctgttcatcatccagcatcagaccagcgagttgtggatgaagctcgcgttgtatgagttgcgggcggcgttgcaggccgtgggccgtgatgagttgccgccggcgttcaagatgctcgcgcgcgtgtcgcggatcatggagcagctcgtgcaggcctggagtgttcttgcaacgatgacgccgtcggaatatacggcgatgcggccttatctcgggagttcttcggggtttcagtcgtatcagtatcggcagatcgagtttttgctcggtaacaagaatgagctgatgctgaagccgcatgcgcatcgggctgatgtgtttgccgaggttaaggcttcgctggaagcgccttctttttatgacgaggtgattcggttgctggcgcggcgtgggtttgcgatttcgccttcccggctcgagagggattggactcagcctactgttcatgatgcttctgtcgaagcagcctggcttgaggtttatcggaatccttcgcaatattgggagctctatgagatggctgaggagcttgtcgatctggaagatgcttttcggcagtggcggttcaggcatgtcactacggttgagaggattattgggttcaagcaagggactgggggaaccagtggggctccttatttgcgcaagatgttagatgtggttctgtttcctgagctttggcatgtcaggacgatgctg

SEQ ID NO: 28195 - DNA, 519 bp, Burkholderia fungorum
gaagtcgccactctcggcggcggttgtttctggtgccttgaagcggtgtatctgggcgtcgaaggtgtgaacgcggtggagtcgggctacgcgggtggtgaggcccggcatccgacttatgaagacgtgtgcgacggcgaaacgggccacgcggaagtcgtgaaggtcgacttcgatccggcgaagatcagctatcgcgagattctcgacatcttcttcgcgatccacgatccgacgcagttgaaccggcagggcaacgacgtcggcacgcaataccgctcggtgatcttcacgcattccgacgcgcagcgggagatcgcgctgcaggcgatccgcgagattggcgaacagcagatctacgacggccagatcgtcacccaggtgttgccgctcaacgacaactactggcctgccgaggattatcaccagaactattttgcgcaccatccgaatcagggttactgctcgttcgtggtggcgcccaaggtggcgaagtttcgtcagaagtttgctcaccgg

SEQ ID NO: 28196 - DNA, 1467 bp, Burkholderia fungorum
gccgcgcgtgatccacaccatatcgcattgatcgaggatgcgcgccgtctgagcagcgcgcaactgctgcaggccgtcgacgccgccaccgcgctgctgcgcgaatggggcgtgcgcggcggcgatcgcgtgatgatcgtcgccgagaacagcatcgcgcagatcgtgctgctgttcgcgaccgcgaggctcgatgcgtgggcgctggtgtcgaacgcgcggctgtcggcagccgaactcgactcgatccgcgcgcatgcgcaaccgcgcgtggtcgcctacgccacggaaagctcgaccgacgccgaacagcacgctcggcggcatcgagccaccacggcgccggctatcacgccggacatcggcaactggtcgtacgccgtggacagcgcggcggtagccgaacctgtcgaagccgccgaccaccgccaatgcgccgcgttgatctacaccaccggcacgaccggcgcaccgaagggcgtgatgctctcgcatcgcaatctgctcttcatcgccgcaatgtcgagccgcttgcgcaaagtcggcccggacgacgtcgtctacgccgtgctgccgatctcgcacgtgtacggcttcgcgtcggtgtgtctgggcagcctgcacgcgggcgcgaccttgcggctcgtaccgcgcttcgcaccggaagccgtgcgccgcgccctcgccggggaacgcgtgtcgatcttccagggcgtgccggccatgcacgccaaactgctcgagtatctgaaaacgcacgggcacccgtggtccgcgccgcaactgcgtttcgcctattcaggcggctcgccgctcgacgccgcgttgaaagcgcaggtggaacgcgtctacggtttgccgctgcacaacggttacggcatgaccgagagcagcccgaccgtgtcgcacaccatgctcgatgcgccgcgcagcgactgctccgtcggcgaggtcattccgggtgtcgaagtgcgtttcgtcggactcgacggcatcgacgccgcgaagggcgagatcggcgagctatgggtgcgcggtccgaatgtgatgctcggctactaccgcagccccgagcagacccggacggtcgtgaccgaagacggctggctcaaaaccggcgatctcgcgcggcaggacgccgacggcgcattgcatatcgtcgggcgcagcaaggagttgatcatccgttcgggcttcaatgtgtatccggccgaggtcgagcatgtgttgaacgcgcatccgcaagtcgtgcagtcggcggtggtcgggcgcgcggtggaaggcaacgaggaagtggtcgcgttcgtcgaactgattgcgggtgcgacggtgacgcccgccgagttgatcgactggtgcggcgagcgtctcgcgccgtacaagcggccggccgaagtcaaagtgcttgccgcgctgccggccgcatcgaccggcaagattctcaagcatcggctgcgcgagtttctc

SEQ ID NO: 28197 - DNA, 315 bp, Burkholderia fungorum
atgaagattcgtcccctctacgaccgggttatcgtcaagcgaatcgagcagcagcgcacgacggcttccggcatcgtgattcccgactcggccgccgagaagcccgaacagggcgaagttatcgcggtcggtgacgggcgtctgctacaggatggcacccggcgtcccctccagttgaaggtcggtgaccacgttctgtttggcaagtattcaggccagaccgtcaaggtcgatggcgaggaactgctcgttatgcgcgaggaagacgtcatgggcgtcctcgagtccgacgcaggcgccgcacgcaaggcggcc

SEQ ID NO: 28198 - DNA, 1608 bp, Burkholderia fungorum
atgagtgcgaaagatgtcaagttccacgacagcgcccgcagccggatcgtcaagggcgtgaacgtgctggccgatgcagtgaaagtgacgctcggcccgaaggggcgaaatgtcctgattgagcgcagcttcggcgcgccgaccatcaccaaggacggtgtgtctgtcgctaaggaaatcgagctgaaggaccgcttcgaaaacatgggcgcccaggttgtcaagcaggtcgcatcgaagaccgccgatgtcgccggcgacggtacgacgaccgccacggttctcgcccagtcgatcgtgcaggaaggcatgaagcacgtcgctgctggcatgaatccgatggacctgaagcgcggcatcgacaaggcggtggcggctgtgctcgatgaactgcacaggctgtccaagccgataaagacaagccgggaaatcgcccaggtcggcgccatctcggcgaatgcggacgaggcgatcggcaagatcattgcagacgcgatggacaaggtcggcaaggaaggggtgattacggtcgaagacggcaagtcgctcgagaacgaactggaggtcgtcgaagggatgcagttcgatcggggttatctgagtccatacttcatcaatgacccggacaaacaggttgcgcatctcgacgatccgctgatcctgctgcatgacaagaaaatttccagtatccgcgacctgctgccggtcctcgaggctgctgccaaggcaggcaagccgctcctgatcatcgccgaggatgtcgaaggcgaagcgctcacgacgctggtggtcaattcgatgcgcggtgtgctgaaggtggcggcggtgaaggccccgggctttggcgatcgccgcaaggccctgctcgaggacattgcgattctcaccggtgcaacggtcatttccgaagagactggcaagcagctcgagaaggcaacgctcgaagagctgggccgcgcgaagcgtgttgaggtgcagaaggaaaacaccatcatcatcgatggtgcaggtgaccagacgcgcatcgacgcacgcgtcaaggcgatccgcgcgcagatcgaagaagcgacgagcgactatgaccgtgaaaaactgcaggagcgcgtggcgaagcttgccggtggcgttgcggtgatcaaggtgggtgcggcgaccgaggtcgaaatgaaggaaaagaaagaccgtgtcgacgatgcgctgcatgcgacccgcgccgcagtcgaagagggcatcgtgccaggcggcggcgtggcgttgctgcgggcgcgttcggccatctcgagtctcacgggcgccaacgccgaccaggacgccggcatcaggattgtgctgcgtgcgcttgaggcgccgctgcgcgtgatcgcagccaatgcgggcgacgagccgtcggtcgtcgtcgcgaaggtgctcagcgggaaaggcaactacggctacaacgcagccacgggcgagtacggcgatctcgtcgagacaggtgtggtcgacccgacgaaggtgacgcgtacggcgctgcagaacgccgcttcgatcgccggactgatcctgaccacggacgccacggtagcggaagcgccaaaagaagaaaaagccgtgccggcacctgcaccg

SEQ ID NO: 28199 - DNA, 1092 bp, Burkholderia fungorum
cccggcggtctcgtcgccgggtcaaccaggaggtgcatcatggctagaaagccgctaggggttggcattgtcggactgcagccgggaagaagctgggcggcgatcgcccatgtgccggcgttgcgtagtttgcccgacgattacgaaatcgtcggcgtggccaattccagtcctgccagcgcaaagcaggcggcccaggcctccgatattccgtatgcgttcgccgatgtcgccgaactggtggcttcgccggcggtccagatcgtgacggtgactgtcaaggttccccatcatttcgagcttgtgaaagcggccatcgacgccggcaagcacgtctattgcgaatggccgctcgggaatggactgcaggaagcgcaggcgctggccgatatggcgcgagccaggggggtgcttgctgtcgtggggacgcaggcgcgagctgctccggagatcgagtatctgaccgggctgatcgcaggcggctatgtgggcgaggtactgtcgtccacgctggttgggtcgggccggatcctcggtccccatgtcaaccaggtaggcgcttatatcctcgatgtccgtaatggcgccaacatgctgacgatcccgcttggccacacgctggctgcgatgcgcgacgtactcggcgatgtggtcgaactctcggcaagcctgattcaccggcgtacttctgcgaccgtggctgagacgcaggaagtcgtgccgatgacttcgcacgatcaggtgctcgtgaacggcacgctgcacagcggcgcaccggtctctatccattaccgtggtggactatcacgtgggacgaatcttctttgggagatcaacgggaccgagggagacattcaggtgagcggtccgagcggccacacccagatggtccagctttcccttaagggcgcacgaggagaggcgtcatcagtggagccgatcgaggtcccgccttctttctacgaaggctggccaaaggagccatcgccccggaatgtggcccgtgtctatgcccggatggcggcagatctgcgcgatggtacgacgagcgcgccgactttcgacgacgcgctggcggtgcaccagatcatt

SEQ ID NO: 28200 - DNA, 1275 bp, Burkholderia fungorum
atgtccaaaaacgaaaccctctttgagcgcgcacaacgcaccattcccggcggcgtgaactcgccggtccgcgctttccgctcggtcggcggcacgccgcgtttcatcgaacgggcgcagggtgcctacttctgggatgcggacggccagcgttatatcgactacatcggctcatggggcccgatgatcctcggccacgtccatccggaggtgctcgaggccgtgcagcgcgtgctgggcaacggcttctcgttcggtgcgccgaccgaatcggaagtggagatcgccgaagaaatctgcaagctggtgccctccatcgaacaggtgcgcatggtgtcgagcggcaccgaagcgaccatgagcgcgctgcgtctggctcgcggcttcacgaaccgcacccgtatcgtcaagttcgagggctgctatcacggccacgcggacagcctgctggtcaaggccggttcgggcctgctcaccttcggcaatccgacttcggctggcgtgcccgccgatattgcgaagcacaccaccgtgctcgagtacaacaacgtcgccgaactcgaagaagcgttcaaggcgttcggcaacgagatcgcctcggtgatcgtcgagccggtggccggcaatatgaacctcgtgcgcgccacgcccgaattcctgcaagcattgcggcgcctgtgcagcgagtacggctcggtgctgattttcgacgaagtgatgtgcggcttccgcgtcgcgttgggcggggcgcaagaggtctatggcatcacgccggatctgacgtgtctcggcaaggtgatcggcggcggcatgccggcggcggcctttggcggacggcgcgacatcatggctcacctcgcgccgctcggcggcgtctatcaggcgggcacgctgtcgggcaacccgatcgccgtcgcggccggtctgaaaacgctgcagctgatccaggcgcccggcttttacgacacactcgccgcgcgcaccacgcgcctcgcacaaggtctcgcgaatgtcgcgcgtgaagccagggtgccgttcgcggccgactcgctcggcggcatgttcggcctctatttcacggagtcgatcccgaccagcttcgccgaagtcacgcaaagcgacgtgccgcgtttcaatgcgttcttccacaagatgctggatgccggcgtgtactttgcgccctcggcctatgaagcaggctttgtctcgatcgttcacgacgacgcgatcatcgacgcgacgatcgacgccgcgcgcggcgcattcgcctcgctc

SEQ ID NO: 28201 - DNA, 1167 bp, Burkholderia fungorum
cgagaagtagtgatctgcaatccggtgagaacgccgatcggcgcattcggcggatcgctgaaagaggtgcccgccaccgaactcggcgcgatcgccgtgcgtgagacattgcgtcgcagtgggctcgacgcggccgcgctgggctcggtcgtgatgggcaacgtgattcaggccggcaacaggatgaatccggcgcgccaggcgtcgatcggcggcggcgtgccggtgagcgtgccggcgttgaccgtcaatcgcgtgtgcggctcgggggctcaggccatcgcgtcggcggcgcaggagatcctgctcggtctcggcgatgtggcagtcgcaggcggcatggagaacatggaccgcgccccgtatctgctcgacggcggccgttggggctaccgcatgggtaacgcgcaaatccacgacagcctgctgcgcgacggtctgaacgacgcgttttcgggcgagcactccggctggcacaccgaagacctcgtcgcgcaattcgacatcacgcgtgaagcacaggaccgctgggcggcgcgttcgcaacagcgattcagcgaggcacaggcgcgcggcgatttcgacgccgaactggtcgccgtggaaaccgcgggacgcaaaggcccgcagcacttcacgcgcgatgaacagccgcggcccgacaccacggtggaaacgctggcgaaactgcgtccggcatttcgcccggatggcacgattaccgcgggcaacgcgcccggattgaacagcggcgcggccgcgatgctggtggccgggcgcggtttcgcggaagcacacggcatcgagccgttcgcgcggctcgtggcgtacggcgtcgccgcggtcgaacccggcatgttcggcctcggtcccgtgccggccgtagagatggcgttggcgcgagcgggttggcaattgcacgatgtcgagcgcttcgagatcaatgaagcgtttgccgccgtgccgatcgcggtcgcgcgcagactcggcattgcggacgaattgatcaacgtgcaaggcggcgcgattgcacatggccatcccattggcgcgaccggtgccgtgttgaccacgcgcctgctccattccatgcggcgcgacggtctcaaacgcggcattgttacgctgtgcatcggcggcgggcagggaattgcgctggcgttggaa

SEQ ID NO: 28202 - DNA, 768 bp, Burkholderia fungorum
atgggtgaggtgccggcgcggcgtgccgctgagatcgacgcgctgcgttgcggcatcgaactcggcatgacgttgatcgacacggcggaaatgtatggcgacggcgcgaccgaatctctgctgggcgttgcgctggccgggttgcgcgacaaggtgtttctggtcagcaaggtgtatccgcataacgccagccggcgcggcgtgatcgcggcctgcgagcagagcctcaagcgtctgaagacggatcagctcgatctgtatctgctgcactggcgcggctcggtgccgctcgcggaaacggtcgagggcttcgaggcgttacggcgggcgggcaagattcgccactggggcgtcagcaacttcgacaccgcggacatggaagaactcgtcgccacgccgggcggcgatgcgtgcgcaaccaatcagattctctacaacgtggcgcgccgcgggccggaattcgaactgctgccgtggctcgccgcgcgcaagatgccggctatggcgtacagcccggtcgatcacgcacgcttgccgaaacgctcgccgctcgacaatatcgccgacgcgcgcggcgtctcggtgttccaggtggcgctcgcatgggtgctgctcgcgcccggcgtgttcgcgattccgaaggcggggcgcgccgagcatgtgcgcgacaaccatcgcgcggcgcaactgcaactcggcgcggatgaactggctgccatcgacgcgtatttcaaaccgccgcgcagcaagcgtccgctcgaaatgctg

SEQ ID NO: 28203 - DNA, 2238 bp, Burkholderia fungorum
tgcccgttcaaccatgccgccggcggcggcaccacgaaccgcgactggtggccgaagcagttgcggctggatctgctcagccagcactccggcaagtccaacccgctggatggcggcttcaattacgctgaagcgttcaggagcctcgatctggcggcagtgaagaaagacctggccgctctgatgaccgactcacaagactggtggcccgcggacttcggccactatggcccgctgttcatccgcatggcctggcacagcgccggcacttatcgcatcggcgacggccgcggcggcgcggggcgcggtcagcaacggttcgcgccgctcaacagctggccggacaacgtcagcctagacaaggctcggcgcctgctctggccgatcaagcaaaagtacggccagaagatttcctgggccgacctgctgattctcacgggcaacgtcgcgctcgagacgatgggcttcaagaccttcggtttcgcgggcggtcgcgaggacacatgggagccggatctggacgtctattggggcaacgagaagacctggctgggcggcgacgtccgttacggcaagggcgcggccggcgataacgacgacggcggcgtgatcgtcgccgacgaagaaaaacacggcgaagaggtgagccgcgacaacagcgggcgaaacctggaaaatccgctgggcgccgtgcagatgggcctcatctatgtcaacccggaaggccccgacggcaatccggacccgctcgccgcggcgcacgacattcgcgaaaccttcgctcgcatggccatgaacgacgaagagaccgtcgcgctgatcgccggtggccataccttcggcaagacgcacggcgcgggtcctgcggacaacgtcggccctgaacccgaggcggccgatctcgagaaccaggggctgggctggaagaacagcttcggcaccggcaagggcgccgacacgatcacgagcggtctggaagtcacctggaccaccacgccgacgaagtggggcaacggcttcttcgaaaacctgttcaagtacgaatgggagctgaccaaaagtcctgccggcgcgcatcagtgggtcgccagggacgccggcgaaacgatcccgcacgctcacgacccctcgaagaagctgcggccgaccatgctcaccaccgacctctcgctgcgcttcgatcccgtctacgagaagatttcgcggcgttttctggagaacccggaccagctcgccgatgccttcgcccgcgcctggttcaagctgacccaccgcgacatggggccgcgcgcccgctatctcggtccggaagtccccgccgaagaactgaactggcaggacccgattccggcgctcgaccatccgctggtgaacgagcaggacatcgcctcgctcaagcagaagattctggcgtcggggctgtcggtctcgcagctggtgtccacggcgtgggcttcggcatccactttccgcggctcggacaagcgcggcggcgccaacggtgcgcgcattcgcctcgcgccgcagaaagactggccggtcaatcagcctgagcaactggcgaaggtgctgaaggttctcgaaggcattcagagcgagttcaacggcgtgcagtccggtggcaagaagatttcgctggccgacctgatcgtgctgggtggcgccgccgctatcgagcaggcggcaaagagcgctggccagcaggtgagcgtgccgttctcgccgggccgcatggatgcctcgcaggagcagaccgacgtgcaatccgtcgcggcgctcgaaccgcttgccgatggcttccggaactacctcaagggcaagtatcgcgctccggcggaggccttgctgatcgacaaggcgcaattgctgacgctgacggctcctgagatgacagtgctgctcggcggcttgcgcgcgttgaacgttcacgcagggcaggattcgcacggcgtattcacgcaccggccgcagacgctgtccaatgacttcttccgcaacctgctcgacatgggcacggaatggaagccgctgtcgccggcccgggacgtgttcgaggggcgtgatcgcaagaccggcgaactgaaatggacgggcacgcgtgtcgacctggtgtttggttcgcatgctcagctcagggccttatgcgaagtctatgcaagcgaggacgcgcaggagaaattcgtccgcgacttcgttgcggcctgggcgaaagtgatggatctcgaccggttcgagatt

SEQ ID NO: 28204 - DNA, 756 bp, Burkholderia fungorum
atggagattcgtgacaatgtattcctgatcaccggcggtgcatcaggcctcggcgcggccaccgcgcgccttctcgtcgaaaacggcggcaaggtggtgctcgccgacctgaatgtggacgccggcgaagcgctcgcgaaagaactcggcggcgtgttcgtcaaatgcgacgtcagccgcgaagacgacgccactcaggccgtcgaagccgccacgaagctcggcacgctgcgcggcctcgtcaattgcgcgggcgttgcgcccgccatcaaaacgatcggcaaggacggcccgcatccgctcgactcgttcacgcgcaccatttcgatcaacctgatcggcaccttcaacatgatccggctcgctgccgcagccatgtcgaagaacgagccgaatgcgaacggcgagcgcggcgtgatcatcaacacggcgtccgtggcggcgtatgacggccagatcggccaggcggcttatgcggcgtccaagagcggtgtggtcggcatgacgctgcccatcgcacgcgacctgtcgcgcaacgcgatccgcgtgatgaccattgcgccgggcattttcgaaacgcccatgctgctcggcatgccccaggaagtgcaggacgcgctcggcgcgatggtgccgttcccgccgcgtctcggcaaaccggcggagtacgcaatgctggccaaacagatcttcgacaaccccatgctcaacggcgaagtgatccgtctggacggcgcgatccgcatgcagccgaag

SEQ ID NO: 28205 - DNA, 765 bp, Burkholderia fungorum
atgttgcgtgtgattaccgccaacctgaacggcatccgctcagcggcgaagaagggctttttcgactggttcggagaacagaaggccgacgtgctgtgcgtgcaagaaatcaaatgctcgcaagacgacatgaccccggaattcatggcgccgcacgatttcaccggctattttcagcacgccgtgaagaaaggctatagcggcgcgggcgtgtacacccgtcacgaaccggacgaagtggtgatcggcttcggcagcgaggaattcgatccggaagggcgctatgtcgaactgcgtttcggcaagctgtcggtgatttcggtgtacgtgccgtcgggttcgagcggcgacgagcgccagcaggccaaataccgtttcatggacgagttcatgccgcatctcgcggaactggctcaggagcgcgaagtgatcgtgtgcggcgacgtcaacatcgtccacaaggaaatcgacatcaagaactggaagagcaaccagaagaattcgggttgcctgccggaagagcgcgcgtggctcaccaaactgttcgatgaggtcggttacgtcgacgtgttccgcacgctcgaccagcggccggaacagtacacgtggtggagcaatcgcggccaggcgtatgcgaagaacgtcgggtggcggatcgattatcagatcgccacgccgggtatcgcgagcaaggcgaaacgcaccgacgtgttccgcgatatcaagttcagcgaccatgcgccgctgacggtcgactacgaccac

SEQ ID NO: 28206 - DNA, 861 bp, Burkholderia fungorum
attgcgcccaccctgaaggctgaaatcctggccgaggcgctgccctacattcgccagtatcacggcaagaccgtggtcatcaaatacggcggcaacgccatgaccgaagagcgtctgaagcagggcttcgcgcgcgacgtgatcctgctgaagctggtgggcatcaatccggtcatcgtgcacggcggcggtccgcaaatcgaccaggcgctgaagaagatcggcaaacagggcaccttcatccagggcatgcgcgtcaccgacgaagaaacgatggaagtcgtcgaatgggtgctcggcggcgaagtgcagcaggacatcgtcacgctgatcaaccacttcggcggtcacgcggtcggcctgacaggcaaagacggcggcctgatccacgcccgcaagatgctgatgccggatcgcgacaatccgggccagtatgtcgatatcggccaggtgggcgaagtcgaggcgatcaacccggcggtcgtgaaagcgctgcaggacgacgcgttcattcccgtcatctcgccgatcgggttcggcgaagacggcttgtcgtacaacatcaacgcggacctggtcgcgggcaagctggcggtggtgctgaacgccgaaaagctggtcatgatgaccaacatccccggcgtgatggataaggaaggcaatctgctcaccgatctgtccgcgcgcgaaatcgacggcctgttcgcggacggcacgatctccggcggcatgctgccgaaaatctcgtcggcgctggacgcggccaagagcggcgtgcggtcggtgcacatcatcgacggccgcatcgagcactcggtgctgctggaaattctcaccgaacagccgttcggcacgatgatc

SEQ ID NO: 28207 - DNA, 891 bp, Burkholderia fungorum
ggcgttcggctcacctgcgggcgcgtcacttacaatagcgtgatgaaactgaaattcaccaagatgcacggcgcgggcaacgacttcgtcgtgctcgacggctacacccaaccggtcaacctgacgccggcgcaggtgcgcgcgctcgcggaccggcatttcggcgtcggcgccgaccagttgctgctggtcgaaaagcccacggtggccggtgtcgatttcagatatcgcatcttcaattgcgacggcggcgaagtggagcattgcggcaacggcgcgcgctgcttcgtcaagttcgtgcgcgagcgcggcctcaccgatcaacgcagcgtgcgcgtgcaggtgcagaagggcaccatcacgctgaccatgcaggaaaacggcgaagtgctggtcgacatgggcacgcccgtgttcgacccggagcgcgtgccgttcgccaccaaaggcctcgaaggccgccgcgagggagcggacacgctctggccgctcgacgtgagcggcacgacacggtggatttcggtggtctcgatgggcaatccgcacgccgtgcaggtcgtcggcgacgtcgaagcgttcccggtgctggccgaaggcccggtgatcgagcgtcatgcgcgttttccgcagcgggtgaacgcgggcttcatgcagatagtcggccgcaatgaaatcaggctgcgcgtgtacgagcgcggcgcgggtgaaacgctggcgtgcggcacgggcgcatgcgcggcggtcgcggccggcatccggcgcgggctgctcgactcacccgtgcgcgtgcacacgcacggcggcgacctgaccatctcgtgggacagcacgcgagaaggcgaaccgctactcatggccggaccggccgtgaccgttttcgaaggcgagatc

SEQ ID NO: 28208 - DNA, 1149 bp, Burkholderia fungorum
tatctcttcacttccgaatccgtctccgaaggccatcccgacaaagtcgcggatcagatttccgacgccattctcgacgccatcctggctcaggacaaatactcgcgtgtcgccgcggaaacgctgtgcaacacgggtctcgtcgtgctggccggtgaaatcaccacgaccgctaacgtcgattacatccaggtcgcacgcaacacgatcaagcgcatcggttacgacaacaccgactacggcatcgactatcgcggctgcgccgtgctcgtcgcgtatgacaagcaatcgccggacatcgcccagggcgtggaccgcgcgcacgacaacaacctcgatcaaggcgccggcgaccagggcctgatgttcggttacgcgtgcgaagagacaccggaactgatgccgttgccgatccacctgtcgcaccgtctggtggagcgtcaggcgaatctgcgccgtgacggccgtctgccctggctgcgtccggacgcgaagtcgcaggtcaccgtgcgttatgtcgacggcaaaccgcattccatcgacaccgtggtgctgtccacgcagcattcgccggacatcgatctgggcacgctgcgcgaagccgtgatcgaagaagtgatcaagccgacgctgccggccgacctcatcaagggcgacatcaagttcctcgtgaacccgaccggccgtttcgtgattggcggtccgcaaggcgattgcggcttgaccggccgcaagatcatcgtcgatacgtacggcggtgccgcaccgcacggcggcggcgcgttctcgggcaaggacccgtcgaaggtcgaccgttcggcggcctacgccggccgttatgtcgcgaagaacatcgtggccgcgggcctggcttcgcgctgcctgatccaggtttcgtacgcgatcggcgtcgcccagccgacttcggtgatggtgaacacgttcggcaccggccgcgtgtcggatgcggtcatcacgcgtctcgtgcaggagcatttcgacctgcgtccgaagggcatcatccagatgctcgacctgctgcgcccgatctacgagaagagcgccgcctatggtcacttcggccgcgaagagccggaattcacgtgggaatccacggacaaggcgctggcactcgccgaagccgccggc

SEQ ID NO: 28209 - DNA, 1560 bp, Burkholderia fungorum
ttgaagaaccatgtagccggccagtggatcgcgggcacgggtgcaggcatcacgctcaccgatccggtaacgggcgtggcgctcgtgcgcgtatcgagcgagggcctcgacctcgctcgcgcattcagctttgcccgcgaagacggcggcgccgcattgcgggcgctgacctacgcgcaacgcgccgcccgcctcgccgatatcgtcaagctgctgcaggcgaaacgcggcgattactacgcgatcgccaccgcgaactccggcaccacgcgcaacgactcggcggtcgatatcgacggcggcattttcacgctgtcctactacgcgaaactcggcgcatcgctcggtgaagtgcatgcactgcgcgacggcagcgccgagtcgctgagcaaggatcgatcgttcagcgcgcagcatgtgctgagcccgacacgcggcgtcgcgctctttatcaacgcgttcaatttcccttcgtggggtttgtgggaaaaggccgcgcccgcgttgctatccggcgtgcccgtcatcgtgaagcccgccacggcgacggcctggctcacccaacgcatggttgccgatgtggtcgacgcaggcatcctgccgcccggcgcgctctccatcatttgcggcagttcggcgggcctgctcgatcagatccggtcgttcgatgtggtgtcgttcaccggctcggccgacaccgccgcgacgctgcgcgcgcatccggctttcgtgcagcgcggcgcacgcctgaacgtcgaagccgacagtctgaacagcgcgattctatgcgccgacgctacgcccgacacacccgccttcgacctgttcatcaaggaagtggtgcgcgaaatgacggtgaaatccggccagaaatgcacggcgatccgtcgtgctttcgtaccggaagcagcactcgaacccgtactcgaagcactcaaggcgaagctcgcgaaaatcaccgtcggcaatccgcgcaacgacgcggtgcgcatgggttcactcgtgagccgcgagcaatacgaaaacgtgctggccggtatcgcggcgctgcgtgaggaagcggtgctcgcctacgacagctccgctgtgccgctcatcgacgccgacgcaaacatcgcggcttgcgtcgcgccgcatctgttcgtggtcaacgatccggataacgcgacgctgctgcacgatgtcgaagtattcggaccggtggcgagcgtggcgccctatcgcgtcaccaccgacaccaacgcactgcccgaagcgcacgcggtcgctctcgcgcgacgcggccagggatcgctcgtcgcctcgatctattcgaacgacgacgcgcatctcggccgcctcgcgctggaactcgcggattcgcacggccgcgtgcatgctatttcgccctcggtgcagcacagtcaaaccggccacggcaacgtgatgccgatgtccctgcacggcggcccgggccgcgcgggcggcggcgaagaactcggcggcttgcgcgcgctggctttctatcaccggcgctcggcaatccaggctgcgagcgcggcaatcgggacgctgacgcaa

SEQ ID NO: 28210 - DNA, 1548 bp, Burkholderia fungorum
gccgcgacggtcgaagcgccgcccgcgctattcaatttcgcggcctatctgtttcgactgaacgaaacgcgcgccggcaagaccgcctatatcgacgacaccggcagcaccacctacggcgaactcgaagaacgcgcgcggcgtttcgccagcgcgctgcgtacgctcggcgtgcatcccgaagagcgaattctgctcgtgatgctcgacaccgttgcgctgccggtcgcctttctcggcgcactctatgcgggcgtcgtgccggtcgtcgcgaatacgctgctcacacctgccgactacgtgtacatgctcacgcacagccacgcgcgcgccgtgatcgcctccggtgcgctagtgcagaacgtgacgcaggcgctggagtcagccgaacatgacggctgtcagctgatcgtctcacagccccgcgaaagcgagccgcgcctcgcgcctttgttcgaagaactgatcgatgccgccgcacccgccgccaaagccgccgcaaccggatgtgacgatatcgccttctggctgtattcgtcgggttcgaccggcaagccgaagggcaccgtccacacgcatgcgaatctgtactggaccgccgaactgtatgcgaagccgattctcggcatcgccgaaaacgacgtggtgttctccgcggccaagctgttcttcgcgtacggtctcggcaatggactgacgttcccgctctcggtcggcgcgactgcgatcctgatggccgagcgccccaccgccgacgcgattttcgcgcgcctcgtcgaacatcggcccactgtgttctacggcgtgcccacgctctacgcgaacatgctcgtgtcgcccaacctgcccgcgcgcgccgatgtcgcgatacgcatctgcacgtcggcgggagaggcgttgccgcgtgaaatcggcgagcgcttcaccgcgcacttcggctgcgagattctcgacggcatcggctcgacggaaatgctgcatatcttcctgtcgaatcgcgcgggcgcggtcgaatacggcaccaccggccgaccggtacccggctacgaaatcgaattgcgcgacgaagccggccatgcggtgcccgacggcgaagtcggcgacctgtatatcaagggacccagcgccgccgtgatgtactggaataaccgtgagaagtcgcgcgccacctttctcggcgaatggatccgcagcggcgacaagtactgccggctgcccaacggctgctatgtctatgcgggccgcagcgacgacatgctgaaagtcagcggccagtatgtctcgcctgtcgaagtggaaatggtgctggtgcagcacgacgcggtgctcgaagcggcagtggtcggcgtcgatcatggcggcctcgtcaagacgcgcgcgttcgtggttttgaagcgtgaattcgcgccgtctgagatactcgcggaggagttgaaggcattcgtgaaagaccgcctcgcgccgcataaatatccgcgcgatatcgtattcgtcgacgatctgccgaaaaccgccaccggcaaaattcaacgcttcaaactgcgcgaa

SEQ ID NO: 28211 - DNA, 2097 bp, Burkholderia fungorum
atgacctcaagaaatcgccgtgattttctgcgctccgccgcgcatgcagccggttccgccaccgcattgagcatgctgcctctgggcattcgcaatgcgctcgccattcccgccaacaacaagaccggcacgattcgcgacgtcgagcacatcgtcgtgctgatgcaggaaaaccgttcgttcgaccactacttcggcacgctcaaaggcgtgcgcggttttggcgacacgcgcgccatcaatctgccgaacggcaagcccgtgtggtatcagccgctcgcggcggatatcggctacgtgctgccgttccgccccagcgcgcccaacctggggctgcaattcctgcaagatctcgcgcacgactggaccagcacgcacgcggcatggaacggcggccgctacgatcaatgggtgcccgcgaaaagcgccacgacaatggcctacctcacgcgcgaggacattccgtttcactatcaactcgccgacgccttcacgatctgcgacgcgtatcactgctcgctgatgggaccgacggacccgaatcgctactacatgtggagcggctgggtaggcaatgacggcagcggcggcggtccggtgatcgacaactccgaactcggctacggctggtccacgtatcccgaagtgctacagagcgcgggcatttcgtggaagatctatcaagacatcggcacgggtctcgacgcgaatggttcgtggggctggacgcagaatccgtatatcggcaattacggcgataactcgctgctctacttcaaccagtaccgcaacgcccagcccggcaacccgctctacgacaacgcccgcaccggcacgaacgcggcgaaaggcgacggctacttcgacatcctcaagcgcgacgtacagaacaacgcgctgccgcaggtgtcgtggatcgtcgcgcccgaagcctattccgagcacccgaactggccggcgaactacggcgcgtggtacatcgaccaggtcctgcagattctcacgtccaatcccgaggtgtggagcaagacggtgcttctggtgaactacgacgagaacgacggcttcttcgaccacatggcgccgcccttcgcgccgtcgtcgagcgcgaacggtctgtccaccgtcgacaccaccaacgaaatctatacgggcgacgcgaagactccctccggcccgtatggactcggaccgcgcgtgccgatgctggtggtttcgccgtggtcgaaaggcggctatgtgtgttcggaactgttcgaccatacgtcggtgatccgctttatcgaaaagcgcttcggccacgaccacaatctcggcgaatcgaacatcacgccgtggcgccgtgcggtgtgtggcgatctgatgtccgccttcaacttcagcaatccgaacgacgccatcccggcgctgccgagcacgagcggctacgttccggcggatcagaaccgccacccggactacgtgccgctgccgccggccttgcaggccgtgccgaaacaggagcccggcgtgcgccccgcccgtgcgctgccctatgaactgttcgtgcgcgtgcacggcgaaggcgcggccaacacactcaccatgcgcttcgtcaacacgggccgcgccggcgcggtgtttctcgtctacgccgctcacagtctcgacgcaccgcgcacctatacggtggaagccggcaagcggctgcaggacccgctgccgttgaatgccgacggcagctacgactacaccgtgtacggcccgaacggctttctgcgccgcttcgcgggcaagccggtgtcgcgcagctggtggcatggctcggacatcgcgcgccctgaagttgcagaaggctacgacgtttcgaacggcaacctgcaattgcggctggagaacgtgggcagcgcgcgttgccagttcacgatcgtcaacgcatacgatccgggcaatgcgatcaagcattcggtgcgcggcggcgataccgaacagctctatctggatctgcgcaatgcacatggctggtatgacctggccatcacggtcgataccgatccgctgttcgcgcggcgctttgccggacacgtggaaaccggcaagagcagcatgagcgatcct

SEQ ID NO: 28212 - DNA, 1575 bp, Burkholderia fungorum
ccggcgcgctacaacatcggcgtggacgtgtgcgataaatgggccgacggttcgggccgtctcgcgctgatctacgaagatcccgagggcactgcgacccgctatacgttcgacgagttgaaagcgctgtccgaccgcttcgccaacgcgctgctcgcagcgggtgcgcaacgcggcgaccggatcggcatcttcctgtcgcaatccgtcgaaacggctatcgcgcatctcgccgcctacaaggccggcatggtggccgtgccgctgttcgcgctgttcggcgtcgatgcgatcgaacatcggctcggcgatagtggcgccgtggcgctgattaccgatcacggcggcgtgcagaaggtcgacgaaatccgcgcggcgttgccgtcgctgcgcaatgttttcagcgtggatatcgatcgggacaacggcgatccgcatgcgccggtgcgttcgttctggcacgcgctgaagagcgcgcccgcgggtttcacacccgtcgataccggcgcggacgatcccgcggtgatcatctatacgtcgggcacgaccggcaaaccgaagggcgcgctgcatgggcaccgcgtgttgccaggccacctgccgggcgtcgagatgtcgcaacagggctttcccgcgcacgccacgctgatctggacgcccgccgactgggcatggatcggcggcctgttcgacgtgctcttgccctcctggcatcacggcgtgccggtactcgcgcgccgctttgcgaaattcgacggcgaggccgcgttcgatctgatggcgcgtcacgcggtctcgcatacgtttctgccgcccaccgcattgaagatgatgcgcggcgtcgaacgtcccgaacgctggagcctcgcgttgcgttcggtggcgagcggcggtgaatcgctcggcgaggaattgatcggctggggccgcaaagcgctgggcgtcacgatcaacgagttctatgggcagacggagtgcaacgtcgtggtgtcatcgtgcgcggcgctcttcgaaccgcgcttcggcgcgattggccgcgcggtgccggggcatcatgtcgcgattgtcgatatggacggcaacgaattgccgccgggcgcgatcggcgatatcgcggtggccgcgcccgatccggtcatgtttctcggctactggggcaacgaggcggcgacgcgcgagaaattccgcggcaagtttctggtgaccggcgacctcggcacatgcgacgcggacggcttcatccgttttgtcggccgtggcgacgacgtgatcacgagcgccggctaccgcatcgggccggcttcgatcgaagactcgctgctgcgtcatccggctgtttcgatggcggtcgtgatcggcgcgccggatcgcgagcgcaccgagatcgtgatggcgttcgtggtgctgaaccccggctttgccggcgacgcggcgctggtgcgcgagatccagcagcatgtcaaaacgcgtctcgcggcgcacgagtatccgcgcgagattcgctttgtcgacagcctgccgttgacggcgaccggcaaggtgatccgcaaagccttgcgcgagggactggaacag

SEQ ID NO: 28213 - DNA, 870 bp, Burkholderia fungorum
tatcgttcggttttccgcgaaggcctcttcgccggcaaagtcattatcgtcaccggcgcgggtagcggtttaggccgatgcaccgcgcacgaactcgcatccttaggcgcaaccctggcgctggtcggccgaagcgaggacaaactgaaagcggtgcaagccgaactggccgaagatcatcaacgcacctccgccggacacaagacctattcctgcgacatccgcaacgagcaacaggtccgcgaaacgatcgcttcgatcattgcggatctgggccgcgtagacggcctcttcaattgcgcgggcggccagttccccgcgaagctcgaaaagatttccctgaatggctgggacgcggtagtgcgcaacaatctgcacggcacgtttctgatgtcccgcgaatgctatacgcaatggatggaacatcacggcggaacgatcgtgaacatgctggcggatatctggggcggcatgcccggcatgggtcactcgggcgcggcgcgggcgggcgtgtggaacttcacggaaaccgccgcatgcgaatggggccacgcgggggtgagagtcaacgcggtcgcgccgggctggatagcgtccgcgggtatggacagctacaacgaagactaccaggcgctgttgcgcacgctcaggcataaggtcccgctgcagcgcttcggcaccgaatccgaactggccggcgcggcggtgtttctgttgtcggaggcgtcggcgttcatcaacggcacggtgatccgcgtcgacggcggcgtgccgaacgcgcgccactcgtggccgcttccgccggcggagcgtacgatcgaatataacggcttcccgcgttatcaaccgccgacgggcttgcaggagcag

SEQ ID NO: 28214 - DNA, 1212 bp, Burkholderia fungorum
atggatctgaacttcactcccgaggaagaggctttccgcgccgacgtgcaggccttcttgcgtgacaggctcccgccgcgactcgccgacaaggtgcacggcggccgccgtctgacgcgcgacgacatggccggctggcacgcgattctcaacgcgcaaggctggcttgcgaaccactggccgaaagaatacggcggcccgggttggaacccggtgcagaaattcatcttcgaaaacgaatgtgcgctggccggcgcgccgcgcgtggtgccgttcggcgtcaacatgctcggccccgtgctgatcaaatacggcagcgaagcgcaaaaacgccattggctgccgcgtattctcgacggctcggactggtggtgccagggctattcggaaccgggcgccggctccgatctcgcctcggtcaaaacttccgcggtgcgcggcacggatgcacagggcgagcactacatcgtcaacggccagaagacgtggaccacgctcggccactacgcgaacatgattttctgcctcgtacgcagcgccaccgacgtgcgcaaacaggaaggcatcagctttctgctgatcgacatgaagacgccgggcgtcgaagtgtgcccgatcatcacgctcgacggcgagcacgaagtcaacgaggtgttctttaccgacgtgcgcgtgccggtcgagaacctggtcggcgaagagaataaaggctggacgtacgccaagtacctgctcacgtatgagcgcaccaatatcgcgggcgttggtttttccgtggccgcgttcaatcgtctgcgcaagattgccgcgaaacagcggcgcaatggccggccgctcgcggaggatcctgcgttcgcggcgcgcatggcgcgtgtcgaaatcgatctggagaacatgaagaccaccaacctgcgcgtgatcgcggcggtggccggcggcggcgtgccgggagccgagagttcgatgctgaagattcgcggcaccgagatccgtcaggaaatctcgtcgctcacgcgccgcgcaatgggtccgtacgcgcaaccgttcgtcgaggaagcgttgcaagacggcttcgaaggcacgccggtcggccccgacgaagccgcgagcgccgcttcgctttacttcaataatcgcaagctgtcgatcttcggcggctcgaacgaaatccagaagaacatcatttccaaaatgatcctgggactgtaagag

SEQ ID NO: 28215 - DNA, 1047 bp, Burkholderia fungorum
atgaatttccagcacaccgaagaccgccgcatgctggcggatacgctcaatcgttttgtcagcgagcaatacggcttcgagacgcgcgaccggatcgcgcgttcggcagaaggctatagccgcgacctgtggacccgttttgccgaactcggcatgatcggcgcactgttcgatgaagcggacggcggtttcggcggcggcggcttcgatatcgccgtggtgttcgagagcctcggacgcggcctcgtggtcgaaccgtttctggacacgctgatagtcggccgcgcgattgcgcggagcggcaacgaggcgcaaaaagccatgcttggcgaattgatcgacggctcgcgagtcgttgcgctcgcacacaacgaaccggacggccactacgaactggcccgcgtgacaacccgcgcgcagcgcaacggcgagacatggcggctgaccggcgcgaaggccgtggttcagcacggcgaacacgcttcgctctttctggtctcggcgcgcacgcacggcaatgacgatgaagaagcgggcgtgacgctctttctcgtgccacgcgatacggcaggcgtgaacgtgcgcggttatcgcaagatcgacggcggccgcgcggccgaagtaacgttcgacaacgtcgcgctcaatgacaacgcattgctcggcgcagcaggcgcgggcttcgcgacgctcgagtatgccgttggctgcggcgtgctggcgttgtgcgccgaagccgtcggcacgatggatgtcgcgaaagaccatacgctggagtatctgcgcacgcgcaaacaattcggcgtgccgataggcagctttcaggcgctgcagcaccgcatggccgatctgctgctcgaaatagaacaggcccgctcggcggtgatcaatgcggcagcggcgcttggtgccgaacgcaggctgcgggagcgcgcggtgtcggcggctaaatacagtatcggcaggatcggcgcgcgggtcgcggaggaatgcattcagttgcacggcggaatcggcatgacatgggaactgccgctcgctcactat

SEQ ID NO: 28216 - DNA, 627 bp, Burkholderia fungorum
ccgctcgccgtttcggtgcgtggtttgcagcgccgctacggcgcgcgtgtcgttatcgacgcgctggacctcgatatccgcgaaggcgaattcgtcacgctgctcggggaaagcggatgtggcaagaccacgctgttgcgtgcgctggccgggctcgatcagcccgacgccggccagattcgcgcgcccgaacgcccttccgtcgtattccaggaacaccggctactaccctgggcgacgctgtgggagaacgtcgtgctcggtcatgaaacgacgattgggcgtgtgggcgcgacgcgcgcgttggccgaagtcgggctttccggtcgcgaggacgactggccgcgcaatctctccggaggtcaggcgcaacgcgtggcgttggcgcgcggcctcgttcgcgaccctgccttgctgctgctcgatgaaccgttcgccgcgctcgacgcgctcacgcggatcaagatgcacggactcgtcaaggagctggtagcgcgccatcaccccggcgtgctgctcgtgacgcatgacgtggacgaagcgctcacgcttgccgacaggattctcgtgatgcgctcggggcgcatcgcggcttccttccaccccaaaaaccacacgccgcaggca

SEQ ID NO: 28217 - DNA, 1479 bp, Burkholderia fungorum
gtcggtttcaaggcctacaacctgctgcgcatggctgaactcggcctgcccgtgccgccggctttcgtgctcggcacgcattactgccgcgatgcgcgggcgcgcgaaatcgccactgcaagcacggtatgggaacccggtctgcaggaactggagcgaaccaccggccagcgcttcggcgatccacgccagccgctcctgctctcggtgcgctcgggcgcccccgtctccatgccgggaatgatggacacgctgcttaacgtcggcctgtgcgataccacgcttgcgggcatgctccgccagaccggcaatccgcgtctggtctgggacacttatcgcaggctcgttgccagctatggtgaactggtggccggcgtaccctcgtctatcttcgaagcggaatacgccgcgttcgccgggacacgcgacgagcacggactcgatttcaccgaactgcgcgaactcacgcatcgttgcctcgccgcctatgagcgcgccgccggccagccatttccgcaggatccgcaggttcaactggcgaacgccatcggctcggtgctggcaagctggcaatcggacagggcatgcgcttaccgcaaacagtgcggtatcagcgatgcaatcggcaccgccgtgacggtgcagacgatggtattcggcaatgccggcggccgttcgggcgcgggcgtcgggtttacgcgggacccggtcagcggcgagccgacgctttgggtcgatttcctcttcaacgcacaaggagaagatgtggtgtcaggccggcgtagcgcgcgcggccacgaagaactggctcaggcgatgcccgcggcctggaaggcattgcaggatgccgcgacgcgactcgagcacgcgctcggcgacatgcaggacgttgagttcaccgtgcaggacgcgcgcctgtacatgttgcagacccgtaatggaaagcgcacgccgcaggccgccgcacggattgcgctggatctgctcgacgagggcgtgatcagtgccgaggtggcacgcgagcgcaccgccgcgctgaaacccgctgcattgacgcgcacgcgtatcgtggcatccggtgatcgccccctgacgccgctcgcgcacgccgcgagtgcgagcaacggcgtcgcggcaggagaaatcgccttcgacgaagcacgcgcgcgcatgcggcatgccgccggtgcttcggtcgtactggtgcggcgcgacgccgagaccgacgacatcgccgcgctggaggtggcggcgggtctgctcacgcagcgcggcgcgcgcacctcgcatgcggcggttgtggcacggcaactcggcaaggtctgccttgtcggctgcacggggttgcgcctcgacgaatcggcgcgcacgctgcaattgggtgatactgtcttgcatgagggcgatgaagtgaccctcgacggcaacgacggtgcaatctatgcgggcacggcgcgcacggttatcgagccgatggcc

SEQ ID NO: 28218 - DNA, 840 bp, Burkholderia fungorum
tttcaacttggcgatctgcctgttacgcgcatgggctatggcgcgatgcaactggcgggtcctcacgttttcggcccaccgaaagaccgcggcgcagcgatagccgtgctgcgcgctgccatcgaaagcggaatcacgcacgtcgatacgagcgatttttatggcccccacgttaccaatcagcttatccgcgaggcgcttcatccgtatcctgatgcgctgaccattgtcacgaaggtcggtgcgagccgaggtagcgatggttcgtggaacgttgcgtcgtcggcggccgaactggagtcggcggtgcatgacaaccttcgcaatctcggtctcgatgcgctggacgtcgtgaactttcgtgcgatgttcaacgtcgccgcgccgaccgagggcgacatcgaagagcccttgacggcgctcgcggagcttcaggcgaaaggcctgatccggcacattgggctgagcaatgtgactccgacgcaggtggcgcagggacgcgcgattacggccattgtgtgcgtgcagaatatgtacaacctcgctcaccgcaacgatgacgcgctgattgaccgtcttgcagaagatggcattgcgtatgtcccgttttttccgctgggcggcttctctccgctgcaagccgatgcgctgagcgacgccgcgaatcgatgcgacgcggcaccgatgcaggtagccctcgcatggctgttacagcgcgcgccgaatattctgctgatacctggcacctcctcggtcgggcatctggaacagaacatcgaaagtgtgaatcttcagttgccggaggatgtgttggcttcgttggacaccatcggcgccgag

SEQ ID NO: 28219 - DNA, 756 bp, Burkholderia fungorum
gctctgaacggcaaactcgctctcgtgaccggcgcttcccgtggaattggcgctgcgattgccgcgcgtctggcacgggacggcgcatcggtgatcgtccattacgcatcgagtgcggagcgcgccgacgcggtggtcaaggcaatccgcgaggcgggcggcgaagccgaagccgttgccgcgaatctgtcgacgcaagacggtgtggcggtgctgatcgactcgctgaacggtgtgtttggcggcaggttcgcaggccggctcgatatcctcgtcaacaacgcgggcacggtcgaatatgggccgttcctcgaatcgtcggcgacttcatacgacacgcacttcaatctgaatgtgcgagcgccgatcgaactcgcgaaggatgcggcgaagcgcatgattgcgaccggctggggacgcattatcaatgtgggttccgctttcggcgaggcggcgccgctgcctggcgtgacgctttacatcgcatcgaaatttgccgttcgcggctttacccgcggtctttcacgtgagctcgggaaattcggggtgacggtgaacgcggtacagcccggcccgatcgacaccgaactggcaccccagcccggtacggaagcccacgctacgatgaccagactggcgagtgtcggccgtttcggcaagcccgaagaaatcgcggctgcggtcgcgtaccttgcgagcccggaagccggctacacgaccggtgaaagtctgaccgtggatggcgggtggattgcc

SEQ ID NO: 28220 - DNA, 1299 bp, Burkholderia fungorum
gtgtccctgaacaatgatgcagcgttctggcgcaacgccaggcagcaccttatccgctacggcggtactttcgagccgatgatcatcgagcgcgcgcagggcagcttcgtctacgacgcggacggtcgcgcgatcctggacttcacctcggggcagatgagcgcggtgcttgggcacagccatccggacatcgtgtcggtcatcaaagagtacgccggcaagctcaaccatcttttcagcggcatgctttcgcggccggtggtcgatctcgcgacccgcctggctgagatcacgccagacggactcgaccgggcgctgttgctcagtaccggcgcggagtcgaacgaggccgccattcgcatggcgaaactcgtcaccggcaaatatgaaatcgtcggtttcgcgcagtcgtggcacggcatgacgggcggggcggcatccgcaacctacagcgccggtcgcaagggcgtcggtccggcggccgtcggctcgtttgcgatccccgctccgtttccgtaccggccgcgtttcgagcgcgacggtcaatacgattacctggcggaactggactacgcattcgacctcatcgatcgtcagtcgagcggcaatctcgcggccttcattgcagagccgattctcagttccggcggaatcatcgagctgccggaaggctacatggctgcgctgaagcgcaaatgcgaggagcgcggcatgttgctgatcctcgatgaagcgcaaaccggcatcggccgcaccggcacgatgttcgcctgtcagcgcgacggcgtcacgcccgatattctcaccctgtctaaaacgctcggcgccggcctgccgctcgcggctgtcgtgacctctgcacagatagaagagcgcgcccatgaattgggttacctgttctatacgacccacgtgtccgatccgctgcccgcagccgtcggtttgcgggtgctggacgtggtcgagcgtgaagggctggttgcgcgcgcgaacctgatgggcgagcggctcaggcgcggcctgctggatctgatggaacgcttcgagtgcatcggcgacattcgcggacgaggtttgctgctcggtatggagatcgtcaaggatcgccgcacgaaggaacccgcggatggacttggcgcaaagatcacccgcgagtgcatgaacctcgggctcagcatgaatatcgtgcagttgcccggtatgggcggcgtcttccggatcgcccctccgctgaccgtccacgaaaatgaaatcgaccttgggctggcgctgctcgggcaggcaatcgagcgctcgctt

SEQ ID NO: 28221 - DNA, 738 bp, Burkholderia fungorum
cccttgattctgataacgggcggaggccgtggcgtgggcgcggcgactgcgcggctcgctgccgcacaaggttacgatgtcgcgataagcttcgtctccgacgagtctgccgctcttgcggtggcggccgacgtggaagcggccggacgccgggctttagccgtgcgcgcggacagcgcggatcccgagcaggtcgcccggctattcgccgcgatcgaccggacgttcggccgcatcgacgtgctggtgaataacgccgcgatcattgcaaagcagtcccgcctggaggacctcgaattcgcgcggatgcagcgtatcttcgcggtcaactcgatcggcccgatcctctgtgcgcagcaggcggtgaagcggatgtcgcatcgttacaatggccgaggcggcgtcgtgatcaacatctcctcggcatcggcccggctcggcagtccaaacgaatatgtcgactatgctgcgtcgaagggtgcgctcgagacattcactaccggttttgcaaaagaagtcgcgcgggacggaatacgcgtcaactgcattcgccccgggcacatctacaccgacatgcatgcaagcggcggagagccgggacgggtagatcgcgtcagggactcgatcccgatgggaagaggcgggcagcctgaagaggttgcgcgggcgattctatggctggcaagcgccgaggcctccttcatcaccggcacgttcctcgacgtcaccggcggcaag

SEQ ID NO: 28222 - DNA, 753 bp, Burkholderia fungorum
agttccatcatgcccgcacatttgcccaatctgaatgatcgcgtcgccctggtgaccggcggctcccgcggaatcggacgcgccatatcgatcgcgctggccgccgccggcgcatcggtcgccgtcaactatcggcaacgcgggaacgaagcggccggcgtcgtcgcggaaattgaacgcgccggcggccgcgcgatcgcggtacgtgccgacgtatcggttgcagacgacgtcaaagcgatgtttcgtgaggtggagaatcaccttggtctcatcgatgtgctcgtgaacaatgcgggcaccggtacgatcgtggacatcgacgatctcacggaagcggagttcgaccgaaccctcgccgtcaatctgaaatccgcatttctctgcacgcaggctgcgctgcccggcatgcgcgcgaggcactggggccgcatcgtcaacctctcgtcggcggctgcccgcggcgcggggctgcttggggttcactacaatgcctcgaaagccggcgtcgagggactgacgcgcggctatgcggcaaagctggcccgcgaaggaatcacagtcaacgccgtggcaccggggccgatcgacaccgaaatggctgggccgctgaaggcggccaacgttgcggacaaactgcccgtggggcgcctgggcgaagcgagcgaggtggcgcaggcggtgctgatggtcgtcggcaatgcgttcattaccggccaaacgattcctgtcaacggaggcgtcagcttcata

SEQ ID NO: 28223 - DNA, 726 bp, Burkholderia fungorum
tcccctgtcgcgcttgttaccggttcgacttctggcattggcgctgccatcgcccggcggctctcaagcgaaggattctcagttgtcttgcattcgcgcagttcggcagaaacaggtcaagcattggctcgcgaactcggttcagctatttacgtacaggctgacctggcggacgatgcggacaggatacggcttatccgtgaagccgtcgccgcgtggggacgactcgacgttctggtcaacaacgccgggatcagccgcgtcatccctcatgcagatctggctgcagctacaccagcggtgtgggcggaactgcacgaggttaacgtggtggctccgtttcgtttgatagccgaggcggaacctgcattacgtgacgcggttcaacgtgtccgcccaggttgcgtgatcaacattagctcgcatgcaggtgttcggccaaagggcgcgtcaatcccttacgcggctacgaaggccgcactaaaccacatgactcgcttgctggcagtatcgcttgcgccggatatccgggtgaacgctgttgctcccggactggtggatacaccattgaccgcagactggacgcaggcacaggagctttggaagacgcgagccccaatgcggcggtcagctagtccggaagacattgctcaggctgtcatgatgctggtggcctcagattatctaactggagaaattctgttgtcggatggtgggctgaatctc

SEQ ID NO: 28224 - DNA, 3507 bp, Burkholderia fungorum
gtgcgtctgacctcgatcaaactcgctggcttcaagtcattcgtcgatcccacgcatttccaggttccgggccagctagtcggcgtggtcggaccgaacgggtgcggcaagtccaacatcatcgacgccgtgcgctgggtgctcggcgaatcgcgcgcctccgaactgcgcggcgagtcgatgcaggacgtgatcttcaatggctcgaccgcgcgcaagcccggcagccgcgccagcgtcgaactggtgttcgacaacgccgacggccgggccgcgggccagtggggccagtatgccgaaatcgccgtcaagcgcgtgctcacgcgcgacggcacctcgagctactacatcaacaatttgccggcgcgtcgccgcgacattcaggacatcttcctcggcaccggtctcgggccgcgcgcatacgcgatcatcgggcagggcatgatcgcgcgcctgatcgaggcgaagccggaagagctgcgcgtgttcctcgaagaagccgcgggtgtgtcgaagtacaaggaacgccgccgcgaaaccgaaaaccgtctgcacgacacgcgcgaaaatctgacacgggtcgaggacatcgtccgtgaactgggcgcgaacctcgagaagctggaagcgcaggccgtggtcgccacgcgttacaaggaactgcaggccgacggcgaagagaagcagcggctcttgtggctattgcgcaagaacgaagccggtggcgagcaggaacgccagcagcgcgcgatcgaacaggcccagatcgacctcgaagcgcacaccgcgaagctgcgcgaagtcgaagcgcaactcgaaacgctgcgcgtcgcgcattattccgcgagcgacgcaatgcagggcgcgcaaggcgcgctctacgaggcgaattcggaagtcagccggctcgaagccgagatcaagttcatcgtcgaatcgcgcaatcgggtgcaggcgcagatcgccgcgctgaacgcgcagcgtgagcaatggcagtcgcaggcgcaaaaagcgcaagacgatctcgcggacgccgaagaacaactggcggtggccgaagaaaaagccacactggtcgaagacgaagccgctgccaaacacgacgcgatgcccgcgctcgaagctcgctggcgcgacgcgcaaaccgaactgaacgccgagcgtggcgggatcgctcagaccgaacaggcgctcaagctcgaagccgcgcatcagcgcaatgccgatcagcaattgcagcaactgcaggcgcgtcacgagcggttgaagtcggaagcgggcggtctcgacgcacccgacgaagcgcagctcgaagacctgcgcatgcagcttgccgagcacgaggaaatcctgcacgacgcgcaaacgcgtctggccgacgcgcaggaaacgctgccgcgcctcgacggcgagcgccgcgcagcgcaggagcgcgtgcaggcggaaagctcgcagattcatcagctcgacgcgcgccttgccgcgctcaagcagttgcaggaaaacgtccagaccgaaggcaagatccagccgtggctcgaaaagcacgagctgaacggcctgccgcgtctgtggaagaaactgcatgtcgaagccggttgggaagccgcgctcgaagccgtgctgcgcgagcggctcgccgcgctcgaagtgtcgaacctcgactgggtcaaggccttcgccaccgacgcgccgcccgccaagctcgctttttacgcgccgcctgtcgccggtcagcctgccgccacgccgcctgcgctgcggccgctgctgtcgctggtgcggatcgacgacgcgggcatccgcgcggtgctgaacgactggctcggcctttcgttcgtcgccgacgatctgcagcaggcgctcgccatgcgctcgcaattgccggaaggcggctcgttcgtcgtcaaggcggggcatgtggtgacgcgcgtcggcgtccagctgtatgccgccgactccgagcaggccggcatgctggcccgtcagcaggaaatcgaaaatctcgcgcgtcaggttcgcgcccaggcgttgctcgcggacgaagcgaaagccgccgcgatccgcgccgaagccgcacacacgcaggccgcgcaggcattgaccgacgtgcgccagcaggcggagcgcgccacgcagcgcgtgcacgcgttgcaaatggacgtgctcaaactcacccaggcgcacgagcgttacacccagcgcagcacgcagattcgcgaggaacttgcagagatcaccgcgcagatcgaagagcagcgcgccatgcgcgcggagtcggaagcgaacttcgagcgtcatgacggtgagctcgccgaactgcaggcgcgtttcgaagatcatcaactggcgttcgaagcgctcgacgaagaactcaccgccgcgcgcggccaggcgcgcgatctggaccgtgccgctaccgacgcgcgctttgccgcgcgcaacatggcgaaccgcatcgacgaactgaagcgcagcattcaggtcgcgcacgagcagagcgagcgtgtcgcggcgtcgctggaagacgcgcgcgccgagctggaaaccatcaacgagcagaccgcgcacaccggcttgcaggacgcgctcgatattcgcgccgtcaaggaagaagcgctgcacgccgcgcgcctcgaactggacgatctcaccgccaagctgcgtgccgccgacgaaacgcgtctgacggccgagcgcgcgttgcagccgctgcgcgaccgcatcaatgaactgcagttgaaggaacaggcggcgcgcctgaacggcgagcagttcatcgagcaacttgccgcggccggcgtcgatgaggcgcagttgcaggccaagctcacgccggacatgaagccgtcgtatttgcagggcgaagtcacgcgcatcaacaacgccatcaccgcgctcggcccggtcaacatggccgcgctcgacgaactgaaggcggcgaccgagcgcaagtcgttcctcgacgcgcagtccaccgatctgaacagcgcgatcgaaacgctcgaagacgccatccgcaagatcgacgcggaaacgcgcacgctgctgcaaggcaccttcgatcaggtgaaccagcatttcggcgaactgttcccgcgtctgttcggcggcggccaggcgaagctgatcatgaccggcgacgaaattctcgacgccggcgtgcaggtgatggcgcagccgccgggcaagaagaattcgacgattcacctgctctcgggcggcgaaaaagcgctgaccgccaccgcgctggtgttcgcgatgttccagctgaaccccgcgccgttctgtctgctcgacgaagtggacgcgccgctcgacgacgccaacacggaacgtttcgcgaacctcgtgcgggcgatgtcggacaaaacccagttcctgttcatctcgcacaacaagatcgcgatggaaatggcgcagcaattgatcggcgtgaccatgcaggagcagggcgtgtcgcgcatcgtggccgtcgacatggaaacggccgcgggtttcgcccag

SEQ ID NO: 28225 - DNA, 1203 bp, Burkholderia fungorum
gtgaacccgctactcgactcccttcagccctacccgttcgaaaagctgcgcgcgcttttcaaggacgtcacgccgaacgccggcctcgcgcacatcagcttcggcatcggcgagccgaaacaccctacgcccgcgctgatccgcgacgccgtggtggcctcgctcggcggcttgtccgcgtatccggccacgagcggatcgcccgccttgcgcgagtcgatcgcgaagtgggtcacacagcgctacaacctgccgccggtcgatccggccacccaggtgttgccggtatcgggttcgcgcgaggcgctgttctccctcgcccaaaccgtgctcgacccgcaaaagaatgccggcggcgagcctgcgatcgtactctgtccgaacccgttctaccaaatctacgaaggcgcggcgattctggccggcgcgcagccgtatttcgtgaatagcgacccggcgcgcaacttcgcctgcgactattcggcggtgccggccgagatctgggcgcgcacgcaactgctctacgtttgttcgcccggcaatccgaccggcgcggtgctcacgctcgacgactggcgcgagctgttcgcgctgtcggaccgctacggcttcgtgatcgcctcggacgagtgctactccgaaatttacttcgacgaagccaagccgccgctcggcggcctggaagcggcccataagctcggccgcggtttcgagcggctcgtcatgctgtcgagcctgtccaagcgctcgaacgtgcctggcatgcgctcgggcttcgtcgcgggcgacgcggcgattctcaaagacttcctgctctaccggacctaccacggcgcggccttgtcgacggtgttccagaacgccagcatcgcggcctggaacgacgaggcacacgtgcgcgagaaccgcgcgaagtacctgcagaagttttccaccgtcacgccgatgctcgccgaggtgctcgacgtgcgcctgccggacgcggcgttctacctgtgggcagacgtctcgcgcacgggtctcacggataccgtgttcgcccagcgcctctacgccgactataatgtgacggttctgccgggctcgttcctcgcgcgcactgcgcacggcgtgaaccccggccgcaatttcgtgcgcatggcgctcgttgccgacgtcgacgaatgcacgcagggcgcgcagcggatcgtcgatttttgccgt

SEQ ID NO: 28226 - DNA, 234 bp, Burkholderia fungorum
ttcacccaggcccaggaagacgtaaaacaactgccggaacgcccgggcaacctcacgctgctgcgtctgtacgccctcttcaagcaggctagcgaaggcgatgttcacggcgacaagccgggcttcaccgacatcgtcggcaaatacaagtacgacgcgtgggccgcgctcaaaggcaccgcgcaggacgccgcgaagcagcaatacgtcgacctcgtcgaatcgctgaagagc

SEQ ID NO: 28227 - DNA, 1415 bp, Burkholderia fungorum
ttcgcgtcgctcggtctgtccgcggacgtcgtctccgcgctgaccgccgctggctatcagaaccccacgccggttcagcaacgcgcgattcccgccggcatcgccggccgtgacctgatggtctcgagcccgaccggttcgggcaagaccgccgcgttcatgctgcccgccatcgaacgtttctcgcaactgcaaaagacgcaggccggccagccgcgtgagccgcgtccggccgacggcgcccgcacgcgccgtccgcaaccggttgcccgtccgaccatgctggttctgacgccgacccgcgaactcgcaatgcaggtcaccaccgccgccgccacttacggcaagcacctgaaacgcctgcgcaccgtcagcattctgggcggcgtcgcttacggccagcaattgatgctgctcgcgaagaacccggaaatcctggtcgccacgccgggccgtctgatcgaccacctggagcgcggccgcatcgatctgtcgcaactgcagatcctcgtgctcgacgaagccgaccgcatgctcgacatgggctttatcgaagacatcgaaacgatcgttgccgctacgccggctacgcgtcaaaccatgctgttctcggccacgctcgacggcaagatcacttcgctgaccggccgcctgctgaaggacccggagcgtatcgaaatcgttcagcgcatggagcagcgcaccaacatcgcgcaaaccgtccattacgtcgacgaccgcgatcacaaggaccgtctgctcgaccatctgttgcgcgactccggcctcgatcaggctatcgtcttcacggcaaccaagatcgatgccgaccagctggccggccgtctggccgatgccggtttcgaatcggccgccttgcatggcgatctgccgcagggcgcgcgtaaccgcacgatccgcgcgctgcgcgagcgccgcgtgcgcgtgctggtggcaacagacgtcgccgctcgcggtatcgacattccgggcatcacgcacgtgttcaactacgacctgccgaagttcgccgaagactacgtgcaccgcatcggccgtactggccgtgccggccgctcgggtatcgcggtgagcctcgtgcatcacgcggaacagggcgcgctgaagcgcatcgagcgcttcgtgcgcaccccgctggcagtcaatgtggtcgaaggcttcgagccgcgcaagtcggcaccgtcgggtaacggccgtcctggctttggtggccgcggccgtccgggcggcggcaacggcggtggccgtcgcttcggtagcggctcgggcaagccggccggcaacggcggcgctgcgcgcagcggcaccggtagcaacggcggcggctgggccggcaagtcggctggcggcggttcgcgtgaaggcggcttcggcggcggttcgcgcgacggcgg

SEQ ID NO: 28228 - DNA, 962 bp, Burkholderia fungorum
ctcgatgtcatcacctacggcgaagcaatggccatgttcgtggccgccgaaaccggccggctcgccggcgtcggccagttcgcgaagcgtattgccggcgccgatctgaacgtggcgatcggcctgtcgcggctgggcttcaaggtgggctggatgagccgcgtcggcaacgattcgttcggccagtacgtgcgcgacaccttgacccgagagggcatcgaccagcgctgcgtgaccaccgacgagcgctacccgaccggcttccagttgaagtccaggaacgacgacggcagcgatccggcggtcgagtatttccgcagggggtcggcggcgagccatctgtcgctggacgactatgcggcggactacgtgctgccggcgcgccatctgcatctaaccggcgtcgcgcccgccatttcggccagctcgcgcgaactcgcgtttcatctggcgcgcgaaatgcgtgctgccggcaagacgatttccttcgacccgaatctgcgcccgacgctgtggccgtcgcgcgccgcgatggtcgaaggcctgaacgcgctggccgcactggccgactgggtgctgcccggcatcggcgagggcgagatcctgaccggctatacgcaaccggacgacatcgcgaagttctatctggaccggggcgcgcgcggcgtaatcatcaagctcggcgcgcagggcgcatatttccgcaccgccgccgacgccgcgctgatcgccggccagccggtcgcgaaggtcgtggatacggtcggcgcgggcgatggtttcgccgtcggcgtggtcagcgcgttgctcgaaggcaagtcgctgccgcaagccgtggcgcgcggcaaccgtatcggcgcgctggcgattcaggtgatcggcgattcggaagggctgccgggccgtgccgaactcgacgcgctcgaatcggccgacgcgacatccatcgccgcggcggcctg

SEQ ID NO: 28229 - DNA, 1266 bp, Burkholderia fungorum
tcaaaggagacacccatgacctcatcgcttgcgattcgccgctggtggacgatcatgccgatcgtattcatcacgtacagcctcgcctatctggatcgcgcgaacttcgggttcgcgtccgccgccggcatcaaccaggatctcggcatcagcaaggggctgtcgtcgctgatcggcgcgctgttcttcctcggctatttcttcttccagattcccggcgcgatctacgcggaacgccgcagcgtcaagaagctcgtgttctggagcctggttctgtggggcggttgcgcggcgctgaccggcatggtcagcaacattccgtcgctgatggtgatccgcttcgtgctcggcgtggtcgaggccgcggtcatgccggccatgctgattttcatcagcaactggttcaccaagagcgagcgctcgcgcgccaacacgttcctgattctcggcaatccggtgacggtgctgtggatgtcggtggtgtcgggctatctggtgcattcgttcggctggcgtcacatgttcatcgccgaaggcgcgcccgcgatcatctgggcggtgatctggtggttcatcgtgcaggacaagccgcagcaggtgtcgtggctcacgcagcagcagaaggacgacctcgccgaaacgctgcgcgccgagcaggccgcgatcaagccggtgcgcaactacagcgaggccttcaaaacgcccgcggtgatcaagctgtgcgcgcaatatttctgctggagcatcggcgtgtatggcttcgtgctgtggttgccgtcgatcctgaagaacggttcgacgctcggcatggtcgaaaccggctggctctcggcgctgccgtatctcgccgcgaccatcgcgatgcttgcagcttcgtgggcatcggataaactcaaccgccgtaaagtcttcgtgtggccgttcctgctggtcggcgcggtggcgttcgcggcttcgtacgcgctcggctccacgcatttctggctttcatatgcattgctggtgatcgccggcgccgcgatgtacgcgccgtatggcccgttcttcgcgatcgtgccggaactgctgccgaagaacgtcgcgggcggcgcaatggcgctgatcaacagcatgggggcgctcggttcgttcgtcggctcgtatgtggtcggttatctgaatggcgccaccggttcgcccgccgcgtcgtacgcgttcatgagcgtggcgctcgtcgccgccgtgattctgacgctggtcgtcaaaccgcagccgcaagcgctgaac

SEQ ID NO: 28230 - DNA, 1380 bp, Burkholderia fungorum
gagaccatcggcgccacgcaggtgctgaccgatccgcacgacaccgccccttacctgaccgactggcgccgccgctacaccggcgcggcgtgcgcggtgctctgcccggccacgcctgacgaagtcgcggcgctcgtgaaactcgccgtcgagcatcgtatcgcgctggtcccgcaaggcggcaacacgggtctcgccggcggcgcgacgccggacgcaagcggcgcgcaggcagtcatcagcttgcggcgtctgaaccgggtccgtgacattgatccgcacaacaatacgattaccgtggaagccggcgtcatcctcgccgaagtgcagaagcacgccgaagaggcgggccgactgttcccgctgagcctcgctgccgaaggcagttgcacgatcggcggcaatctcgccaccaacgcgggtggcaccggcgtgctgcgctatggcaacacgcgcgagctgtgcctcggcctcgaagtggtcacgccgcaaggcgaactgtgggacggcctgcgcggactgcgcaaggacaacaccggttacgatctgcgcgacctctttatcggcgcggaaggcacgctcggcatcatcaccgccgccgtgctcaagttgcatccgcaaccggccgcgcgcgtcacggcgctcgccgcactcgcatcgccgcacgccgcgctcgattttctgtcgctcacgcagcgcgtcgccgggccgctgctgaccggtttcgaattgatgtcggatttttgcctgcgtctggtcggccggcacttcgagcagatgcgctatccgttcgccgagccgcacgcgcaggtcgtgctgctcgaactgtcggacagcgagagcgaggagcacgcgcgcgaactgttcgaacgtctgatggaaacggcgctcgagggcggcctggtgcaggacgccgtggtcgcggaaaatctcggccagtcgcgggcgttctggaatctgcgcgaacacattccgctcgcccaggccgaagaagggctgaacatcaagcacgatatcgcggtgccgatctcgcgcatcggccacttcatcgaggaaaccgacgcggcaatcgcgcaggccgtgcccggcgcgcgcatggtgacgttcggccatctcggcgacggcaatctgcactacaacgtgcaggcgcccgagggcgtcggcgccaaggcgttcctccagcagtaccaggccgcgatcaatcagatcgtctacgacagcgtgcaccggcatcgcggcagcatcagcgcggaacacgggctcggccagttgaaaatcgacgaggcgatgcactacaagcaggacgtcgaggtgcagttgatgcgcgccgtcaaacgcgcgctcgatccgctgaacctgatgaatccgggcaaggtgcta

SEQ ID NO: 28231 - DNA, 1266 bp, Burkholderia fungorum
cgtttcgacacgcttgcgctgcacgccggcgctgctcccgacccgaccaccggcgcgcgcgccacgccgatttaccagactacctcgttttcgttccgcgattccgaccacgccgcggcgctcttcaatatggagcgcgccggtcatgtttattcgcgcatttcgaacccgaccgtggccgtgttcgaggaacgcgtggccgcgctggaaaacggcgcgggcgcgatcggcacggcaagcggccaggcggccctgcatctggccattgccacgctgatgggcgcgggttcgcatatcgtcgcctccagcgcgctgtacggcggctcgcacaatctgctgcactacacgttgcggcgcttcggcatcgagacgactttcgtcaaacccggcgacctggacgcgtggcgcgccgcgctgcgcccaaacacgcggctgctgttcggcgagacgctcggcaatccggggctcgacgtgctcgatatcgccgccgtcgcgcagatcgcgcatgagcaccgcgtgccgctgctggtcgactcgaccttcaccacaccttacctgctcaaaccgttcgaacatggcgcggacttcgtctatcactcggccaccaaattcctcggcggccacggcacgacgatcggcggcgtgctggtggacggcggcacgttcgacttcgacgcctcggggcgcttccccgaattcaccgaaccttacgacggctttcacggcatggtgttcgccgaggagagcaccgtcgcgccgtttctgctgcgagcacgccgcgaggggctgcgcgacttcggcgcatgcctgcatccgcaagccgcatggcaactgctgcaaggcatcgagacgctgccgttgcgaatggaacggcacgttgccaacacgcgccgggtggtcgagttcctcgccggtcacgccgcggtcggggccgtcgcctatccggaactgcccacgcaccccgaccacgcgctcgcgaagcggctgctgccgcgcggcgccggtgccgtgttcagcttcgatctgcgcggcgaccgcgccgccggacgcagctttatcgaagcgctctcgctgttctcgcatctcgcgaacgtgggcgacgcgcgctcgctcgtgatccatcccgcctcgaccacccactttcgcatggacgccgctgcccttgccgcggccggtatcgccgaaggcacgatccgcctctcgatcggcctcgaagatcccgacgatctgatcgacgatctcaagcgcgcgctaaaggccgcacag

SEQ ID NO: 28232 - DNA, 1104 bp, Burkholderia fungorum
atgtccggcaacacgctcggtacgcttttcactgtcacgaccttcggcgaatcgcacggtcccgctatcggctgcgtgatcgacggctgcccgccgggcctggcgctcaacgaagccgacatccagctggagctcgaccgccgcaagcccggcacgtcgcgccacgtcacgcagcgtcaggaagaagacaaggtcgagatcctctcgggcgtgttcgaaggccagaccaccggcgcgcccatcgcgctcctgatccgcaacacggaccagcgcagcaaggattacggcaacattgccgacacgttccgtccgggccacgccgactacacctactggcagaaatacggcattcgcgactatcgcggcggcggccgttcgtcggcccgtctcacggcgccgacggtggccgcgggcgcggttgcgaagaagtggctgcgcgagaagttcggcacggagattcgcggctatatggccgcgctcggtgaaatcgacgtgccgttcgtcgactgggcgcacgtgcgcgaaaacccgttcttcgtgcccaaccagcagatcgtgccgcaactggaagcgtatatggacgcgctgcgcaaggaaggcgactcgatcggcgcgcgcatcaacgtggtggcctccggcgtgccggtcggcctcggcgagccgctgttcgaccggctcgacgcggacattgcgcatgccatgatgggcatcaacgcggtgaagggcgtcgaaatcggcgcgggctttgcgagcgtcgcgcaacgcggttcggtgcacggcgacgaattgacgccggagggcttcgtcggcaatcacgcgggcggtgtgctcggcggtatttcgaccggacaggacatcacggtgtcgatcgcgatcaagccgacttcgagcattcgcacgccgcgccgctccatcgacaaggcggggcaaccggccgtcgtcgaaacgtttgggcggcatgacccgtgcgtcggcattcgcgccacgccgatcgccgaatcgatgctcgcgctggtgctcatcgaccacgcgctgcgccatcgcgcgcaatgcggcgacgtgtccgtcagcacgccgaagatcgcggcgagcgcgccttaacgg

SEQ ID NO: 28233 - DNA, 747 bp, Burkholderia fungorum
aatctggaaggcaaggttgcgctgattacgggcgcttcgagcgggttgggaaagcgctttgcgcaagtgctgtcgcaggcgggcgccaaggtcgtgctggcgagccggcggaccgagcgtctgaaggaattgcgcgccgagatcgaggcgtccggcggtgcggcgcacgtcgtatcgctcgacgtcacagattatcagagcatcaagtcggccgtcgcccatgcggaaaccgaggccggcacgatcgacattctggtgaacaactcgggcgtgtcgaccacccagaaactctccgaggtcacgcccgctgacttcgaatacgtgttcgataccaacacgcgcggcgcgttcttcgtcgcccaggaagtcgccaagcgcatgatcatgcgcggcaacaacgcgcagaatccgtcgtaccggatcatcaatatcgcgtcgatggcgggcttgcgggtgctgccgcagatcggcctttactcgatcagcaaggcggccgtcgtgcatatgacgaaggcgatggcgctggagtggggcaagcacggcatcaacgtcaacgcgatctgcccgggctatatcgacaccgagatcaaccatcatcactggtcgacggagcaagggcagaagctcgtgtccatgttgccgcgccaccgcgtcggcaaaccggacgacctggacgggctgctgctgctgctggcagccgacgaatcgcagttcatcaacggctcggtgattgcggcggacgacgga

SEQ ID NO: 28234 - DNA, 1002 bp, Burkholderia fungorum
ctggaccagattgtcgccgacgcgcaaaaagccttcgcagaagccaccgacgtcaccaccctcgagaacgagaaagctcgctttctcggcaaatcgggtgcgctgaccgagctgttgaagggccttggcaaactcgatcccgaaacgcgcaagaccgaaggcgctcggatcaacctcgtcaagcaacaagtggaagccgcgttgacggcccgccgtcaggcgttggccgaggcgttgctgaaccagcgcctcgccgctgaagccatcgacgtcacgctgcccggccgcggcaccggcgcaggcagcctgcacccggtaatgcgcacgtgggagcgcgtcgaacagattttccgtacgatcggattcgacgtggccgacggccccgaaatcgaaaccgactggtacaacttcacctcgttgaacagcccggagaatcatccggcgcggtccatgcaggacactttttacgtcgacggcaaagatgccgacggccgccagctgctgctgcgcacgcacaccagcccgatgcaggttcgctacgcgcgcaccaacacgccgcccatcaaggtgatcgtgccgggccgcacgtaccgtgtggacagcgacgcaactcactcgcccatgttcaaccaggtcgaaggcctgtggatcgacgagaacatcagcttcgcggacctgaagggcgtctacaccgacttcctcgagaaattcttcgagcgcgacgatattcaggtgcgcttccgtccgtcgtactttccgttcaccgaaccgtcggcggagatcgacatgttgttcgaaacgggcaagaacgccggcaagtggctcgaaatttcgggctcgggccaggttcaccccacggtgatccgcaatatgggcctcgacccggagcgttacatcggctttgctttcggcagtggcctcgagcggctcaccatgttgcgttacggcgtgcaggacctgcgtctgttcttcgaaaacgacctgcgtttcctgcgtcaattc

SEQ ID NO: 28235 - DNA, 1119 bp, Burkholderia fungorum
acgccgttcttcgcctacgaccgctctgcgattgacatccgcgtgcgggaactacgcaacctgctgcccgccggcatgcatcttcactactcgatcaaggcgaacccgatgcccgccgtgatccaccacctcgcccaacgggtcgacgggttcgatgttgcctccgcacaggagatggcgctggcgctcgatgccggcaccgctccggacgcaatcgggttcgccgggccgggcaagtctcacgacgacctgcgccgcgcagtggccagcggcatcaatgttcacgtcgagtcggaaacccagttgcggcttgtcaccgcccttgggtgggagctgggcgtgcagcccagcgtggcgatccgcgtcaatccggattttcaggttggacacagcggcatgcgcatgggcggcggtgccgcaccgttcggcgtggatgtcgaccaggtcccggcactgctgcgcgaactcgaagcgcgggaagtcgccctcgctggctttcacgtcttctggggctcgcagtgcctgcatgcggcaaccatcatcaaagcccagcgccagagtgctgatctcatccttcgactcgccagcggggtgccgcggccgctgcggttcgtgaatctcggcggcggctttggcatcccctactttccgggcgaaaccccgctcgatgtaaaggcggtctgcgaggcgatgcaggactggctgccgccgctttgcgaacgtctgcccggaacgacgccgatcctcgaactcggccgttacctcgtgggcgaggccggtatctacgtgtgccgtgtcatcgaccggaaagtgtcgcgcggcaggacgttcgtcgtcaccgacggcggactgcatcatcacctggcggcctccggcaacttcggccaggtcctgcgccgcaactttccggtcgtgatcggcaaccgccccgacggcgtgccacgcgagcggtgtcatgtggtcgggtgcctctgcacgccactcgatcgtcttgcggacgaggttgaacttcccgaagcgcacatcggggatttcgtggtgattatgcaatcgggtgcctatggccgttcggcgagtcctgtgcgttttctcagccacccggaacccgtcgaaatgctc

SEQ ID NO: 28236 - DNA, 1747 bp, Burkholderia fungorum
gacccgttcatcaatttccacaccgcgccacgcggggaaccgggctcgcactccctgctgttttccagcggacttgccggctgctttggcgcgatggtgatccgccactgatcccgaacctgatcgctatccagccatgagaaacctcattgatctcatccagtcggcggcgcgccgcacacccgatgcggaatcgctcgtctgcggcgatgtccgcctcacctaccgccaactgctgcaaagcagccgtgcgttcggacaggtattgtcttccctcggtgtggctccgggcggacgcgtcgccatctttctcgacaagcgaatggagactgtcgtgtcgatgctcggcgcctgtgctgcaggatgcgttttcgttccggttaatccgctcctgaaaccggaacaggtggcccacgtgcttcgcgacagcggcgcccggtgcctcgtgaccaccgcattgcgtgtccgcgccctggccgcggagggcgttgcgccggtaaccgacctgatcctcgtagacgaaccggaccaggttactcctgatcagccgaccgcggtcagggttcaccgctggccagactgcatctccagccccgacgacgcgctggtgccggccccggccgtaacatgcattgacaccgaccttgccgccctcctctatacatccggctcgacgggattggccaagggcgtgatgctcagccaccggaacctgctcgaaggcgcctggagcgtcgccgagtatcttcggcttgatccgtctgaccgagtccttgccgtcctgcccctgagcttcgatgcgggcctcagccagctaacctcggcgtggtcggcaggcgccacagcagtgctgctgaactatctcacggctcatgatgctgtcctcgcgtgcgagcgcgaacatatcactgcgatcacgggtgtcccgccattgtggatgcaactcaccggcgcaacctggtcagacgcggcgcgcaatactttgcgctacttcgcgaacacgggagggcgtcttccgctgcctgttctgcagaagctgagggcgctgtttccgcacgctacgcccttcctgatgtacgggctgaccgaggcgttccgctccaccttcctcgaccctgccgaggttgaccgtcgacccgactcgatcggcaaggccgtgcccaatgcgcgggtactcgtcgttcgcgaggatggcacaccgtgcaacccggacgaagccggcgaactggtgcatgtcggcgcatgcgtcaccctcggctactggaacgacgccgtgcgcaccgcgcaacgctaccgcccttcgcccgaggcgaaacccggtggcgcgccgcgtgacatggcggtgtggtccggggacctcgtgcggtgcgacagcgaaggttttctctatttcatcgcccgcaacgacgcccagatcaagagctccggctaccggatcagcccggaagagatcgaggaaacagtccattcgagcggccttgtcgtggaagccgtcgcgctgggcgtcccggacgatgagctcggcgaagcggttgtgctgctcgtcgtcctcgccggtgattcagatatcgatgagctacgcaactggtgcacgcagcgcctgccgcgttacatggttcctcgccatatcgccagttatccggatattccacgcaacgccaacggtaaattcgacagggcggccctgcgtagcacggttgcgtcgtccggcctcgcctcactcaaacgcggcccagaggagaaagca

SEQ ID NO: 28237 - DNA, 903 bp, Burkholderia fungorum
gacgcaagcctcgcgctggcgctgccgggcccggggctcgccatgccgcctgtcgttgcgctcgcctcgacgcagcagcaggcccggttcttccagcggttccagtcgggcgcgccgctctggggcgctttcgccatcaccgagccggactacggttccgacgcgactgccatgcgtacccgtgcacgaaagacgggtcgcggctgggtcctgaatggcaccaagtgctttatcacgaacggcgcgcgcgccgactgcgtgatcacgtttgcaacgatcaattcgcagatgggtcggtacgggatccgcgcattcctggtggattgcaatacaccgggattcacggtgtcgcgcatcgaacgcatggctggcctgcgcgcgacccaactcgccgcgctgtcctacgccgactgcgagctcaccgatgatgcgctgcttgcccgcggcgacgaaaagcccctcgatgacgctttctcgggtgcgcagcggtcctgggattatttcaggccactgctttccgccgtcatggtcggcgcttgccggcgggtccgtgcggaccttgtggcctggctcgatgccggcggcacgcccgcggacaggcatcgcagcgtagcgagcgtggaagcgtccctgctcgacatcgaccgccagattgcggccgcatggctgctgtgccattgcacggcctggaaagcagatcgcggcgccgcaacgtcaatggattcatccatgacaaaggcgtttgcctcgcgcatggccgcgcgggtgacgcgcgctgcgatggacctcgccggcatcgacggcatcactgcctttccatcacttgaacaagcctaccgggacgccaaagcgttcgacatcatggaaggtaccggcgacctgcagcggcttatgattgcgcgg

SEQ ID NO: 28238 - DNA, 1263 bp, Burkholderia fungorum
aacgaagcactgttgcagcgaaaaaataatgcgactccccgcggagtcggcgtgatgtgtccgttttacgccgatacggcgctgaacgcagagctctgggacgtcgaggggcgccgctatattgactttgccgcgggcatcgccgtgctcaatacgggtcatcgtcaccccaaggtcatggctgccgtgcgcgaacagcttgaccgctttactcacacctgctggcaggtcgtaccctacccgtcgtacgtcgaactcgccgaacaactgaaccggcttgcaccgggcgattttcagaaaaaggcgtcgcttttcagcacaggtgccgaagcagtcgaaaacgccatcaagattgcgcgagcgttcaccggccgagctgcggtgatcgccttcagcggcagctttcacgggcgcaccatgatgggcatggcgctgaccggcaaggttgccccgtacaaagtcggcttcggcccgttccccggcgaggtctaccacgcgccttacccgaacacgctgcatggggtcaccacgaccaatgcgctcgattcggtgcgggcgctgttcaaaaccgacgtcgatccgctgcgcgtggcggcgatcatattcgaacctgtgcagggagaaggcggcttctacgaagctccggccgacttcgtcaaagggcttcgggacatctgtgaccagcacggcattctgttgatcgccgacgaggtgcagaccggctttgcccgcaccggcaagctgttcgccatgcagcaccatgcggtcgccgcggatctcacgaccgtcgccaaaagtctggcgggcgggctccccttgtccggcgtgatcggccgtgccgatgtcatggatgcggcggcgcccggtggtctcggcggtacctatgcgggcaacccactttccgtggccgccgcgcttgccgtgctcgacgtgatcgaaagcgagaatctgtgcgagcgggccacgcaactcgggaaccggctgaaaagccacctgacgtcgatgcgcgaaagtcttccgcacatcgcggaaatccgcggaccgggggccatgattgcagcggaatttttcgaacccggcacgctcatccccgatgcggacttcgcaaagcgattccaggcgcgagcgctggagctcggcttgattctgctggtgtgcggtgtccattcgaatgtgattcgtttcctgtttccgctcacgatcgaggaagcggttttcgaagaagcgctggtgctgatagaaacggcgatgaaagacgctgcg

SEQ ID NO: 28239 - DNA, 1434 bp, Burkholderia fungorum
ttgcaggagccgtccctctttcgtcaggaatgctacattgccggcgaatggattgaatccgatccgatggcccggatcgacgtcgtcaatccggccaacggcttgaagatcggtacagtgccgcgcgccacgcttgccgatgtgcgaacctgcatcgacgccgccgaacgcgcgctgcccgcgtggtccggaaagacgggcaaggaacgcgcagcgatcctgcggcgctggtacgaactgatgctgcaacatcaggaagaccttgcggtcatcatgacctgcgagcagggcaagcctttagccgaaagccgcggcgaaatcgtgtacgcggcgtcgttcctggaatggttcgccgaggaagcgaagcgtgtgtacggcgatacgatcccgacgccggcatccgaccggcgcattgtcgtgctgaaacagccaatcggtgtgtgcgccgccattacgccgtggaatttccccgcagccatgctcacgcggaagatcggccccgcactcgccgccggttgcacgatggtcctcaagcccgcgagccagactcccttctccgcgctggcgctgtgcgtgctggccgagcgtgccggcgtgcccgctggtgtgctgtcctgtgtgacaggaaaggcctcgatgatcggcgacgagttctgccggaacccggcagtgcgcaagctctccttcaccggctcgaccgaaataggcaagctgctgcttcagcaatgcgccagcacggtgaaaaaaacgtccatggaactgggcggcaatgcgcccttcatcgtattcgacgatgccgatctcgacgcagccgtcgtaggcgccatcgcggccaagttccgcaatgccgggcaaacctgcgtctgcgtgaaccgctttcttgttcaggacactgtccacgatgctttcgtcgagaagctgtccacggcgatcgcggcgctgaaggtgggagacggcctcgatgccggcacacggatcggtccgctcatcgacagcaaagcggttgagaaggcgcgcgagcacgtcgatgacgccatcgcaaggggcgcaacggtggtgacgggaggctcgggtcacgcgctcggaggcaattattttgaacccacgttgctaaccggcgcttcgaaggacatgaagatcttccgcgaagagaccttcggccccgtggcgcccgtgttccgcttcagaaccgaggaagaagcgatccagctcgccaacgataccgagttcggtctcgcctcctatttctacggacgcgacatcggcagagtgtggcgcgtggccgaggcgctcgaatacggcatggtcggcatcaacgaagggctgatctccacagaagtagcgccctttggcggcgtaaaggaaagcggtcttgggcgggaaggttcaaagtacggcattgaagactatctggaagtcaaatatctctgtatg

SEQ ID NO: 28240 - DNA, 1449 bp, Burkholderia fungorum
caagtcgaagttttctcgatgtatatcgacggcgagttcgtacaggccgaaggcggccgcacgctcgacagcatcaacccctggagcgggagcgtctgggcgaaggttcccgatgcgacggctgccgacgtcaatcgcgcggtcgaagccgcgcaccgcgcgttcacgagcggtccgtggccgaagatgacgccgaccgagcgcgcggtactgctgcaaaagctcgccgacaagctcgtcgaacacaaggaacgcctcggctacgtcgaaacgcaggacaccggcaagctgctgaaggagaccacctggcaggccggacacacggcccgcgcgtacacgtatttcgcggggctggccgataagctgcaaggcgatattccaccgtcgggcgccagcatgctgaatctggtcctgcacgaaccggtcggcgtcgtggcagctatcattccgtggaattcacaactgcaactgtcggcctacaagattgcgccggcactcgccacgggcaatacgatcgtcgtcaaagcgtccgaagacgcatctacaccgctgctcacgcttgcaaagctcgttcacgaagtgggcttcccgccgggcgtcatcaacttcgtatcgggcggcgccaatccgtgcgcgatcacgctgacgagccaccctctcgtccggcgcatcgcctttacgggcggcgcagatactgcgcggcgcctcatccccaactcggcgcacaacatcgcgaagctgtcgctcgaactcggcggcaagtcgccggtcatcgtgttcgacgacgcggatctcgacagttgtgtgaacggtatcgtggcgggcattttcggcgccagcggacagagttgtgcggcgggctcgcgtctgcttgcacacgaatcgattcacgacgttctcgttgaacggcttgtcgagcgttgcaaaacgatccgcgttggtgatccgtttgatgcggccaccaacatggggccgcttgccaccgcacgccaggtggaccggatcgagacgctgctggccagctcggtggaacagggtgcgcgtgttgtcagcggcggaaagcgtattggcgggttaccgttcaaccaatgcttcgagcccactattgcattgtgtgatcgtagcgactatccgatcgtgcaggaagaactgttcggccccgtgttgagcgtgctcaaattccgcgacgacgacgaagcggtcgccctcgccaacgacagcaagtacgcattcgccggcggcattttcagccgcgactttgcccgcgccatgcgcacggcgcgcgtggtcaacgcggggcgtctctggatcaacacgtaccgcgttaccggcgtcaacgttcctttcggcggattcaagcaaagcggctacggacgcgaagcaggtatcgatgcgctcaaggactacactgagacgaaggccgtcatgatcgaggtcggcggcgaagcc

SEQ ID NO: 28241 - DNA, 1668 bp, Burkholderia fungorum
tacgactacgtcgtcgtaggcgcaggctccgcgggctgcgccgtggccgcgcgactggcggaggacctgtcggtcacggtcgctctgctcgaagcgggcccgcatgaccaccacatgagcgtatgggtgccgataggtctggcatcgaccgtgcaaaaagccggtccacgcaactatgcgtactacacggaacgccagcccggccttgacggacgcccttcctttcagccacgcggacgcggcctgggcggcagctcgtcgatcaacggcatggtctacattcgcggacatcgcaacgattacgacgaatgggccggcatgggttgtacgggttggggcttcgatgacgtactgccctacttccgccgcagcgaatgcaaccagcgccacgccggacgcaccgacgacccgtggcacggcggcgacggcccgctgcatgtcagcgacctgcgttcgcccaacccgttctctcatcgtttcgtgaacgccgccctgcaagccggattgccgctgaatacggacttcaacggcgcggagcaggaaggcgccggcctttatcaggtcacgcaattcaacggcgaacgctggaatgccgcgcgtgcctacctgcacaacggcaatgcgaaagatgcgaacctgaacggcggccgcccgaacctcgatgttcttccggacacccaggtactgcgcctcgtcgtcgaggacaaacgcgcgcgcggcgtgcgcgtggtgcgtgcaggcatcgagcagacagtgcgggcccggcgcgaagtcgtgctcagttgcggcgccttcaattcgccgcaactgctgatggcttcgggcatcggtccggccgggcatctgcgcagccacggtatcgaggtcatacaggacctgcccggagtgggcgaaaatctgcaggatcacctcgacgtgatcgtcaacaaacaggtcaagtccaacgacctctacggctactcggcgggcggctttctgcggctcgcatccggcatatggcgttaccggcgcgatcgcagcggcatggtcagttccaacttcgcggaggcgggcgcctttgtgaagacccgccccgacctggccgtcccggacgtgcagctcgccttcgttctcgctctgctcggcaatcgcactgtggcgaaacgtagcaagctcgggcacggctactcctgccatgcttatattctgcgtccgcaaagccgcggtcatgtgcgtctgcgtagcgcggacatgcgcgacgcaccgtcgatcgatccgcgctttctgtcagcagaggccgacatggacgcgctggtcgccggcgtcagaatcgttcgccgtatctttgcgcagccggcgctggccgaagcgggcggacaggaactgctgacggacgacttcggaccggacgattcgaacgaagaggcgatccgggcgttcgtgcgcagtcgcgccgacagcgtttttcatccggtcggcacatgcaagatgggcatcgactcaatggccgtggtcgacccgagcctgcgcgtgcgcggcatcgaaggtctgcgcgtggccgacgcgtcgatcatgccgacgctgatcggcggcaacacgaatgcgcccgccatcatgatcggcgagaaagccgccgatctgatccgcgccgacaaccggtagcgtgccgctccgcgcgctgaacctgcc

SEQ ID NO: 28242 - DNA, 1347 bp, Burkholderia fungorum
ttctacatcggcggccattgggtcgagccgtccgccggcagcacgcagacggatatcgtcaatccggccaccgagacgctgaccggccacctcgcaatgggaaccgcgcaagacgcggatcgtgccatcgccgcggcgcgagccgcctttccggcgtggtcggaatcgagccgcgccgagcgggtcgcgctgctcgagcggatcatagaatgctatcgcgcgcggctcgacgacatcgccgaggcggtccgcatcgagatcggcgcacccatcacgctgtgcaagcatctgcaggccgcaatcggcctctcgcagctcgaagccgcactggaaacgctgcgccatttcgagttcgagactcgtcacgacaagagctatgtgcgccgcgaagcggtcggtgtcgcggcactgatcacgccgtggaactggccgttgaatcagatcgccgccaaagtcgcgccggccctcgctgccggttgcaccatcgtgctgaagccgtccgaaatcgctccgctggacgccgtcatcttcgcggaaatcatgcacgcggcgggcacgccgccgggtgtattcaacatgattttcggcgaaggacgggtggtcggcgcgcggctgtcgtcgcatcccggcgtcgatatggtatcgatcaccggctcgacacgcgccggcgtcgaagtggccgtgagcgccgcgcccacggtcaagcgtgtagcgcaggaactcggcggcaagtcacccctgctgattctcgacgacgccgatctgcagcaggcagtgacgagcggcgtgatgcagtgcatggcgaattccggccagacctgtgtcgcgccaacccgcatgctggtgccgcgcgagcgatacgacgacgccattgcgattgccgcggcggtagccaacgggattgtcgtcggcgatccggcggacccggccaccaggatgggcccgatctcgaaccgcgcgcaatacgagaaggtgcagcacatgatccgggccggtatcgaggaaggcgcccgcgtgattgccggcggtcccggcaggccggaaggattggcacagggcttctacgcgcgccccaccgtgttcgcggatgtccgcaacgacatgatgatcgcacgcgaggaaattttcgggccggtgctggtgatgattccgtacgacggcgaggaacacgccattacgatcgccaacgacacgcaatacggtcttgccggttatatcgccacccgtgaccccgaacgcgcacgccgcgtggctgcgcgcctgcgtgtgggatcggtgcggatcaacggcgcgatgctggacattacggttccatttggtggctacaagacatccggtaacgggcgg

SEQ ID NO: 28243 - DNA, 1125 bp, Burkholderia fungorum
cgtaccgtttttcgtgacgatcatgaaatgctgcgcaccacggtgcgtcgcttcctggagcgcgaatgcacgcccaaacaggccgagtgggacaaggccggccgtgtggaccgcgaaacgtggctgaaggcgggccgcgagggtttgctgtgcctcacgctgccgactgaatacggcggcggtggcggcgacttcggccacgcggcgatcctcaacgaggaagtcaatcgcgccggtctgagcggcctgggctttggcgtgcattccgacgtcatcgctccgtatatcgctcgcatcggcaatgaggaacagaagcagaaatggctgccgaaaacctgcaccggcgaatccattctcgcgatcggcatgaccgagcccggcaccggcagcgacctgaaggcgatacgcaccaccgccttgcgcgacggcgacgagtacgtgatcaacggcagcaagaccttcatcagcaacggcctgaacgccgacctgatcatcctggtctgcaagaccgatcccagcgcgggctccaagggcgtcagcctgatcgtcgtcgaggcgacccgcgagggattccgccgcggccgcaagctcgacaaggtcggcatgcactcgcaggacaccgccgagctgttcttcgacaacgtgcgcgttcccgtgagcaatcgtctcggtgaagagggcaaaggcttcgcctatctgatgggcgaattgccgcaggaacggctctcgattgccatcggcgcggctgcaaaactcgaagcctgcctcgagcacacgatcaactacgtcaaggaccgcagagccttcaatcagaccgtgtgggacttccagaacacgaagttcaagctggccgacatcaaggcgcaggcgaccgccgtgcgcgtgctggtcgaccactacctcgccgagcacgtgcgccggcgtctgactctggaagaagcggcgatcgccaagctgttcgcgaccgaatcgctcggcaaggcgctcgacgacatggtgcagctgcacggcggctacggctacatgctggagtaccccgtggcccgcgcgttcgccgatgcgcgcgtcaaccgtatctatggcggcacgagcgaggtcatgcgcgacctcatctcccgcaagctg

SEQ ID NO: 28244 - DNA, 1197 bp, Burkholderia fungorum
tccatttcaaggagcagtgatatgactcgtaacgtgttcgtcgccggcgtcggcatgattccgttcaagaagcccggcaccagcgacccctacgacgtgatgggcgcgggtgccgtgcgcgaagcactgatcgatgccggaatcgattacgcggacgtgcagcaggcctacgccggctatgtctacggcgattcgacctgcggtcagaaagcgctttaccacgtcggcatgaccggcattccgatcatcaacgtgaacaacaactgcgcgacgggttcgtcagccttgttccttgcgcgccaggctgtgcaaagcggcgcggtcgattgcgcactcgcggtcggtttcgaattcatgcagccgggcgcgctctcgtcgaagtggagcgatcgtgcaccggcgctcgaacgcgcgctgagtgtggtcaacgaactggtggatcgcaccgatctgccgagcgcgattcgccagttcagcggcgccggccgggctcacatggaaaagtacggcacgaagctcgaaacgttcgcgaagattcgcgcgaaggcgagccagcatgccgcgcgcaatccgctcgccgtgttccgcacggtcgtgacgccggaagaagtgctcgcatcgccgatgatctgggaaggcgtgctcacgcgtttgatggcctgcccgcccacctgcggcgcagccgcggccatcgtggtgtcggaggaattcgcccgcaagcgcggcctgcgcaccgatgtgctgatcgccgcccagtccctcaccaccgacctgcccagcacgtacgactcacgcgacatgatccgcgtagtcggcttcgacatgacgcgcgccggcgcgaagctcgcttatgagcaggccggcgtcggtccggaagacatcgacgtgatcgaactgcacgactgcttcgcgcagaacgaactgctgacctatgaaggtctgggtctgtgcgcagaaggcgaagcggaaaaactcgtcaacgacggcgacaacacgtatggcggcaagtgggtggtcaacccgtcgggcggtttgctgtcgaaggggcatccgttgggcgcgaccggtctcgcgcagtgctacgagctgacgcatcaactgcgcggcactgccgatcaacgccaggtggaaggcgcgaaggtcgcacttgcgcacaacctggggctcggcggagcgtgcgtcacgaccgtgtacaag

SEQ ID NO: 28245 - DNA, 878 bp, Burkholderia fungorum
cctcggcgacgccgtgatcgccttgtaatccgcatcaatcaaggagacaggaaatgggaaagcttgacggtaaagtagcgctcgtcacgggttcgggtcgcggcattggccgcgcgatcgccgagaagctggcgagcgaaggcgcacgtctcgtgatcaacgacctcgacgccgacccggcgcacgaaacggtcgaagcattgaagaagatgggcgcggaagccgtggcttgcgtcggcaacgtaggtgcgccggacttcgccgaccgcttcatcaatacggcgatgagcacgtacaagggcatcgacatcatcgtcaacaatgcgggttacacgtgggacgacgtgatccagaagatgaccgacgaacagtggtacgcgatcatcgactgccacatgaccgcgccgttccgcattctgcgcgccgcctatccgcatgtgaaagccctgcacgcggctgacaaggaagccggccgcgacgtgtatcgcaagatcgtcaacatctcgtcgacgtccgcgctcaacggcaacgcgggacagatgaactactcgtcggccaaagccggcgtgatcggcatgacgcgcgcgttgagccgcgagtgggggcgcttcaacgtcaacgtcaattgcgtggcattcggtctgatccacacccgcatgacgacggccgacgcgcatgcaggcgcgaccgtgaaaatcgaaggacgcgatatccgcgtgggccttaatcccgagctgctcaagacgcacgcgcagcgcaatccgctgggtcgcggcggcacgcctgaagaagcggccggcggcgtctacctgttctgctcgcccgagtcgaactacatcaccggccagaccatcgcggtcgcgggcaatctgcagtaa

SEQ ID NO: 28246 - DNA, 1502 bp, Burkholderia fungorum
ctgcatcgctcgctgcagcagaatccggaccgggtggcgatttcgttcaaagggcgcacgcggactttccgcgaattcgcggatcgggtcgcgcgtctggctgccgcattgcgcgagatcggcatgaccgcggatgaccgggtcggcatgctcgcgctcaattcggaccgctacctcgaatacgtaatgggcgtgtggtggggcggcggcgtgctgaacccggtcaatatccggtggagcgcggcggagatcgcctattcgctcgacgattgcgacacgcgcatcctgatcgtggacgaccacttcgccgacatcgcgcgagaggtttgcgcgctggcgcggaccgcgccgcttctgattcacgccggcgacggcgcggcgccgaccggcatgctctcgttcgacacgttgatcgcggccgcggcgccgatgccggacgccggccgtggtggcgcggatctcgcgtgcatcatgtacaccggcggcacgaccggctttccgaagggcgtcatgcagacgcacctgaacatctggtcatcgtgcatcatgcggattgccgagtccgcgccattgcccgacaccgcggtgctgcatgcggcgccgttcttccatgtggcaggactcggccgagcgctcgtgcagttcattgccggcgaggcgcatgtcgtcattccggctttcgatgcgggcgccgtgctcaaggcgatcggcgaagagcgcgtgagcgatacgctgctcgtgccgaccatgatccaggcggtgctcaatcatcctgactttgcccgcaccgatctgacgagcctgaagcgcctcacctacggcgcgtcgccgatccccgaaacgctgctggaccggctgatcgaagccctgcccggcatccagctcgcgcattcatatggaatgaccgaggcgtgtccgagcatttcggcgaactcgccttccaatcacgacgaagcgggccgcaggagcggcctgtaccgctcgatcggtcgcggcttgccgggcctgatggtgaaggtggtcgacagcgacggcgccgaagtgccgcgcggcacggtcggcgagatcgtcgtgcgtgggccgaacgtcatggccggctactggaagaagcccgaagaaaccgcgcaggccgttcgcgacggctggctgcataccggcgacggcgcttacatggacgctcagggttatctctacatcgtggaccgcatcaaggacatgatcgtgagcggtggcgagaatgtttactccgccgagtggagagtgtgatcgcgcgacaccccgcggtcgccgcgtgcgcggtcatcggcattccgcacgacacgtggggcgaggccgtgcatgccgtggtggtgtgcaagcctggcgcgacactcgcggaagaagagattcgcgagcattgccgccaggtcattgccggctacaagtgcccgaagtcggtcgagttccgcgtgcaactgccgttgtcgggcgcgggcaaggtgttgaagcgcgaaatccgcgcg

SEQ ID NO: 28247 - DNA, 1488 bp, Burkholderia fungorum
ccggacaaggccgccgcgatcaacagcacgagcggcgaggtcctgacctatcgcgaactcgacgagcgttcgaatcgcttcgcacaatgtctgtacgcggcggggttgcggcgcggcgaccatatcgcgatggtgctcgagaacaacatgcgctgcttcgaggtgtgttgggcggcgctgcgttcgggtctgatgatcacgccggtcaaccggtatctgaccgcggcggaagcggccgccattatcgaggacagccatgcgcaagtggtggtcagttcgtacgccatgcgcgaactcgcggccggactgaccggcatgatgccgacatgccgcctgcggctgatggtcgacggcaccatttccggctgggacagctacgaggcgctcacgggccggtatcccgcaacgcgtctggcggacgaatggctgggcgccatgatgatctatagctcgggcacgaccggccgtccaaagggcatcattcgcgcgcagccgcaaggccgggtgaccgaaggttccggttccgcgcgccgcccgcagttcgagcgctatggcttcgacgcgcaaacggtgtatctgtcgccggcgccgctctatcacaccgcgccgctcggctacggaatcgaaacgcagttcggcggcggcaccgtggtcttcatggagaagttcgagccgctcgaggcgttgcaggcgatcgagcgctatcgcgtcacgcacagccagtgggtgccgaccatgctgatccgcctgctcaagctcggccccgctgtgcgcaacgcgttcgacctgtcgagccatcgcgtggcgatccatgcggccgcgccgtgtccgcaggaggtcaagcggcagatgatcgactggtgggggccgatcatcgaggagtattactcgtcgaccgaaggcaacggcgtgaccacgctcaacaccgaggagtggctggcgcacccgggctccgttggccgcgcgctgctgggcgtcattcatatctgcgacgacgacggcaacgagctgccggtgggcgaaaccggaaccgtctatttcgagcgcgaccagttgccgttccgctaccacaacgatccggacaagacccgtgccgcgcagcatccgcgccatccggcctggacggccgtcggcgacatagggcatgtggatgcagatggctacctgtatctgaccgaccgcaaggcgttcatgatcatttcgggcggcgtcaacatctatccacaagcgatcgaagacgcgctggccgtgcatcccgatgtgcaggatgcggcggtgatcggcgtgcccgatgccgagatgggcgagcaggtcaaagcgattgtcgagccggcgcccggcgtggcgccgtcggacgcgctcgcggaacggctattggcttacctgcgcacgcgggtggcgcgctacatggtgccgcgctccatcgacttcatcgacgcgatgccgcggctgcccaccggcaagctgtacaaacgggcactgcgtgag

SEQ ID NO: 28248 - DNA, 846 bp, Burkholderia fungorum
cgcgttgttgtcatcaccggcgccggacgaggcctggggcgggaatatgcgctggagttcgcccgtcagggcgcgaaagtcgtcgtcaacgaccttggcggcaaaggtgacgggtcgggcgcggcgagtggccccgcgctcgacgtggtcgccgaaatcgaagcgctcggcggcgaagccgtcgccaacttcgacgacgtggccgactggaatggcgcaaagaacatgatcgacacggccatttccgcgttcggcggactcgacgtgctggtcaacaacgccggcattctgcgcgaccgcacgctcgccaacatgagcgaagaagactgggactcggtgattcgcgtgcacatgcgcggcacctttgcgccgtcgcgccacgcggccgcctactggcgcgatgaggccaaggcgggccgcgagcgggtggcgcggctcatcaacaccagttcgtcgtcgggtctctactgcaacccgggccaggccaactacggcgcggcgaaggcgggcattgcggccatgtcggtgattgccgctcgtgaactggagcgctatggtgtaaccgtgaatgcgatctatccgaccgcgatgagccgtctgaccgaagacatcttcgcgaagcggcgcgacgaattcaccgcgggcgccgcacccggcttcgatccgctggacgcgggcaacgtcgcacccctcgtggcatggcttggcagcagcgcgtcgagcggtatcaccgggcgtgtattcggtgtgcgcggcggtcgtattacggtggccgaaggctggcatgcgggcccgcgcatcgaaaaagacgggcgttgggacgtggcggaactcggcgcgctgata

SEQ ID NO: 28249 - DNA, 1167 bp, Burkholderia fungorum
aaagtactggtggcgggcgtgggcatgatccagttcgccaagcccggcgcgagccagagctacaccgaaatgggcgccgaagcgacccgccgtgcgctggccgatgcaggcattgcgtacgacctcgttcagcaggccttcgcaggctacgtctacggggactccacgtgcgggcagaccgcgatctacgaagtgggcatgacgggcattccgatcgtcaacgtcaataacaattgctcgacgggttcgaccgcgctctatctggcacgccaggcgattgccaccggcgacgccgactgcgtgctcgcgctcggcttcgagcagatgcaggccggcgcattgaaatcgcactgggacgaccggccggtaacgcgtgcgcgcttcgtaccgatcatgcacggcctgaccgccgacctcgcgcatctgccgcaggcgctgcgcacgttcggcggcgcggggcgcgaacacatgcagcgctacggcacgcgcatggaaacctttgccgcggtgcgggccaaggcgagccgccacgcggcgaacaatccgctggcgctgttccgcaaacaggtcacgaccgaagacgtgatgaacgacacggtgctgatgcccggcgtgatgacgcgtctgatggcctgtccgccgacttgcggcggcgcggcggcgatcctcgtctccgagaagttcgcgaagaaacacggcttgcgcacgggtgtgcagatcgttgcacagtcgctcaccacggatccgccggcttcattcgacccgccgtcgatgctcaactacgtcggcacgcacatgacgcgttcggccgcgaacaaggtctacgaaaaagccggtatcggaccggaagacatcgacgtatgcgagctgcacgactgttttgcgcacaacgaagtcatctgctacgaatcgctcggcttctgtccggaaggtggcgccgagaagttcgtcagcgacggtgacaacacgtacggcggcaaggtggtggtcaatccgtcgggcggtctgctttccaaggggcatccgttgggcgcgaccggccttgcgcagtgctatgagctgacccaccagttgcgcggcaccgccgaccagcgtcaggtgcaaggcgcgaagctggcgcttcagcacaatctcggccttggcggcgcgtgcgtggtgacgttgtac

SEQ ID NO: 28250 - DNA, 1251 bp, Burkholderia fungorum
ctctacgggggtaggcttgctccccatccccgccacgcacaatgcgttcatggaagcagccggccgataacccggtccgcgctgccaacgcattcaatcgatgaggagcgtgcggtggaagtcaaacgtaatgtctatcgcgaggatcacgagatgctgcgtgaaaccgcgcggcgtttcttcgaacgggagtgcctgccgcgtcaggcgcagtgggacgaggccggctgcgtcgatcgcgagacctggctgaaggccgggcgggaaggtttgctgtgcgtgaccgtgccggaagaatacggcggtggcggcggcgatttcggccattcggcgatcgtcgcggaagagttgcaccgtgcgggcgtgtcgggtttcagctattccgtgcactccgatatcaccgcgccgtacatcgttcgtctcggcaccgaagagcagaaacgcaactggctgccgcccatttgccgcggcgaaaagatcctcgcgatcgcgatgaccgaacccggcacgggctctgatctgaagtcgatccgtactaccgcggtgcgcgacggcgacgactacgtcatcaacggcagcaagactttcatctccaacggcctgaattgcgacatggtggtggtggtctgcaagaccgacccgtcggcgggtgcgaaaggcgtgagcctcatcatggtcgaaaccgaccgcgcgggttttcgccgtggccgcaagctagagaaagtcgggcaggccgcggccgataccgccgaacttttcttcgacaacgtgcgcgtgccggccaccaacctgatcggcaacgagaacggcggcttcatccacctgatggaagaactgccgcaggagcgcctgatcatcgcggtgtattgcgccgcgaagctggagcggcagctcgaactgacgctgcaatacgtaaaggaccgccgcgcgttcaatcagaccgtgtgggacttccagaacaccaaattcaaactcgcggacgtaaaggcgcaagccgttgcggtccgcacgctggtcgactactacattcgcgagcatatggagcgcaagctcacgctgcaggaagcggccattgccaagctgttcgcgaccgaagcgatgtggaagtgcatcgacgaaatggttcagctgcatggcggttacggctacatgctggagtatccgattgcccgtgcttttgccgacatgcgcgtcacgcgcattttcggcgggaccagtgaagtcctgcgggatctgatctcgcgcaagctt

SEQ ID NO: 28251 - DNA, 2106 bp, Burkholderia fungorum
gattgcggcgcggcgtgccttgcgatgatatgccgccactacagcattccgatgacgctcggcaaattgcgcgaactcgccaacgtcaccactcagggcgccacgctcgacagtctcgcgcgagcgggtgaatcgctcggcttcacggcgcgcggcgtgcaatgcacgttcgattcgttgcgcggcttcgatctgccgttcatcgtgcactgggagggttaccactatgtggtggtatacgggctctccaaagattatgtgtgggtggcggacccggcggtcggcttcaggaagatgaccgtcgaagatttcgaacgcggctggagcggcacctgtctgctgtttaccggcgggccgaatctgctgcaaatgtctgccgcgcgttcaccgtggattcgttttgtcggctacctcacgccgtacaagaagattctcggccacctgtttctcgccaccttcgtgattcaggtattgggcgtgattccgccgctgattatccagaacattctggacggcgtgatcgtgcatcagaatgtcagcctgctgcatctgctgattggcggcttgattattgccaatgtcttttcgcaattgatgtcgtcgattcgcgcctatctggccaatttcatggtgcgcaatatggacttcgcgatgatgtcgcagttcttcaagcacaccctgtcgctgccattctcgttctttgccaagcgcaagaccggcgacattttcgcgcgcttccaggagaatcagacgatccgcgctttcctgaccgaatccaccgtcaccacggcgctgaacctgctgatggtgttcatctacttcacgatcatgttcgtctacaacgtgaagatgacactggtgctgattgcgttcatcattccgatcatggcgctgaccgcgatcgccacgccgaagatcaagggctatgcgcgcgaagtgttcaccgcgtcgaccgaatcgaagtcgtttctgatggaagccctcgccggcgtggagaccatcaagggcatgggtatcgaacggccggtgcgcttgcgttgggagaagaagtacgcaaaggcgctcgaagtgcaatatcgcgcgcatgcgttcaacattctcgtgggactcggcagtcagttgctgaatgcggcgacgacgattgcgattctctgggtcggcgcgaatctcgtgctggcgcgtgaaatgacgattggccaattgatcgcgttcaacgcattcatgggcagtgtactgggtccgttaatgggcctggtcggcttgtggagcatgctgaacgatgcgggcgtggcaatggaacgccttggcgatgtgctcgatatcgaacccgagcagaagccacaggatttgccctcgcgtgtgatgctgcccgaactccagggcgaaatcagtctgagcggcgtttatttccgttacggcgaaaacgactcggcctacgtgctcgaaaacatcagcttcgacatcaagccgggtgaactggtggcgatcgtggggcgcagcggttcgggcaagaccacgctcgccaagttgctggtcggcttctacacgccgaccgagggcaagatgacgatagacggctacgatctcggcgtggtcgataaagcctattatcgcgcgcagatcggctatgtgatgcagagcaacctgctgttttccggcacgattgccgagaatatcgcgagcggcgacgatgcgcccgatcggcgccgcatcgaggaagtggcgaagatggccgacgcgcacgcgttcatcagcaagatgccgcttggctacgagcagattgtcggcgagcgcggaatcggcttgtccggcgggcagatccaacggttgtgcattgcgcgggcgctgtatcacgatccgcgactactggtattcgacgaagcgacttcggcactggactcgcaatcggaaagcaatattctcggcaatatgcacgacattctgaaaggccgcacggcggtgatcattgcgcaccggctcagcacgatcatgcgtgcggacaagattctcgtgctgtacgaaggggcgattgtggaacagggccgtcacgaagagctgattcagcgcggcggcatgtattaccagctggtccagaaacagttgagt

SEQ ID NO: 28252 - DNA, 2012 bp, Burkholderia fungorum
cgcacgctgttcgacaagctgtgggacagccacacgattgcgaatctgccgggcggcgccgatctgttgcaggtggatcgcaatctgatgcatgagttgaccggcgtcgaagcggtacgtgtactcgaagcccgccatttgccggtcagcaaccccgagttgacgttcgcgacgctcgatcacgtgatctccacgcgccccggccgcgaggcgggggatgccgactggagcacgacaatggtcgacacgctgcgcgaacaggcggcgcagcacgccattcccctgttcgatattggcaccgaaggcaggcagggcattgtccacgtgatcggaccggagctcggtttgtcgctgccgggcacgctgatcgtctgcgccgacagccatacctgcactcacggggcattgggtgcgctcgcgttcggcatcggttcgaccgaactggtgcatgtgctggcgacgcaaaccgtacgccagaagaagcccaaaacgatgcgcatacggtttaaaggcagcgttgccgagggcgtcacggccaaggacatgatcctttacgtgatcggcgcgctcggcgccggcgcgggcaccggctacgcggtcgagttcgccggcgaggcggtcgaagcgctctcgatggaagcacgtttgacgctgtgcaatctgacgatcgaactcggcgccaagttcggcctcgtcgcgccggacgagacgacctttgcctatctgcgcggacgtccgtatgcaccgcaaggcgcgagcttcgaggcggcgctggaagactggcgccgcttgccgacggatgacggtgcgcacttcgagcgcgaagtggagatcgacgccgcggcgatcgcggtgcaggtcacctggggcacgagccccgaacacgtgatcgcgatcgacgctgccgtaccggacccgggcaacgagtccgatcccgcgcgccgtgaagcgttgcaacgggcgctcgattacatgggcgtgcatgcggggcagcatctggatgaactggcggtcgatcgcgtgttcatcggctcgtgcaccaacagccgcatcgaagacttgcaggcggccgcgcgcatcgtggcgggccaccatgtcgccgagggtgtgaccgcatgggtggtgccggggtcgctgagcgttgcgcgagaggcggaggcgcagggccttgcacagatattccgcacggccggcttcgaatggcgcgagcccggctgctcgatgtgcgtcggggcgaacggcgacgtggtggggcgtggcgagcgttgcgtatcgacatcgaatcggaacttcgtcggccgtcaggggccgggcgcgcgcacgcatctggcgagtccggccgtggctgcggccagtgcgctggctggtcacattgccgcgccggtgtcgtacgcgggagccgcatcatgaaagcgttcacgatggtcaaaggcccggccgcgtcgttaccgcgcaataacgtcgacacggacctgatcattcgcatcgaaaggatttcgcaacttgtgcgaggccagctcggcccgtggctgttcgagacgctgcgttatcgcgaaggcggtccggagcagggagaacgcgaagatttcgtgctcaaccagccggcattccggcacgcgtgcattctgctcggcggtgtgaacttcggttgcggcagttcgcgcgaaatggccgtgtgggcgctcgaagagttcggcatccgctgcgtgatcgcgccttcattcggcgacattttcttcgccaactgcctgcaaaacgggctgctgccgatctgtctcgacgctgcgtcgatcggaacactcgctgcggtcgccgctgacggcacgccgctcgaagtcgatctgcgcaccctgcaaatccgcgcggacggacttgaaccgatgccgttcgagttcgacgccgcgcgccgggcggttctgctcgaaggactcgacgaggtcgatcagacgttgcgtctggccgacgatatcgacgcgtttcgccgcacggaccgcgccaaacgcgcgtgggct

SEQ ID NO: 28253 - DNA, 669 bp, Burkholderia fungorum
ctcacggacgtcacccgaatctatcagggcagccagggcaagccgccgtttcacgcgctggggcccgtgagccttgaattgcgagtgggcgagttcttctcggtggtcggtccatccggctgcggcaagtccacgctgctcgacgtgctggccggcctgaacccggcgagcggcggcacggtgacgttcgaaggcaagccggtcggtgcggaagtgccggacggcgtggccgtcgtgtttcaggaagacgcgagtttcccgtggctcaatgtattcgacaacgcagcgtttgccgcacggcaggcaggcgtcgctgaaacggaagtgcgtgagcgggtcgatcatgcactgtcgttcatgggcctgaaatcgtttgcccgcgcatatccggcgcaactgtcgggcggtatgcggcaacgcgtttgcattgcccgcgcaatggtggtgcggccgcgcctgatgttgctcgacgagccgttcggcgcgctcgaccagcaaacgcgtcttctgatgggtgacgaaaccctgaagctgtggcgcgatacgggcgcgaccgtgctgctgatcacccattcgatcgacgaagccgtgttgctgtccgaccgcatcggcgtgatgtccgcgtgtcccggccgttttatcagaacgatcgaaaccgggtggccacgc

SEQ ID NO: 28254 - DNA, 774 bp, Burkholderia fungorum
atggcttacgagaatattctggttgagacgcgggggcgggtcgggttggtcactttgaatcgaccgaaggcgctgaacgcgctgaacgacgcattgatggacgaactgggcgcggcgctgcgcgagttcgatgccgacgacgcgatcggtgcgatcgtggtgaccggcagcgagaaagcgttcgcggccggtgcagacgtcggcatgatgtccacttatacctatatggatgtttataagggggactacatcacccgcaactgggaaacggtccgctccatccgcaagccgatcattgcggcggtggcgggctttgcgcttggcggcggctgcgaattggcgatgatgtgcgatattatttttgccgccgacacggcaaagttcggtcagccggaaatcaagctcggcatcatgccgggtgccggaggcacgcagcggttgccgcgcgccgtctccaaggcgaaggcaatggacctttgcctgaccgcgcgtttcatggatgccgccgaagccgagcgtgccggcctggtgtcgcgtgttattccggctgcttctctggttgacgaggcggtagccgcggctgccacgatcgcagaattcccgttgccggccgtgatgatggtgaaggaatcggttaatcgtgcttatgagacgacgctcgcggaaggtgtgcatttcgagcgccgcctgttccattcgctcttcgctaccgaagaccagaaggaaggcatggccgcgttcgtggagaagcgcaaaccggttttcaaacatcgt

SEQ ID NO: 28255 - DNA, 1200 bp, Burkholderia fungorum
atgaacgacgccttcatttgcgatgcgattcgcaccccaatcggccgctacggcggcgccctgaaggatgtccgcgccgacgacctcggcgcggtgccgatcagggcgttgatcgaccgcaatcccggcgtcgactggcgcgccctcgacgacgtgatctacggctgcgccaaccaggcgggcgaagacaaccgcaacgttgcgcgcatgtcggcattgctggccggcttgcccactgaggcaccgggcgccaccatcaaccgcctgtgcggctcgggtatggacgcggtcggcaccgcggcgcgcgccatcaaggcgggcgaagcgcgtctgatgatcgccggcggcgtcgaaagcatgacacgtgcgccgttcgtcatgggcaaggcgactggcgcgttctcccgccaggctgagatctacgacacgaccattggctggcgcttcatcaatccgctgatgaaacgccagtacggcgtcgattcgatgcctgaaaccgcggaaaacgtcgccgttgaattcagcgtgagccgcgcggatcaagacatgttcgcgctggcaagccagcaaaaggcggctcgcgcacaacaggacggaacgctggcccaggaaattgtcggcgtcgaaatcgcgcaaaagaaaggcgacccagtgcgcgtgctgctcgacgaacacccgcgtgaaacgtcgctcgaaagcctgggcaagctcaaaggcgtggttcgccccgacggcagcgtgacagccggcaacgcgtccggtgtgaacgacggtgcctgcgcgctgttgctcgcgaaccagcaggccgccgaccagtacggcctgcgccgccgcgcccgcgtggtgggcatggcgaccgcgggcgtcgggccgcgcatcatggggatcggtccggcgccggctacgcaaaagctgctgaagcagctcggcatgacgctcgaacaattcgacgtgatcgagttgaacgaagcgttcgcatcgcaaggcctggcagttctgcgtacgctcggcttgcgcgacgacgacccgcgcgtcaatccgaacggcggagccatcgcgctcggccacccgctgggcgcatcgggtgcgcgtctgatcacgaccgcgctgtaccagctggaacggatcaacggccgctttgcgctttgcacgatgtgcatcggcgtaggccagggcatcgcgctggtcatcgagcggctc

SEQ ID NO: 28256 - DNA, 624 bp, Burkholderia fungorum
gccgcgatcatcgacctcgacggcacgatgatcgataccgccgacgacttcaccgccggcctgaacggcatgctcgcgcaactcgacgcgcaggagacttcgcgcgaggaagtggtcggttatgtcggcaagggttcggagcatctgatccgcagcgtgctggcgccgcgcttcgaaacggagcatgcgcaagaccgcttcgacgaagcgctcgcgatctatcaggcggagtacgcaaagatcaacggcacgcacacgcggctttatcccgatgtcgaagccggcctgatcgccatgcgcaatgccggcctcaaactcgcctgcgtgaccaacaagccgcatcggttcgcggtcgagctgctgcagcaatacgggctcgcccagtatttcagcgtcgtgctcggcggcgacagcctcgcgaaaaagaagcccgatccgctgcccatgctcaccgccgcagcgcaactgggcgtcgagccgcaggccacggtcgccatcggcgattcggaaaacgatgcactggcaggccgcgcggcgggcatggccacgttgacggtgccctacggctacaaccacggccaagctatacaaacaataaaatccgatggtatagttgcctcgctg

SEQ ID NO: 28257 - DNA, 594 bp, Burkholderia fungorum
cgctttgtcgacggtgagcgcgccgccggcaaaaccgtctatcccgccgacgtattccgcgcgctgcgcctgaccagtcccgatgaagtgaaagtggtgatcctcggccaggatccgtatcacggcgaagaccgtggcacgccgcaagcgcacgggctggcgttttcggtagcgccgaacgtgcgcacgccgccgtcgctgcgcaacatcttcaaggagatcgccgcaagccttggccacgagacgccgcgtcacggctgtctcgacacctgggcgaagcagggcgtgctgctgctgaacacggtgttgacggtggagcgagactcggccgccagccacgcaaaacgcggctgggaaaaatgcaccgacacgctgatccacgaactcgcgatgcgccatgacggcctcgtgttcatgctgtggggcgcgcatgcgcaagccaagcgcgcgctgctcggcggcaagtcgcattgcgtgctggaagcaccgcatccgtcgccgctgtcggcgcatcgcggttttctcggctgcgggcatttcgccaaggccaacgaatatctcgcacagcacggccgcgagccgatcgactggcgc

SEQ ID NO: 28258 - DNA, 1230 bp, Burkholderia fungorum
atgcagcttctaacgatcggaatcaatcaccacactgcgcctgtcgccttgcgcgaacgcgtggcgtttccgctcgaacagatcaagcccgcattggacaccttcaagagcatctggctcggtccgtcggcccgcacggcgcccgaagcggcgattctgtccacctgcaatcgcaccgagctctactgcgcgaccgacgaccaggccgcgcgcgaagccgcgatccagtggctgtcccgctaccacaacctgcccatcggcgaactcgcgccgcacgtctacgcgctgccgcagtcggaagccgtgcgccacgcgtttcgcgttgcatcggggctggattcgatggtgctgggcgagacgcaaatcgtcgggcaaatgaaggacgcggtgcgtaccgcatccgaagctggcgcactcggcacctatctgaaccagttgttccagcgcaccttcgccgtcgcgaaggaagtgcgcagcacgaccgaaattggcgcgcagtcggtttccatggccgccgccgccgtgcgcctcgcccagcggattttcgacaaggtcgcgaaccagcgcgtgctgttcatcggcgcgggcgagatgatcgagctgtgcgccacgcatttcgcggcgcagcagccgaaggaactggtggtcgcgaaccgcacggccgagcgcggcacgcgtctcgccgaacgcttcaacggccgcgccattccgctgtcggaactgccctcgcgcatgcatgagttcgacatcatcgtgtcgtgcactgcgtccaccttgccgatcatcggcctgggcgcggtcgagcgggcggtgaaagcgcgccgtcaccggccgattttcatggtcgatctggccgttccgcgcgatatcgaacccgaagtcggccagctcgaagacgtgttcctgtacaccgtcgacgacctcggcgcgatcgtccgcgaaggcaatgcttcgcggcaagccgcggtcgcgcaggccgaagcgatcatcgaaacgcgcgtgcagaacttcatgcaatggctcgacgcacgcagcatcgtgccggtgatccgccatatgcacacgcaggccgacgtgctgcgtcgcgccgaggtggaacgcgcgcagaaaatgcttgcgcgcggcgacgatccggccgccgtgctcgaggcgctgtcgcaggcgctcaccaacaaactgatccacggccccacgcacgcgctcaatcgcgcgagcagcgaaaaccgtgac

SEQ ID NO: 28259 - DNA, 1575 bp, Burkholderia fungorum
agttctatacaacggaacatcgggccattcgcgctgatgctcaccggcttgggctcgatcatcggatcgggctggctgttcggcgcctggaaggctgcaaaaattgccgggcccgctgccatttgtgcgtgggtgatcggcgcggtcgtgattctcgcgatcgcattgacctacgcagaactcggcgcgatgttcccggaatccggcggcatggtgcgttacgcgcgctattcgcacggtgcgctggttggattcatcagcgcatgggctaactggattgcgattgtttcagttattcccatcgaggctgaagcatccattcaatatatgagtacatggccctatccctgggcgcatgcgttattcgtggacggatcattaaccacccacgggttattactgtccgcggcactcgtgatcatttacttcctgctgaactattggggcgtgaaactgttcgcgcgcgccaattcggcaatcacgatcttcaagtttctgattccgggcgcgaccatcctcggcctgatgctgacgggcttccacaaggaaaatttcggcgaagtgagtaccttcgcgccgtacggctggtcggcggtgctgaccgccgtggcgacgagcggcattgtgttcgcgttcaacggtttccagagcccgatcaaccttgccggtgaagcgcgcaatccggccagaagcgtgccgttcgcggtgatcggctcgatcctgctggcgctggtgatctatgttctgttgcagatcgcgtatatcggcgcggtgaacccgagcgacgtgatgaagggctggagccacttcaactttgcttcgccgtttgcggaactggcgatcgcgctaaacctgaactggctggcgatcctgctctatgtcgacgcgttcgtcagcccgagcggcacgggtacgacctacatggcgaccaccagccgcatgatctacgcgatggagcgcaacaacaccatgccgaagatgttcggcaacgtgcacccgttctacggcgtgccgcgcccggcaatgtggttcaacctgctggtgtcgttcattttcctgttcttcttccgcggctggagttcgctcgcggcggtgatttccgtcgccaccgtgatctcatacctgaccggcccgatcagcctgatgtcgctgcgccgtgcggcaacggacctcgagcgtcccttgcatattccgggcatgaagatcattgccccgttcgcgttcgtctgcgcgtcgctgatcctgtactgggcgaagtggccgctgaccggcgagatcattctgctgatggtcgtcgcgttgccggtgtacttctactttcaggcgaagtcgggttttgccggctggggccgtgatctgaaggcggcatggtggctggtcgcctatctgccggtgatggcgattctgtcgctgatcggcagcaagcagttcggcggtcacgacctcatcccttacggctgggacatgctggtggtcatcgcgttttcgctggtgttctactactggggcgtgaatagcggctatcggtcggaatatctggacgagcgccaggagcacgatgaagtgctcgaaggc

SEQ ID NO: 28260 - DNA, 1140 bp, Burkholderia fungorum
atggcgaaacgggattactacgaggttctgggcgtcgcaaagaacgcgagcgacgacgaaatcaagaaggcttatcgcaagctggcgatgaagcaccaccctgaccgcaatccgggcaacaaggatgcggaagggcatttcaaggaggtgaaggaagcctatgaaatgctctcggactcgcaaaagcgtgccgcgtacgatcagtacggccacgcgggtgtcgatccgaacatgggcggtgccggcgcacaaggttttggtggttttgccgatgcattcggcgatattttcggcgacatcttcggccaggcggccggtggcgccgcacgcggcggtggcggccgcgcgggcccgcaggtgtatcgcggcgccgatctgcgctacagcatggaaatcacgctggaacaggccgcgcacggctacgacacgcagattcgcgtgccgagctgggtgtcgtgcgaggtctgccacggttcgggcgccaagcccggcaccaagccggaaacctgcccgacctgtagcggttcgggttcggtgcggatgtcgcagggtttcttcagcatccagcaaacctgcccgaagtgccacggcaccggcacctacattcccgacccgtgcggccattgccacggtgccggcaaggtgaaggaaaccaagacgctggaagtgaagatcccggcaggtatcgacgacggcatgcggatccgttcggccggcaacggcgagccgggtatcaacggcgggccgtcgggcgatctgtacgtcgagattcacatcaagcagcattcggtgttcgagcgcgacggcgacgatctgcactgccagatgccgattccgttcaccactgcggcactgggcggcgagatcgaagtgccgacactcgcgggccgcgccagctttaccgtgccggaaggtacacaatcgggcaagacgttccgtctgcgtggcaagggcatcaaggggctgcgttcgagtattgccggcgatctgtacgtgcatgtgcaggtcgaaacgccggtcaagctcaccgagccgcagcgcgatctgctcaagcagttcgaaaaggcgctcgtcgagggcggctcgcggcatagtccgcaaagcaaaagctggttcgaccgggtgaagagcttcttcgat

SEQ ID NO: 28261 - DNA, 1953 bp, Burkholderia fungorum
atgggcaaaatcatcggcatcgacctcggcacgaccaactcgtgcgtggcgatcatggaaggcaattcggtcaaggtgatcgagaactcggaaggcgcgcgcaccacgccgtcgatcatcgcttacatggaagacggcgagattctcgtcggcgcgcctgcgaagcgccagtcggtcacgaacccgaagaacacgctgtacgcagtcaagcgcctgatcggccgccgtttcgaagaaaaagaagtgcagaaagacatcggcctgatgccgtacaagatcatcaaggccgataacggcgacgcatgggtcgaagtgcgcgaccagaagctcgctccgccgcaaatctccgcggaagtgctgcgcaagatgaagaagaccgctgaagactatctcggcgagccggtcaccgaggcggtgatcacggttcccgcgtacttcaacgacagccagcgtcaggcaaccaaagatgcaggccgcattgccggtctggaagtgaagcggatcatcaacgaaccgaccgccgctgctctggctttcggcctcgacaagaacgaaaagggcgaccgcaagatcgcggtgtatgacctgggtggcggtacgttcgacgtgtcgatcatcgaaatcgcggatgtcgacggtgaaaagcagttcgaagtgctgtccacgaacggcgatacgttcctcggcggtgaagacttcgaccagcgcatcatcgattacatcatcggcgagttcaagaaagagcagggcgtcgatctgtcgaaagacgtgctcgcgctgcaacgcctgaaggaatcggctgagaaggccaagatcgagctgtcgtcgagccagcaaaccgaaatcaacctgccgtacatcacggccgacgcatcgggtccgaagcatttgaacctgaaaattacgcgtgcgaagctggaagcgctggttgaagagctgatcgagcgcacgatcgaaccgtgccgcgtggcgatcaaggacgcaggcgtgaaggtcggcgaaatcgacgacgtgattctggtcggcggtatgacccgcatgccgaaggtgcaggaaaaggtcaaggagttcttcggcaaggatccgcgccgtgacgtgaacccggacgaagccgtggccgttggcgccgcgatccagggccaggtgttgtcgggcgaccgcaaggacgttctgctgctcgacgtgaccccgctgtcgctcggcatcgaaacgctcggcggcgtgatgaccaagatgatcaacaagaacaccacgatcccgaccaagcactcacaggtctactccacggccgacgacaatcagggcgccgtgacgatcaaggtgttccagggcgaacgcgaaatggcagccggcaacaagctgctgggcgagttcaacctggaaggcattccgccggcaccgcgcggcacgccgcagatcgaggtgagcttcgacatcgacgcgaatggcattctgcacgtcggcgcgaaagacaaggcgaccggcaaggaaaaccgcatcacgatcaaggcgaactcgggtctgtccgaagccgaaatcgagaagatggtgaaggacgccgaagccaacgccgaagaagatcacaagctgcgtgagctggccgatgcccgcaatcagggcgacgcgctggtccacagcacgaagaaggcgctcaccgaatacggcgacaagctggaagccggcgagaaggaaaagatcgaatccgcgctgaaggatctcgaagaaacgctgaagagcggttcgagcgacaaggccgcgatcgaagccaagatcgaagtggtggccaccgcctcgcagaagatgggcgagaagatgtacgcggacatgcaggctgcgcaaggtgctgaagccgcggcagcgggcgcggcgggtgcgggcggcgcgggtgcatcggcgggtggcgcgagccagcagcaggacgacgtggtcgacgccgagttcaaggaagtcaag

SEQ ID NO: 28262 - DNA, 1044 bp, Burkholderia fungorum
ttacctctgctgcctatgcgcttcgacctcgagcggccttcacagaacgccacgtcacaccgtgtcgccgtgctgctgatcaatctcggcacgcccgacgcgccgacgccgcgcgcggtccgccgctatctcgcgcagtttctgtccgatccgcgcgtggtcgaaattccggcgctgctctggcagatcatcttgcgtctgctgatcctgccgttccggggcagtgcctcggccaagaagtacgctgcggtgtggatgcccgaaggctcgccgctgcgcgtgtatacagagaagcaggtggagggcttgcgccatctgctgcaactgaacgactacacggtgctggtcgattacgcgatgcgctacggtacgccgggtattccggccatgctgaaccagctcaagctggcaggcgccgaacgcgtgctgctcatgcccatgtatccgcagtattcgtcgtccaccaccgccaccgctttcgacgacgccttttcggcgctcaagcgcatgcgcaatcagccggaaattcgcacggtgcgccagtacgccgatcatccggcctacattgcggcgcttgccgcacaggtgcatcaatattggcatcagcatggccggccggatttcgccgcgggcgacaagctggtgctgagttttcacggcgtgcccaaacgcacgctggatctcggcgacccataccatgagcaatgccagcaaacgggcgcgctgctgatgcaggcgctcgaactgacgccggtggagtgccgcattacgttccagtcgcgtttcggcaaggccgagtggctgcagccgtatacggcgcccacgctcaaggaactgggcgcggcgggcgtgcggcgcgccgatgtgttctgtccgggctttactgccgactgccttgagaccatcgaggaaatcggcatggaagtgcgcgatgaattcctgcacgcgggcggcaaggattttcatcggattccctgcctgaatgcgtcgcaggcctggattgccgcgctgggcgaaatcgtcgcgcagaatctccagggctgg

SEQ ID NO: 28263 - DNA, 1041 bp, Burkholderia fungorum
cacaacaccgacgatgtccgcatccgcgaattgaaagaactcacgccgcccgctcacctgatccgtgaattcgcctgcgacgaaacggtgtccgacgtgatctataactcgcgcacctcgatgcatcgcattctgcacggcatggaagatcgcctgatcgtgatcatcggaccgtgctcgattcacgatacgaaggcggcgatggaatacgccggccgtctggtcgagcagcgcaagcgctttgccggcgagctcgaaatcgtgatgcgcgtgtacttcgaaaagccgcgcacaactgttggctggaagggtctcatcaacgacccgtacatggacaatagcttcaagatcaacgaaggcctgcgcaccgcgcgcgagttgctgttgcgcatcaacgaactcggcctgccggccggcaccgaatacctcgacatgatcagtccgcagtacatcgccgacctgatctcgtggggcgcaatcggcgcgcggaccaccgaatcgcaggtgcaccgcgaactggcttcgggcctgtcgtgcccggtcggcttcaagaacggcacggacggcaacgtcaagatcgcggtcgacgcgatcaaggccgcctcgcagccgcaccatttcctgtcggtcacgaagggcggccactcggcaatcgtgtcgaccgcgggcaatgaggactgccacatcatcctgcgcggcggcaagacgccgaactacgacgcggacagcgtcaacgccgcgtgcgcggacatcggcaaggccggtctcgccgcgcgcctgatgatcgacgcgagccacgcgaacagctcgaagaagcacgagaatcagattccggtgtgcgcggatatcggccgccagattgcttcgggtgacgaacggattgtcggcgtgatggtggaatcgaatctggtggcgggccgccaggatctgcaggaaggctgcgcgctgacgtacggccagagcatcaccgacgcgtgcatcggctgggacgaaagtgtcgccgtgctggaaggcctcgccgacgcggtgaagcagcgccgt

SEQ ID NO: 28264 - DNA, 1224 bp, Burkholderia fungorum
cgcactaccgaagacgtgcagaacgtcgtcaaactgtgcggccagtacaacgtcccggtcattccttacggtaacggctcgtcgctggaagggcatctgctcgccgtgcaaggcggcgtatcgatcgatctgtcggaaatgaaccgggtgctgtcgatcaacgccgaagacctgaccgtcaccgtcgagcccggcatctcgcgcaaacagttgaacgaggcgttgcgcgacacgggtctgttcttcccgatcgaccccggcgcggacgcgagcatcggcggcatgtcggccacgcgcgcgtcgggtaccaacgctgtgcgctacggcacgatgcgcgaaaacgtgctcgggctgaccgtggtgctggccgatggccgcgtgatcaaaaccggcacgcgggcccgcaagtcgtccgcgggttacgacctcacgcgcctgttcgtcggctcggaaggcacgctcggcgtgattacggaaatcacagtccgcctgtatccgcagccggaggcggtgtccgcggcggtgtgcacgttcccgtcgatgggcgacgcggttcgcgcggtcatcgaaacgatccagatcggcgtaccgattgcgcgcgtcgaattcgtcgactcgctcgccatccgctcgatcaaccgccactcgaatctgacgctgcgtgaagcgcccacgttgttcttcgagttccacggcaccgaggccggcgtaaaagagcaggccgaactcgtccaggaggtcgccgcgcagaatgccggcgagggcttcgaatgggccacgcgtccggaagaccgcagccgtctatggaatgcgcgccacaacgcctatttcgccatgctgcaactgaagcccggttgccgcgcggtcacgaccgacgtctgcgtgccgatctcgcgcctcgcggaatgtgtggaggaaacggaacaggacctgaaggcgtcgcctctgccctgcccgatcgtcggccatgtcggcgacggcaacttccacgttgcgatcctgatcgatcccaacaagccggaagaactggtcgaagccgagcgcctgaaccatcgcatcgtggagcgcgcgctgcgcatggacggcacctgtacgggcgagcatggcgtcggcttgcacaagatgggcttcctgctcgaagaacacggtgaagtcgcggtcgacaccatgcgctcgatcaagcacgcgctcgatccgcacaatctgatgaacccgggcaagatc

SEQ ID NO: 28265 - DNA, 1413 bp, Burkholderia fungorum
ttgccgacccactgtctgctgtatcgcgaagaagacaccgtcgcctatgaatgcgacggtctcgccgcctaccggcgtctgccgctcgcggtcgcgttgccggagacggaatcgcaggtgcagcgcatcgtgcagatctgccaccgcctcgacgtgccgatcgtcccgcgcggtgcgggcaccggcctgtccggcggcgccatgccgatccgccacggtgtggtggtgtcgctcgcgcgcttgcgcaagatcgtcgaggtcgattcgtacgcgcgaaccgccacggtgcagccgggcgtgcgcaacctgtccatctccgaagccgccgcaccttacggcctgtattacgcgccggacccgtcgtcgcagattgcctgcacgatcggcggcaatgtctcggagaattccggcggcgttcactgcctcaaatacggtctgacggtgcataacgtgctgcgcgtgcgcgccgtcacgatggaaggcgaaatcgtcgagttcggctcgctcgcgccggatgcgcccggcctcgatctgctggcggtgctgatcggcagcgaaggcatgtttgcgatcgtcaccgaagtcaccgtcaagctgatccccaagccgcaaacggcgcaggtcatcatggccagtttcgacgacgtcgtgaaaggcggcgacgcggttgccggcatcattgcggcgggcatcatcccggcgggtctggaaatgatggacaagccggccacgcgcgccgtcgaggaattcgtcaacgcgggctacgatctcgacgcggcggcgatcctgctgtgcgaatcggacggcacgcccgacgaagtcgccgacgagatcgtgcgcatgaccgcggtgctgcgcgaacacggcgccacgcgcatccagatttcgcgctcggaaaacgaacggctgcgcttctggtcggggcgcaagaacgccttcccggccgccgggcgcatttcacccgactattactgcatggacggcaccgtgccgcgccgcagtattggcccgctgctcacgcgcatcgaggcgatggagaagatctacaacttgcgctgcatcaacgtcttccacgcgggagacggcaacatgcatccgctgatcctgttcaacggcaacgaccgggacgagtggcaccgggccgaagcgttcggttgcgacattctcgaagcatgcgtggaactgggcggcacggtgaccggcgagcacggcgtcggcatcgagaagatcaattccatgtgcgtgcagttttcgcccgaagagcgcgacgcgttccacgcggtcaagcgggctttcgacgcgcctggcctcctgaaccccgacaaaggcattcccacgcgcgcccgctgcgccgaatacggcaagatgcacgtacgcggcggcttgctgccgcatccggacctgccgcgtttc

SEQ ID NO: 28266 - DNA, 807 bp, Burkholderia fungorum
aaaattgcttttatcggcggtggcaacatggccgccgcgttgatcggcggcctcatcaaacgtggcgtcgcagccgctgacctctacgcaatcgatcccaacgaagaggcgcgcaaacgcaatgagcagcagttcggcatccggaccggcgccgccgcggatgccgcgctggccgcgtacgacgccgtcgtgctggcggtgaagccgcagatcctgaagagcgtcgccgaggcggtggcgccgcatctgaacgcgtcgcaactggtcgtgagcatcgtcgccggtattcgcatgggcgacatgtcgcgctggctgaacggtcacagccgtatcgtgcgcgtcatgcccaatacgccggcgttgatcggcatgggcgtgaccggtctcgtggcaaccggcagcgtggacgaagcgggccgcgcgctcgcgtcgcaactgctgggcgcagtcggcgaaacggtctggttcgacgacgaagcgaagatcgacgccgtcaccgcaatctcgggcagcgggcccgcctacgtgttctatttcatcgaagcgttgcaggaagccgcccgccagctcggcatggatgaagcgcagggccgtgcgctcgccgtcgcgaccttcaccggcgcggcgcaactggcggcgaattccgacgagccgccgggcgtgctgcgcgaacgcgtgacgtcgaagggcggcaccacggcggcggcgctggcgtcgttcgacgcgagcggcatcaaggatgcgatcgtgcgcggcgcgctcgcggccaatgcccgtgcgcgggaaatgggcgacgaattcggcaag

SEQ ID NO: 28267 - DNA, 1425 bp, Burkholderia fungorum
atgtccgaacacaagctcaccaatgccgccggcgcacccgtcgccgacaaccagaattcgatgaccgccggcgcgcgcggtccggtcgtcctgcaagacgtctggctgctcgaaaaactcgctcacttcgaccgcgaagtgattccggaacgccgcgttcacgccaaaggttcgggcgcgttcggcacgctgaaggtcacgcacgatatctcgcgctacacgaaggcgaaggtgttcgcgcaagccggcaaggaaacgccgcttttcatgcgcttttcgacggttgccggcgagcgcggcgcggccgacgccgaacgcgacgtgcgcggcttctcgatcaagttctacacggaagagggcaactgggacgtggtgggcaacaacacgccggtgttctttatccgcgatccgctgaagtttccggacttcatccacacgcaaaagcgcgacccgtacaccaacatgcgcagcaatgtggccgcgtgggatttctggtcgcgtcatccggagtcgctgcatcaggtgacgattctgatgagcgaccgcgggattccgcagaatttccgtcagatgcacggcttcggctcgcacacgtactcgttcatcaacgccaacaacgagcgtttctgggtgaagttccacttcaagtcgatgcaaggcgtcgagaactttaccgatgcagaagccgcacaggtggtcgcgcaggatcgtgaaagcgcgcaacgcgatctgctcacgaacatcgaccagggcaacttcccgaaatggcgcttcgccattcaggtgatgccggaagcggaagccgccacgtatcgcttcaatccgttcgacatcacgaaagtgtggtcgcagaaggactatccgctgatcgatgtcggcacgatcgagttgaatcgcaatgccgccaactatttcgcggacgtggagcaggcggcgttcacgccggccaacgtggtgccgggcatcggtttctcgccggatcgtctgttgcaggggcgtctgttctcgtatggcgacacgcagcgctatcgcctcggcgtgaatcaccaccagattccggtgaacgcctcgcgtgtggcgagcccgcattcgtttcatcgcgacggcgcgatgcgcacggacggcaacctcggcggcaacgtgaattacgagccgaaccgcttcggcgacttcgcgcaggacgccaacgcgtccgaaccgccgctcgcggcgggcgcggtggatcgctacgatcatcgtctggacgacgactactacacgcagccgggcatgctgtttgcgctcttcgatgcggcccagcgcgagcgtctgttcggcaacatcgcacgccatatcaacggtgtgccgcaggagatcgtcgcgcgtcagatcgagcatttccgccgcgccgatccggcatacgcggaaggcgtgatcgcagcgatt

SEQ ID NO: 28268 - DNA, 792 bp, Burkholderia fungorum
atgaactcaggaagattgagagacagggtcgcactcgtcacaggggccggatgcattggtcccggttggggcaatggccgcgcgatcgcagtgaggtttgccgaggaaggcgcgcacgtcgtcgcgatcgaccggaatctggcatccatggacgaaacgcttgaattgatacggcaggcgggagggaaggtcacaccgtacgaatgcgacgtgaccgatagtgccgccgtcgagcgcctggtcgcggatatcgtggcgcgttcggggcgcatcgacgtactggtgaacaacgtgggggcgcccgcgccgggcggcccggtccagttgagcgaagcgcagtggggcgagcagctggaactgaatctgacgacgacgttcctgatgtgccaccacgtactgccagtcatggaagggcaggccggcggctctattgtcaacatcgcatcgacgtccggcatccgctggacgggcgccgcccaggtcggctatgcggcagccaaggctggcgttattcagttcgcgcgcgtggtggcggtcgaatatgcgtcgaagaacatccgggccaactccgtggtgccgggtctgctgtacaccccgatggtcgatacgacgatcgcccgcaaccagaccggcggcgatctcgaactgctgctccgcaagcgcaaggcacgtattcctctgccgttcatgggcgacggccgcgatacggccaacgcggcgctgtttctcgcgtcggacgaggcccgcttcatcaccggcaccgagatcgtagtcgacggcggcatgagcgcg

SEQ ID NO: 28269 - DNA, 462 bp, Burkholderia fungorum
cgggtcgtgcttgttgcggccatggcagcaaatcgcgtcatcgggcttggaaacgatattccatggaggattcccggcgaacagaagcgctttcgagagctgacgatgaaccagcttgtcgtgatggggcgtagaacgtttgaatcaataggcaagccgctgcctggtcgagatttgctggttttgagttcgggtaccagcagattgggcacggtgcgaaccgtcaagtcgttcgcggaagtgaccgctgccgttaataatgacccgcgggaagctatttttgtcggcggggggcagcaggtttacgcgatgctcatgccgtacgctgacgtcgtctatttgaccgagattgacctgcgccctcccggcgatgctttttttcctgagatccctgaacggttcagcctgccggacagcgtggattttccgggcgagatacgctacacgttcaatacctacgca

SEQ ID NO: 28270 - DNA, 1323 bp, Burkholderia fungorum
atgtctgttttcacctcgaaagtggtgcgcaacctgttcggcaccgacgcgatgcgaaccatcttttccgacgacacgcgcgtggcgaactacctgaaaatcgaagtcgcgctggccaaggtcgaggccgggctcggcgtgattccgcaggacgcctggcgcgatatcgagcagaagtcgcatagcttcgaaatcgactgggaacgctttcgcatcgacgtggaagcggtcggctacccggtgatgcctttcgtcacccaactcgccgaacattgcggggagtccggtgaatacctgcactggggttccaccacgcgcgatatcaccgacacctcgttcgtgctgcaattgcgcgaagcgctcggcgtgctcgccgccgatctcgacaaggtgcgtcgcaagctgcgcgagatgacggcgcgacatcgttcgacgctgatgatcgcgcgcacgcatggcaagcatgcgctgccgtccaccttcgggtttcgttgcgcggtctggtatagcgaagtcgagcggcaatgcgaacgcctcgcggcattgcgcgccgagccgttcgtgggccagttcggcggcgcgatcggcacgctggccgcggtggggccgcgcggcctggaagtgcagtctgcgttaatggcggaactgggactcggcacggcagagatcgcgtggtttgcctcgcgcgaccgcgtctccgaggtggtgttcagaatcgcctcgattgcgcaatcgatggcgagcatcgccaaatcgctggtcatcatgacgcgcgacgaactcgccgaagcctccgaaggcggcggcgagcagcgtggcaccagctcggcgatgccgcacaagcacaacacggtcgtgccggaactggtgatcgtgcacggcaagatggcgacacagcaggtggcgatcgtgatggagtcgatggtgcaggacttcgagcgcgactggcaggggcatttcgagaccatcgccgtgcctcagactttccagcacgcgcatgccgccgtcacgcagatgcacaccgtgctgtccggcctgattctgcacgaagaccgcatgcgcgcgaacctcgatgtaacacgcggacaggtgatggccgagagcgtgatgatggcgctcgcgccgaagctcggccgcaagaacgcgcaccatgcgatttcgcggctgtgcaaccaggcgctggcggaagaccggccgctcggcgaagtgctgcgcgccgatccgcaggtcgcgcaatatctgggagagcacgaactcgccgatgcgctcgacccggccggctatatcggccttgccacgcaagtggtcgataacgtgctgaaa

SEQ ID NO: 28271 - DNA, 1134 bp, Burkholderia fungorum
atgttcgaactgactgatgcgcaacgccaattgcagcaaagcgcccgtcgattggcgctagaagcgatcgccccgcacgcggcgcagaccgaccgcagcgagcagtatccgtggcataccgtcgaggcgctgcgcgagcagcgtctgatgggcatgacgctgccgcctgagtacggcggcaagggcgcgagctatttcgacacggtgctggtcatcgaggaactgtccaaggtttgcgcggcatcgggccgcatcatggtcgaatcgaatatgggcgcgatcggcgcgatcatgaaatacggctcggacgcgcagaagcagctcgccgcgcgcctcgtgctggccggcgacaagcccgccatctgcatcaccgaaccgcaggccggcagcgccgccagcgatatgcagacgcgcgccgagcggcgcggcgacacctggcatttgagcggctgcaagcactggatcacgggcggcggcgtatcgaagctgcacttcgtgttcgcgcgcgcgatcgaggacggcaaggacaccggtatcgccggctttatcgtcgtggggccggatgtgccgggcatgacgatccagcgcattccggctatgggcattcggggcgttccggaagcgcggatcgaattcgacgacatgcgcgttcggcacgacatgaaggtcacgccgccgggccgcaccgaagccggttttgccgggctgatgaacgcgtacaacgcacagcgcgtcggcgcggccacagtcgcgctcggcattgcgcaaggtgcattcgacctcgcgctcgactacgcgaaacggcgcgaacagttcggccgtcccatcgccgaattccagggccttcaatggatgctcgcggacatgtcgatccagctggaagccgcgcgcctgatggtgtggaaggcggccgcgtcgggcagcgaattcccgtcgatgtttgccgccgcgcaagccaaaatcgccgccggcgaagccgccatcaaggtcaccaacgacgcgttgcagattcacggcgcggtgggttacggacgcgatctgccactcgaacggatggtccgcgatgcgcgcatgtttacgatttcaggcggcaccgcgcagatcctgcgcacgcaggtggcgggcacgttgctt

SEQ ID NO: 28272 - DNA, 1407 bp, Burkholderia fungorum
cccgaagcactcgcgctgagcgattcgggcacgtcgctcaactatgcgcaactcggctcgcgcatcgaagccacggccggctggttgcatacgctcggcatacaggccggcgaccgtgtgatgctcgtcggcgagaacagcgtggcgctggctacgctgatccttggcgcgcatcgcgcgggcgtcaccgtcgtgctcgaaaacgcgcgccgcgcgccggcggagaccgatacggttcacgcgcactgcgcagcgcacgccatgctgttcgtgctcgaccggtcacccgatgccgctgcgcatgcaaagcggctcggcgcgaccgaagcgatcgatgctccagcgggccgcgtcgctgtccgcctcgaagccaccgcgcgaggcgaacccgccgacgaagcgtcggccgccgcgatcatttacacgaccgggacaaccggcaagcctaaaggcgtgatgttgtcttcgcgcgcgctgagttttatcggccagcagatgcgcgtattgcgtcacgtcacgccgcgcgacacggtctacggggtactgcccatcacgcatgtgatgggcctcgcctcggtgctgttcggcacgctcgcgtccggcgcgcatctgcatctggtatcgcgcttctcagccgcagaatgcgtagcatgtatcggccgtcttcacgtgagcatgctgcagggcgcgccagcaatgttcgcgaggctcgtcgaccactgccaggctaacggaatcacgcgtatcgagggcgtacggttcatcggctcaggcggcgctccgatcgatccgaccatcaagaaggacgcgcaacggttattcgacacgccgctgcacaacgggtacggtttgaccgaagcggcctcgacctgctggacccgtttcgaagacgacaacagcgacgacaccgtgggccgtccgctccccggcgtcgaactacgcatcgccgcgccgcccggcagtgacatcggagaactatgggttcgcggcccgcatgtgatgaacggctactttcgcgatccgctgcgcacgtcggaagtgctgaccggcgacggttggttcaatacgcaggatctcgcccggcaatccgccgacggccgtatctacatcgttgggcgcacgcgcgacatcatcatccgctcgggcttcaacgtgtatccgctcgaaatcgaactggcgctggcgacgcatcccgacgtgctgcattgcgcggtactcggccgtcccgtcaaaggtaacgaggaaatcatcgctttcgtcgaactcacgcagaacgcctgcgtgaaaccggaaacgctgcttgcatggttgtcggagcggctctcgccgtacaagcgtccggcgcagatcgtcgtgatggcgacgctgcccgtcgcggcaaacggcaaggtgctcaagagcgcattg

SEQ ID NO: 28273 - DNA, 741 bp, Burkholderia fungorum
gtcgtgctgatcaccggcgccgggtccggcatcggcgccgcgctggcccggcgcatcgccgcgccgcgctcggccttgatgttgcacgcacgcggcgccgatcacgaagcgcgtgaacgactcgcccatgtcgccgccgattgcagcgcgaacggcgcgcgctgcgcgacggtgtacggcgatctcgccgaacgcggcgccgcggagcatgtgatccatcaaacgctcgcaagcttcggcgcgctcgatcaactggtcgccaacgccggccacgcacagcgccaaacgcttggcggactcgatccggacgcgttcagcgcagccttcgcggccatgccggccgcgttcgcggcgctcgtcaaacgcgcaacgcccgcgctggagacgtcgaaacgcggccgcgtaatcgcgctcagctcgttcgtcgcacaccgctatcgcgcggacgcgccgtttgccgcgacggccgccgcgaaagcggcgctcgaatcgctggcgaaaaccgcggcggcggaactggcgccgcacggcgtgacggtcaattgcgtggcgcctggctacacccgtaaagatcgcggcccgagtgccgataatgcagcagtgtggacgcgcgccgccgaagcgacgccgctcggccatgtcgccgaacccgcggatatcgccgcgctgattgcgttcctgctctccgacgaggcgcgccacatcaccggccaggtaatccacatcgacggcggcctcacg

SEQ ID NO: 28274 - DNA, 891 bp, Burkholderia fungorum
gccatagaaattcgtaacgtcaagaagcgctacaaggatttgcaagcgctcaagggcgtcagcctcacagttgaagaaggcgagttcttcggactgctcggtccgaacggcgcgggcaagacaacgctcatcagcatcctcgccgggctcgcgcgagccgacgaaggcagcatcgcggtgcgcggccacgacgtcgtcagcgatttccgcgccgcgcgccgcgcgcttggcgtggtgccgcaggagctcgtgttcgatccgtttttcacggtccgcgaaaccttgcgcatccagtccggctactacgggctgcgcaacaacgacgcgtggatcgacgagatcatggccaatctcgacctcaccgacaaagccgacgccaacatgcgcgcgctgtcgggcggcatgaagcgccgcgtgctggtcgcgcaggcgctggtgcaccggccgccggtgatcgtgctcgacgagccgaccgcgggcgtcgacgtcgaattgcggcaaacgctgtggaagttcatttcgcgcctgaatcgcgaaggccacaccatcgtgctgaccacgcactatctggaagaagccgagtcgctgtgcgatcgcatcgccatgctgcggcgcggcgaagtcgtggcgctcgagcgcaccagcacgctgctgcaacgctttgccggcatgcaactgttcctgcgtttctcgcaaggcgtcctgcccgccgatctgcgtgtgctcgaagtggaaagcggcacgggcaacggcaatggccgccagcatctgctgcgtctcgcgagttacgacgacgtcgaaaaaattctcgcgcagtgccgcgcagcgggctgcacattcgaagaaatcgaggtccgcaaggccgacctcgaagatgtgttcgttcaggtg

SEQ ID NO: 28275 - DNA, 1299 bp, Burkholderia fungorum
attcgcaaactcgattccaccgctcccgacttccagaagtcgctgcacgcggtgctcgcgttcgaggcgagcgaagacgaagcaatcgagcgctcggtcgcgcagattctgaacgacgtgaaggcgcgcggcgatgctgcggtgctggagtacacgagccgcttcgaccgtgtcgaggcgaagagcgtcgacgcgctcgaactgccgatgtcggagctggaagcggcgctggaaggcctcgaaccgaagcgtcgcgcggcgctcgaagcggcggcggcgcgggtgcgcggctaccacgagaagcagaagatcgaatgcggcagccatagctggcggtacacggaagccgacggcaccgtgctcggccagaaggtcacgccgctcgatcgcgcgggtatctacgtgccgggcggcaaggcggcgtatccgtcgtcagtgctgatgaacgcgattccggcgcgagtggccggcgtgcgcgaaatcgtcatggtggtgccgacgccggacggcgtgaagaatccgctggtgctcgcggccgcgctgctcggcggcgtggatcgcgtgttcacgattggcggcgcgcaggcggtgggcgcgctggcgtacggcacggcgaccattcccgcggtcgacaagatctgcggtccgggcaacgcgtacgtcgcgtcggccaagcgccgcgtgttcggcacggtcggtatcgacatgatcgccgggccgtccgaaatcctggtgctgtgcgacggcaccacggatccgcgctgggtggcgatggacctgttctcgcaggccgagcacgacgagctcgcgcagtccattctgctgtgcccggacgacgcgttcatcggccgcgtgaaagatgcgatcgacgaactgctgcccaccatgccgcgccgcgatgtgatcagcgcgtcgctggaaggccgcggcgcgttgatcaaggtgcgcgatatggcggaagcctgcgcgatcgccaacgacatcgctccggaacacctcgaaatttccgcgctggaaccgcagcagtggggccagctgatccgccatgccggtgcgatctttctcggccgctacaccagcgaaagcctcggcgactactgtgcggggccaaatcacgttttgcctacgtctcgtaccgcacggttctcgtctcctttgggcgtctatgatttcttcaagcgttcgagcgtgatcgaggtcagcgcggagggcgcgcagacgctgggcgagatcgccgccgaactcgcttacggcgaaggcctgcaggcgcatgcccgcagcgccgaataccggatgcgg

SEQ ID NO: 28276 - DNA, 1056 bp, Burkholderia fungorum
atgacgacacctcaagacatcatccgccgcgacgtgctcgcgatgacgagctatccggttccggacgccacgggctatatcaagctcgacgcgatggaaaatccgttcccgctgccgccggtgctggccgcgcatctgggcgagcacctcgccggcgtcgcgctgaaccgctatccggcgccgcgtccggatgcgctgatcgagaagatcaagcgtgtgatgcaggtgccgcccggctgcgacgtgctgctcggcaacggctcggatgaaatcatcagcatggtgtcggtcgcgtgcgcgcagccgggcgccaaggtgctcgcgccggtgccgggcttcgtgatgtaccagatgtcggcgaagctggcgaatctcgagttcgtcggcgtgccgctgaaagcggatttcacgctcgataccgaagcgatgctggccgccatcgccgagcaccagccggcgatcatctacctcgcgtatccgaacaacccgaccgggacgctgttcgacgacgccgacatggagcgcatcatcgccgcggccagcaagagcctcgtggtgatcgacgaggcctaccagccgttcgcgcagcaaagctggctgccgcgcgccgacgcgttcgacaacgtggtggtgatgcgcacggtgtccaagctcggcctggccggaatccgtctcgggtatctggtcggcaaaccgggctggctgacggaattcgacaaggtgcggccgccgtacaacaccaacgtgctcacgcaggccgccgcggatttcctgctcgaccacgtcgacgtgctcgattctcaagccgcgcaattgcgcgaagaacgcacgaaactcgcgcacgcgatcgcccagttgccgggcgccgaagtgttcccgagcgccggcaacttcctgctggtgcgtgtgccggacgcgtcggtcctgttcgaaacgctgctggcggcgcgggttttgatcaaaaacgtgagtaaaatgcatccgttgctggccaattgcgtgcgtttgaccgtcggttcgcccgaagaaaatgcgcaattgctggccgcactgaag

SEQ ID NO: 28277 - DNA, 582 bp, Burkholderia fungorum
cgccttgcggaagtcgttcgcaacaccagcgaaacgcagatccgtgtgaagatcaatctggacggcaccggtcagcagaagctggccaccggcgtgccgtttctggaccacatgctcgaccagatcgcgcggcatggattgttcgacctcgagatcgaagcgcatggcgatctgcatatcgacgaccatcacacggtcgaagacaccggcatcacgctcggccaggccgtcgcgaaagcgatcggcgacaagaagggcatccgccgttacggtcattcttacgtgccgctcgacgaagcgctgtcgcgcgtcgtgatcgatttttccggtcgtccggggctcgaattccatgtgccgttcacgcgcgcgcgcatcggtacgttcgacgtcgatctgtccatcgaatttttccgcggcttcgtcaatcacgccggcgtgacgctgcatatcgacaacctgcgcggcctgaacgcccatcatcagatggaaacggtgttcaaggcgttcgggcgtgcattgcgcatggctaccgaactggacgaacgcgcggccggacagattccgtcgaccaagggcagcctt

SEQ ID NO: 28278 - DNA, 771 bp, Burkholderia fungorum
atggctctagctaaacgcatcatcccctgtctcgacgtcacggctggccgcgtggtcaagggcgtcaacttcgtcgaactgcgcgatgcgggcgacccggtcgaaatcgcccgccgctacgacgatcagggcgcggacgaactcaccttcctcgacatcaccgccacctcggatcagcgcgatctgatcctgccgatcatcgaagcggtcgcctcgcaggtgttcattccgctgacggtcggcggcggcgtgcgcgccgtcgaagacgtgcggcgcctgttgaacgcgggcgcggacaagatcagcatgaattcgtcggcggtggcgaatccgcagctcgtgaaagacgcgacggacaaatacggctcgcagtgcatcgtggtcgcgatcgacgcgaagcgcgtctccgcagaaggcgaagtgccgcgctgggaagtcttcacgcacggcggacgcaaggctaccgggctggacgcggtcgaatgggcgcgcaagatggccgaactcggcgccggcgaaatcctgctcaccagcatggaccgcgacggcacgaagagcggcttcgatctcgctctcacgcgcgccgtgtccgatgcggtgccgatcccggtgatcgcctcgggcggcgtgggcaacctgcagcatctggccgacggcatcaaggaaggccacgcggacgcggtactcgccgcgagcattttccactacggcgaacacaccgtgggcgaggccaagcgcttcatggccgatcagggcatttcggtgaggttg

SEQ ID NO: 28279 - DNA, 710 bp, Burkholderia fungorum
ctcgacaaggtcaggtgggacgcgaacggcctcgtgccggtgatcgcgcaggaagcgtcgacgaacgacgtgctgatgttcgcgtggatgaaccgcgaagcgttggcgaaaaccgtcgaaacaggccgcgcggtgtatttctcgcgctcgcgtcagcgcctgtggttcaagggtgaagagtccggccacgtgcagcatgtgcacgaagtgcggctcgattgcgacgaagacgtcgtgctgctgaaagtggagcaggtgtcgggcattgcctgccataccggccgccactcgtgctttttccagaaattcgaaggctcggtggaagatggcgactgggttgccgtcgacgccgtgctgaaagaccccgaacagatctacaaatgacgcaatccacgcaaaccacgccgtccaacgccgcgtccaccaccgacacgctgctgcgcctcgcggcgatcatcgacagccgcaagggcggcgatccggaggtctcgtatgtgtcgcgcctgttccacaaaggcgacgacgcggtgctgaagaagatcggcgaagaagccaccgaagtcgtgctggccgccaaggacgcacgccacggcggcgcgccgaaggcgctggtcggcgaagtcgcggacttatggttccattgcctcgtcatgctgtcgcacttcgatctgagcccggctgacgtgctcgccgaactcgaacgccgcgaa

SEQ ID NO: 28280 - DNA, 1875 bp, Burkholderia fungorum
caagaaaccatgagctttcaggcagaagtgaaacagcttctgcacctgatgatccattcgctgtacagcaacaaggagattttcctgcgcgagctgatttcgaacgcgtccgacgcggccgacaagctgcgcttcgaagcgatcgaaaacagcgcgttgtacgagaacgatccgaacctgcggattcgcgtgtcgtacgacaaggacgcgcgcaccatcacgatcgacgacaacggcatcggcatgagccgcgacgaagcgatcgccaacctcggcacgatcgcgcgctcgggcaccaaggaattcttcggcaagctctccggcgaccagcagaaagacgcggcgctgatcggccagttcggtgtgggcttctattcgggctttatcgtcgcggacaggatcaccgtggaaacccgccgcgccggtttgccggcttcggaaggcgtgcgctgggaaagcgcgggcgagggcgatttcgcggtcgagcagatcgagcgcgccgcgcgcggcacgaccatcacgctgcatctgcgtgcggatgaagacgaactgctgtcgtcgcatcgtctgaaatcgatcattcagaagtactccgaccacgtcgcgctgccgatcctgatgaagaaggaagagtgggacgcggaaaagagcgcgatggtcacgaaagacgaagacgagaccgtcaaccaggccagcgcgttgtggacgcgttcgaagagcgacatcaccgacgagcagtacaagcagttctatcagcacctctcgcacgatcatcaggacccgctcacgtggacgcataaccgtgtcgaaggccgcagcgagtacacgcaactgctgtacgtgccgacccacgcgccgttcgacatgttcaaccgcgatcatcgcggcggcctgaagctgtacgtgaagcgtgtgttcatcatggacgacgccgagcaactgctgcccgcgtatctgcgtttcgtgaagggcgtggtcgattcggcggatctgccgctgaacgtgtcgcgcgaaattctccaggaaagccgcgacgtgaaggcgatccgcgaaggcgtgaccaagcgcgtgctgtccatgctcgaagatctggccaattcggataacgaggcggacaaggaaaagtacgccggtttctggaaggaattcggccaggtgctgaaagaaggcattggcgaagacttcgccaatcgcgagcggatcgccaaactcctgcgctttgcgtcgacgcatacggacacgcctgagcagaccgtgtcgctcgccgactacgtcgcgcgcatgaagcccgagcagaccaagatctactacgtcaccgccgacacctggcaggccgcgacccacagcccgcacctcgaagtgttccgcaagaagggcgtggaagtgctgttgctgaccgaccgcgtggatgaatggatcctgtcgttcctgaccgagttcgaaggcaagccgctgcaaagcgtggcacgcggcgatctcgatctgggcgcgctgaacgacgaagaaaaagaggcgcaggaaaaggttagcgaagagttcaaaccgctcgtcgagaagatgaaggaagcgctgaaggacaaggccaaggacgtgcgcctcacgttccgcctgaccgattcgccgtcctgtctcgttgccgacgacggcgaaatgagcggctatctgcaacgcatgctgaaggccgcgggccagcaggcgccttcgttccatccgattctcgaggtgaatccggagcacgcgctggtgaagggcctgcatgcggacagcgcgaacttcgacgactggtgccatttgctgttcgaccaggctttgctcgccgaaggtggcgcgctggaagatccggcgagcttcgtgaagcgcaccaatgcgctgctg

SEQ ID NO: 28281 - DNA, 933 bp, Burkholderia fungorum
accgcactcgatcaactcaagcaatacaccactgtcgtggccgataccggcgacttccagcaactggcccagtacaagccgcaagacgccaccaccaatccgtcgctgatcctgaaagcggtgcagaaagacgactacaagccgttgctggaaaagaccgtcaaggcgcacgcgtcgaaaccggtcggcgcgatcatcgaccagttgctgatcgcattcggcaccgaaattctcaagatcattccgggccgtgtctcgaccgaagtcgatgcgcgcctgtcgttcgacacggaaggctcgatcgccaagggccgcgaactgatcgcgctgtacaaagagcacggcatcggccgggagcgcgtgctaatcaaactcgcttccacgtgggaaggcattcgcgcggcggaagtgctgcaaaaggaaggcattcactgcaacatgacgctgctgttctcgctcgcccaggccgccgcctgcgccgaagcgggtgcgcagttgatctcgccgttcgtcggccggatttacgactggtacaaaaagaacgccggcagcgcgtgggacgaagcgaaagacggcggcgccaacgatccgggcgtcaaatccgtgcgccgcatctacgcgtactacaagaagttcggctacaagaccgaggtgatgggcgcgagcttccgcacgccgggccagattctggaactggccggctgcgatctgctgaccatcagcccggatctgctgcaaaagctgcatgagagcaccgagaaggtggagcgcaagctgtcgccggatatcgccaaagaatcggacatcgaacgtgtgccggtcgacgagtcgtcgttccgtttcctcgtcaacgacgaagcgatggccaccgaaaaactcgccgaaggtatccgcgccttcgccgccgacgcaatcaagctggaaaagctgatc

SEQ ID NO: 28282 - DNA, 1197 bp, Burkholderia fungorum
atgcagatcggccaacggatcggcacgcccctttctgaatccgccacgcgtgtcatgctgctcggcgccggcgagctcggcaaggaagtgatcatcgcgctgcagcggctgggcgtcgaagtgatcgccgtcgaccgttacccgaatgcgcctggccaccaggtggcgcaccgcgcgcacgtgatcgacatgaccgatcgcgccgcgctgcgcgcgctggtggaacaggagcggccgcatctgatcgtccccgagatcgaggcgatcgcgacggacgaactcgccgccatcgaaagcgccggtctcgccgaagtgatcccgaccgcgcgcgccacgcagctcaccatgaaccgcgaaggcatccgccgtctcgccgctgaggaactcggcctgccgacctcgccgtacgcgttcgccgattcgctcgacgaactgcgcgcgggcatcgccaaagtcggctatccgtgcgtggtgaagccggtcatgtcgtcatcgggcaagggccagtcggtgctgcgcggcgacgccgacgtcgaacccgcatggcaatacgcgatggccggcggccgcgtgaatcacggccgtgtgatcgtcgaaggcttcatcgacttcgaatacgaaatcacgcaattgactgtgcgcgcgatcaaccccgcgagcggcgaggtcagcacgtatttctgcgacccgatcggccacgtgcaggtggcgggcgactacgtggaatcgtggcagccacagcccatgagcccgctcgcgctcgaacgttcgcgtgaagtggcgcacaaggtgacggccgcgctcggcgggcgcggcctgttcggcgtggaacttttcgtgcgcggcgatgacgtatggttttcggaagtgagtccgcgtccgcacgacactggtcttgtcacgctgtgctcgcaacgcttttcggaattcgaactgcacgcgcgcgcgatcctcggtttgccggtggatacgtcgctgcgggcgccgggtgcgtcggcggtgatttatggcgggctcgacgaggccggcattgcgttcgaaggcgtggccgcggcgttggcggtgccgaacgcggacctgcgcctgttcggcaagccggagagcttcgtcaagcgccgcatgggcgtggcgctcgccaccggcgagaccaccgacgaagcccgctcgcgcgcgaagcaggctgcggcggcggtgcgg

SEQ ID NO: 28283 - DNA, 1419 bp, Burkholderia fungorum
ttgcaaaagacttacccgtactacctcgccaacgttgcggtggccgccaacaccgatctcgaagtcaccgataaattcagcggcgaggtcgccacgcgtgtcgcgatggccgacgccgccgcgatcgatcaggcgatcggccatgccgtcgacgccatgccggccttgcgcgctttcccgccgttcaagcgccaggcggtgctcgaacattgcgtgaagcgctttcgcgaacgctacgacgaactggcgctcgcgctgtgcattgaagccggcaagccgatcaacgactcgaaaggcgaggtcacgcggctgatcgatacgttcaaggtggcagcggaggaagcggtgcgcatcgacggggagatcgtcaatctggagatttcgccgcgcgccaagggctatcacggctacgtgaagcgggtgccgatcggcccgtgttcgtttatttcgccgttcaattttccgctgaacctgactgcgcacaaggtcgcgccggccatcgcggccggcgtgccgttcgtgttgaagccggcgagccgcacgccggtcggcgcgctcatcatgggcgagattctcgcggaaaccgacctgccgaagggcgcattctcgattctgcccgcccatcgcgacggcgccgatctgttcaccaccgacgagcgcttcaaattgctgtccttcaccggctcgcccgcggtgggctgggaactgaagaagaaggcaggcaagaaaaaggtgattctggaattgggcggcaacgcggcggcgatcgtcgacggcgatcagggcgagaagctcgactatgtggttgaccggctcgcgttcggcgcgttctaccagtcgggacagagctgcatcggcgtgcagcggattctggtgcacgccaaggtctatgatgcgttgcgcgagaagctgatcgccagaacgaagtcgctggtgatgggcgatccgaaagacgaaaagacctttgtcgggccgatgatctcggaatcggagtccagacgccttgccggctggatggaaagcgcggtgcaggcgggcgcgaaaatcgtcgcgggcggcaaggtggagggcgcgatgttcgaggccacgctgctcgaaggcgtgcagcgcgacacggatctataccgcaaggaagccttcgggccggtggcgattctggagcgtttcgacgatttcggcgctgcgcttgcgaccgtcaacgacagcgacttcggcctgcaagcgggcgtgttcacggattcgctcgcgcatgcgcatcgcgcgtgggacgagctcgaagtgggcggcgtggtgatcaacgacgtgccgtcgttccgggtcgacaacatgccgtatggcggcgtgaaggattccgggctggggcgtgaaggcgttcgctacgcgatcgaagacatgaccgagatgcgcctgatggtgatg

SEQ ID NO: 28284 - DNA, 1395 bp, Burkholderia fungorum
acttttgatcaattcggcctcgcgcccgacatcctgaaagccgtcaaagagtcgggctacaccatccccacgccgatccaggagcaggcgattcccgtcgtgctggccggccgtgacatgatgggcgccgcgcaaaccggcaccggcaagaccgcgagcttctcgctgccgatcatccagcgcctgctgccgcaggcgagcacgagcgcttcgcccgcccgccatccggtgcgcgcgctgatcctcacgccgacccgcgagttggccgaccaggtcgccgcgaacgtgcaggcctatgcgaagcacacggcgctgcgcagcgccgtggtgttcggcggggtggatatgaatccgcaatccgagcaactgcgccgcggcgtcgagattctgatcgccacgccgggccgcctgctcgatcatgtgcagcagaaaaccgccaacctgggccaggtgcagattctcgtgctcgacgaagccgaccgcatgctcgacatgggtttcctgccggatctgcagcgcattctgaacctgctgccgaaagaacgtcagacgctgctgttttcggccaccttctcgggcgaaatcaagaagctcgccgccacctatctgcgcgacccgcagactatcgaagtcgcgcgcagcaattcgactgcgaccaacgtgaggcagatcgtctatgaagtcgccgagggcgacaagaccggcgcggtcgtgcaactgattcgcgagcgcggcctcaagcaggttatcgtgttctgcaacagcaagatcggcgcgagccgtctctcgcgcagcctggagcgcgacggcgtgatcgcgaccgcgattcacggcgaccgctcgcagaatgaacggatgcaggcgctcgacgcgttcaagcgcggcgagatcgaagcgctggtggcaacagatgtcgccgcgcgcggcctggatatcgccgaactgccggcggtgatcaacttcgatctgcccttcaacgcggaagactacgtgcatcggatcggccgtaccggccgcgcgggcgcctcgggcgacgcgttgtcgctgtgcagcccgaacgagcgcaagcagcttgccgatatcgaaaagctgatcaagcgcccgctggaggtgcagcgcctgacggtggaagcgccggtgcggcatcaccatgaagagcgcgcgccgcggcgcgagcgtagcagcgaggggcgcgaagatcggggcggccgccgccgctcgggcgcttcgtcgtcgggttcgttcgaccggccgcatcatcatcgcgcgcagcctgtggatgatttcttcctgaagccttatgagccgtcgcctgcttcggtgcgcaaggtcgaggaggccgacgcggcttcggccgcgccgcagaagccggcttccaagcagccgttggcagcg

SEQ ID NO: 28285 - DNA, 1917 bp, Burkholderia fungorum
ctcgacaccgccatcacacgcgccaccgatgcgatcctcgccgcgcaaaagccggacggccactgggtctacgaactcgaagccgacgcgacgattcccgccgaatacgtgctgctggtccactatctcggcgaaacgccgaacgtggaactggagcagaagatcgcgcgctatctgcgccgcatccagttgcccgacggcggctggccgctctttaccgatggcgcgcccgacgtcagcgccagcgtcaaggcgtacttcgcgctgaagatgatcggcgacccggcggacgcggagcacatggtccgcgcacgcgaggcgattctcgccaacggcggcgccgaagccgtgaatgtgttcacgcggattctgctcgcgctgttcggcgtggtgtcatggcgcgcggtgcccatgatgcccgtcgagatcatgttgttgcccatgtggttcccgttccatctctcgaaggtgtcctactgggcgcgtaccgtgatcgtgccgctgctggtgctcaatgcgaagcggccgctggcgcgcaacccgcgccgcgtgcggatagacgagctgttccgcggtgcgccggtcaacaccggcccgcgcgaccgggcgccgcatcagcatgccgggtggttccggtttttcagtggcgtggacatgctgctgcgcgcggtggacggcctgttcccgaaagccacgcgagagcgcgcggtgcgcgcggcggtggccttcgtcgatgaacggctgaacggcgaagacgggctcggcgcgattttcccggcgatggcgaactcggtgatgatgtacgacgtgctcggctatccggccgatcacccgaatcgcgcaatagctcgccagtcgatcgaaaagctgctcgttatcaaggatgacgaagcatattgccagccgtgtctgtcgccggtctgggacacctcgctcgtcgcgcatgcgctgctcgaaaccggcgaggctcgtgccgagcaggccgccgaacgtgggctcgcgtggctgcgtccgctgcagattctcgacgtgcgcggcgactggatttcgcgccgtccgaatgtgcggccgggcggttgggcattccagtacaacaacgactactacccggacgtcgatgacacggcggtggtggtcatggccatgcatcgctcggcggcgctcacgcattccgaggtcgatcgcgaagccatagcgcgggcgcgcgaatgggtggtcggcatgcagagcagcgacggcggctggggtgcgttcgagccggaaaacacgcagtactacctgaacaacattccgttctccgaccacggcgccttgctcgatccgccgaccgcggacgtctccggccgctgtctgtcgatgctcgcgcaactcggcgaactgccgcagggcagcgagccggcgcaacgcgcgttcgcgtacatgctgaaggaacaggagccggacggcagctggtatggccgctggggtctgaactacatctacgggacgtggacggcgctgtgttcgctgaacgcagccggcatgccgcacgacgacccgcgcatgaagcgcgccgcgaagtggcttctgtcgatccagaacgaagacggcgggtggggcgagggcggcgagagctacaagctcgactaccacggctatgaacgcgcgccgagcacggcttcgcaaacggcgtgggcgctgatgggcctgatggcggcgggcgaggtcaatcacgaagcggtggcgcgcggcgtcgcgtatttgcagcgggaacagcgcgagcatggcctgtgggacgaaacgcgtttcaccgccaccggcttcccgcgcgtcttctatctgcgctaccacggctatcgcaagttcttcccgctgtgggccctggcgcgcttccgccatctgaagcgtcatggcctgacgcgcgtcgcggtcgggatg

SEQ ID NO: 28286 - DNA, 237 bp, Burkholderia fungorum
tacgtgcgggtgcgcggcaccgtgcagggcgtgggctttcgccacgcgaccgtgcggcaggcccacgcgctcggaatcaagggatgggtggcgaatctcgacgacggttccgtcgaagccatgttgcaaggctcggccaaccaggtcgaccgcatgttgtcttggctgcgtcacggaccgccggcggcgcgcgtgaccgaggtcagcggcgaagagcgctcgaccgaaaagcgttac

SEQ ID NO: 28287 - DNA, 825 bp, Burkholderia fungorum
atgttctcaggtatctggttgcccatcgtcacgccgctgcgcaacggcgaagtcgacatcgatgcattgcagcgtctcgccgactactattcgcgcacggagatcgccggcattgtcgcgttgagtacaaccggcgaagcagccttgctacaggacgccgagcgtctcaccgtattgcaggcgctaagcgatgtagtccgctcccgtctgccgatgctgatcggcgtcggcggatcgagtacacgcgacgtcctgcacgatatccagcgctacgagcgctgggactgcgcgggctatctggtctccgcgccctcatacatatgtccggatcaggccggcgtgcggtggcatttcgagcaggttgccggcgcgaccgggcgtcctgtcgtcctctataacgtgccacaccgaaccggcgtgtcgatcgcgccggataccgtcgcgcggctcgtcgagtgcggcaacatcgtcgcgatcaaggagtgcgtgaaagagcacttcagcccgttgagcgccctgccgatcaacgtcctgtgcggcaccgacgaagccctcgacgactgtctgcatcacggcggcacaggcggcattctcgccagcgcgcacgtctgcgccgacctgctggttgcgttccaggatctgctgcaagcaggacgcgacgtggatgcacgaaatctgttcgccagcttgctgccggttttacggctcctgttcgccgcgcccaatccgtccgccatcaaggccatgctcgccttcgatcattcgctcagcgacgaaacacgcatgccggtctcgcgcgcatcggcgcaactggtcgagcgtctg

SEQ ID NO: 28288 - DNA, 1200 bp, Burkholderia fungorum
tacgtcgccggcggtgtagtcggatttctcgtcaagacgggctgggcgaacatgcactctgcggcgatgttcgtgtcggccagtgtggctgggatggcgctcggcacgtggctcgcaggggtattaggcgaccgctttggccgtcggtttacgtatcagttcaatctgctgctgtttggtctggcgtcatttgcagccgcggtcgtttcgtcgatggatcagttgattgtcgcccgcttcgtcatggggataggcttgggtgcggaagtcgtcgtgagctatggcaccctggtcgaatatataccaccggctcaccggggcagatggtccagcggcctgtcgctatgcggtaatgcggcgctattcgtagccgcgctggtgggttatttcgtcataccggaccttggctggcggtggctgttcggtggagtcggcgttgccgccctgatcatctggtacatgcgcaaggcagttcccgagtccccgagatggctcgaatcccagggacgattcgaagaagcagaccgtatcctggacgacattgaacaggaactcgcgtacgtcggacagccgggagaagccgctgttcccgcctatgcagtggtgccggacctgccccgacgcatgctggttccgcggtttatcatcggcattatgatgagtgtggcgggtaacgcggcattctacggattgattgtctggctaccgaccttcttcttcaggcagggatttacggttggaagctcgctcggatattcgatggtcatgtccgccggaggtcctgcaggtgcgctggttggcatggctatcgccgatcgtgtccgccgcaagcgtgcaatcatcgttctgtcgatcgtggctgcattgcttggtcttgtctatccgctctgcaagaccccgttgagcgttctggttaccggctttctgcttgtgagcgcgctgtatgcgttcgtcgccgtggcgtgggcgtcatacctgccggagctttttcctacaagaatccggctgcgtgcctcggccgtatgcaacgtgaccggacggcttgcagcgatcgccatgccattcgcggtcgtccagctttacgcgaaattcggtgtgtttggcgtggtgggcgcattgggggggatcctgcttgcccaggctgcggtgattgcgttgctgggcatcgacaccaacaacgtctctcttgaggaactaacc

SEQ ID NO: 28289 - DNA, 1131 bp, Burkholderia fungorum
atgccagattccttcactgacgagcagcgaatgatccgcgacgcggcccgcgacttcgccacgcaatgcctggcgccgcacgcggcgaagtgggatcgtgacggcgacattccacaaaatatcgtttcgcagctcggtgagctgggcctgatgggaatgactgttccagcggaatggggcggtacctatacggattacgtcgcctatgcgctggccgttgaagaaatcgcggccggttgtgccgcatgcgcaacgatgatgagcgtgcacaattccgtcggatgcagccctatcctgaactttggaaccgacgagcagaagtcgctctatctggcggatctcgccagtgggcgcgcgatcggcgcgttttgcctgacggagcctcaagccggctcggaggcgcacaatctgcgcacccgtgcggtgttgcgcgacggaacgtgggttctcaacgggagcaaacagttcgtgaccaatggtcggcgtgccgcagtggccattgtgtttgcggtcacggatccggatgccggcaagcgcggcatctccgcgtttatcgtgccgacccatacgccggggttcaaggtcggcaagccggagaaaaagttggggatacgcgcatcggatacctgcccggtcacgctggaagactgcgccgtgccggagagcaccctgcttggccgtcgtggagaagggttgaagatcgcgttgtcgaatctggagggcggccggatcggcattgcagcccaggcgattggtatcgcgcgtgcagcatttgacgccgcacgctcatatgcagcgcagcggatccagttcggaaaaccgatacgggaacaccagtctgtcgcgaacatgctggctgacatgattacccgtctgaacgccgcacgcctgctcgttcatcatgcggcgcgtctgcgcagcgccgggctaccctgtctgtcggaagcgtcccaggcgaagctgtatgcatcggaagtggccgaggaggtttgctcacaagcgatccagatccacgggggatacggctaccttgaagactatcctgtggaacggcattaccgggacgcccggattacgcagatttacgaaggcaccagcgaagtacagcgcatggttatcgcaaggcagctt

SEQ ID NO: 28290 - DNA, 1772 bp, Burkholderia fungorum
tacagatcgcgggggtgctcggcggtggcgtggcaccgatgattgcgaccgcgctgctcgcgctcggtagcggcaatccgcactacgtggtggcctatatggtcgcgctggggatcgtcgcgttgatctgcacgctgttgatgcgtgcgggtgcggagtagcggtgaccttcttgcggtgacgatttcgcgctgctgcgagaaggcggcaacgcgtaaggttcaccgtctgtcttccttttccggagcttgtccggacctgcaactaaattgagagagtgaaccatgaatgctgtgacccgggaatccagtgggaacattggcacggcgaggctgctgattgccggcgagttcgtcgaatcgaagaccaccgagtggcgtgatattgtcaacccggccacgcaggaagtgctggcgcgcgtgccatttgcgacggccgaagaagtggatgcagcaatccgttcggcgcacgccgcgttcgccacctggaagaacacgccgatcggcgcgcgcatgcgcatcatgctgaagtaccaggcgctgattcgggaacatatgccgcgtattgcaaaaacgctcagcgcggagcagggcaagacgattcccgatgccgaaggcgatatcttccggggtctggaagtcgtcgagcacgcggcctcgatcggcacgctacagcagggcgaattcgccgagaacgtcgcgggcggcgttgacacatacacgctgcgccagccgatcggcgtgtgtgtcggtatcacgccgttcaattttcccgcgatgatcccgctgtggatgttcccgatggccatcgtctgcggcaatacgttcgtgctgaagccctcggagcaggacccgttgtcgaccatgcaactcgtcgaactcgcgctcgaagccggcgtgcccaagggtgtgctgaacgtcgtgcatggcggcaaggacgtggtcgatgcgctctgcacgcacgagctcgtgaaagcgatttcattcgtcggctcgacggcggtgggcacgcatgtgtatcgcctcggcagcgagcacggcaagcgcgttcaatcgatgatgggcgcgaagaatcacgcggtggtgttgcccgatgcgaaccgtgaacagacgttgaacgcactggccggcgcgggttttggtgcggcaggccaacgctgcatggcgacctcggtggtggtgctggtgggcgcggcgcagcaatggttgccggatctggtggcgaaggcgaagacgctcaaggtcaacgcgggcaacgaaccgaacacggacattggtccggtggtctcgcgcgcggcgaagcagcgcattctcgacctgatcgaaaccggcgttaaagagggggccacgctggcactcgacggccgcgacgtgaaagtggcgggttacgagcaaggcaacttcatcggtccgacggtcttcaccgacgtcactacggacatggaaatttaccgccaggaaatcttcggtccggtgctggtggtgctgaatgccgcgacgctcgatgacgcgatcgcgttggtcaaccgcaacccgttcggcaatggtgtgggcctcttcacgcagagcggcgctgcggcgcgcaagttccagagcgagatcgacatcggccaggtcggcatcaacattccgattccggtgccagtgccgttcttcagcttcaccggctcgcgtggttcgaagctcggcgacctcggcccctatggcaaacaggtcgtgcagttctacacgcaaaccaagaccgtcacggctcgctggttcgacgacgatacg

SEQ ID NO: 28291 - DNA, 525 bp, Burkholderia fungorum
agaaataccatgagcaccgaaaaaatcaatctcgacattcacaagattctcacgctgctgccgcatcgttatccgattctgctcgtcgatcgggtgctcgaactcgagccgcacaagcgcatcaaggcgctgaagaacgtgtcgatcaacgagccgtacttcatgggtcactttccgagccgtcccgtgatgccgggcgtgctgattctcgaagcgctcgcgcaggccgcggcgctgctgacgttctcggaagaaccgcacgatcccggcaacacgctgtacctgttcgtcggcatcgacaatgcgcgcttcaaacgcgtagtcgagccgggcgaccagctgatcctgaacgcaacgttcgagcggcatatgcgcggcatctggaagttcagggcgtgcgcggaagtggataatgtggttgcggcgtcagcggatctgatctgcaccgtgcgcaacactgatgcggacgcacggtagttagcacggcgctgcaccgtcatgcgtccagtgagtccccaggccgga

SEQ ID NO: 28292 - DNA, 987 bp, Burkholderia fungorum
atggcacgcaagatcacattttctcaggcaatcaacgaagcactgagtcaggaaatggcccgcgatgaaaccgtcatcgtgatgggcgaggacaacgcgggcggcgccggctccccaggcgagcaggacgcgtggggcggcgtactcggcgtcacgaagggcctgtttcacaagtatccgggccgcgtgctcgatacgccgctctccgagggtggctatatcggtgcggcggtgggcgcggccgcgtgcggcatgcggccggtggcggagttgatgttcatcgacttcatgggcgtgtgcttcgaccagatattcaatcaggccgccaagtttcgctatatgttcggcggcaaggcggtgacgccagtcgtgattcgcgccatgcagggcgccggcttgcgcgcggccgcacagcactcgcagatgctgacctcgctgtttactcacataccgggcctgaaagtggtgtgcccctccacaccgtacgacgcgaaaggcctgttgatccaggcgatccgcgacaacgacccggtgattttctgcgagcacaagctgctctatagccgcgaaggcgacgtgcccgaagagtcgtatgcgattccgttcggcgaggcgaacgtcgtgcgtgacggcgacgacgccacgatcgtcacgtacggccgcatggtgcattacgccacggaagccgcggaaaagctcgcgaaagacggtatcgaagtcgaggtgatcgatctgcgcaccacgtcgccgctcgacgaagacaccattctcgaaagcgccaaccgcacgggccgtgtcgtggtagtggacgaagcgaatccacgctgctcgatggccacggacatctcggcgctgatcgcccaacgcgcatttcgctctctgaaggcgccgatcgaaatggtgaccgcgccgcatacgcccacgccgtttgccggcgtgctcgaagacatgtacatcccttcggcccggcagattgccgacgccgtg

SEQ ID NO: 28293 - DNA, 969 bp, Burkholderia fungorum
acagagttgagcaaggacgaactgctgaaggcgtatcgcatgatgcgcacgatccgtgagttcgaggagcgcctgcacgtcgaattcgcgaccggcgaaatacccggcttcgtgcacctgtatgcgggcgaggaagcgtcggcggtcggcacgatgctgcatctgaacgacgcggactacgtggcgaccacgcaccgcggccacggccactgcatcgccaaaggcgtcgacgtgcgcggcatgatggccgaaatctacggccgcaagaccggcgtctgccacggcaagggcggctcgatgcatatcgccgacctgtcgaagggcatgctcggcgcgaacggcattgtcggcgcgggtggtccgctgatttgcggcgcggcgttggcggcgaagtacaagaagtcgggtggcgtgggcgtgtgtttcttcggcgacggagcctcgaatcagggcgtgattttcgaatcgatgaacctggcttcggtgtggcggctgcctgcgattttcgtggcggagaacaacggctacgccgaagcgacttcttcgacgtggtccgtcgcgaccgacaacatcgcggatcgcgcgagcggcttcggcatgccgggtgtgatcgtggacggtttcgatttcttcgcggtgcacgaagcgctcggcgaggcgatcgagcgggcgcgtcacggcggcgggccgacgctcgtcgaagtgaaattctcgcgctatttcggccacttcgaaggcgatgcgcaaacctatcgcgcgccgggagaagtgcagaaactgcgcgacgagaaagattgcctgaagcgtttcgaagagcgcgtggtgcgggcgggcatgctcagcgcggatcaattgcgcggcgtggatgcggaagtaaagaccttgatcgacacagccgtgaccgaagccaaggccgctccgctgccgactgccgaagacctgctgagcgacgtctacgtgtcctatccg

SEQ ID NO: 28294 - DNA, 1677 bp, Burkholderia fungorum
cttgcaatgagcgtggccgttgccgtcagtctggtattcggatcggccgcagccgccgacgattacccagccgtcacctatgagcgtttgacagctgcgcagagcgaccccggctggctcacgtactaccgcacgtacaacggccaggcgcattcgccgctcaagcagatcgacaccgcgaacgtgaagaacctcaagcaggtctggagctacaagtttccggcggatctgcagcagggtttcgaagccacgccgatcgtcaacggacgctaccttttcgtgaccacgccgaaagacaacgtctatgcattcgatgcggcgaccggcaagcagttgtggaagttcgaaccgaagctcggtgcggaatcgttcaagacggcatgttgcgacgtgatcaaccgcggtgtggcgctgtacggcaagaatgtctacgtcgcgatgctgagcggcgacgtcgtcgcgctcgacgcgcagacaggcgcgctcgcctggcgcaagcagatgttcgagccgggtctcggctacgcgttctcgctggcgccgctcgcgctcgacggcgcactggtggtgggtagcgcaggcggcgaatacggcgcgcgcggttttatcgcggcattgaatccggataacggcaatgtgctatggaagcgcttcacggtgcccgcggccggcgagaagggcgcagacacgtggccgaacggcatgcaggaacacggcggcgcgccggcctggctgacgggcacttacgacgcagcatcgaagaccctttactggggcgtgggcaaccccggcccgtggctcgccgatctgcgaccgggcgacaacctctattccgattcgctactcgcactcgatccgaaaaccggcgatctcaaatggcactaccagtacacgaaacatgacacatgggactacgacggcgtgaatacgccggtgctcgcgacgatcaggtatcaggacaaggagtacgacgccatcatccacgcggaccgcaacggcttcttccacgcgatcgatcgcggcaccggcaagctgatctatgcgaagccgttcgtgacggcgacttcggtgacgggttataccgcagatggcgcgccgattcaggatgcgtcgaaatacccgaaggccggcacgacgatcgaaacctgcccgagcttcctcggcggcaaaaactggtggtcgatttcatacgacccggacaagcacatcgcagtcgttccggctttgcacgcctgcatgtcgctgtcgggcaaatcggtgaactacatggaaggcttgccgtatctcggcgaaggtttcgaaatcaaaccggagcccggcagcaagggttatggcgagttgcaggcgatcaacgtcgacacgggcaagaaagtctggagccactggagcaagctgccgtggaacggtggcgtagcgaccacggccggtggtcttgcctttagcggctcgctcgacggccacctgtacgcattcgatgaaacaaccggcaaggtgttgtggcagagcccgaagctggcaagcgggatcgtcgctcaaccttcggtgttcgaggtcgacggcaaggagtatgtcgccattctcgcgggctacggcggcgcgaatccgatctggggcgggccgatggcgaaggcggcggagaaggtcccgcgcggcggcacgttgtacgtgtttgcgctc

SEQ ID NO: 28295 - DNA, 1479 bp, Burkholderia fungorum
ccgtatgcgcggcaatacggcaatttcataggtggcgagtgggttcctccagtacgcggcgagtacttcgacaatgtgtcgccgatcaccggcgaaccctttacgtcgattccccgttcaactgaagaagatatcgaactcgctctggatgcggctcaccgcgcccgcaaagcctgggccgatactgcacctgctctgcgcgcgaacgtgttgaaccgtattgcggaccgcatggagcagaacctctcgcgtatcgcgttttccgaatcgatcgacaacggcaagccgatccgcgaaacgctcgccgccgacattccactcgcgatcgaccacttccgctacttcgccagttgcattcgcgcacaggaaggaacgctctccgagatcgatcacgacacagttgcctatcactttcacgaaccgctcggcgtagtcggccagatcattccgtggaatttcccgatcctgatggccgtgtggaagctcgcgcctgcactcgccgccggcaactgcgtggtgctcaagcctgccgagcaaacacccgcgtcgattctcgtgctgatcgaactgattcaggatttgctgccgccgggtgtgctgaatgtggtcaatggtttcggtctcgaagccggcaaaccgctggcgtcgagcaagcgtatcgccaagatcgcgtttaccggcgagacttcgaccggccgcctgatcatgcagtacgcgagccagaacatcattcccgtgacgctcgaactcggcggcaagagcccgaacattttcttcgccgatgtggtcgatcaggacgatggctacttcgacaaggcactcgaaggcttcgcgatgtttgcgctgaatcagggcgaggtgtgtacctgtccgtcgcgtgtattgatcgatgaaaagatttacgaccgcttcatggaacgcgcgttaaagcgcgtcgcggcgattgcgcaaggacatccgctcgaccccaggacgatgatcggcgcgcaggcttcgcaggaacaactcgaaaagatcctctcttatgtggatctcggcaaacaggaaggcgccgaatgcctgattggcggcgaacgcaatacgctgggcggtgagttgagcaaaggctattacgtgaagccgaccgtatttcgcggcaacaacaagatgcgcatcttccaggaagagatcttcggaccggtggtgtcagtcacgacgttcaggaccgaagaagaggcactcgaaatcgccaacgattcgctctacggcctgggcgccggcgtgtggacgcgcgacggtacacgcgcgtatcgcttcggcaggcagattcaggcaggccgcgtgtggaccaattgctatcacgcctatccggcgcatgcggcgttcggcggctacaaacagtcgggcattggccgcgaaacgcacaagatgatgctcgaccattatcagcagaccaagaatctgctcgtgagctatagcgagcagccgctgggctttttc

SEQ ID NO: 28296 - DNA, 1416 bp, Burkholderia fungorum
gcccggagccgcatcctgaacctgcattccgattcattgattccggagcctgtcatgctgcacgcagcccagttctatatcgacggaggttgggtcgaacccacgtcacccgtctggttcgatatcgtcgatccgtcgacggaaacaccctttgaaaaactcgcgttgggcaacgcacaagatgtcgatcgcgccgtcgccgccgcacgccgcgcgtttgcaagctggtcggcgacgagcgtggccgaccgcgtcgcattgctcaagcgcatcgtcactatctacgagcgacgctacgacgagttcgccgagttgatgcgccgcgaaatgggcgcaccgatcacgttcgcgcgcaacggtcaggcggcacgcggccccgcgcatctgaatgcgctgatcgacgtgctcgaacgcttcgaattcgaggaacagcgcggcagtacgcgcatcgtgctggaaccgatcggcgtgtgcggtctgatcacgccgtggaactggccggtcaaccagatcgtcgtgaagatcgcaccggcactcgcggcgggttgcacgatggtgctcaagccgagcgagtattcgccgctgagcgcgctgctgtttgccgacgtgctcgacgaagccggcgtgccggcgggcgtgttcaatctcgtcaacggcgacgggccgggtgtcggttcggctatcgcgagccatccggatatcgacatggtgtcgttcaccggttcgacccgcgccggcgtgctggtcgcgcagtccgcagcggaaacggtcaaacgcgtcgctcaggaactgggcggcaagtcggccaacatcctgctcgacgacgtcgatctggatcaggcggtgacgcgtggcgtggccgcctgcttcacgaactcgggccagtcgtgctcgattccgacccgcatgctggtgccgcgtcatctgatgaacgatgccgcgcagatcgcaaagcgtgccgcgcaagcgtatcggctcggaccgaccgacgacccggccacgcaactcggaccgctcgtcaacgcgaaccagttcaagcgcgtgcaggcgctgatccagatcggcatcgacgaaggcgcgcgtctggtcacgggcggcacgggccggccggacggtatcgacacgggctattacgcacgcccgaccgtgttcgccgatgtcacgccgcaaatgaccatcgcccgcgaagaaattttcggaccggtgctctcgatgattccgtacgactcggaagagcaggcgatcgacattgccaacggcaccgactacggcctcgcggcctacgtgcaatccgcggacctcgcacgggctcgcaaggtcggccgcgcgttgcgtgcgggcggcgtgcatctgaattacccgcctgccgatttcggcgcgccgttcggcggctacaagcgttcgggcaatggccgc

SEQ ID NO: 28297 - DNA, 669 bp, Burkholderia fungorum
ctggtcgtgctgcgtcatggccagtcgatatggaatcgcgccaaccgttttaccggctggagcgacgtcggcctgtccgtgcagggcgtggccgatgcgcagcgtgtcggcgaacggttgcgcgaggcgggctttcgcttcgacctggcggtgacctcggcgctgctgcgcgccaccgatacactcgcgcacgtgctgcgaacccttgagcagccgccgcccagaaccgtgcgctcgtggcggctgaatgaccgccactacggcatgctgaccggcatggaaaaagacgaggccgcgctcgcctatggcgcggagcgggtgcggcaatggcggcgcggtttcgacctggcgccgccggcgctcgatgcagacctgcacgcggcactcgtgcgtgcattgcacgacgacgcgatgccccacgccgacgcgctgccccgcaccgaaagcctgcgcgacacgttgcggcgcgtgctgccgctgtgggacgaatgcgtggcacccgcgctgacgcgtgggcagtcggtgctgatggtggggcatggcaactcgttgcgcgcgcttttcaagcaactcgacaacatcggcgacgacgcgatcgcttcggtcgaggtcgcgcatgcggaaccgttggtcatgaagttcgacgcaacgctctcggtgatttcgcgc

SEQ ID NO: 28298 - DNA, 1428 bp, Burkholderia fungorum
atgaaacgctatcagttgttcatcgacaacgaatgggtggatccgcattcgggcgcctggttcgaaaccgacgatccgttcacgggagagccgtgggcggagattccgcgggccgacccgacggacgcggatcgcgcggttcgcgcggccgaaaaagcgctggagggaccgtggtcgacactctcggcgagtgaacgcgggatgctgatgtacaagctcggcgcgctgatcgagcgtgatgcggaacatctcgcgacgatcgaaagccgcgataacggcaagctctttcgcgatgtactcggccagatgaagtacatggcaaagtactactactatttcggcggtcttgccgacaagattcaaggcgcggtcgtgccgatcgacaagccggggattttcaacttcattcgctatgaaccgatgggtgtcgtactgagcatcacgccctggaactcatcgttgcccttgaccacgtggaagatggcgccggctttatgtgccggcaatacgatagtgtgcaagccatccgaattcacgtcggcgtcgctattcgaacttgcgaaactgttcgtggaggccggatttccacgaggcgtattcaatgtcgtgacgggcttcgggccggagatcggagcgtcgctcgtcagtcatccgggtgtcgcgcggattgcgttcaccggtggcgatgaagcggggcgcaagatttacgcggcggcggcacagcacctgaagcgcgtctctctcgaactgggcggcaagtcgccgaatatcgtgttcgacgatgcggacctcgaccaggcggtcaacggtgtgatctccggcattttttcggcgaccggccagacctgcgtcgcgggttcccgtgtgcttttgcaggaatcgatacacgacgcgttcgtcgaacgggttgcaaagctgaccagggcggcgaaggtcggcaatccgctggatccggcgagcgagatcggaccgatcaccaccaagccgcagttcgagaagattctcggctacatagacatcgcgaccagggaaggcgcgcgctgcgtggccggcggccgcgcgctttccggtcccgggtatggcgcgggccgattcgtcgagccgaccgttttcgtcgatgtgacgaacgacatgcgcatcgcccaggaggaagtgttcggaccggtgctgtcgatcatcagattcaaggacgaagaagacgcgatccggatcggtaacgacatcaaattcggactcgcagccggggtgtggacgaacagcctgcatcgcgcaatgttgatgtcgcaacgcctgaaggcgggcacggtatggatcaataactaccgctccagcagtttcaccacgccttttggcggcttcaagcaaagcggcattggccgcgaaggcggtatcgaatccgtcaaggaattcatggaggccaagagcgtc

SEQ ID NO: 28299 - DNA, 744 bp, Burkholderia fungorum
ctcgccggcaaagtcgcgcttgtcaccggagcgggacgcggcatcggcgcggcgatcgcgtacgcgttcgcgcgcgagggtgcggcggtggtgctggcggaactggatatcgaaaccgcgcagcagacagcggagcacatcaggtcgcagaccggcgcgcgcgtgctcgcggtacacaccgacgtgacgcaggcggcctcggttcaacacgcggtgagcgaggccgaacgcgcattcggcgcgctggacgtgctggtgaacaacgccggcatcaacgtgttctgcgacccgttgaccatgaccgacgacgactggcgccgctgcttcgcggtcgatctcgacggcgtctggaacggttgccgcgcggtgttgccgcgcatggtggagcgcggcgcggggagcatcgtgaatatcgcgtcgacgcactcgttcaagatcattccgggctgctttccgtaccccgtggccaagcacggcgtgatcggcctgacgcgcgcgctcggcatcgaatacgcgccgcgcaatgtgcgggtcaacgcgatcgcgccgggttacatcgaaacgcaattgacgcacgactggtggaacgaacaggccgatccggccgccgcgcagcaggcgacgctggatctgcagccgatgaagcgcatcggccgcccggaagaagtggcgatgacggcggtattcctcgcctcggacgaagcgccgttcatcaacgccacctgcatcacggtggatggcggc

SEQ ID NO: 28300 - DNA, 732 bp, Burkholderia fungorum
agtcttgtcgaccgcacggtgttgatcacgggcggcgcgactggcatcggcgcgtcgttcgtcgagcatttcgcggcgcaaggcgcgcgtgtcgcgttcttcgacattgacacgagcgccggtgaagcgctcgccgacgaactcggcgactcgaagcacaagccgctgtttctgccgtgtgacctgaccgacatcgacgcgctgcaaaaagcaatcgccgacgtgaaggccgccctcggtccgatccaggtgctggtgaacaacgccgcgaacgacaagcgccacaccatcggcgaagtcacgcgcgagtcgttcgacgcgggcatcgcggtgaatatccgccaccagttcttcgcggcgcaggcggtgatggacgacatgaaggcggccaacggcggctcgatcatcaacctcggttcgatcagctggatgctgaagaacggcggctatccggtgtacgtgatgtcgaaggcggcggtgcagggtttgacgcgtggtctcgcgcgcgacctcggccagttcaatatccgcgtcaatacgctggtgccgggctgggtgatgaccgggaagcagaagcgcttgtggctcgacgacgccggccgccggtcgatcaaggaagggcagtgtatcgacgccgagctggaaccggccgatctcgcccgcatggcgctcttcctcgccgccgacgacagcaggatgatcacggcgcaggacctcatcgtggacggaggc

SEQ ID NO: 28301 - DNA, 1518 bp, Burkholderia fungorum
atgaatcacgcagagatgcaatttctgaccaccgaattcccgtacaaaaaacagtatgcgaactttatcggcggcgagtgggtgaagcccgtgggcggcgagtacttcgacaacgtgtcgccgatcaccggcgaggcgttcacctcgatcccccgttcgcgtgaagccgacgtcgaactcgcactggacgccgcgcatcgggcgaaaacggcgtggggcaaaacctcggctgcggatcgcgcgaatatcctgaaccgcattgccgaccgcatggaagcgaacctgcaacgtctcgccgtggccgagacgatcgacaacggcaagccgttgcgcgaaacgacggccgccgacattccgctcgccatcgatcacttccgctatttcgccggcgccgtgcgggcgcaggaaggctcgctctccgagatcgaccacgacacggtggcgtatcactttcatgaaccgctcggcgtagtcggccagatcattccgtggaatttcccgatcctgatggccgtgtggaagctcgcgcccgcactcgccgccggcaactgcgtggtgctcaagcctgccgagcaaacacccgcgtcgatcctcgtgctggtggaactgattcaggatttgctgccgccgggcgtgctgaatgtggtcaatggtttcggtctcgaagccggcaagccgctggcgtcgagcaagcgtatcgccaagattgcgtttaccggcgaaaccaccaccgggcgcctgatcatgcagtacgcgagccagaacatcattcccgtcacgctcgaactcggcggcaagagcccgaatattttcttcgccgacgtgatgaatgaggacgacagttttttcgacaaggcgctcgaaggcttcgcgatgttcgcgctgaatcagggcgaggtgtgtacctgtccgtcgcgcgtattgatcgatgaaaagatttacgaccgcttcatggaacgcgcgttaaagcgcgtcgcggcgattacgcaggggcatccgctcgacacgaagacgatgatcggcgcacaggcctcgcaggagcagctcgaaaaaatcctctcgtatgtggatctcggcaaacaggaaggcgccgaatgtctgattggcggcgaacgcaatgcgctgggcggtgagttgagcaaaggctattacgtgaagccgaccgtatttcgcggcaacaacaagatgcgcattttccaggaagagatcttcggaccggtggtgtcggtcacgactttcaggaacgaagaagaagcgctcgagatcgccaacgacacgctctacggcctgggcgccggcgtatggacgcgcgacggcacacgtgcgtatcgcttcggccggcagattcaggcaggccgcgtgtggaccaactgctatcacgcctatccggcgcatgcggcgttcggcggctacaagcagtccggcattggccgcgagaatcacaagatgatgctcgaccattatcagcagaccaagaacctgctcgtcagttatagcgacaagccgctcggtttcttc

SEQ ID NO: 28302 - DNA, 1362 bp, Burkholderia fungorum
tttagccagctatcgctgccgcccgcgacgctcgccaacctgacgcagctcggctacgtcgagatgacgccgattcaggccgcgagcctgcccatcgcgcttgccggccatgatctgatcgcccaggcgaaaaccggcagcggcaagactgcggcgttttcgctggcgctgctggcgcgcctcgacgtgcgcaactttgccgtgcaggcaatggtgctgtgcccgacgcgcgaactcgccgaccaggtcacgcaggaaatccggcgcctcgcgcgcgccgaagaaaacatcaaggtgctgacgttgtgcggcggcacgccgatgcgtccgcaaacggcgagtctcgaacacggcgcgcacatcgtggtgggcacgccgggccgcatcatggatcacctggagcgcggcagcctgccgctgcagtcgctcaatacgctggtgctcgacgaagcggaccgcatgctcgacatgggtttcttcgacgatatcgccaccgtcgtgaagcaatgcccgaaggaacggcaaacgctgctgttctcggcgacgtatcccgaaggcatcgtcaaactgagccagcaattcctgcgcaatccgaaagaagtcaaactcgcggaacggcacgacaacaccaagatccgtcagcgcttctatgaagtgaccgaagacgagcgtctgcacgcggtcggtctgctgttgaaccactatcgtccggtgagcacgctggcgttctgcaataccaagcagcaatgccgcgatctgctcgacgtgctgcgcgcgcagggttttcatgcgctcgcgctgcatggcgagctcgaccagcgtgaacgcgatcaggtgctgatccagttcgccaatcgcagctgctcggtgctggtggccaccgacgtcgccgcgcgcggtctcgacatcgcgcaactcgaagccgtgatcaacgtcgacgtgacgccggacccggaagtgcatgtgcaccgcatcggccgcacgggccgcgccgatcaggaaggctgggctttgagtctggcgagcatgaacgagatgggccgtgtcggcagtctcgaacaggcgcaaaagcgcgacgtcgaatggcacaagctgtccgaactcacggcgacgagcaatgaaccgctgttgccgcctatggaaacgttgcagattctcggcggccgtaaggaaaagatccgtcccggcgacgtgctcggcgcgctgaccggtgaagcgggtttcgccggctcgcagatcggcaagatcaacgtgacggaaatgtccacctacgtggcggtggagcgcagcgtcgcccgtgaggccgtgcgcaagctcagcgcaggcaaggtgaagggcaagaaggtcaaagtccgcctgatg

SEQ ID NO: 28303 - DNA, 1155 bp, Burkholderia fungorum
cttatgcagagcgccatgcaagcccgctcgaagttgcctgatgtgggcacgacgatttttaccgtgatcggtcaactggccgcgcaatacgatgcgctgaacctgtcgcaaggcgcaccgaatttcgcgccggacgccagcctgatcgacggcgttgctcaggccatgcgcgctggtcataaccagtacgcgccgatggccggcatcgccgctctgcgcgaagcgctcgccgacaaggtcgccacgctgtacggcgtgcactacgacccggccagcgaagtaaccgtgatcgccagcgcgagcgaagggctgtattcgaccatcagcgcattggtgcatccgggcgatgaagtgatctacttcgagccttcgttcgacagctatggcccgatcgtccgcctgcaaggcgccacgcccgtggcgatcaaactgtccctgaacgatttccgggtggactgggacgaggtcgccgccgcgatcacgccaaagacccgcatgatcatcatcaacacgccgcacaatccgaccgcgaccgtgttcagcgaagccgacgtcgcgcgcctgaaggccattacgcgcaataccgatatcgtgattctcgccgacgaggtctacgaacacgtggtgttcgacggcgcgaagcatcaaagcatggcctgccatgccgaactcgcggagcgcagcgtgatcgtttcgtcgttcggcaagtcgtatcacgtgaccggatggcgcgtcggctactgcctcgcacccgctgcgttgatggacgagattcgcaaagtccatcagttcatggtgttttctgccgatacaccaatgcagtacgcgtttgtcgacgcattggccaggcgcgaaagctacctcggcttgtccgcgttctatcagaagaagcgcgatctgctcacggacgcactgcgcgattcgcgcttcgagctgctgccaagcgagggcagcttcttcatgctcgcgcgttttcgcggcttctccgaggaaagcgatagcgatttcgtgctgcgcctgattcgcgatgcgcgcgtcgcgacgattcctctttcagcgttctataccgacggcacggattccggcttgatccgcctgagcttttcgaaggatgatgcgaccttgatcgaaggcgcgcgccgtttgtgccaaatc

SEQ ID NO: 28304 - DNA, 1590 bp, Burkholderia fungorum
atggcagaccgattcgactttgtggtcgtcggcgcgggttcggcgggttgcgtgctcgcgaaccggctttccgaaggcggccgctactcggtatgtctactcgaagccggcccggccgatcgcttcatgtggattcatatccccatcggttatggcaagacgatgtttcacccggtctataactggggcttctataccgatcccgatccgaacatgcacaatcgccggctctactggccgcgcggccgcacgctgggcggcagcagttcgatcaatggcctgatctacgtgcgcgggcagaaggacgattacgaccactgggcgcggctcggcaatcgcggctggggctggcaagactgcctgccgtatttcaggcggctggaacacaacgaattgggcgaggggcccacgcgcggtgtcgacggcccactgtgggcctcgaccatcaaacagcggcatgagctggtcgatgcgttcattgcggcgtcgaattcgttaggcgtggaaaccgtcgaggacttcaatacgggcgatcaggagggcgtcggctactatcagctgactacccgccgcggcttccggtgctcgaccgccgtcgcctatctgaagcccgcgcggcaacgcaggaacctgcgggtggaaaccgatgcgatggcctcgaaaatcctgttcgagggaacccgcgcctgcggggtgcagtatcggcaacacggcgagttgcgggaagtgcgcgccgatcgcgaagtgatcctgactgccggcgcgctgcagtcgcctcaattgctgcaactgtccggcgtgggaccggcggcattgctgcgcgagttcgggattcccgtggtggccaatcgcgcgggcgtcggcgaaaacctgcaggaccatctgcaaatccggctgatctatgaggtcaccaaaccgattacgaccaacgatctgctgcgctcgtggaccgggcgcgccagaatgggcctgcaatgggcgctgatgcgcggcggcccgctcgcggtcggcatcaaccagggcggcatgttctgccgggcgttgccggaggaatcggcgacgccggacatccagtttcatttctccacgttgtcggcggactccgccggcggcaatgttcatgactttcccggctgcacttactcgatctgccagttgcggccgcaatcgcgaggggtggtgcgcattcgcagcgtcgatccgcgtgaagcgccgtccattcagccgaactatctggacaccgatctggaccggcgcacgacgatcgccggtgtgcgtttcgcgcgccgcgtcgcggccgccgagccgatggccgcgctgatgaaacgcgagttgcgcccaggcgcgcatgcgcagaccgacgacgaactgctggatttctgccgggagtacggacagacaattttccatccatctggtacagcaaagatgggcacggccggcgatccgctcgcggtggtcgacgagcgcctgcgcgtgtacggcacacaggggctgcgcgtggtcgattgctcgatcatgcccacgctcgtgtcgggcaatacgaacgtgccgatcgtgatggtggctgaaaaggcgtcggacatgatt

SEQ ID NO: 28305 - DNA, 1572 bp, Burkholderia fungorum
gcatccgacgacgatgaaccggcggcccccgaccggcgcgcgaccgtgctgacgtttcgcgagttgcgagacgactgccgcgtgctggaggcacgtttcaggcaggccggcctgcaacccggcgacgtcgtttcggtgttcatgggcaatggcatccagaccgcccgtctgttgctcgcggccatgtatagcgggctcgtggcgaatccgctgaatctgctttgccagccctcgcaggtgcgctatatcgtcgaccattccgacacgcggatgattttcgccgcgcgcgatacgcaagcggtaatcgataccgccgtcgccgaactgcgcgacgccgggctcagccgcgagatcgcattgatcggcaccgaaccggcgcaggcggcgccgcctgtgctcacgaagcgcgagcctgcgttggctgaagccggcgcgcggatcgcaagcggctccgctgctgccgcagcggcacatgcgttcgcgatgcgcggcgcacggcacgaggaggacaccgcgccaacgcacgaaccggccgcggacgacgttgcgctgctcatgtacacctcgggcaccaccggcacgcccaaaggcgttttgctgacgcatcgcaacctggtcgcaaatgctcgcaatatcagcgccgaacaccggctgacggccgacgatcgcgtgctggcgtcgttgccgctgtatcacatcaacgggcttgtggtgacgctgctcgcgccgctctttcatggcggctcggcggtcatgacgtcgcgcttttcggcgcgcacgttctggcgcgacgtcgcgcttcatgcctgcacgtggatcaacgtggtgccgaccatcgtcgcgtatctgctcaatgccgacgaaacgtgcacctacgatctgtcggcgctgaagttttgccgcagcgcgtcggcggccttgcccgccgatcaccatcgcgcgttcgaggcgcgcttcgggatcggcgtgatcgaaacgatgggcatgaccgaaaccgccgcgccggtttttagcaatccctatgaaatgaaccggcgccgcgtgggcagcgtcggcctgccttcgggcggcgaggcgagggtgatcgaccgtgaagggcgcgagtgcgccgccaatgaatgcggcgagctggtgttgcgcggcgaacaggtgatgggcggctattacaagcggcccgaagagacggcggcggcgtttacggcggatggctggctgcgcaccggcgacctcggttatcgcgacgcggacggctatttctacatcaatggccgcgccaaggaattgatcatcaagggcggcgaaaacattgcgccgcgcgagatcgacgaagcgctgttgcggcatcccgatgtgctggatgccgcggcggtcggcgtgcccgacccggcttacggtcaggagatcgtggcgttcgtggtgccgcgcctgagcgacggacgggccgcgcccgacccggcggacttgcgcgaacactgcatgcgcgaactcggccgttacaagacgccgaaggagttccggttcgtcgacgaactgccgcgcgggccttccggcaaggtgcagcgcctgaagctg

SEQ ID NO: 28306 - DNA, 1206 bp, Burkholderia fungorum
aagacacgccatatcatcctggcggtcatgtgcctgatgtatttcatctcatacatcgatcgggtcaacattgccgtggccggcccattgattcgtcacgagatgggtctcacgaccgttcaactgggactggtgttttcggctttcgcttatccgtatgcggcaatgcagattatcggcggctggctcgccgacaagttcgggccgaaactggtgctgacggtgctctcgctgatctggggcgtggccacgttggccaccggctttgccggcagcgtcacgatgctggtcctgatgcgcttcgcgctcggcgtcggcgaaggcggggcgtttcccaccgcgacgcgggccttcacctactggatgccggtcgccgagcgcggctttgcacaaggcattacccacagtttcgcgcgcctgggcggcgcggtcacgccgccgctggtgctggccgtggtggccacgggcggctggcgcgatgcattcattctgctcggcatcgcgagcctcgcctggactgtgctctacctgttcgtgttcaccaactcgccggaacagaaccggcgcatcacacccgaggaaaccgcggaaatcggctaccgcgccggcgactgcgaccgcgccaaacacgcggccacgccgtggcgcaaactggtgcgccggatgtggctcgtcacctttgtcgacttctgctatggctggttgctgtgggtctatctgacctggttgccgtcctatctgcgcgaatcgcgaggcttcgatctcaagcaactggcgctcttcaccgcgctgccgctgctggcgggagtggtcggcgacacgctcggcggcgtcgtgtcggacaagctttacaagatcaccggccggctgcgctttgcgcgctgtgcggtgctggtggtgggcatgggcggctcgctggtgtttctgctgccgatggtgtccgctaccgatccgctcaccgccgtgtggttcctgtcggcttcgttcttcttcctggaaatcaccaacccggtgctgtggacgttgccgctcgacattgccggcaagtacgcgggcacggccggcggcatgatgaacacgggcttcggtgtcgcggggatgatctcgccggtggcgttcggctttctgatcgagaagaccggcagctacaacgtgccgttcaatatctccgcgggactgctcgcggtcggtatcgtggcggcgcta

SEQ ID NO: 28307 - DNA, 2031 bp, Burkholderia fungorum
atttttcagaacgaagtcgcggaatgcggctatgcctgcctggcaatggtgctctcgcacctgggccgcgccactgaagtgcgcgagctctccgcattcaggccgatatcggcgaacggcctgtccttgatggacctgtacgacgtggcgaccgaattcggcctcgccgtgcaggcttaccggttcgacgtcgcggatctgccgtcggtgaagcgaggctcgattctccactttggtggcgcgcatttcgtggtgttcgagaagtgcggtcatggctatgttcaggttgtcgatcctgccagcggccggcggcgggtttcgatggacacgttcgtggcgagcgtgtccggctatctgctcgaatgctcggccacccctgcaatgccgcgcattcgcgcgaaatcgcaggtgcccggcgcgttggcgcgcgtgcgggcgttgaatcccgcactgcgcaagcaactggcgaaagtcatgttcgtcgcgctgggcagccagttcgcgatcctcgccatgccctatctgggcaatctcgtactcgactacgtggtctcggctgacaacatgaatctgctgggcgtgctggtgctgacatttgccggcatcttcgcggtcggtgcgctcagtcagtatgtggagacgcgtcttgtcgaattgctgcatcagcttacgcagatcaacatgaccgaggggctgctcggccatcttctgcgcaatcccatgtcgtggttcgagaagcgccatgtcggcgacgtgttcgcgcgcatcaaggcgcaggacgaaatcagcgtacacgctacccgaaccgtgacgtcgatgtgcatcgacatcgccgtggggtcgctcgcactcgttctgatgctcgtgcaaagccgcatgctgacggccgtcgcggtgggcatgttcgtcgtctatcttgcggtcgcgctgggtatgttcgcccgcatgcgggacaaccatgcactggtgctcgaaacgtcggcgcgttgcgacgatgcattgatcgagacgatccgcgcggcgagcctgatcaagctcgcccagggcgagacgcgccgcacggcgcttttcatgatcaagtacaaggaatatgtgagcgcgctgctggcgagtaaccggctgaccagcgcgcgcgacgcaatcctcaagctggtccagtacgcggacacgattgcgatcacctggttcgccgcgcggctgatgctggccggcaccgtttccgtgggcgttttctattcgtttctgatctacaagtcgctgatgtccgagcgctttgcacacgcggtcaacggtgcgtttgcctacttcatgctgagtgtgccgactgcgcgtgtggcggatatcgtcgagtgcgaagaggagcgatacacgccgctggccgactgcaaccgcgtgaccgagatgcgcaagttcgagcgggtcgaagtgcggaatgtgacgtttcgctacggcgtgtccgaccagccggttctgcgggatgtgagcatcgatatccggcacggcgacaagatcgccattacggggccgtccggcgcggggaaatcgacgttgttcaaactgctgtcggcttccgaaccgcttcaggaaggccagatagcactgaacggcattgcatggcccaatctgaccgtcgacgagatccggcggcatgccgcacacatgcgtcagggcgacctgattctgcacggctcgattgccgagaacatcaccctgtttgcggccagcatcgacgaagaccgcgtgcacgcgctactcgaagacgtgggcttactacaggacgtcatgcgtctgcccatgcgcacacgaaccgtcattagtgacacgatcgcgaacatttcggcgggccagcggcagcgcttgctattggcgcgcgcgctctatcagggccgcagtctgctgctgctcgacgaaccgacgtccaatctcgatccggcttcggtgcagcacgtcgccgctttgctgcgccggctggattgcacggttgttgtgattacacacgaccggtcactggccgccgcgttcgacgttcgc

SEQ ID NO: 28308 - DNA, 1449 bp, Burkholderia fungorum
atcgaccatctgatcaacggcaaatcgggcgccgcgaaagactacttcgaaaccgtcaatccggccacgcaagaggtgctcgctgaagtagcccgcggcggcgccgaagaagtggacgccgccgtgcgcgccgccaaagacgcgtttcccgcatgggccgccaggcccgccgcggaacgcgcgaagctggtccgcaagctcggcgaattgatcgcgaagaatgtgccggaaatctcggagaccgaaacgaaggacaccgggcagacgatctcgcagacgcgcaagcaactcgtgccgcgcgccgccgacaacttcagctacttcgccgaaatgtgcacgcgtgtcgacggccatacgtatccgaccgatacgcacctgaactacacgctgtttcatccggtcggcgtctgcgcgctgatctcgccgtggaacgtgccgttcatgacggcgacctggaaggtggcgccctgtctcgcgttcggcaatacggccgtgctgaagatgagcgaactgtcgccgctcacggccgcgatgctcggcaatctcgcgctcgaagccggcattcccgccggcgtgctgaacgtggtgcatggcttcggcaaggaaaccggcgaaccgctggtcgcgcatccggacgtgcatgccgtatcgttcaccggatcgacggcgactggcaaccgtatcgtgcaaaccgcagggctgaagaagttttcgatggaacttggcggcaagtcgccgttcgtgattttcgacgacgccgacttcgagcgcgcgctcgacgccgccgtgttcatgatcttctcgaacaacggcgaacgctgcacggcgggttcgcgcattctcgtgcaacggggcatttacgcgcgtttcgccgagcgtttcatcgagcgtgcgaagcgtttgagcgtgggcgatccgctgtccgacagcaccattgtcggccccatgatcagccagggccatctggcgaaagtgcgcagctatatcgaactgggtccgaaagaaggcgcgacgctcgcgtgcggcggtctcgatctgcccgagttgcccgacgcgctgcgcaaaggcaacttcgtccagcctaccgtgttcgtcgatgtcgacaaccgcatgcgtatcgcgcaggaagaaatcttcggcccggtcgcctgcctgattccgttcgacgacgaagccgacgcgatcgagctcgccaacgacatctcctacggcctgtcgagctacatctggaccgagaacacgggccgcgcgctgcgcgtcgccgccgccgtcgcagcgggcatgtgcttcgtcaacagccagaacgtgcgtgatctgcgccagccgttcggtggcaccaaggcatccggcgtgggtcgcgaaggcggtacatggagctacgaagtgttcctcgaaccgaagaacgtttgtgtgtcgctcggctcgcatcacattccgcgctggggcgtt

SEQ ID NO: 28309 - DNA, 1437 bp, Burkholderia fungorum
ttgggccactatatcggcggcgcgccggccgcgccgaccagcggccgcttcaaggacgtgttcaatcccgccaccggcaaagtcaccggttcggtcgccctcgcttcggtcgaggaagtggacgcggcagtgcaggccgccaaggccgcctttcccgcctggagcgaaaccgcgccgctcaagcgcgcgcgcattctgttcaggttcaaggagttgctcaaccagcatcacgacgaactggcgatgctgatcacgcgcgaacacggcaaggtgttcacggacgcacaaggtgaagtggtgcgcggcatcgaagtcgtcgaattcgcgtgcggcattccgaacctgctcaagaccgatttcaccgaccagatcggcggcggcatcgacaactggaatctgcgtcaggcgctcggtgtggtcgcgggcatcacgccgttcaacttcccggtcatggtgccgatgtggatgttcccggttgcgctcgcctgcggcaatacgttcgtgctgaaaccgtcggagcgtgatccgtcggcgtcgctgcggattgccgaactgctgaaggaagccggcctgcccgacggtgtgttcaacgtcgtcaacggcgacaaggtggccgtcgatgcgctgatcgatcacccggacgtcgcggcgctgtcgttcgtgggctccactccgatcgccgaatacattcacacggaagcgtcgaagcgcggcaaacgcgtgcaggcactcggcggcgcgaaaaatcacctggtggtgatgccggacgcggatctggaccaggcggtcgacgcgctgatcggcgcagcctacggttcggcgggcgagcgctgcatggcgatctcggtcgcggtggcggtcggcaatgtggccgaccaactgatcgagaaactggtgccgcgcgtcaaatcgctcgtgatcaggaacggcgaaaatctcgacgctgaaatgggtccgctggttaccgccgaacataaggccaaggtggccggttatatcgcgtcgggcgaggcggaaggcgcgaagctgatcgtcgacggccgcgcgcatccggtggcaagcgaagaaggcttctttatcggcggtacgctgttcgacaatgtcggcacgcagatgaagatctacaaggaagagatcttcggcccggtgctggcagtggtgcgggtgcccgatttcgcgagcgccgtggagttgatcaacgcgcacgaattcggtaacggcgtgtcgctcttcacgtcggatggcggggtggcgcgcgcgttcggccggcagattcaggtgggcatggtcggcatcaacgtgccgattccggtgccgatggcatggcattcgttcggcggctggaagcgttcgctgttcggcgaccatcacgcttacggcgaagagggcgtgcgcttctatacgcgctacaagagcatcatgcagcgctggccggat

SEQ ID NO: 28310 - DNA, 1080 bp, Burkholderia fungorum
gaatttatcgccatgctcgggcacgagttgcgaaacccgatggcgccaatcgatagcgcggtcggcgccgccaagcaattgtgcgcggacaacgccagggcggtcgaggttctgaccatcgcgcagcggcagatgcgccatctgcgaaccctcgtcgacgacctgctcgacgccgcgcggttgcggcacggcaagctcgccatcaagcacagcgatacctcgctcaacgagatcgcgttcgacgccgtgaccgcggtgaagcatcacatacagtcgcggcggcattcgctcacgctgaccggcctcgaaacgccggtgccggtgcgggcggatcacgtcagactgagccaggtgcttggcaaccttctttccaatgccgcgaagtacacgccagtcggcggcgcgatcgaactcgccgtcagggtcgccgaagacggacaggaaccggagcgcaaggaggtggtcgtcatcgaggtgaaggacaacggaattggcatcgacaattccatccagccacgcgtcttcgatctcttcgcccagtcggcacgcggtaatgcccgtgccgaaggcagactgggaatcggtctcgctgtcgccaagcgaatggtcgaactgcacgacggcacgatttccctgcgcagcgaaggaacaggcaaaggcacgctggttacgttgaagttgccgatcttgcgctcgggcgacgagttgcaggcaagggtcgaaactccgccgtctcccggtctcgggcctgtgcgtctgctgttggttgacgacaatgtggacgcgttgcagtccctgggtatcctgatggaactcgaaggacatcaggtcacgatgtgcgacagcgggcgcgaagcggtccggctgatcagggagaatttgcccgaagtcgccattatcgacgtcggcatgccggatatggacggcttcgacgtcgcccatgcggtgagatccgacagcggactcgccgacgtcatgctggtggcgctcactggctatgcggcggaatccgacaagtcgcgagccctggccgcgggattcgactatcacctcaccaaaccgttatcgctcgacaagctg

SEQ ID NO: 28311 - DNA, 771 bp, Burkholderia fungorum
atggcagaccattccatcaagggcaaggttgcgctcatagccggtggcgcgaaaaacctgggcggcctgatcgcccgcgatctcgccgcccagggcgcgagagccattgcaattcactacaacagtgccggcagccgggcgcaagccgatgccacggtcgaagcaatccgcgccgcgggcgccgaagcggtggcgtttcaggcggacctgacccgcgcgggcgcggtcgagaaactgttcgccgatgcggcggccgcgatcggcaagcctgacattgccatcaacacagtcggcaaggtgctgaaaaaaccgtttgtcgagatcagcgaggccgagtatgacgagatgaccgcggtcaattcgaagaccgctttcttctttctcaaggaagcgggcaagcacgtcaacgacaacggcaagatcgtcacgctcgtcacgtctctgctcggtgcattcacgccgttctacgccgcgtacgccggcaccaaggcgcctgtcgagcactacacgcgcgcggccgcaagggaatatggcacgcgcggcatttcggtcaccgccgtaggcccgggaccgatggacacgccgtttttttatcctgccgaaggcgaagacgcggtcgcttaccataagaccgccgcggcgctatcatcgttttccagaacgggcctgaccgacattcaggacgtggtaccgtttatccgccatctggtcagcgacggatggtggatcaccggccagaccatcctcgtcaatggcggctatacgacgaag

SEQ ID NO: 28312 - DNA, 909 bp, Burkholderia fungorum
aagggacgcgtcgtcattctcggcatctacgtcaccgatctgacgtttcgcgccggtcgcatgccgcagatcggcgagaccatcgcgggctcggcgttcgcgatggggccgggcggcaagggctcgaatcaggcggtggcggccgcgcgcgccggcgccgacgtggtgttctgcacccgcatcggcaacgacgcgttcggcgcgattgcgcgcgccacgtgggccgctgaaggcatcacggcgcgcgcgtcggtgatcgaaggcgtctcgacgggcgcggcgcatattttcgtcgacgacaacaccggcatgaacgcgatcatcgtcgcctccggcgcggccgggacgatggagcccgccgatgtcgacgcaatcgaagccgacatcgccgccgcgcgggttttcgtcacgcagctcgaacagccgctcgaggccgcgcgccgcgggctcgaagtggcgcgccggcacggcgtcatcacagtgttcaatccggcgccggcgttgccgctcgacgacggcatcttcccgctgtgcgactacatcaccccgaatgaaaccgaagcgaccgcgctcaccggcgtgccgatcgcgaacgccgacgacgcccgccgtgccgccgacgtgctgctcgccaaaggcgtcggcacggtcatcgtcacgctgggcgagggcggcgcgctgctgcattcggcggcgcaatcgatcctcgtgcccgcctatcactgcggccgcgtggtggaaaccgcgggcgccggcgacggcttcacgggcggcttcgcggccgcgctcgcacgcggcgacgacgccatgaccgcattgcgtttcggctgcgcactcgcgggcatttccgtgacacgtccgggcacggcgccttccatgccgacgctcgacgaagtgaaccaggttctg

SEQ ID NO: 28313 - DNA, 1431 bp, Burkholderia fungorum
tcgatggagtacggtcccgcacccgaggacgatcaacccgcgcgcgcctggctggcgcagcacgaggagcgtttcgggcatttcatcggcggtgcgtggcatgcgcccgcggccggcgagcgctttgcctcgcacgcgcccgcaacgggcgagcggctcgcggatatcgcccagggcgatgctgccgatatcgacgccgcggtggccgccgcgcgtgccgcgcagccgggctggttcgcgttgggcggcgcgggccgggcgcggcatctgtatgcgctcgcgcgcatggttcagcgccatagccggctcttcgccgtgctcgaagcgctcgacaacggcaagccgatccgcgagacgcgcgatatcgacgtgccgctggtggcgcggcacttcctgcatcacgcgggttgggcgcagttgcaggagagtgagtttgccgattacgcgccgctcggcgtggtcggtcagatcgtgccgtggaattttccgctgttgatgctcgcgtggaagatcgcgccggctattgccacgggcaactgcgtcgtgctgaagccggccgaatatacgccgctcaccgcgttgctgttcgccgaactcgcgcatcgcgcgggtctgccggccggcgtgctgaacgtggtcacaggcgacggacgcaccggcgccgctttggtcgagcatccgcaggtcgacaagatcgccttcaccggctcgacggaagtcggccggctgatccgctcggccacggccggctccggcaaatcgctgacgctcgaactcggcggcaagtcacccttcatcgtgttcgacgacgcggatctggacggcgcggtggaaggcgtggtcgacgcgatctggttcaaccaggggcaggtgtgctgcgcgggctcgcggctgctcgtgcaggaaggtgtcgaggcgcggttcatcgcgaagctgaaacggcgcatggcgacgctgcgcgtgggtacgtcgctcgacaagagcatcgacctcggcgcgatcgtcgatccggtgcaactcgaacgcatccagtcgctggtggaaaccggccggcgcgaaggctgctcggtctggcaatcgcctgagacgaccatgcccagcggcggctgcttctatccgccgacactcgtgaccggcgtggcgccggcttccacgctggcgcaggaagaaatcttcggcccggtgctggtgacgatgagctttcgtacccctgatgaagcgatcgcgctcgccaacaactcgcgttacggactcgctgcgagcgtgtggagcgagaccatcggccgcgcgctcgacgtcgcgccgcgtcttgcatgcggcgtcgtctggatcaatgcgaccaatctgttcgacgcggcggtcggcttcggcggctatcgcgaatcgggttacggccgcgagggcgggcgtgagggcatctacgaatatctg

SEQ ID NO: 28314 - DNA, 918 bp, Burkholderia fungorum
ttgcctatcgtcgatgtcagcggcctcttcagcgacgacatagaccgccgactcgccaccgcccgcgaactggatcgcgccgcacgcgaggccgggttcttttacgtcaccggccatcaggtgtcgcgcggacagcagggcgcgctgatcgagcaggccaaacgcttctttgccgccgggcacgactggaagatgcgctattacatcggcaactcgagcgcgcatcgcggctatgtgcccgaaggcgaggaagtcttcgcgggcggcaagcgcgacaggaaggaagcgttcgacacaggccgcgaactgcccgccgacgaccccgacgtgattgccggcacaccgatgctcggctcgaatagctggcccgaacaaccgggttttcgcgaggcggtgggcggctactatgaagcgtcgttcgaactcggccgcgcgttgtttcgtggcttttcgctcgcgctcggcttgcccgagcagcacttcgagcgctatctacgcaagccgccgagccagttgcgcctgatccactatccgctcgatccgtcagccgaagaccggccgggcatcggcgcgcataccgactacgagtgcttcacgatcctgctgccgaccgcgcccggtctcgaagtgatgaacggcaggggcgagtggatcgatgcgccgccggtcggaaacgcgttcgtcgtgaacatcggcgacatgctggaagtgtggacgggcggcacctatgtcgcgacttcgcatcgtgtgcgcaaagtgcgggaggagcgctattcgttcccgctctttttcgcctgcgactatcacacggtggtcgcaccgctgccgcagttcgcgacacccgaggcggtggcgaagtatccgcccgtgtcggcgggcgaccatctgtacgcgcagacggcacagagctttacctat

SEQ ID NO: 28315 - DNA, 636 bp, Burkholderia fungorum
atgagtctacgtcttggcgatatcgcgccggatttcgaacagcagtcgagtgtcggcccgatcagattccacgagtggctgggcgatagctggggcgtgctgttttcgcatcccgctgacttcacgcctgtctgcaccaccgaactcggcctgaccgcgaagctggccagcgaattcgagaagcgcaacgtgaagacgattgcgttgtcggtggacagcgccgagtcgcacaaggagtggattaaagacattaacgagactcaggccgccaatgtcggcttcccgattctcgcggacggcgaccgcaaggtttccgagctgtacgacatgatccacccgaatgcgaacgaaacgctgaccgtgcgctcgctgttcgtgatcgacccgaagaagaaggtgcgtctcatcatcacctatccggccagcacgggccgtaacttcgacgaagtgctgcgtgtgatcgattcgctgcagctgaccgacagtcactcggttgccacgccgggcaactggaagcagggcgatgacgtggtgatcgttccgtcgctgaaggacgaggaaatcatcaagcagaaattcccgaagggctataaggcgctgcgtccgtatctgcgcatgacgccgcagccgaacaaa

SEQ ID NO: 28316 - DNA, 1188 bp, Burkholderia fungorum
atggccgaggccgcgcagtttcactgggaagacccgttgctgctggatcagcaactcaccgaagacgaacgcatggtgcgcgacgccgccgcggcttacgcgcaggacaagctccagccgcgcgtgctcgaagcattccgtcacgagaagaccgacatcgagatctttcgcgagatgggcgagctcgggctgctcggcccgaccattcccgaacaatacggtggtcccggcctgaactacgtcgcttacggcctgattgcgcgcgaggtggagcgcgtcgattccggctaccggtcgatgatgtcagtgcagtcgtcgctcgtcatggtgccgatccacgcattcggctccgaagcgcaaaagcagaaatacctgccgaagctcgccaccggcgagtggatcggctgcttcggcctgaccgagccgaaccacggctccgatccgggcagcatggtcacgcgggccaaaaaggtcgacggcggctattcgctgtcgggctcgaaaatgtggatcaccaactcgccgatcgccgacgtgttcgtggtgtgggcaaagctcgaagaaaacggcaaggacgcgattcgcggcttcattctggagaagggctggagagggctgtcggcgccgaccatccacagcaaggtgggtttgcgcgcctcgatcaccggtgagatcgtgctcgacgaagtgttcgtgccggaagagaaccgtttcccggaagtcagcggtttgcgcggtccgttcacctgtctgaactcggcgcgctacggcattgcctggggcgcgctcggcgcggccgaagcatgctggcacaccgcgcgccagtacgtgctggatcgcaagcagttcggccggccgctcgccgcgaaccagctgatccagaagaagctcgccgacatgcagaccgagatcacgctcggactgcaaggcgtgctgcgtctcggccgcatgaaggacgaaggcaccgcggctgtcgagatcacctcgatcatgaagcgcaattcatgcggcaaggcgctggatattgcgcggcttgcacgcgacatgctcggcggcaacggcatctcggacgagttcggcgtcgcgcggcatctggtgaatctggaagtggtgaacacctatgaaggcacgcacgacattcacgcgctgattctggggcgcgcacaaacaggtattcaggctttcttc

SEQ ID NO: 28317 - DNA, 1284 bp, Burkholderia fungorum
tatcagtcgggtttcgcgaacgaattcgcgacagaggcgttgccgggcgcgttgccggaaggccgcaactcgccgcaacgcgtggcctatggtctgtacgccgaacaggtgtcgggcacggcgtttactgcgccgcgcgcccacaatcgccgttcgtggctgtaccggattcgtccggcggcggtgcacaagccgttcacgccgctgccctcggagcggctcgtcgccaacttcgccgaggtgccgcccacaccgccgaaccagttgcgctgggacccgctgccgatgccggccgagccgaccgatttcatcgacggctgggtgacgatggcgggcaacggcgcggcggaatcgatgagcggttgcgcgattcacctgtacgcggcgaaccgctcgatgcaagaccgcttcttctatagcgccgacggcgaattgctgatcgtgccgcaggaagggcgtctcgacattgccaccgaaatgggccggctcgaagtcgaaccgttcgagatcgtggtgattccgcgcggcgtacgcttcgcggtgagcctgccggacggcgcggcgcgcggctacatctgcgagaatttcggggcgttgctgcgtttgccggacctcggaccgatcggctcgaatgggctcgccaatccgcgcgatttcctcacgccgcatgcggcctacgaggatcgtgagggcgacttcgaactcgtcgccaagctgaacggcaacctgtggcgcgcggatatcggccattcgccgctcgacgtggtggcgtggcacggcaactatgccccatacaaatacgacctgcgccgcttcaacacgatcggctcgatcagcttcgaccatccggacccgtcgatttttctggtgctgcaatcgcaaagcgatacgccgggcgtcgatgcgatcgacttcgtgatcttcccgccgcgctggctggcggccgaagatacgttccggccaccctggttccatcgcaacgtcgcgagcgagttcatgggcctcgtgcacggcgtgtacgacgcgaaggccgagggcttcgtgccgggcggagggagtctgcataactgcatgtcgggtcacggcccggatgcggacacgttcgaaaaggcttcgcatatcgatacgtcgaagccggcgaaagtcggcgacacgatggcctttatgttcgagacgcgcacgctgatcaagccgacccgtttcgcgctcgaaaccgcgcaattgcaggcgcattactacgagtgctggcaaggcctcaagaaacatttcaatccggagcaacga

SEQ ID NO: 28318 - DNA, 1506 bp, Burkholderia fungorum
ctggcggacaaggcgcagcgtattccggacaggactttcctgatctggcaggaccgccggtacacctatgcggaactggagacgatcaccaaccgctacgccaacggctttatcgcgcacggcatcggctacggcgaccacgttgcggtgatgctgcccaattgcccggagtttttctgggtggtgtggggcttgagcaagatcggtgcggtggcggtgccgatcaataccgccgcgaaaggcgagctgatgcgctatttcctcgataaatcggactcggtgtgtttcgtcgtcgatgaagaatggagcgagcgggtcgccgcaatcagaagcgaggtgccgcaaatcaggcagtatttcatccacggcggcaacggtgtgccgagccttccggacaacgcggaaagcaccgtccatgcgctgtccgagctcgaatcggacgacgcgagccagccgccgctcgaccgtgtcgcttacgacgacacgcagctcatcatgttcacgtccggcacgaccggaccgtcgaaaggcgtgcaatgcccgcattcgcaaggtcatgcggtgggtcgcgcgctgacggtcgatttcggctatcgggaggacgacgtgctgtacacgtgcctgccgctctttcacggcaacgccgcgtattactcgtgttacgcggcgctctgggccgatgcggccatcgcgctcgcgccacgcttttcggccacgcgcttctgggacgacatccgccgaaccggcgcgacgcagttcaatacgctcggcgcgatgaccaacatcatctggaagctgccgcccggtccgcatgagcgcgaaacgaagctgcgcctgtgcatggcggtgccggtgcccaaagagatctactccgagtttcaggaacgcttcggcgtggtgctgacatccgtgttcgcaatgacagaaaactttgcgatgacgcgcttcacgccctcggacccggcggaaaaagccggctcggccggcaaaccgcgcggcgaatgcgaactgcgcatcgtcgccgacgacggcaccgacctgcccgccggcggggtcggtgaaatctacatgctgccgctcaaacccggcagcatgatgaagggctactacaggatgccgaaggaaacggcgcgcgaattcgacaatggctggttcaagaccggcgatcgcggctatctggacgaagacggctacctgtttttcatggaccgcaagaaggaagcgattcgccggcgcggcgagaatatttccgcgtacgaggtggagctgattctgtgccgccatccggcgattcatgaagtggccgcgattccggtcgcctccgaactgagcgaagacgacgtgatggtgtatgtcgtgctgaagcccggcgagtcgatgacgcatgcggacgtcgtgcatttcagcgccgagcacatgagctatttcatggtgccgcgctttgtcgagttcatcgacaaactgccgaagaccgccagcgaaaagctcgaaaaatacaagctgaaa

SEQ ID NO: 28319 - DNA, 1983 bp, Burkholderia fungorum
gaatccattcttatcgcgaaccgtggcgaaatcgcctgccggatcgcacgcaccagccgccggctgggcattcgcgtcatcgctgtctattccgacgcggaccgtggcgcgcgccatgttcgcgaggccgatgtcgcggtgcggatcggtccggcggacgccacgcgcagttatctcgacgccgacgcgatcatccgcgcggcgctcgaaaccggcgcgagcgcgatccacccgggctacgggtttttgtcggagagcacgcagcttgtcaaccgctgcgccgagcacggcattgcgtggatcggtccacgcggcgacgtgatcgagcgcatgggctcgaagatcgaatcgaagcgtatcgccgccgacgcgggcgtgccgtgcgtgccgggttaccacggcgataaccagaagctcgagcatctgctcgaacaggcgcgcgcaatcggcgcgccgcttctgatcaaggcgagcgccggtggcggcggcaagggcatgcggcgcgtcgacgacctcgacgatttcgccgcgcaactgagcatggcgaagcaggaagcactgcgcgcattcggcgacgaccgtgtgctgatcgaaaagctgatcctgcggccgcgccatctggaagtgcagcttgcgggcgaccgtcacggcaacctcgtccatctgttcgagcgcgaatgctcgatccagcgcaactatcagaaggtgttcgaagaagcgccggcgccgcgtctcgcgccggccgtgcgcgaaaaactgctcgacgccgcgctgaagctcggcaacgcgatcggctacgactcgctcggcacggtcgaattcgtgctcgccgaggacgccgatacgccgtacttcctggagatgaacacgcgcctgcaggtcgagcatccggtcaccgaaatggtcacgggtctcgatctggtcgaactgcagatccgcattgccgcgggcgaaccgctgccgatgcagcaggacgcggtcgctgtcacaggctgggcagtcgaggcgcgcatcaattgcgaagaccctgcgcatgggcatcggccggagttcggcacggttgcgcgatatagcgagcctgcgctggccggcgtgcgtgtcgacagtggtatcgaaagcggctcggaaatcgcgccgcactatgattcgatgatcgcgaaggtgatcggttacggcgcgacccgtacgcaggcggtcgagcgtttgcgtgccggcctcggcgcgttcgaggccgccggcatcggcaccaatcagagcttgctgtgcgcgatcgcggatcactcgctgttccgcgcgggccgcttgaccaccggctttctcgcggaagcattccccggcggctggcacgacgacccggcggacttccgctacgcggtgtgcgccgccgtgctgcatcggctcgcggcacgcgcggcgccgggtcccgattactggcacaggcaaagcggacaccgcttcatggcggcggcggggcggcgggcggccgcgcgcatgcgggttgccctggacggcgacgaacagccggtcagtgtcgaacgcgatggcgagcactggctcgtaaaaaccggcgacgaggccgcgctcgatctccaggtgcgcgcgcttgccgaggaccagttgctgctgctgccgatgcatggcgtgccgcgccgttacacgctcaccgccgacggtgcgcatctattcgtcaatcacgtcggcacgcgctggcgcgtgctcgttgtgagcgaagtggaagcgctggcgcgcgtggctgcgcaagcgggcgtgcagggcagtgaagtggcatcggaaatgccgggcgccgtgacggcaattcatgtcgcgcccggcgaccaggtggccgcgggcgacgtgctggtcgtgatggaagccatgaagctgatctttccgctggtcgcgccgcgcgacggcacgatcgccgtggtccgttgcgcgctcaacgaaatcgtgccgcgcggccatgtgctcgtgcagctggag

SEQ ID NO: 28320 - DNA, 1128 bp, Burkholderia fungorum
tatttcagcgaagaacacagcatgttgcgcgacgtgatacgtcgcttcatcgccaaagaggtgctgccattcgcggatcagtgggagatcaatggctatgtgccgcgcgagctgctgcgcaagatgggcgagcagggttttctcggaatccggcagtccgaagcatttggcggtgcggcaatgaatgtgctcggcacagtggtgcttgccgaagaattgggccgctccaccttcggcggttttgcgatcacggtgctggttcatacggacatggcgtcgccgcatctgcagcatgcgggcaatcccgcgcaactcgaacggctgatgcccgatctcgtcgcgggccgcaagatcgccgccgtcgccatgacggaagcgggcgcgggttccgatctggcgtccatgcgcaccacggcgcgtctggacggtgaccattacgtgctgaacggcgcgaagatgttcatcaccaacggcgttcacggcgacatctatttcgtcgcggccaaaaccggcggaccgggccgcagtcatggcggcatctccatgttcattgtcgagaagggcatgccgggcttctccgtcgcgcggccgctgagcaagcagggctggctgtcgtccgatacggcggaactggtgttcgacgaatgccgcgtgcccgtgcaaaacctgcttggcgaagagaacaagggtttttattcgctggtcaggaatctgcagaacgagcgcatcacgcttggcgcgcaggcgctgggcgaagcatccagagccatcgagatcacgctcgattacgttacccagcgcaccgctttcggccagacgctgtgggagaaacaggcgatccgtcagaagatggcgatgctgctcgcgaaggtggaagcggcgcggcaactcctttacaacactgcatggcgcgatgcgcaagggcaaacggtcgtcgcggaagtctcgatgatcaaggcgctgtgcggagaactcgtcaacgaagtgatgtacgcatgccagcagtttcacggcggcttcggctatatgcgtgaagcgccgatcgagcgaatggtgcgcgatgcccgtgtgcagtcgatcggcggcggcgcgaccgaggtgatgctcgaagaagttgcgaagcggatg

SEQ ID NO: 28321 - DNA, 1764 bp, Burkholderia fungorum
tactgggaatgggtggcgaagaaattccgctggatgcgcccgtgggagagcgtgcgcgacggcaacttccccgaattcaaatacttcgccggcggcatgctcaacgtgtgcgacaactgtgtcgatcgctatgcggaagatccgcattacgcgtcgcggccggcaatcacgtgggaaggcgaaccgggcgattgcgccacgctcagctatgcgcaactgcgcaccgccaccgcacgctttgcgaacggactacgttcactcggcgtcggtcagggcgacgtcgtcgcgatctatctgccgaacatgctggagtctttcgtcgcgattcaggcgtgcaaccggatcggcgcaatttataccgtgctgttcgcgggtttttcggccgacgccgccgcgctgagactgcaaacctcgcgggccaaagtcctggtgacggcggacgccagttatcggcgcggcaagcaggtgccgttactcgaaaacgcccgcaaagcgcggcgctcggcaccgaggctggagcacatcgtcgtgatcgatcgcaccggggcggcgcccgcgttgcatgacggcgagaccggctacaaggaactggtcgccgcgcagtccgacgattgcccgtgcgtgccgctcgaagccaacgcgccggcatttctgattttcacgagcggcaccgaatcgaagcccaagggtgtggtgcatagcgtcgcgggatttctgcttggcacatgggccaatgtgcaatggcaggtcggaccggcaaaagacgacgtctactggtgcgcggccgacgtcggctggttgacgtttccgattcaggccgtgatcggcggactcgcgcacggcgcgagtctggtgtgctacgaaggcgcactcgatacgccgggcaaagaccgcttctaccagatcgccaaccggcatcacgtcaccaagatcctgatcgcgccgaccgcgctgcgtatgctgcgcgcgctcggcgacgaggtggcgaaggcgaaccggatcgacggcttgcggctgattacgacgcaaggagaaccgctcgatccggaaacgtatcactggacatccaacacgctcggcgatcagttgccgatcgtcaatgcgtacggacagaccgagaccggttcgacctggacctatcccgtctacggcgtcgagccgttgaaagcgggttcgtgcggcacgccggtgccgggacacgcgtaccgcgtgctgctcgaagacggatcgactgcaccggtcggcaccaaaggcgcgctggtactcacggcgcccttcccaacgctcgcccgtacggtgtgggacgaccatcaacgctatctgaatacgtatttcggccgttatcccggcgtgtacaacacgtccgatgaggccgtggtcgatagcaccgggcagttgtgggtgctcggacgcggcgacgatgtcatcaacgttgccgcgcatcggctaagtacgatggagatcgaatcggtcgtggcatcgcagccggggattgcggatgcggcggtggtcggcgtgagcgacgcggtcaagggcacggtgcccgtggcgttcgtgacgctggtagccggggcgccggtcgagtcgactatcgggcagatttgcgcggcggcgagcgacgcgatcgggactatcgcgcgtctggagcaggtgttcgtctgcaaggcgctgcccaagacacgcgccggcaaaaccgtgcggcggctattgagagagattgtcgagaccggcgaggcgaaaagcgatctgacgggaatcgaggat

SEQ ID NO: 28322 - DNA, 1278 bp, Burkholderia fungorum
gtacgccgcgtcgccataatcgggggcaaccggattccgtttgcccgctcgaacaccgcctacgcgaccgcgtcgaatcaggacatgctgaccttcacactgcaaggcctgatcgaccgctacaacctgcacggcgaacggctgggcgaagtcgcggcaggcgctgtcatcaaacattcacgcgacttcaatctgacgcgcgaatccgtgctgtccaccacgctggccaaagagacgcccgcgtacgacgtgcagcaggcctgcggcaccggactcgaagctgccatcctcgtcgccaacaagatcgcgctggggcagatcgaagtgggcattgcgggcggcgtcgatacgacttccgatgcgccgatcggcgtcaacgagcggatgcgcaagatcctgctcgaagcgaatcgcggcaggagcaccgggcaacgcgtcggcgcgctgagcaaactgcggcccggcatgtttttcaagccgctgctgccgcgcaacggcgagccgcgcacgggcctttcgatgggcgagcattgcgagctgatggcgaaacgctggaacatctcgcgcgaggcgcaggacgtgctcgcctacgacagccaccgcaagctgacggcggcgtacgcgcgcggcttcgtcaacgatctgatgacaccgtaccggggtcttgcgcaggacaacaatctgcgcgccgacctcacgctcgaaaaactcgcgagcctgaagcccgtgttcgaccgcgacgccggcacgctgaccgccggcaattcgacgccgctcaccgacggcgcctccgcggtgctgctcgcgagcgaggactgggccgcgcggcatggactgcccgtgctcgcgtatctgagctggtccgaaaccgccgccgtcgatttcttcgacaggaaagaaggcctgctgatggcgccggtgtacgctgtgccgcgcatgctggcgcgcgccggactcacgctgcaggacttcgatctgtacgaaattcacgaagcgtttgccgcacaggtgttgtgcacgctcgcggcatggcaggatgacgaatattgccgcacgcaactcggtttgccgggcgcgcctggtgcgatcgaccgggcgaaactgaacgtgaatggcagctcgcttgccacgggtcatccattcgcggcaacgggtgggcgcatcgtcgccggtctcgcgaaaatgctcgcgcaactcgacaagccggccggcaccgcgcgcgggctgatttcgatctgcgcggcgggcggccagggggtggtcgcgattctggagcgc

SEQ ID NO: 28323 - DNA, 1683 bp, Burkholderia fungorum
gacggcatctggtacgcgtcctatccggccgacgtgccgcacgacatcgacgtcgcgcaatacgaatcggtcgtgcagttcttcgacgaatgtatcgcccggttccgcgagcgtgtggcctacgtgagcgtgggcgcgaacatgacctacggcgagctcggccgcaaggccagcgcattcgcggcgtatctgcaaagcctcggcgtgaagccgggcgagcgcgtggcgatcatgctgccgaacacgttccagtacccggtgtcgctgttcggcgtactgaaggccggcggcgtggtggtcaacgtcaatccgctctatacggtgcgtgaactcgcgcatcaactgaaggacagcggcgcgcaaaccatcatcatgttcgagaacttcgcgaagacggttgaagacgcgctgcccggcaccaaagtgcagaacgtcatcgtgaccggcctcggcgatctgcttgccgacggcctgaatctgaagggacgtctgctcaatttcatgctgcggcacgtaaaaaagatggtgcccgcgtacaacctgcccaaagccgtgccgctgctcgaagcgctttcgatcggctactcgcggccgttgacgcccgtgcgccccacgcatgcggacattgcgttcctccagtacacgggcggcacgaccggcgtcgccaagggcgcgatgctcacgcacaagaacatcatcgccaatctgctgcaggcgaaggcgtggtccgaagggcaactgaccggcgacgtcgaaacggtgctcacgccgctgccgctctaccacatctattcgctgaccgtgaacgcgctgatcttcatggggctcggcgggcgcaacattctgatcgccaatccgcgcgacatgaagcgcgtgatgatgatcatccgtcacgaaaaattcaccggcatgaccgccgtgaatacgctctacaacgcgttcctcgaaaacgaggaattctgcaagcgcgacttctcggatctcaagctcgcgatggccggcggcatggccacgcagaaatcggtggccgagcgtttcaaggcggtgaccggcaaaccgatcatcgaaggatacgggctgaccgaatgctcgcccatcgtctcgatgaatccggtcgatctggccaacatgcgtgacttcgaagggtcgatcggtttgcccgcgccgtccactcacgtgcgtttcagaaaggacgacggcagttgggcgaacatcggcgaggcgggtgaattgtgcgtgaaggggccgcaggtgatgaagggctactggaatcgcccggaggagaccgccaaggtgatcgacggcgacggctggctcgccaccggcgacatcggcgtgatggattcgcgcggcttcatccgcctgatcgaccgcaagaaggacatgatcctggtgtcgggcttcaacgtctatccgaacgaagtcgaagacgtgatcgcaacgcatccggacgtgcgggaagtggcggccatcggcgtgcccgatgccgcgcaaggcgaacgggtgaaggtgttcatcgtccggcgcaatccttcgctgacggccgaacaggtgattgctcattgccgcaagaacctgacaggctacaaggtgccgaagctcgtcgaattccgcgacgagctgccgcaaaccaacgtagggaaaattctgcgccgcgcactgcgcgacgaggaactcgcgaag

SEQ ID NO: 28324 - DNA, 939 bp, Burkholderia fungorum
cgtcggaagctcatcgatatatacagaacgatggtgctcgtgcgcgaggtcgaattgtccttgagccgtctttttgccgacagcgaggtgccgggcttcattcacctgagtctcggacaggaggccgtttccgccggcgtcgcgagcgtgctcgaagtccaggacacgctggcgaccacgcatcgtggacacggtcacgtgctggctcgcggcatcgacgtcggtgggtttttcaaggaaatcatgggacgcgtgggaggcttgtgcaaggggcgcggcggctcgatgcacgtcgccgatctggcgctcggggtgctcggcgcgaatggcatcgtgggcgccggtatcccgatcgcgctcggcagcgcggtggcgcatcacgtgcgcaagacccgcggcgttgcggtcgcatttttcggcgatggcgcgatggccgaaggcgtactgcacgaaacgatgaacatggctgcgttatggaaggcgccgctgttgctggtctgcgaaaacaacggctggtcggaattctcgcccaccgaacggcagttcgccgcccgcctcgaagcgctggcaggcgccttcggcattgcctataaacgggtcgatggcgatgacgcggtcgcggtcagcgaagcgtcggggattgcggcggccgccgcgcgcagcggagccggaccgttcgtgctcgagtgcgtcacgcatcgggtgcgggggcactacgaaggcgatccgcagaaataccgtgacccgaccgagctggacggtctggcggggaaggacccgctgaaacggatgcacacgcatctggaatcggccggcgtgtccgcgagtgagatcgatcagatcggccgggctgtgttgactcgcgtcgaggcagcgatcgaagcggcgcgtgcggacgcgttgcccgacttcgacgaggcgagtcgcgacgtctacacc

SEQ ID NO: 28325 - DNA, 927 bp, Burkholderia fungorum
attcgctatgcgcaggctgtcgcgcaggcgcttcacgacagtttgcgggacgacgaaagcgtgatggtgatgggcgaggacattgcggccgccggcggctcgttcaaagcgactcgtggactgctagatgcgttcggtccgcaacgcgtgcgggatacgccgatctcggaagcttcgatcgtgtccgcggcggtgggcgccgcgctgaccggcatgcgcccggtcgtcgaaatcatgttcatggatttcatcacgctggcgatggatgcgttggtgaatcaggcgtccaaggcgcgtttcatgttcggtggccagggcagcgtgccaatggtgttgcgcacgccgcacggtggcggcatgaatgcgggtccgcaacattcgcagtgcctggaagcgtggctcgcacacgtaccgggactcaaggtggtctgtccgtccacgccgcaggatgcgtactcactgttgcgagcggccatcgcggaccccgacccggtgatcgtcgtcgagcataagggactgtatgcccgcaaaggggtggtcgaaccggttgtcggtcgcatcggcgaggcttcgatcgttcgtgcggggcgcgatctcacgctggtgagctatggcgcgaccgttgccgcttgtctcgatgccgcgcgtacccttggcgccgagggcgtggaggccgaggtgatcgatctgcgttcgatccagccgtgggacaaggcggcggtgctcgcctcgctggcacgcacgcatcgggccgtgatcgtgcacgaggcggtaagtgccttcggcgtcggcgccgaaatcgccgcgacgctttcggacgaaggcttcgacgacctcgatgcgcccgtgcgacgggtcggcgcgccattcatgccggttccatttgccagttcgcttgagaaaggctacgcggttgatgctgaaaaa

SEQ ID NO: 28326 - DNA, 1272 bp, Burkholderia fungorum
gaactgctcgtgcccaagctgggcctcacgatgaccgaggggaccttgatcgagtggatgatcagtccgggggaccgcttcgatgcggaccagggcctgtatgtgatcgagtcggacaaggcggccaacgaagtatcggcggaagggtctggcgtcctgctggaagtcactgccgaactgggaatgccgttgagtgtcggatcggtgatcggctattgggacgacgatccgcaagcggcaacgaatcatgcggttcgtgctgaaccctcggcgcacgcagccgccgcctcggcgtcttcacccgatagcaacgcagccaatgccgcgccgtccgcgcagacaagccgcccgcccgccgctatgaacggccagagcggccagagcggccagagcggcgcgcgcggtatttctacgccgcttgcgcgccgcctcgcgcgcgagcggggaatcgatctgaccaacctcgcgggcagcggcccgcgcggacggatccgcgcgcgcgacgtggaattggcgccggcgaattcgccggccagtgcgcctgatgtgccgttgccggcgaccgcttcgcgcgccgcgcaggtcgcgcaggccgcgacggtgcgtgcggcaacatcgatcgaaaaaaccatcgcgcgccgtctcgtcacgtccaagcagactattccgcatttctacctgtccgtcgaagccgaaatatccgccgtccagcgtttgcgctcgcagctgaatgacgcgcaatcgaatcggcgcttcaccgtcaatcatttcgtggtggcggcagtgggccgtgcgctcgcactggtgccagaggccaatcgcgtatgggacgacagcggcatcaccagctttgccgcgacggacgtcggcgtcgccgtgcacaccgaacgtggcttgctggtgccggtcttacgcgacgtcggccgccaggcactcggcgaggtcgcgcgtcacgccagcgaggcaatcgggcgtgcacaggccggacaactgaacgcggccgagatggcaggcggcgcgatcaccgtctccaatgcgggcatgcacgacgtcacgttgatgacctcgatcatcaatcctgggcagtcgatgatcctcggcgtcggcagcgttcgccaggtgttccgcccggacgcgcacgggcaaccggcgctgaagaacgaagtgggactcgtgctgtccgtcgaccatcgggtgctcgacggcgtgaccgcgttgaagtttctcaggcaggtcgtagcggcgatcgagcgtcctgccagtctgctggtg

SEQ ID NO: 28327 - DNA, 1389 bp, Burkholderia fungorum
gaccattatgacgtgatcgtgatcggcggcggccccggcggctatgtcgcggccttgcgcgccgcacagctcggccggcgcaccgctttgtgcgagcgtgaccagttgggcgggatctgcctgaactgggggtgcattccgaccaaggcgctgctgcacacggccgacaccttgcgaacggtgcgcaaagccgcgcatctcggtatcgggatcgacgatccggtcgtcgacttcacacgggtgatggcacgctcgcgagaggtcgcgcagaagctcaatcgcggcgtcagccatctgctgcgcaaggcgggcgtgacggtgcttgccggcacggccgccttcgccgcggaccgttcggttcgcgtgcacggtgccgacggcgcgcttcggacgttgcaggcgcgccatacgatcgtcgcgaccggcgcggccgcgcggcaattgccggcgttgccgtgggacggcgagcggatctggacgtatcgcgaggcgctggctgcgacggccgtgccgaaatcgctgctcgtggtcggcgccggtgcgatcggaatggagttcgcgggcttctacgccgcgatgggaaccgaagtcacggtcgtcgaagtcgcgccgcgtatcttgccggcgagcgatgccgatgtctcggagttcgttgcccgagcgtgcgagcgtgacggtatccgcctacgcaccgggtgcagcgtggtccacagcgccgctcacgcggagggcgttcgcgtgatgttccgctcggagaacgctgaagagcagcgggagttcgagcgcgtgctggtcgcggttggcctggacggcaacaccgaaggactggggctggagcacacgcgagtcgcgttcgagcgcgggctgatcatcgccgatgctgccggcgcgacgagcgatcccgtggtgcatgccgtcggcgacgtcaccggcgcgccgatgcttgcgcataaggcgagccatcaggcgatcgcctgcgtcgagcgcattgcggaggtcaatcgcggcgagcgtcacgcgtcgccgaagatacccggctgcgtctacagccatccgcaaaccgcgagcgtcggcctgacggaagacgaggcgcgacgcaccggccgcgcgttgcgcgttggccgctttcccctcgacgcgaacggtaaagcgatcgcactgggcgaccccagcggctttgtgaaaacgatcttcgacgccgctagtggcgagctgttgggcgcgcatatcgtcggtcccgaagcgcccgaactcattcacggcttcacgctcgccgcgacgctggaggcgacggaaagcgaattgattgaaaccgtattccctcatccgaccttgtcagaagcaatgcacgaatcggtgctggcagcttttggcaggccgctgcacatc

SEQ ID NO: 28328 - DNA, 1170 bp, Burkholderia fungorum
atggactttcgatttgacgagtcacagcgaatgatgatcgacacggcgcgccagattggccaacgcttcggtctggagtactggcgcaagcaggacgcggccaggtcgtttccggccgaatactggcgcacggtctgcgaggccggtttgtgcggcgtggcgctgcccgaggaatacggcggaagcgggctcggcatgatggagatgtcactcatcgtcgagaatctcgcggcgaccggcggcggctccaccgtaggtcagctcttcatgatcaatccgatcttcggcggcgtgtcgattgcccgcttcggccccgaggcaatgcgaaaagaactgctgccgggcatcatcagcggcgagatcaactgttgcatggcgctcaccgagccggatgcgggcaccaacacgctggagatccgcactttcgccagtgccgacggcgacggctggcgcctgaacggccgcaagatctggatcacgggcgtgcaatcggcgaacaagatgctgatcgttgcgcgcacgaaaaaggtcgcggactcgacctcgcgaaccgatggcctctcgatgttcatgatcgatgtgcaacgcgaaggcctgtctttcacacccatcgataagctcggcacctgcacgctcgattccagcagtgtgtttttcgacgacgtcgcgattgagcccaccgaactgatcggcacgctgcatcaaggttggcgtgagttgctggacgtgctgaacacggagcgcatcgtgacgaccgcgggtctcgtcggcacgggcgagctggcgatccagctcgccgtcgactatgcaaacgaccgcaaggtattcggcaacacacccatcagcgcctaccagggtttgcagtttccgctcgcacagtgtcacgtggaagtgcaagccgcgcgcctgctcaactataaggccgcgacgcagttcgacatgggtcttccgtatggcagcgaggccaatgccgccaaactcctggccgcgcaggccgtgagccgcgcgacggagcgcgcgatgcaaacgatgggtggcatgggttattcgaaggagtttcacgtcgagcgcctatggcgcgattgccgcctgttccggttcgcaccggtttcggaagaaatgatcctgaactacgtcgcgaatcatgatctgaagatgccgcgctcgtac

SEQ ID NO: 28329 - DNA, 1452 bp, Burkholderia fungorum
cgcacgaatccgtcccgtaccgcattgatgtacggcaatcagtcaatttcgtatggcgatctgcagcggcgcgtcgaggccaccgccgggatgttgaagggtacccgaatccgtcgtggcgatatcgtcgcgttgctgatgaagaacagcgcggccttcgtcgagatcatgctggcggtctcgcaggcaggcgccgtcattcttcccatcaactatcggctaggtccggacgaggtggcctatattctccagcattcgggtgcgaaactgctgtttcacgatgaggagttcgaagtgccccccggccttgtgcattcgcaggccgtgaccggcgcggcgcagtcggacacgagtgtgcttgccgccggtcacgaaccctgtacggaagcttatccgtcccgccccgacgatctgtatcgactgatgtacacctccggcacgacggatcgccccaaaggggtgatgcattcctacggcaacgtggcgtggaaaagcttcgatcacatcgccgcgttgggtatcacgaaagacgacaggcttctcgtagtcggcccgctttatcacgtcggtgcgtgcgatctgccggggcttgccgtgctcgcgcaaggcggcatgctgcgcatcatgcgcgatttcgacgcgcaggctgtgctggaagcgatcgagcgcgagcgtctgaccggcgcgtggctggcacctgtcatgctgagccgcattctggcattgcccgaacgataccgcttcgacctgggcagtttgcgctgggtggtcggcgggggcgagcgtacgccggaacaacgcattcgtgagttcggatccctattcacgggcgcccgctatatcgacgcttacggactgacggaaagttgttccggcgatacgctgatggagcaggggcgcgagctcgacaagatcggctccacggggcgggcgctggctcacgtgcaactggcgatcatgagcgacgatggccggatgcttgcgcccggcatgcaaggcgaaatctgcgtgcgcggtccaaaagtcacccaaggttactggaaagacccggaaaaaaccgcaagaagcttcgttgacggatggtttcgcaccggcgacgtcggctatatggacgaggaaggcttcctgtatctcaccgaccgcaagaaggacatgatcatcagcggcggcgagaacatcgcctcttccgaagtggagcgggtgatctatcagcttgccgaggtggcggaggccgcggtgatcggtgcacccgatccgcgttggggcgaacaggtgacagccgtcgtggtgctgcgagccggagcgacactgacgctggacgcgctgcggacccactgcgaaggccgtctcggcggattcaaaacgcctcggcaactgatcctgcgcgacgcactgccgcgcaatccttctggaaaggtcctcaagcgcgtgctgcgcgacgaactgctcaag

SEQ ID NO: 28330 - DNA, 702 bp, Burkholderia fungorum
gccgtggtcacgggggcgggcagcggcatcggccgcgcctgtgcggagttgctgagccgtagcggcgcgaacgtcatcgtcgccgaccgggacattgaagcggcgacgcgggtagcgcgcgccaccggcggaaaaacgctggtgctggacgtgggcgaagatgcgtcggtgacggccgcggcgaacgaagtgcgcgcccggtacggtgtggcggatgtgctcgtcaactgcgctggcgtcctgcaacggacactcccgcccggtgagttggcgcagcgcgaatgggacgtcgtctcgcgcatcgacttgcgcggcacatacctttgctgcgccgccttcggcgcgccgatggccgaccgccggcgcggcagcatcgtgaacatcgcgtcggtggccgggatgcgatcgggtccgctacacgcctatggaccggccaaagccggcgtcatcagcctcacggaaacgctcgcgggcgagtggggaccgaaaggcgtgcgggtcaattgcgtatcgccaggcttcacgcagacgcccgcgctcgaacggggtttcactacccataccctgaaagccgatgtgctgcgcgacgcggcggcgctcggccatatcgtctccgcaaacgagatcgccgaagcggtagtctttctcgcttcggaacgggcgagcgcgattacaggcgtcaatctcccggtcgatgcgggc

SEQ ID NO: 28331 - DNA, 1407 bp, Burkholderia fungorum
atgagtcgcctggttgtggtctcaaatcgtacggtcgacccacgtaaaactgctgccggcggcctcgctgtcgctgtgcgggaaagtcttcagcgcaccggtggcctttggttcggctggagcgggaaaatctacgacgagtcggatgagatgacaagccggcgtggcgttcacgtgcaaacactcggcaatgtcacactcgccacagtcgatctgagccagcaggatcatgacaactactatctcggctatgcgaacggagtgctgtggccggtctttcactatcggctggatctcgcggacttcgacacgcgcttcgctgccggttaccggcgcgtgaaccagctgtttgccgagaaactccttccactgctcagacccgatgacatcatctgggtgcacgactatcacctgattccgcttgcagcggaattacgcgcaataggctgtggtaaccgtatcgggttctttctgcatattccaatgccgccgccgatgatcatggcagccattccggaacacgaatggttgatgcgttcgttgttcgcctatgatctcgtgggcttccaggggcagatcgacgtcgagcactttacgcattacgccgaatccgaagcgaacgccagacaggtcggcccgcaacaactccgtgcattcaatcgcacattgagactgggtgcgtatcccatcggaatcgatgtggaggagttcgtcagtctcgccaatggcaaggaagcgcgcgagatgttcacgcggatgcgtgacgagtattcgcgtcgacgcctgctgctaggcgtcgaccggctcgattactccaaaggcttgcctcagcgcattcacgcgtttcgagaactgcttgcacactatccagagaatcgcgatagcgcgaccttgatccagattgcgtcgcctagccgcgaaagcgtggctgcctatgacgatcttcgtcgtcagatggacagcctgtgcggcgcgatcaacggcgactacggtgaactggactggatgccggttcgctacattcaccggcacgtggcacgcaagcgcctgcctggtctttatcgcgcgagcaaggtcgcgctggtcactccgctgcgcgacgggatgaatctcgtcgccaaggaatttatcgccgcacaggatccgtctgatcccggcatgttggtactgtcccgtttcgccggcgccgcggagcaactcaaggaagcgttgctggtcaatccctacgacacgcaaggcaccgcgcatgccatccaaagggcgctgaccatgccgctcgatgaacgtcgcaatcgtcatgctgcactgatgaaaaggattcgcgagcatgacgtccactggtggtcttccagtttcctggacacactccaggatattccttgagcgaagaaaatacgtaaggccgat

SEQ ID NO: 28332 - DNA, 1140 bp, Burkholderia fungorum
atgaccgaggagcgccggctgatccaggcgtcggcccggcagttcgcgcgcgaggtggtgttgccgctcgccaaccggctcgatccgctgaaggaggatatcccgatgtccttgcgcgagcggatggccggactcggctacttcggcattctgatcccggaggaatacggcgggctcgggctcggcgtgtccgagtactgcctgatcacggaggagctatcgcgggcctggatgagcgtcggcagcatcatccgcaacctcgggctgatggtcgtgcaggggatgaccgacgggcagcggcagcgctggctgccgcgcatggcatgcggcgaattcctcggtgcgctggcgatgtcggagcccaacgccggctcagacgtggccgcgctcaccacacgcgcgataccggacggcgacggctggcgcatcacgggctcgaaatgctggtgcacatttgccgatggcgccgactacatcgtcgtgatcgcgcgcaccgcgcgggtcaccgacgtggcgaggcgccatcaggggctgtccgcgttcctgatcgagaagccccgtggcgcattgccggcgggcgtgatcggctcgccgatgccgaagatcggctactacggctggaagacgtgggagttgtcgttcgacgacgtctacgtcggccctgagacgctgatcggcgaaccgggccgcgcgttctactacgttgcccacggcctcgagacggcacgcgcgcataccgccgcgcgctcgatcggattggctcagggcgctcttgaggatgcactcgactacgcgacccagcgcgtgcagttcggccacccaatcggtgactttcaggcgctgcgtttccgtctcgccgacatggcgacgcgtgtcgagaccgcccggcaactgctgcgctcggtgtgcgagcagatcgacagcggcgtgcgctgcgagaaggaagccgcgatggccaagtactacgcagcggagatcagcgagacggtcaccagcgatgcgttacagatccacggcggcgccggctacacgacccacttcgcggtcgagcgctactggcgcgacgcacgcctgaccaagatcttcgagggcacctctgagatccagctacgcatcatttccgatcacttgctgggcaag

SEQ ID NO: 28333 - DNA, 735 bp, Burkholderia fungorum
aagttcgcgcttgtgaccggcggcgcacgcggtctcggcctcgagattgcccagcagcttgcaacgctgggcgcgcacgtcatcatcggcgcacgagacacggcgaaggccgaggcggtcgccaccgagttgcgcaacctgggccatgcagtatccgcgctcaagctcgacgtcacgagcgatgaggatcggcaggcggcctacgccgaaatcgacagagcgcacggcaggctcgacattctgatcaataacgccggaattttgctggatagccccgacggcggcacaccagctacccgacagccgagcgaggcactgcccaacgtggtgcgcgacacctttgaggcgaacttctttgctcccgtttttctaacacaaaccctgctgccgctgattcggcggtcgagtgctggccggatcgtgaacgtgtcgagcatcagagggtcgctcgcacatctatccgatccgtgctcgccggtctacccgatccgggctctcggctatgacacatccaaggccgcgctcaacgccttcactattttgatcgccgcggaactgcgagacacgccgatcaagatcaatgcggttcatcccggctggctgcgaaccagcatgggcggtgaacgggcaaacatgagcgcagaggacggtgcgcacgccgtcgtgaagtacgccagccttggtgaagacggccccaccggcggcttcttcttcctcgatgaacggctgccgtgg

SEQ ID NO: 28334 - DNA, 735 bp, Burkholderia fungorum
ctcgctggaaaggttgccctcgtcacgggtggatcgcgcgggctcggtgcggcgaccgctgccgcgctggccgatcagggcgcggacatcgccatcagctatgtcgcttccggggaaaaggcattggccgtcattgaaagcatcaaagcgaagggcgtgcgtgccattgcgatcaaggccgatcagggcgatccggccgccgcggaaccgatggtgcgcgaagtgctgtcgaagctcggaaagctcgacatcctggtcaacaacgctgccgttgcactgcaaggcaaaaccatcgacgaccccgccatcgacaatgcggcaatggatcggcaatgggccatcaacacctttggcgtgatcgccaacattcgtgccgccgccaaggtgctgcccgagggtggtcgcatcatctccatcggttcgggcctcggcacacgcatcgcattccccggcaccgccgactatgccgccacgaaggctgcggtggtcggttactccaagggagccgcgcgtgatctcggcggccggaacattaccgtcaacgtcgtccaggccgggatgatggacaccgacatggctgccggatcgaagggcaagctgcctccgatcatcatggaaagccatgccatccaccgcttcgccgaattgagcgaggtcgctgcagccgtcgtctttctggcggggccggatgccggttttataaccggctccgtcattgatgtgaacggcggcttc

SEQ ID NO: 28335 - DNA, 723 bp, Burkholderia fungorum
aaagtcgtggtgctgacaggcgcaggcggtggcatagcgtcggccatcgtcgatcgcttcgcccgatcgggatcccgcattgtactgctcgaactgcgtacgtcgtcgctggcggacgcggagcaacgactcgctgcggcgggcatcgaatcggtttcgattgaatgcgatgtggccgatgagtcatcggtgaaaaacgcagccgggcgtacggtcgaacattttggccgctgcgacgtgctcatcaataatgcggcaacgcttgcaccggcgacgtcgatcgagaagttgctggtggccgactgggaccgtacgctcgctatcaatctgcgcggcgtattcctcaccactaaatatttgggcgctctgatgttgaatcagggttcgggcagcatcgtgaatatcgcttcgatcgcggccaccgcgcccaacgcctcgccgcaatatggtgcaagcaaagcggcggttctcgcttttacgcggcacactgcggtggaatgggggccgcgaggcatccgcgcgaacgcggtcagtcccgggttcattcgaacgccactgtcggagagcaactacgcggagccggaaatgctggcgcgtcgctcgaacatggtgccgtcccggcggctcggtcttcccggcgacattgcagaagcagtcgcgtttcttgccggcgacggtgcgtcgttcatcaacggacaggaactcgcagtcgatgggggcttc

SEQ ID NO: 28336 - DNA, 1350 bp, Burkholderia fungorum
gactggatcgcccgcagcctgcgcgccgtctggcacccctgcacccagatgaagcaccacgaacgcctgccgctcgtccccgtcgcgcgcggtcaaggcgcgtggctctacgaccgcgccggccatcgctatctggatgcgatcagctcctggtgggtcaacctgttcggtcacgccaatccgcgcatcaacgcggcactgaaagaccagctcgacacgctcgaacacgccatgctcgccggctgcacgcacgaaccggccatcgaactcgcggagcgcctcagcgcgctcaccggcaacacgctcggccacgcattcttcgcatcggatggcgcgtccgccgtcgaaatcgccctgaaaatgagcttccactcgtggcgcaatcgcggtttcgccgacaagcaggaattcgtctgcatcgccaacagttaccacggcgaaaccatcggcgcgctcggcgtcacggatgtcgcactcttcaaagacgcctacgacccgttgatccgccacgcgcacgtcgtagcgtctccagacgcccgcctcgcgcaagccggcgaaaccgccgccgatgtcgctcgccgcgcgctcgatcacgtccgctcgcttttcgaagcacgcgccacgaaaatcgccgcgctgatcgtcgagccgctcgtgcagtgcgcagccggcatggccatgcacgacgcgtcgtatatcgccggactacgcacgttgtgcgatcagtacggcgtacatctgatcgccgatgaaatcgccgtgggctgcggccgcaccggcactttcttcgcgtgcgaacaggccggtatctggccggacttcatctgtctgtcgaaaggcatcagcggcggctatctgccgctctcgatcgtgctgtcgcgcgacgaaattttcgaagccttctatcacgacgacaccgcgcgcggcttcctgcactcgcactcgtacacgggcaatccgctcgcctgtcgcgcggcgctcgccacgctcgatctgttcgcagccgacaacgtgatcgccgtcaacgcacaaaaatccgcgaagctgaaagccgcgctcgcaccgctcgccgaacacgaacaagtccgcaatctgcgtcagtgcggcacgatcttcgcgttcgacgccctgatcgacgatgctcagcaggccagaacattctcgcgccgcttcttcgaaaacgcgctgcggcgcgaactgctgctgcgcccaatcggcacgacggtgtatctgatgccgccttatatcctcgacgacgaagaactcgcgctgctcgcctcgcgcacgcgcgagaccttcgacgccacgctcgcggagacccgctaatgcatctgctcgacacactcgccg

SEQ ID NO: 28337 - DNA, 1113 bp, Burkholderia fungorum
gcgcgcggcctgcgccgtcgccgccgcaccgccgacacgccgtgcgcggcccacatgaccgtcgacggccgcgcgatcatcggcttcgccagcaacgactatctcggcctcgccgcgcatccgcaactgatcgcggccatcgctgaaggcgcgcagcgctatggcgcgggcagcggcggctcgcatctgctcggcggccactcgcgcgcgcatgcgcaactcgaagacgatctcgccgaattcgtcggcggcttcgtcgagaatgcgcgcgcgctctacttcagcacgggctacatggcgaatctcgccacgctcaccgcgctcgcgggccgcggcacgacgctcttctccgacgcgctgaatcacgcgtcgctgatcgacggcgcgcgtttgtcccgcgccgacgtgcagatctacccgcactgcgataccgacgcgctgagcgcgatgctcgaagcctcggacgccgacgtcaaggtgatcgtctccgacaccgtcttcagcatggacggcgatatcgcgccgctcccacgtctgctcgaactcgcggaacaacacggcgcctggctgatcgtcgacgacgcgcacggtttcggcgtgctcggcccgcaaggccgcggcgcgatcgcgcaagccgcgctgcgttcgccgaatctcatttcgatcggcacgctcggcaaagcggcaggcgtctccggcgcgttcgtcgcggcgcatgagacggtgatcgaatggctcgtgcagcgcgctcgcccgtacattttcaccacggcgtcggtgccggctgcggcacatgcggtgtcggcgagtctgcgcatcatcggcggcgaggaaggcgatgcgcggcgcgcgcatcttcagcaattgatcgggcgcacgcgcgccatgctcaaggcaacgccgtggctaccggtcgattcgcatacggccgtgcagccgctcatcatcggcgcgaacgacgccacactcgagatcgcggccacgctcgatcgcgcgggcctgtgggtgccggcgatccgtccgcccaccgtgcccaccggcacgtcgcgtttgcgcatttcgttatcggccgcgcactcgcaggcggatctggatcgtcttgaagcaggcttg

SEQ ID NO: 28338 - DNA, 891 bp, Burkholderia fungorum
agcgaattccctctcttcgtctcagccggcgacatcctcaccgatctcgtgcgcaccggcccttcccaatggctctcgcgtcccggtggcgccggctggaacgtggcgcgctgcgtggcgcggctcggcctgcccacggcatgcgccggctcactgggcgtcgacaatttctccgacgaactgtggaacgccagcgtcgccgcagggctcgacatgcgcttcatgcagcgcgtggaacgcccgcccctgctcgcgatcgtgcatcagacgcatccgcccgcgtatttcttcatgggcgagaacggcgccgatctggctttcgatccggcacgcctgccggcaggctgggcgagccacgtgaagtgggcgcacttcggctgcatcagcctcgtgcggcagccgctcggcaacacgctcgcagcgctcgcggcgcagttgcgctcgcaaggcgtgaaaatcagtttcgatccgaactaccgcaatctgatggagcatggctacgagcccacgttgcgaaaaatggccgcgctcgcggatctgatcaaggtatcggacgaagacctgcgcctgctcttcaaaaccgacgacgaagccagcgcgcttgcgcaactgcgggccatgaaccccgccgccaccgtgctggtgacgcgcggaccggagaccgccgtgctgatcgacggcgccgtggtgaccgaggcccggccgccgcgcgtcgaggtcgtcgacacggtcggcgcgggcgacgcgtccatcggcggcctgctgttcagcctgatgaccgcgccgcagcgggcgtggcccgaacacctcgcgttcgcgctggccgccggggcggccgcgtgccgccatgccggcgcgcacgcgccgtcgctcgatgaagtggtcgcgctg

SEQ ID NO: 28339 - DNA, 1440 bp, Burkholderia fungorum
ctgatccgcacggacaacttcatcaacggccagtggatcgcggcggcaagcggccggcgtttcgcggtcaccgacccggccaccggcaacctgatcgccgatgtcgccgacagcggtccggccgacgcgcgcgccgccaccgacgccgccgcgaaagcgctgcccgcctggcgcgcgctgctcgcgagcgaacgcgcggcgatcctgcatcgctggcacgcgctgatcgtcgccaatcgcgacgcactcggcgcgctgatctcgctcgaacagggcaaaccgctcaccgaagggcgtggcgaggtgggttacggcgcgtcgtatgtcgcgtggttcgccgacgaagcaacgcgcatctacggcgacctgattccgcagcagcagcgcggcaaacgcatgagcgcggtgaaggagccgatcggcgtggtcgcggcgatcacgccgtggaattttccgctcgcgatgatcgcacgcaagattgcgccggcgctcgcggcaggctgcacggtggttgcgaaaccggctgaagacacgccgctcaccgccatcgcgctcgtgatgctcgcgcacgaagcgggcgtgccggacggcgtactcaacctcatttcggcgtcgcgcgcggctgccgccgaaacggtcggcgactggctcgccgacagccgcgtgcgcaagatcacgttcaccggttcgacgccggtcggcaagcatctcgcgcgcgaatcggcgggcacgctgaaaaagctctcgctcgaactcggcggcaacgcgccgttcatcgtgttcgacgacgcggacctcgatgccgccgtcaacggtctgctggccgcgaagttccgcaacggcggacagacctgcgtatgtccgaatcgcgtctacgtgcaacacggcgtgtacgagcatttcgccgcgctgctgcgcgcgagggtggcggagttgcgggtcggtccggcgagcgatcccacgtcgcagatcggtccgatgatcaacgtgcgcgcggtcgacaagatcgcccgccatgtcgacgatgcggtcgaacacggcgcggtcgtgctgacgggcggccgccgccttaccgagctcgggccgcactactacgcgcccacggtgctcggcaatgcaagtgcgtcgatggcgctgtgcggcgaggaaaccttcgggccggtcgtgccgctgttcccgttcgacaccgaacaggatgccgtgcaggccgcgaacgacaccccgttcggcctcgcgtcgtatttctacagcgaaaacatgcgccggatcgagcgcgtgtcgcgcgcgctggaggccggtatcgtcggcatcaacgaaggcgcgctcgcgtccgaagcggcaccgttcggcggcgtgaaggaatccggttacggccgcgaagggtcgaagtatggactcgacgactatctgtcgatcaagtatctgtgtcagggaggattg

SEQ ID NO: 28340 - DNA, 1068 bp, Burkholderia fungorum
taccgcattgccgtcattcccggcgacggcatcggcaacgaagtcatgcccgaaggtctgcgcgtgctggacgccgcgtgccggcgctttgacatcggcatcgaataccgtcagatcggatgggcgtcgtgcgactactacgcgcagcacggccagatgatgccggacaactggaaagagcaactgcaggattgcgacgcaatcctgttcggcgcggtcggctggccggagaaggtgcccgaccacatctcgctgtggggatcgctgctcaagttccgccgcgagttcgatcagtacgtgaacctgcgccccgcgcgtctgttcgaaggcgtgccctgcccgctcgctaaccgcaaaccgggcgatatcgacttcatgatcgtgcgtgaaaacaccgaaggcgaatattcgtcggtgggcggcacgatgttcgaaggcaccgagcgcgaagtcgtgatgcaacagtccatcttcacgcgccacggcaccgaacgcgtaatgaagttcgcgttcgacctcgcgcagcgtcgcgcgaagaagatcaccgtggcgaccaagagcaacggtatcgcgatcagcatgccgtggtgggacgcgcgcgccgacgaaatggccgcccgctacccggacgtgaagatggaccgccagcacatcgacattctgtgcgcgcgcgtcgtgctgaacccggaccgcttcgacgtggtggtcgcgtccaacctgttcggtgacatcctgtccgatctcggcccggcgtgtaccgggaccataggcattgcgccgtcgggcaatctgaatcccgaccggcgttttccgtcgctgttcgagccggtacacggctcggcgcccgacatcgccggcaagggcattgccaatccggtcgcgacgatctggtcgacggcgatgatgctggagtttctcggcaacggcgcgcgtgtcgagcgcgacgcgcatgacgcgatcgtcgcggcgatcaccgaggtgctgaaggacggcccgcacaccggcgacctgggcggccgcgcgtcgaccaccgaggtcggcgcggcgatcgcggcccgcgtcgcgcaa

SEQ ID NO: 28341 - DNA, 1413 bp, Burkholderia fungorum
tttattggcggtgcgtactattcgacgggcgaggcgcagatcgccgttcatcggccgtcggacggcgcgctgctcggccatgtgccggacgcgaccgacgccaccgtcgatcacgcggtcagcaacgcgctcgctgcatggaagacgagcggctggggtacccgttcgccgcgcgaacgcgcgaaggtgctgcgccgctgggccgacctgatcgatcgcgatgcggtgagcctggcgcaactcgaaacggtcagctcgacgcggccggtcgccgaaagctatgcatcggacgtgccgttcaccgccgaagcgatccgttttttcgcggaactggccgacaagctcggcggcgatatcgcggccacgcgccgcgacagcctcggcttcgtcgcgtcggaaccgtacggcgtgatcggtgcgatcacgccgtggaatttcccgctgtcgatgtgttcgtggaaatgcggcccggcactcgcggccggcaacgcggtcgtgctgaagccgtcggaaatgacgccgttctcgacgttgcgtctcgccgaactcgcgatcgaagccggcatgccgcccggcatcttcaatgtcgtgaacggccgtggtgcgaccaccggcgcggcgctaacgcgtcaccccggtatttcgaagatgagcttcacgggatcgacccgcaccggcgccgcgatcatgagcgacgccgcgatgcacggcaccaagccggtcacgctggaactcggcggcaagagcccgcaactggtgttcgaacacgtacgcgaccttgacttcacggcgggttgcatcgcccgcggctttaccgcgaacggcggccaggcctgcgtggccggcacgcggctgatcgtgcacaagcgcattgccgagccgctcgtcggggctatccaacgtcaattgcagtcgatcaaacccggtccgctgtgggacagccgcaccacctattcaccgatcatcagccccgcccaggcgcgccgtatcgaaacgctgatcgaccagagccgcgacagcggcgcggaagtgatcttcggcggcggctttttcgacggcaccgacgaaggcttttttcatcgcccgacgctgctcgccaacgtgaccgacgcgacgcccgccgtgcgcgaggaactgttcggcccggtcctgacggtgcagacattcgacgacgaggacgagggcatcgcgctcgccggtcatccaatttacggcctcgcggcgggtattcacagcagcgacatcggccaggcgctgcgcgcgatgcgccgtatcgccgcgggcacgatctggatcaaccgttatggccgcagcggcgacatgatcattccgaccggcggcttcggccagtccggcatcggcaaggatctcggccgcgaggcgatggtcgcgagcatgcgccacaagagcgtg

SEQ ID NO: 28342 - DNA, 1377 bp, Burkholderia fungorum
atgtcaaaaacatcgcttatcgccgccgaccgcaagcatctgatccacccggtcatcaactaccgtgcgcacgaagcgcgcggcgccaccgtactcgaatccggccagggcgcgtatctgcgcgacatcgacggcaacgagctgctcgacgcgttttcgggcctgtggtgcgtgaacgtcggctacggccagcagagcatcgtcgaagcggcgacgcgtcagatgacgaagctgccgtatgccaccacctatttccacttttcgtcggagcccgcgatcgaactggccgacaagctggtcgcgctcgcgcccgcttcgctgcaacacgtgtacttcacgcttggcggctccgacgcggtcgactccgcgatccgcttcatcacgcattacttcaacgcgactggacgtccgtcgaaaaagcagatgatcgcgctggagcgcggctatcacggctcgtcgtcggtcggcgcgggactcaccgcactgcccgcgttccatcgcaacttcgatctgccgctgccgcaccagcatcatctgccgtcgccgtatgcgtaccgtcagacgcatggcgacgacgcgcaggcgctgatcgccgcgtcggtcgccgctctcgaagccaaggtcgcggcactcggcacagacaacgtcgcggcgttcttctgcgagccgatccagggatcgggcggcgtgatcgtgccgccggtcggctggctgaaagcgatgcgcgacgcgtgccggcgtctggacatcctgttcgtcgccgacgaagtcatcacgggcttcggccgcacgggtccgctcttcgcgtgcgaagcggaacaggtcgagccggatctgatgacggtcgcgaagggactgacctcgggctatgcgccgatgggcgccgtgctgatgtcggacgaaatctaccagggcattgccggcgacgcacgcgacaccgcgatcgtcggtcatggccagacctactccgcgcatccggtcagcgcggcgatcggcctcgaagtgctgcgtctttatcaggaaggcggtctgctcgcgaacggtcaggcgcaggcgccgcgctttgccgccggcctcgacgcgctgctcgggcatccgctcgtgggcgactcgcgtcatcgcggcctgctcggcgcgctggaactggtcgccgacaaggattcgcgcgcccgcttcgacccggcgctcaaactgccggaccggatcgcggcggccgcgtaccgcaaccgcctcgtgttccgcgcattcggcgacagcattctgggcttcgcgcccgcgctgtgtttcggcgaggccgaattcgagcagatgttcggccgcctgaagcgcacgctcgacgaagtgctcgacgaaacggaggtgcgcgccgcgttgcgc

SEQ ID NO: 28343 - DNA, 786 bp, Burkholderia fungorum
atgaaagaaagacttgcttccaaggttgcggtcatcactggggcagcccaaggaataggtgcgtcggttgcacggtcattcgcacagaacggttgcttcgtctacgtcactgatatcaacgatgagcttggcagaacagtggcgacgtcgattggcgattgcgctgcgtatttgccacttgacgttcgagaagaaggcgattggcagcgtgtaacgacgcatgtcctggaaaaacacggccgactggacgtattggtcaacaacgcagggattactggctttgaggctcgtgtcgtgccgcatgatccagagcacgcgagccttgaggagtggcgcgctgtacatcgaacgaacctcgacggagtgtttctcggctgcaagtacgccatacgtgccatgcgacgtcatggacagggctcgatcataaacatctcttcacgctctggcctggtcggcattccaggtgcggcggcatatgcatcgtcaaaggccgcagtccgcaaccacacaaagactgttgcgctctactgcgcgggacaaaacctcgaagttcggtgcaactcgattcacccagccgccatcctcacgcccatctgggaacccatgttgggcaccgacgccggccgcgaggaacgaatggctgcactggtccgtgataccccactccggcggttcggcacgcctgaggaagttgccgccctcgcattgttgctggcatcggatgaggcgacgtacatcaccggtagtgaattcaacattgacggtgggctcctggccgggtcggcg

SEQ ID NO: 28344 - DNA, 993 bp, Burkholderia fungorum
tacccgctcgtacgcgcccaactctttcgcatggacgcggaagacgcccaccacctgaccttgcgtattctcggcgccgccggccgcaccggcctcgccggcgcgctcgcgccgcgcgtgccggatgcgccgcgcaccgtaatggggctgacgttccgcaatccggtggggctcgccgcggggctcgacaaggacggcgcatgcatcgacggtctcgccgcgctcggcttcggctttatcgaagtcggcacggtgacgccgcgcgcgcagccgggcaatccgcgcccgcgcatgttccgtctgccgcaggcgaacgccgtgatcaaccgcatgggcttcaacaacgcgggcgtcgaccagttcgtgaagaacgtgcaggccgcgcgctatcgcggcattctcggtctgaacatcggcaagaacgccgacacgccgatcgagcgcgccgccgaagactacctgtactgcctcgaccgcgtgtatccgttcgccagctacgtgacggtcaacatctcgtcgccgaatacgaagaatctgcgccagttgcaaggcgcgggcgaactcgacgcgctgctcgcggcgctcaaggacaagcagcagcgtctggccgacatgcacggcaagctggtgccgctcgcgctgaagatcgcgccggacctcgacgacgaacagatcaagtcgatcgcggacacgctgctgcgtcatcgcttcgaaggcgtgatcgccactaacaccacgctctcgcgcaccgccgtcgccggcatgcaatacggcgacgaagccggcggcctgtcgggcaagccggtgttcgacgcgtcgaacgcagtgatccgcaagctgcgcgcggaagtcggcgaaacggtgccgatcatcggcgtcggcgggattttctcgggcgaggacgcgcgcgccaagatggcggccggcgcgtcgctggtgcagctctataccggcttcatctaccgcggaccggcgctggtggccgaatgcgtt

SEQ ID NO: 28345 - DNA, 1899 bp, Burkholderia fungorum
gccagcatcgacggcatggaggcttatcgcgccctcgttgccgaagcgagccaggatcacgaagcgttctgggcacgtcttgcccgcgaacacctgacgtggcgccgcccattcacgaaagtactgaacgacgcagacgcgccgttctatcgctggttcgaagacggcgaactgaacgcctcgtacaactgcctcgatcgcaatctcgccaacgggctcgcggagaaaaccgcgatcgtgttcgagtcggacgacggcaacgtcacgcatgtcacctatcaggcgctgtatcaccgcgtatgccggctcgccaatgcactgcgtgcccgcggcgtgaagaaaggcgaccgcgtggcgatctatatgccgatgtccgtggaaggcgtagtcgcgatgctcgcgtgcgcacgcatcggcgcgccgcactcggtggtgttcggcggcttttccgccaagtcgctgcatgagcgcatcgtcgatatcggcgcgtgcgcgatcattaccgcggacgagcaggttcgcggcggcaagaccctgccgctcaaaacgatcgtcgacgaagcgctcgcaatggccggcacggccggcatcaggacggtggccatctaccggcgcacgggcggccagattccgtggattgccggccgcgatacatggctgcacgaactcgaagcggcgcagccggacacctgtgagcctgagtgggtcggtgcggagcacccgttgttcgtgctctacacgtccggctcgacgggcacgcccaaaggcgtccagcacagcaccggcggttacctgctgtgggctgccgtgacgatgaagtggaccttcgacatcaaaccggcggatgtgttctggtgcacggcggacatcggctggatcacgggtcacacctatatctgctatgggccgaccgcggtcggcgcgacgcaggtgatcttcgaaggcgtgcctacctatccgaacgcgggacgcttctgggacatgatccagcgccacaaggtcagcatcttctacacggcgccgaccgccatccgctcgctcatcaagtccgccgacgccgatcattcggtgcatccggacagcttcgacctgagcagtctgcgcctgctcggcacggtcggcgagccgatcaatccgagcgcctggacgtggtatgcccagcatgtcggcggtggacggtgtcccgtgctcgacactttctggcagacggaaacgggcggacacatgatttctccgttgccgggcgtcactccgctcgtgccgggttcgtgcacattgccgttgccgggcatcgacgcggcgatcgtcgacgaaaccggtcaggaagtgccgaacggaaacggtggcgtgctggtcattcgcaagccctggccttccatgatcagaaccatctggggtaatccggaacgcttccggcaggggtatttccccgaagagctcggcggcaagctgtatctcgccggcgacggcgccatccgtgatcgcgacaccggctacttcaccatcaccggccgtatcgacgacgtgctgaacgtttccggccaccggctcgggacgatggaaatcgagtcggcgctcgccgcgcatccgctggtggccgaagccgcggtggtcgggcgtcccgatgaaaccgccggcgaggcgatcgtggcgttcgtggtgctcaaggcagagcggccgtccggagccgacgcaaagcgcgtggccgacgaactgcgcgcgtgggtcggcaaggagatcggcccgatcgccaaaccgaaggacatccgcttcggcgacgccatgccgaaaacgcgctccggcaaggtggtgcgccggctgttgcgctcggtggccaaaggggaagtcatcgtgcaggacacgtcgacggtggaaaaccccgcggtcatttcacagttc

SEQ ID NO: 28346 - DNA, 1020 bp, Burkholderia fungorum
atggcccaactaatgaaagctgctgtcgttcacgaattcggcgctccgctgcgtatcgaagaggttcccgtcccgcaggtggggcgcggccagattctggtgaacatcaaggcgtccggcgtctgtcacacggacctgcacgcggccgacggcgactggccggtcaagcccaccctgcccttcattcccggtcacgaaggcgtgggctatgtcgctgccgtcggcgaaggtgtcaagcatgtcaaggaaggcgatcgcgtcggcgtgccgtggctttataccgcctgcggtcactgcgagcattgcctgggcggttgggaaacgctgtgccaggaacagcagaatacgggctactcggtcaacggcgcttacgccgaatacgtggtggccgacccgaacttcgtcggtcatctgcccgcggccgtctcgttcgaagatatcgccccgattctgtgcgcgggcgtgacggtgtacaaaggcatccgcatgacggacgcgcggccgggtcaatggatcacgatttcggggatcggcggcctcggccatgtcgcggttcaatatgccattgcgatgggcctgcgcgtggtggccgtcgatatctcggaggacaagctggctcttgcccgcgaactcggcgcaacgcttgcgttcaacgcttcggagtgcgaccccgcggcggcgatccagaaggaaatcggcggaacgcacggcgtgctcgtcaccgccgtatcgcgcagcgccttcgctcaggcgctgggcatggtgcgccgcggcggcaccgttgcgctgaacggtctgccgccgggcgactttccgctgccgatcttctcgaccgtgctcaacggcattaccgtgcgcggctccattgtcggcacgcgccaggacttgcaggaatcactcgaattcgccgcacagggccgtgtgcgtgcccgaatccatctcgaccggctggacaatatcaaccatgttctcgccgaattgaagagcgggaaagtggatggacgcatcgttctgaatctc

SEQ ID NO: 28347 - DNA, 996 bp, Burkholderia fungorum
atggctttcaatctacgcaatcgcagtctgctcaacatgcaggacttcgcgccgcgcgacatccgctttctgctcgacctcgcctccgagctgaagcgcgccaagtacgccggcaacgaagtcccgcggctcaacggcaagaacgtcgcattgattttcgaaaagacctcgacgcgcacgcgttgcgcattcgaggtcgccgtgcacgaccagggcggccacgtcacctacatcgactccgcgagttcgcagctcggccgcaaggagtcgctcaaggacaccgcgcgggtactcggacggctctatgacggtatcgaataccgcgggtttcatcagagcgtggtcgaggatctcgcgacctattcgcatgttccggtctggaacggactcaccgacgaattccaccccacccaggtactcgccgacctgctcaccatgcaggaattcggcgagaaaccgttgcacgagctatcgttctgctacctcggcgacgcccgcttcaacatgggcaattcgctgctgatcggcggggtgcaaatgggcatggacgtgcgcatcgcggcgccgcgcgaattgtggccgcacgacgaactggtagcgcaaatgcggcttctcgccgagcgcaccggcgccagcgtgacgatcgtcgaggatccgcatgaggcggtgagcggcgtcgacttcgtctacacggatgtctgggtgtcgatgggcgagcccgtcgaagcgtggggcccgcgaatcgatctcctgcgcccctatcaggtcaacgccgcgctgatgaaagcgaccggcaacccgcgcacccgcttcatgcactgcctgcccgcctatcacaatctcgacaccgacaccggccggatggtccacgagcatttcggcatgtccgaactcgaagtcagcgacgaggtgttcgaatcggatgcgtcgatcgtcttttcccaggctgagaaccgcatgcacacgatcaaggccgtgcttgtggcaaccctcgct

SEQ ID NO: 28348 - DNA, 1209 bp, Burkholderia fungorum
ttcggcgtctattccgaaataggcacgctgcgcaaggtcatggtctgccgcccgggacttgcccaggcgcgcctgacaccggccaattgccgcgacctgctgttcgatgacgtgctgtgggtatcgcaggcaaagaacgaccattacgcattcgtcagcacgatgcaggagcacggcgtcgacgtgctggaaatgcacgatctgctggccgacatcctgcaaggccgcgaggcgcgcgactgggtgctcgaacacaagcttgcgcccggcaccgtggatgcggaactggcggcgcaactcaggccctggctccaggagatggagccgggcgaactcgccacacgcctgatcggcgggatcgttcgcgccgaattgccgttcgaggccgacggcctgctcgcgcaatgcacgccgccctcgggattcattctgccgccgctgcccaacacgctcttcacgcgcgacagcagttgctggatcaacgacggcgtcgtgctcggatcgatgtactggccggcacggcgacaggagacgctgctcgccaccgccatctaccgcttccatccgctgttcagcagcggaacacgcgtgtggtggggcggcccggaaacggaccacggcggcgcgacgctcgaaggcggcgatgtcatgccgctgtcgcgtgacgtcgtgctgatcggcatgggcgagcgcagttcgccgcaaggcgtcgcgcagctcgcgcgggccctgttcgccggcgaatcggtcaagcaggtgattgctgcgcagttgccgcgctcgcgcggcgcgatgcacctcgacacggtgttcaccttctgcgatcgcgacctggtcacgatcttccccgaggtggtggatgccatccgttgcacgagtttgcgccccggcaagcagcccggtcagctcgacgtgcgggccgaaagcgcgccgtttctggacgtggtcgcgcaggcgctgggtatcgggacgctgcgcaccgtcgccaccggcggcgatacgtgggaatccgagcgcgagcaatgggacgacggcaacaacgtgatcgcgctcgcgccgggcatcgtcgtggcctacaaccgcaatgtgtacaccaacacgcttctgcgcaaggcaggcgtggaagtcattacgatcccgagcggcgaactgggccgcgggcgcggcggcggccattgcatgacctgcccgatcgaacgcgcccccctc

SEQ ID NO: 28349 - DNA, 1377 bp, Burkholderia fungorum
gacgcctggctcgcggcacagcgcaaggtgctggcccgcacggcgcccgcgccttatgccgacacgctcggccgcgtggagcggatcggcgacggtatcgcgttcgtttcgggactggccgatgcggcgctcgacgaactgctgcgcttcgaaagcggcgcgagcggtttcgtgcacacgctggaagccgatctgatgagcgtcgtgctgctggacgacggcgccacggtcgaagccggcgcgcgcgtgacccgcaccggcgcggtgatcgaggtgccggtcggcgaaggcctgctcgggcgcgtgatcgacccgctaggccggccactcgatcgcgacgagccggtggcgacggtgaagcgcatgccgatcgagcggcccgcgccggcgatcatcgatcgcgatctggtcagcgagcctgtcgaaaccggcgtgctgatcgtcgacgcgcttttcgccgtgggccgcggacagcgcgagctgatcatcggcgatcgtgcaaccggcaagaccgccctggccctcgacgcgatcgtcaaccagaagcactcggacatgatctgcatctatgtggcgatcggccagcgctcgacggccgtgcagcaggtgatcgaatccgtgcgccgctacggcgcgcccgagcgctgcgtgttcgtggtggcgccggcggcttcggcggccggattgcaatggatcgcgccgttcgcgggcgtcacgatcgccgagtactttcgcgaccgcgggcagcacgcgctggtcgtcatcgacgatctcaccaagcatgccgcgacccatcgggagctggcactgctcacacgcgagccgccaggccgcgaggcctatcccggcgacatcttctacgttcacgcgagattgctcgaacgcgcggcgaaactgtcggccaagctcggcggcggctcgttgacggcattgccgatcgcggagaccgacgcgggcaatctgtccgcctatatcccgaccaatctgatttccatcacggacggccagatcgtgctggatgccgcgctatttgcggcgaaccagcgtcccgcggtggatgtcgggctgagcgtgagccgggtgggcggcaaggcgcagcatcccgcgttgcgcgaggtgtcgggccgcttgcggctcgactacgcgcagttcctggagctcgagatgttcagccgcttcggcggcctgacggatgctcacgtcgcgggcaagatagcccgtggcgaacgcatccgggcattgatcgcgcaaccacgattcaggccgctgcgcacggtcgatgaaatcgcgctgcttgccgcactggcggagggcgtgttcgatgccgcgccgccggccattgccactgaggcgcgggctcagctcgccgaacaactg

SEQ ID NO: 28350 - DNA, 2430 bp, Burkholderia fungorum
agcgaccaggcgaaggaaatactgcaacgcgccgccgaacgcgccgtgcaattcggccgtcacgaagtggacaccgaacacgtgctctatgaactcgtcgaaagcgaagcagtacagcgcattctgtcggcgctgaagatctccgccagcgaccttcagaagcatatcgaagcaaacgcgcccaaaggacacgccacgtcgaaagcgccgcaaggcgagatttccgtttcgccgcgcctgaagagtgcgcttgaacgcgcggttatcgcgtcgcgcgaattcggacagaactacgtcgggcccgaacatattctcaccggcctcgccgaagtcaccgacagttttgccggcgatctgttgatgaagtatggcctgtcgtctcaccagttgcgtcagcagacgttgaaacaggccggccaggaagaagccgcacaggcgcccagcaacacgccgcagctcgacaaatacagccgcgacgtcacgcggctcgcccgtgaaggcaagctcgatccggtgattggacgatcgaaggaaaccgagacgctcgtcgaggtgctggcccgccgcaagaagaacaaccccgtgctgatcggcgagcccggcgtcggcaagaccgcgattgtcgagggcctcgcgcagcgcatgatcagcggcgacgtgccggaaacgctgcgcgaaaaacgcctgatcgaactcaatgtcaactcgctggtcgcgggctcgaaataccgcggcgaattcgaggaacgcgtcaggcaggtgatggacgaaatcgccgcgcacaaggatcagctggtcctcttcgtcgatgaagtgcacaccatcgtcggcgcgggccagggcggcggcgaaggcggcctggatattgccaacgtgttcaagccgccgatggcgcgcggcgagctcaacctgatcggcgcgaccacgctcgccgagtaccagaagtacatcgagaaagacgccgcgctggaacggcgcttccagcccgtgctggtcggcgagccgagcgtggagcagaccatcggcattctgcgcgggctgcgcgaccgtctggaagcgcaccacaaggtcacgatcctggatgaagcgtgcgtcgccgccgccgaactgtccgaccgctacgtcacgggccgcttcctgccggacaaggccgtcgacctgatcgaccaggcggccgcgcgcgagcatctgtcgtccacatcgcgcccggcggaggtgctggaactcgaatcggaaatcgcccagatccggcgcgaacaggaatacgcggcgtcgcacaaacagttcgaacgggccacggcgctcggagagcaactgtccggcaagcaaacccggctcgacgacgcgacccaggcatggaagcggcgcgtgagtacgagcaccgcggaggtgacccgtacgctggtcgccgaaatcgtcgcgaagatgacgggcattccggttgccgacctgacgcaggaagagaaaaccagactgctgcaaatggaggaccgcctgcaccggcgcgtgatcggccaggaagaagcgatcagcgcggtaagcgatgcggtgcggcgaagccgcgcgggtttgcaggcccgccatcagccgctcgccgtgtttctgttcctcggcccgaccggcgtcggcaagaccgaactggccaaggcgctcgccgaagtcgtattcggcgacgaggacgccattgtgcgtatcgacatgagcgagtacatggagcggcacgcggtggcgcgactgatcggcgcgccgcccggctatgtcggctacgacgaaggcggccagctgaccgagcgcgtgcggcggcgtccgcatagcgtgattctgctcgacgaaatcgaaaaggcgcatccggacgtctacaacgtgctgctccaggtattcgacgacggccgcctgaccgacggcaagggccgcgtcatcgacttcgccaatacgctgatcattgcgaccagcaatctcgcctccgacgtcatcatgggcacgccgcgcaagcgtcccggcttcatcgccgcggacaacgacctcgccgccgacaagggcgcccgcaaggaccgccagccggacggcgtgcgcgaaggtgtgatgacggtgctgcggtcccatttccggcccgagttcctgaaccgtatcgacgagatcatcattttcgaatcgctgaacgccgaccagatccgttcgatcgtgcgcctgcaactcgacaaggtcgcgcacatcgcgaagagtcaggatatcgacatcgtgttcgacgacagtatcgtcgatcaactggcgaaggaggcttaccggcccgaatatggcgcgcgtgagttgcggcggcgcatccgccaggtcatcgagaatccgctggcaaagcagatgctcgacggcgcggtccgcgagggcaaccgcgtggtgtgccggttcgatccgctcgcggacgatacggtgttc

SEQ ID NO: 28351 - DNA, 1827 bp, Burkholderia fungorum
ctggtcgcgcggcaactcgacaacctggagatcggttcggaccagatcaccggcagcgtccggatgccaggcgcggctcctttgctgccggcatccgccgcgagcggactcgccgccaatggcgagccgtggcgctttttgaccgtgcgcgtgagcgacgatcatctgatcgaggatctcgccaactcgggcgtccgttataccggtgtagccgacaggatagggttggcggcggtgctcggctggatcgtccccatactgatgctcgcggctgtgtggagtgttttcatgcggcgcggtggcggcggtttgcgtgatttcagcgggatcggcaaaagcaggcccagagtctacgtcgcacaggacaccgacgtcacattcgacgatatcgccggcattgacgaagcgaaggccgagctgaagcagatcgtcgaatttctgcgtaatgccgagcgctatcggcgcctcggaggcaagattcccaagggcgtgctgatcgtcggcgcgccgggtaccggcaagaccctgcttgccaaggccgtggcgggggaagcgggcgtgccgttcttttcgatcagcggttcggcgttcgtcgagatgttcgtgggagtgggggcggcgcgggtgcgcgacctgtttgaacaggcgcagaagaaggcgccgtgcatcgtctttatcgacgaactggatgcgctcggcaaagtgcgcggcgccggtgtcacatccggcaacgacgaacgcgagcaaaccctgaatcagctgctggtcgagatggacggattccagccgaattccggcgtgatcattctggcggcgaccaatcgccccgagattctcgatccggccttgctgcggcccggacgcttcgaccggcatattgccatcgaccggccggacctcaacgggcgccggcagatcctgcaggtccacgtgaagaaagtgacgctcgcagcggacgtcgatctggccgagattgcatcgcgcacgcccggttttgccggagccgatctcgccaacgtggtcaacgaagccgcgctgcatgcggccgaactcgacaaatccgcggtcggcatggtggatttcgacgaagcgatcgaccgggcgatgaccggcatggaacgcagaagccgcgtcatgaacgaacaggaaaagatcaccattgcctatcacgaagcgggccacgcgctggtcgcgctgagccggccacattgcgaccccgtcaagaaggtgtcgatcattccgcgcggcgtcgccgcgctcggctatacgcagcaggtgccgaccgaagaccgctacgttctgcgcaagagcgaactgctggaccggctcgacgcgtacctcggcggacgcgtggcggaggaaatcgttttcggcgacgtatcgaccggagccgagaacgatctggaccgggcaacggcgctggtgcggcatatggtgacacgctacggaatgagcgagcggctggggcttttcacgttcgacagcagtgatcccggcgtgggctatccgtcggcgggcgggcgaggcgagcgcttcagcgaaagcaccgcgaagctggtcgacgacgaagttcgacgcgaactggccgaggcccacgaacgcgtgacgcgcacgctcgccgacagccgcgcgcaactggaccgcattgcgcggcgcttgctggagtgcgaagtgctcgaccaggccacgctgctgcaactgatgaccggcgacgccgcgccgccaaccgcgctgcaacagaacgccacggcggcagccagtgcggcggggaccggcgcttcagggcccgcggcgcccgaggcgaacgccgcgggcactccgtctcca

SEQ ID NO: 28352 - DNA, 855 bp, Burkholderia fungorum
atgagcggcagactcgcggaaatcgaagcgcgtaccgccaccgcgcgccaactggacgccgtgatcggcgccatgcgcggcattgccgcggctcgctcgcgagaagcgcagcggcggctgcccggtatccgctcgtcggccgcgaccgtgggggccgcgatcggcgccgtgctcgcctatggcagaggggcgcaggcaccttcggccgagccggatcatggcgtgcggatcgtgatcgcgctgtgctcggagcagggcttcgtcggctcgttcaacgagcaggtgctggactatgtacggactcgcgtcgatagcgcacggtgcgagctgctgctcgtcggcacgcgcggcgagatggcggccagcgagcgccgccttgcgctcgcatggagttcccccgcggtttcccacgccgacgaagtgccgtctctggccaaccgcattacggatgcgctctacgcgcgtctcggcctgcgcgcggtagatcaagtctcgatcatccatgcgctgccgggcggcggcgccgcctctggcaagatggtcgagcaccggttgataccgtttgatttttcgcgctttcaggtggcgcggcgcgctgtgccgccgctgctcacattgccggtcgaacgtttgcttcccggtctcgtcgaggaatatgtgttcgtcgagatctgcgaagcattgatgctctcgttcgccgcggaaaacgaagcgagggtgaacgcgatgctggccgcgcgcaccaatgtgcgggatacgctcgaagaactgacgcagagctatcgccgggtccgtcaggacgaaatcaccgacgatatcgcagagctggccgcagccaccacgcagccggtctag

SEQ ID NO: 28353 - DNA, 1617 bp, Burkholderia fungorum
ctcgagcgccgtgaggccaactacatccccgtcacgccgatcgatttcatcgtgcgcgcggcagaagtctacggtgatcgactggcagtcgtccacggggagattcgccgcaactggcgcgaaacctacgaacgctcccggcgtctcgccagcgcgttgcagcgggccggcattgaacgtggcgacacggtcgcggccttgctccccaacattcctccgatgatagaagcgcacttcggcgtgccgatggccggcgccgtgctcaatacgctgaatacgcggctcgacatttcgtcgctattgttcatgctgcgccacggcgaggccaaggcgctgatcgtcgataccgaatatggcgagttcgcgcatcgcgcttcgctggaattcccggatttgcgcgtgatcagcgtggcggacgccatgcccgccaatgccgatcaattcatccgcgcaacagactacgaagcgttcctgcaatccggcgaccccgaattcgcgtggaccatgccggccgacgaatgggacgccattgcgctgaactacacctcgggcacgaccggcgatccgaagggcgtggtgtaccaccatcgcggcgcgtatctgaatgcggtgagcaatatcctcgagtgggatatgcccaagcacgcggtttacctctggaccttaccgctcttccactgcaacggctggtgttttccgtggacggtggccgcgcgcgccggcgtcaacgtctgtctgcgcaaattcgatgcgaagacggtgttcgatctgattcgcaatgaaggcatcacgcattactgcggcgcgccgatcgtgcagagcgcgctcgcgaatgcgccggccgaatggcgcgacggcatcaaccatcgcgtgtcgacgatggtggcgggtgcggcgcccgcgccggcggtgatcgcgaagatgaaggaaattggtttcgatctcacgcacgtgtacggactcaccgagacctacgggccggccgcggtctgtgcgaaacaggaggcgtgggagacactggacgacagcgcgcgcgccgaactgaacgcgcgccagggcgtgcgctaccacctgcaggccgcggtgaccgtgctcgatccgcagacgctggcactcgtgcccaacgacggcgagacgatcggcgagatcatgttccgcggcaacatctgtatgaagggctatctgaagaacgagcgcgcgacggaagcggccttcgaaggcggctggttccataccggcgatctcggcgtacggatgcccgacggctatatccgcattcgcgatcgcagcaaggacatcatcatctccggcggcgagaacatctcgagtatcgagctcgaagacacgttgtatcgtcaccctgcggtggctgttgccgccgtggtggcgatggccgatccgaagtggggggaggtgccatgcgccttcgtcgaactcaaggaaggcgcccaggtgagcgcggaagagatcattgcgcactgccggctgtttcttgcgggatacaagctgccgaaagcggtgcgcttcggcgaattgccgaagacatcgacggggaaaattcagaagttcgaactacgcgcgcgcatcaagacggaagaaaaccagtaacgcagtcgc

SEQ ID NO: 28354 - DNA, 636 bp, Burkholderia fungorum
atgagtctacgtcttggcgatatcgcgccggatttcgaacggcagtcgagtgtcggcccgatcagattccacgagtggctgggcgatagctggggcgtgctgttttcgcatcccgctgacttcacgcctgtctgcaccaccgaactcggtctgaccgcgaagctggccggcgaattcgagaagcgcaacgtgaagacgattgcgttgtcggtggacagcgccgagtcgcacaaggagtggattaaagacattaacgagactcaggccgccaatgtcggcttcccgattctcgcggacggcgaccgcaaggtttccgagctgtacgacatgatccacccgaatgcgaacgaaacgctgaccgtgcgctcgctgttcgtgatcgacccgaagaagaaggtgcgtctcatcatcacctatccggccagcacgggccgtaacttcgacgaagtgctgcgtgtgatcgattcgctgcagttgaccgacagtcactcggttgcaacgccgggcaactggaagcagggcgatgacgtggtgatcgttccgtcgctgaaggacgaggaaatcatcaagcagaaattcccgaagggctacaaggcgctgcgtccgtatctgcgcatgacgccgcagccgaacaag

SEQ ID NO: 28355 - DNA, 612 bp, Burkholderia fungorum
cccttcctgtacgaacctgcgcccgacttcgaggcgcgctccacaatgggaatggtttcctcggcggattaccgcggaaaatggctgctgttcttttcccaccctgcggatttcacgccggtctgcacaagcgaattgatcgcttttgcacgcatcgctccgcgtttcaaggaacttggctgcgagcttctcgcgctttccatagacgggctctactcgcatctcgcctggctgcgcagtattcaggagcgcttcaacatggacattccatttcctgtcgttgaagacccgtcaatggccgtggcgaaggcctatggcatgctgccgccgaaagcggtctcgtcgagcacggtacgcggcatgttcctgatcgaccccgagggcatcatcaaggcgatcagctggtatcccatctccaccggccgctcggttgaggaagcattccgcctcttccaggcagtccgaatgacctggcaggaaaatctctacgcaccggccgactggcaaccgggttcaccatgcgtggtgccgccacccaagacgatcgaggacgcgtcgaaacgcctttcggaaggcgatgtactcgactggtactatcagactcgccagatc

SEQ ID NO: 28356 - DNA, 1848 bp, Burkholderia fungorum
tacgacttgctgaaaaccattgacgacccggcggcactgcgccgcctcgatcgccgccaattgcaaccgcttgccgacgagttgcgtgcctttgtgctcgacagcgtatcgcagacgggcggccatctttcgtccaacctcggcacagtcgagttgaccattgcgctgcattatgtgttcgacacgccgcatgaccggatcgtctgggacgtcggccatcaaacgtatccgcacaagatcctgacgggccgccgcgatcagatgcatacgctgcgtcagttgggcggcatctcggggttcccgaagcgtgacgagtcggaatacgacaccttcggtacggcgcactccagcacgtcgatctcggccgcgctcggcatggcggtcgcgagcaagctgaagggcgacaaccgcatgggcatcgccgtgatcggcgacggcgcaatgacggccggtatggccttcgaggcaatgaacaacgccggtgtcgaagacgacgtgccgctgctggtcatcctgaacgacaacgacatgtcgatttcgccgccggtcggcgcgctgaatcgccatctggcgcgcctgatgtcgggccgcttttacgcggccgcgcgtgccggtgtcgagcgcgtgctgcgcgtcgcgccgcccatgctcgatctcgcccgcaagctcgaagagcacgcgaagggcatgatcgtgccggccacgctgttcgaagagttcggcttcaactacatcggcccgatcgacggccatgatctcgattcgctgattccgacgctgcagaacatcaaggaactgcgcggtccgcaattcctgcacgtcgtgacgaagaagggccagggctacaagctggccgaagccgatccggtgctgtaccacggcccgggcaagttcaatccggccgagggcatcaagccggccgccacgccgtcgaagaagacttatacgcaggtgttcggcgaatggctgtgcgacgctgctgagctggatgcgcgcgtaatcggcatcacgccggccatgcgtgaaggttcgggcatggtggagttcgagaagcgcttcccggaccgttatttcgacgtcggtatcgccgagcaacacgcggtgacgttcgcaggcggcctggcggcggaaggcatgaagccggtggtcgcgatctactcgactttcctgcaacgcgcttacgaccagctgattcacgacgtcgcactgcagaatctgccggtggtgttcgcaatcgaccgcgcggggctcgtcggcgcggacggcgcgacgcacgcgggtgcttacgacctcgcgttcctgcgctgcattccgaacatgacggtgatggctgcgtcggatgaaaacgaatgccgccagatgctgtacaccgcattgcagcaaccgaaccccacggcggtgcgctacccgcgcggtgccggcacgggcgtggcgaccatcaaacagatgacggcgctgccgctcggcaagggggagatccgtcgcgaaacgtcgcagccggccggcaagcgcattgcgatcctggcattcggcacgatggtggcgccgtcgctggcggcggcggagcaactggacgcaaccgttgcgaacatgcgcttcgtgaaaccgctggacgccgatctggtccgtcagctggccgagacgcacgacgccatcgtcaccgtcgaagaaggctgcgtgatgggcggcgcgggttcggcgtgcgtggaagccctgcttgccagtggggttactcgtccggtactacaattgggcctccctgaccggttcatcgatcatggagatccggccaagctgctcgccgcgtgcggtctcgacgccgtgggcatcaccaagtcgatccgcgag

SEQ ID NO: 28357 - DNA, 882 bp, Burkholderia fungorum
ggacgacctatgacattcgaacaatggatgcgctcggtgctggagcgcgtcgaaacggcactagaccattatctgccgggcgaggccaccgagcccgccacgctgcatgaagccatgcgctacgcggtgctgggcggcggcaagcgggttcgcccgctgctgtgccacgcggctggcgaactgaccggcgcgcgtgccgaatgcctcgatgcggcagccgctgcgctggaaatgatccacgtgtactcgcttgtccacgacgacatgccatgcatggacgacgacgcgctgcgtcgcggcaagcccacggtacacgtcaagtatgacgaagccacggcattgctggtcggcgacgcgctgcaatcgcaggcgttcgtcgcgctgacctcggacgtgctcgctccggcgcaacaggccgcgctcgtgcgcgaactggcgctggcgagcggctcggtcggcatgtgcggcggccaggccatcgacctggcgagcgtcggccacacgctgacgcgcacgcagctcgaaaccatgcaccgcatgaaaaccggtgccttgctgcgcgccgcggtgcgcatgggcgcgctggctggcgaaacgccggacgcagcggccatgcgctcgctcgacgcatattcggctgctgtcggcctcgcgtttcaggttgtcgacgacattctcgacgtcacgaccgattccgccacgctcggcaaaaccgcaggtaaagacgcgaaggacggcaagccgacctacgtgtcgatcattggactcgacgcgtcgcgtgcgctcgcagcgcaactgcgcagtgacgctcacgccgcgctggcgccgttcggcgcacgcgcgcagcgtcttgccgaattggccgatctggtggtgaaccgg

SEQ ID NO: 28358 - DNA, 834 bp, Burkholderia fungorum
ctgatctccgcggccaatctcgcggaacggctcgccgccgcgccgggcagcgtgttcgtcatcgattgccggttcgatctggccgacccggaggcgggcgaaaaagcctatctggccgggcatctgccgggcgcgcattacctgcatctcgatcgcgatctgtcggggccgaagaacggccagaacggccgccatccgttgccggatcgtgcgcggctggtggagacgctggagtcgcgcggcctgaaacaagggcagcaggtcgtcgcctatgacgcacaaggcggcatgtacgccgcccgcgcatggtggctgctgcgctggctcggtcacgacgcggtcgcgctgctcgacggcgggctgcaggcatgggaggcaggcggttatccgctgacgcaggacgcgcccgcccagaacaccggcgacttcaaagccggcgcgccgctgtcggtcacggtcgacgcgcaaacggtcgagcgcaatctgggttcgaaggaacgcgtggtggtcgacgcgcgcgccgccgaccgttatcgcggtgagaacgagacactggatcgcgtcggcggccacattcccggggcgctcaaccgcttcttcaaagacaacctcaccgccgacaaccgcttcaagccggctcacacgctgcgcgaggaattccacgcgctgctcgccggcacgccgccggaacacgtgatactgcaatgcggctcgggcgtgacggcctgcgtgaatgcgctggcgatggaagtcgccggcctgcacggcgcggccttgtacgcgggatcatggagcgaatggagttcggatccaaagcgccccgtcgcaactggc

SEQ ID NO: 28359 - DNA, 729 bp, Burkholderia fungorum
agactggccggcaagacggccctgatcacggcggcaggacaaggcatcggactcgccaccgccgaactcttcgcccgcgaaggcgcgcgcgtgatcgccacggacatccgcatcgacggactcgccggcaagccggtcgacgcgcgcaaactcgacgtgcgcgacaacgcggcgatcaacgcgctggccgccgaactcggcgcgatcgacgtgctgttcaactgcgcgggtttcgtgcatgcgggcaacattctcgaatgcagcgaagaagattgggactttgcgttcgacctgaacgcgaaggcgatgtaccgcacgatccgcgcgtttctgcctgccatgctggacaacggcggcgggtcgatcatcaatatgtcgtcggcggcgtcgagtgtgaagggtgtgccgaaccgctttgcctatagcgcctccaaggcggcggtgatcgggctgaccaagtccgttgctgcggacttcatcacgcgtggtgtacgctgtaacgcgatctgcccgggcacggtggcttcgccgtcgctcgaacagcggatcgtcgcgcaggctcaggcgcagggcgcgacgctcgacgccgtgcaggctgccttcgtggcgcggcagccaatgggccgcatcggcaagccggaagagatcgccgcgttggcgctgtatctcgcgtccgacgaatcgtcgttcaccacgggccatgcgcatgtgatcgacggcggctggtcg

SEQ ID NO: 28360 - DNA, 792 bp, Burkholderia fungorum
gtgaacatcgatctatcgggcaagacggcgattgtcagcgcatccacggcggggatcggctttgcgatcgccaccggcattgccgcatcgggcgcgcggaccattatcaacgggcgcaagcaggacgcggtggaccacgcgatcgaggcggtccgcaagagcgcgccgcaagcggaactgcaaggcttcgcgggcgacctcggcacgccgcagggctgcgacgcgttgatcaaagccgtgccgcaggcggacatcctcgtgaacaatctgggcgtcttcggccccggcgacatcttctccaccgcggacgacgactgggagcgctacttccaggtgaacgtgatgtcgggcgtgcggctcacgcgccactacctcaaaggcatgatggagcgcaaatggggccgcgtggtgttcatctcgtccgagtcggcgctgaatattccgccggacatgcttgcttacggcttttcgaagaccgcgcagttgagcattgcgcgcggcatcgccaagcacgcggccggcagcggcgtgaccgtgaatgcggtgctgcccggaccgaccctgtccgacggcttgcgggcgatggtggaagagacggccagacagcagggcaaaacggtcgaacaggtcgccacggagttcgtgcgcgagcatcgcggcagttcgatcatccagcgagcggccaccaccgaggaagtggccaacatggtcgtctacgtgtgctcgccgcaggcgtcggcgaccaccggcgcggcgctgcgcgtggacggcggcgtgatcgatacgatcgcg

SEQ ID NO: 28361 - DNA, 2085 bp, Burkholderia fungorum
cccgaccggcttctgcccggctcgccctatccgctcggcgccagttgggatggcctcggcgtcaactttgcggtgttctcggcaaacgcgcaaaaaatcgagctttgtctgttcgatcccaccgggcgcaaggaactgcgccgtttcacgctgcccgaatgcaccgacgaagtctggcacggctacctgcccaacgcgcatccgggcaccgcctacgggtttcgcgcgcacgggccgtatcagccgcagcatggacatcgcttcaatccgcacaagctgctgctcgatccgtacgcgcgcaagctggtcggacagtttcgctggtcggatgcgctattcggttatcgcgtgcattcgaatcgcgcggatctttccatcgaccggcgcgattcggcgcccgccatgccgaaatgcgtggtgatcgacgaggcgttcgactggtcgcacgacaagcggcccaatgtgccgtggggcgaaaccatcgtctacgaaacgcatgtgcgcggcgcttcgatgctgcgcgccgatttgcgccagcatgaacgcggcacgttcgcggcgctggcttcgccggagttcatcgaccatctgctgaaactgggcgtgaccgcggtcgaattgctgcccgtgcacgcgtttctcaacgatcgctttctggtggaacgcggcctgcgcaactactggggctacaactcggcggcatttttcgcgccggagccgtcctacctcagcacgcaccggctcgacgaaatgcgcattgccgtgcgccagttgcacgcggccggcatcgaggtcattctcgacgtggtctacaaccacacctgcgaaggcaacgagatgggcccgacggtgtcgtggcgcggcctcgacaacgccagctattaccgcctgattcccggcgacgaacgccaccatatcaacgacaccggctgcggcaacaccgtgaatctgccgcatccacgcgtgctgcaaatggtgatggattcgctacgctactggtcgacggcattcaatatggacggcttccgtttcgatctcggcgtcacgctcggtcgcgagcaacacggcttcgatcccggctccggtttcttcgacgccttgcgccaggacccgatcctgtcgcaacgcaagctgatttccgagccgtgggatatcgggccgggcggttatcagctcggcaatcatccgccgggcttcggcgaatggaacgaccgtttccgcgacaccgtgcgccgcttctggcgcggcgacgccggcttgcggcccgatctcgccgcgcgtctgaccggctcggccgatctgttcaaccgccgcttcagaaagccgtgggcgtcggtcaatttcgtcacgtcgcatgacggttttacgttggccgacgtcaccgcctacgagcagaagcacaacgaagcaaaccgcgaagacaacaacgacggccacaacgagaattgcagccgcaattggggcgtggaaggcgagagcgacgacccggcgattctcgccacccgcaagcgcgtggcccgctcactgatcgccacgctgctgatggcgctcggcacgccaatggtgctggccggcgacgaatcgctgcgcacccagcacggcaacaacaatgcgtactgccaggacaacgaactgtcgtggctcgactgggcgcgcgcggaatcgccggacggtcgccagatgaccgcgttcgtcgcgcgcgtgatcgcgttgcgcaagcaacatccgctgttgcgcgaaacgcgtttcctgttcggcgatcgtgaagtgttgcccggtctgttcgacgtgggctggttcgacgagcggggcgacccgctcaccatcgaagcctggcaggatcccgaaggccgcgcgttcacattgcgccgcgccggcccaggcttgaacggcgaaacagaagtattgttgatgatgctcaacgccaacgagaaaacactgcggtttacgcctcccgcaccgcatctggaatggcatgtgctgttagacactgctgaacccgagaacgcaccgcatcggctggcggtcccggagatcgaagtggccgcgcacggcctcgtgatgctggccgcgcagccggtgggc

SEQ ID NO: 28362 - DNA, 1179 bp, Burkholderia fungorum
gactccctgaacttcgatacgctggcagtccgctcgggcacggtgcgcagcgacttcaacgaacattcggaagcgattttcctgacctcgagcttcgtgttcgcgagtgccgcggacgccgccgagaaattcaggaattccgaagacaactacacctattcgcgcttcacgaatccgaccgtttcgatgttccaggatcggctggccgcgctcgaaggcggcgaagcctgcatggcgacggcctcgggcatggccgcgatcatgtcggtggtgatgtcggcgttgcaggcgggcgaccatctggtgagctcgcaggcgttgttcggctccacgctcggcatgttctcgcagatcttcagcaaattcggcatcacgaccacgttcgtcgatccgaccgatctggacgcgtggaaaaacgccgtgcgcccggagacgaagatgttcttcctcgaaacgccgtcgaatccgctgaccgaagtcgccgatatcgaagcgatcggcaagatcgccaaggcgtcgaacgcgctgttcgtggtcgacaactgcttctgcagcccggccttgcagcagccgctgaagctcggcgcggacgtcgtgatgcattcggccaccaagttcctcgacggtcagggccgcgtgcttggcggcgcgctggtcggctcgaagcagttcatcatggagaaggtgttcccgttcgtgcgcagcgccgggccgacgctgtccgcgttcaacgcgtgggtgctgctcaagggcatggaaacgctatcgctgcgcgttgaaaagcagtcggcgaatgcgcttgaaatcgcgcgctggctggaaacgcatccggccgtgaatcgcgtgttttatccggggctggaatcgcatccgcagcatgcgctggccatgcgtcagcagaaggcgggcggcgcaatcctgtcgttcgaactgaagggcgacacgcccgagcagatgcgcgcgaatgcatggcgtgtgatcgacaacacgaaaatctgctcgatcaccggcaacctcggcgatacgcgcaccaccatcacgcacccggccacgaccacgcatggtcgcgtgacgtcggaagcgcgcgcggcggcgggcatcagcgaaggcttgatccgtcttgcggtgggtctggagaacgccggcgatatccgcggcgatctggagcgcggactggcg

SEQ ID NO: 28363 - DNA, 645 bp, Burkholderia fungorum
cgcacgcgcatcaagctgtgcgggctctcgaagcccgaagacgtagcccacgcgatcgacctcggcgccgatgcgatcggcctcgtgttctatccgccgagcccgcgttcggtcagcgtcgcgcaggcggtcgaactcgtgcgcgacgtgccgccgttcgtctcggtggtgggcctgttcgtcaatgccacgccggactggatccgcgaagtggtgagcaacgtcgggctcacgctgctgcagtttcacggcgacgagactgccgggcagtgtgaatcgctcgccggcgttgcgggtttgccttggttgcgtgcgttgcgcgttgcggcggatactcagccggccgatttggtaaaatcggctcttagctattcagcagccagcggccttctgttcgacacccatgtcgaagggtacggcggcggcgggaaggtcttcgattggtcacttattccagcagggctcgcgcgtcgggccgttttgagtggtgggttgagcgcgcaaaacgtcagtgatgcgatccattgcgtgcgcccgtacgcggtcgatgtctcgagcggcatcgaatcgccgggcgccaagggcgtgaaagatcacgcccggatggcggcgttcgtacgcgcggtgcgcgcagcggacgccgaa

SEQ ID NO: 28364 - DNA, 1113 bp, Burkholderia fungorum
gtaggtctcgtaggttggcgcggcatggtcggcagcgtcctgatgcaacgcatgcagcaggaaggcgatttcgatcttatcgaaccggtgtttttcagcaccagcaacgcgggcggcaacgcgccgtcgttcgccaaaaacgagaccaagctcaaagatgcgacaagcattgaagacctgaagaagtgcgaagcgatcatctcgtgccagggcggcgactacacgaacgaagtgttcccgaagctgcgcgcggcgggctggaacggctactggatcgacgcggcttcgtcgctgcgcatgaaggacgacgcggtcatcattctcgatccggtcaacctcgacgtgatcaagaacgcgctggtcaagggccagaagaatttcatcggcggcaactgtacggtcagcctcatgctgatggcgctcggcgggctgttccgcgaaaacctcgtcgactggatgacggccatgacgtatcaggccgcttcgggcgcgggcgcgcaaaacatgcgcgaactgctgcagcaaatgggcacgctgtacggtgcagccaaggaagatctggctgatccgtcgtcggcgattctcgacatcgaccgccgcgttctgagtgcgatgaacagcgaccgcatgccgaccggcaactttggcgtgccgctcgccggctcgctgattccgtggatcgacaaggatctcggcaacggcatgtcgaaagaagaatggaagggcggcgccgaaaccaacaagattcttggcaagccggctatgggcacgccgggttcgattccggtggacggcctgtgcgtgcggatcggcgcaatgcgctgccactcgcaggcgctgaccatcaagctgaacaaggacgtgccgctggacgaggtgaacagcatcctcgcgtcgggcaacgactgggtcaaggtcgtgccgaacgagcgtgaagcgtcgatgcgcgatctgtccccggcggtcgtgacggggacgctgacggtgccggttggccgcgtgcgcaaactggcgatgggcggcgaatatctgtcggctttcaccgtcggcgatcagctgctgtggggcgccgcggagccgctgcgtcgcatgcttcgcattgtgctcgacaag

SEQ ID NO: 28365 - DNA, 2193 bp, Burkholderia fungorum
accacctcagcgttcgaggccgaagctgctgagcggccggttggcgcatcagcgcgaacctcgcgctgtcggaccataacgtgccgaccacggaccgcagccacggcattgccgatcccatctcccggctgcaagtcgacacgctcgattccaactgcgacgcctacggcatcacccagttcaagatgaacgatctgcggcagggcatcgtgcacatcatcgggccggagcagggcgcgacgctgccgggcatgacgatcgtctgcggcgactcgcacacgtccacgcacggcgcgttcggcgcgctggcgcacggcatcggcacgtcggaagtcgagcacgtgctggccacgcaaacgctcctgcagaagaagagcaagaacatgctggtgaaggtggaaggcgcgctgccgcgcggctgcaccgcgaaagacatcgtgctcgccatcatcggcaagatcggcacggcgggcggcacgggctatgcaatcgaattcggcggctcgaccatccgcgcgctttccatggaaggccgcatgacggtctgcaacatggcgatcgaggcgggcgcgcgcgccggcatggtcgcggtcgacgacaccaccatcgaatacctgaagggccgcccgttctcgccggaaggtgtggagtggaaccacgcggtcgagtactggaaacagttcaaatcggacgacggtgcgcaattcgaccgcgtggtcgagctgaacgccgccgagatcgtgccgcaagtcacgtggggcacgtcgccggaaatggtcacggccgtagacggccgcgtgccggatccggatcgcgagaaggacccggtcaagcgcgacgccttggagcgcgcgctgaaatacatggcgctcgaaccgaatgcgccgatcgaatcgatcaagccggataaaatcttcatcgggtcgtgcacgaacgcgcgtattgaagacattcgcgccgcggcttacgtcgtgaagaaactgggccgccgcgtggcgccgaacattcgtctggcgatggtcgtgccgggttcggggctcgtgaaggcgcaggcggaacgtgaaggcctcgacaaggtctttaccgacgccgggttcgaatggcgtgaaccaggttgctcgatgtgtcttgccatgaacgccgaccggctggagccgggcgagcgttgcgcatccacgtcgaatcgtaatttcgaaggtcgtcagggcgccggtggccgtacccacctcgtgagccccgcgatggctgcggctgcggctatcgaagggcatttcgtcgatattcgcaagcttggataaacacgcatgatgaagaacatgaatcgcaccactctattgcgccgcttcgcgctcggttccctggctgggctattgctcggtctggccggttgcaacacggtgcacggattcggcgaggacatgtcgcacctcggcaattcgatcagcaatcacgctgataaataagcggtttttgatttttgccggccatgcgcaaagcggctttttttagtcgctgcgcgcatcgcccggtctcgaaacaggcgcaagcgtcatggaaaaattcatcgtacacaccggcgtcgtggcgccgctcgatcgcgaaaacgtcgacacggacgcgatcattccgaagcaattcctgaagtcgatcaagcgcacgggtttcggtccgaacgcgttcgacgaatggcgctacctcgaccacggcgagccgggtcaggacaattcgcagcgcccgctgaatccggacttcgtgctgaaccagccgcgttatcaaggtgcttcggtgctgttggcgcgcaagaacttcggctgcggcagttcgcgtgagcacgcgccgtgggcgttggagcaatatggctttcgcgcgctgatcgcgccgagcttcgccgacattttctacaacaactgcttcaagaacggcgtgttgccgatcgtgctgaccgaacagcaagtcgatcacctgttcaacgaaacgtatgcgttcaacggcttcaagctgacggtcgatctcgaagcgcaagtcgtgcgcacggcggacggcggcaccgaatatccgttcgaagtcgcggcgttccgcaagtactgcctgctgaacggcttcgacgacatcggtctcacgctgcgtcacgcggacaagatccgccagttcgaagcggagcggatcgcgaagcagccgtggctggctcaccgc

SEQ ID NO: 28366 - DNA, 1659 bp, Burkholderia fungorum
aatatcagtcctcttgccggcaagcgcttgcctgatgcaatgctggtgaatgtgccgcggcttgtcaccgcgtactacaccgacaaaccagatgccgcgatcccggcgcatcgggtcgcgttcggcacctccgggcatcgcggctcggcgttcgcgcgcagcttcaacgagtggcacgtactcgccatcacgcaggccatttgctactaccggaagcagcaggctatcgacgggccgctctttatcggcatcgatacccatgcactgtccgagcccgcttacgcgagtgcgctggaggtactggctgcaaacggcgtggaggtcatgatcgcgcagaacggcgaatacacacccacaccggcggtgtcgcacgccatccttgcgtacaatcgcggccggtccgcggggctggcggacggtatcgtcatgacgccatcgcacaatccaccggaaagcggcggtttcaagtacaacccgccgaacggcggcccggccgatgagacggtgaccggctggatcgaaagagcggcgaacggattactcgaaagcaggcttgatggcgtgctgcgcatctgtttgtcaaaagcgctgcgcgccacgacgacgcaccggcacgacttcctcaacgcctacgtcggcgatctcgtcaacgtcctcgatatggatgtggtgcgtggtgcgccaatccgcctcggagtcgacccgctcggcggtgcgggggtgcactactgggggccgattgccgagcgctataacctgaatctcagcgtggtcaacgacgaggtcgatccgaccttccgtttcgtgagcgtcgattgggacggacggattcgcatggatccgtcgtcgccgtatgcgatgcaaacgttgatcgaccagaaggatcgcttcgacgtggcctttgcgtgcgataccgatcacgatcgccatggcatcgtcacgcggcacgcggggctgctgccgccgaatcactatcttgcggtcctcgtccattatctgtacgcgaatcgaccgcaatggcgcgctcatgtggcggttggcaagaccatcgtcagcagccagatgatcgatcgtgtgacggaaaaactcggccgcacgctttacgaagtgccagtcggcttcaaatggtttgtcgatgggctgctcgacggttccctgggtttcgcaggtgaagagagtgcgggcgccagttgtctgcggctcgacggcacggcgtggagtaccgacaaggacggtatcgtgcccgctttgctggcggccgaaatgacgacccgcactggccgggatcctgccgaaatttaccgtgatctgacccagcgactgggcgagccggtcgaacgccgcgtccaggcggcggcgacggcgccgcaacgcgcgctgcttgcacggctgtcgccggcacagtttcctcacactgaacttgccggcgaaaaaatcgagcaggtgctcgaccgggcgccgggcaatggcgcagccataggcggcatcaaggtggtcacgaagagcggctggttcgctgcgcgcccgtcaggcaccgaagatgtctataagatctatgcggaaagcttccgcggcgaggctcacctgacacgcatcgttggcgaagcccaggcgatggtcgacagcgtgttcgaggcacaggttgccacggatgatggc

SEQ ID NO: 28367 - DNA, 1008 bp, Burkholderia fungorum
atgcaagccgctgtggtcgaacagttcggcaagccgctggtactgaaggagctcgccattccgacaccgggtccgggccaggtgctggtcaagaccgaggcctgcggcgtatgccataccgatctgcatgcgaccaacggcgactggccgctcaagcccggtttgccattcacgccggggcatgagggtattggtattgtcgccgccctcggcgcgggtgtgacggcggtgaaggagggcgaccggatcggcgtgccctggctgtattccgcctgtgggcactgcgagtactgccttgcggcacgcgagcccgtctgcgccgaagcacagttcggcggctacacgaagaacggcggctttgccgaatacatcgtggctgacccgaactacgtcgctcacataccggcaggtctggctgcccgcgaagcagcaccgctcatctgcgccggcatcacttcgtacaagggcatcaaggagacccaggcgcggccgggtgaatgggtcgtgatctcaggcgtcggcggactagggcacctgggtatccagtacgccaaagcgatgggcttgcaggtgtgcgccgtcgatatcgacgacggcaagctagcccatgcgaaacgcctcggcgccgacgccgtggttaatgcgaacgacggcgacccgattgccgccgtgataagggccactggcggcggcgcgcatggcgtgctgattacggcgccctctcttggggcgttcaaacagggcgtcggcatgacgcgcaaatgcggtacctgcgtgctggtcggactgccgccgggtgaattccccacgccgctgttcgatgtcgtggccaactgcatcacgattcgcggctcgttcgtcggcaatcgccgcgatatggcggaagcgctggcctttgccgccgacggcaaggtcagggccgacatcgagctgcagccgctgtcggcgatcaacaacgtgttccagcgtctgggacacggcgatgtaccgtcgcgcgtggtgctcgag

SEQ ID NO: 28368 - DNA, 1320 bp, Burkholderia fungorum
atgacctatcagagcgtcaacccgaataccggcaagacattgaagagcttcgacgagctgaacgatcagcagcttgaaaaagcgctgtccaccgctcagtcatgcttccatgtgtggaagaaaaccagctatgcgcagcgcgccgcgattatttccagggctgccgggctgatgcgtgcaaatgttgacgaattcgccaaactggcaacgctcgaaatgggcaagcgcattgacgaggcgcggggagaggtcaacttcagcgccgacattctcgactactacgcgaggcatgcggaagcgttcctggcaccgacgaagctccatccgaaagtcggcgaggcccatatggagacgagtccattcggcgtgctgttctgcgtggagccatggaactttccgtactatcagctcgcgcgcgtcgcagggccacaactgatggcgggtaacgtgctggtggtcaagcacgcaggctgcgtaccgcaatgtgcgattgccttcgaaaagcttctgattgacgcgggtgcaccggtgggcgcttacacgaacctcctgatctcgcataaacaggctgaacggatcatcgatgacccgcgcattcagggcgtggcgttgacgggtagcgtcgcggccggcagaagtattgcggcgcgagctggccagaaccttaaaaagacgtcgatggaacttggcggcagcgatgcgttcatcgtgctcgacgacgccgatctggagaagaccattccgtgggcagtttggggccgcatgtataacgccggccagacctgttgcgccgcgaagcgcttcatcgtcctcgattcgattgcggacaggtttctcgagaaattcaaggccgcgctcaacgaactgaagcctggcgatccgatggatgaaaagaccacgcatggtccgctgtcgaccgaggcggccctgacgcaattgctcaagcaggtcgacgatgcggtcgcaaagggtgccacgctggtgatgggcggaaagcgcatcgaccggcccggctcgttcatgcagacgacgatcctgacggatatcaagcccgacaacccggccttccgtgacgagttttttggcccggtcgtctcattcttccgcgtcaaggacgaagccgccgcgattgcactggccaacgactcggactttggtctgggcggctcggtcttcacggcggatgccgcacgcggcaagcgcgtggcgagcggagtcgataccgggatgatgttcatcaacaacatcgactggtccgatgccgaactgccgtttggcggtatcaaatattccggttacgggcgcgaactcggcaacatg

SEQ ID NO: 28369 - DNA, 1158 bp, Burkholderia fungorum
cttcgggagcgtgccgaacgcctggcgcaggccgaccggcgaaagaacgaatttctggcgatgcttggacacgaactgcgtaatccgctcgctgccctgtgttcctctggagatttgctcgcctcggaaaccatcgatccgcgacaaaagtcctgggccgtcggcgtcatccagcggcaaggtcgatcgatgacgcaactggtcaacgagatgctggatctcacgcgtattacgagtggcagcatagagttgcgtcgtcaggcggtcacgctgaaagcggtcatccagagcgcggtcgaggtttgccagccgattattgacgaacggcatcacaccttgtcggtgtcgctaccggacgagccggtgttgatgtacgtcgaccccacccggctatcgcaggtcgtcgaaaacatcgtgatcaacgcagccaggtacacggaacctggcggccatatcagtctcacagcgacaagaaccggccgtcggctttcgcttcgtgtcaaggacaacggaaggggaattcctgcttcgatgctcagcacgctttttgacatgttcgtccaggggccggtgccctacggtcagcttcataatgggctgggagtcggcctgtccgtggtccggcggttggttgagttacatggcggatcggttcgggccatcagtgatggcaggacaggtagcgaattcatcgtcgatcttccgctgggcatgatcccgcccggcgtggaacaggccggtacaccgcaggaaccggtcaacgcgggtccgcgcaagatactcatcattgacgacaatgccgacgcgagcgaggccctggccatgcttctggcggcggaagggcatgtggtggagacacggctggatggccccggggggctcgaagccgcttcgactttcaggccggacgttgtgctccttgacatcggattgcccggcatggacggctatgaggtggcgaagcagttgcgcgactctgtggccacgtacgacacgatgctgatagccgtcaccggctacgggcaaccaggcgaccagctcagatccgcagaggcgggacttgattaccacctggtcaagccagtggatatcaacgcgttgacgcgtctgcttgctgtgcaggtgaaaccccgcggcagataaataaagagactggac

SEQ ID NO: 28370 - DNA, 1329 bp, Burkholderia fungorum
gctgtcgtctgcggcgacgatcgcctgaactggcgtgagtttcaccttcgtacgaacaaggtcgccaatgcactcgtgcgagccggacttcagaaaggggaccgcgtatgcttcttcatgcagaactccatggcggccttcgagttgatctggggcacgattaaggccggaggcgtggtctcgccactgaatgtcatgatggccgctgattcgctaccggccatgatcgataacgctgcgccgcgtttcatattcgtcgacagcgagctcgctggcgcggtcgatgcagtccggggcgccgtgcggaataagccggatattttttacgcggagtctggcgcggttgagggctggcaatcatacgtcgaactggttgaggccggttccgaggcggagtactttccggatctgaagctgtccgatacgatgacggtgctctacagttccgggaccactggtgttccgaaaggcagcgagcatacgcacgcagcgcgccacttctattcgctcggctgcggtcctgccctgcgaatggatccttacagcgtggcgctctgcgcaactccgctgtacacaaatggaacctggatcaccctccttccagcgctgtacctcggcggcacagtagttctcgcccgcaagctgacgcctcaagcctggctggaactggtggcgcgcgagcggatcacccatgcattcctggttcccactcagtgcatcgggatcgtggagcgtgcgtcacccgaatatgacgtttcatcgctgcagggaattctttatggtggtgcgccgatgaccagccagacagcggcggccatggcgaagaccttcccgaacacccgcatgtacgagatctacgggatgtccgaggggtggtgcacgctcgcatatcctgaggatcgcgcgcacggcaggagttccaccgtgggcaaaccggtgttcggaggcgatatttgcgtcatcgatccagaaggcagggaactgccacccggagagcaaggcgaacttgccggctggagcgctgggcttatgaagggatatcttggcgacccgcagcgcaccgcagatatcgtctggaagggcccgcatgggcgcacttatctgcgaagcggcgatatcggatacatggacacggaagggttcttcttcgtgaacggccgagtgaaagacatgatcatctctggcggcatcaacgtgtttgcatcggatattgaggaggtcttcatgcagcaccccgcggtggccgaagctgcggccatcgggattccgcatgacaaatggggtgaaaccccgatcgttatggttatcctgcggcagggccatcagatc

SEQ ID NO: 28371 - DNA, 1158 bp, Burkholderia fungorum
aactccaacctgattgaaaccagtgctgaacatcagcaaatttacgacagcgttgcaaagatcacgcgagcatacggccatgctgcattcgccaaggccggacggcgtggcgaggaagcgcgcgagctttggcagaacctggccgaagcgggctacctgggtatctcggtccccgaggaatacggcgggagcggacagggcgttgaggaactcgcgatcgtcctggaggccaccgcggcgcagggttgcccaatgacttcatttgtcgtactgccgattatcgtctttgtgctttcgaagcatgcaacggaagcacagaaaagggaaattcttcctgcaatcgcgactggagagaagcgcttagcctttgcgattacagagcctgacgccggaacgaatactcacaatctgaaaaccaatgcggtcaggaccgcgaatggcgggtggaggctaagcggctcgaagtactacatcaccgaggccgaagtggccgatgcgttgctggtcgtggcccgaaccggtgtcgacgaggctaccggtcgggggaaactatcactctttctggtgccgaagcatctgaagggcgtgacccttcagaatctcccgacggaactaattgtgccggaacggcaggctagcgtcttctttgacgacgtcgaacttccggcagatgccttaatcggcgcggaaggcgaaggtttgagaaatgttttcgcgggtctcaacccggaacgtattgcagtggcggcactctgtaatgggctgaccacgtacgctcttaccaaggcctgcgagtatgccaaagtgcgaaaagtatggaagacgcctatcggcgcgcatcaagccgttgctcatccgctggctgaagcctacgcccgtcttcagctatcgaagatggcgacccagcgcgccgcgcaactctacgacgcggggcgggatgccggcgacgcttcaaacatcgcgaagctgactgcttcagacaccgcagtgtttgcattggaccgtgctatccagactcacggaggcaacggtttctcacaggaattcggactgggtgacttatggtttgtggcccgggttcagcaaaccgccccggtcagtcgggaaatggtcttgaaccatatcgctcaacataacctgggactcccaagatcatac

SEQ ID NO: 28372 - DNA, 1308 bp, Burkholderia fungorum
gggcgtaacgtcgtcgtcgtggggacccaatggggtgatgaaggcaagggcaagatcgtcgactggctgacggaccacgctcaaggcgtcgttcgcttccagggcggtcacaatgccggtcacacgcttatcatcggcggcaagaaaaccatcttgcgtctgattccgtcgggcatcatgcatcccggcgtcgcgtgctacatcggcaatggcgtcgtgttgtcgccggaagcgctgttcaaggaaatcggcgagctcgaagccgccggggtcgatgtccagaatcgcctcttcatttccgaagccaccacgctgatcctgccgtatcacatcgccatcgaccagggccgcgaagcgcgccgtggcgcaggcaagatcggcaccaccggccgcggcatcggcccggcttacgaagacaaggtggcacgccgcggtttgcgcgtgcaggacctgttcgagccggagatcttcgccgaacgtctgcgtgaaaacctcgactatcacaacttcgtgttgacgcaatacctgggcgtcgccgctgtcgacttccagcaaacgctcgacacgatgctcagctatgccgaccgtctgaggccgatggtgaccgacgtgtcgcgccgtctgtacgacgtcaacgccgccggcagcaacctgctgttcgaaggcgcgcaaggcacgctgctcgacatcgatcacggcacgtatccgttcgtcacgtcgagcaactgcgtggccggtgcggccacggccggcgcgggtgtcggtccgcaaaagctgaactacattctcggcatcaccaaggcgtactgcacgcgcgtcggctcgggcccgttcccgagcgaactgtacgacgcggataacgctgcacgccaggaagcgatcggcctcgaactggctaccgtcggcaaggaattcggctcggtcacgggtcgtccgcgccgcaccggctggctcgacgcggccgcgctgcgccgctcgatccagatcaacggcgtatcgggtctgtgcatgaccaagctggacgtgctcgacggtcttgacgaagtgaaactgtgcgttggttacaaggtggacggcaagaatgtcgacctgctgccgcgcggcgcgtcggaagttgcacgctgtgagccggtgtacgaaaccttcgcgggctggaaggaaagcacggttggcatcaaggaatgggacaaactgccggcgaatgcgcgcgcgtatctgtcgcgtgtgcaggaggttgcgggcattccgatcgacatggtgtcgaccggtccggatcgcgatgaaaccatcctgcttcgtcatccgttc

SEQ ID NO: 28373 - DNA, 423 bp, Burkholderia fungorum
atggcgatcgaacgcaccctgtccattatcaagccggacgcagtggccaagaacgtgatcggccagatctacacccgtttcgagaacgctggtctgaagatcgtggcatcgcgcatggttcacctgtcgcgcgccgacgcggagaagttctacgctgtgcacgcagcacgtccgttcttcaaggacctggtcgatttcatgatctcgggtccggtcgtcgtgcaagcgctggaaggcgaaaacgccatcctgaagcatcgtgatctgatgggtgcaacggacccgaagaaggcggaaaagggcacgatccgcgccgacttcgcagacagcatcgacgcgaacgcagtgcacggttccgacgcgcctgaaacggccgcagtcgaaatcgcgttcttcttcccgcaagtgaacgtctactcgcgc

SEQ ID NO: 28374 - DNA, 870 bp, Burkholderia fungorum
attcgcggcagcattcctgccatcatcaccccgatgctcgaagacggcagtctggatctgccggcgtttcgcaaactgatcgactggcacgtcgcagagggcacgaacgctctcgtggtggtcggtacgagcggcgagtcggccacgctgtcggtcgaagaacacgtgctaatggtcaagaccgcggtcgagcacacggcgggccggattccggtgatcgcgggctcgggcggcaactccacgaccgaggcgatcgaacttacccagcgcgccaaagaggtcggcgccgacgccacgctccaggtcgtgccgtactacaacaagccgacgcaggagggcatctaccgccacttcgcgaagatcgcggaaaccgtcgatctgccggtgattctgtacaacgtgccgggccgcaccgttgccgacatgagcaacgaaaccatcctgcgcctcgcgcaggtgccaggtatcatcggtgtgaaggaagcgaccggcaatatcgatcgcgccgcgcatctcatcaagtttgcgccgtcgcacttcggcatctacagcggcgacgatcccaccgccatcgcgctgatgctgctcggcggccacggcaatatttcggtcaccgccaacgtcgtgccgcgcgccatgagcgagctctgcaaggccgctctcgccgcggacgttaagaccgcccgtgagattcatctgaaactcctgtcgctgcataagaacctgttcgtcgaatcgaatccgattccggccaaatgggcgctgcagcaactgggtcgtgtgcagggcggaatccgcctgccgcttacgccgctcgacccgcagtaccacgaagtggtacgcggcgcgctgcgcgaagcgggcctgctg

SEQ ID NO: 28375 - DNA, 1278 bp, Burkholderia fungorum
atgagtgctatcgtagatatcatcggtcgagagattctcgattcgcgaggcaaccccaccgtcgaatgcgacgtgctgctcgaatcgggcacgatgggccgcgccgcggtgccgtcgggtgcgtcgacgggttcgcgcgaagcgatcgaactgcgcgacggcgaagccggccgctacggcggcaagggcgtgctgaaggctgtcgagcacatcaacaccgaaatctccgaagcgatcatgggcctcgacgcttccgagcaggcgttcctcgacaagacgctgctggaactcgacggcacggacaacaagtcgcgcctcggcgcgaacgcgatgctggctgtttcgatggccgtcgcgaaagccgccgctgaagaagccggcctgccgctgtaccgctacttcggcggctcgggcgcgatgcaactgccggtgccgatgatgaacatcgtcaacggcggcgcgcacgccaacaacagcctggacatccaggaattcatgatcgtgccggtcagccagccgaccttccgcgaagcgctgcgctgcggcgccgaagtgttccacgcgctgaagaagatcctgtcggatcgcggcatgagcacggcagtgggcgacgaaggcggcttcgcgccgaacttcggcagcaacgacgaatgcctgtcgaccatcctgcaagccatcgagaaagcaggctaccgcgccggggaagacgtgctgctcgcgctcgactgcgcagcgagcgagttctaccacgacggcaagtaccagctggccggcgaaggcctgcaactgtcgtcaacggaattcacggactacctggcgaatctggccgacaagttcccgatcgtgtcgatcgaagacggcatgcacgaaagcgactgggccggctggaagacgctgaccgacaagctcggcaagaaggtccagctggtgggcgacgacctgttcgtcaccaacacgcgcatcctgaaggaaggtatcgagaagggcatcgccaactcgatcctcatcaagatcaaccagatcggtacgctgacggaaaccttcgcggccatcgaaatggccaagcgcgccggttacacggcggtgatttcgcaccgttcgggcgaaaccgaagattcgacgattgcggatatcgcggtcggcctgaacgccggtcagatcaagacgggttcgctgtcgcgctcggaccgcatctcgaagtacaaccagttgctgcgcatcgaagaagatctgggtgatatcgccagctatccgggcaagtcggcgttctacaatctg

SEQ ID NO: 28376 - DNA, 1869 bp, Burkholderia fungorum
atggccctactgcaaatctccgaacccggcatggcgccggcgccccaccagcggcgtctggcggtcggcatcgatctcggcaccaccaattccctcgtcgccgcggtgcgcagcggcgtgcccgacgtgctgcccgacgaagacggccatgcgctgctgccgtcggtggtgcgctacctcgaaaagggcggccgccgtatcggccgcacggccaaggccgaggcggcgagcgatccgcgcaacacgatcgtctcggtcaagcgtttcatgggccgcggcaaggcggaagtggagggcgccgaaaacgcgccgtacgatttcgtcgacgcacccggcatggtgcagatccgtaccgtggacggtgtgaagagcccggtcgaagtgtcggccgaaattctcgcgacgctgcgtcagcgcgcggaagacacgctcggcgacgaactggtcggcgctgtgatcacggtgccggcgtacttcgacgaagcccagcgtcaggcgaccaaagacgccgcgcgtctggcgggtctgaacgtgctgcgcctgctgaacgaaccgaccgcggccgcgattgcctatggcctcgataacggttccgagggtctgtacgccgtgtatgacctcggcggcggcaccttcgacctgtcgattctcaagctcaccaagggcgttttcgaagtgctcgcagccggcggcgattccgcgctcggcggcgacgacttcgatcacgcgctgtatcgccatgtgctggagcaggtgggcattgcgccgcaaacgctcgctccggaagacgtgcgcctgctgctggatagcgtgcgcgaggccaaggaggccttgtccgacgcgccgagtgtgaagctacgaaccaggctctcgaacggcactgagatcgatctgacaattggtgaggccactttcgaggccatcacacaggcgctggttcagcgcacgctcggccccacgaaaaaggcgctgcgcgacgccagggtcacgacgaaggaaatcaaaggcgtggtattggtgggcggcgcgacgcgcatgccggtgatccgccgcgcggtcgaatcgttcttcggccagccgccgctgatcaatctcgatcccgatcaggtggtcgcgctcggcgcggcgatccaggccgatctgctcgcgggcaatcgcggcgcggacggcgacgactggctgctgctcgacgtgatcccgctgtcgctcggcgtcgaaacaatgggcggtttgaccgagaagatcatcccgcgcaattccacgattccggtcgcgcgcgcgcaggatttcaccaccttcaaggacggccagacggcgatggcgatccacgtcgtgcagggcgagcgcgagctcgttagcgactgccgctcgctcgcgcggttcgagctgcgcggcattccgccgatggccgccggcgccgcgcgtatccgcgtgacctaccaggtggacgccgacgggctgctgtccgtgtttgcgcgcgagcagggttcgggggtggaagcgtcggtggtggtcaagccgtcctacggcctcgccgacgacgacattgccagaatgctcgaagacagcttctcgaccgctgaaatcgacatgcgggcgcgcgcgctgcgcgaagcgcaagtcgaagcacagcgtctcgtggaagccaccgacgccgcgcttgccgccgacgccgaactgctcgacgacagcgagcgcgccgagctcgacaagctgctcgatgcattgcgcaaggtcgcgcagagcgacgacgtcgatgcgatcgaagccgccaccaaaaccgtcgccgaaggcaccgacgaattcgccgcccgccgcatgaacaagggcattcgccgcgccctcgccggccgcaagctcgacgagatc

SEQ ID NO: 28377 - DNA, 1149 bp, Burkholderia fungorum
ctacgcgggcaggtcgcggtagtgggcgtcggcgagagcgaatactaccgtgccggccacgcgccggacccggaattcagacttctgctcaaggcggtgctggcggcgtgccgcgatgcggatatcgacccggcggacatcgacggcttcgcctcgttcgccgacgatcgcaacgacgcggtgcgtatcgccacggcgctcggcgtgaagcgcttgcgctccacgacgatgcagtggggcggcggaggcggcggctgtgccgccgcggtggccaacggcgcggccgcgatcatgagcggcatggcgcagtgcgtgctggtctatcgcgggcttgcgcagggacagttcgggcgcttcggccaggcggcgccgcgtgcgtccatttctggcgagatggcatatcagatgccgtatggcgtgcttgcgccgccacagaagttcgcgatgaaggtgcagcgtttcatgcacgaacacggcgtgcgccgcgaagcgctgcgcgcgatcgcgctcgcgtcctatcagcacgcgcaggccaatccgcgcgcggtgatgcacggcaaaccgctgaccgccgaagcgtacgacgcatcgcgctggatcgtcgagccgtttcgtctgttcgattgctgcatggagaatgacggcgcgggcgcgttgctgctggtggccgcagaacgcgcgaaagactttccacatcggccggtgtatctgcttggcgcggcgagcggcggtgactggcgagcggccgcctcgccgcacaacgcgccccattacgcgagtgccaactatagcggcgtttcaggcgatttgtaccggatggcgcgcgtgtcgcccgcggacgtcggcgtggtgcagagctatgagaacttcaccggaggcgtggcaatggcgctgagcgagcacgggtttttccatcccgacgaagccaacgattttctaacgccggagaatctcgtcgcgccgtcgggcaagctgccgctcaacacgagcggcggcaatcttggcgaatgctacgtgcacggcttcgaactggtgatagaagcggcgcgccaggtgcgcggcgagtcgaccagtcaagcggcgcggcatgacgtggcgctggtgatcggcggcccgatggtgacgccggcaagcagcctgctgttcgga

SEQ ID NO: 28378 - DNA, 1456 bp, Burkholderia fungorum
cctacacctgtcgacgtcaggccgggcccgaacgattcaaatgcgccacggcgccgtcaaatcaagaacactcaccctggaagacaagaacatggcatacgcaagcatcaacccgaatagtggcgagaccctgaagcgcttcgacccattgaccgacgcacagctcgaacaatctctcgcgagcgctcaggcatgttcccagacgtggaagcagaccacctacgctcagcgcgccgggatcctcaacaaggcggccgccctgttgcgcactcatgtggatgaattcgcgaagctggcgacgctggaaatgggcaagcgtatcaatgaagcgcgaggcgaggtgaatttcagcgccgatattctcgcctactacgcgaagcatgcggaagcgtttcttgctccgatcagactcgagccgaagattggcgaagcccatatggaaagcagtccgttcggcgtgctcttttgcgtggagccgtggaatttcccgtattaccagttggcgcgagtcgcgggtccgcaattgatggccggcaatgtcctcgtggtcaagcacgcggcctgtgtgccgcaatgcgcgatcgcgttcgaaaagctattgatcgatgcgggcgcacccaaaggcgcttataccaatctgctgatctcgcatgagcaggcccagcgtgtgatcgacgatccgcgtatcaagggcgtggcactgaccggtagcgccgcggccggcaaaagcgtcgccgcgcgagccggacagaacctcaagaaaacctcgatggaattgggcggcagcgatgcattcatcgtgctggatgacgccgacctcgaaaagacgattccgtgggcagtgtggggacgtatgtataacggcggccagacctgctgcgcagcgaaacgctttatcgttctcgattcgattgccgacaggttccttgagaaattcaaggcggcgttgtcggaactcaggccaggcgacccgatggatgaaaagaccacacatggtccgctttcgagcgaatcagcgctcgttcaactgctcaagcaggttgacgatgcggtggcgaacggcgccacgctgttgatgggcggcaagcggatcgatcgccccggctcgttcatggaaatcaccattctgaccgatatcaagccggacaaccctgcctttcgcgacgagtttttcggcccggtggtgtcgttcttccgcgtgaaggatgaagccgcggcgattgccttggcgaacgactccgacttcggtttgggcggttccgtcttcacagaagatatcgtgcgcggcaagcgggttgcgagcagcgtcgagacgggaatgatgttcatcaacaacatcgactggtccgatgcggaactgccgttcggcgggatcaaggactcgggctacggacgcgaactgggcaacatgggcatccaggagttcgtcaacaagaagctggttcgcaccgcgcat

SEQ ID NO: 28379 - DNA, 954 bp, Burkholderia fungorum
ctccatgtcggcgagatgccgatgccgaaggcggtgccgggtcacgtggtcatccgcgtgcgtgcgtcgtctttcaattatcacgacgtctttacggtgaagggtatgccgggcatcaaggtgccgttgcctgtggtcatcggtctggatatggcgggagagatcacggaggtgggagacaacgtcgagaactggtcggtcggcgcgcgggtgctcgtcaatccgctcaacaagaagaaaggcctgatgggcgaaatgctcgacggcggcatggcgcaatactgcctcgtcagcgcggaccagttgatcgcaatgcccgaaggcgtgacgttcgaagaagcggcgtcgctgccggtcgcctacggcacggcgcaccggatgcttgtcacgcacaacaccatcaagccgggcgatcgtgtggtcattctgggtgcgagcggcggcgtcggaaccggttgcgtgacgcttgccaaaatgctcggcgccgaagtgatcgcggccgccggcagtgcggacaaggctgaacggctcaaggcgatgggcgcggatcacgtcatcaactatcgcgacaccgatttctcgaagtgggtcatcgagaagtacggcaagccgcaacgccgcagctatgaaggcggcgcggacgtcgtaatcaatttcaccggcggcgatacgtgggtgccgtcgctcaaatgcatcaaacgcggcggcagcctgctcgtctgcggcgcgaccgcgggccacgatccgaaggaagacctgcgctacatctggagcttcgagattcgcgtgatcggctcgaacagtttctatgacgacaacctctctgcactgatggaattgatccgtacgaagaagatcgcggtgcagatcgacaaggttctgccgctcgaacaggccgccgaaggcctgcgcatgattcgcgatcgggaagtgctcggcaagattgtcgttacc

SEQ ID NO: 28380 - DNA, 1446 bp, Burkholderia fungorum
aagcttgcggtgatcgcccttggggaaccggatgaaacgggttgcgcgtggcacgatacgcgtatgacctacggagaactcgacgcgctggctgacggcgtcgcgcgtgcactggtgcggcgcggtctgaaggtcggtgagcgcgttgccattcttgcggcgaatcgtgctgaatatgtcgcggcgctgctcggcatcatgcgcgcgggaatggtcgccgtgcccgtcaacttcaggtttccgcccgcgctctccacctttgtgattcgcgatagcggtgcaaggctggtgttttgcgacgccgcgcgacttgccgattgcccggacgatctgccgacagtcgtattcgattcgacgggggaagacagtttcgcctctttcgtcgaacgcggcccgttcgagactttcgtgcctacgcccgacacgccggcaatgtttctctatacgtccggctcgactggcaagccgaagggcgtaatgctctcgcacggcagccatctgtgggtggcgcgtacgcgagcgcgcgcgcagccaccggaggcgcatcgctttctggtggccgcgcccatgtatcacatgaacgcgctgacgctcgtgctgatgtcgttatacgggcacggtacggtggtactgcttccgcaattcaccgcgcgcatgtacatcacggcgatcgagcgttatcgggttacgtggctcacctccgtgccgcccatgatcgcgatgatgctgcgcgaaaaggaactgctcgagcgcacggatctttcatcggcgcgcttcatccggatgggctcggcgcccgtcagcgagagcttgcttgcgcagatcggcgaggtactgccgaatgcgaagctcactaacgtctacggcacgaccgagggcggcccgatcgtgttcgggccacatccgcaagggatcgaaccgccgttgctgtcggtcggatatccgcatcccgaagtcagcgtcaagttgctcgacgcaccgccgacaggtgttgcaaccggcgtgctggccgtaaaaagccccgccgtcatgctcggttaccacaaccggccggacctgccgctgccggtgacagcagacggcttctatataacgggtgacgtatttcaccgcgacgaacagggcttctatgcgttcgtcggccgtgcggacgacatgttcgtgtcgggcggcgaaaacatctttcccggtgaagtcgagcagatgctggagacgcacccggacatcgtccaggcttgcgtggtgccggtcgccgacgacatcaagggaaccaagccggtggcgttcgtggtgcggcgcgcgggcgcgtcgctaacggaagaggaagccaaacagtatgcgctgacgcatgcgcccgcctaccagcacccgcggcgcgtgtggttcgtcgacgcattgccgcttgcgtccacgaacaagatcgatcgcgccgcattaaaagccata

SEQ ID NO: 28381 - DNA, 930 bp, Burkholderia fungorum
atgaaatacaaagactattacgaaatcctgggtctcgagcgaagcgcgtctcaggatgacatcaaacgttcgtatcggaaactcgcgcgcaagtatcacccggacgtcagcaagcacgccgacgccgaagaacgtttcaaggaattgggcgaagcctacgaggtgctcaaggacccggagaaacgcgccgcctacgaccgcatgggcagcgactggcgcaacggccaggacttccagccgccgccgaactgggacgaaggtttcgaattcagcggcgcgggcagcgggcccggcgaacaagccgacttccacgacatcttcgagaagatgttcggcggcgcgcgcggtgcgcatccgcatgcgcggcagcggtccttcgacgcgcgcggcgaagaccatcatgccaaggtattgatcgatctcgaagacgcctatcgcggcgcccagcgcgcgatttcgctgcaaatgccggtggtcgacgcgcaaggccatgtttcgctggaaacgcgcacgctcaacgtgaccattccgaaggggatccgcgcgggtcagcatctgcggctgagcggccagggcgccgccggcgccacgccggaaacggccggcgacctctacctggaaatcgcctttcgggaccacccgcgttttcaggtggacgggcgcgatgtttcgctcgagttgccggtggcgccgtgggaagcggcccttggcgcgaaagttaccgtgcccacgcccgacggttccgtcgagatgacggtgccggcgggttcagccagcggcaggcgcttgcggctcaaaggcaagggcattccggccaacccgcctggcgatctgtatgtgattctgaacattgtcctgccgcctgcggataccgaatcagcgaaggccgcttacgatgcgatgcggcaggcgttcaatttcgatccgcgc

SEQ ID NO: 28382 - DNA, 2715 bp, Burkholderia fungorum
tacgcgaaaaccattgcgctcgacaacctcacgctggattttcccgccggccgcatgaccgggctgatcgggcccgacggcgtcggcaagtcgagcctgctggcgctcgcagccggcgcccgcgcggttcaggaaggcaccgtcgaggtgctcggcggcgacatgcgctcgcgccggcaccgtgcgctcgtttgtcctcgtatcgcctacatgccgcaagggttgggaaagaatctgtacccgacactgaccgtcgaggagaacctgcagttcttcgcgcggctgttcggccacgatgccgcggagcgccgccggcgcatcgactcgctgacccgcagcaccggcctgaaaccgtttctggcgcgcccggcgggcaaactctccggcggtatgaagcagaagctggcgctttgttgcgcgctgatccacgaccccgatctgctgattctcgatgagccgaccaccggcgtcgatccgctggcgcgcgcgcagttctggaatctgatcgcgagcatccgcaagggccggcccggcatgagcgtgatcgtcgcaacggcttacatggacgaagcgcagcgcttcgattcactcgtcgcgatggatgcgggacggatcctcgcgaccggcgaaccgcgcgccctgctcgaacagacgaacagcgacacgctggaagcggcgttcatcgcgctgctgccggaggaacggcgccgtgaccatcgaccagtcgttgtcgaaccgctgccggccgacgccgctgccgacctcgccatcgaagcacgcgatctgaccatgcgtttcggcgatttcgtcgcggtggaccacgtgagcttccgcatccgcagcggcgagattttcggctttctcggctccaacggctgcggcaagtcgaccacgatgaagatgctgaccggactgctgcccgcgagcgaaggctcggccaaactgttcggccgcgaagtcgatcccaacgacatcgacacgcgcacccgcgtcggctacatgtcgcaagctttttcgctctacggcgagctgacggttcagcagaatctggtactgcacgcgcagctctttcacgtgccgccgcagcagattgccgccagggtcgacgagatggtgagccgcttcggcctgggcgaggtacgcgacgcgttgccggacagcttgccgctcggcatgcgccaacgcctctcgctggcggtcgcgatggtgcacaagccggaactgctgattctcgacgaaccgacttcaggcgtggaccccgtcgctcgcgacaacttctggcagttgatgatcgagctcgcccgccgcgaccgggtcacgatcttcatctccacgcacttcatgaacgaggcggagcgctgcgaccgcatctcgctgatgcatgcgggccgcgtgctcgccaccgaggcaccggcggaactcgtgcgcctgcgcggcacggcaaccctggaggaggccttcatcggctacctgatcgaagcaggtgccgacaaggccgaagacggcggcgccgaagcaacgatcgaagcgcccgcaagcacgaacgattccggcacaggcacgctggaccaatcgccgaaccgctcccgccctcgcgcgttcagcccgagccgtgccctcacctatatctggcgggaggcgctcgaattgcgccgcgatccggtgcgtgccacgctcgccctgctcggttcgctggtgttgatgttcgtgatgggctacggcgtgagtctcgatgtcgagagcctgtcttacgcggttctcgatcgcgaccagaccgaactgagtcacgactatgcgctgaacatgtcgggttcgcgctatttcgtggaacaggctccgctcagcgactacgccgatctcgacaagcgcatgcgcggtggccaactttcgctcgccatcgaaatcccgccgaatttcgcacgcgatctgcaacgcggcgcgccggtgcaactgggagtgtggatcgacggcgcaatgccgcagcgcgcggaaaccatccgcggctatgtgctcgggctgcatcaggcctggctgacggatcagagcatccaccggctcggcctgacgcccgccgcgcaggtcaacattgaaacgcgctttcgctacaaccccgacgtgaagagcgccccggcgatggtgcccgcgatcattccgctgctgctcctgatgctgccggccatgctgaccgcgctggcggtagtgcgtgagcgcgaactgggctcgatcatcaatctgtatgtcacgccggtcacacgcagcgagtttctgttgggcaagcaggtcccttatgtcgtactggcgctgctcaatttcctgctgatgaccatgctggcacgaatcgttttcggcgtgccggtcaaaggcaactttctgacgctgctcgccgcggtgttgatctatagcatcgtcgcgaccggcatgggcatgctggcgtccacgttcacccgcagccagattgccgcgatcttcctgaccatgatcggcacgctgatcccggccatccagttttccggcctgatcaatccgttgtcttcgatggaaggcagcgggcgcctgatcggttcgatctatccggccacctacatgttcacgatcagccgcggtgtgatcaacaaggcgctgggctttaccgatcttcaggggcaattctggccgctgctggccgccataccggtggtgctcggcctgaccacggcactcctcaaaaagcaggaa

SEQ ID NO: 28383 - DNA, 813 bp, Burkholderia fungorum
atcttgacccgcaaactcgaaggtcgcgtcgccatcgtaaccggctccagttcgggcaatggacgagcaatcgcgctagccctcgcgcgcgaaggcgcccacgtcgtctgctctgacctgaagaagtcggcactgaaaggcggctacgagaaggatatcgaaaccgataccgacgcagttatcgcccagcaaggtgggaagaccgcgttcatcgcggctgacgccagcaaagcagccgacgtgcagaaaatcgtcgatcatgcggtttcgactttcggccggctcgacatcatcgtcaacaacgccggcgtgttcaccggtctgcatagcatcatcgatgagaccgaagagcaatacgatttcacgatgaacgtgaatgcaaaaggcgtgtggctcggttgcaaatacgctatcacgcagttcatgaaacaggagccgctgaccacgtcaaccggcgtccaggtccgtggccgcattgtcaacatcgcgtcgatcggcggcctggtcgggttggcactcgagccggcttattgtgcgtcgaagggagccgtcgtcaatctgacacgcgaactggcactcgacttcgcacccgagcgaatcaatgtgaacgcgatctgccccgggttcctcgcaaccgcgatggtgcgttccttcctcgaaaacgacgataccaacaagctgcttcacgacctgacgccgtggccgcgtgtcggcaccgcggaagatgtcgcgaaagccgcgctattcctcgcttctgacgacgccgaatggatgacaggttccatgctcacagtcgacggcgcctttacggcg

SEQ ID NO: 28384 - DNA, 762 bp, Burkholderia fungorum
ctcaaaggaaaggtcgccatcgtcacgggcgcgagttcgggattcggtcgcggcatcgcgatggcgtatgccacggaaggtgccagcgtggttgtgagcgatatccacgaggccccgaaccagggcggtttcgaaggcaacccgcaactgacgaccgcagccgccattaccggcgccggcggcaaggctcagtacgtggcatgcgatgtgacgaggctcgaccaggttgcgaacctggtcaaggaaacagtccggctctacggcggtctcgatgtgatggtcaataacgccggtatctatcgcgccgggaagctcgcccacgaattttcggtcgaagacctcgacgcctgcttcgacgtgaatgtgaaaggcacgtggttcggctgtcaggaagccatcaaggtatttctcaagcaggctcgcggcggcaacatcatcaacattgtttcgaccgccggcttgcaaggccacccgaagcaatccgtctacaacatatcgaagggcgcggccgccaatctgacacgctgcctcgcaatcgaatatgggcgcgacaggattcgcgtcaacggcatctgccccacgtatgcgaaaacgtcgctgacacgcgcgctattcgacgacaaggacttcgacaaggtgttcacggaagccattccgctgaaacgctggggcgaagtcgaagatattgcgaacctcgcggtatttctcgcctcggacgaatcgagttacatccacggcgatctcattcgcatcgatggcggc

SEQ ID NO: 28385 - DNA, 1506 bp, Burkholderia fungorum
gacttcgcgatcgtcggcacgggcgccggcggcggcacgctggcatgccggctcgctgaactcggcttcagggtggtcgccttcgacgcaggcgcatggtggcgtccgctcgaagagttcgcttccgacgaaacccatcaggcgaaactgttctggaccgacgaacgaatctgcgacggcgaaaatccgctgcaactcggcaacaacaacagcggcaaggcggttggcggcagcaccgtgcacttcgcgatggtgtcgctgcgttttcgtccggaatggttcaagtcgcgcagcgcgctcggctatggcgcggactggccgctggactggcgcgagatgtggcgctactacgcgcaggtcgaggacgcgctgaagatctccggaccggtgaactatccatgggggccaccccggccgcgctatccgtaccgcgcgcacgaactgaacgcggccgccctggtgcttgcgcgcggggccgaagcaatgggcatcccgtggaccccgacgccgctcgccacgctatcggcgccgcgcgggcttgctcatccttgcgtttatcgcggcttctgcgtctccggctgcgcgaccaatgccaagcagagcgcgctggtcacgtggatcccgcgcgcgctgcgggccggcgcggaaatccgcgaccttgcgatggtcggccggattgcgaccaacgccctcgggcgagtcaacggcgtggaatatctgcgcgaagggcgctggcagttccagcgcgccaaacatgtggtggtggcgggctatgcgatcgaaacgccgcgcctcctgctgatgtcggcgaccagccagtatcccgatggtctcgccaaccgctccggcctggtcggcaagaacctgatggcccaatcgaatcaggccgtgtacgggacgatggaggaagagatccgctggtacaaagggccgccatcgctcgcgattaccgaacactggaattacaccgacgaaggcaaggacttttttggcggctactcgtacatgagccaggggccgttgccggaggtgtgggccggcgcgcagaacaagcgcggactatggggcgacgcgctggctcgggagatgcgcaattacaaccatcaggcgggcctgaagatcgtcggcgaaatgttgccgcaggagcgcaaccgcgtgacgctggccgacgaaaaggaccagtacggcctgccggtcgcgcgcgtcacctattcgtggggcgacaacgacaagcggctgatcgcccattcgctcgacttcatgcagcaggcgctcgccgcggccggcggccgggacatctggcgcgaaaccgacgacacctgtcacctgaacggcaccgcgcgcatgggcagcgatcctgccacgagcgtcgtggatgccgattgccgcagctgggacatacccaatttgtggatttgcgacggctcggtatttccgaccgtgggcggcgtcaatccgtcgctcaccattcaggcaatcgcatgccgtacggccgcgcgcatcgcc

SEQ ID NO: 28386 - DNA, 1794 bp, Burkholderia fungorum
atgagtcaaaccgtgggtgactttattatcgatcggctgcatgcgtggggtgtgcggcgaatttacggctatccgggcgacggcatcaacggcgtcttcggcgcgctgaatcgcgcccacggcaagatcgaattcgtgcaggtgcgccatgaagaaatggctgcattcatggcctcggcgcacgcgaaattcaccggcgagctcggcgtttgcatcgcaacctcagggccgggcgcatcgcatctgctcaccggcctctacgatgcccggctcgatcacatgccggtactcgccattgccggacaacaggcccgcgcggcgctcggcggccattaccagcaggagctggatctggtgtcgatgttcaaggacgtagccggcgcgttcgtggagcaggctagcgtgccctcccaggtccgtcatctggtcgaccgcgcggtgcgcacggcgctcgccgaacgcaaggtcacggctctcgtgttgcccaacgatctgcaggatcttgcgtacgaagcaccggcgcgcaagcacggcacgctgcattcgggggtcggctaccggcggccccgcctcgtgccctatccggacgatctgcaacaggccgcggaagtgctcaacgccggcaagcgggtcgcgattctggtcggcgcgggcgcgctgcatgccaccgacgaagtgatcgccgtcgccgacaagctcggcgcgggcgctgccaaggccttgctcggaaaagcggcgttgccggacgatttgccgtgggtgaccgggtcgatcgggctgctcggcaccaaacccagttacgacctgatgaccgagtgcgacaccctgctggtgatcggctcgggtttcccgtacgccgaattcctgcccaaggagggcgccgctcgcggcgtgcagatcgacctcaaggccgacatgctcagcctgcgctatccgatggaagtcaacctggtgggcgacagcgtcgagacgctacgcgcgctgctgccgttgctcgaacagaagcaggaccgcggatggcgtgaaaagatcgaaggttggactgccgactggtggaagacactcgacaaacgcgcccacgaagcaggcaggaaggggatgaatccccagcgcagcgtatgggaactgtcgcctcgcctgcctgccaatgccatcgttacaagcgattccggatcatgcgcgaactggtacgcgcgcgacctgaaagtgcagcgcgggatgatgtgctcgctgtccggcggtctcgcctcgatgggggcggcggtgccgtacgcgatagccgcgaaattctcccaccccgagcgcccggtgatcgcgctggtgggcgacggcgcgatgcagatgaacaacatggcggagctgatcaccgtggccaagtactggaagcagtgggccagtccacgctggatctgcatggtgctcaacaatagcgacctgaaccaggtgacgtgggagcaacgggtaatggaaggcgatccgaagttcgaggcatcgcaggacattccgtccgtgccctatcaccgttttgcggagctgatcggcctgaagggcatctacgtcgaggacccggagcgcatgggagcggcctgggacgaagcgctcgcggcagaccgtcccgtggtcattgaagtgaaggccgatccggacattccgccactgccgccgcatatcacgttggcgcaagccaaagccttcgcgtcgacgctgatcaagcgcgatccgaacgaaggcagcgtgatcatcgaaaccgccaaacaggtgctcggcgcggtgctgccggggcatcgcgacaaa

SEQ ID NO: 28387 - DNA, 930 bp, Burkholderia fungorum
atgggaaccatcgtcagcatcggcagcatcaatctggacctgcaaatgcgcgtcgaccatccggtgggcagcgccgaaacgcagcgcgcccatgacttctcgcgcctcgccggcggcaaggcggcgaacgtcgcctatctcgcgcgccgcttcggtcacgacgcgcaactgctcgggatggtcggcgacgaccgtttcgccgacgaagccgttgcgccgttgcgggacctcggcatcgacgtgtcgcgggtgcgcacggccgccgggcagcccaccgcggtatcgatgatcttcgtgcccgacaacggaaaaaagaccatcgtgctggcgtccaacgcgaatgacgcgtggcagcgcgcggatatcgacgccgcgctggaagcgatcgatgccgctcccgcgcacagcgtgcttgcggtggactgcgaaatgagcgtcgacgcgtgcgcggccgtgctcgctgctgcgcaacgccgcgcgctgtgcgtcgtgctcgaccccgcgcctccccaacgcgcccagtcgggcgcgctgcgtgcgctttggcgcgctgtgcacgcgctgacgcctaatgaggaagaagcggcggcgctcaccggcatcgagatcgcggatcaggccggcgccgtgcgcgccgctcgtgccctgcatcgtgaaggcttcgaacttgtgtgcgtgaagcgcagcgatggcggctgcattgccgtgtcgcgcgacggcgtgctggcggtgcaggtgaaaccggtcgaagcgctcgacaccaccggcgcgggagacgccttcaccggcgcgctcgccgtatcgctcgtcgagcgccgcgcgttcgcggatgcggtccggctggcgacggccgccgccaacctcaccgtcatggcgtggggctcgcaaaccgcattgccggatcgcgcccgtgcggacgcgttcgccgcc

SEQ ID NO: 28388 - DNA, 630 bp, Burkholderia fungorum
gcgcgcgagtggatggtcgaacgacagatcgtgcgccgtggggtgcgcgatccccacctgctcgccgcgatgcgacgcgtgccgcgcgatgcgttcgtgccagccgaactacgcgaattcgcttacgacgacacgccgttgcctctcgaaaacgagcagtcgatttcgcaaccggtcatcgtggcgaaaatgctcgaggccgcgcagcttcatcccggcgaccatgtgctggatatcggcacgggctctggctacgctgcggcggtcgctggggaaatagccgcgcgggtggattcgatcgaacgcgacgccgcgctggccgatacggcccaggaccgattggcgagactgggatatacgaacgtggtggtgcatcatggcgacggcacggccggcctcgcggaacacgcgccttacgatgcgatcatcgcagccgctggcggtccgcgcgtgccccatgcgttatgttcgcagcttgcgcccggcggtcgcctcatcatgccggtcggccccgagccaaaccggcagcggctggtgaagatcgtgcgtcggggcgagcaggactacgaagagcgtgtgttgggagacgtgcgattcgtcccgctggtcggtgatgacggctggcctgaa

SEQ ID NO: 28389 - DNA, 1431 bp, Burkholderia fungorum
tcgatggagtacggtcccgcgcccgagagcgatcaagccgcgcgtgcgtggctcgcgcagcatgaagcgcgcttcgggcatttcatcggcggcgcatggcgcgagccgggcgccggcgagcgcttcgcttcgcatgcgcccgccagcggtgaaccactggcccagatcgcccacggcgatgccggcgacatcgacgcggcggtgtgcgccgcgcgcgcggcgcagccggcttggcttgcgctcggcggcgcggggcgcgcgcggcatctgtatgcgctcgcgcgcatggtgcagcgccacagccggctgtttgccgtgctggaagcgctcgacaacggcaagccgatccgcgagacacgtgacatcgacgtgccgctggtcgcgcggcattttctgcatcacgcgggttgggcgcaactgcaggagagcgagttcgccgcgtacgcgccgcttggcgtgatcggccagatcgtgccgtggaattttccgctgctgatgctggcgtggaagatcgcgccggccattgcgatgggcaactgcgtggtgctgaagcccgctgaatacacgccgctgacggccttgctgttcgccgagctcgcgcatcgggcgggcctgccggcgggcgtgctgaacgtcgtgactggcgacggccgcaccggcgccgcgctggtcgaacatccgcagatcgacaagatcgcctttacggggtccaccgaagtcggcaaggcgatccgcgcggtcacggccggctcgggtaaatcgctgacgctcgaactgggcggcaagtcgccgttcatcgtgttcgacgatgcggacctcgacggcgctgtcgaaggcgtggtcgacgcgatctggttcaaccaggggcaggtgtgctgcgcgggttcgcgactgctggtgcaggaagggatcgaggcgcgcttcattgccaggctgaaacgccgcatggaaacactgcggattggcagctcgctcgacaagagcatcgacatcggcgcgatcgtggacccggtgcaactcgagcggatccggtcgctggtggaaacggggcggcgcgaaggctgcgcggtgtggcagtcgcccggcacggtcctgccggcgcaaggctgcttttatccgccgacgctcgtcaccggcgtggcgccggcttccacgctcgcgcagcaggaaatcttcgggccggtgctggtggccatgagctttcgcacacccgacgaagcgatcgcgctcgccaataattcgcgctatgggctcgccgccagcgtgtggagcgagacgatcggccgcgcgctcgacatcgcgccgcgactcgcgtgcggcgtcgtgtggatcaacgcgacgaacctgttcgacgcggcggtcggcttcggcggctaccgcgaatcgggctatgggcgcgaaggcggacgtgagggcatttacgaatatctg

SEQ ID NO: 28390 - DNA, 1005 bp, Burkholderia fungorum
atgaaagtgtatcgcttcgatcaagccggcagtctcgaccatctgacgcttcacgacgaacccacgcccgagccccagcgcggcgaagtgctgatccgggtgcgcgcgtcgtcgctcaactatcgcgacatcgcgatggttcacggcacctacctgcgcgcgcagcgggcgggcctgattccgctcagcgatgccgccggcgagatcgtcgccgtgggggaggacgtggtcgacttcaaggtcggcgagcgggtcatcaatacgtttcatccgcgctggtacggtggcaatccgccacccacgctcggctcggagggctacggctcacatcgcgacggctggctgagcgaatacaaggtcgtcagccaggaagcgatcgtggcagcgccccccggcctctcgttcgaggaagcggcaacgttgccttgcgcggcgctgactgcatggacctcactgtccggattgcgaccgctgcgtcccggacaaaccgtgttgacccagggcagcggcggcgtctcggtattcgcggtccagcttgccaaactgctgggcgcgcgcgtcatcgccacgacttcttcggcggaaaaggcggcgcggctcaaggcgctcggcgccgatgaagtgatcaattatgtcgagacgccggcgtggggcgagcgggtccgcgagctcaccgagggacgcggcgtcgatcgggtgctcgaggtcggcggcccaggcacgctcgaacagtcgatcaaggccgtggcgagccgcggcgaagtcgcgctgatcggctttctcgcctcaggcgattccggcgtcgggttcaacgacctgtttcgcagcggcggcgttttctaccggatttcggtcggcgaccgctcggggctgctggaactggtgcgtgccgtcacgtcatccggcctgaagccggtcatcgacaccgtatttccgttcgagcgtgcgcttgacgcctggcatcacttcgacgaccgcgccttcttcggcaaggttgtcatctct

SEQ ID NO: 28391 - DNA, 744 bp, Burkholderia fungorum
actatgcggttgacaggaaaaacagccatcgtcacgggtggcggctcgggtttcggtgaaggcattgccaaaacctacgcgcgcgaaggcgcgaacgtggtggtcaacgatctgaacggcccggccgccgaacgcgtggcaagcgaaatcgcgctggccggcggcaaggcgatcgcggtgacgggcaacgtcgcccagcgcgaggactggcaaaagctgcgcgaggccgcgctcgaagacttcggcagcgtgcagatcgtcgtcaacaacgccggcaccacgcaccgcaacaagccagtgatggaagtcacggaagccgaattcgaccgcgtctacgcggtgaatgtgaaaagcatctactggagcgtgcaggaattcgtgccgtatttccgcgagcaaggcggcggctgcttcatcaatattgcgtccacggcgggtgtgcgaccgcgccccgggctcgtctggtacaacggcagcaaaggcgcggtgattatcgcgagcaagtcgctggcggtcgagctgggtccggaccggattcgggtgaactgcgtgaatccggtgatcggcgagacggcgctgctgtccgaattcatgggcgtggaagatacgccggaaaatcgccaacgctttctcgccggcattccgctcgggcgtttctccacgccgcaggatattgccaacgccgcgctttatctggcctcggacgaggcggaattcatcaccggcgtgtgtctcgaagtggac

SEQ ID NO: 28392 - DNA, 1422 bp, Burkholderia fungorum
atggaagaagcccgacacttcatcggcggagaatggtccgccgcatcaggcggcgagacgatcgccgtgctcgatccctcggacggccaacccttcacccaactggcacgcggcaccgcggcggatatcgacgccgccgtgcacgccgcgcgccgcgctttcgaaggcgcgtggggcgaggccagcgcagccgaacgcggccgcgtgctgtaccggctgtccatgctggttgccgcgcgccaggaagaactggcgctgctcgaagcccgcgacaccggcaagccgctcaagcaggcgcgcgccgattcggccgccctcgcccgttacttcgagttctacgccggcgcggcggacaagctgcacggcgaaacgctgccgtaccagaccggctacaccgtgctgacgatccgcgatccgcacggcgtgaccggccatatcgtgccgtggaattaccccatgcagattttcgggcgcagcgtgggcgcggcgctcgccgccggcaatgcctgcgtcgtcaaaccggccgaagatgcgtgcctctccgtgctgcgcgtcgccgaactggctgccgaggcgggtttgcctgccggcgcattgaatatcgtgaccggctatggtcatgaagcgggcgcggcgctcgcgcgtcatccgggcatcgatcacatatcgtttaccgggtcgccggaaaccggcaagctcgtcacgcagatggccgccgagaatcacgtgccggtcacgctcgaactcggcggcaagtcgccgcaaatcgtgttcgccgacgcggatctcgacgcggcgctgcccgtgctggtgtcggcgatcgtgcagaacgcggggcaaacctgctcggcgggcagccgcgtgctgatcgaccggtccatttacgaacccttgctcgaccggctgagcggcgcgtttcatgcgttgcgggtcggcccttcgcatgccgatctggactgcggaccgctgatcagcgcgaaacagcagcggcgcgtgtgggatttcctctccgacgcgcagcacgacggcattcctatggcagcgcatggcgaggtgattcccgaggcgccggaaagcggcttctatcaggcgcccacgctgttgcgcgacgtgcccgccagccaccgcctcgcgcgcgacgaagtattcggccccgtgctcgccgccatgtccttcagcggcgaggacgaagcgcttgcgctcgccaacggcacgccatttggtctggtcgccggtatctggacgcgcgacggcgcgcggcagatgcggcttgcgcgccgcctgcgctccggccaggtgttcatcaacaactatggcgcgggcggcggcgtcgaactgccgttcggcggcgtcaagcattcgggccacgggcgggaaaagggattcgaagcgctgtatggctttaccgtgctgaaaaccatt

SEQ ID NO: 28393 - DNA, 1359 bp, Burkholderia fungorum
atgagcagactgatcgtggtatcgaatcgtgtcgcgccgactcaggaaggccgtcccgcagcgggcggactggcgatcggcgtgctggacgcgctgaaggaaaccggcggagtctggttcggctggagcggcgagacggtgagcgagccgagcgctccggtgatcgagaaacagggcaacgtgacgtacgcgacggtgggtctcaccaagcgcgattacgaccagtactaccgcggtttttccaacgcgacgctgtggccgacgttccattaccgcaacgacctctcgcgctacgaccgtcaggaatacgcgggctatcagcgcgtgaacgcgacgctcgccaagcagctcaaggagctgctgaaacccgacgacatcatctgggttcacgactatcacctgctgccgttcgcgcgctgcctgcgcgagctgggcgtgaagaatcccatcggcttcttcctgcatattccgtttccggtgccggaggtgctgcgcaccattccgccgcacgaagaactggtcaaggccatgtgcagctacgacgtgatcggcttccagaccgatgcggatcgccagtcgttcgtcgacttcatcgagcgtggccagcacggcacatcgagcgaggacggcatggtgcacgcgtacaaccgcttcctgaaagtgggcgcgtatccgatcggaatctatccggacgcgattgccaaggccgccgagcagttcaccgaccgcaagccggtgcgcagcctgcgcgacggtatgcgcgggcgcaagctgatcatgagcgtggatcgtctcgactattcgaaggggctggtggagcgctttcaggcgttcgagcgactgttgctgaacgcacccggttggcacggacgcgtatcgctggtgcagatcgcgccgccgacgcgtgcggacgtgcagacatatcagcggattcggcagacgctggagggcgaagcgggccgcatcaacggccggttcgcgcagctcgactggacgccgatccagtacctgaaccgcaaatacgagcgcaatctgctgatggcgctattccgtcaatcgcaggtcggttatgtgacgccgctgcgcgacggtatgaatctggtcgcgaaggagtatgtcgcctcgcaggatccggccgatccgggcgtgctggtgctgtcgcaattcgccggcgccgccgagcagttgccgggcgcgctggtcgtcaatccgtttgatctgtcgcagatggccgaagcgcttgaacgcgctctgtccatgccgctcgccgagcgtcaggcgcggcatgccgacatgatggcgccgatgcgagagaacaatctgtcggtgtggcgcgatacgttccttgccgatctgcgc

SEQ ID NO: 28394 - DNA, 723 bp, Burkholderia fungorum
aaagtggcgatcgtaaccggcgcgggcggcggcattggcgcggcggtatgtgcgcggctcgcggccggcggctgggcggtcgtgctcgcggaccgcagcgccggcacgaccgccgaagccgaggcgcgctgccgcgcgctcgatgcgccggcggacacgttcgcgggcgacgtgacggatgcggactacgtgcgtgagctggtcgcgttcgcgctgcgccgtcatgggcggctcgacgccttcgtcggcaacgccgggatcgccgggcaggtcaagccgctcgcagactatccggacgacgcgttcgatctcgtgatgaacgtgaacgtgcgcggcatgttcctgtgcctgaagcatgggattccggcgttgcgcgagcgcggcggcagcttcgtcgcgaccgcgtcgacctcggcgattcgcggtcgcgcgaacctgtccgcgtatgtcgcgagcaagcacgcggtgctcggactcgtgcgcagcgcggcgctcgaatgcatgggcagcggtgtgcgcgtgaacgcggtactgcccggtccgatccagacgccgatgatcgacgcgatcaacgacatggccgcgcagcacggcggcgtcgcacgcgccgctcacgcggcttacggtcgcccggaagacgtcgcgaacacggtcgcgttcctgctgtcgcctgacgcgtcgcatatgaacggcgccgcgctcgtggtcgacgcgggcagcacc

SEQ ID NO: 28395 - DNA, 1257 bp, Burkholderia fungorum
aagaaggcgctcgttgccgcttgtgtcggcaactttatcgagtactacgacttcgtgatctacggctattttgcgtccgtgatcgcgcgtctgttctttccggccgacaacgaggccgcgagcctgctgctcacgttcgcggtgttcgccatcagctatgcgtcgcgaccgctcggcgggctgatcttcgggcacctcggcgatcgctacggccgcaagacgccgctcgccgtcgcggtgatgctgatcgcgtgctcgaccacggtgatcggcctgttgcccacctatagcgcgatcgggatcgcgtcgccgatcattctcaccgccgcgcggctggtgcagggcatttctgtcggcggcgagtatggcggcgcgacttcgttcatcgccgaatatgcgccgcccggccggcgcgggttctataccggctggcagaccttcacgatcggcctcgcgttgctggtgggcggcgcggtggcgtcgatcatcaccggagcgctgtcggccgaagacctgcgcgcctggggctggcgtctgccgtttttcgcgggactgccgctcggtttcgtcgggctctatctgcggctgaagctggaggaaacgccgcacttctcgtcggtgcaacagactgccgagatcgagcgcacgccgctcgtgaccggattgcgcagagagtggaaggcgattctgatcggaatggggctcatcgccgcgccctcggcgtgcatctacatctactacatctattcgccgacgtatctgtccgtggtgctcggtttcaagctcgcggacgcgcagcgcgccaacctgtatagcctgatcttctattgcgcgctactgccggtcttcgcgcacctgagcgacgttgtgggccgtcgtccgttgatgctcgtgagttcgctcgccatcatgctcgtcacgtacccggcgtttcatctgctcgatccgcatgacttcggcaagacggttgcggcgctatgcctgatgagcctcgcgttcgcgccgcattcggccacggcgctatgcgcgatggccgagatcatgccgaccagactgcgctacaccgggctgtcggtgagcctgaacattccggtcacgctgctcggcggcacggcgccgttcattgcgacgtatctcgtgtcgcgtaccggcgatctgtattcgccggcgtggttcgtgatcggcgcaggcctgtgcacgttggtggccgcgtatgcgtataaggagacgctgcatagtggattgcggtgaagcgcc

SEQ ID NO: 28396 - DNA, 637 bp, Burkholderia fungorum
cttcagctgtactcgctgcccacgcccaatggcgtgaaggtgtcgatcatgctcgaagagacgggtttgccgtacgagccgcatctcgtgcgtttcgatacgaatgatcagatgacgccggagtttctgtcgctcaatccgaacaacaagattccggcgatcatcgatccggatggcccggatggcaaaccgctgccgctattcgaatccggcgcgatcctgatctatctcgccgacaaaagcggccggttcattccgcaggatgccgccggccgctacgaagcgatccagtgggtgatgttccagatgggcggtattgggccgatgttcggccagctgggtttctttcacaagtttgccggtaaggaatacgaggacaagcgtccgcgcgaccgttatatcgccgaatcgaaaagactgcttggcgtgctggatcgccaactcgaagggcgcgactggattctgggcgatacgtactcgattgccgatatcgccaccttcccttgggtgcgcaatctgatcggcttttatgaggcgggcgatctcgtcggcattcaggatttcccgaatgtcacgcgtgtgctggcggcgtttgtcgcgcgcccctgccgtggcgagggggctggagattccgaag

SEQ ID NO: 28397 - DNA, 1941 bp, Burkholderia fungorum
atgtcgctttacaccattaccggagcccaactggccttcggtcacgtcgcgttgctcgatcacgcggatttctctctcgaagcgggcgagcgcgtcgggctgatcggccgcaacggcgcgggcaagtcgtcgctgctgaagatcgtcgccgatctgaccaggcctgacgacggcctcgtcacgcgccagcagaacctgaccacggtttacgtgccgcaggagccggagttcgatacggacgacacggtgttcgacgcggtcgccgccggcctcacgcacgcccgcgcgctgctggacgaatacgacgcggtcgccaaccagctcgccgacgagccggaaggcgcggagcacgacgcgctgatgtcgcgcatgaacacgctgcagtcgtcgctggacgccgtggacgcctggaactggagcacccgcgtgtcgaccacgctgcagcagatcggcctgaacggcgaggcgcgggtgggttcgctgtcgggcggcatgcaaaagcgcgtcgcgctggcgcgcgcgctggtcgtgcagccggacgtgctgctgctcgacgagccgaccaaccacctcgacttcgaaggcatccgctggctcgaagatctgctggtctcgctgcgcgcgggcctgcttttcattacccacgaccgggcgtttctcgatcgcgtcgccacgcgcatcgtcgaactggatcgcgggcgcctgctgtcgtatccgggcaatttctcggcttaccagacgcgcaaggcgcagcagctcgaagtcgagcaggtggaggcggccaagttcgacaaactgctcgcgcaggaagaagtgtggattcgcaagggcgtcgaggcgcgtcgcacgcgcagcgtcggccggatcgcgcggctcgtggaaatgcgcaaccagcgcgcggaacgccgcaacgtgcagggcaacgtcaagctcgacgtcggccagggcgagaagtcgggcaagatcgtcgccgagttgaccgacgtgaccaaacgctacggttcgcgcacggtggtcgacaacttcacggccacggtcatgcgcggcgacaagatcggctttgtcggcccgaacggcgcgggcaaaaccacgctgctcaagctgatcctcggcgaactggcgccggatgaaggcacggtgcgcatcggcacgaatctgcaggtcgcgtatttcgaccagatgcgcgcgcagctcgatctggaaaagagcctcgccgacaccatcagcccgggcagcgagtgggtcgaagtgaacggccagaagaagcacgtcatgagctacctcggcgacttcctgttcgcgccggaacgcgcgcgttcgccggtcaagtcgctgtcgggcggcgagcgtaaccgtctgctgctcgcgcgcctgttcgcacgcccggccaacgtgctggtgctggacgagccgaccaacgacctcgatattcccacgctcgaactgctcgaagaactgcttacggaatacgacggcacggtgctgctggtcagccacgatcgcgcgttcctggacaacgtcgcgacctcggtgatcgcgtcggaagggggcggcaagtggcgcgagtacgtcggcggctttaccgattggcagatccagcgcgaccgctcgcagcagatggcgctggacgcgcagaaagaagccggcaaggacgcgggcaaagacgcggcgccgggcaaagacggttccgcgggccgcaatacgcaacgcgccgcgaagctgtcgttcaaggagcagcgcgaacttgaggcgctgccggggaagatcgccgcgctcgaagcggagcagaaaacgatcggcgcgcaactcgaagacggctccgtgttcgccaaagatgcgcaggaaggtacgcgcctgaccgaacgctacgccgcgatcgacgaggaactgctggtcgcgctcgagcgctgggacgagctggaaaatcgccgcaagtgaggc

SEQ ID NO: 28398 - DNA, 999 bp, Burkholderia fungorum
acgcaaggcgcccgcatcgcaggcgtcgtgtcgtgcgtgccctcgaaacaggtggataacgactacttcgtcgagaggttcgacgcatccgccgtccgcgatgtggtcaagatgatcggtgtcaaccggcgccgctgggcagacgcgcagacgagcgccggtgatctgtgccgcaaggccggcgagaagctgcttgccggactcggctggcaggcggactcgatcgacgcgctcattttcgtgtctcaaacgccgaactaccgcttgcccgccacggcgttcgtattgcaggcggagctcgatctgccggcatcgtgtctcgcgctggacatcaatctcggctgctctggctatccgcaggcgctgtggctcggcatgaacctgatccagacgggcgcggcaaagcgcgtgctgctggcggtgggcgacacgatcagcaagatgatcgacccgaccgaccgctcgacctcgctgctgttcggcgacgccggcacgatgacggcgctggagacctcgaacggcgatgcggccgcccacttcatcatcggtgcggacggcaagggcgcgcgcaatctgatcgtgccgtcgggcggcttcaagccgtatgacgccgcggccgacgagcgcatggccggcaagtcgccggaatgcctgttcatggacggtggcgagattttcaatttcacgctgaacgcggtgccgaagctggtctcacgcacgctcgacattgccggccgcgacaaggactcgtacgacgcgttcctgttccatcaggccaatctgttcatgctcaagcatctggccaaaaaggctggcttgccggccgaacgcgtgccggtcaatatcggcgagtacggcaacacgagctgcgcgtcgattcctctattgatcaccaccgaactgaaagaccgcctgaaggaagagacgctgcaactaggcatgtttggcttcggcgtcggatattcgtgggcatcggcggcacttgcggtcggaccgctc

SEQ ID NO: 28399 - DNA, 1020 bp, Burkholderia fungorum
tccgaccgggtgcaggcacgcattctcgatatcgccggattcctgcccgagcaggtcctgacgaacgagcagctggcggcgctctatccggaatggccggcggacaagattctggccaagacaggcattcagcaacggcatatcgccgcggccgggcagaccgcggcggacctggcttatgaagcggcgcgcaacctctttgcccaaggctcggtgaatgcgcaggacgtcgacttcgtcattctgtgcactcaggcgcccgactatgtgttgcccacctcggcctgcctgttgcaggaccggctcggcatttcgactcacgccggcgcgctcgacgtcaatctcggctgctccggctatgtgtatggactttcgctcgccagggggctggtggaaaccggcgccgcgcgctgcgtgctgttgctgaccgccgacacttattcgaagtacgtacaccccctcgacaagagcgttcgcaccctgttcggcgacggtgccacggcgacggcaatcacggcctccacgaacggcgacgcgtcgatcggccccttcgtattcggcacggacggccgcggcgcgcagaacctgatcgtcaaggcagggctgttccgcgagccgaagaacgcacaaagcgcgctcgaaacccaggatgcgtccggcaacgtgcgcaccgacgaacacctgtacatgaacggcgccgaagtcatggcattctcgcttgccgaagtgcccaaagcggcgacatcgctgctcgaaaaagccggcatggaccgcgaggaaatcgacttcttcgtgctgcatcaggcgaaccgtttcatgctcgaggcactgcgcaagaaaatgaaggtcccggaagcgaagtttccgatcctgatggagcaatgcggcaacaccgtttcgtcgacggttccgctcgcattgaagcagatgaaagacgacggcctgctccagcatggcagtcgattgatgttgttgggctttggtgtcggctactcatgggccggctgcctcgtgacttac

SEQ ID NO: 28400 - DNA, 1965 bp, Burkholderia fungorum
atgtccaatctcatcaatctcggcctcagtggactgaacgcagcccagtggggactcacgacgaccggccagaacatcagcaacgcgtcgacgcccggctacaccatcgaaacgccggtatatgcggaaagcggcggccagtacacgggttcgggctatctgccgcaaggggtctcgaccacgaccgtgacgcgccagtacagccagtatctgaccactgagctgaacaacgcgcagtcgtccagcagttcgctgtcgacgtacaacacgctgatctcgcaactgaacaatctgatcggcagcccgactgccgggattgcgagcgcgatcaccagctatttcaccggcttgcagaacgtctcgaacaacgcatcgagcctcgcgacgcgccagaccgcgatgagcggcgcgcagacgctggtgaaccagatcaacgccgcgggtcagcaatacgacgcgctgcgccagagcgtcaacacgcaactcaccaacaccgtttcgcagattaacagctactcgcagcagatcgcgcaactgaacggacagatcgcccaggccagcacgcaagggcagccgccgaaccagttgctggaccagcgcgatctcgccgtgtccaacctgtcgcagttgatcggcgtgaacgtcgtcaacagcaacggcagctacagtgtgttcatgagcaatggccagccgctcgtgtcgtccaccaacagctacaacctgggcaccgcgccttccaccggcgacaccagtgaactgtccgtgcagtatctcggccaggccggcgcgaacccggcggcgacgccgcagaacctgcccgacagcaagatcgacggcggcacgctcggcggcctgcttgcgttccgcagccagacgctcgatccgggcgaggcgcaactcggcgcgatcgccgtgagcttctccgcgcaggtcaacgcgcagaacgggctcggtatcacgctcgccggcgccaagggcggcgcgctgttctcggtgggcggcccgaccgtctacgcgaacacacagaacaccggcaacgcgtcgctgaacgtgtcgttcgcggacgccacgcagccgaccaccggcgactacacgctggcctacaacggcaccacctacacgctgaccgacaattcgacgggcaccgtggtgggttcggcaactaacctgagccagccgatcaacggcctgaatttctcgaccaccggcacgatgaacgccggcgattcgttcacagtcgagccgacgcgcggcgcgctgaacagtttcgcgaccgccaccaccgacgcatcggcgatcgccgccgccgcacccgtgctggccgccgctgccgcgagcaacaccggcaccgccacgattacgcagggcacggtgacggccggctacaccatgccgaactcgaccaccacgctgtcgtacgacggcacgggcctgtccggcttcccggccggttcgacggtgaccgtggccggtacgcctcccaccacgtacacgatcgccagcgcggcgacggtggtgccgtattcgtcggcgaccggcgccacgctcacgatcaacaacgcgaccgccggccagatgaacaatgtgtcggtgacgatcagcaacgcaccggctgccggcgacaagttcaccatcggcccgaacaccggcgcgaccaacgacggtcgcaacgcgctggcattgtcgaatttgtccaccgcgaaagcgatgtcgggcgggacggtcacgctgacgggcgcgtatgcgaactacgtcaacaatatcggcaaccagaccaaccagatccagacctcgagcacggcgcagagttcgctggtgacgcagatcaccaccgcgcagcagtcggtttcgggcgtgaacatcaacgaagaagcagccaacctgcttcagtatcagcaactgtatcaggcgaacagcaaggtcatccagaccgcgcagaccctgttccagacgatactcggcatc

SEQ ID NO: 28401 - DNA, 750 bp, Burkholderia fungorum
acgctcacgggacagcacgcggtggtcaccggcggcggcagcggcatcggcgcggcggtcgcgcaggcgctgctacacgccggcgcgcgcgtcaccttgatgggccgcaatgcggagcggctcgacgcgcagcgcgagaaatgccaaacgttgggcgaggtggcttgcatcagcgtcgacgtcacgcaggaagattcggtcgagagcgcgttccgtgaggccggcgcggtcgacatcctcatcaacaacgcaggccaggcgcaagccgcaccgttcacgcatacggacctggcgctctggcagcgcatgctggacgtcaacctcaccggcgtctttctcggcacgcgcgcggtgttgcccggcatgctcgaacgcggtcatggccgcatcgtcaacgtggcgagcacggcgggacagatcggctacgcctacgtcgccgcctattgcgccgcgaaacacggcgtgatcggcctcacgcgctcgctcgcgctggaagtggcgaccaaaggcgtcacagtcaacgcggtttgtcccggttatacggagacggaactgctgcacgcatcgcttgaacagatcaccagcaagacttcgcgcaccgaacaacaggcgcgcgaaaccttgcttcgctcgaatccgcaacatcgcttcgtgagtccggaccaggtcgccaatgcggtgctctggctgtgtcagcctggctcggacgccgtcacggggcaatccatttccatctctggtggagaagtc

SEQ ID NO: 28402 - DNA, 960 bp, Burkholderia fungorum
tacggcggccacggcgacacgatcgacacgcgcgccgtctgcctgctgcgcgaaacgctcgccaaacactctggcctcgcggacttcgcgctggcgatgcaaggcctcggttcgggcgccatctcgcttggcggcacgcacgaacagaagacgcgctatctgccgcgcgtcgccaacggcacggccatcgcggcgttcgcgctatccgagcccgaggcgggatcggacgtcgccgccatgacgctctccgcacgcgaagacggcgacgcctacgtgctcgacggcgacaagacgtggatctccaacggcggcatcgccgatttctacgtggtgttcgcgagaacgggcgaagcgccgggcgcacgcggcatcagcgcgttcgttgtggatgcggatacgccggggttggagattgcggaacgcatcgacgtgatcgcgccgcatccgctcgcacgtctgcactttgccggcgcgcgcgtgccgcgcagccagatgctcggcgcacccggcgaaggtttcaagctcgccatgcgcacgctggatattttccgcacgtcggtggcggctgcttcgcttggcttcgcgcgtcatgcaatggccgaaggtgtcgcgcgtgccgcgtcgcgcaaaatgttcgggcagacgctcggcgattttcaactgacgcaggccaaactcgcgcagatggccttgaccatcgacagcagcgcattgctggtctatcgcgcggcatggctgcgcgatcaaggcgaaaacgtcacgcgtgaagcggcaatggcgaaatggcacgcaagcgaaggcgcgcaacaggtgatcgacgccgccgtgcaactctacggcggcatgggcgtgcaaagcggcacggccgtcgaaatgctgtatcgcgagattcgcgcgctgcgcatttacgaaggcgcgaccgaagtgcagcaactgatcgtcggacgtgatctgctgaaa

SEQ ID NO: 28403 - DNA, 1077 bp, Burkholderia fungorum
gacacactcgcgatcaacaagcccgaccacttcaccgcgtgcgacaccgccgccgacgacgtctgcctgatcgccttcaccagcggcacgaccggtgcaccgaaaggttgcatgcactttcatcgcgacgtgctggccatgtgcgatctgttcccgcgctacgtgctcaagcccacgtcgagcgatattttttgcggtacgccgccgctcgcgttcacgttcggactcggcggtttgctgtgctttccgttgcgagtgggcgcatccacggtgctgatcgagaagctcacgcccgagactttattgcagaccgtcgagcgttttttcgcgaccatcgtattcaccgcgccgaccttctaccggcaaatggcgccgctggttgcgcatcacgacatctcgaccttgaagaagaccgtctcggcgggagaagccttgccggattcgacgcggcgtttgtggcgcgacgcgtccggcatcgacatgatcgacggcattggcggcaccgagctgatccacattttcatttcggcgcaaggcgacgagatccgcccgcatgccatcggccgcgcggtgccgggttacgccgtgcaggcagtggacgacgacatgcgaccggtcgcgcccggcaccatcggcaaactcgcggtgcgcggcccgaccggctgccgctatctcgccgacgaacggcaacagaagttcgtgcgcgacggctggaatctgcccggcgattccgtctatctcgacgcggacggctacgtgttctaccaggcgcgtgccgacgacatgatcgtctccgccggctacaacatctccggccccgaagtggaaagcgtgctgctgcaacacgacgcggtgtccgaatgcggcgtgataggcgcgccggacgaaacccgcgggcagatcgtcaaggcgttcgtcgtggtcaatcccggttacgtcgccgacgacaaactgatcgcgcaactgcaggatttcgtgaaaaatagcgtggcgccgtataaatatccgcgcgagatcgttttcgtcgatacactgccgcgcaccgaaaccggcaagctaaaacgtttcgagttgcgc

SEQ ID NO: 28404 - DNA, 474 bp, Burkholderia fungorum
ttgactatccatatccgtcccgctcgcgcagccgacgccgcattgattcttcgcttcatcaccgaactcgcggtgtacgaaaaggcggagcacgaagtcgtcgcatccgtgaaggacatcgaagcgagcctgttttccgcaagcgccagtgcgaaggcgctgatctgcgagatgaacggcgagcccatcggcttttgcgtctactttttttcgtattcgacctggctcggcaaacaggggctttatctggaagacctgtatgtgtcgccggcatcgcgcggcagcggcgcgggcaaacagatgctgcgtcacctcgcgcgcattgcgtgcgacaccggttgcggccgcttcgaatggagcgtgctcgactggaacgaaccggccatcggcttctacgaatcgatcggcgcgagcgcgcaaagcgaatgggtgcgctatcggttggcgggagatgcgctcaagaagtttgcggag

SEQ ID NO: 28405 - DNA, 1725 bp, Burkholderia fungorum
ttcacgctgcatggaattcccgtgtcacgcggtatcgccatcgggcgggcctatctgatcgccccggctgcacttgacgtagaccactatctgattgaaccggcccagatcgacggcgaggtcgagcgctttcgcgcggcccagcaacacgtgcatcgcgagctcgacgcgttgcgcgccgatctcgccgcagacgcaccgagcgagatgggcgcgttcatcaacgtccactcaatgatcctgaacgacgcgatgctcgtgcaggaaaccatcgacctgatccgcacgcgccgctacaacgtcgagtgggcgctgaccgaacagctcgagcgcctgtcgcgccatttcgacgatatcgaagacgaatacctgcgcgagcgcaaagccgatatcgagcaggtggtggagcgcgtgctgaaggcgctcgccggcgcgtcggtcgcgctggtggacggcgtgcacggcgcctgcgacgagatgatcgtggtcgcgcacgacatcgcgccggccgacatgatgcaattcaaaacgcaaacgttccagggtttcgtcacggacctcggcggccgcacctcgcatacagcgatcgtcgcgcgcagcctgggcattccggccgcggtcggcgtgcagcatgcgagcgcgttgattcgccaggacgacctgatcattgtcgacggcgatcatggcatcgtgatcgtcgatcccgcgccgatcgtgctggaggagtactcgtaccggcagagcgagaaagcgctcgaacagcgcaagctgcagcggttgaagttttcgcccacccaaacgctgtgcggcacgcgtatcgagttgtgcgcgaacatcgagttgccggaagacgcgcgcgcggcgctcgaggcgggggcgatgggtgtcggcctgttccgctccgagttcctgttcatgaatcacaaggaccgcttgccggaagaggaagagcaattcgccgcctaccgtcgcgcggtcgaattgatgaacggcctgccggtcacgatccgcacgatcgacgtgggcgccgacaagccgctcgattcgatgggcgggggcgacggctatgaaaccgccgcgaacccggccctgggtctgagagcgattcgctggagtctctccgagccgcagatgttcctcacgcagttgcgcgcaatactgcgcgcgtcggcgttcggtaccgtgaagattctgattccgatgctcgcgcatgcgcaggagatcgaccagacactcgatctgatccgcgaagccaagcgtcagctcgacgacgcgggcatcgcctacgatccgaacgtgcaggtgggcgcgatgatcgagattccggctgccgccatcgcattgccgctgttcctgaagcggctcgattttctgtcgatcggcaccaacgatctgatccagtacacgctggcgatcgatcgcgcggacaacgcggtcgcgcatctatatgacccgctgcatcccgcggtgctgcatctgatcgcgttcacgctgcgcgaggcgaagcgggcgggtgtgccggtgtcggtgtgcggcgaaatggccggggacccggcgttgacgcgtctgttgctcggcatgggtctcaccgagttctcgatgcatccgagccagctgctggtggtcaagcaggaagtgctgcgcgcgcatctgaagacgctggaaaagccggtggccgatgtgctggcttcgttcgaaccggaagaagtgcaggccgcactgaag

SEQ ID NO: 28406 - DNA, 735 bp, Burkholderia fungorum
aaactcgttctcatccgccacggcgaatcgacgtggaacaaggaaaaccgcttcacgggctgggtcgacgtcgacctcaccgagcagggcaacaatgaggcgcagcaagcgggcgtgctgctgaaggattcgggctacacgttcgacatcgcctacacgtcggtgctcaagcgcgcgatccgcaccttgtggcacgtgcaggacaagatggatctgatgtacctgccggtggtccattcgtggcgtctgaacgaacggcactacggtgcgctgtcgggtctgaacaaggctgagacggccgccagattcggcgacgaacaggtgctggtctggcgccgcagctacgacacgccgccgcccgctctcgagccgacggacgagcgcgcgccctacaacgatccgcgctacgccaaagtgccgcgcgaacagttgccgctcaccgaatgcctgaaggacacggtcgcgcgcgttctgcccctgtggaacgagtcgattgcgccggccatcaagtcgggccgccaggtgctgatcgccgcccacggcaattcgatccgcgcgctcgtcaaatacctcgacgatatttcggacaacgacatcgtcggtctgaatattccgaacggcgtgccgctcgtttacgaactcgacgaaaacctgcggccaatcaagcactactatctgggcgaccaggaagcgatcgccaaggcgcaggccgcagtcgccaggcagggaaaggca

SEQ ID NO: 28407 - DNA, 303 bp, Burkholderia fungorum
ctgtcggccgctgaagccactcaactgatcaaccggcgcaatgcggcggtcatcgacctgcgtccatccgccgacttcgccaaagggcatttgcccgcggcacggcaccttgaatttgcggagctgcaggcgaaggtcgcgcaactcgtgaagaacaagaccaacccggtactgctggtatgccagaccggccagcagtcgaacaaggcagcgcgtatcgtgcaggatgcagggtatgcggaagtccatgttctcgaaggcggtgtcgacgcctggcagaaagccggcatgccggttgtgaaa

SEQ ID NO: 28408 - DNA, 929 bp, Burkholderia fungorum
acacagtgttgtgggcgcgccagcccgcgctcattgccgatctccgcgcttcacacgaaaacgcccgctatctggcgggcgttgcgttgccgccggcgcttcgctatgaaacggatctgaacgcagcgctcgaccacgcgctcgccgacaacgcgttatgcgtcgtggcaacccccgtggccggactgcgcggtctgttccgggccatgcgcgatgcaggcaaagtgccggcgcatgtggtgtggctgtgcaaaggttttgaagccgactcgcagttgatgccacatcaggtggtcgcggccgaactgccggagcacggcagcaacggcgtgctgtcgggtccgagttttgcgcgtgaagtcgggcagggcttgccggtcgcgttgaccatcgccagcgcttcggcggcgtgccgcgagcgcacggtggccgcgttccatcacggcgccatgcgcatctataccggcgacgacgtcgtcggcgtggaagtgggcggcgcggtgaaaaacgtgcttgccattgccacgggcattgccgatggactcgggctcggtctgaacgcgcgtgcggcattgatcacgcgcggcctcgctgaaatgtcgcgcctcggcgtgacgctcggcggccgtgcggaaaccttcaccggtttgaccggcctgggcgatctgatcctgaccgccaccggcgatctgtcgcgcaatcgcacggtcggcctgcaactcgctgcgggccgcacgctcgacgatattctcggcggcctcggtcacgtggccgaaggcgtgcgttgcgcgcaagcggttcttgcgatcgcccgcgcacatgcaatcgagatgcctatcacgcaggcggtgtgtgccgttctgttcgacggcgtggctccgcgcgacgccgtcagcgccctgctgcggcgcgactccaaagccgaataa

SEQ ID NO: 28409 - DNA, 1011 bp, Burkholderia fungorum
tcgaatatgcttaaagaggcgctggcgtccgctgaaacggtcgccgcgcaactcatggatacctcgcgcgtcgaggcattggcggcgaagcttgcgcagcagccgcgtcatgtcgcgctgacggtcgcgcgcggcagctccgaccatgctgcgagttacttcgccagcctgacgatgagccgcctcggcgtgccggtcgcctcgctgccgatgtcggtcgccacgctccagcaagcgccgctgcaggtgtgcgatcagctcgcgctggccttctcgcaatcgggcaagagcccggatctggtcggcacgatggaagcgctgcgcaaagcgggcgccttgacggtagccgctgtcaacgtgtcgggctcacccctggccgacgcgtgcgaattcgagttgccgctcgtcgccggtccggaactgagcgtcgcggccaccaagagctatatcgcgatgctgtcgatttccgcgcaactcgtcgcgcattggcagaaagacgccgaactgctcgcggcgttgaagacgctgcccgaagcactgcgtgcggcaggcaagctcgactggtcgaatgccgtggaggaattgcgcggcgtggagcgcatgatcgtgatcggtcgcggtctgggtcttgcaatcgcgcaggaagccgcgttgaaactgaaggaaacctccggcattcaggccgaagcgttttcgagcgcggaagtgcgtcacggtccgatggaactgatcgaccgcgactacccgctgctggtcttcgcaccgcgcggtccggaacaggccggcttgctgcaactcgcgcgcgacatgcaggcgcgcggcgcccgtgttctgctcgcggcgccggccgacgtgccggaagccacgctgccgctcgccatcaccgctcatgcggcgctcgatccgatcgccgccatcctgtccttttacgtgatggcagccggccttgccgccgcgcgcgggcgcaatcccgatgcgccgcgccatctcaacaaagtcaccgaaactcac

SEQ ID NO: 28410 - DNA, 2541 bp, Burkholderia fungorum
catatcgttttactcgcgcccatgaccggtccggtcgtgccgctcgcgaacgtgcccgacccggtgttttcgggcggcatgttcggcgacggcatcggcatcgatccgctcgagggccggctcgtcgcgccctgcgacggcaccgtgacgcatctcgcgcgcaccggtcacgcggtgacgctggcgactgccgaaggcgccgagattctgctgcatatcggtatcgatacggttgcgctgaacggcaagggctttgcgccgatggtcgcgcaaggcgcccacgtgcgagccggccaggtgctgatcgagttcgaccaggatcaggtggcgctgaatgcgccgagccttgtttctgtggtcgcgatcgccaattccgatgcgttcgaaatcgtcgagcgcgtgcaaggcggcctgctgaaggcgggcgaaacgccgctgctggtgctgcgcgcgcgcggtggcgcggcggccgaggcttcgcgtcaggcgagtgcgacgaacgtcgcggaagaagcgcgtcagcaagtcacgctggtccatgcgggcggtctgcatgcacgtccggcggcgcgtgcccgtgaagcggcgcgcggtttcgatgcacgcgtcgaagtgcgttacgaagggcgtaaggcggcgatcgaaagcgtggtcggtttgctgggactcggcgcaggtgaaggcgcgacggtcgaattgctcggcatcggtccgcaagccagagccgcgatcgaagccattgcgcacgaattgacgcgtgaagcacagggtgaagcggaagaaaaacccgcgcgtgaaagttcgccggcgccgcaggccgtggggcatgcggcagacgaagcgctcgccccgaatacgcttgccggcgtctgcgccgcaccgggcgtcgcggtcggcaagctggtgcgctgggacgacgcggatatcgatccgccggagaaggcggccggcacgtcggctgcggaaagccggttgctcgacaaggcgattgccactgtcgatgcggacctcggcacgaccgtgcgtgacgcatcgcaacgcggcgcggtcggcgaagcgggcattttcgcggtgcaccgcgtgctgctcgaagatcccacgctgctcgacgccgcgcgcgatctgatcagcctcggcaagagcgccggctttgcatggcgcgcagcgatccgtgcgcagatcgccatcctcgcgaaaatcgaagacgcgttgctcgcggaacgcgccgccgatctgcgggacatcgagaagcgtgttctgcgcgcgctcggttatacgaacgccgcgtcgcgcacgttgccggaagaagcggtgctcgcagcggaagagttcacgccgtcggatctgtcgacgctggatcgctcacgcgttaccgcactggtgatggcgcgtggcggcgcgacctcgcacgcggcgatcctcgcgcgtcaggcaggcattcccgcgctggtggcagtcggcgacgcgctgcatgcaatccctgaaggcacgcaagtggtggtgaacgccacgaccgggcgcctcgaattcgcaccgaccgagctcgacgtcgaacgcgcacgtctggagcgctcgcgtcttgccggtgtacgcgaagccaatcgccgcacctcgcagcaggcggccgtcacgtccgatggccgtgcaatcgaagtggccgcgaacatcgccacgctcgacgacgcgaaaaccgccgtcgaaaacggcgccgattctgtcggcctgttgcgcaccgaactgttgttcattcaccgcgccgccgcgccgaccacggacgaacatcgtcagagctaccaggcaatcgtcgatgcgttgagcggccgcaccgcgatcatccgcacgctggatgtcggcgcggacaaggaagtggattacctgacgctgccgcccgagccgaatcccgcgctcggcctgcgcggcatccgcctcgcgcaagtgcgcccggatctgctcgacgatcagttgcgcggtctgctcgcggtgcgtccgctcggtgccgtgcgcattctgctgccgatggtgaccgatgtcggcgaattgatccgcatccgcaagcgtatcgacgaattcgcgcgcgagtcgggccgcacggagccgatcgaagtcggcgtaatgatcgaagtgccgtcggcggcgctgctcgccgatcaactggcgcaacacgcggatttcctctcgatcggcaccaacgatctgacgcaatacacgctcgcgatggaccgttgccaggccgacctggccgcgcaggcggacggcctgcatccggctgtgctgcgcctgatcgcggccaccgtgcaaggcgccggcaaacacggcaaatgggtcggcgtgtgcggcgcgctggcgggcgatccgcttgcaatgccgctgctcatcggcctcggcgtgaccgagttgtcggtcgatccggtttcggtgccgggcatcaaggcgcgggtgcgcaacctcgattatcagctgtgccgtcaacgcgcccaggatgccctggcgctcgaatcggcgcaggcggtaagagcagcaagccgcgaaacctggcctttg

SEQ ID NO: 28411 - DNA, 1607 bp, Burkholderia fungorum
atccatgtacgcgacctggtccgcagtttcggggccgtgcaggcggtgcgcggtgtcagcctcgatatcgagcgcggagaaatcttcggcctggtcggccccgacggcgcgggcaagaccaccatcatgcgcatgctggcgggcgtgctgcgaccggacgccggcgagatctcgctggaaaatatcgacgtgatagcgaagccggaactcgcgaaagcggcgctcagctatatgccccagcgtttcggcctgtacgaagatctgacggtcgccgagaacatttttttctacggcgaactgttcggggtgtcgcgcaaaaccaatcgaacccgcagcggcgaacttctcgaggccgccgggctcgtgccgttccgggatcgtctcgccgggcagttgtcgggcggcatgaagcagaaactcggcctggtttgcgcattgattcacaccccgcgcgtgctgctgctggatgagccgactaccggcgtggacccggtgtcgcggcgcgatttctgggcgattctgtacaacctgcgcgaaagcggcgtcaccatcgtgctgtccaccgcttatatggacgaagccgaacgctgctcgcggctcgcgctgctgcataccgggcaaatccgccagtgcgatacgccgtcacggctgaagcagaccatgccgggagccctgttcgcagtcgtcgcggcagacccgcgcgcggtacacgacgcactcgtggatgcgcccggcgtgctcagcgcattactgatgggcgaccgtgtgcacgtgcgcgtcgacgacgcggcgcgccgtctgccggagttgcaggcacggcttgccgcgcgctccattgcgaacgcaaccgtgagttccatcgagccgggcatcgaagatgttttcgtcgcgctcgtcgggtcgggaagcgcaacatgagcgccgcggctccggtcgtggaggcggtcggcctgaccaaacgattcggcgcgtttactgcggtcgacgggctcaacctgtccatcgcccaaggcgaggtcgtcggcttcatcggtccgaacggagcgggcaagtcgaccaccatccgcatgctgtgcgggctgctttcgcccagcgccgggcgcgcctgcgtggccggcttcgacgtcggcacccaggccgaggcgctacgctcgcatatcggctacatgtcgcagaagttctcgctatacggcgacctgacctgccgcgaaaacctgcgctttttctgcggcatctaccgggttccccggcgcgaaatcgccgagcgtatccagcttgccatttcgaccgcgggactcgaagggcgtgaagatacgctggtgcgcacgctcgcgggtggctggaagcaacggctcgcgctcggctgtgcgaatctgcaccacccgcccgtgctgtttctcgacgaaccgacctcaggcgtcgagcccgaggcgcgccgccggttctgggacctgattcacggcctcgccgcgggcggcgtgacagtactggtgtccacgcattacatggacgaggcggaatactgccaccgcatcgcgctgatcgatgcgggccatctggtggcaatcggcagccccagtgagctgcgcgaacagaatctcgggggc

SEQ ID NO: 28412 - DNA, 1718 bp, Burkholderia fungorum
atgacgccatcggaggcatttgtcgaaaccctggcggccaacggcgtgaccgatatgttcggcatcatgggctccgcattcatggacgcgatggacatttttgcgcccgccggcatccgcctgattccggtggtgcacgagcaaggcgccggtcacatggccgacggctactcgcgcgtgtcgggacgccacggcgtggtgatcggccagaacggcccgggcatcagcaactgcgtcacggcgatcgcggcggcctattgggcgcacagcccggtggtgatcgtcacgccggaagccggcacgatgggcatcggtctcggcggcttccaggaagccaaacaactgcccatgttccaggagttcaccaagtaccagggccatgtgacccatccggcgcgcatggcggaattcacgggccgctgcttcgaccgcgcaatggcggagatgggaccgacccagctcaatatcccgcgcgattacttctacggccaggtcaaagtggaaatcccgcagccgcagcgtctcgatcgcggcgcgggcggtgagcagcgcctgaacgaagcggccgagctgctcgcgcaagccagatttccggtgatcatttccggcggcggcgtggtgatggccgatgcgatcgaagagtgcaaggcgctcgccgaacgtctgaacgcgccggtcgtcaacagctacctgcacaacgattccttcccggccaatcatccgctgtggtgcggcccgctcggctatcaaggctcgaaggcggcaatgaagctgctctcgcgcgccgacgtcgtgatcgcgctcggctcgcgtctcggaccgttcggcacgctgccgcagcacggcctcgactactggccgaccaatgcgaagatcatccagatcgacgccgatcacaagatgctcggcctcgtgaagaaaatctcggtgggcatctgcggcgacgcgaaggccgccgctgtcgcactgaccgaacgcctcgccggacgcacgattgcaagcgacgccacgcgcgaggaacgcggcgctcagatcgctgccgaaaaagcggcgtgggagaaagagctcgacgagtggacgcacgaacgcgacgcctacagcctcgacatgatcgaggaacagaagcacgagcgcacgcccggcggcggcgcctatcttcatccgcgccaggtgctgcgcgaactggaaaaggccatgccggaagacgtgatggtgtcgaccgacatcggcaacatcaactcggtggccaacagctatctgcgcttcaacaagccgcgcagcttcttcgcggcgatgagctggggcaattgcggctacgcgtttccgaccatcatcggcgccaaggtcgcggcgccgcaccgtccggccgtttcgtatgcgggtgacggcgcatggggcatgagcctgatggaaaccatgacctgcgtgcgccacaacattccggtgacggcggtggtgttccataaccgccagtggggcgccgagaaaaagaaccaggtggacttctacaatcgccgcttcgtggcgggcgagcttgataaccagagcttcgcggccattgcgcgcgcgatgggcgccgagggcgtcgtggtggatcgcctggaagacgtcggccccgcgctcaagcgtgcgatcgacgcgcagatgaaccgcggcaagaccacgatcatcgagatcatgtgcacccgtgaactgggcgatccgttccgccgggacgc

SEQ ID NO: 28413 - DNA, 1329 bp, Burkholderia fungorum
ttgaaggcgggcctcaagcagcgccacatgacgatgatcgccctcggcggcgtgatcggcgcggggctcttcgtgggcagcggggtggtcgtgcagcaggccggccccgcggcggtgttgtcgtttctgattaccggcgcgctggtggtgctggttatgcggatgctcggcgaaatggcctgcgcgatgccggccgtcggctcgttctatgaatacgcgcggctcgcgttcggcggcaaacgcgcctgcggcaatctggccggctttctgaccggctggatgtactggtatttctgggtcatcgtcgtggcggtggaggccgtcgcgggggcgaaactggtgcagttctggttgcccgatgtccccgcgtgggcgatcagtctcgtattgctcgtgacgctcactgcaaccaacctggtctcggtcggcagttacggtgaattcgagttctggttcgcgtcgatcaaggtcgcggcgatcatggtgtttctgtttctcggcagcatgtacgtgctgggactgtggcccgcgtcgaagcacgtcacggaggtgctgccgacgctgttctcacacggcggcctgatgcccaaaggaatcggaccggtactgagcggcgcggtcgccgccacgggtttttacttcggagcggaaatcgtcaccattgcggcagccgaggcacaggagcccgcgaaggccgtcgccagggcgaccaactcggtgatcacgcgcgtgctggttttttacgtgggctcgatcctgctcgtcgtcgcgctcgtgccgtggaactcgccgaagatggcgacgccgtatgtgagcgcgctcgacgcaatgggtattcccgccgccgccagcgtcatgaacgccatcgtgctcaccgcggtgctgtcggcgctcaattcgggactctatgcggcgtcgcggatgatcttcgcgctgacccgccacggcgacgcgcccgccgcgctcgccagggtcaaccggcgtggcgtgccggtgcgcgcgattctgatcggcaccgtattcggctatgcgtcggtcgtaatgtcgtatgtctcgccggatacggtgttcgcgtttctcgtgaattcgtacggcacggtggcgattttcgtctatgtgctgattgcgatctcgcaactgaaactgcgggcccggatcgagcgggatgcgccgcagacacttcgggtgaggatgtggtgctatccgtacctcacgtgggtttccattatcggcatggtcggcattctggttgcgatggccttcattccggagcagcgccagccgctatggttcggggtcgcgagtctgggcgtgctgctgctcgcctat

SEQ ID NO: 28414 - DNA, 1557 bp, Burkholderia fungorum
atcggcgtggacgtcggcacgggcagtgcccgcgccggcctgttcgacctggccggccacatggtggcgtccgcaaagcgtgacatcacgctgttccacgcgagcggttccattgtcgagcagtcgagcggcgaaatctggatcgccgtctgcgatgccgtcaaagacgcgctgtcacaggccgcggtgtcgccggatcaggtcgccggcatcggcttcgacgccacctgttcgctcgtcgtgctgggcgcgggcggccggccattgccggtgggtccgtcggagcaggcggagcgcgacatcatcgtctggatggatcaccgcgccgtggcgcaggcggagcgcatcaacgcgacgggtcacgaggtgctgaactatgtcggcggcaagatctcgccggaaatggagacgccgaagctgctgtggcttctcgagaacaggccggccgtcttcgcggcggcacggcaattcttcgatctgaccgacttcctgacctggcgcgcaaccggcgacctgtcccgatcgacctgcacggtcacctgcaagtggacctatctcgcgcacgagcggcgctgggacgagagctactttcgcagcgtcggccttggtgtgctggccgacgaagccttcgcgcgcatcggtcaaacggtcgtcgatccgggtacgccgctcggaagcggactgaccgcggacgccgccgcgcagctcggcctgcgcaccggcacgccggtcgccacgggcgtgatcgacgcccatgccggcggcatcggcacggtcggcgccgatggcgatcccgaggcctgcctcgcctacgtgttcggcacctcgtcgtgcacgatgaccacgacccgcagtccggtcttcgtgcccggcgtgtggggaccgtacttttcggcgatggtgccggatgcgtggctcaacgagggtggtcaatcggtagcgggcgcggcgatcgaacggctgctcgcgatgcatcccgcggccgccgacgcaaagcgccgcgcggaacacgaaggccagtcgttgccggcaatgctcgccgccctcgccgtgcaggcggcggacagtctgtcggaagcggcagtgctcgccgacggtctgcatgtggtcccggagtttctgggcaatcgtgctccgctggccgacccgcacgcccgagccgtgattgcgggtctcggcatggaagacgatctggacagcctggtcgcgctctacattgccggcatttgcagtgtcggttacgggcttcggcagatcatcgaagcgcaggcgaacgccggtgcgccgatcgcgcgggtggtgatcagcggcggcgcgggacggctcgatctggttcggcaactgctcgcggatgcgacgggcaagcccgtgctcgccacccaggcggaagaaccggtgctgctcggtgccgcgatgctgggaagcgtggccggcggccagttcggcgacgtgcgctcggcaatggccagaatgtcgcagatcagcaaaacctaccaaccggacaccggcaagatcgcggggctgcacgaggcacggtatcgcgccttcctgaagttg

SEQ ID NO: 28415 - DNA, 1299 bp, Burkholderia fungorum
gatctgtcgtctttctggatgccgtttaccgccaaccgccagttcaaggccgcgccgcgcctgctggaatcggccaagggcatgtattaccgcagcacggacgggcgtgaagtgctcgacggctgcgcgggtctgtggtgcgtgaacgccggccacggccgcgaggaaatcatcgccgcgattacccagcagctctccacgctcgacttcgcgccgaccttccagatgggccacccgctcgccttcgaagccgccacgaaagtcgccgaactgatgccggaaggcctcgaccgcatcttcttcacgaactcgggctcggaatcggtcgacaccgccctgaaaatcgccctggcatatcaccgttcgcgcggcgaaggccagcgtacccgcctgatcggccgcgagcgcggctatcacggcgtgggcttcggcggcatctccgtcggcggcatcgcgccgaaccgcaaaaccttttcgggcgcgctgctgccggcggtcgatcatctgccgcacacgcataacctcgaacagaacgcgttttcgaaaggccagccggcgtggggtgcacacctggccgaggaactcgagcgcattgtcacgctgcacgatgcctcgaccatcgcggcggtgatcgtcgaaccggtggccggctcgacgggcgtgctgattcccccgcaaggctatttgcaaaagctgcgcgagatctgcacgaagcacggcatcctgctgattttcgacgaagtgattaccggtttcggccgcgtcggcaaggccacggcaagcgagtacttcggcgtgacgccggatctgatcacgatggcaaaggcgatcaacaatgccgcgattccgatgggcgcggtggccgcaagccgcacggtccacgacacgatcgtgaacagcggcgcgcaaggcgcaatcgagctgttccacggctacacgtattcggctcacccggccgcgacggcagccgcgattgccacgctcgacctgtatcgccgcgagggtctgttcgaacgcgccgccacgctcgcgccgacgttcgaagctgcggcccattcgctgcgcggcgcgaagcacgtgaaggatgtgcgcaatatcggcctgatcgccggcgtggaactcgaatcgcgcgacggcgcgccgggcgcgcgggcatacgaagcgttcgtcaaatgcttcgaagcgggcgtgctggtgcgcttcacgggcgacattctcgcgttctcgccgccgctcatcatcaacgaagagcagatcgcgcacatcttcaagaccgtgggcgacgtgctggctacggtg

SEQ ID NO: 28416 - DNA, 549 bp, Burkholderia fungorum
agccgcgaggaagccgaagcagctgttcgcgtgctgctgcgctgggccggcgacgatccggcgcgtgaaggcctgatcgacacgccggcgcgcgtggtgcgctcgtacgaggagttttatgccggctaccaggtcgacccgcgcgagatccttgcccgcaccttctccgaagtggacggctacgacgagatgatcgtgctgaaagacatccgcttcgaaagctattgcgaacatcacatggtgccgatcatcgggcgcgcgcacgtggcgtatctgccggagcatcgcgtggtgggcatctccaagctggcgcgtctcgtggatgcattcgccaagcgcctgcagatccaggaaaagatgacggtgcagatcgccgacaccttgaacgaagtgctgcaaccggcgggcgtcggcgtgattctcgaagccgcgcatcaatgcatgtcgacacgcggcgtgcacaaggcaggcgtgacgatggtcacctcgcgcatgctcggcacgttccgcacggatccgtccacgcgtcgcgagtttctgtcgatcgtc

SEQ ID NO: 28417 - DNA, 2028 bp, Burkholderia fungorum
gccctcgaccagctgtgtatcaacacgatccgcacgctgtcgatggacgctgtgcaaaaggccaattccggtcaccccggtacgccgatggcactggcacccgttgcctatcacctgtggcaaaaccatctgcgctacgaccccgacgagccgctctggcctgatcgcgaccgcttcgtcttatccgtgggacacgcgtcgatgctgctgtattcgctgttgcaccttgcaaacgtgaaagccgtggacgacgacggcaacccgaccgacggacccgcagtttcgctcgacgatatcgaacatttccgccagatgggcagcaagacaccgggccacccggagtaccgcatgaccaccggcgtcgagaccaccacgggcccgcttgggcaagggctcggcaatagcgttggcatggcgatggcggcgcgctggtacgagagccatttcaacaagcccgatgcgccgctgttcgactatcgggtctacgcgttgtgcggcgacggcgacatgatggaaggcatctcgcacgaggcggcttcgctcgccggccacctgaagctgtccaatctgatctggatctacgacagcaaccgcgtgacgattgaaggccacaccgacctcgcttatagcgacgacgtggaaacccgctttcgcgggtacaactggcacacgctgcatgtgagcgatgcaaacgacgccgccgcgctggaagcggcattcgtcgaagcgaaaagcattaccgacaggccgacgctgatcgtggtgcacagcatcatcggctggggggcgccgcataagcaggacacctcggcggcgcacggcgagccgctcggcgtagaagaagtggcgctcgccaagaaagcgtacggctggcccgaggataaattcttctatgtgccggacggtgtgcacgaacgcttcgcggcgggcatcggcgcgcgcggcaaggcggcgcgcgaggaatggcaggcgaagtacgacgcctacagcagaaagtaccccgaactcgcgcgtgaattcgcgcagatcgaagcgcacgaattgccggccggttgggacagcgacattcccaccttcgacgcggacccgaaaggcgttgcgtcacgcgaatcgtcgggcaaggtgctcaatgcgattgccgcgcgcgttccgtggatgatcggcggcgcggccgacctttcgccgtccaccaaaacgaatctgaaattcgagggcgcgggcagcttcgaatacgacaactacggcggctgcaatctgcatttcggcattcgcgaacacgcaatgggcgcggcggtgaatggcctcgcgctgtcgaatctgcggccgttcggctcgaccttcctgattttcagcgactatatgaagccgccgatccgcctctcggcgatcatggaagtgccggccatctacgtgttcacgcacgattcgatcggcgtcggcgaagacggtccgacccatcagccaatcgagcagctggcctcgctgcgcggcgtgccggggctgaccgtgctgcgtccgggcgacgccaacgaagtggccgaggcgtggcgcgtggcgcttgccgatccgcggcggccgtcgtgcatcgtggtgtcgcgccagccgttgcccacgctggaccgcagccgctatgcggccgcgaagggcacgcagaagggcgcctatgtgctcgccgatgcagccgacgggcaaaagccgcaggtgatcctgatagccacgggcagcgaactctcggtctgcgtcgacgtgtatgagaagctcacgagcgaaggtattgcggcgcgcgtggtgtcgatgccgtcgtgggatatcttcgagcgccaggacgaggcctatcaggactcggtgctgccaccggatgtggacgcgcgcgtggcggtcgagcaggcggcctcgcttggctgggaccgttatgtggggcgtctcggcgcgcaggtggtgatgcatacgttcggcgcgtccgcgccgcttgccgaactgaagaagaagttcggcttcacgccggagcatgtgtacgaagcggcaaag

SEQ ID NO: 28418 - DNA, 852 bp, Burkholderia fungorum
atgagcgacacgcagcgtcccacaccgccgtttccgaagcagcagcaaaatcacacgcctgggcacacggcagaaatgcaacctcaacccgatcacggcgagcgctcctatcgaggctcgggacggctcgcgggcaaagcggcgatcgtcacgggcggagatagcggaattggccgcgccgttgccattgcgttcgctcgcgaaggcgcggacgtgctgatttcgtatcttgacgaggacgacgacgcgcgcgagaccgcgcgctggatcgaggaggccggccgcaaggctgtcctgctgcctggcgatatcacgaaccccgcgcactgcaaggcgatcgtcgaaagagctatcgaggcgttcggccggctcgacgtgctggtcaacaatgccgcctatcagatgagctatccctcgctcgacgcgatcagcgaccaggagtgggacaagactttcgatacgaacattggcgcgatgttcaggatcacccgggccgcggtcaagcatatgaaaccaggcgccgcgatcgtgaacacgacgtcgatcaatgcggatcatccgaatcccggtctgattgcctacgcggcgaccaagggtgcgattcagaacttcaccggtggccttgcgcagttgctcgcggagaaaggtatccgtgcgaactgcgtggcgccggggccgatctggacgccgctgattccgtccaccatgccgccggagaaagtcgagcaattcggcgcccaggtgccgatgaagcgccccggccagcccgccgaactggcggctgcctacgtgatgctggcatccgacgaagccagctatatttccggcgcgaccatagcggtcacgggcggc

SEQ ID NO: 28419 - DNA, 2226 bp, Burkholderia fungorum
atcgcggaaggcacgccttttccgctcggcgcgacatggaacggaagcggcgtcaacttcgcgctattctcggcgcacgctaccaaggtcgaactgtgtctgttcgatgaaaccggtgaaaacgaaatcgaacgcatcgaactgccggaatacaccgacgaggtgtggcacgtgttcgtgccgaatctcaaaccgggcgcggtctacgggtatcgcgtgcacggaccttacgagccggagaaagggcaccgcttcaatccgaacaagcttctgctcgacccgtatgcaaaagcgcacatcggcgagctcaaatgggcgccggagattttcggctatacgctggattccgaagagggcgacctgtctttcgatgaacgcgacagcgcgcccttcgtgccgaaatgcaaggtggtcgatgccaatttctcgtggagtcaccccgagcgcaatgcattgccgtgggaacgcgtgattttttatgaagcccatgtgcgcggatttaccaaacggcatccggaagtaccggaaaatctgcgcggcaccttcgccggactggggcagcaggtcgtgctcgactacatcaagaaccttggcgtgacctcggtggaattgatgccgatccagaccttcgtcaacgacagttatctgctcgataaaggactcacgaactactggggctacaacaccatcggttttttcgcggccgatccgcgtttcttcgcgtcgtcgatcgattcggtgggcgagttcaaggagatggtggaccgctttcacaacgccaatctcgaagtcattctcgacgtggtctacaaccatacggccgaaggcaacgagcgcgggccgaccatctcgttcaaaggtatcgacaacgcgtcgtactaccggctgatgcctgacgagccgcgctactacatcaacgacaccggcaccggcaacacgctgaacctgtcgcatccgcgcgtattgcagatggtgaccgacagcctgcgctactgggtgacggaaatgaaagtggacggtttccgtttcgacctcgccacgattctcggccgcgaactgcacggtttcgacgaaggaggcggttttctcgacagttgccggcaggaccccgtgctgtccagcgtgcggctggtggccgagccgtgggattgcggtcccggcggttatcaggtgggcggctttccgcccggctgggcggagtggaacgaccgctttcgcgataccgtgcgcgaatactggaagggcgacgaaggcaaggtcccggatctcgccacgcgtctcaccggttcgggcgacaagttcaaccatcgcggccgccgcccgtgggccagcgtgaacttcatcgccgcgcacgacggcttcacgctcaacgatctggtttcgtacaacgacaaacacaacgaagccaacggcgaggacaacaaggacggccattccgacaacaaatcctggaacatgggcgtggaaggcccgaccgacgatccggacattcgtcagcaacgcgagcgacagaagcgcaatctgctcgccacgctgctgttgtcgcaaggcacgccgatgattctcgcgggcgacgaattcggccgcacgcagaagggcaacaacaacgcctattgtcaggacaacgagatcagctgggtcgattgggaagcgatcgacgacgacggccgcgcgctgatcgagttcgtcaggaatctgaccacgctgcgccaccgtctgccggtgctgcggcgcggccgctttctgaccggcgaatacaacgaggcgctggacgtgaccgacgcgcgctggatctcgccggacggcaaggatctctcgcaggagcaatgggacgatgcgtccatgcgctgctttggtctcgtgatcgacggccgcgcgcaggcgagcggcattcgccgtccggcttcggacgcgactttgctgctggtgctgaatgcgcatcacgacgtcgtcaatttcacgctgcccgacattcccgaaggccagcgctggacctgcctgctcgacaccaacatgccggtgcgctccgagttgcctcacttcgcggccggcgacgcgtatcaggtgaccgcccgctcgctgctgctgcttgcgctggaagcgccgagccgcgccacgcagcgcgtgttcgaccgcctcgaagaacagctgaccaccgaggatagcgaaccgcccgcgcaagcttgacggaccggcacgaaaaccgtcgtcaagcaggcgctgccg

SEQ ID NO: 28420 - DNA, 984 bp, Burkholderia fungorum
gagctgcaagccaccatcaaggcaatggttcaacccggcaagggtcttctcgccgccgacgaaagcggcccgaccatcgccaaacgcttcaagacgatcggcctcgaatcgagcgaggaaaaccgccgcgcctatcgcaacctgctgctcaccacgcccggactcggcgaattcgtgagcggcgtgattctctacgaagaaacgctgggccagaaagcggacgacggcacgccgttcccgcagctcgccgcgaaaaacggcatcgtgcccggcatcaaggtggatctcggcaagattgcgctcgcgctcgcgccgggcgacgagatcaccgaaggtctcgacggactcgcccgccgtttcgtcgattacaagcggcaaggcgcgcgcttcgccaaatggcgcgcggtctacaacatcacggcgagcctgccgagccgtctcgcgatcgaggcgaatgccgattcactcgcgcgctacgccgcgatctcacaggaagcgggcatcgtgccgatcgtcgaacccgaagtgctgatggacggcgagcacaccatcgagcgcagcgccgaggtcaccgaggccgtgctccacgcggtgttccatgcgctgcaccggcatcgcgtcgtgctcgaacatattctgctgaagccgagcatggtgatcgccggctccgaacacgcgcagcagtcgtcgactgccgacattgccgcttataccgtgcgggtgctcaagcgcacggtgccctcggcggtgccgggcatcgtgtttctgtccggcggccaatcgcctgaagaggcgaccgcgaatctcgacgccatgaaccgtctcggcgcgttgccgtggaatctgagcttttcatatggacgcgcgttgcaggaaccgccgctgcaagcatggaaaggcgagcggagccacgtcgagcaggcccagcaggcgctgctcaagcgggcgcgtctgaatagcgccgcggcactgggcaagtacgag

SEQ ID NO: 28421 - DNA, 1011 bp, Burkholderia fungorum
atgcagctaggcatgattggattgggacgcatgggcgccgacatggtgcggcgtctgacgaagggcggtcagcaatgtatcgcgtacgacgtgcagccggcggcggtggagaagctgaagcaggacggtgtcgcgggcgcggcgtcgctggaagatctggtcgcgcaactcgacaagccgcgcgccgtgtggctgatggtgccggcggcggtggtcgatatgacgctggagaaactcgtgcccctgctggagcccggcgatatcgtgatcgacggcggcaattcctactatcacgacgacatccgccgcggcgccgagctggcgaagcgtcagcttcactatgtggacgtcggcacgagcggcggcgtggcgggccgcgagcgcggctactgtctgatgatcggcggcgagccggaggtcgtgaagcggctcgaaccggtcttctcgacgctcgcgccgggcgccggcaccgcgccggccacgccggggcgcgtcagcggcagcagcaccgcggatcagggcttcctgcactgcgggccgctgggcgcggggcacttcgtcaagatggttcacaacggtatcgagtacggcatgatggccgcgtatgccgaagggctgaacattctgcgccacgccaacgccggtaagcacgcgcgcgaggccgacgccgagacaacgccgctgcgccgccccgagttgtaccagtacgagctgaatctcgccgacgtcaccgaggtctggcggcgcggcagcgtaatcggatcgtggctgctcgatctgattgccggttcgctcgtcagcgacgccgatctgaagaactacgcggggcgcgtatccgattcgggcgaggggcgctggaccgtggccgccgccatcgacgaaggcgtgcccacgccggtgctgagcgccgcgctgttcgcccgcttcagttcgcgcggcgaagcggattttgcgaaccgggtgctctcggccatgcggcacgatttcggcggccacgtcgaaaaagcggcc

SEQ ID NO: 28422 - DNA, 456 bp, Burkholderia fungorum
atcgatccggagctgctcgaactcgcgcagcaggttttcgacctcgcgcggcgcggcgatgccgccatgctcgcggcggtcatagaaaaaggcgtgccgccgaatctgcgcaacgacaagggcgacagtctcgtcatgctggccagctaccacggccacgtggacgccgtgcgcacactgctcgaacgcggcgccgatcctgatctgcgcaacgacaacggacagacgccgattgcaggtgcggccttcaagggcttcgatagcgtgatcgaaaccttgctggcgcatggtgcggatgtggaaggcgcgtcgccggacgggcgcaccgcgttgatgatcgccgccatgttcaatcgcacggcgatcatggaactgctgatcgcgcacggcgcgaacccgaaggcccgcgatgcgaacggcgtgacagcaatggatgcagccggccgcatgggcgcc

SEQ ID NO: 28423 - DNA, 1953 bp, Burkholderia fungorum
tcggttcttcaggaacgccgtgttttcccgccctccgctgaaacagtagcggccgcgacgatctccggcatggacgcgtaccgggcgctcgccgccgaagcggaacgcgattacgaaggtttctgggggcgcctcgctcgcgagacgctaagctggaatacgcccttcaccaaggtactcgacgaatcgaaggcgccgttctacacgtggttcgaagacggccggctgaacgcgtcgtataacagcatcgaccgtcacgtcgaagccggcaacggcgcgcgcgtcgcgatcattttcgaagccgacgacggcaccgtcaccaacgtcacctaccaggatctgctgcaacgcgtgtcgcgctttgcgaacgcgttgaagaagcgcggcgtgaaaaagggcgaccgcgtggtgatctatatgccaatgtcgatcgaaggcattgtcgcgatgcaggcttgcgcgcggatcggcgccacgcactcggtcgtgttcggcggcttctcgtcgaagtcgctcaacgagcggctggtggacgtgggcgcggtcgcgctcatcacgtcggacgaacagatgcgcggcggcaaggcgctgccgctgaagaacatcgccgacgaagcgctcgcgatgggcggctgcgaagcggtcaggagcgtgattgtgttccagcgcaccggcggcaagatcgcctggaacgcagaccgcgatctgtggatgcacgaactcacgcaggccgaaccggatcaatgcgcgccggagtgggtcggcgccgagcatcctctgttcattctgtacacgtccgggtcgaccggcaagccgaagggcgtgcagcacagtaccggcggctatctgctgtgggccgcgcagaccatgaagtggaccttcgactggaagcccaccgacgtgttctggtgtaccgccgacatcggctggatcaccggccatagctacatcacgtatggtccgctgacgctcggcggcacccaggtcgtgttcgaaggcgtgccgacctatccgaacgccggccgcttctgggacatgatcgcgcggcacaaggtgtcgctgttctataccgcgcccactgcgatccgctcgctgatcaaggccgccgacgcggacgcgaaggtgcatccgaagagctacgacctgtccacgctgcgcatcatcggcacggtcggcgagccgatcaatccggaagcgtgggtctggtattacgagaacgtcggcggcagccattgcccgatcgtcgatacgtggtggcagaccgaaaccggcggtcacatgatcacgccgctgccgggcgccacgccgctcgtgccgggttcgtgcacgttgccgctgccgggcatcatggcggcggtggtcgatgaaaccggccaggacgtgccgaacgggcagggcggcattctggtggtgaagcgcccgtggccgtccatgctgcgcaacgtgtggggcgatccggaccgctacaggaagagctactttcccgaagaactcggcggcaagctgtatctcgccggcgacggcgcggtgcgcgacaaggagaccggctacttcacgatcatgggccgtatcgacgacgtgctcaacgtgtcgggccaccgcctcggcacgatggagatcgagtcggcgctggtgtcgaacccgctggttgccgaagcggccgtggtggggcgccccgatgcgaccaccggcgaagccgtgtgcgcgttcgtggtgctcaagcgttcgcgtccggaaggcgaggaagcggtgaagctcgccaacgaactgcgcaactgggtcggcaaggagatcggtccgattgccaagccgaaggacatccgtttcggcgaaaatctgcccaagacgcgttcgggcaagatcatgcgccgcctgctgcgctcgctggcgaaaggcgaggaaatcacccaggacgtgtccacgctggagaaccccgcgattctcgaccagctc

SEQ ID NO: 28424 - DNA, 1248 bp, Burkholderia fungorum
ttgcgcggccgggtggtggaagcgcgcggcgtgatcgcacgggtggtgggcgtgtcgttgcggatcggagagaaggtgcgcctcgtgcggccggatacgctcgaagcgcaatacggggaagtggtcggctttacacacgatggcgcgctggtcatgccgcttgccggcctgaacggcctgtcggatatcaccgaggtgcaaggctgcggctcggcgtggggcacgttcgacgcggcggggctgctcggccgcgtggtcgacggtctcggcaatccgctcgacggcggtccggtgccacggccgctcgcgagcgcggcggcgcaagccggggaggggacgctcaatccgctggagcgcccggttatcgcgacgccgttcgccaccggcgtgcgcgcgatcgatggcctgctgacttgcggcgtgggtcagcgcaccggcatcttcgcgcccgccggcggcggcaagagcacgatcatgggcatgatcgcgaacggcgcatccaccgatgcgatcgtggtcgccctgatcggcgaacgcggccgcgaagtggcggaattcattcacgaccacctcgaacgacggcgcgcgtcgacgatcgtgatcgcggcgacgtccgatcgccccgcggcggaacggatcaaggcggcggaacttgcgtcgcaggtcgccgtggggctgcgcgcgagcgggcgtaacgtcctgctgctattcgactcgctcacacgctatgcgcgcgcgctgcgcgagctcgggctggcggtcggcgaaccgccgctgcgaggcggctttccgcccagcgtgtttgcgcagttgccgcgtctgatcgaagcggccggggtgacggcgcagggcagcatcaccgcgttttacaccgtgctcgccgacgaagccgatctgtccgatccggttgccgaggaagcgcgctcgctgctcgacgggcatatccagctgtcgtcgaaactgggcgcggcggggcactatcccgccatcgatattctgcgcagccgaagccggttgatgacgcgcgtcgcggctgccgtgcatcaggcggacgcgaaccgcgtgcgcgactggctcgcgcgttatgaggatgtcgaactattgctgcagatcggtgaataccagcgtggtaacgatgcggacacggaccaggctattgaccggcgtgcggcgatcgtgagctttctgcgccagcggtacgacacgcgttgcggctgggacgacacgcgcaggcagttgcatgcgttg

SEQ ID NO: 28425 - DNA, 1194 bp, Burkholderia fungorum
atgtctctgttctccgccgtcgaacttgctccccgcgacccgattctgggcctgaacgaagccttcaatgccgatacgcgcaccaccaaggtcaaccttggcgtcggcgtgtacttcaatgaagaaggcaagattccgttgctgcgcgccgtgcgcgacgcagaaaaggcccgcgtcgatgccgcgctgccgcgcggctacctgccgatcgaaggcatcgccgcttacgatgccgctgtgcagaagctgctgctcggcaacgactcgccgctgatcgcggcgggccgcgtcgtgacggcgcaggcgctgggcggcacgggcgcgctgaaaattggcgcggacttcctgaagcgcctgaacccgaacgccaaggtcgcgatcagcgatccgagctgggaaaaccaccgcgcattgttcgaaggcgcaggtttcgaagtcgtgtcgtacccgtactacgacgcgcacacccacggcgtgaatttcgacgccatgctgagcgcgctgaacagctatgccgccggcacgatcgtcgtgctgcacgcgtgctgccacaacccgaccggcgtggacctcaacatcgagcaatggaagcaggttgtcgaagtggtcaaggcgcgcaatctggtgccgttcctcgacatcgcctaccagggtttcggcgacaacatcgaagcagacgcagcggccgtccgtctgttcgccgcggcggaactgaacgtgttcgtgtcgtcgtcgttctcgaagtcgttctcgctgtacggcgagcgcgtcggcgcgctgtcgatcatcacggcaagcaaggaagaagccgctcgcgtgctgtcgcaactcaagcgcgtgatccgcacgaactattcgaacccgccgacgcacggcggctcggtggtcgcggccgtgctcgcgtcgccggagctgcgcgccacgtgggaaacggaactggccgaaatgcgcgatcgcatccgcgccatgcgcaatggtctggtcgaacgcctgaaggcgagcggcgtggatcgcgacttcagcttcgtgaacgcgcagcgcggcatgttctcgtactcgggtctgacggcgccgcaggtggaccgtctgcgcgaagaattcggcatctacgccgtgagcacgggtcgcatctgcgtggccgcgctgaatacgcgcaacctcgacgcggtggccaacgcgatcgctcacgtattg

SEQ ID NO: 28426 - DNA, 765 bp, Burkholderia fungorum
aaagtcgcggtggttaccggcgccgcaagcggcatcggcaagcagattgcgctgaccctttccgcggcgggcgcagcggttgcgatcgccgacctgaaccaggacggggcgaatgccgttgctgaggaaatcagaaagggcggcggcaaggcaatcggtgtggcgatggacgtcacgaatgaagacgccgtcaaccagggcatcgacaaggtcgccgcggaactcggctcggttgacattcttatttccaacgccggcatccagatcgtcaatccgatcgaaaactattcgttttcagactggaagaagatgcaggcgatccatgtggacggcgccttcctgaccaccaaggcagcgctcaagcacatgtacaaagacgatcgcggcggcatcgtgatctacatgggttcggtccattcgcatgaagcgtcgccgctcaaatcggcttatgtgacggcaaagcatgcgctgcttggcctctcgcgcgtgctcgccaaagaaggcgcaaagcacaacgtgcgctcgcacgtggtgtgtccgggtttcgtacgtacgccgctcgtcgacaagcagattcccgagcaggccaaggaactcggcatcagcgaggaagatgtggtgaagcgcgtcatgctgggcggtacggtcgacggtgtcttcaccacggtggaagacgtcgcgcagacggtgctgttcctgtccaccttcccgacggcggcgctcaccgggcagtcctttattgtgagccacggctggtatatgcaa

SEQ ID NO: 28427 - DNA, 1242 bp, Burkholderia fungorum
cacaaagtgctgtacgtccaggtgatcgtggcgatcatcatcggtatcgggctcgggcatttctacccggatctcgccgtcgacatgaagccgctcggcgacggcttcatcaagctgatcaagatggtgatcgggccgatcattttctgtacagtggtgacaggtattgccggcatggaggatatgaagaaagtcggccgggtgggcggcaaggcgctgctgtatttcgaaatcgtctcgaccttcgcactggtgctcggccttatcgccacgcatgtactgaagccgggcgtcggcttcaacatcgatccggccacgctcgacggcaaggccgtcgcctcgtacgccgcgaaagcgcacgggcagaccacggtcgacttcctgatgcacatcattccggatacgctcgtctcggcgttcgcgcagggcgagatcctgcagatcctgctgatcgcgctgctgttcggcgcggtgctcgccacggccggtgagaagggcaaggtcgtgacgggctttatcgacgggctctcgcatgtgctgttcggcatcgtgcgcatcatcaccaagctggcgccgatcggcgcgttcggtgcgatggccttcacgatcggcaagtacggtatcggctcgctgttgccgatgctcaagctgatcggcacgttctatctgacctcggtcgtgttcgtggtggtggtgctcggcatcatcgcgcgtgcggtgggcttcaacatcctgcgcttcgttgcgtacatcaaggaagagatgctgatcgtgctcggcacgagctcgtccgaagcggcgctcccgcaactgatgctgaagctcgaacggctcggctgctcgcgttcggtggtgggcctcgtggtgccgaccggttactcgttcaatctcgacggcaccaacatctatatgacgatggccgtgctgttcatcgcgcaggcgaccaacaccgacctgacatggacgcagcagctcacgctgctcgcggtcaccatgctgacctcgaagggcgcgagcggcgtgacgggcgcgggcttcatcacgctggcggcgacgcttgccgtggtgccgaccattccgctgtcgggcatggtgctgattctgggtatcgaccgcttcatgagcgaatgccgcgcgctgaccaacattgtcggcaacggtgtggcgacggtggtcgtgtcggcgtgggaaaaggaactggaccgcagcaagctgaacgccgccttgcgcggcgacgtggcg

SEQ ID NO: 28428 - DNA, 1161 bp, Burkholderia fungorum
atcgtcatcgtgggcgtggcccgcacgccgatggcggcattccagggcgacttcgccacgctgagcgcgccgcaattgggttcggtggcaatccaggcggccgtgcagcgcgccggccttaaacccgaacagatcgacgaagtggtgatgggttgcgtgctgcccgccggcctcggccaggcgcccgcgcgtcaggccgcgctcggcgccggcttgccgctcgccaccggcagcaccacggtgaacaagatgtgcggctcaggcatgcgcgcggccatgttcgcgcacgacatgctcgccgcgggttccgtcgacgtgatcgttgcgggcggcatggaaagcatgacgaacgcgccgtatctgctgcccaaagcgcgggcgggaatgcgcatgggccacggtcaggtgatcgaccacatgttctacgacggtctcgaagacgcctatgaaaaaggccgtctgatgggctccttcgccgaggaatgcgcggcttcgttcgacttcacgcgcgaggcgcaggacgcgttcgccgtcgagtcgctcgctcgtgctaagcgtgcgaacgaggacggttcgttcgcctgggaaatcgcgccggtgaaagtggagagccgcaagggcgaagtcaccatcgatcgcgacgaacagccgttcaaagcgaacatcgagaagattccgacgctcaagcccgcgttcagcaaaaccggcaccgtgacggcggcgaactcgtcgtcgatttccgacggcgcggccgcgctcgtcatgatgcgcgagtcgacggcgaagcgcctgggcgtccagccgattgcgcgcgtggtcggccactcgaccctcgcgcaggaaccggcgaagttcaccaccgcgccggtcggcgcgattcgcaagctgttcgagaagaacggctggcgcgccgacgaagtcgatctgtttgaagtcaacgaagcctttgctgtcgtgacgatggccgccatgaaggagcaccatctgccgcacgagaaggtcaacgtgaacggcggcgcctgtgcgctcggccacccgatcggcgcgtcgggcgcgcgcattctcgtcacgctgatcggcgcgctgaaaaagcgcggcggcaagcgcggcgtcgcgacgctgtgtatcggcggcggcgaagcgacggcaatgggtatcgaa

SEQ ID NO: 28429 - DNA, 990 bp, Burkholderia fungorum
cgtaccactctcacgaagtacctgatcgagcagcagcgcgagaccaacaatctgccggccgatctgcgccttttgatcgaagtcgtcgcgcgtgcgtgcaaggcgatcagctaccacgtcagcaagggcgcgctgggcgacgcgctcggcacggcgggcagcgagaacgttcaaggcgaagtgcagaagaagctcgacatcctgtcgaacgaaatcctgctcgaagcgaatgaatggggtggcaacctcgcgggcatggcgtccgaggaaatggaacagttcttcccgatcccggcgaactatccgaagggcgaatacctgctcgtgttcgatccgctcgacggctcgtcgaacatcgacgtcaatgtttcgatcggcacgatcttctcggtgttgcgctgcccggacggccagcagcctaccgaacagtcattcctgcaaccgggcacgcagcaggttgccgcgggttatgcggtatatggtccgcaaaccgtgctggtgctgaccaccggcaacggtgtgaactgcttcacgctcgaccgcgaactcggctcgtgggtgctcacgcagagcgacatgcgcattcctgtcgaaacgcgtgaatatgcgatcaacgcttcgaacgaacgtcactggtatccgcctgttcagcaatacatcggcgagttgaaggacggcaaggaaggttcgcgccaaagcgacttcaacatgcgctggatcgcgtcgatggtggcggacgtgcaccgcattctgaatcgcggcggcatcttcatgtatccggccgacaagcgcacgccggacaaaccgggcaagctgcgcctgatgtacgaagccaatccgatggcctttattgtcgagcaggcaggcggtgccgcgaccaatggcgagaagcgcattctggacatccagccgaaaagcctgcatgaacgcgtggcggtattcctcggttcgaagaacgaggtcgaccgggttacccgctaccatctcgaa

SEQ ID NO: 28430 - DNA, 1518 bp, Burkholderia fungorum
gtggtaataggcgggcgcaagctgacgatcgaagaggtcgtcgcgattgcgcggcaccgcgcgccggtcgccttgagcgccgatccggcatggcgcgcgcgcatccagcgcggcgcggattttctgcgccggcatctggccgcgggcgcgaccgtgtacggcgtcaacaccggttacggcgatgcctgcgtggtcgacgtgccgatggaactggtcgaagcactgccgctgcaactcacgcgctatcacggctgcggcatgggccagtatctcgacgaagcgcaaacgctcgcggtgatcgccgcgcggctcaactcgctcgcatacggtttttcgggcgtgcgtccggtgttgctcgaacgtctcgccgatctggtcaatcatcgcgtgttgccgcgcattccgtcggaaggctcggtcggcgcgagcggcgatctcacgccgctttcgtatgtggccgccgcgctcgccggtgagcgcgacgtaatgttcgaagggcagttgcgcaacgtgcgcgaggtgtggaccgaactcggtcaaacgccgctcacgctcgcgccgaaagaagggcttgcgctgatgaacggcaccgccgtgatgacgggtctcgcctgtctcgcgtttgcgcgcgccgatcatctcacgcggctcaccgcgcgcctgacggcgctgtgcacggtcgcgctcgacggccgtgccgcgcatttcgacgcaatgctgttcgaggtgaagccgcacgccggccaggccgaagcggcggcatggatccgcgacgacctggccgggcgcgacgacacgccgggccaccgtttgcaggaccgctattcgattcgctgcgcgccgcacgtgatcggcgtggcgcgcgacgcgctttcgtgggtacgccgcgacatcgagaacgaactgaacagcgcgaacgacaacccgctgatcgatccggacaacgaacgcgtgctgcacggcggcaacttctacggcggtcatatcgctttcgcgatggactcgctgaaggtcgcggtcgccaacctcgccgatctgatggaccggcaactggcgcttctcgtcgacgtcaatttcaataacggcttgccgcgcaatctgtcgggcgctacgtccgcgcgcgccgcgatcaatcacgggttcaaggcggtgcagatttcctcatccgcatggaccgccgaagcattgaagaacaccatgcccgccagcgttttctcgcgctccaccgaggcgcacaaccaggacaaggtcagcatgggcacgatcgccgcgcgcgactgcctgcgcgtgctggaactgaccgaacaggtggcggcagcgcatacgctcgcaaccgtgcaagctgcccgtctgcgattgaagatcgatagcggaacaccggttcccgcgccgctgcgaacgttcatggagagcgtgagcgcgcagtcgccgttcgtggacgaagaccgcgcgctcgaacacgaactgcgcgccctgaccgcgcgcattgccgcgtgcgatctgctgcgggactatcgc

SEQ ID NO: 28431 - DNA, 1164 bp, Burkholderia fungorum
gtttatttgcacgcgctcggcatgatcaacgcgctcggcggcgacctcgacagcattgtcccggcgcttgccgccggccgttcgccgggtatggcgaacgcgcatacggggatcggcgaggcgttcgtcggcagcgtgctcgcgccgctggagctggcgccgcgcgccgaactcgcccgctacgactgccgcaataaccgcttgctgctcgccgcgctggcgcagatcgcgcccgctgttgaagcggcgcgcgaacgttacggcgcgcatcgcgtcggcgtggtgctcggcaccagcacgtcgggcatcgaggccgctgaagccgcgttcgtctatcaggcgcaggccggcgatcttcccgcgaacttcaactaccggcagatggaaatcggcaccgccgcgccgttcgccgccgccgcgctcggcctgcacggtccggcgttcaccatttcgaccgcgtgcacatcgagcgcgaaagcctttgcgtcggcacgccggctgttgcagttgcaactatgcgatgcggtcgtggtgggcggtgtcgattcgctgtgcgagctcacggtgcagggtttcgcatcgctcgaatcgaccagcaacgtgcgcagcaatccgatgagccgcaatcgttgcgggatcaatgtcggcgaaggcgcggccgtgttcctcatgagccgcgacgaggcgatggtgcgcgtcgcgggcgtgggcgaatcgagcgacgcgcatcacatttcctcgccggacccgcagggcgtgggcggcgaactcgcgctgcgcgcggcgctcgcggatgcgggtgtcgaatcggcggcgatcggctacgtgaatctgcacgccaccgccacgcgcaagaacgacgagatggaagcccacctgatgtcgcgcgtctttcccggcggcgtgccgaccagcggcaccaagccgttgaccggccaccagctcggcgcggcgggcgcgaccgaactcggcttcgcctggctgacgctggcgcgtgagaacgtgccgttgccgcgtcatctgtgggacggtgaagccgatccggcattgccgccgctggatctcgtggaaagcgagcggtttttgccgcaaggcggcgcgcagtacgcaatgagcaattcatttgctttcggcggcagcaacgtcagcctgattcttgcccga

SEQ ID NO: 28432 - DNA, 720 bp, Burkholderia fungorum
atgagccggcgtgttctcgttaccggcgcaagccgtggcattggccgcgcgattgcgtacaagttggccgccgacggcttcgcggtctccgtgcattgccgcacggggcgcagcgaggccgacgcggttgccacgggtatcgccgcgcagggcggcacggcgcgcgtgttgcagttcgacgtgcgcgagcgcgccgtgtgccgcgaagtgctcgaagccgacgtcgcggcgaacggcccgtattacggcatcgtgtgcagcgcgggcgtgacccgcgacgcggcgttccccgcgctcagcggggaagactgggacgtggtgatcgaaaccggactcgactcgttctacaacgtcgtccatccgttgaccatgccgatggtgcgggcccgccagggcggccgtatcgtcacgatcgcttcggtgtccggcgtaatgggcaatcgcgggcaggtgaactacagcgcggcgaaagccggcctgatcggcgcgaccaaggcgctcgccgtcgaactggcgacgcgcaacatcaccgtcaattgtgtcgcgccgggtttgatcgaaaccggcatgctcgacgagctgccgctcgaacaggtgttgaagacggtgccgatgaaccgcgtcggccagcccgccgaggtggcctccgtggtcagcttcctgatgtcggatgcggcctcgtatgtcacgcgccaggtgatcggcgtgaacggcgggatg

SEQ ID NO: 28433 - DNA, 1221 bp, Burkholderia fungorum
ctgatgaagcgcgtcgtcattaccggcatgggcggcgtcacggcattgggcgacagctgggacgtgatcgaaacgcgtctgaggagcggcgtgaacgccgtgcggcgcatgcccgaatgggactacttcgagtcgctgcatacgcggcttgcgtgtccgctgccggggttcacgatgcccgcgcattatccgcgcaagaagacccgctcgatgggaccggtctcgatgtactcggtgcgcgcgagcgaactggcgctcgccgacgcgggcctcgccgacgacgccaccatcaaggacggccgcatgggcgtcgcgtacggttcgtcgtcgggctcggtgcagccgatccgcgctttcggcacgatgctcgaaaccggctcgatgagcgacgtcacctccaacagctacgtgcagatgatgccgcacaccaccgcggtcaacgtcagcctgttctgggatctgaaagggcggatcattccgacctcgtgcgcgtgcgcctcgggcagccaggcaatcggctatgcgtatgaagcgatccagaccggcaagcagacgctgatgctggcgggcggcgcggaggaactgtcgggcccggcggtcgccgtgttcgatacgctgtacgccaccagcacgcgcaacgacgagccgcatctgacgccgcgtccgttcgacgccgcgcgcgacggcctcgtggtcggcgaaggcgcggccaccctggtgctcgaagaatacgggcacgcggtggcgcgcggtgcgcggattcacgcggagatcgtcggcttcggctgcaattcggacggcgcgcatatgacgcagccgaccgccgaaacaatggcgctcgcgatgcaactcgcgctcagggatgctcagctcgcgcctgaagcgattgcctacgtgaatgcgcacggcacctcgacggatcgcggcgatattgccgaaagccacgcgaccgcgcagaccttcggcgcgcacatgccgatcagttcgctcaagagctatgtcggccatacgctcggcgcgtgcggcgcgctcgaagcctggtggaccatcgagatgatgaagcgcaactggtatgcgccgaccttgaacctgacccgcgtcgatccggcctgcgcgccgctcgattacatcgccggcacgggccggcagatcgatgccgaatacgtgatgagcaacaacttcgcgttcggcggcatcaacacgtcgctgattttcaggcgc

SEQ ID NO: 28434 - DNA, 1221 bp, Burkholderia fungorum
ctgcaacgcgtggtcgtgaccggtatggggatcgtgtcgtgtctcggcaatacgctcgacgaagttgcctcggcgttgcgcgcgggccgctcgcgcattcagcggatcgacgcctggcgagagcgcggcttcgcttcccaggtggcgggcgttgcgtcggttgcgcacgaaccgccgtttgagcgcaagctcgaacgcttcatgggcgacacggcgcggttcgcctgtcacgccgcgcgcaacgcgatcagcgacgccgggctcgatgccgcggcgttgcgctcgccgcgcgccggcacggtgatcggttcgggcgtcggcacgatgtccacttacgacgcggcgatggcaaccgcgcacgctcgcggtgtcgacaaggtgccgccgtacacggtgccgcatgcgatgagcagcaccgcgtcggcgaacgtcgcgcaggtgttcgggctcgaaggcgtcagctattcgccgtcatcggcgtgtacgacctcggcgctcgcgatcgggcaggcgatgcagctgatccagaccggccgccagcagatcgtgctggccggcggcagcgagtcgctgcacgacaacatgacgctcatgttcgacgcaatgggcgcgctgtcgcgccgcttcaacgacacgccgcagcgcgcatcgcgtccttatgacacggagcgcgacggcttcgtgatcgcgtcgggtggcggcgtgctggtgctcgaatcgctcgagtacgcgctcgcacgcggcgcgcgcatctacgcggaactcaccggattcggcgactgcacggacagcgccggcatggtcgcgccgcgcgcggcggggatcgcgcgcgccatgcgcggcgcgctgcatgaagcgggcaagcggcccgattacgtcaacacgcacgcaccgtcgacaccgctcggcgatacggaggaattgcgcgcgttgagcgaagtgttcggcgcggcgttcgatcgtcgcgtgccggcgttttcatcgaccaaggggatgacggggcatccgctcggcgcttgcggcgcgcacgaggcgatctacacgctgctgatgatgcgtgacggcttcattgctggcacggcgggcatcgacacgccggagccggccgtcgacggcatgccgctcgtgcgcgtcacgcgtgaggcgcgtatcgacacggcgatgtcggtttcattcgggttcggcggcagttgcgcgagcctggtgttcgaagcatggcag

SEQ ID NO: 28435 - DNA, 2787 bp, Burkholderia fungorum
tccttcttcgacgacacggactacggcacgcccgagcgtcacgccgacatcgacgtcacgctggaaatcgacggccagtccgtcaccgtgccggccggcacctccgtcatgcgcgccgccgtcgaagcgggcgtcaacgtgccgaagctctgcgcgaccgattcgctggaaccgttcggctcgtgccgcctgtgtctcgtggaaatcgaaggcaagcgcggctatcccgcgtcatgcacgacgccggtcgaagccggcatgaaggtgcgcacgcagaccgatcgtctgcagtcgctgcgccgcaacgtgatggagctgtacatctccgatcacccgctcgactgcctgacctgccccgccaacggcgactgcgaactgcaggacatggcgggcgtcacgggcttgcgcgaagtgcgctacggcttcgacggcgcgaatcacctgaaggataagaaagacgagtcgaacccgtacttcacctacgacgcgtcgaagtgcatcgtctgcaatcgctgcgtgcgcgcgtgcgaggaaacgcaaggtacgttcgcgctgaccatcgccgggcgcggtttcgaatcgcgcgtggcggccagcgaaaacgtgccgttcatggaatcggagtgcgtgtcgtgcggcgcgtgcgtggccgcatgcccgaccgcgaccttgcaggaaaagaccgtcatcatgcttggccaggccgagcattcggtcgtgaccacgtgcgcgtattgcggcgtcggctgctcgttcaaggcggagatgaagggcaaccaggtcgtgcggatggtgccgcacaagaacggccaggccaacgaaggccacgcctgcgtgaagggccgctttgcgtggggctacgcgacgcacaaggaccgcatcaccaggccgatgatccgtgcaaagatcaccgatccgtggcgcgaagtgagttgggaagaagcgctcacgtatgcagcgtcggaattccgccgcattcaggcgaagcacgggcgcgattcgatcggcggcattacgtcgtcgcgttgcacgaacgaagaaacgtatctggtgcaaaagctcgtgcgcgccgcgttcggcaacaacaacgtcgacacctgcgcgcgcgtgtgccactcgccgaccggctatggactgaagaccacgctcggcgaatcggcgggcacgcagacgttcgcctcggtcgataaagccgacgtgatcatggtgatcggcgcgaatccgaccgacggccacccggtgttcggctcacgtctgaaacgccgcgtgcgcgaaggcgcgaagctgatcgtggtcgatccgcgccgcatcgatatcgtcgatacgccgcatgtgaaggcgtcgcatcatctgcaattgcgcccgggcaccaacgtggcagtggtaaacgcgctggcgcatgtgatcgtcaccgaagggctggtgaacgaagcgttcgttgccgagcgttgcgaaacgcgcgcgttcgagcaatggcgcgatttcgtcgcgctgccggaaaacgcgccggaggcgaccgaggcggcgaccggcgtgccggctcaagccgtgcgcgaagccgcccgcatctatgcgaccggcggcaacgccgcgatctactacggtctgggcgtcaccgaacacgcgcaaggctcgacgatggtgatgggcatcgccaacctcgcaatggcgacgggcaacatcggccgcgaaggtgtgggcgtgaatccgctgcgcggccagaacaacgtgcagggttcgtgcgacatgggctcgttcccgcacgagctgccaggctatcgccacatcagcgacacggtcacgcgcacgctgttcgaggaagcgtggaacgtcacgctgcaacccgaacccggtctgcgcattccgaacatgttcgacgccgccgtgcacggcaccttcaagggtctgtactgccagggcgaagacatcgtgcagtcggatccgaatacgcaccacgtgtccgcggcgctgtcggcgatggaatgcattgtcgtgcaggacattttcctgaacgagaccgccaagtatgcgcacgtgctgctgcctggttcgtcgttcctcgaaaaggacggcacgttcaccaacgcggagcgccgcatctcgcgcgtgcgcaaggtcatgccgccggtaccgggttacgccgactgggaagtcacggtgctgctcgcgcgcgcgctcggctatgaaatggactacacgcatccgtcgcagatcatggacgagatcgcgcgtctcacgccgaccttccacggcgtctcgtacaaaaagctcgacgaactcggcagcatccagtggccgtgcaacgagaatgcgccggacggtacgccgaccatgcatatcgacaccttcgtgcgcggcaagggcaagttcgtgatcacgaagttcatcgcgacgccggagaaagtcacgcgcaaattcccgctgctgctcaccacgggccgcatcctgtcgcaatacaacgtgggcgcgcagacgcgccgcaccgagaactcgcgctggcacgacgaggaccggctggaaatccatccgcacgacgccgaagaacgcggcatcaggacggacgattgggtcggcattgaatcgcgcgcgggacagaccgtgctgcgcgccaaggtgaccgagcgcatgcagccgggcgtcgtttatacgacgttccacttccccgaatcgggcgcgaacgtgatcaccaccgatagctcggactgggcgaccaactgtccggaatacaaggtgaccgcggtgcaggtgatgccggtcgaacagccgtcgcaatggcagagagactat

SEQ ID NO: 28436 - DNA, 1356 bp, Burkholderia fungorum
agcatctccgcccgcctcgaccggctgcccgccacgcgctccatctggaaactggtggtactgctgagcctcggcttcttcttcgaactctacgatctgctgtactcgggctatgtcgcgcccggcctcgtcaaaagcggtttgctgaccgcgaccacgcatggcctgttcggctcgaccggcgtcgcgagtttcattgccgcgctgttcagcggcctctttatcggcacgatcgcgtgcggctttctggcggatcgcttcggacgccgtgcggtgttcacctactcgctgctctggtacaccgcggccaacatcgtgatggcgtttcaggaaacggctaccgggctgaacttctggcgcttcctggccgggatcggcattggcgtcgaactggtgacgatcggcacgtacatttcggagctggtgcccaagcagattcgcggccgcgcattcgcgtgcgaacaggcagtcggttttacggcggtgccggtggtggcatttctctcgtatctattggtgccgcgtacgctgctcggcctcgacggctggcgctgggtcgtgctgatcggcgcacacggtgcgctgttcgtgtggtggattcgccgcgcattgccggaaagcccgcgttggctcgcacaacaaggacgtcttgccgaagccgatcgggtgatgaccgaactcgaagcaaaggtgcgccgcgagtacggccgcgaactgccgccgcccgcgccgccggtgccggtcgcgccgcgcggcagcttccgcgatatgtgggtgccgccataccgcagccgcacgctgatgatgacgatcttcaatatcttccagacggtgggcttctacggctttgcgaattgggtgcccacgcttctgatcaagcagggcattacgatcaccacgagcctgatgtattcgagcgtgatcgcgctggctgcaccgctcggtccggtgatcgggctttttatcggcgaccgcttcgagcgcaagacggtgatcgtggtgatggcgggtgtgaatatcgtctgcgggctgtggttcagtcaggcggcgggtgctgtgttgctggtgagtctcggcgtgggtctgacgctcgcgggcaacatcatttcgtacagctttcacgcgtatcaggccgagctttttccgaccagcattcgtgcacgcgcagtgggcttcgtttattcgtggagccggttttccgcgatttttaccgcttttctgatcgccgccgtgttgaagcactttggcactggcggcgtgttcgtgttcatcgccggtgcgatgttgatcgtgatgctcgcgattggtttgatggggccacgcaccaacggaatcgaactggagaagatttcgaag

SEQ ID NO: 28437 - DNA, 780 bp, Burkholderia fungorum
tcgtccaacaaacgcttcactgaaaaagtcgtgatcgtcaccggcgcggcgcaaggtatcggccgtggcgttgcgctgcgcgcggcagccgaaggcgcgatcgtcgtgctcgccgatcgcgccgaactcgtgcacgaagtggaggcggagatcgccgcgctcggcagcccctcgctcgccgtgatcgccgatctggaaacctatgccggcgcgtgcaagctgatgcgggcggcgctcgatgccttcggcaagatcgacgtgctgatcaacaacgtgggcggcacgatctgggccaaaccgtacgaagagtatgaggaagcgcagatcgaagccgaagtgcgccgctcgctgttccccaccttgtggagctgccgtgcggtgttgcccgccatgatcgcgcagcggcgcggcgcgatcgtcaatgtatcgtcgattgccacgcgcagtatctatcgcgtgccttatgcggcgtccaaaggcggtgtgaacgcgttgacggccagcctcgccttcgaacatgcggacgacggcattcgcgtgaacgccgtcgccaccggcggcaccgaagcgccgccgcgcaaggtgccgcgcaataccgcaccgcagagcgaacaggaagcgcgctggtatcgaggcatcgtcgatcagaccatcgcttcgagtttgatgcgccgttacggcaccatcgatgaacaggtcggcgcgattctgtttctcgcctcggacgaggcgtcgtacatcaccggcaccgtgttgccggcaggcggtggcgatctcggg

SEQ ID NO: 28438 - DNA, 1308 bp, Burkholderia fungorum
gcggcaagcaccgtgcgccgctcgaacgcccgctacaagattctgacgctgctcgcgctcggaacgatgatcaactatctcgaccgcacggtgctcggcatcgccgcgccgcagttgaccaaagaactcggcatcaacgcggcgctgatggggctgctcttttccgtgttttcgtggagctatgtggcctcgcaaattccgggcggtctgtttctcgaccgcttcggcagcaagctcacttatttcctgtcgatgaccttctggtcgctgtgcacgctcgcacaaggactcgtacacggtatcggcgcgctgttcgcgttccggctcggcctcggcgtttcggaagcgccgtgttttccgaccaatagccgcgtggtcgcgacatggttcccgcagagcgaacgtgctatggcaaccggcacgtacacggtcggcgaatatatcggcctcgcttttttcagcccgttcctgttcatgctgatgggcgcattcggctggcgttcgctgttctatgtggtcggcggcatcggcctcgtattcggcgggatctggtggatcttctatcgggagccgcgcgatcatcccgcggcgaatcaggcggagctcgactatatcgaagcgggtggcggtctcacgaacgcgaagaagaacgccgacgcacagggcaccgcggccggcgcttcgacgagcggcttcgaatggcgcaccattggacgcctgctcaagcatcgtcaactggcgggcatctgcctcggccagtttgccggcaactcgacgctcgtgttcttcctcacctggttcccgacttatctcgccaccgaacgtcatatggcgtggctgaagatcggtttcttcgcgatcatgccgttcattgccgcatcgatcggcgtgatgctcggcggcattttctcggactggctgctgcgccgcggcaagtcgccgaacgtggcgcgcaagctgccgatcattgccggcctgctgctcgcgtcgaccatcgtgctcgccaactacgtggagagcaacgtggtggtgatcgcgattctgtccgtggcgtttttcgcccagggcatggccgcgctcggctggacgctggtgtcggacatcgcgccggaagggctgctcggcgtgaccggcggcatcttcaacttcgcggccaacctggccggcatcgtgacgccgctggtggtgggttttatcgtcgcggcgagcggctcgtttgtcggcgcgctggtgtttatcggcgcgatcgctctggtcggcgcgctgtcgtacatctttgtcgtcggcgatatcaagcggatcgtgctg

SEQ ID NO: 28439 - DNA, 843 bp, Burkholderia fungorum
gcaaccccccactcctacctggtcggtctgattggctcgggcatcggcggatcgctcacgcccgcgatgcacgaggaagagggcagccaactcggcctgcactacgtgtaccgccgcatcgatctggaagcgttgaagctcgacatcgccgcactgccggatctgctcatcgccgccgagcgcatgggcttcaacggtctgaacatcacgtacccgtgcaagcaggcggtgattcctttgctcgacgaactgtccggcgacgctcgtgcactcggcgcggtcaacaccgttctgttcaaggacggcaaacgcattggccacaacacggactggtccggtttcgcccgtgcgttccagcgcggtttgcctgacgtgtcgctggaacgtgtcgtgcaactgggcgcgggcggcgccggcgcggcggtcgcgcacgccgcgctgaccttgggcgcgaaatcgctcacgctattcgatgtggatgcttcgcgcgccgcctcactcgcccgcgaattgcagaagcgctttcccgccgccgcgatcagcgccggcagttcgctcgccgggtcgctcacagctgccaatggcctgattcacgccacacccaccggcatggcgaaattgcccggcctgccgctgccggtcgaattgctgcaccgtgacctgtgggtagcggacatcgtctatttcccgattcgcacggcgctgctgcaggcggctgagtcactcggctgccgcacgctgagcggcggcggcatggcggtgtatcaggcggtcgacgccatgcgcatcttcaccggtctcgaacccgacgccgagcgggtgtatcgccattttcagtcgttg

SEQ ID NO: 28440 - DNA, 435 bp, Burkholderia fungorum
tcggtactggtcctcaatggaccgaatctcaatctgctcggcacgcgcgagccggccatctacggctcggaaacgctcgacgacatcgcgaagctctgcggcgatgcggcagagcgtctgaatctgtcgatcgacttctgccagtcgaacgccgagcatcaactgatcgactggctgcacgcggcgcggaccaaggtcgacggcatcgtgatcaatcctgcagcttatacgcatacctcggtggcgattgccgacgcgctttccgcgatcgaaaagccggtcatcgaagtgcatatttcaaacgtgcatcgccgcgaggcgttccggcatcactcgtatgtgtcggcggcggcggacggggtcatcgtcggttgcggcacgcagggctatgtgctggctttggagcggatggcggccattcttgagcatagggca

SEQ ID NO: 28441 - DNA, 891 bp, Burkholderia fungorum
tgggaaggcgtattgcccgcagtcaccaccaaattcaacgcggatttcagcatagaccgcgcatggaccggcaagaatatcgaggcgcagatcgcggcgggtgtggacggcatcatcgtgtgcggatcgctgggcgaagcgtcgacgctctcgctggatgaaaagctgcaggtgctcgacgtcgccgtggaggcctcgcgcggccgtgtgccggttctattgacgatcgccgaaaacagcacgctcgacgcgtgccgccaggccgaagccggcagccgtcacggcgcggccggctacatggtgctgccggggttgcgctatctgtcggaccgtcgcgagacgctgcaccatttccgcagtgtcgccgacgcaagcgcgctgccgctgatgatctacaacaatccgctcgcctatggcgtcgacatgacgcccgacatgttcgcggaaatcgccgacgagaagaaggtcgtcgcgatcaaggaatcatgtggcgacgtgcggcgcgtgaccgacctgatcaacgcggtcggcgaccgcttcgcgattctctgcggcgtcgacaatctcgcgatggaagcaatattgatgggcgcgcatggctgggtggccggtctcgtgtgcgcgttcccgcgtgagacggtggtgatctacaagctgctgaaggcgggacgcttcgaggaagcgcgggcgatctaccgctggttcgcgccgctgctcgcgctcgacgtctcggcaaagctggtgcagaacatcaagctcgccgaagccattgtcggcctgggcacggagccggtgcgcccgccacgtctgccgctggccggcgacgaacgcaaggctgtcgaagcgctgattcgcaaggcgctcgaaacacggccggcactgccgcagatc

SEQ ID NO: 28442 - DNA, 1101 bp, Burkholderia fungorum
agtgccgcgcagcgcgatctcgaaggcggccacgccgcccaggaaaaacaatggatcgccgacgcggggcttctcacgctcgcggtgccgcgcgaattcggcggcctcggcgcgcgttggcccgacatctacgagacggttcgcaagatcgcgcaagtggacagcgcgctcgcgcatctgttgggcttcacgtgcctgcaggtggtcagcgtcaatgtatggggcaatcctgaacaacgcgcccgctttctgagcggcaccgtcgaaaaccggtggtggtggggtaacgccgtcaatccgctcgacacacggctcattgccaccgcaagcggcgacggcggctacctgctcgacggccagaagggattctgctcaggcacgcgcggctcgcagatgatgacggtctccgcgcaggatccggtcaccggcaaaccggtgttcggtgtcctgccgaccacgcgcgaaggcattaccgttcacgaagactggaatccgatcggccagcggcagaccgacagcggcagcgtgtcgttcgtgcgcgtcaagctcgaaccgcatgaagtcatggagcggcccgacacaccgcacgcgagtttgcgcacgctgatttcgcaactggtgctgaccaacctgttcgtgggcattgcacagggcgcgctcgacgaagcgcgagcctacgtcacgcagcacggtaaggcgtggatctattccggcgtggacaaagccaccgacgatccctacctgatccagcgcttcggcgaaatgcgcctgcaagcggtcagcgcggaagcgctggccacgcgcgcggcctggctgctcgacgacgcgtggcaacggggcgcggcgctttcccccgaaacccgtgcgcaggttgcgctcgccacttcggaggcgaagatcgtcgcgcaccgcgccgcgctcgacgtcagcgaacagctgttcgacgcctgtggtgcccgcgccacgcacgcgccgctcgcgctcgaccgtttctggcgcaacgctcgcgtgcacacgctgcacgatccgctggactatcgcgtgcgcgacgtcggccgctacgcgctcaccggcacgttgccggaggtttctttgtacact

SEQ ID NO: 28443 - DNA, 1503 bp, Burkholderia fungorum
accatgatgaatctgaagcccggccacctgactctcccgcaactgcgccagatcgcgcgcgaacatgtcgcattgcaactcgatcccgccagccatgccgcgatcgacgcctgcgcgcaagccgtcgccgatatcgccgcgaagggcgagccggcctacggcatcaacacgggctttgggcgcctcgccagcacgcatattccgcacgaccaactcgaactgttgcagcgcaatctggtgctctctcacgcggtcggcgtgggtgagccgatgtcgcgtccggtcgtgcgtctgctgatcgcgctgaaactctcgagcctcggccgcggccattcgggcattcgccgtgaagtgatggacgcgctgatcacgctgtacaacgccgacgtgctgccggtgattccggtcaagggttcggtcggtgcatcgggcgacctcgcgccgctcgcgcatatgtcggcggcgctgctcggcgtcggcgaagtgttcgcgaagggcgagcgcatgccggccaccgagggtctcgcgctcgtcggcctcaagccgctcacgctgcaagccaaagaggggctggcgctcctgaacggcacgcaggcttcgacggcgctcgcgctgtacaacatgttcgccatcgaagacctgtaccgcaccgcgctggtgtcgggcgcattgtcggtagatgccgcaatgggctcggtcaagccgttcgacgcgcgcattcacgagttgcgcggccatcaaggtcagatcgacgcggcggcggcataccgctcgctgctggaaggttcggcaatcaacgtttcgcacgccgattgcgacaaggtgcaggacccgtacagcctgcgctgccagccgcaagtcatgggcgcgtgtctggatcagatgcgccacgcggccaacgtgctgctgctcgaagcgaacgcggtctccgacaatccgctgattttccccgacaccggcgaagtgctgtcgggcggtaacttccacgcagagccggtcgccttcgcggccgataacctcgcgctcgccgccgccgaaatcggcgcgctggccgaacgccgcatcgcgctgctgatcgacgcgacgctgtcgggcctgccgccgttcctcgtgcgcgatggcggcgtgaattcgggcttcatgatcgcgcacgtcacggctgcggcgctcgcctcggaaaacaagacgctcgcgcatccggcttcggtcgattcgctgcccacttcggcaaaccaggaagaccacgtgtcgatggcgacgttcgccgcgcgcaagctcggcgacattgctgaaaacaccgcgaacattctgtcgatcgaactgctcgccgccgcgcaaggcgtcgatctgcgcgcgccgcacaagaccagcccgagcctgcagaaagcgatggacacagtgcgcaaggacgtcgcgcattacgagctcgaccattatttcgcaccggatatcgcggctgtcacgcgcctcgtgcagaacggcacgatcgcgaagctgagcccg

SEQ ID NO: 28444 - DNA, 1449 bp, Burkholderia fungorum
attcgcgccctgcacgtcgcaagcgagctgtatcccctcctcaaaacgggcggcctcgccgacgtcgcgggcgcgttgccgcccgcgctgatcgagcgcggcgccgatgtgcgggtgctgttgcccggcttcccggcggtggtggccggtttgaccgagctcgcgccggttgcgcaactggggcgccaattcgatgccccgggcgtcacgctcgaacgcggcacgctggcgtcgagcggcctgatcgtctatgtgatccgcgcgagcacgctgtatgaccggccaggcaatccctatctgaacgacgaacacgtgccgtacggcgacaacgcgcagcgtttcgcgctgctcggctgggtcgccgcgcaactcgcgcagcatctggatccggcctggtcgccgcagatcgtccacgcgcacgactggcatgcggggctcgcgccggcctatctgaaagcggccgaacgccagcatggccggtctttcgcgcgcagcgtcttcacggtgcacaacctcgcgtatcaaggcgtgtttcccgcgccccagttcggccaactggggctgccggccgattacttcagcatgcacggcgtggagttctacgggcaactgtcgtttctcaaggccggcctttacttcagcgaccgcatcaccaccgtgagcccgacctacgcgcgcgaaatccagacgctcgcccagggcggcggactcgacgggctgctgcgccatcgttcgcacgacctgagcggcattctgaacggcgtcgactacacggtctggaatccggccagcgacgcgcttctcgaagaccactacagcgccacgcgcctcgccggcaaactggcgtgcaaggaagcactgcaaaaacgcttcggcctcgcgcagaaaagcgacgcgctgctgttcggcgtggtgagccgcctgaccgaacagaaaggcctcgacctgctgctcgaggcggtgcccgaaatcatcaaacatggcggccaactggtggtattcggcaccggcgacccggcgctggaaaacggtttgaaacgcgtcgcgcatgcgcacccggaagccgtcgcggtggaactcggcttcgacgaaaagctcgcgcatacgatcgtcgcgggcagcgacgtgatcgcggtgccgtcgcgtttcgagccctgcggcttgacccagctgtatgcgctcgcttatggctcgctgccgctcgtgcattgcgtgggcggtctcgcggacacggtggtggacgcgtcgctcgaaaatctcgccgacgacctcgccaccggtttcatgttcgaacgcttcgagctgaagggtatcggcgccgcgatccgccgcgccttcgcgctccgagaacgccgcaccgaatggaaagcgacccagcggcgcgcgatgcgccaggacttcggctggggcgcttcggcggagcgctatctggcgctgtatcgcgagctc

SEQ ID NO: 28445 - DNA, 1275 bp, Burkholderia fungorum
tcgataaaggagacagacatggacactccggcacggctgaacgatctgcagcgcaccaccctcgccatcgtcctcgcgggcggacggggcacgcggctcggcccgcttaccaacaaacgcgtcaagccggccgtgcacttcggcggcaaataccggatcatcgacttcgcgctgtccaactgcctgaactccggcatccgccgcatcgcggtcgtcacgcagtacaaggcgcactcgctgctgcgtcacctgcagcgcggctggagcttcctgcgcggcgagttcggcgagttcatcgacctgtggcccgcacaacaacgcgtggaaggcgcgcactggtatcgcggcaccgcggacgcagtgttccagaatctcgacatcatccgttccatccggccgaaatacgtggtggtgctggcaggcgaccacatctacaagatggactacacgcgcatgatcgccgaccacgcggagagcggcgcggattgcacggtcggctgtatcgaggtgccgcgcatggacgcggtggccttcggcgtgatgcacgtggatgaaaaccgccgcgtgaccggcttcgtggaaaaacccgccgacccgcccgccatacccggccgcccggatacggcgctcgccagcatgggcatctacgtgttcagcgccgactacctgtactcgctgctcgaagagaacatctcgtccgtcgacaccgatcacgacttcggcaaggacatcctgccgcgcgtcgtcacgcaaggcacggcgatcgcgcatccgttcagcatgtcgtgcgtgtcgtcggacccgaacgtggagccgtactggcgcgacgtcggcacgatcgacgcatactgggccgccaatctcgacctcgcctcgaccattccgacgctcgatctctacgatcgcagctggccgatctggacatatcaggaacagttgccgccggccaaattcgtgcgcgacatgaaggggctgcagggctcgggcaacaatctgatcgtgtgcgggggctgcgtgatctcgggctcgcagatctcgcgctcggtgctctcgtcgaatgtcaaagtgagttcgttctgtaacatcaatgaggcagtcttgttgccgcaggtcaccgtcggcgcgagctgccggctgcagaaagtggtgatagaccgcggctgcgcgataccggacggcacggtaatcggcgaagatccggtgagcgatgccgagcgcttttaccgtaccgacgacggcgtggtgctggttacgccggaagccttgcggcagatg

SEQ ID NO: 28446 - DNA, 1170 bp, Burkholderia fungorum
atggtgccggtgttttctcccgccgccttcgtgccggaccgcggtctcggctcacgcgtctgggatacgcagggccgcgactatatcgacttcgccggcggcatcgctgtcaccgcgctcggtcatgggcatcccgaactgctgaaagtactgcacgagcagggcgccaagctgtggcacatcggcaatggctacaccaatgaaccggtgctgcgtctggccaaacgcctcgaagagctgactttcgccgaccgcgcgttcttcgccaactcgggcgcggaagcgaatgaagctgcgttgaagctggctcgccgcgtcgcgttcgagcgtcacggcgcggataaattcgaaatcgtttcgtttacgcagtcgttccacggccgcacgttcttcacggtgagcgtcggcgggcagccgaagtattcggaaggcttcggcccggtgccggccggcatcacccacttgccgtataacgacatcgaggccgcgaagaaagccatcggcgcgcaaacctgcgcggtgatcgtcgagccggttcagggcgaaggcggcgtgatcccggcggatccggcgttcctcgcggcattgcgcgaagcctgcgatcagcacggcgcactgctgatttttgacgaggtacaaacgggtgtgggccgcagcggctatttctacgcgtaccaggaaaccggcgtgacgccggacatcctgaccacggccaaggcgctcggcaatggcttcccgatcggcgcgatgctgaccaccaacgaactggccgcgtatttcaaggtcggcgtgcatggcaccacgtacggcggcaatccgctgggcgcggcgattgccgaaaaggtggtcgaactgatcagtgatccgaagctgctcgaaggcgtgcgttcgctcagtgaagcgctgaaaggccatctcgcgaagctgaacgatcgcttcggcctgttcacggaagtgcgcggccgggggctgctgatcggtgcggaactgaccgatgcattcaagggccgcgcgaaagatttcgtcaccgccgccggccagcatggcgtgatcatgctgatggccggtcctgacgtgctgcggttcgtgccgtcgctgatcatgccgctcgacgacatgaacgaaggcttcgcgcgtctggccagcgcgatcgagggcattgtcggcgca

SEQ ID NO: 28447 - DNA, 1464 bp, Burkholderia fungorum
atcatgagcgagcttttcatcggcggcgaatgggccgccggcacaggacccgcattcgcgtcgcgcaacccgggcacgggcgcggcggtgtgggaaggcaacagcgcgtcggctgacgacgtggaccgcgcggtgcgcagcgcgcgccgtgcgttcgccgcctggtcggcgtcgagtgtcgacgaacgttgcgccgtggtgcgtcgcttcgccgcgctcgtgaccgaacgcaaggaagcgctggccgaagcgatcggccgcgaaaccggcaagccgttgtgggaagcgcgcacggaagccgcttcgatggcggccaaggtcgagatttcgattcaggcctataacgaacgtactggcgagaagcgctcggcaatggcggacggcacggccgtgttgaggcatcggccgcatggcgtggtggccgtgttcgggccgtataactttcctgggcatctgccgaacggccatatcgtgccggcgctgatcgcgggcaatgcggtcgtgttcaagccgtcggaactcgcgcccggcgtggccgcgctcaccgtgcagatctggcgcgacgccggtttgccggcaggcgtgctgaacctcgtgcagggcgagaaagacacgggcattgcgctggcgaatcaccggcagatcgacggcctcttcttcacaggtagttcggataccggaacattgctgcacaagcagttcggcggccgccccgagatcgtgctggcgctggaaatgggcggcaacaatccgctcgtgatcgggccggtggccgatgtcgatgccgccgtgcatcacacgatccagtcagcgtttctgtcggcggggcagcgttgcacgtgtgcgcgccgcatcttcgtgccgaacgacgcagcgggcgatcgcttcctggagcgcttcaccgaggtcacctcgcgcatcactgtcggcgaatacaacgccgatccgcaaccgttcatgggcgcggtgatttcggtgcgcgcggcgtcgcgtctcgtcgccgcgcaggaacgcttgctggctgacggcgccaaagcattgctgaagatggagcaacgcgatccgaagctcggcttcgtcacgcccgcgattctcgacgtcacgaacgtggcgaatcggccggacgaagaacacttcggtcctttggcgcagatcatccgctacggcagctttaacgaagcgctggaacaggccaacgacaccgagttcggcctctcggcgggcctcctcgccgacgacgaagcgctctgggcgcacttccagcgcaccatccgcgcgggcatcgtcaactggaaccggccgaccaacggcgcctcgtcgggcgcgccgttcggcggtccgggccgctcgggcaatcaccggccgagcgcgtactacgccgccgactactgcgcgttcccgatggcttccgtcgaaagcgcgcaactgcaaatgcccgcgagcgtctcgccgggccttcaattc

SEQ ID NO: 28448 - DNA, 561 bp, Burkholderia fungorum
attccagctcccatgcaggacgaaaaagccgccgcgacgcatagtgaaacggcagtgttcgcgggaggctgcttctggggcgtgcagggcgtgttcgaacacgtgcgcggtgtgaaggaggtcgcctcgggttacagcggcggcgccgcttccacggcgcaatacgaaaccgtcagcgagggggatacgggacacgcggagtcggtgcggattacttacgatccgacgcagatcacgtatggacgtctgctgcagatattcttctcggtcgcgcacaatcctaccgagctcaactatcagggtcctgaccacggcacgcaatatcgctcggcgatttttcccgtgaatgcaatgcagcgcggcatcgcccagtcgtatatcgcacaactcgataacgcacatgtgttttccgcgccggtcgtaacgcgtgtggagaacttcaagggcttctatccggcggagaactatcaccagaacttcctcgcgttgcatccggactacccgtacatcgcaatcaacgatctgccgaaggtggccgatctcaagcggatgttcccggat

SEQ ID NO: 28449 - DNA, 645 bp, Burkholderia fungorum
atccagacgtctttcctcttcgatctcgacggaaccctggtcgacagtgtctaccagcacgttctggcctggaaagaagcgctcgacagcgaagggattcccctgtcggtatggcgaattcaccgcaagatcggcatgagcggcggcctcttcacccatcagcttctgcgcgagacgcacggtgaaatcagtgccgagcgggtcgagcgtcttcgtcatgctcacgccgcggcctatcagcgattgcgcgcgcaggtgtgtccgctgcccggcgcgcgggccttgctcgatgcgctgacgcaagccggaacgccgtgggcggtggcgaccagcggccgcatggagacggcggcgctcaatctggaggcgctgggcgtcgatcccgcgaaggtggttgtcgtgacgcgcgacgacgtcaaatatgccaagccggatcccgatctgttcgtcgccgcggccgggcgcctcggcgtgcccgtcgaaaacacggtggtggtcggcgatagtatctgggacatgctggcggcgcggcgctgccgtgcgctgggcgtaggcctgctgtcgggcggatacggcacggaggaactcgaacgcgccggtgcgctgcgggtctacgacgatccggccgatctgctggaacatctg

SEQ ID NO: 28450 - DNA, 1443 bp, Burkholderia fungorum
ttgaccttgaaagacccgtcgcttctgaaaacgcacgcgtacatcgcgggcgaatggcaaggcgcggacgacggctcgaccttcgaagtgaagaaccccgccacgggtgaaatcatcgcgaccgtgccgcgcatgggcacggcggaaacccgccgcgcgatcgacacggccaacgccgcgtggcccgcctggcgcgccacgaccgcgaagcagcgagcggtgatcctgcgcaaatggcacgacctgatgatggagaacgccgacgatctggcaaagatcctcaccacggaacaaggtaagccgctcgccgaagccaaaggcgaaatccagtacgccgcttcgttcctcgaatggttcgcggaagaaggcaagcgcgtgaacggcgacaccatcccgacgccggccaacgacaagcgcatcgtcgtgacgaaagaaccgatcggcgtgtgtgccgcgatcacgccgtggaacttccccgcggcgatgatcacgcgcaaggtcggtccggcgctggcggcgggctgcccgatcatcgtcaaaccggctgaagccacaccgctctccgcgctcgccctcgccgtgctggccgaacgcgccggcgtgccgcgcggcgtgttcaacgtcgtcaccggcgagccgaaagccattggcgcggaaatgacgggcaatccggtcgtgcgcaaactgtcgttcaccggttcgacgccggtcggccgtttgctgatggcgcagtgcgcgccgacagtcaagaaagtgtcgctcgaactcggcggcaacgcgccgttcatcgtattcgacgacgcggatctggatgccgcagtggccggcgcgattgcgtcgaagtatcgcaatagcggccagacctgtgtgtgcacgaaccgtttctatgtgcacgacaaggtctacgacgcgttcgccgaaaaactgcgcgtcgccgtcgaacagctcaaggttggccgcggcaccgaagacggcgtgacgcaaggtccgctgatcaacgaagccgccgtgctcaaggtcgagtcgcatatcgaagacgcgctcgccaaaggcgcgcgcatcgtcaccggcggcaagcgtcatgtgctcggccacggcttcttcgagccgaccgtgctcgcggatgtcacgccggccatgaaggtggcacgcgacgaaaccttcgggccgctcgcgccgctgttccgcttctcatcggacgaggaagtgatccgcctcgccaacgatacggagttcggtctcgcgtcgtacttctatagccgcgatatcggccgcgtctggcgggtcgccgaagcgctggaatacggcatggtcggcatcaatacgggcctcatctcgaatgaagtcgcgccattcggcggcgtcaagcaatcgggcctgggtcgcgaaggttcgcattacggtatcgatgattacgtggtcatcaagtacctgtgcgtcggc

SEQ ID NO: 28451 - DNA, 1263 bp, Burkholderia fungorum
atgaagaatgccgaactgaagagccgcaaagacgctgccacgccgcgcggcgtcggagtgatgtgcgatttctacgccgagcgcgctgaaaacgcggagctgtgggatatcgagggccgccgtttcatcgacttcgcggccggtattgcagtgtgcaacacgggccaccgtcatccgaagatcgtcgccgcgattcgcgaccagctcgatcacttcacccacacggcgtatcagatcgtgccgtacgcgtcgtatgtcgagctggctgagaagctcaacgagcgcgcgccgggcgactatccgaagaaaactgcgttcttcacgaccggcgccgaagccgtcgaaaacgcgatcaagatcgcccgcgccgcgaccggccgccccggcgtgatcgccttcaccggcgctttccacggccgcacgctgatgggcatggcgctgaccggcaaggtcgcgccgtacaagatcggctttggcccgttcccgtcggacgtgttccacgcgccgttccccaacccgctgcacggcgtgaccaccgccgattcgctgaaggccatcgaattcctgttcaaggccgacatcgatccgaaacgcgtggccgcgatcattttcgaaccggtgcagggcgaaggcggtttctatccggcgccggccgaattcgtgcgcgccttgcgcaagctgtgcaatgagcacggcattctgctgatcgccgacgaagtccagacgggtttcgcacgcaccggcaagctgttcgccatgaatcactacgacgtcgtgcccgatctgatgacggtcgccaagagtctcgccggcggcatgccgctgtcgggcgtgatcggccgcgcggatgtgatggacgcggccgcgcccggcggcctcggcggcacgtatgcgggcaatcctctggcggtggccgccgcgcatgcggtgctcgatatcatcgacgaagagaagctgtgcgaacgcgccacgctgctgggtgaccgcatcaaggccaaactgatcgcactgcaaagcgacgtgccgcagatcgccgacgtgcgcggccccggcggcatggtcgcggtcgagttctgcaaggcaggcaccaccgagccggatgcggagttcaccaaacgcgtgcagagccgcgcgctcgaacgcggcttgctgctgctggtgtgcggcgtctattcgaacgtggtgcgcttcctgttcccgctcacgattcaggaggcggtcttcgacgaagcgctggcgattctcgaagacgtgatcaaggac

SEQ ID NO: 28452 - DNA, 744 bp, Burkholderia fungorum
atccgtatcgaacggttgagcaagacgttcagcaacggccgcaaggcgctggacgaaatcgatctgcgtatcgagccgggcgagatggttgcgttgattggcgcctcgggttcgggcaagtcgacgctgctgcgccatatcgcgggcttcacggcttcggatgcgcagccgtcgcagatcgagattctgggccggccgatccagcagaacggccgcatcgtgcgggaagtgcgcagcattcgccgcgatatcggcttcgtgttccagcaattcaacctggtgaaccgcctctcggtcgaaaccaatgtgctgatcggtgcacttgcgcggctgccctggtggcgccgtctcagcggccgttttccacgcgccgagcgggccttgtcgatagccgcgctcaacgaggtcggcattggcgaacatgcgcgcgaacgcgccgccaatctttccggcggccagcagcagcgtgccgcgctcgcgcgtgcgctggtgcagcgcgcgcgcatcgtgctcgccgatgaaccgatcgcctcactcgacccggaatcgtcgcgccgcgtgatggacatgctgcgcacgctgaacatcgagcatcggctcacggttctggtgtcgctgcatcaggtcgagatcgccatgcagtattgcccgcgcacgattgcgctgcggcgcggcaaggtggtctacgacggcccttccgccgcgctcacaccggccctgctcaaaacgctctatggcgacgag

SEQ ID NO: 28453 - DNA, 927 bp, Burkholderia fungorum
ctttgtctcggctgcatgagctatggcgtgccgtcccgcggccctcatccgtggacgctcggcgacgaagccgcccgccctttcatcaagcaggcgctcgatcacggcatcaacttcttcgataccgcgaatgtttattccgacggcacgagtgaggaaatcgtcggccgcgcgctgaaggactttgcgatgcgcgacgagatcgtgctcgccaccaaggtgcacggccgcatgcatccgggcccgaatggcgcgggcctctcgcgcaaggtgatcatggcggagatcgacaacagtctcaggcgcctcggcacggattacgtggacctgtatcagatccatcgctgggactacggcacgccgatcgaagaaaccatggaagcgctgcacgacgtcgtgaaagccggcaaggcgcgctatatcggcgcatcgtccatgtatgcgtggcagttcgccaaggcgttgcatgtggctgagcgcaacggctggacgcgcttcgcaacgatgcagaactacgtgaatctgctctaccgcgaggaagagcgcgaaatgctgccgctgtgcgagagcgaaggtatcggcgtcattccgtggagcccgcttgcgcgcggccgcctgacgcgcgactggaacaccggaagcgcgcgctccgagaccgacgaattcggccgcacgctgtacgcgcagacggaagacgcggatcggcgcattgtcgaacgggtcagcgagatcgcgaaggaacgcggcgtgccgcgcgcgcaagtggcgctggcgtgggtgttgcagaaaaagccgatcaccgcgccgatcgtcggcgcgaccaaactgcatcatctcgacgacgcagtggccgcgctatcattgaatctgagcgcggacgaaatcggcaggctcgaagaattgtatgtgccgcacgcggtgaccggg

SEQ ID NO: 28454 - DNA, 480 bp, Burkholderia fungorum
gacgattggcagcaggtactgtcgaccaatctgaccgcccagttcctgaccgcgcaagcgcccgtgaaggaattccggcgacgcggcccgcggcccgcttccagagcgctcggcaagatcatctgcatgagctcggtgcacgaggtcattccgtgggccgggcacgtcaattacgcggcgtccaaaggcggcgttcagatgttcatgaagtcccttgcacaggaggtcgcgccggaacgcattcgcgtcaactccattgcgccgggcgcgatccgcacgccgatcaacaaggacgcatgggacaccgacgccgcgttgcagaaactattgaagttgatcccctaccgccgcgtgggcgaatcccaggacatcggcaaggccgctgtctggctcgcctcggatgaaagcgactacgtggtcggcacgacgttgttcgtggacggcggcatgacgctctaccctggtttcgacgacaacggt

SEQ ID NO: 28455 - DNA, 762 bp, Burkholderia fungorum
cgtacggtgttggtaacgggcgcttgcggcggcatcggcagcgtgttgtgcaagcgtttcgtggagcagggcgatacggtgctggcgctcgacatcgacgccgcggcgctgaacgcgttgaccgcacaactcggcgaggcgcatgtcacgccggtcgcggtcgatctcggcgatgccgccgcggtgcagcgggcagtggccgcggcagtcgaggtgcgcggtccggtcgacgtgctggtcgccaacgccggcgcggcacaaggtctgacgctggccacgacggatgccgcgagctggcagcgcgacattcatctgaatctgaacggcacgtatcacacggttgaagccgtgcgcgcgtccatgatcgagcggcagcggggcgtgctggtgctgatcggctcggtgaacggcatggccgcgctcggtcatccggcctacagtgcggcgaaggccgggctcatcggttatacgaaggcgctcgcgctcgaactgggccgctacggcattcgcgccaacatcgtgtgtccgggcacggtgaagacgcaggcgtggcaggcgcgcgtcgagaagaatccgcaggtcttcgaagacctgaaaaagtggtacccgttgcgcgatttcgcgacgcccgacgacattgccgacgcggtactgtttctcgcctcgccgatggcgcgcgtgattaccggcgtcgcgttgccggtggacggcggcctgatggctggcaaccgtctgatggcggaagaactgacgctcgaatcg

SEQ ID NO: 28456 - DNA, 1623 bp, Burkholderia fungorum
tccggagacaagcacatggacctgtttggccagatgatgtacgcgccgttactattgtcgtcgttgctccagcaggcggcgcggcactccagcaaggtcgagatcgtgtcgcgccgtgtcgagggcgatattcaccgctacacctatcgcgactgccatatccgcgccatgcaactcgcgaatgcgctgacggcgcacggcatcgaagcaggcgatcgcatcggcacgctggcatggaacggctatcgccacatggagttgtactacggcgtgtccggtatcggcgccgtctgtcataccatcaatccacggcttttcactgagcagatcgccttcatcatcaaccacgcgcaagaccggttcatctgtttcgacatgtcgttcgcaccgcttgtcgagcagattgctcaccagtgtccgcttgtggagaagtggatcatgttgtgcgacgagtcggcattgccggagacattccccgtgccgctggtgagctacgagacgctgatcggcgcgcagcctcaggaattcgactggccccggttcgacgaacaacgtgccgcggtgctgtgctacacgtcggggacaaccggcaaccctaaaggcgtgctgtattcgcatcgttcgctcagcctgatggcctacgcgtcggcgttgccggacacgctctgtctgtcctcgacggacaccgtcgcccccgtggtgccgatgttccatgtcaatgcctggggtctgccgttttcggcgccgctagtgggtgcaaagctcgtgctgcccggagcgaaactcgacggcgaatcgttgtggacgctgttcgagcaggaaggcgtcaccttttcggcaggcgtgccgactatctggttgggcctcgtcgactacatgcggcgtgcaggcaagcgcagcgcgcacttcaggcgcgcaatcgtcggcggatcggcgtgcccgccgcaactggcttcgtcgttgcgcgagctcggcatcaaggcggtgcatgcgtggggtatgacggagctgtcgccgctgggcacggtctgctcgccgtcgcatgactacgcggataaaaccacggaggagcagaagtgcatcgacgcgaagcaggggcgcgtcgtgcccggcatcgatctgaagatagtcgggtccggcggagcggaactgccgtgggacggaaagtcggcgggcgatctgatggcacgcggccactgggtgctggatcgctactacggcgccgggcaaacagcactggaggacggctggttttcaacgggcgacgttgcgacaatcgatccggacggctatatgcagatcacggatcgaagcaaggacgtcatcaagtccggcggcgaatggatttcgtcgatcgaactcgaacacgttgcgatgtctcatcccgaggtcgaatcagcggcatgcattggttgcgagcatccgaaatgggacgagcgtccggtgttgattgttgtaaagcgtcccggcagtacgttgagcgcgcaacaattgttagcgttctacgagggcaaggtcgcaaagtggtggattccggatgacgttgtattcgttcccgagatgccgttgaccgccacggggaagctccagaaactggttctcaagcagcgcttcggccgctat

SEQ ID NO: 28457 - DNA, 1782 bp, Burkholderia fungorum
tatagcgcacccatcaaggacatgctgttcgtgatgaaagaactggccggtctcgaacacatcgcgacgctgccgggcttcgaagatgcgaacctcgacaccgcgcaggccgtgctcgaagagtcggcgaaactgtgcagcgaagtgctggcgccgctgaatgtcgaaggcgatcgcaatccaagcagctggaaagacggcgtggtcaccgcaacgcccggcttcagcgaagcgtttcgccagttcggcgaaggtggctggcaaggcgtgcagcatccggtccactacgaaggccaggggctgcccaagctgattgccacagcctgtatcgagatgctcaacgcgtcgaacctgtcgttcgcgctgtgcccgctgctcaccgacggcgcgatcgaggcgctgctcaccgcgggcagcgaggagcagaagcagacctatgtgcccaggctgatttccggcgaatggaccggcacgatgaacctgaccgagccgcaggccggctccgatctcgcgctggtgcgcacgcgcgccgagccgcagggcgacggctcgttcaaactgttcggcacgaagattttcatcacgtggggcgagcacgacatggcgaagaacatcgcccatctcgtgctggcgcgcacgccgaacgcacccgaaggcgtgaagggcatttcgctcttcatcgtgccgaagtttctcgtcaacaaagacggttcgctcggcgagcgcaacgacgtgcactgcgtgtcgatcgaacacaagctcggcatcaaggcgagcccgactgccgtgctgcagttcggcgaccacggcggcgcgaccggtcatctgatcggcgaagagaatcgcggtctcgagtacatgttcatcatgatgaacgcggcgcggtttgcggtgggcatgcagggtgtgggcgtgtcggatcgtgcttaccagaaggcggtggcatacgcgaaagaccgtgtacaaagccgtcccgtggatggctcagcgaaacagccggttgcgatcattcagcaccccgatgtgcgccgcatgctcgcgaccatgcgtggtctcactgaagcatcgcgcgcgctcgcttatgtggccgcggctcattgcgatatcgcgcaccgtcacgcggacgaagccacgcgcgcggaacaccaggcgatctacgaatacctcgtgccgatcgtgaagggctggagcacggaactgtcgatcgatgtgacgagcctcggcgtgcaggtacatggcggcatgggcttcatcgaggaaacgggcgccgcgcagtactaccgcgacgcgcgcattctgcctatctacgaaggcacgaccgcaattcaggccaacgacctgatcggccgcaagacggtgcgcgacggcggcaaggtggcgaagtcgctgctcgccggggtggctgaaacggttgaggcgctcggcgcgcagcaaggcccggcgttcgcgtcgatgaagaagtatctcgcgcagggtcatcgctcgttgagtgcggtggtcgagttcgtggttgcgaatacgaagagcgatccgaatgcggtgttcgccggcagcgtgccgtatctgaagcttgccggcatcgtgctcggcggctggcagatggcgcgtgcgctgctcgtggcggcagagaagcgtgacgaagacccttcgttctacggcgccaagatcgcgaccgcgcagttctatgccgagcatgtgctgccgctggcgtcggcgctcgaagcgtcgattgtcagtgcgaagggtggcgagagcgtgctggcgctgtctgaagatcagttc

SEQ ID NO: 28458 - DNA, 1167 bp, Burkholderia fungorum
gaagttgttgttgtcagcggtgtgcgcaccgcgatcggcaagtttggcggaagcctcaaagacgttgcgcccaccgaactcggagcgctcgtggtacgcgaggttctcgcgcgcgccggcgttgcgggagacaaggttggccaggtcgtattcggcaatgtgatagcgaccgaacccaaagacttttacctcgcgcgcgtggcagcgctcaacggcggcgtcggccaaacgacaccggcgttcaatgtcaaccgtctgtgcggctcgggtttgcaggccatcgtctctgccgcgcaatcgattctgctcggcgatgccgacatcgcgatcggcggtggcgtggaaaacatgagccgggcaccgtacatcgcgcccgacgcacgctttggcgcgcgaatgggcgacgcgcgcctgatcgatatgatgctcggcgcgttgagcgatccattccacacggtcccgatgggcgttaccgcagagaatgtcgcaaagaagtatggcattacgcgtgaacaacaggacgcgctcgcagtcgagtcgcatcggcgcgccgcccatgcgatcgccgaggggcgcttcaaggatcagatccttccggtaactcgcaccgtgaaaggccggcccgtcgtattcgataccgacgaacatgtgcgtctgcaactggatcccgctgagatttccggactgcggcccgtcttccagaaggaaaacggcacggtgaccgctggcaacgcgtccggcatcaacgacgcagcggccgccgttctgctgatgtcgcgtgaagcggcggacgcaagtggcgtgaaaccgctggcccggctcgtgtcatatgcgcatgccggcgtcgatcctctctatatgggcattggcccggtgcccgcaacgcgccttgcgctccagcgcgccggcctcggcatcggcgatctcgacgtgatcgaggcgaacgaggcctttgccgcgcaagcgtgcgcggtggcgcaggaactcgaattcgatccgcgcaaggtcaacccgaacggctccggcatttcgctcggccatccgattggagcgacgggtgcgctgattaccgtcaaggcgctatatgaattgcagcgtatcaaagggcgctatgcattggttacgatgtgcatcggaggcggccagggtattgcggccatattcgag

SEQ ID NO: 28459 - DNA, 840 bp, Burkholderia fungorum
atcaacaccgttgggataattggtgcgggcacgatgggcaacggcattgctcaggtcgtcgccgtcgcaggattgaaggtagtgctgatcgacgtcaccgaggcagcgctcgcaaagggcatcgccacattgacgggtagcctcgaccggctggtcgccaagggaaaactcgaggctgcggtgaaagaggccgccctctcgcgaatcgagacgtccaccgactatcaacgcctcgctgccgtcgacatcgtgatcgaagccgccacggaaaataccgatctgaagatccgcatcctgcggcagatcgaatcggtggcgcggccggatgcgatcatcgcgtcgaatacgtcgtcgatctcgatcaccgcgctcggagcggcgcttaccgacgcgtcgcgctttatcggcatgcacttcttcaatccggtgccgctcctgccgctcgtcgaaatcattcgcggcgtacagaccagcacagccacgatcgaagccgtgcgtgagctgacagtcaaactcgacaaatcgccgatcagcgtaaagaacgcgccgggcttcgtggtgaaccgcattctggtgccgatgatcaacgaagcgttcttcgtgctcgccgaaggcattgccacagcagaggagatcgacctcggcatgcgactcggcgcgaatcatccgatcggtcctctggcactcgcggatctgattggacttgacgtgtgcctttcggtcctcgatgtcttcctgaaggacttcggcgattcgaagtaccgagcgagcccgttgctgcgcgagttagtggcggctggccgtctcgggcgaaaagtcggtcagggcgtctaccgctac

SEQ ID NO: 28460 - DNA, 1881 bp, Burkholderia fungorum
taccgcgacttccaccgccgttcgatcgagcaccccgaggcattctggcgcgacgaggcacggcgcatccattggcagacgccgttcgacaccgtgctcgaccgttcgaatccgccgttcgcgcgctggttcgtcggcggccgcacgaatctgtgccataacgcggtggaccgccatctggccgagcgcgcgcagcagaacgcgctggtgtacgtatcgacggaaaccggcatcgaacgccgctacacgtacgccgagctgcacgcggagatcaaccggatggccgcggtcatgcgctcgctcggcgtgaagcgtggcgacgtcgtcctgctctatctgccgatgatccccgaggccctgttcgcgatgctcgcctgcgcacggctcggcgcgattcattcggtggtgttcggcggcttcgcggcgcccaacctcgcggcccgcatcgacgacgcgaagcccgtgctgatcgtcaccgccgacgccggcgcgcgcggcggcaaggtgatcgactacacgccgctggtggacgaagcgctcgcccgcgcgacccacaagacgccgcgcgtcctgctgatcgaccggcagctcgcgcccgagcgcctcaacgcgagctatctggtcgcctacgaaccgctgcgcgaacagttcttcgacgcccatgtgccgtgcgagtggctcgaatccaacgagccttcctatgtgctgtacacgtcgggcacgaccggcaagccgaagggcgtgcagcgcgacgtcggcggctacgcggtcgcgctggcggcctcgatggaacatatcttccagggcaagccgggcgacgtcatgttcaccgcctcggacgtgggctgggtggtcggccatagctacatcgtctacgcgccgctgctcgccggcctcaccacggtgatgtacgaaggcacgccgatccgccccgatggcggcatctggtggcgcctcgtcgagcatcacgggatcaatctgatgttcaccgcgccgaccgcgttgcgcgtgctgaaaaagcaggacccggcgttcctgaagcaagccgatctgtcgagcctgcgcacgctgttcctcgccggcgagccgctcgacgaaccgaccgccgcatggatcaccgacgcgctcggcaagccggtgatcgacaactactggcagaccgaaaccggctggccgatgctcgccattccgcgcggcgtcgaggcgctgcccaccaggctgggctcgccgggcgtgccgtcggccggcttcaatctgaccttgcgcaacgaattgaccggcgagccttgcccgcccggcgaaaaaggcgtgctcacactgggctatccgctgccgccgggctgcatgtcgacggtatggggcgacgaccggcgcttcgtcagcacgtactggtcgagcattccgaaccagcaggtctattcgaccttcgactggggcgtgcaggacgaagacggctacgtgacgatcctcggccgtaccgacgacgtgatcaacgtcgccggccaccggctcggcacgcgcgagatcgaggaggcgttgtcgagccacgcggccgtcgcggaagtcgcggtggtcggcgtgacggatgcgttaaagggtcaggcggcgatggccttcgtggtgctgcgcgatgcgcaggcgcatgcgcatgcggacgccacccggcgcggcaaactggaggcggaactcatggcgacggtggaccggcagctcggcgcgattgcgcggccggcgcgcgtcgtcgtggtgtcgatgctgccgaagacgcgctccggcaagctgctgcgccgcgcgatcgcggcgctcgcggaaggccgcgatccgggcgatctgccgaccatcgaagatccggcggcattgcagcaggtgagcgacgcgctg

SEQ ID NO: 28461 - DNA, 2358 bp, Burkholderia fungorum
ccctccagacaaatgcccgacctgctagccaatctcaaccccgaacaacacgccgccgtcacgctccccaacgagccggcgctcattctcgccggcgcgggcagcggcaagacccgcgttctgatcacgcgtattgcctggctgatccagcatgggctggcctcgcccgccacgattctggcggtgactttcaccaacaaggccgcccgcgaaatgatgtcgcgcctctcggcgctcctgccgatcgacacgcgcggcatgtggatcggcaccttccacggtctgtgcaaccgcatgctgcgcgcgcatcaccgcgacgcgggcctgccggccaccttccagattctcgacaccgcggaccagctttccgcgatcaagcgtctgatgaagggcctcaatatcgacgacgaaaagtacccggcgaaaaatctccagtacttcatcaacaacgcgaaagaacaaggcctgcggccgaaagacgtcgacgccacggacaacttcaaccgcaaattcgtcgaactctacgaagcctacgaccagcaatgccagcgcgaaggcgtggtcgactttccggaactgctgctgcgctgctacgagctgctcgcgcacaatccgccgctgcgcgcgcactaccaggcgcgcttcaggcacattctggtcgacgagttccaggacaccaacaagctgcaatatgcgtggctcaagctgctggcgggcgaggccaactcgatcttcgcggtcggcgacgacgaccagtcgatctacgcgtttcgcggcgcgaacgtcggcaacatgcgcgacttcgaacacgagttcaacgttcgccacctgatcaagctcgaacagaactaccgctcgcacggccatattctcgacgccgccaatcagctgatcgccaacaactcgcggcgtctgggcaagaatctgcgtaccgacgcgggtcacggcgaaccggtgcgcgtgtatgaatccgccaccgactcgcaggaagccggctggatcgtcgaggaaatcaaggcgctgatcagcaccggcacgtcgcgcagcgaaatcgcgattctttatcgcagcaacgcgcagtcgcgcacgatcgaacacacgctggtcaatgcgggtatcgcgtaccgcgtgtacggcggcttgcgctttttcgagcgtcaggaagtcaagcacgcgctcgcctatctgcgcctgatcgacaatccgaacgacgacaccgcgttcgcgcgcgtcgtcaatttcccgacgcgcggcatcggcgctcgctcgatcgagcaactcgcggacgcggcgcgtcagtacaactgctcgatggccgcggcgattccgtacgtggcgggcaaggcggggtcgagcctcgcgggcttcgcgaacctgatcggcaagatgcgcgccgaaacgcagcagatgagcctgccggaaaccgtcgaatacgtggtgcgcgcaagtggtctgtcggagttctatcagaacgaacgcgaaggccaggaccgcctggagaacttgcaggaactggtcaacgcggccgcggcgttcgtcagcgaagagggctacggcatggacacgccggcgcgctccattccgctgcgtccgggtgcgaccgccgcgcccgaactggcggtcgccaccgacgatccgaataccatcgtgttcgacgcgcccggcatcgccgatccggcgcaaaacccggacacgatgacaccgctcgccggcttcctgtcgcacgcgtcgctggaggcgggcgacaaccaggcgcaagcgggccaggaagccgtgcaactgatgacggtgcacgcggccaagggccttgagttcacggcggtgttcatcaccggtctcgaagaagggctgttcccgcacgagaacagcgcgatggaatcggacggtctggaagaagagcgccgcctgatgtacgtggcgatcacgcgggccaaggagcggctgtatctgtcgttcgcccagagccgcatgctgcacggccagacgcgttacaacatccgctcgcgtttcttcgacgaactgccgcaggaaacgctcaagtggctcacgccgaagatcgagccgggcgcgcgctggggtggccgttcggacaacgcgggttatgggcgcgactggttcgcgcggccgggttacacgggcgccgcgtcgtcgacgcccgcgccgctgccagcgttcgcgaacgaacagcgtgcagcggaaacgggtttccgcgtgggccagcaggtgttccacaccaaattcggcgaaggcacgatcaccgcgctcgaaggcggcggcaccgacgcaaaggcgcaggtcaaattcaagcggcacggcgagaagtggctggcgctcgcggtcgccaaactgcaggcggtg

SEQ ID NO: 28462 - DNA, 873 bp, Burkholderia fungorum
atgctaaaagttacaaaggcagtttttccggtagcaggtcttggcacccggttcctccctgccacgaaggcgagcccgaaagagatgctgccgatcgtcgacaagccgctgatccagtacgcggtcgaagaggcaatggcggccggcatcaccgaaatgatcttcgtcacgggccgcagcaagcgcgcgatcgaggaccacttcgacaaatcttacgaaatcgaagccgagttgcaggcgcgcggcaaggacaagctgctggaactcgtgcgcagcatcaagccgagccatgtggactgtttctacgtgcgtcagccggaagcgttgggcctgggccacgcggtgctgtgcgccgaaaagctggtgggcgacaacccgtttgccgtgattctcgcggacgacctgctgtacggcacgccgcctgtcatggcgcagatgatcgaggtgttcgatcactatcacagctcggtgatcggcgtcgaagagatcccggcgcaggaaaccaagtcgtacggcatcgtcgacggcaaggagtgggaagattcgatcatcaagatgtcgggcatcgtcgaaaagccggagccgaacgtggcgccgtcgaatcttggtgtggtgggccgctatgtgctcaagccgcgcatcttcgaacatctgcgtgcgctgaagccgggcgcaggcggtgaattgcagctgacggacgcaattcaatcgctgctcgccgacgaacaggtgctggcgtacaagtatcacggcacgcgtttcgactgcggcagcaagctgggttatctgaaggcgacggttgaattcgcgctgcgtcacccggaagtggctgcggatttcgaagaatatctgcgcacgcgttcgccggtactg

SEQ ID NO: 28463 - DNA, 984 bp, Burkholderia fungorum
agccgcgacatcgtctgcctcggccggctcgccgtggatctgtacgcgcagcaggtcggcgcgcggctcgaagacgtgtcgagcttcgcgaagtatctcggcggatcgtcggcgaatatcgcgttcggctgcgcgcggctcggtctcgcgtcgtcgatgctggcgcgcgtcggcaacgatcacatgggccgctttctcaccgagacgctcaccaaagagggctgcgacgtcagccacgtgcgcatcgaccgggaacgcctgaccgccctcgtgctgctcggcctgaaagaccgcgacacgttcccgctgatcttctaccgcgagaactgcgcggacatggcagtcgatgaagcggatttcgacgaggccttcattgcatcgtcgaaagcgctgctgattaccggcacgcacttttccaccgagcaggtgaaccgcacgagccgccgcgcgctcgattacgcacgccgcaaccaggtgcgcaccgtgctcgatatcgactatcgcccggtgctttggggtcttaccggcaaagcggacggtgaaacgcgcttcgtggcgagcgaaggcgtcaccgcgcacttgcagcgcattctgccgctgttcgatctggtgatcggcaccgaggaggaattccgcattgccggcggcaagaccgaactggtcgatgcgctcgcgatggtgcgcgccgtcacgccggccacgctcgtgctcaagcgcgggccgctgggctgccagatcatcgacggccaggtgcccgcctcgctcgacaatgtgccgattcacggcggcgtggaagtggaagtgctgaacgtgctcggtgcgggcgacgcatttgcttccggctttctctccggatggttgcgcgatcaaccgctcgaagcctgcgcgcgcgcggcgaacgcgagcggcgcgctggtcgtctcgcggcacggctgcgcgcccgccatgccgacgcccgccgaactcgactacttcctgcgcgaa

SEQ ID NO: 28464 - DNA, 1146 bp, Burkholderia fungorum
atggcctatattttctatctgacccatatccatctcggctacgacgcgctgtcgcagctatcgtccgaatgcggacgtgtcggcatcaagcggcctttgatcatcaccgacaagggcgtcgtcgcggccggcctcgcgcagcgcgcgctagacgcgctgaaatccggcgccgtgccggtcttcgacgacacgccttcgaacccgaccgaggcgatggtgctcgccgccgcccaggcgtaccgcggcgaaggctgcgacggtctgatcgcggtgggcggcgggtcgtcgatcgatctggccaagggcgtagcgatcgcggccacgcatgccggtgcgctgacgcagtacgcgaccatcgaaggcggcagcccgaagatcacggccgcggccgcgccgctgatcgccgttcccaccacggcgggcacgggcagcgaagtcgctcgcggcgcgatcgtgatcctgaacgacggccgcaagctcggctttcattcgtggcacctgctgcccaagtcggcgttatgcgatccggcgctcacgctcggcctgccgccgggtttgacggcggccaccggcatggacgcaatcgcgcactgcatcgagacttttctcgcgccggccttcaatccgcccgcggacggcatcgcgctggacgggttggagcgcgcgtgggccaacatcgaacgcgcgacggcggacggcagcgatcgcgacgcgcgtctgaacatgatgagcgcctcgatgcaaggcgcgatggcgttccagaaagggcttggctgtgtgcattcgctgtcgcatccgctgggcggcttgacggtgaacggcaaaacgtcgctgcatcacggcacgctgaacgcggttgtgttgcccgcggtgctgcgcttcaacgagacagcggacagcgtggtggctgagcgccgttatgcaagaatgcgccgcgtaatgactttgccggacaacgcggatctcgcgcaggcactgttcgacatgaccgcgcggctcggcttgccgaccggtctcaggcagatgggcgtcgacgaaagcatgttcgacaaggtgatccagggcgcgctcgccgatcattgtcaccgcacgaatccacgcgaagccaccgccgacgactaccgccgcatgctgaccgaatcgctc

SEQ ID NO: 28465 - DNA, 1719 bp, Burkholderia fungorum
cccgacagactttcaccatctcgcatgaataccgaacgcaacgacgcgccagcggcatccaatttcatccgcaacatcattgacgaagacaaccgcaccggcaagtggggccagcgcgtcgaaacgcgctttccgcccgagccgaacggctatctgcatatcggtcacgccaagagcatctgcctgaacttcggcgtggcgcgcagctacggcggcgtgtgccatctgcgctttgacgacaccaacccggaaaaggaaagcgtcgaatacgtcgactcgatcatcgacgccgtgcgctggctcggcttcgagtgggaaaaagacggcaaggaacagctctactacgcgagcgactactacgacaagctgtacgaattcgccgaactgctgatccagcgcggcaaggcgtacgtggacagccagtcggccgaggaaatgcgcgcgaaccgcggttcggccacggaagtcggcacaccctcgccgtttcgcgaacgttcggtgcaggagaacctcgacctgttccgccgcatgaaagccggcgagttcaaggaaggcgagcacgtgctgcgcgcgaagatcgacatgtcgtcgccgaacttcaacatgcgcgatccggtcatctaccggatccgcttcgcgcatcactaccgtaccggcgacaaatggtgcgtgtaccccatgtacgactacacgcactgcatttcggacgcgctggaaaacatcacgcattcgctgtgcacgctcgagttcgaagatcatcgtccgctgtacgactggatcctgaacgagctcgcggaagccggcattttcacgcgcccgctgccgcagcaaatcgaattctcgcgcctgaacctgacctatgcgatcaccagcaagcgcaagctgctgcaactcgtgaccgaaggccatgtagacggctgggacgatccgcgtatgccgaccatcgtcggcgtgcggcggcgcggcttcacgccggaatcgatccagttgttctgcgagcgtatcggcatcaccaaggtcgattcgtggatcgacatgagcgtgttcgaaggcgcgctgcgcgacgatctggacgagaaagcaccgcgcaccgccgccgtcctcgatccggtcaaactgatcatcgacaacttcccggaaggcgtaacggagccgtgcaatgcgccggtccacccgcatcatccggaaatgggcgtgcgggagtttccgatttcgcgcgagctgtggatcgaacgcgacgactacaacgaaacgccgccgaagggctacttccgcctgttcccgggcaacaaggttcgcctgcgctacggctacgtgatcgaatgcattggcgcggacaaggacgagaacggcaacatcgtcgcggttcactgcaactacttcccggacagcaaatcgggcaccgaaggcgcgaacaactacaaggtcaagggcaacatccactgggtcagcgcggcagccgcatgcccggccgaagtgcgtatctacgaccgtctgttcaaggaaccgcaaccggacgccggcggccgcgacttcctcgaagcgctgaatcccgattcgaagcgcgtggtcaacgcgtacctggaaccgggcgcgcgcgaggcgctgccggagcaacgctatcagttcgagcgccacggctacttcgttgccgatcgcgtcgattcgaaaccgggcaagcccgtattcaatcgcatcgtcagcctgcgcgatagttgg

SEQ ID NO: 28466 - DNA, 1122 bp, Burkholderia fungorum
gacttcatcgcgacgctcggtcacgaactgcgaaatccgctcggtccgattgacagcgcgctcgcggcggcgcaaaagttggcagccggcaacccctccgtgctatcggcgctggcgctcgccaacaggcaggtgcggcaactgaagcgcctcgtgagtgacctgcttgacgcatcgcggatacggcacggcaagctgtctgtccgccacgcctacggactactcggcgacatcgtcaaggacgcgatggccgccgtcacggacgaggcagagcgacgtcaccaacagctacaggtgacgctgccggagtacccggtgacggtctttgcagatgctgcccgtctgacccaggtcgtctcaaacctgctgtcgaacgccgtgaagtacacgccatcaggaggtgaaatcaggctacgggtggatgctcccgacccgaatacgatacccgcgcacgattcgacgccgagggacgcaatcgtcaccttgcgggacaacggcatgggtatcgcgccgggcatgctaccgcacgtcttcgacatgttcgcccaatcaccgtccgcgcgaacgcgttcagacggcgggctgggcattggcctgtcggtcgtcagatacctggtcaacgcccataggggcgagattgcagttgtcagcgagggtgagggcaacggtacggaagtcacggtacggctgcctatcgtgtgcagaagtcagctcgaccacgcggcggcgaccacgcacggcatgtccccagctcgcatcctgctggtagacgacaatgcagatgccaccgaggcactcgcgatgttgttgacgctcgacggtcatgaggtcagacgtgcgcagtccggaccggaggcgctctcgatagtcgagtcgttcacgcccgacattgcactcattgacatcaacatgcccggcatggacgggcatgaactggcacgccgactgcgcgagcatgcgcaatgctcatcgacccgtctggtggcactgaccggttacgcagggacaatgccggattccaccgccattgagagcggattcgaccaccgtctcatcaagccgccctcgctcgaggacctcgcgtatgtcttgcgtggttagcttgaccaccaatgcaggagc

SEQ ID NO: 28467 - DNA, 726 bp, Burkholderia fungorum
atggccggagaactgcagggcaaggtcgctgttgtaacgggcgctgcttcagggataggtttggcgagtacccaggcgatgttgactgccggtgctcgcgtcgtgctggtcgaccgcgatgaggcggcattgacgtcaatctgtggggagcacggcgacgcagcttttcctttagtcgtggatttgctcgacccagcagcgtgctcggctctcgtaccccatgtgctggacatcgccgggcaaatcgacatcctgcacgcgaacgccggcacttatgtgggtggcgaactggtcgaggcagacactgcagcgattgaccgaatgctgaatctcaacgtcaatgtcgtgatgaaaaacgttcacgacgtgctgccccacatgattgctcgtcggacgggtgatattgtggtgaccagctccctggcggctcactttccgacgccgtgggagccggtctatgcttcgtccaagtgggcgattaactgctttgtccagaccgtgcggcgtcaggttttcaaacacggaatccgcgtcggttctgtatcgcctggcccggtcatcagtgcactgcttgccgattggcctgaagaaaaactgaaagaagccaaagaatccgggagcctgctcgaggctagtgaggtggcggatgcaatcatgttcatgttgacacggcaacgcggcctgaccatccgcgacgtggtcttgatgcccaccaacttcgaccta

SEQ ID NO: 28468 - DNA, 1452 bp, Burkholderia fungorum
atgttcctcggcattgacctcggcacgaccgaattgaaggtccttttgctgtcaagcgatggaagtgtcgtcgggaccgctcgtcattctttggaaatctcacggccgaggcaccgatggtcagagcaagacccagatgattggtggcgagctacgagaattgcgctttcgacgctacgcaatagccatcccgatgcgtttgctcgcgtgcaggccattggcatgtcgggtcagatgcacggcgctgttctgctcggcgcaaatgacgaaccgttgcgctcagcgatactttggaatgacatgcgcagcgccagcgaatgcgccgaactcgaggcccgcgcaccgagactgcgcgagatagcaggcaactgcgcgatgccaggactcactgcgccgaagcttctatggctggcgcgacacgagccggagtgcttccgacgggtgtcatgcgtggtgctaccgaaagattacgttcgtctgcgcttgaccggcatcaagcttacggacgcgtctgatgcgtcgggaacgctttggctagatgttggacgccggcagtggtccgacgagctcctacatgcctgtgacatgacgcagatgcaggttcctcggattgtggaaggttgccaggcaaccggcgttgtgctcgcaagtgtcgccagtgagcttgggttgtccccaaatgtactggttgcagcgggcggaggcgacacggcgacaagcgcgctcggcgtcggcgcgacagaacctggagagggctttctgtcgctcggtacgtcgggtgtcctttccgtcgtcaccgagcgcttccggccaagcccggaactgggactgcacgcactttgccacgcaattccagacaggtggcaccgaaccagcgtcgtgctgtccgcggctagctgcattcgctggctttgcaagctgacttcggctgacgaaactgctttgttagccgaggtcgagggtgtcagcgcgagcggtcgcactaaagcgccattgttcctgccgtatctttccggcgaacggacgcctcacaatgacccatatgctcagggcgtgttctgcggtcttaatcaatcaacggaccgtgcgacgctcgcttattccgttatcgaaggcgtcacgtttgccctgtccgatggcctcgacgccttgcgtacagatggtactcaggaaacgttggtgaaccttataggcggaggcgcacgcagtacgttctgggcacagttgctcgtcgacgtactcgggatagtgttacgccgtccgtttgacacacattacatcgctgcgctcggcgccgctcgtctaggctggcttgcagctggcggggacttccccgttgtcgtccgtacgcagtcgctatcgcaggagttcttccctgacgacgaacggcgtcaaatactctccgagcggttggcgtcatacagattcctgtataggcaaatgcgaccgctt

SEQ ID NO: 28469 - DNA, 1815 bp, Burkholderia fungorum
atgtgtggcattgtcggcgcggtagcgcaacgtaatatcgtccccgtcctgatcgaaggactgcgtcgcctcgagtatcgcggctacgattcgtgcggcgtggccgtgctcggcagcgacggtccgcgccgtgcgcgcagcgtcgcgcgtgtggccgatctcgacgagcaggtgcgcgagagccatcttgaaggcatcacgggtatcgcgcatacgcgctgggccacgcacggcgcgccggtcacggacaacgcccacccgatcttctcgaaagacgcactcgcgttggtacacaacggcatcatcgagaactacgagacgctgcgcgacatgctgcgcggcaagggttacacgtttgtttcgcagaccgacacagaggttatcgcgcatctgattcacagcctgtatcacggcgatctgttcgcggcggtgcgcgaagcggtcgggcaactgcacggcgcgtatgcgatcgccgtgttgcataaagaccagccgcatacggtggtcggcgcgcggcagggttcgccgctggtggtcgggctcggcgagggcgagaacttccttgcctcggacgcgttggcgctcgcgggcagcaccgaacggttcatcttcctcgaagaaggcgacgtctgcgaactgacgctcgagggcgtgcgcatcgccgatcgcgacggctacgaggcgcagcgcgaagtgcgccaggtggcggcgtatggcggcgcggtcgaactcggcccgtatcgtcacttcatgcagaaggaaatcttcgaacagccgcgcgcgatcacggacacgattccgcaagcggattcgttcgacccgtcgttattcggcgagggcgcgggcaaggtgttcgcggagatcgacagcctgctgattctggcgtgcggcacgagctattactcggggctgaccgcgaaatactggctcgaatcgatcgcgaagattcccacgcaggtggaaattgccagcgagtatcgttaccgcgagtcggtgccgaatccgaagtcgctggtcgtcgtgatctcccaatcgggcgaaacggcggacacgctggcggcgctcaagcatgcacaggagctcggtcacaagcatacgctggcaatctgcaacgtcggtacgagcgcgatggtgcgccagaccgagctggcgttcctgacgcacgcgggccgcgagatcggtgtggcatcgaccaaggcgttcacgacgcagctggttgggctgttcgtgttggcggcaacgctgggcaagttgcgcgggcgtgtgagcgaagagcaggaaggggagtatctgaagcaactgcgtcacttgccggcggcattgaatagcgtgctggcgctggagccgcagatcattgcgtggtcggaagagttttcgcgcaaggagcatgcgctgtttctcgggcgcggcttgcattatccgatcgcactcgagggcgcgctcaagctcaaggagatctcgtatatccacgccgaggcttatccggccggcgagttgaagcatgggccgctcgcgctcgtgaccgaagccatgccggtggtgacggtggcgccgaacgacgcgctgctggaaaagctgaagtcgaatattcaggaagtgcgcgcgcgcggcggtcagctgtatgtgttcgccgacgcggatacgaagatcgtcaacgacgaaggtttgcatgtgatccggatgccggagcattacggcctgttgtcgccgatcttgcatgtggtgccgctgcagttgctggcgtatcacacggcgtgtgcgcgcggtacggatgtggataagccgcggaatctggcgaagtctgtgacggtggag

SEQ ID NO: 28470 - DNA, 1383 bp, Burkholderia fungorum
gatttcattgttgccgacatgtcgcttgccgactggggccgcaaggaactgaacatcgccgagacggaaatgcccggcctcgtgcaaacgcgtgaagagtacaaggtgcagcagccgctgaagggcgcgcgcatcgcaggttcgctgcacatgacgatccagaccggcgtgctgatcgagacgctgacggcgctcggcgccgacgtgcgctgggcctcgtgcaacatcttctcgacccaggatcatgccgccgcggcaatcgccaaggccggcacgccggtgttcgcattcaagggcgaatcgctcgacgaatactgggagttctcgcaccgcattttcgaatggccgaacggcgagttcgccaacatgatcctcgacgacggcggcgacgccacgttgctgctgatcctcggctcgaaggccgagaaagaccgttcggtgatctcgaagccgaccaacgaggaagaagtcgcgctgtacaagtcgatcgagcgccatctggacgccgacccgacgtggtactccacgcgccttgcgcacatcaagggcgtgaccgaagaaaccacgaccggcgtgcaccgtctgtatcagatggaaaaagaaggccgcctgccgttccctgcgatcaacgtcaacgactcggtcaccaagtcgaagttcgacaacctgtatggctgccgtgagtcgctggtcgacggcatcaagcgcgcgaccgacgtgatgatcgcgggcaagatcgccgtggtcgccggttacggcgacgtgggcaagggctgcgcgcaatcgctgcgcggtttgggcgccaccgtgtgggtcaccgaaatcgatccgatctgcgcattgcaggcggcgatggaaggctaccgcgtcgtgacgatggaatacgcggcggacaaggccgacatcttcgtgacggcgaccggcaactaccacgtgatcggccacgaccacatgaaggcgatgcgtcacaacgcgattgtctgcaacatcggtcacttcgactcggaaatcgacgttgcgtcgacccgtcagtaccagtgggacaacatcaagccgcaagtcgaccacatcattttcccggacggcaagcgcgtgatcctgctggctgaaggccgcctcgtgaatctgggttgcgcgacgggccacccgtcgttcgtgatgtcgaactcgttcacgaaccagacgctcgcgcagatcgaactgttcacgcaaggcaacaagtacgagaacaaggtgtacgtgctgccgaagcatctggacgaaaaggtcgcacgcctgcatctggcgcgcatcggcgcgaacctgaccgtgctgtcggacgagcaggccggctacatcggcgtcgacaagaacggcccgttcaagccgaaccactaccgctat

SEQ ID NO: 28471 - DNA, 1572 bp, Burkholderia fungorum
tacgactacatcatcgtcggcgcaggctcgggtggctgttcgctggcgagccgtctcgcggacaactgcccggacgcgacgattgcgctgatcgaagccgggccgcacacggaccgcaatctgttcgtcaacatgccggtcggcgtggcggccgtggtgccgcacaagctcaaaaccaactacggatatctgaccacgccgcagccgggactcggcgggcggcaagggtatcagccgcgcggacgtggcttcggcggatcgagcgcgatcaacgcgatgatctacacgcgcggccatccgctcgattacgacgaatgggctgaactgggttgcgaaggctggtcgtgggcggaggtgctgccgtactttcgccgcgccgaaggcaacgaacgcggtgccgacgcctggcatggcgatagcggcccgctcaccgtctccgatctgcgctatcagaatccgttttcgcgccgtttcgtgcaggcggcgatggaagccggctacaagccgaatagcgacttcaacggtgcggagcaggaagggatcggcttctatcaggtgacgcagcgcgacgggcgccgttgcagcgtggcgcgcgcctatatctacgaccgcgcgcgccccaatctgcacacgatcgccgacgcgacggtgctgcgcgtggccttcaaaggcaagcgcgcgagcggcgtggagatcgtgcgcggcggccgccgggaaacgctcgaagcgcgcgccgaggtggtgctcgccgcgggcgcgttcaattcgccgcaactgctgatgtgctcgggcatcgggccggcggcgcacttgcgctcgttcggcattccggtgctgcacgacgcgccggaggtcgggcagaacctgatcgaccacgtcgatttcacgatcaacaaacgggtttcgtcgatcgagccgaccggcttttcgattcgcggcattgcgcggatgctgccgcagttcgttactttcatgcgccacgggcgcggcatgctgtcgagcaatgtcgccgaagcgggcggttttctgaagagcagcccgacgctcgagcggccggatctgcagttgcacttctgcgcggcgatcgtcgacgaccacaaccgccacatgcattggggccacggttattcgctgcacgtgtgcgttttgcgaccgcatagccgtggcaccgtgacgctggcgagtgccgatgcgcgcaccgcgcccgtgatcgatccgcgctttttcagcgactcgcgcgatctcgacctgctggtggaaggcgcgcagatggcgcggcgcatcctcgatgcgccttcgctcgcgctgcacggcggccgcgagttgtacacgcatcccggccagtcggaggcggagttgcgccggaccattgccgagcatgccgacacgatctaccacccggtggcaacgtgccggatggggggcgacgtgcgctcggtggtcgatccgcaactgcgggtgcggggcgtcacggggctgcggatcgtggatgcttcggtgatgccgacgctgatcggcggtaacaccaattcgccgacggtgatgatcggcgagcgggccgccgagctgatc

SEQ ID NO: 28472 - DNA, 1398 bp, Burkholderia fungorum
ccggaagtagccgcgctcgaagcactgctgcgcgatcagcgccatgcttatctgcgcgcgccgtatccgtcatgggagacccgcgccgcgcacctgaaagcgctgcgcaaagtcatgctcgacaatcgcgacgccctcgccgacgcgatgaacgtcgacttcggcaatcgcgcgaaacaggaagtgctgctcgccgaattcctgctggtgaaggaggagatcgacgccgcgcttcggcacggcaagcgctggatgaaatcgcagcgccgcagcaccagcaaatggctgctgccggcgcgcgccaaagtcgtgccgcagccgctcggcgtggtcggcatcatcgtgccgtggaattatccggtgctgctcgccgtcgggcccctgatcagcgcgttgaccgcgggcaatcgggcgatcatcaagatgtccgaactgacgccgcgcacttcggcattgttcgagcagttgatcggccagaccttcgcgcgcgatcacgtcgcggtggtgaacggcgacgccgcgctcgccgccgcgttcagcgcgcagcccttcgaccatctgctgttcaccggctcgaccagggtcggccacgaagtgatgcgcgccgccgccgagcatctgacgccggtcacgctcgaactgggcggcaagtcgccggccatcatcggcgcgcatgcgcgcttcgacaacgcggtggacaacctcgtcgccggcaagacgctcaatgcggggcagacctgcgtcgcgccggactacgtgctggtgccgcgcggcaaggagcaggcgttcgtcgagcgggcgcgcgcacggatggcgaggatgtacccgaacttcgccaacaaccccgattacacgacgatcatctcggcgcgtcacttcgcgcgcctcgaacgtctcgccgacgaagcccaggccgccggcgcgcaactgcacccgctcaccgacagttcgcccgatgcggcaagccgccgctttccgctgatcgccgtcacgaatgcgccggacgcgtgcgcgctgatgcaggaggaaatcttcggcccgctgctgccgatcgtcccctacgacacgctcgacgacgcgatcgcgtggatcaacgctcgtccccgcccgctcgcgctgtatctgtatgccgacgacgccgccaccatcgggcgcgtgacgcacgaaaccatcgccgggggcatggcggtcaacgagacgctgatgcatctggcgtgcgaaagcctgccgttcggcggagtcggggcgagcggaatgggcgcatatcacggctacgaaggcttcgtgacattctcgaagatgaagccggtgctgacgcaggcgcgtctgaacgcgcgcgggtggatatcgccgccgtacggcaaacgggtgaatgcgctgctgaagctgatgatgcgg

SEQ ID NO: 28473 - DNA, 1290 bp, Burkholderia fungorum
gggcgtctcacccgcgccgccggtctggtgctcgaagcggtcggcctgcgcctctcggtgggcgccgaagtgatgatcgaactgccgcaaggcagttcgctgccgatggccgaggccgaagtggtcggcttctccggcgacaaactgtttctgatgccgaccaccgaagtgatgggcctgctgcccggcgcacgcgtgtttccgctcgaaagcgcgccgatcgccgatccgatggcgggcgccaagcgcctgccggtcggctgggaattgctcggccgcgtgctggatgcgtccggccgtccgctcgacggactcggtcctctcggcgcgcatgccgacgcgccgctgtccgcaccggtcatcaatccgctgaaccgcgaaccgattcacaaggtgctcgacgtcggcgtgcgcgcgatcaacgcgctgctgaccgttggccgcggccagcgcatgggcctgttcgccggttcgggcgtgggtaaatcggtgctgctcggcacgatggcgcgctacaccagcgccgaagtgatcgtgatcggcctgatcggcgagcgcggccgtgaagtgaaggaattcatcgagcagattctcggcgaggaaggtctggcgcgctccgtggtgatcgccgctcccgccgacgtctcgccgcttctgcggatgcaggctgcgtcgtattcgacgtcgcttgccgaatatttccgcgaccagggcaagcacgtgctgttgctaatggattcgctgacccgttacgcgatggcgcagcgcgagattgcgctggccgtgggcgagccgcccgccaccaagggctatccgccttcggtgttcgccaagctgccggcgctcgtcgagcggaccggcaacggcccggcgggcggcggctcgatcaccgcgttctacaccgtgctgaccgagggcgacgaccagcaggacccgatcgccgactccgcgcgggcgattctggacggccacatcgtgctgtcgcgctcgctggccgaagccggccactatccggccatcgacatcgaagcgtcgattagccgcgcaatgaccgcgttgatcgacgataaccatctcgagaagacgcgtatgttcaagcagatgctgtcgcgctatcagcgcaatcgcgatctgatcaacgtcggcgcgtattcgagcgggcgcgatgcgctgctcgaccgtgccatcgcgctgtatccgcggatggaagcatttttgcagcaaggttttcgcgagtgcgcgaactttgaaccgagtctcgaaatgctggacgcgctgtttgcccaagga

SEQ ID NO: 28474 - DNA, 817 bp, Burkholderia fungorum
acagaacgtggtcgcaggtatcttgcgcgcatcgccgcgatcgagggcggatgcagtgaaggcataccggccttcaacgtcaatcgccggtgcggttctgggctgcggcccgtcatttcggcgagccagtccatcgtgcctggtgacactgagattgccatcggcggcggtgcagagaacatgagccgcaccccctacattgcagccgccgcgcgctggggcgcccgcatgggcgatagtacgatgatcgacatgatgcccggtgcgctgcacgaccccttccatgggatccatatgtgtgtgacgctggaggacatgatgcgtctcaaacccgcgtttgtcatggaaaacggaactgttaccgctggcaacgcgtcgggtatcaacgacgcggcggcagcactcgttctgatggagcatattgccgccgaggagcgcggcaccaaaccgctggcccgactggtcgcgtacgcgcatgccggcgtcgaccccagatacatgggtatgggatccgtgccgctcacccggttggcgctacaacgggctggccttgcggtggatggacttgacgttatcgagacccacgaggctttcgcggcacaggcatgtgcggtgactcgcgcgctggggctggaccccgccaaggttaatccgaatgactcggaaatcccgttgggccatccggtcggggcaaccggtgcggtgattacgataaaaggccctgcacgaactgctacggacaggcggccgttacgcgctggtgacgatgtgtatcggtgacggaccgggtatcgcggctgtcttcgagaatctcaat

SEQ ID NO: 28475 - DNA, 678 bp, Burkholderia fungorum
ttggcgcaccgcacgataatcgtcacgggcgggctgggcgcgttggggcgcagcgtcggtgcagtgctggccgcacggggcgcgcgtgttgtgctgatcgatcgcgcagagccaaccgcggtagcgggtgtcgccgcggtcgtcggcaaggtcgatctgggagagcgcgagagcaccgcgcacgctttcgcggacgtggcccggcaactgggcggcttcaacgcacttgtgaacgtcgccggcggcttcgcctgggaaacgctggaaggcggcagcgtcgaaacatgggaccgcctctacgcgatgaacctgcgcagcgcggtcgtcgcgtctcgcgaagcgctgccccatttgctgcgccagcctcccgggcgcatcgtcaacgtcggcgcgctcgccgcgcagaaggccggcgcgggcatgggtgcctatgccgcctcgaaggccggtatcgcgcgtttgaccgaagcgctcgccgacgagctcaaggatcgcaatatcaatgtgaacgccgtgttgccgaacgttctggatactccggcaaaccgcgccgacatgccggatgccgatgcgacgcgctgggtatcgaccgaagcgttggccgccgtgatcgcctttctgctgtccgacgacgccggtgcggtaacgggcgcgtgcctgcccgtcgcgggacgcatg

SEQ ID NO: 28476 - DNA, 747 bp, Burkholderia fungorum
atcgacggccgccgggcgattgtctgcgcgtcgtcgcgcggtcttggcaaggcttgtgcgcttgccctcgcgcgcgagggctgcgaggtgttcatcaacggccgtgacgaagcgaggctcggccaggcggcgcgcgagatcgagcaggccagcgggcgccgtccgactcccgtcgtcgccgatctcgactccgatgcgggacgcgccgcgctgctcgccgcgtgtccgcagcctgacatcctcgtgaacaacaatgctggcccagcgcccggcgaactggagcaatgggatcacgcggcgtggctggcggcgctcgaggcgaacctgctcgcgcctatcctgctgatgtccgctgtcgttcccggcatgcggacgcgcaagttcggccgcgtcgtcaatatcacgtcggcggtcgtcaagtcgccgcgcctcggcatgagcctgtccacgaccgcgcgcaccgggctgaccgcattcgccaagggcctgtcacgcgaagcggtcgccgacaacgtcacgatcaacaacctgcttccccagcatatcgacacggaccggcaggaatacatggcccggcggatcatggaggaccgcgggatcaccttcgcacaggcgcgctcgcttcaggtgaaatcggtgcgtgcgcgccggctcggcaggcccgaggaattcggcgacgcctgcgcgtttctctgttcggcacaggcatcgttcatctcgggacagaacctgcaactcgatggcggc

SEQ ID NO: 28477 - DNA, 741 bp, Burkholderia fungorum
ctgcttgagcagcgagtggcactcgtgaccggagcgggcggcggaattggccgcggcgttgcgcgctcgttcggtaacgaaggtgcagcggtgattatcgcggagatcaacgaaagcacgggccgccaggtcgagcaggaaatccgcgagatggggggccgctcgctgttcgtcaaaaccgacgtcacgagcaaggcgtcgattgaagcagcggtgcgcagtgccgtcgagcagttcggcagtctcgacattctcgtcaacaacgcgtttgttccgacgccgaatgtgctactcgaagagaagaccgacgagatgctggagcagacgctcacgacctcgttgtgggcgacctggtgggccatgcgcgccgcgtttgtgcccatgcgcgagcggcgctgggggcgcatcgtgaacttctactcgatcgacaccgagacaggcgcatggctccatggcgattacaacacggcgaaggcgggcatcgtcgggctgactcgcagcgccgcatcggaatggggacgcttcaacatcaccgttaacgcgatcgcgccgacggcaatgggtgcgaccttcttcgagctggcggcgaagaacccggagtttgccgaacgctcggccgcggcgcggccgctcgggcgcagcggggacccggagcaggacatcgggcctgccgcggtgttctttgcgtccgagatgtcacgcttcgttacgggcgaaacactgcatgtcgacggtggcctg

SEQ ID NO: 28478 - DNA, 1491 bp, Burkholderia fungorum
gttgccgcacatccggaccgggtgctgctcgacttctcgggcgatctgtacacctatgcacaggtcgacgggctgtccacccgtcttgccaattcgctcgccgagctcggcgtgacggcgggccagacggtcgtcacgatgctcgacaacaatctcgacgccgtgatcacatggctcgcgatcaacaagctgtgtgcggtcagcgtgccgatcaataccgccctgcgcggcgaattcctgcgtcaccagctcgacgacgcgagtgcacggctcgtcatctgcgagggcgattacgtcgaacgcatcgcggccattgccgatcagctcaaggaagccacacgcgtactgcatcgcggcgcgaccaccgtcaggaaatgcggcgcgctcgcgctcgcgcctctcgaccagcaccgcggcagcgacgacacgccgctcagccgcaagccgaatccgtgggacctcgcgagcctcatctatacctcgggcacgaccgggccgtccaaaggctgcatgatcagctacaacttcatgtgcaatctcgcgcgccagcagttgcgggcgggcccggcaacggcgaacgacatcacgatcacgccgctgccgctctttcacatgaacgcgcttgcggtcggcgtgctctcgaacatactcgtgggcgcgcgcgtcgccatcgtgccgcgcttctcggtatcgaaattctggtccgaggtcgagcgcagcggcgcgaccatcgcatcgattctcggcggcatgggcggtctgctcgccaacgcgcccgacgacgaagctgcgaaacgatgctacggacagattcatacggttcgcggcaacccgtttaccgaagcgaccaagcagatatggcgcgagcgcttcggcgcgaggcaggtcggcggcaacggctacgggctgaccgaggcgtgcgtgatcacgtcgctgccggccggcgagtatgcggcgccgggttcctcgggcaagcgcattcccgagttcgacgtacgcatcgtcgacgaactcgaccgtgagctgcccgcgaaccaggcaggcgaaatcgtctgccgtccactgcaccccgacgtgatgttcatgggctactggcaccggccggaggacacgctcaagctgatgcgaaacttgtggtttcatacaggcgacattggcaagttcgacgacgatggtttcttctacttcgtcgaccggaaaaaagactatctgcgcaggcgcggcgagaacatttccagcttcgagatggaatcggcgttttcacgtcatcccgacatcgccgaagtggccgtgcatgccgtcccgtcggacaagggcgaggacgacgtcaaggtcacagccgttctcaacccggatgccgcgctgacggccgaagcactgtttcactgggcaactgacgccgtgccgtattacgcgctgcctcgctacatcgaattccgcgacacactgcccaagaacccgcaaggccgcattctcaagtaccagttgcga

SEQ ID NO: 28479 - DNA, 834 bp, Burkholderia fungorum
aaggtcgtggtggcgggcgcggggctgatgggcaccggcatcgctcatgcgttcgtgagttcgggtttttcgaccgtgctggtcgacaccgacgacaacgcgctcgagcatgcccgtcaggcaatcggcaagatactcgacgacggcgtgcggctcggcaaggtgcaggcagccgacgcgcaagctgcgctgagccggttgtcgatcgagctcgagctgaagaagggcgcggcgggcgcccggctgctggtcgagaccgtgacggagaagctgcccgtcaagcaggcggtgctggccgaggcggcggcggtgatggcggacgaggcgctctacgcgaccaacacgtcggcgctcagcgtgaccgaaatcgcgacggccgtgacgaagccggaacgcgtgatcggcatgcacttcttcaatccggtccacaagatgaagctggtcgagctcgtgcgcgggctcgcgacgagcgacgaaacggtggccggcgcgcgcgaatactcggacgcgctcggcaagacctcgatcatcgtcaacgaagcgccgggcctcacgacgagccgcatgtcggcgctgctcggcaacgaggccatgtggatgctccaggatggcaccgcgagcgccgaggacatcgacaccgccttgcgtctcggcttcaatcatccgatggggccgctcgaactcggcgacctcaccggctgggatacacgcctgtccgtgctgaagtatctgcatcagacgcttggcgagaagttccggccgtgtccgctcgtcatcaagatggtggcggcagggcgtctcggccgcaagaccgggcacggcgtctatcgctac

SEQ ID NO: 28480 - DNA, 1158 bp, Burkholderia fungorum
cgtgacgtcgtcatcgtggatgccgtacgtacgccgatcggcaagtttcgcggcgcactcgccggcgtgcgtgccgatcatctcggcgcgcttgtcatcgatgagctgattcggcgcgcgggcgtaaagccgcaggccgtcaacgacgtcgtattcggctgcgtcacgcagatcggcgagcagtcggcgaacatcgcccggacctccgtgctcggcgcgggctggcccgagaccattccgggcctgacgatcgatcgcaagtgcggttccggcgaagaggcggttcacatcgccgcgggcctgatcgcgttcggcgcggccgatgtaatcgtcgcgggcggcgcggagagcatgagccgcgtgccgatggggagcaaccgcgacctgcacggcgaagcgttcggctggatggcgagcgagcgcttcgagctgacgagccagggcgaggcggcggagcgtctgtgcgattgctgggcgctcacccgcgcgcaactggacgcgtactcggtcgagagccatcgccgcgcggccgcggctgcggccgaaggctggttcgcgcgcgagatcgtgccggtgccggtcggccaggtgcgcgagaagtcgctcgaaggcgaggcggcgcttttcgccgccgacgagacgatccgtccggggaccaacgcggacaagctcgccacgctgaaatcgagctttcgcagcgacggccgcctgacggccggcaactcatcgcagatctctgacggggcggctgcgctcctgctgatgtcgtcggacaaggcgcgcgagctcggcgtgaaagcgcgcgcgcgcgtgcgcgcggtgacgaccgtcggctcggacccgacgctgatgctgaccggcccgatcctggcaacgtgccaggtgctggaaaaggcgggtctcgggctgagcgacatcgatctgttcgagatcaacgaggccttcgcgccggtgccgctggtctggatgaaggaatttggcgtgccgcacgcgaagctcaacgtgaacggcggcgcgatcgccctcggtcatccgttgggcgcaagcggcgcacgcatcatgacgtcgatgctgcacgaactggagcgccgtggcgcccgctacggtctgcaggcaatctgttgcgccggcggcatgggcacggcgacgctcatcgaa

SEQ ID NO: 28481 - DNA, 1137 bp, Burkholderia fungorum
cgcaggataaccgacatgcgaaccgtattccgggaagatcacgaactattccgccagcaggcgcgtcgtttcatcgaaaacgaaatcgtcccgcatctgcacgaatgggaacacgccggcatcgtgccgaaggaactctggcgcaaggccggcgaaatcggcctgctctgctctaccgtcccggaggagtatggcggcagcggcggcgacttcggccactcggccgtgatgatcgaggaactggcgcgcgtcaatgcgacggcagtcggattcacgacgcactcggagatcgttgcgccctacatcgtcgcctacggcaccgaggagcagaagcgccggtggttgccgcgcatggcggcgggcgagctggtcggcgtaatcgcgatgagcgagcccggcatcggcagcgatctgcgttcgatgcgaacgaccgctcagcgcgagggcaacgactacatcgtcaacggccagaagaccttcatcacgaacggtggcaatgccggcctcgtcgtgaccgcgaccaagctcgatccgcaatccagggacctgacgctgatctgtgtcgaggaagacatgcccggattctccaggggaaagctgctggagaagatcgggctcaaggggcaggacacggcggagctgttcttcgacaacgtccgcgtgccggccggattccggctcggcgaggaaaacaacggctttcgctacctgacgcatcagctcgcctgggagcgcacgatcatcggcattcgcgcggcggcctccatcgactcgctgctggacgaaaccgtcgggtacacacgtgatcgtcaggtgttcggcaagcggctgttcgactttcagaacacacgcttcaagctcgccgaggtcaaggcacaggccacgatgctgcgcgcgttcgtcgacgattgccttggcaaggccatgagcggagagctgaccgccgaggtcggcgcgatgtgcaagctggtgggctccgagctgcaaggcaagctgctcgacgagctgctgcaattgcacggcggatacggcttcatgagcgaataccggatcagccgtgcgtgggtggatgcgcgcgtcgcgcgtatctatggcggtacctcggaaatcatgaaggaaatcatcggtcgctcgctt

SEQ ID NO: 28482 - DNA, 789 bp, Burkholderia fungorum
tttctgatcgtcgagcatgaaggcgccgtgctgagcgcgcgtctgaacagcccgcaaacgcgcaacgcgctgtccgaacccgcgcagatggacgagctggtcgagctgtgcaaccgggtgcggcgggaccgcaccgtcaaggcggtcgtgctgagcggagaaggtagcgcgttttgcgcgggcggcaacgtaaaggacatgcgcgagcgcggcggcatcttcgccggttcgccgcacgatctgcgcgagagctaccgcaacaccatccagcgcattccgctggcgctctacgagctcgacgtgccggtgatcgcagcgatcaacggaccggcgatcggcgcggggctcgatctcgcctgcatgtgcgacatccggattgcatcggacaaggcgctgttcgccgagagcttcgtcaaggtcggcatcgtgccgggcgacggcggcgcatggctgctgccgcgcgcgatcggcatgcagcgcgcgagcctcatggcgttcacaggcgaaacgatcgacgccgcgaaggcactggaatgggggcttgtcgccgaagtagtacccgccgaccggctgatcacgcatgcgctgggcctcgcgcagcgcatcgccggcaatgcgtcgcacgcgctgcggctcaccaagcgcctgctgcgggaaggccagcacatgcgcctcgattcgctgctggagatgtcggcggcgtatcaggccctcgcgcatcacacgcatgaccacctcgaagcggtcaacgcgtttcttgagaagcgcgcgccgcaattcacggaccgc

SEQ ID NO: 28483 - DNA, 756 bp, Burkholderia fungorum
cttcgcaacaagcgtgtcatcgtcaccggtgcgtcgcgcggcatcggccgcgcgattgcccgcgcattcgccgcggaaggcgcgcgtgtcgccatctgcgcacgcaccgccgccgacctcgaagccgccggcgcggaccttcagtctcgcggtgcaggcgacgtgatcgcccgcgccgtcgacgtcacggacacggccggggttcggcaattcgtcgaagacatcgccgcgcgctgggggggggtcgacgtgctgatcaacaacgccggccaggggcgtggcggcaatctggaaaccctgacacccgagcagattctcgaacacgcgaacgtgctgcaaatgggacacttccgtttcgtgcaggcggtcgtgccgcacatgcgccaacagcgctggggacgcatcgtcgaaatcaacgcgctggccggcgtggtgccgacgccggacggcattccatcggtggtcaaccgcgcagcctgcatcgcgatgtcgaagtcgctcggcatgtcgctcgcaaaggacaacatcctcgtcaacacgctcaacatgggctggatcgatactggccagtgggaccgacactaccgtgagatgccggcgggatgctcgcgagaggagttcgaccagatggtcctgaaagtcgtgccgcttggacgcttcggcaagcctgaggacgtcgcggggatggcgttgtttctcgcaagcgattacgccagtttcatcagcgcggcgtcgatcgacattgccggcggcatg

SEQ ID NO: 28484 - DNA, 726 bp, Burkholderia fungorum
aacgaactggacttctcgggcaagacggtcctggtggtcgggggatcgagcggcatcggcaatggcattgcgcgtgcgtttctcgagcgcggcgccacggtccatgtctggggcacgcgccgcagcgcgtccgactatgcggactcacccgattccagcctgacggacctgcactacgcccagctcgacgtttccgatgcagccagcgtcgagcgctgtgtgctgccgttcgcgtcgctcgacgtgctggtccaggcccagggcaccgtgctctacgaccgtcaggaattcaaggcgccggcgttcaggaaggtgctcgacgtcaacctgacgagtctgatggcatgtgcggatcgctgcttcgaggcactgaaggcggcgcgcggcgcgatgatcatcgtcagctcggccgcggcgtttcattcgacgcgtggcaatccggcctacaacgcgtcgaagactggcgcgttcggactgacgcgcacgcttgcggaagcctgggcgcgcgacggcatccgcgtgaacggcatcgcgccgggcctcgtcgacacgaagctcacgcgcgtgaccaccgcggatccgaagcgcctcgacgcggccttgcgccgcatcccgctcgggcgtctgggcacagccgccgacatggccggtggcgcgctgtttctcgcctcgccgctgtcggcgtacatgctcggacaaaccttgctgctcgacggcggcatgttg

SEQ ID NO: 28485 - DNA, 1044 bp, Burkholderia fungorum
ctcgtcaagccgttgcagcagcgggtcaaggagcgccggctgtgggcctgtcacctcggccccgaactgggcggccccggctatggacaggtgaagctcgcgctcatgaacgagattctgggccgcgcgctgttcgcgccgatcgtgttcggctgccaggcgccggactcaggcaacgcggaaatcctcgcgcattacggcacggaggcgcagaaggagcgcttcctgaaaccattgctcgccggcgacatcgtgtcctgcttcgcgatgaccgagccgcagggcggcgccgaccccaaggtgttcacgacccgcgcggtgcgcgacggcgatgcgtgggtgatcaacggacgcaagtggttcgcgtcgaatgcgcgctacgcggacttcttcatcgtgatggcgatcaccgatccggaagtgtcggcgtacaagggcatgtcgatgttcatcgtgccggcgaacacgcccggcctgagcatcatccgcaatgtcggcatggccgacgagccggaggcgacacacgcgtacctggcgttcgatgacgtgcgcgtggcggacgaacagatgctgggcgcgccgggcgacgcgtttgtcgtcgcgcaggtgcggcttggcggcggccgggtgcatcatgcgatgcgcacgatcggactcgcgcagaaggcgctcgatgcgctatgcgagcgcgcgctgtcgcgccatacacagggcggcgcgctcgccgacaagcagatggtgcaggagaagatcgccgactcctggctcgaactcgaacagtttcgtctgctcgtgatgcggaccgcgtggcgcatcgaccgttaccaggactatcagaaggtgcgcaaggacattgccgccgtgaaggccgcgatgcccagggtattgcacgacattgccgcgcgcgcgctgcatgtgcatgggtcgatcggagcctcgtcggagatgccgttcgcgggaatgatctcgcgtgcgtttcagatggggctggccgatgggccgaccgaggttcacaaggtgacggtggcgaagcaactgctgcgc

SEQ ID NO: 28486 - DNA, 759 bp, Burkholderia fungorum
ctcgaaggcaagcgcgtgatcgtgacaggctgcgcaagcggcattggcgcgagcgccgtcaaggcactggtacgggccggcgcggaggtggcggcgctcgatctgagcgacgaggcgggccgcgccgtagccgcggacgcttcggcggcgggcccgggtgtggcgcactacttcagttgcgacgtcagccgcaaggaccaggtcgacgaggtcttccgctcggccgtcacgcgcctcggcgggctggatgcgctcatcaacatcgcgggtgtcgagcgcaaggcgccggccgaagcggtcacgcaggacgattgggacctgatgttcgacgtcaacgcgcgcggcacgctgaacacgaaccaggcggcattcgcgtggctgcgcgagcacggcgggcgcatcgtcaacttcgcctcggcggctggcgtgatgggcgtgccggggcttgcgcactactcggcatcgaaggccgcggtgctcggctggacgcgcaccgccgcgaaggagtggggcaaatacggcatcgcggtcaacgccgtggcgcccgcgatgtggacgccgatgtacgagaagttccgcgcgcggctcgacagcgcgcaactggccgcgcacgacgccatgatggcgcagcaggttccgctaggggggcggctcggcgacccggacaagtcgatggcgccggtgctggtgtttctggtcagcgacggcgcgaacttcatcaccggacagacgctggccgtcgacggcggtctgatgatt

SEQ ID NO: 28487 - DNA, 702 bp, Burkholderia fungorum
gacaaggttgtcatgatcacgggcgcgagcagcggcatcggcgaagcaacggcgcgccggctcgcgcagcagggcgcgaaactcgtgctggcggcgcgcaggagcgagcgcctcagtcggctggccgcccagctcggcggcgccgaccgcgtgctgtgggacgccaccgacgtgacgaagcccgaagcgctccagcaactcgcggcgacggcgcgcgagcgtttcgggcacctcgacgtgctcgtcaacaacgcgggcatcatgccggtttcgctgatcgcgcaaggccgcgtcgacgactggaaccgcatgatcgacgtgaacatcaagggcgtgctgtacggcattcatgcggtgctgggcgccatgctggagcggggggtggggcacatcatcaatatttcgtcggtggcgggcctgagcgtcgggccgggcggcgcggtctattcggcgacgaagttcgccgtgcgcgcgatcagcgaggggctgcgccaggaatgcgcgggcaaggtgcgcgtcacctcgatctgtccgggactcgtggcgagcgagctgccggacagcatcacggtgcccgcattccgcgagcgcgcgcagaagctgttcgaaggggcgatgcctgccgacgcggtcgccgatgccatcgtctacgcgctcacccagcccgagcaggtcgcggtgaacgaaatcgtcgtgcggccg

SEQ ID NO: 28488 - DNA, 1536 bp, Burkholderia fungorum
acccatgatgtcgtgattgtcggcggcggtcacaacggcctgtccgccggatgctatctggcggcagccggcaagaaggtactggtgctcgaagcgctggagaaggtcggcggcatggcctcctccggctatctgctgcccgaggcgcctgaacatctcattcatccttgcgcgctcgacatgatgtcgatgcgcgttcattcacgcgttccgcgcgaactcgaacttgagcggcatggctttcggcaggtggagatgacgcccggctacgtctacctgcatccggacggcacgtcactggtgttctggcgcgaccccgggaagaccgcccaggagattcgccgttacagcccgaaggacgcggaatccttcctcgcgttcatcaaggtagtcttcgccttcctcgacctggccctgccgatgatgcgcgtcgatccggcggagcgcaacctgggcgcgcgcttcgagtcgctgcgcgccgcgctgcgcaaccgcaagctcaagccggagctgatggcgctgctgaccgggtcggcttatcaggccgcgctcgagcacttcgaacatcccgtcacgatctcggcaatgtgctccctgactggacttgccggaccgattactgcggacggcagcggcatctactacgcactactgggctttttgcatcgcttcggtgtcggccgggtggtcggcggcatgcaggcgctctcgaatgcgatggccgcacgcctgcgcgaactgggaggcgaagtgctgacatccgcccgcgtcgaggaaatcgtcgccgatgagcgggcgctgcgcggcgtgcgtctcgccgacggccgcaccttcggcgcgcgggccgtgatcgcgagctgccacccgcaggtcgcgctggaactggtgtcgccgggccgcatcgaccagcgcctgctgacccgcatccgccatgcaccggccaacgcccacggcgcgtcgccgttgaagctcgacatggcgctgcgcgggcagatttcgcttgcgcgcttcgaggcgaagcgcggcgacggcctcgatttgcgcaagacctgtctgctgatcggcaccgccgaggcggtactggagaatttccgtgcgtcggcgcgcggcgaggtgccgacgctgccttatctgagcctcgcggcgccaggtgcgatcgatccctcgcaggcccccgccgggcaggacacggtctacatctatccgcccgccatgcccgcgcatccgcgcgagggctgggacgcgatccgcgagcgcgtcgcacagcaggtgatcgaccaggcaagcgaatatgtcgacgggctgaaggagttcgaaatcgctcgccggatggaggcggcgccggacttcacgcgacggctgaacacggtcaatggctgcgtggtgcatatcgacaccaccacgatgcgctcgagcaagctcaggcccgcctatggcctcggaggcgcaaccctgccggtgccggggctttacttcggtggcgcgggcatccatccgggcggcggcgtgaacggcatgccgggccgcatcgcagcg

SEQ ID NO: 28489 - DNA, 753 bp, Burkholderia fungorum
atgggacggctcgaaggcaaggttgcattgatcagcggcacaggcggcggacaaggcagggcggcggcgctacggttcgcgcgtgaaggcgcgaaggtgttcggctgcgacgtcgatgcggctgcgcagcaggagaccgtggcgctcgcgcgggccgggggcctcgaagtggccggcggcggcagcgtggacctgggggacgcgcaggccgcgcgggcgtgggtcgaagaggcggtcgccgcatacggcaggatcgacatcctgtacaacaacgcgtccgccgcgcgcttcggcgctgtcggcgacatgtcggtcgacgactggcgctggaccatccgcaacgaactcgatctggtcttctacagcacgcactatgcgtggcggcatctcgccgaacgcggcggcgtgatcgtcaacatctcgtcggtggcggcgtggggcgcttcgggcacgaccggcatcggcgcacactctgcggcgaaagcgggtgtcgtggcgttgacccggcagctcgccgtcgaaggcgcccggcatcgcatccgggcggtcagtatcagtccgggcgtcgtcgccacccccggcacccggccgtttctcgacaaccccgcgacgcgagcggcgctgctggccggggtgccggtcgagcgagcggccgagccggaagaaatcgtcgccgtcgcgctgttcgctgcgtccgacgaggcttcctacctcaccggcgccgacatcgtcgtggacggcggaatgctgtca

SEQ ID NO: 28490 - DNA, 756 bp, Burkholderia fungorum
aagctggaaaacaaggtcgcgatcgtgaccggcgcgggtgcgggactcggcgccgcgtgcgcccgcgcgctggcgcaacacggcgcgcgcgtcgcggtcgtcgacatcaacggcgaagcggccgccgccgtggcggccgacatcggcgagcgcgcgatgagcgtgcgtaccgacgtgtcgtcggaggcgcaggtcaaggcgatggtgagcgccgtgctggaacattttgggcgcatcgacatcctgcacaacaatgcggctgtgctcgacgacgcacagcgggccggcgaccgcgatgtgatcaacatgagcgtggaagtgtgggaccgggcaatggccgtgaatctgcgcggtgccatgctgtgctgcaagcatgcgatcccggcgatgctgcgtggtggaggcggctcgatcattcactcgtcctcgggcttcggcgcgcagggcgactttacgatgagcgcctacgcagcctccaaggcggggctcgcgatgctgagcaagtcggtggccgcgcagtacgggaaagagcgcatccgctcgaacacgatccagatcggcctcgtggtcgcggaccatccgcttcccgaggacatcaagggtgtgatcctcgacgggcacctcacgccctatctgggcgatccgaagcatgtcgccgacgtcgtgtgctttctcgcgtcggacgaagcggcgttcatcaccggggacacgctcgcggtggacggcggattctcgagccacgcgccgacgctcgcg

SEQ ID NO: 28491 - DNA, 1347 bp, Burkholderia fungorum
taccgcacgcgccgtgagcgcgtactcgccgcgctccgggcggcgggcggcggcgtcgccatcgtgcccaccgcgccggaagcgctgcgcaaccgggacgccgattatccctatcggcacgacagctacttctactacctgaccggcttcaccgaacccgaggcgttgctggtgctcgacgccagcgccgcgcccggcgagccggcttcggtgctgttctgccgcgagaagaatgtcgagcgcgaaacgtgggaaggtttccgcttcggcccggacggcgcgcgcgcggctttcggtttcgacgcggctttcgccatcggcgaaatcgatacgcaactgccgcgtctgctcgccgacaagccgtcgctgcactacgcgctgggcacttcgccgcagctggacgaacgggtgcgcggctggctcgacgcagtacgggctcaagcccgcggcggcgtcgccgcaccggccgccgcgcacgatctgattccgttgctcgacgacatgcggctcatcaaggacgaccacgaactcgccatcatgcgccgggccgggcagatttccgccgaggcgcatcgtcgcgcgatggccgcgtgccgtcccggcatgcgcgagtacgaactcgaagccgagctgctctacacgttccgcaagttcggcgcacaggcgccggcttacacgtcgatcgtcgcggcgggcgcaaatgcctgcgtgctgcactacccggcgggcaatgcgattgctcgtgacggcgatctgatcctgatcgacgcggcctgcgagctcgacggctacgcgtccgacatcacccgcacctttcccgcgagcggccgtttcacgccggcgcagcgcgagctgtacgacatcgtgctggccgcgcagcaggccgccatcgacgcgacccgcgccggcgccaccttcgacgacccgcaccaggccgccgtgcgtgtgctgtcgcagggcctgctcgacactggcatcatcgagcgcgcgaagttcgcctcggtcgacgacgtaatcgccgagcgcgcctacgtgcccttctatatgcaccgcaccggccactggctcggcatggacgtgcacgacgtgggcgactaccgcgaacgcggcgcgccgcgcgacgaagcgggcgcgctgccgtggcgcacgctgcaggcctcgatgacgctgaccatcgagcccggcctgtatatccggccgaccgaaggcgtgcccgagcgctactggaacatcggcatccgcatcgaggacgacgcgatcgtcacgccggacggctgtgagctgatcacgcgcggtgtacccgtcgccgccgacgagatcgaggcgctgatgctggaagcccgcgca

SEQ ID NO: 28492 - DNA, 642 bp, Burkholderia fungorum
atcgaccacctcatctgtgactgcgacggcgtgctcgtcgacagcgaaatcatcgctgaccgcgtaatgctcgaaacgctgagcgccacgttccccggcctcgacttcgaacccgtcgtcaaaacggcctttggccagcaaacgtcgcgctttctcgaaagcattgaaaagtcgttcgatatcacgctgccggccaattttttcgacaccatcgaacacaacgtcgagctcgcgctcgcggcttcgctcagcccgatcaacggcgtgcgcgatgccttgcaacgcgttaccttgccggccgccgtcgtctcgaacagccgcatgacgcgcgtgaatgcgtcggtgcggcgcgcgggtttgcagcagattttcggcgaacgcattttcagcgcggaacaggtggcccggccaaagccctatcccgacgtatatctgttcgccgcgaagacgctgggcgtggagccgtcacgatgcgtcgtggtggaagacagcgtggcgggtttgaatgccgcgcgtgcggcgggtatgaaaacgatcgctttcgtcggcgcgagccacattcccgatggctatgcggaagcgctgcgcaagatgggcatgacgcgcatcatgcagcatatggatgaattgcccgcgctggtc

SEQ ID NO: 28493 - DNA, 1422 bp, Burkholderia fungorum
cagtacattctcgcgcttgaccaaggcaccaccagctcgcgcgcgatgctgttcgaccggctcggcaatatcgtgtcgaccgcccagaaggaattccagcaaatctacccgcgtccgggttgggtcgagcacgatccgcaggaaatctggtcgacccaggccggcgtcgccgccgaggccgtgacgcgcgccggcatgaacggcacctcgatcgccgcgatcggcatcaccaatcagcgcgaaaccaccatcgtatgggatcgcgaaaccggccatcccatctataacgcgatcgtctggcaggaccgccgcactgcggacttctgcgaccagctcaaggagcaggggctcgaagaaaaagtccgcgcgaaaaccggcctgccgatcgattcgtatttctcggcgaccaagatccgctggattctcgacaacgtcgaaggtgcgcgcgaaaaagccaaacaggggcgtcttgcgttcggcaccgtcgatagctggctggtgtggaatttcaccaagggcggcctgcatatcaccgacgtcaccaacgcgtcgcgcacgatgctgttcaacatccactcgctgaagtgggacgacgaactgctcgaagcgctcgacattccgcgcagcatgctgccggaagtgcgcgcttcgtcggaaacgtatgggccgaccaagaccaccgtgttcgcttcgaagattccgctcgcgggcattgccggcgatcagcacgccgcgctcttcggccagatgtgcacggagtcgggcatggtgaagaacacctacggcacgggctgcttcctcgtgatgaacaccggcgacaagccgatcgaatcgaagaacaatctcgtcaccacgatcgcgtggcagatcggcgaccagatcaattacgcgctggaaggcagcatcttcattggcggcgccgtggtgcagtggctgcgcgacggcctcgggatcatcaggaacgccgctgaaatcgaaacgctggcgcgcagtgtgccgcattgcgacggcgtgtatctggtgccggccttcgccggtctcggcgcgccgcactggaatgcgcgcgctcgcggcacgctgttcggcgtgacgcgtggcacgtcgtcggcgcatatcgcacgcgcggcgctcgactcgatcgcttatcaatcggtcgacgtactgaaggcgatggaagccgactccggcattcgcatcggcgaattgcgggtggacggcggcgcctgcgcgaacaatctgctgatgcaattccaggcggacattctcggcgtcgacgccgtgcgtcccaaggtgtcggaaacgacagcattgggtgccgcttatctggccggtctcgcggtgggttactggaaagatgtcgacgagctgcaaagccagtggaaactcgaccgccgcttcacgcctgccctgccgcacgccgag

SEQ ID NO: 28494 - DNA, 1437 bp, Burkholderia fungorum
tacgatttgctcgtcgtgggcggcgggatcaacggcgccggcatcgctcgcgacgcggcgggccgcggcctgtcggttctgctgtgcgaacaggacgatctggcggcgcatacgtcgtcggccagtaccaagctgattcacggcggcctgcgctatctggaataccgcgagttcgggctggtgcgcaaagccctgcaggagcgcgaaacgctgctgcgcgccgccccgcacatcatgtggccgctgcgcttcgtgatgccgcacatgcccgacctgcgcccggcctggctgatccgcgccggcctgttcctgtacgaccatctggccaaacgcgaactgctgcccggctcgcgcggcattgtgatgcgcaaccatccggcgggcgcgccgctggtcgattcgatcaagcgcggctttgtgtattcggacggctgggtcaacgacgcgcggctggtcgtgctgaacgcgctggatgccaaagagcgcggcgcgaaaattctcacccgcacgaaactgctgagcgccgtgcgcgcgggcggcgaatggcgcgcgcaactcaagcgcgaggacggcacgattctggacgtgcgcgccgcatcgattgcgaacgccgccggaccgtgggtcggcgaactgctgcaaggcgcgctcggccgcgcggcgtcgcacagcgtgcggctcgtgaaaggcagccatatcgttacgcggcgactgttcgaacacgatcacgcatatatcttccagaatccggacaagcgcatcatcttcgcgattccgtacgaacacgattacacgctgatcggcacgacggatctcgaatatcgcggcgacccgtcgcaagtggcgatcaacgccgaagaaacgcaatacctgtgcgattcgatcaaccgctatttcaagcagaagatctcgccggccgatgtgcgctggacctattccggcgtacgcccgctgctcgaagaagaaggcgcggacaatccgtccgcggtcacgcgcgattattcgcttgaactcgacgcgcccgccggtgaagcgccgctgctgtccgtgttcggcggcaagatcaccaccttccgcaaactggcggaagaagccgtcgaccaactcgcgcatgcactgcatcacgacacatcgtcatggacagccggtgcgccattgcctggcggcgatattcccggcgccaacttcgagcgctttctcagcgaattcaggcagcagcatgcatggctgccggccggcctcgcgcaccgccttgcccgcgcctacggcacacgcgtcgagcatgtgatcggcaatgcgcgttccgtggccgagctcggccgcgccttcgcgcccggtctttacgaagcggaactgacttatctgcgcgataccgaatgggcgcgcagcgcgcaagacgtgttgtggcgccgatcgaaactcggcctgcacgtcgag

SEQ ID NO: 28495 - DNA, 1354 bp, Burkholderia fungorum
atgtcttttgattctctcggcttgtccgaaccgttggtccgcgctgtacacgaacttggctacaccacgccgactccgatccagacgcaagcgattcccgctgtgctcaacggcggcgacctgctggccggtgcgcaaaccggcaccggcaagaccgccggcttcacgctgccgatcctgcaacgtctgaactcctcgcccgccgttgcgaacggttcgggcaagcgcgccgtgcgcgcgctgatcctcacgcccacgcgtgaactggccgcgcaggtggaagaaagcgtgcgcgcctacggcaagtatctgaagctgaagtcgaccgtgatgttcggcggcgtcggcatcaatccgcagatcggcgcgttgcgcagcggcgtggatatcgtcgtcgccacgccgggccgtttgctcgatcacatgcagcagaaaaccatcgacctgtcgcatctcgagattctcgtgctcgacgaggccgaccgtatgctcgacatgggcttcatccacgacatcaaacgcgtgctcgccaagctgccgccgaagcggcagaacctgctgttctcggccactttctccgacgagatcaagacgctcgccgacaatctgctcgactcgccggcgctgatcgaagtcgcacgccgcaacacgacggcggaaacggtcgcgcagaagattcacccggtggaccgtgacaagaagcgcgagttgctcacgcatctgatcaaacagcacaactggttccaggtgctggtgttcacgcgcaccaagcacggcgccaaccgccttgccgaacagttgaccaaagacggcatcagcgccctggcgattcacggcaacaagagccagtcggcccgtacccgcgcgctcgccgagttcaaggacggcacgctgcaggtgctggtcgcgaccgacatcgccgcgcgcggcatcgacatcgatcaactgccgcacgtggtcaactacgatttgccgaacgtgccggaagactacgtgcaccgcatcggccgcacgggccgcgcaggcgctaccggcgaagcggtctcgctggtgtgcgtcgacgaactgcaactgctgaaggacatcgagaagctgatcaagcgtccggtgccgcaggaagtggttgccggtttcgaaccggacccgaccgcgaagccggagccgatcctgcgccgcggccagggtggtggcggcggcggtggtggccgctcgccgcgtcagggtcaaggcgcaccgaagcgtgacgatgcaaggcgcgatggcgccggttccgcgaaaccggcgcaacgttcgggtcaacgtccggccaacggtcaacagcagccgaagccgcaggggtgcgaagccggccggc

SEQ ID NO: 28496 - DNA, 2121 bp, Burkholderia fungorum
atgacctcactggaccgccgtaccttcctgcgcagcgccgcgggcgctgccgcgctcggcctgttcccacccgcgattcgccgcgcgctggcgattcccgcgaacaacacgaccggcaccatcaacgacgtgcagcacgtcgtcatcttcatgcaggagaatcgatcgttcgaccattatttcggcacgctgccaggcgtgcgcggctttagcgaccgcttcacgattccccagcccggcggcacgaccgtgtttcagcagaacgacgggacgcgtaccgtgctgccgttccatctcgacagcacgcaaggcaacgcgctgctcgccggcggcccgcattcgtggagcgacgcgcatcaggcgtgggacagcggacgcatgacgcaatggccgaaggccaagggcgacgtgtcgatgggttatctcaatcaggccgacgtgccgttccatgtcgcgttggcgaatgcgttcacgatctgcgacgcctatcactgctcgctgcatggcggcaccaactccaaccgcattttcctgtggaccggcaccaacggcgcgagcgcgggcgccaatccggtggtcaacaacgacggctgggatggcctcggcgcttccgccacgggcctgacgtggacgacttatcccgagcgcctgcaggccgcgggcgtgagctggaaggtctaccagaacatgccggacaactacacggacaattcgctcgccggcttcgcgacctatcgcaaggtcaacgagacgctgcccggctcgccgctgctgccgtacacgcagtcgctcgaagcggtggcgccgctgtacaagggcatcggtaacacgatgcccgatggcggcttcctgcaggcgttgaaagacgacatcgccgcggggcagatgccgcaagtgagctggatcgtgtcgccgcaggcgtactgcgaacaccccggcgcctcgacgccggggcagggcgcttactatctgcaactgctgctcgacacgttgaccgcgaaccccgacgtgtggagcaagacggtgctgttcgtcaattacgacgagaacgactgcttcttcgatcacatgccgccgcccgacgcgccgagcaaaaatgcggacggcacgtttgccggcaagtcgaccgtggacacgcagtacgaatatttcacgaagaccaacccgccgggcgattcgtcgccgatcgtgccggacggacaatgtttcggcccggggccgcgcgtgccgatgttcgtcgtatcgccgtggagcaccggcggttgggtgaactcgcaggtgttcgatcacacttccgtattgcgtttcctcgagcagcgtttcggtgtgaccgaaaccaatatcagcccgtggcgccgcgcggtgtgcggcgatctcacgtcggcattcaacttccgtaatccgaacgacgtgccgccggcttcgctgccggcggccccgagcaaagctcaggcggacgcacagaacacgcagcagagcgcgctcggcgcggtgccggtgccgtcggcggccagtcagcagatgccgcagcaggtgctgatgtcgcggccgtcgcgcgcgctcccgtatctgctgcacgtgagcgccaacgccgacgtgcaggatggcctgatctggctggtcttcagcaacacaggcacggcgggcgcggttttccatgtgtacgaccagttgcatctcgaccgcgtgccgcgccgctataccgtcgaagccggcaaggaactgtcggactcatggagcgcgctcgccgacgatcagggcaactacagtctgtgggtgctcggaccgaacggatttcatcgttcgtttcagggaaatgtcgcgacggtggcgaccggaccgaacccggaagtgcgcgtttgctacgacgtggtcaacaacgccgtctatctgacgatcatgaatacgggcaatgccgtcgccaacgtcacggtgacttcgaacgcgtatcgcggcgacggtccgtggacgtacgcggtaccggcgggcatgcaggtcgagccgtactggtcgaccggcgccgtgggtggctggtacgacttcacgctgagcgcggccggtgggttttcgcggcgttttgccggccgtatcgaaaccggcaaggatagcgtcagcgacccg

SEQ ID NO: 28497 - DNA, 1149 bp, Burkholderia fungorum
atgaagattcacgagtaccagggtaaggaaatcctgcggaaattcggcgtcgcggtaccgcgcggcaagccggtcttctcggtggatgatgcggtcaaggccgcggaagagctcggcggcccggtatgggtcgtgaaggctcagatccacgcgggtggccgtggcaagggcggcggcgtgaaggtcgccaagtcgctggaacaggttcgcgaatacgcgaaccagatcctcggcatgcagctcgtcacgcaccagaccggcccggaaggccagaaggtgaatcgtctgctgatcgaagaaggcgctgacatcaagaaggaactgtatgtcggcctcgtgatcgatcgcgtgtcgcagaagatcgtcgtgatggcatcgagcgaaggcggcatggacgtcgaagaagtcgcggaaaagacgcctgagctgatccacaagatcgccgtcgacccggcaaccggtctgaaagacgccgaagccgacgagctcgcaacgaagatcggcgtgcccgccgcttcgctgccgcaagctcgcgcgatcctgcaaggcctgtacaaggcattctgggaaacggacgcatcgctcgccgaaatcaacccgctgatcctgaccggcgacggcaaggtcatcgcgctggacgccaagttcaacttcgattcgaacgcactgttccgtcacccggaaatcgtcgcgtatcgcgatctggacgaggaagatccggctgaagtcgaagcgtcgaagttcgacctcgcgtacatctcgctcgacggcaacatcggctgcctcgtgaacggcgccggcctcgcaatggcaacgatggacaccatcaagctgttcggcggcgaaccggcgaacttcctggacgtgggcggtggcgccacgaccgagaaggtcacggaagcgttcaagatcatgctgaagaacccgaacctgacggcgattctggtcaacattttcggcggcatcatgcgctgcgacgtgatcgcggaaggcgtgatcgcggcgtcgaaggccgtctcgctgaaggtgccgctcgtggtccgcatgaagggcacgaacgaagacctcggcaagaagatgctcgctgaatccggcctgccgatcattgcggcggacagcatggaagaagcggctcagaaggtggtcgcg

SEQ ID NO: 28498 - DNA, 906 bp, Burkholderia fungorum
atgtcgattctgattaataaagacaccaaggtcatcacgcagggcatcaccggcaagaccggtcagttccacacgcgtgcttgccgtgaatatgcaaacggccgcgaagcgtacgttgcgggtgtgaacccgaagcgtgccggcgaagacttcgaaggcattcccatctacgccagcgtcgctgaagccaaggctgaaacgggcgcgaccgtgtcggtgatctacgtgccgccggcaggcgctgctgctgcgatctgggaagcggtcgaagccgatctggatctggcgatctgtatcacggaaggcattcctgtccgtgacatgatcgagctgaaggctcgtatgcgcgccgaaaaccgcaaaacgctgctgctcggcccgaactgcccgggcacgatcacgccggacgagctgaagatcggcatcatgccgggtcatatccaccgcaagggccgcatcggcgtcgtgtcgcgttcgggcacgctgacgtacgaagcagtcggccaattgacggcgatcggcctcggccagtcgtcggcggtcggtatcggcggcgacccgatcaacggtctgaagcacatcgacgtgatgaagatgttcaacgatgatccggaaacggacgccgtcatcatgatcggcgagatcggcggtccggacgaagcgaatgccgcgtactggatcaaggacaacatgaagaagccggtggttggcttcatcgccggtgtcacggcgcctccgggcaagcgcatgggccacgccggcgcgctgatctcgggcggtgcggatacggccgaagcgaagctggaaatcatggacgcctgcggtatcacggtcacgaagaacccgtcggaaatggcgcgtcttctgaaggcgatgctgtaaatcgaaattcacgcgcagtcacgg

SEQ ID NO: 28499 - DNA, 1200 bp, Burkholderia fungorum
cacacgcccatgaacaaggtattgcgtctctccgatctgatcgccgaaggcaagctatccggcaaacgcgtgttcatccgcgccgatctgaacgtgccgcaggacgatcaaggcaacatcaccgaagacacccgtatccgcgcttccgtgccggccatcaaggccgcgctcgacgcgggcgccgccgtgatggtcacgtcgcacctgggccgtcccacagagggtgatttcaagcctgaagactcgcttgcgccggtcgcgaaacgtctggccgaactgctcggccgcgaggtgccgctggtggcgaactgggtcgaaaacggcgtgaacgtcgcgccgggctcggtcgtgctgctggaaaactgccgcgtcaacaagggcgaaaagaaagattccgacgagctcgcgcagaaaatggcgaagctctgcgacatctacgtgaacgacgcattcggcaccgcgcaccgcgccgaagccaccacgcacggtattgccagatacgcgccggtggcgtgcgccggcccgctgctcgcggccgaactcgaagcgctcggcaaggcgctgggcgcgccgaagcgtccgctggtggcgatcgtcgccggctcgaaggtgtcgaccaagctgaccattctgaagtcgctcgccgacaaggtcgatcaactgatcgtgggcggcggcattgccaacacgttcatgctggccgcgggcctgaagatcggcaagtcgctcgccgaagccgatctggtgaacgaagccaaagccatcatcgacgcggcgaaagcccgcggcgcctcggtgccgatcccgaccgacgtggtcacggcgaaagagttttccccgaccgccaaggcagaagtcaaagcagtcgccgacgttcaggacgacgacctgatcctcgacatcgggccggaaacggccaaagtgctcgccgcgcaactggaaaaggccggcacgatcgtgtggaacggtccggtcggcgtgttcgaattcgaccagtttggcaacggcacgaagacgctggcggaggctatcgccaaatcgtcggcgttctcgattgccggcggcggcgatacgcttgctgcgatcgccaagtacggcatccacgacaaggtcagctatatctcgacgggcggcggcgctttcctcgaattcctcgaaggcaagaagctgccggcggtcgaagttctggaatcgcgggct

SEQ ID NO: 28500 - DNA, 1410 bp, Burkholderia fungorum
cgcgccaccaagattgtcgccaccatcggaccggcttccaatacgccggaaatcctgctgcaaatgattcaggcagggttggacgtggtgcggctcaatttttcgcacggcaccgccgacgaccaccgccagcgcgccggattcgtgcgcgaggcggcccgccaggccggccgcgaagtcgccatcatggcggacctgcaaggcccgaagatccgggtcggcaaatttgaaaacggcaagatcatgctggtcgccggcgagccgttcgtgctcgacgccgactgcgaactcggcaacgagcaacgcgccggcctcgactacaaagacctgccgcgcgacctgaaaccgggcgacgtgctgttgcttaacgacggcctgatcgtgctgaacgtctcgcgcgtgatcggcaacgagatccacacggtcgtcaagatcggcggcgaactgtcgaacaacaagggcatcaaccgccagggcggcggcctgtccgcgccggcgctgaccgccaaggacatggaagatattcgcaccgccatgtcgctcggcgtcgattatgtcgcggtatcgtttccgaagaacgcgaccgacatggaaatggcccgccagctggcgaacattgccggcgcgccgttcggcgtcaagccgaagatgatcgccaagatcgagcgcgccgaagcgattccggcgctgcaaggcattctcgacgcgtcggacggcatcatggtcgcgcgcggcgatctggccgtggaagtggggaatgccgcagttccggcgctgcaaaagcgcatgattcgtatggcgcgcgaatcgaacaagttcgtgatcaccgccacgcagatgatggagtcgatgatccacgcgccggtgccgacccgcgccgaagtgtcggacgtcgccaacgccgtgctggacggcacggacgcggtgatgctgtcggcggaatcggcggcgggcaagtatccggtgcagaccatcgagacgatggcggcgatctgtatcgaggcggagaagtcggagcagtcggagctggacaaggatttcctcgaccgcacgttcacgcggatcgaccagtcgatcgcaatgggcgcgctcttcacggcgttccatctcggcgcgaaggcgatcgtggcgttgacggaatccggctcgaccgcgctgtggatgtcgcgtcactggactcacgtgccgatcttcgcgctcacgccgcgcgtcggcagtgaacgggcaatggcgctgtatcgcaacgtgacgtcgctgcatctcgataccaacaccgaccgcgacacggcgttgcagcaggcgttggagaccgtggtgagcaagggctacgcgtcgcgcggcgacatggtggtgctgacggtcggcgagccgatggggcaggccggcggcacgaatacgctgaagatcgta

SEQ ID NO: 28501 - DNA, 870 bp, Burkholderia fungorum
cgtaaaggcattatcctagccggtgggtccggcacgcgtctttacccgatcacgcggtcggtgtcgaagcaactgctacccgtctacgacaagccgatgatctactatccgctgtcgacgctgatgctggcgggtattcgcgacatccttgtgatctccacggcggaagatacgccgcgttttgcagagatgctcggcgacggcagcgcttggggcatcgatctgcaatacgccgtgcagccttcgcccgatggacttgcgcaggcctttattatcggccgtgaattcatcggctctgatccttgcacgttgattctcggcgacaacattttccacgggcatgatctcgtgcgtcagctgacacgtgcggggcagtccgagcagggcgcgactgtattcgcctatcacgtgcacgatccggagcgttatggggtagttgagttcgacgagaatttccacgcgctatcgctggaagaaaagccgctcaagccgcgctccaattatgcggtgactggtctttatttctacgacaaccaggtctgcgacattgcagctgacgtcaagccgtcagcacgtggcgagctcgaaatcacggatgtcaacaaacgatatctggaaatagctcagctcgacgttgagatcatggggcgtggatatgcgtggctggatacaggcacgcacgattcgctgcttgaggccgccagtttcatagcgacgctgcagagtcggcaggggctgatggtggcctgcccggaagagattgcgtaccgcagccattggatcagtgccgaacaggtcgaacgcctcgctggaccgcttgccaaaaatcgatacggccaatacctgaaacagatcatttcggaagcagtt

SEQ ID NO: 28502 - DNA, 864 bp, Burkholderia fungorum
gttaccggcgcaagcggctttaccggccgctacctggtcgataacctgctcggccggggccacactgtgatcgaaacggtcgccgggcgcgatgagcctgaaacgccaacccgcgtgaggctcgacatcacgtcgccggacgcctgccggcgcgcgatcgaaatcgcgcgccccgactatattgtccatctggctgcgatcagtttcgtggggcataacgacccgctcgacttttaccgcgtcaacgtgatcggcacgctgaatctgctggaggcctgtgccgccgtcgggcatacgccgcgcaagctgctgatcgcgagcagcgcgaacgtctacggcaacgtgacgagcgaggctatcgacgagagctttccggtcacgccggtcaatcactacgccgccagcaaggcggcgatggaaacgatggtgcggacctggttcgaccggctgccgatcctgattgtgcggccgttcaactataccgggcgcggccaggcgtcgaacttcctcgtgccgaagatcgtcgggcacttcgcgcgtcgcgaagcgtcgatcgaactcggcaatatcgatgtcgcgcgcgatttctccgacgtacggtatgtggcaagcgcttatgaagcgctgctcgactcggaggccgcggccgaaaccgtcaatgtctgcaccggcacgccttttacgctgcgcgaaattctcgcggcggcaagcgatctgaccggacatgagttggagattcagatcaatcccgccttcgtgcggcaaaccgacgtgaaaatgctggccggttcgcccgccagactgcgcacgctcgtgccgaccgtcgaggcgattccgttcatggatacgctgcgctggatgctt

SEQ ID NO: 28503 - DNA, 951 bp, Burkholderia fungorum
cagctcacgaaaaacggcgagctgaaacatctgttgtcgatcgagggtttgccgaaggcgatcgtcaatcacattctcgacaccgccgaccagttcgtcagcgtgaccgatcgcgaagtgaagaaggtgccgctgctgcgcggcaagtcggtgttcaatctgttcttcgagaactcgacgcgcacccgcaccactttcgagatcgccgcgacgcgtctttctgcggacgtgctcaatctgaacatcaacgcgtcgtcgaccagcaagggcgaatcgctgctcgacacgatcaacaacctctcggcgatgcacgccgatatgttcgtcgtgcgccacgcatcgagcggcgcgccgtatctgatcgcccagcattgcgcgccgcacgtgcacgtgatcaatgccggcgacggccgtcatgcgcaccctacgcaggggctgctcgacatgtacacgatccgccactacaagaaggatttcaccaagctgcgcgtggcgatcgtcggcgatattctgcattcgcgggtcgcgcgctcggacatccatgcgctgaccacgctcggcgtgccggaagtgcgcgcgatcggtccgcgcacgctgctgccgggcggcctcgaacagatgggcgtgcgcgtgttccacaatctcgacgaaggcctgaaggacgtcgacgtgatcatcatgctgcgtctgcagaacgaacggatgagcggcgcgttgctgccgtcggcgcaggagtacttcaagagctggggcttgacgcccgagcgtctcgcgctcgccgcgccagaggcgatcgtgatgcacccgggcccgatgaatcgcggcgtcgaaatcgattcgcaggtggccgacggaccgcagtcggtgattctgaatcaggtgaccttcggtatcgccgtgcgcatggcggtgatggggatcgtggccggcaatcacgactgatcccgcagg

SEQ ID NO: 28504 - DNA, 2280 bp, Burkholderia fungorum
atgaccacgcgacgcgaagttccgggaatccggccgtatgacggtccggccggcggttggggcgcgctgcgggcgacggctcaggccgttcgcacgcagatggagaacatcgaggcgccgattacgctgatgcggaccaatcagcccgatgggttcgattgtccgggttgcgcgtggccggacaaggagcacaagtccactttccagttctgcgaaaacggcgccaaagcggtgacatgggaagcgaccaccaggcgcgtgggaccggagtttttcgaaaacaacacggtgtcctcgctgctgcaacgctcggatttcgaactggaggatctcggccggctgacacatcctctcgtctacgaccgcgccaccgacaagttccgggcagtggaatgggaggacgccttcgcccggatcggtgaagtgctgcgcggcttgtcctctcccgacgaggccgagttctacacatcaggcagggcgtcgaacgaagccgcgtacctgttccagttgctcgcgcgggaatacggcacgaacaatttccccgactgctcgaacatgtgccacgagccgaccagcgtcggcctgccgcagtcgatcgggatcggcaaaggcacggtgtcgctggacgacttcgactcgaccgagctcatcctctcgatcggtcacaatcccggcacgaaccacccccggatgatgggcacgctgcacgaatgctcgcggcgcaatgtgccgatcatcgtgttcaatccgctgcgcgagcgcgcgctcgaacgcttcgccgatccgcagagcgtggttgaaatggcgaccttcggctcgacccgcatcgcgtcgacctattttcaggtcgatgccggcggagacgcggccgccctcaaaggcatcatgaaggcgcttctcgtgatggacgcggagcagggaaaaaccgtcctcgaccacgagttcatcgcgacacatacccagggtttcgaagcgttcgcggcggatctggaagcgacctcatgggacgacatcgaaaaggcgagcgggctgacccgtgaagatctcgaagaggtcgccattgcctatgcgaaatcgaacgcgacgatcgtcacttacggaatgggcgtgacccagcataacaagggcaccgccaatgtccggctgattgccgatctgctgttactgcgcggcaatatcggcaaaccgggcgcgggcatctgtccgttgcgcggacattcgaacgtgcagggcaaccggaccgtcggcattaccgaaaagccttccgaagccttcctcaagcagatcgagaacgtgctcgggttcaagccacccgcggcgcacggacacgacgcggtccaggcaatgcaggcgatgatcgccggcacggccagggtgctgatctgtctcggcggcaacttcgctgtggcgttgccggactccgggcagtcgtttcccgccatgagcaagctcgatctgagcgttcacctcggcaccaagctcaaccgttctcacctgcttgtggcgaaagaaacgtatgtgctgcccgtgctcggccgcacggaactcgacatacaggcaaacggccggcaatccatcaccgttgaagattcgatgtcgatggtccacgcttcctcgggcaagctgaaacctgcttcagagcacctgcgatccgagccggcgatcatcgcgggtatcgccacggccgcgttgccgaacagcaaggtcgcatggtcggaactggtggccgactacgacaggatccgcgatctgatcgagcaaaccgtgccgggattcgaagcattcaatgcacgaatccgggtgccgggaggattccgtatgccgcttccgccgacggagcgcgcgtggcccacgccgtcgggaaaagcgatgttctcggtgtacggcggcgtcagggaagacgccgacgtgctcggcgccgacaatgtgctgcgtctcatcacgatccgcagccacgaccagtacaacaccaccatctacgcgctggacgatcgttaccggggtgtgttcggccggcgcgacgtgctgttcatgaacgaggacgatctggccgaacgcggactcgaacatggtgatctggtcgacatcgaaaccgttctggccggcaggcagcttcgcctgaagaagattactgcaatcgcgtacaacatcgcgccgggttcggtggcggcctattatccggaagccaacgtgctggtgccactcgacttcatcgacaaggagagcggcacgccttcgtacaagtctgttccggttcatgtcatgcgctcagcggaaacc

SEQ ID NO: 28505 - DNA, 1086 bp, Burkholderia fungorum
aaggtcgcgctgatcaccggcatcacaggacaggacgggtcgtatctggcggagttgctgctcgccaaggattacgacgtacacggcatcaaacgcaggtcatccctgttcaatacagaccggatcgatcacctgtaccgcgatcctcacgatccggaccagcggctctttctgcatcacgcggatctgaccgactcgaccagcattctgcgcgtgatccagcgtgtcgagcccgacgagatctacaacctcgccgcgcagagccacgtcgcggtgtcgttcgaggagccggaatacaccgcgaacgccgacggcctcggcgcgttgcggattctcgaagcgatccggattctcgggctgcaggaaaagacgcgcttctatcaggcgtccacctcggagctttacggcctcgtgcagcaggtgccgcagtcggagaccacgccgttctatccgcgcagcccgtatgccgtcgccaagctgttcgcgtactggaccacggtcaattatcgcgaggcttacggtctctatgcgtgcaacgggattctgttcaatcacgaatcgccggtgcgcggcgagacgttcgtgacgcgcaagattacgcgcgcagtcgcgcgtatcgcggtgggcatgcagaagaccctgtatctcggcaatctgtcggccttgcgcgactggggccacgcgcgcgattacgtggagatgcaatggcgcatgctccagcaggagcagccggaggattacgtgatcgccaccggcgtgcagtacagcgtgcgccagttcgtgcagcacgcggccgccgagctcggcgtcaccgtgcgcttcgaaggcaccggcgtggatgaaatcggcattgtcgagaaagtggaagggcgcgagatcaagatgtcgccgggcgacgtgatcgtgcgtgtcgatccgcgctacttccggcccgccgaagtcgagacgctgctcggcgatccgtccaaggcgcatgcgaagctcggctggcagccgaccacgtcgttcgcttcactggtcaaggaaatggtgcgcgcggactatcagattgcccgacgtgacgcgctcgtcacgctggccggcttc

SEQ ID NO: 28506 - DNA, 2688 bp, Burkholderia fungorum
ccgccgattacctatccggaagcgttgcccgtttcgggccgccgcgaggaaatcgcgagagccatcgtacagaatcaggtggtgatcgtctgcggcgagaccggctccggtaaaaccacccagttgccgaaaatctgcctcgaactgggccgcgggctcggcgcgggcggctccggtctgatcggccacacgcagccgcgccggatcgccgcgtcggcgacgggccgccgcattgccgaagagctcggcacgccgtttggcgaagtggtcggctacaaggtgcgctttaccgacaatctgtcgccgggtgcatcggtcaagctgatgaccgacggtatcctgctcgccgaaacgcaaaccgatccgctgctgaaagcgtatgacacgctgatcatcgacgaggcgcacgagcgcagtctgaacatcgactttctgctcggctatctgaaggaaattctcgtcaagcgtcccgatctgaagttgatcgtgacctccgcgacaatcgacgcggaccgtttcgcgcgtcacttcggcagcgaagacaagcccgcgccggtgatcgaggtgagcggccggctttatccggtcgaggtgcgctaccggcccgtcgcggaagacagccccgccgtgaaagcggcgcaaggtgatgggcctgctgcgcaacgcggcggcgaccggccgaaaacccagcgcgaaaccgatcgcgatctgatggaagccatcgtcgacgccgtcgacgaactgtgccgtgaaggtccgggcgacgtgctcgtgttcctgcccggcgagcgcgaaatccgcgacgccgccgaggcgctgcgcaagcaccatccgccgcacacggaaattctgccgctgttcgcccgtctttccgcggccgaacaggagcgcgtgttccgcacctcgaacgcgcggcgcatcgtgctcgcgactaacgtcgccgaaacctcgctgacggtgccgggcattcgctacgtggtcgataccggacttgcgcgcgtgaagcgctactcgtatcgcaacaaggtcgagcagttgcaggtcgagtcgatttcgcaggccgcagccaaccagcgggccggccgttgcggccgggtcgccgacggcatctgcattcgcctctacgaggagagcgattaccagggccgcgtgcgttttaccgatccggagattctgcgttcgtcgctggcctcggtgattctgcgcatgaagtcgctgcatctgacggcgatcgaaacgttcccgttcatcgagccgccgccgggccgcgcgatcgccgacggctatcagttgctcaacgaactcggcgccgtcgacgacgacaaccagctcacgccgctcggccgcgaactcgcgcgcctgccgctcgatccgcgcgtcggccggatgattctggccgcgcgcgaccagcaggcgctgaaggaagtgttgatcatcgcgagcgcgttgtccgtgcaggatccgcgcgaccggccgatcgaggcgcaggagcaggccgatcaggcgcatcgccggttcgccgacgagcgctcggaattcctgcaatggctgaaaatctggaactggttcgaagaagcgatcacgcacaagaaatcgaacaggcagttgcacgaggaatgccgcaagaacttcctgtcgcaactgcgtctgcgcgaatggcgcgatgtgcattcgcaactgctgacggtggtgcgtgaacatggctggcgtttgaacgaagcggaagcgactttcgagcagatccatctcgcgctgctgacgggtttgctcggcaatatcggcctgaaggccgacgacgaaccgtattacctcggcgcgcgcggcatcaaattttatctgtggccgggctcggcgctggtgaagaaagccggcaagtgggtgatggccgccgaactggtcgagacgagccggctgtacgcgcgctgcatcgcgaagatcgagccggaatggatcgagaagatcggcccgcatctgttgaagaagtcgctttccgagccgcattgggagaagcgcgcggcgcaggtgtcggcattcgagcgcgcggtgctgtacggtctgccgatctatcaccggcggcgcgtgagcttcggcaagcaggatccggcgcgcgcccgcgagctgttcattcgcggtgcgctggtggaaggcgagttcgataccaagctcgcgttcttcgcgcacaaccgcaagctgcttgccgatatcgaacaactcgaacacaagtcgcgccgccaggacgtgctagtcgacgacgagctgatttttgcgtactacgatcaggcgctgccgaagggcatttataccggcgcgtcgttcgagcgctggtatcgcgacgaggtgaaaaagagcggccagccggaagacaggctgcgcctgctgtatctgtcgcgcgacgatctgatgcggcacgaagccgccggcgtgacgaccgacctgttcccgaaacgcatgacgatggcgggcgtcgacatggcgctcacgtatcacttcgagccgggctcgccgcgcgacggcgtgacgctcggcgtgccgctgtatgcgctgaatcaggtcgacgcgcggcgctgcgaatggctcgtgcccggcatgctgaaggagaagacgcaactgctgctgaagtccttgccgcaaaagctgcgccgtcactgcgtgccggtgccggagtatgcggcgggtttcgtcgaccgg

SEQ ID NO: 28507 - DNA, 1311 bp, Burkholderia fungorum
cagcacgcgcaattcgtcgactggatgcgctcagtcgccccttacatccatgcgttccgtaacaagacgttcgtcgtcggtttcggcggcgaggtggtgcatcaggggctcctgaatgcgctcgtgtccgatatcgcgctgttgcaggcaatgggcatccagatcgtgctggtgcacggctcgcggccgcaggtcgaagagcagatgagcctgcacggcgtggaatccgagttttcgcacggcatgcgcattaccgacgcgcgcgctttggagtccgcgaaagaagcggccggcgaagtacgtctggatatcgaggccgcgatcagccaggggttgccgaacacgccaatggcgcacgcgcacatcagcgtggtgtcgggcaacttcgtgacggcgcggccggtcggcattctcgacggggtcgatttcgcccacaccggcgtggtgcgcaagatcgacgccgattcgatccgccattcgctggcaagccgcaagctggtgctgctctcgccgctcggcttctcgcccaccggcgaggccttcaatctggctatggaagacgtggcgtccgccgcggcaatcgcgctgcgcgccgacaagatcgtgttcctgaccgaaacgccgggcctgatgcaagccggcgaagacggtcccgaactggtgcgcgaactgtcgctcgacgacgcctacaagctgcatgaaagcggcgaagtcaccggcgacgccggcttctacctgaaacactcgatccgcgcctgccgcggcggcgtcgcgcgggcgcacatcatcccttacgcgctcgacggcagcctgctgctcgagctgttcctgcacgacggcgtgggcacgatgatctcgtacgagaatctcgaaagcctgcgcgaagccacgccggacgacgtcggcggcattctggcgctgatcgagccgctcgaatcggacggcacgctggtgcggcgcgggcgtcaccagatcgaacgcgacatcgaccatttctcggtgatcgagcacgatggcgtgctgttcggctgcgcggcgctgtatccgtacacgcaggagcgcatcggcgaaatggcgtgcctgacggtcgcccccgaagcgcaaggcaccggcgacggcgagcggctgttgaagcgcatcgagcagcgcgcgcgggcgcgcggcctgacgcgcattttcgtgctcaccacgcgtaccgaacactggtttctcaaacgcggcttcgtcaaggtcacggtcgacgacctgcccgaagaccgccgcagactctataactggcagcgcaagtcgctcgtgctgatgaaacagctc

SEQ ID NO: 28508 - DNA, 2412 bp, Burkholderia fungorum
tcggcatcgccgggtttcatcgccgtcatcacactcctgtttactgcgctaaccgccctctatctgctgataggcggtgcatggctgctctcgctcggcgggtccgcgtattacgtcgtggtcgggttcgtgctgctcggcgtgacctggctgctgtaccgccgcagtccggcggcgctcacactctacgcactcgtgctggtcggcacggcggtctgggcgctgtgggagtcgggtcccgacttctgggcgcttgcgccgcgctccggcgtgctcgtcgtgttcggcgtgtggctgctgctgctcgtgagctggcgcctcgatgcgccgcgcaagctcggcgtaacgtcgctagtcggcgcgctcgtgatctgggccggcgtgctggtctacgcgagcttcaatgatccgcagacgatcaacggcacgctgagctcagtggccgccacgcccgccgccaatcccaacggcatcgatccgtccgactggcccgcctatggccgaacccaggaaggcacgcgctacgcgccgctgcagcagatcacgcccgaaaacgtcaagaacctgcaggtggcctggaccttccgcacaggcgatatgaaaggtccaaacgatccggtcgagatcaccaatgaagtcacgccgatcaagatcggcaatctgctctatctgtgctcgccccaccagatcctgttcgcgctcgatgcgaagaccggcgaacagaaatggaagttcgacccgaaactgcggcccgatccgtcgttccagcacgtgacctgccgcggcgtgtcgtatgtcgatctctcggcaagcgctgcgaccgcgcaacccaacgcgcccgccgcacccgcgagcgacaccgcgccggcggcatcggccgcatcggcggccagcggcgcctgcctgcgccgcatctatctgcccgtcaacgacggccacctctacgcgctcgacgcgcagacaggcgagcgctgcgcgggcttcggcaacaacggcgatctcgaccttcagcacgcgcagccggtcacgacgccgggcatgtacgagccgacttcgccgccgatcgtcacgaacacgacgatcatcgtggcgggcgcggtggaagacaacttctcgacgcgcgagccctcgggcgtgatccgcggcttcgacgtgcgcaccggccagctgcagtgggcgttcgatcccggcgcgcaagacccgaacaggattccgggcgcgggcgagcactacaccatcggttcgccgaactcgtgggcgccctccgcctacgacgcgaagctcgacatcatctatctgccgatgggcgtgaccacgcccgacatctggggcggcaaccgcacacccgagcaggagcgctatgcgagcggcctgctggcgctgcatgcgtcgacgggcaagctggcctggttctaccagaccgcgcaccatgacctgtgggacatggaccagccgtcgcagcccacactggcggacatcaccggcaaggacggcaagaccgtgccggtcgtgtatgcgcccgccaagaccggcaacctgttcgtgctcgatcgccgcaccggcaccccggtcgtacccgcgcccgaaatgccggtgccgcaaggcgccgcgcccggcgatcacgtttcgcccacgcaaccgttctccgatctcacattccgcccgaagaacctgctcaccgacgccgacatgtggggcgcgacgatgtacgaccagctcgtatgccgcgtcatgtttcacaagctgcggtatgaaggcacgttcacgccgccgtcgctgcagggcacgctggtgtttccgggcaacctcggcatgttcgagtggggcggcattgccgtcgacaccgaccggcagatcgccattgccaatccgattgcactgccgttcgtctcgcgcctgatcccacgcggcccaggcaacccgatgcaacccgagccgggcgcaaaaggcagcggcaccgaagcgggcatccagccgcaatacggcgtgccgtacggcgtgacgctgaacgcgttcctctcgccgttgggcttgccgtgcaaacagccggcctggggctacatctcggcggtcgatctgaagaccaacgagatcgtgtggaagaagcgcatcggcacggtgcgcgacagttcgccgattccgctgccgttcagaatgggcatgccgatgctcggcggtccgatcgtgacggcgggcggcgtcgtgttcatcggtgcgacggcggacaactacatccgcgcgttcgacgtgaacaacggcaaggaactgtggcgcgcgcgtctgccggcgggcggccaggccacgccgatgagctattccatcgacggccgccagtacatcgtgatcgccgcgggcgggcacggttcgttcggcaccaaactcggcgattacgtgatggcttacgcgttgccg

SEQ ID NO: 28509 - DNA, 1377 bp, Burkholderia fungorum
ttcaatgcagtcgtaatcggtacaggacaaggcggctcgccgctggcggtgcgtctcggtcaaagcggccgtaaaaccgcggtcattgaacgcgcggccttcggcggcacgtgcgtgaacgtgggctgcacgcccaccaaatcctatgttgccagcgctcgcgcagcgcatgtcgcgcgccattgcgcggaactcggcgtgcaggtgagcggagcgatcagcgtcgatctggccgcggtcaaggcgcgcaaggacaggatcatcgggcagtcgcgcgacggcgtcgagaaatggctgcgcggcgcgcagaacgtgagcgtgttcaacggccacgcgcgcttcaccggcgcgcatacgctcgccatcagcgggccggacggcacggtgctcgaagagatcagcgccgacgaaatcttcatcaacaccggcacgcgcgccgtcgtgccgccgctcgaaggcatcgggcggattcgctactacaccaactccaacctgcttgaactgacggaattgccggatcatctggtgattgtcggcggcagctatatcgcactcgaattcgcgcagatctttcgccgcttcggcagccgtgtgaccgtgctggtgcgcggcgaacgcgtgctcactcgcgaggacgccgattttgccgaatccgtgcggaaggtgctcgcccgcgagggtgtggagttccgcttcggcgtgcagccttcgcgggtcgagccgcatccgcatcatccggacgaagtgtgcatcggcttcgagcagaacattcccgcgctcgaagcgtcgcacctgctgttcgccaccggccgcgagccgaataccgacgacctcggcctcgcggccgccggcatcacgacggaccggcacggcacgattccggtcgacggccagttgcgtaccaacgtgccaggcgtgtgggccatcggcgacgtgaacgggcgtggcgctttcactcacacgtcctacgacgactttcagatcgtcgcggccaacctgctcgacggcggcgcgcgcagtgtcgatacgcggatcatggcgtatgcggtgttcgtcgatccgccgctggcacgcgtgggggcttcggaggccgaggtgcgcaaagcggggcgccccgcgctgatcgccaccatgccgatgtcgcgggtgggccgcgcccgcgaacgcggcgagaccgacggcttcatgaaggtgatggtcgaccgcgagagcaggcagattctcggcgcggccattcacggcatcgaaggcgacgaggcgattcataccttcatcgacatcatggcggcgggcgcgccgtatccgaccttgcagtacgccatgcatattcatcccaccatcagtgaactggtgccgaccctgctcgacgggctcaaa

SEQ ID NO: 28510 - DNA, 747 bp, Burkholderia fungorum
atgacccgtttccagaacaagtcggttctcgttaccggcggcagcagcggcatcggcttcgccgcggccaaagcattcgtcgatgaaggcgcccgcgtcgtcatcaccggccgcgacgccgccgcgctcgaagccgccagaacggcgctcggcgccaatgccgtcgcggtgcgcaacgcggccggctcggtggcctcggcgcatgaactggcagcggcggtccgcgcggccggcatccggctcgacgcggttttcgtcaacgccggcacggcgaaattcgcgcccttcgcggacgtcgacgaagccttctgggacgccatgttcgacaccaacgtcaagggcgcctacttccagattcaggcactgttgccgctgctcaatcgcggcgcgtcgatcgtgatcaatggttcgatcaacgcccatatcggcatgccggcgtcgtccgtgtatgcggcgagcaaggccgcgctgatttcgctggcgaagacgttgtcggcggagttgctgccgcagggcgtgcgcgtcaacgtcgtgagccccggcccggtgcaaacgccgctgtacggcaagctcgggctggacgccgccgcgctcgaagccaccgccgcgcagattctcggccaggtgccggtcggccggttcggcacgccggaggaaatcgcctcgaccgtgctgcatctggctgcgccggaatcggcgtttatcgtcggcacggaaatcatcgcggacggcggtatgagccagctt

SEQ ID NO: 28511 - DNA, 1446 bp, Burkholderia fungorum
ctgactctcgtgccgggccaggtaacgctcggtcagttgcgccgcatcattgaagcgcggccgatggtgcagatcgagcgcgcgtcgctcgagcgggtcgaaaaatcgaaggacatcgtgagccggatcgtcgcggacggcaagatcgtctatggcgtgaacacgggcttcggccggctggcaaacacgacgatccccgctgggcggatcgcggagttgcaaaagaatctcgtgctctcgcacagcgtgggcacgggcgaactgatggaagaccgggtcgtcggcctgatcatggcgctcaaggcgatcagtctcgcgcgcggtcactcgggcgtgcgtccgcaagttgtgctcgccatcatctcgatgctcaatgccggcgtctatccgtgcattcccagcaaggggtcggtcggcgcgtcgggcgatctcgcgccgctcgcgcatctggcggccgcgatgttgggcgtgggccacgtgcgcatcgacggcaagcgcgtgccggccgctgaaggcttgagcgtcgccggactcgaagcacttaaactaggtccgaaggaagggctcgcgctgctcaacggaacgcaggcgtcgactgcgctcgcgctctcagggcttttcgccgcggaacgcgtgttcgcttcggcgatggttaccggtgcgttgtcgctcgaagcggtgaaaggctcgaccgtgcctttcgatccgcgtattcatgttgcgcgcggccagcgcgggcaaatcgacgtggcggggcgtctcgcggcactgctcgatggcagcggcatcatcgcgtcgcatggaaacgggactcgcgtgcaggacccgtattcgattcgctgtcagccgcaggtcatgggggcgtgcctcgaccacatccgctacgttgcgggcattctgaccatcgaggccaatgctgcgtcggacaatccgctcgttttcgacaatggcgatgtgctgtctggcggtaatttccatgcggaaccggttgcgctggcagcagacgcgctagcagtggctatctctgagattggcgctatttccgaacgacgtacggcattgttgcttgatagccatatgtcgggcctgccggcgtttctcgtgaaagaaagcggaatcaattccggcttcatgattgcgcaggtaacgagcgccgcgctggcttcggagaacaagtcgcttgcacatcccgcgagcgtggacagtttgccgacgtcggcgaatcaggaggatcacgtttcaatggccacgtttgctgcgagacggctcaaggatatggccgacaacacggccgttatcgtgggcatagaagggatggccgcggcgcagggcatggactttcatcgtccgctgcgttcgagcgaactgctggaggaacagcatgtgcagattcgcgcgcgcgtttccttttatacgaaagaccgctacctcgccgacgacatcgag

SEQ ID NO: 28512 - DNA, 1014 bp, Burkholderia fungorum
atgaatctgcaacgatttcctcgttacccgctgactttcgggccgacgccgatccaaccgctagcgcgtctgagcaagcatctcggcggcaaagtgcatctgtatgcgaaacgcgaggactgcaacagcggtcttgccttcggcggcaacaagacacgcaaactcgaatatctgatccctgaagtgcttgcgcagggttgcgacacgctcgtgtcgatcggcggcatccagtcgaaccagacgcgccaggtggcggccgtggcagcgcatctgggcatgaaatgcgtgctggtacaggagaactgggtcaactactcggacgcggtctacgaccgggtcggcaacatccagatgtcgcgtattctcggcgccgatgtgcgcctcgtgcccgacggcttcgacatcggctttcgcaagagctgggaggaggcgctcgaaagcgtgcgcgccgccggcggcaaaccgtatgcgattccggccggctgctcggaccatccgctcggcggcctcggtttcgtcggcttcgcggaagaggtgcgtcagcaggaagccgaattgggcttcaagttcgactacgtcgtggtgtgttccgtaaccggcagcacgcaagccggcatggtggtgggttttgccgccgacggccgcgctgatcgcgtgatcggcatcgacgcatcggcaaagcccgcgcagacgcgcgagcagatcacgcgaatcgcccggcaaacggcggaaaaagtcggcctgggccgcgatatcacgagcgaagacgtggtgctcgacgagcgcttcgccggtccggaatacggcctgccgaatgacggcacgctggaagcaatccgcttgtgcgcccgcatggagggcgtgctgaccgatcccgtctacgaaggcaaatccatgcacggcatgatcgagatggtgcgcaacggcgaatttccggaaggttcgcgcgtgctgtatgcgcacctcggcggcgtgccggcgttgaacggctacagcttcattttccgcaacggc

SEQ ID NO: 28513 - DNA, 2097 bp, Burkholderia fungorum
aagcccgcggcgaagaacgcgcaggcgagcggtccgcagtcggatccgaaagcgaaggatctcgaacagtttcgagtcagcccagaaggtgaggcgctgagaaccaatcagggcgtcaagatctctgacaatcagaacacgctgcgcgcgggcccgcgcggcccttcgctgctggaagatttcatcatgcgtgagaagatcacgcacttcgaccatgagcggattcccgagcgcatcgtgcatgcgcgcggctcggcggcgcacggcgtgtttcaggtgtacgaatcgatgcaggaatacaccaaggctgcgtttctgcaggaccccgccgtgcagacgccggtgtatgtgcgcttttccacggtacagggtccgcgcggttccgccgatacggtgcgcgacgtgcgcggctttgcagtgaagttctacacgcaggaaggcaattacgatctggtcggcaacaacatgccggtgttcttcattcaggacgccatcaaatttcccgacttcgtgcacgcggtcaaaccggaagcgccgaacgaaatgccgacgggcggttccgcgcacgacaccttctgggacttcgtctcgctggtgcccgagtccgcgcatatggtgctgtggaccatgtcggaccgcgcgatcccgcgcagcctgcgcacgatggagggcttcggcattcacacgttccgtttcgtgaatgcgcaaggcaagggacgcttcgtcaagtttcactggcgcccggtgctgggctcgtactcgctgctgtgggacgaagcgcagaagctggctggcaaagacccggattttcatcggcgcgatctatgggagtcgatcgaacggggggactttcccgagttcgagctcggcgtgcagatcatcgaggaagcggacgaacacaagttcgacttcgacctgctcgatccgaccaaactgattccggaagaacaggtgccggtgaagatcatcggcaagatgacgctcaatcgcaatccggacaacttcttcgccgagaccgagcaggtcgcgtttcatccgggccatgtggtgccgggtatcgacttctccaacgatccgcttctgcaaggtcgtctgttctcgtacacggatacgcagatcagccgcctgggcggcccgaactttcacgagattccgatcaaccggcccgtgtgcccgttcaacaacaaccagcgcgacgccatgcaccggcagaccatcaacgtcggccaggcctcgtacgagcccaattcgctgagcggcggctggccgaaggaaactgatccggcgccctccgacggcggcttcgagacctatcaggagcgcgtggaaggcaccaagattcgcgtacgcagcgaatcgttcgccgatcatttctcgcaggccgcgctgttttacaacagcatgtccccgccggagaaagaccatattgccgcggcttatcagttcgaactcggtaaggtgacgaagccggaaattcgtgcgcgcgtcgtgaacgagattctcgccaacttcgatgcggggctcgcggcacaggtggctgaagggctgggtttgccggcgccgaagaaaggcacggcgaagctgaccggtcccaaggaatcgccggcgctgagcctgctcaaccgcgtgaagccgggcatcaagacccgcaagatcgcgctgctggccgcgcccggttccgatggcgccgcgatcaaaaagctgcagcaggcgctgcaaggcgagggcgccacgccgatgctgatcgccccgacgcttgccgcgatcgacggcatggcgccggacgccacgattgccggcttgccgtcgatcatgttcgacgcggtgatcgtggtgggcggtgatcagggcgcgaaggcgctggcgcaatcgggcgacgcacggcatttcgtgcttgaggcgttcaagcatctgaaggcgatcgcggcaatcggcgcggggcgtgacgtgctcgccgccgcgcacttgccgcacaatgccgacggcgtcgcaaccggcgacgacaagcaggccgctgaagtgctgaaggcgttcatcgaggcagccgggcagcaccgcgtgtggtcgcgcgcgcagcaggctgagaccgtgccggcg

SEQ ID NO: 28514 - DNA, 1188 bp, Burkholderia fungorum
atgttcgaccacattcccgcttatccaggcgacccgattctgggcctgaacgaagactttcaactcgacccgcgcaccaacaaggtcaatctgagcatcggcatctatttcgacgacgccggcaagctgccggtcatgaacgcggtgcgccgggccgaaaccgcgctgctcgattcgatcggcccgcgctcctatctgccgatggccggcctgccgctctatcgcgatgcggcgcaggcgctcgtattcggcgcggacagcgaggcgcgcaaggcgggccggatcgcgacgttgcaaaccatcggcggatcgggcgcactcaaggtcggcgccgatttcctgaagcgctatttcccgggctcgcaggtctggatcagcgacccgagctgggaaaaccaccgcgtcgtattcgaaggcgcggggctcacggtcaacacctatccatattacgacgcccagaccggcggcctgcgtttcgccgagatgctcgacgccattggccgcctgccggaacagagcgtggtgctgctgcacgcgtgctgccacaacccgaccggcgtcgatctgagccctgcgcaatgggccggactggtgccggtattgcagcgccgcaagctgatcgcgttcgtcgatatggcttaccagggttttggcgcgggtctggaagaggacgccgcctgcgtgcgcctgctggccgacgcgggcattccattgatcgccgcgaattcgttctcgaagaatttttcgctgtacggcgagcgtgtcggcgcattgagcgtcgtttgcaaaagcgcggaagaggccgggcgcgtgctcggtcaattgatgtcgacggtgcgcgcgaactacagcaatccgcccacgcacggcgcgcggctcgtcgccaacgtgctggcggatgcgtcgctgcgcgcttcatgggaagcggaactcgccaccatgcgcgaacgcattctcgccatgcgcggcacgatccacgccggactcgccggccgtgtggacgaagtgatgcgcgcacgctacgtcgcgcagcgcggcatgttcacctacaccggcctgagcgaaagccaggtggagcggctgcgcagcgaacacgcggtgtacgtgctgcgctccgggcgcatgtgcgtggccgggctgaacgcgcgcaacgcggagtatgtggcggcctcgatcgcggcggtggtg

SEQ ID NO: 28515 - DNA, 2357 bp, Burkholderia fungorum
atggcccgcacgcacattcccggctttccccgcatcggcgcgcagcgcgaactgaaattcgcgcaggaatcgttctggcgcggcgaatccggcgagccgcatctgcgtggcgtcgcgcgcgaattgcgcgcgcgtcactggcaattgcaacaggacgccggactggatttcgtcaccgtcggcgatttcgcctactacgaccagatgctcaatctgagcgcgctgctcggcgccttgccgcagcgtttcggcttcgaaccgaagacgctgtcgctcgccgagtactacgagcttgcgcgcggcaacgcggcgcagccggccatggaaatgaccaaatggttcgacacgaactatcactacctcgtccccgaactgggaccgcagacgagtttcgacggcggcgtggagtggttgttcgaggagatcgacgaagcgctcgcgctgaatctgccggtcaagccggtgctgatcgggccgatcacttatctgtggctgtccaagagccatgttgccgggttcgaccgtttgtcgctgctgccgaagctcgtgatccgctacgcccgtctgctcgacaagctcaggcagagcggcatcgaatgggtgcagctcgacgagccggccttgtgcgtggatttgcccgcggaatggctcgacgcgttttccgccgcgtatgaggtgctcggcacgtcgggcgtgaaggtgctgctcgccacgtatttcgaaagcgcggcggagcacgcgccgcgtgtagccgcgctgcccgttgccggtgtgcatctcgacctcgtgcgtgccccgcagcagctcgacgcatggcgcgcggcgttgcctgcgcacgcggtgctgtcggccggtgtgatcgacggccgcaatatctggcgcgcggatctcggcgagatcgtcgagtcgctgcagagcttgcaggcggaattcggcgagcgcttgtggatcgcaccgtcgtgctcgctgctgcacgtgccggtctcgctcgacgccgagaaaaaactcgacgccgatctgaaatcctggctcgcgttcgccaccgaaaaactcgctgaagtcgccacgctcgccctcgcgttgcgcgatcccgccgcggccgaaccggcgctcgccgccaccgaccgcgcgctcgaagcacgccgccgctccagcgcggtagtcaacgcgctcgtgcaaaaacgcgtagctgcagtgagcagcgcgatggcggaacggcaaagcccgtttgccgaacgcaaccgtctgcagcgcgaagcgctcggcctgccgctcctgccgaccaccacgatcggctcgttcccgcaaacggcggcgatccgccaggcgcgcgccgcctacaaacgtggtgaactgcgcgcactcgactatctgcagcgcatgcgcaccgagatcgaaatcgccgtgcgcaaacaggaagagctcgggctcgacgtgctggtgcatggcgaagccgagcgcaacgacatggtcgaatatttcggcgaacagttgtggggctatgcgttcacggaaaacggctgggtgcagagttacggctcgcgctgcgtgaaaccgccgatcatctacggcgatgtctaccggcccgaaccgatgacggtcgagaccacgcgttacgcgcaatcgctcacgcagcgcctgatgaaaggcatgctgaccggcccggtgacgatgctgcaatggtcgttcgtgcgcgacgaccagccgcgctcgaccaccgcgctgcaactcgcgctcgcgatccgcgacgaggtcgtggatctggaaaaggccggcattcgcatcatccagatcgacgagccggctttccgcgaaggcttgccgctgcgtcgcgcggactgggccgcgtatctggaatgggccacgcgcgcgttccgcatttcggcagcgggcgtcgccgatcaaacgcagattcatacgcacatgtgttattcggagttcaacgacattctgccgtcgatcgccgcgatggatgccgacgtaatcaccatcgagacctcgcgctcggcgatggaactgctcgacggcttcggcgccttcgcgtatccgaacgaaatcggcccgggcgtctacgatatccactcgccgcgcgtgccgggcgcggacgcgatgcagcgtctgctggaacgcgcgtgcgaagtgattccggccgagcgcctgtgggtcaatccggattgcgggttgaagacgcgcggctggccggaaacggaggcagcgctcgcgaacatggtgcgggctgccaaggcattgcgcgcgaagctggcggcgagacaggcggacgagttgaccgcgtaatgtgatcggccattgaaccagcgtcgaaagccccttaacgcgccatatcgtgccgcgcgaag

SEQ ID NO: 28516 - DNA, 621 bp, Burkholderia fungorum
ttgaagctgtaccactccgcttcgtcgccgaactcacggcgcgtgcgcatctttctggctgaaaagggcgttccggtgacgctcgtcgcagtcgacctcggcaaaggcgagcaacacggcgatacctatcgcgcgatcaatccacggcgcgtcgtgccgacgctggtgctcgaagacggcacgtcgatcggcgaagtgccggcaatccagcgctacgtcgaagagactcatcccgacgcaccgctattcggcaccacaccgaaagacaaggcgctgatcacgatgtgggaacggcgcgcggaacaggagggctttgcctcggtgatggaagcgatccgcaacatcgcgccgggtttgaagggccgcgcgattgccgggccgcacgactacgaacagattcccgcacttgccgagcgcagccggcaacgcgccgccaattttctggccgatctcgacgatcgcctgaaagactccgcgttcgtggcgggtgaacgctattcggtcgccgacattaccgctctggtcacgatcgatttcgccgcgaaagcaatcgacctgcaagtgccggccgatctggaatcgctcaagcgctggtacgacacggtatcgtcgcggccgagt

SEQ ID NO: 28517 - DNA, 715 bp, Burkholderia fungorum
ctgatcaccggcgcactcaccggcatcggtcgcgccaccgctatcgcgtttgctgaaatcggcgcccgcctcgtcgtctcgggccgtcgtgaagccgaaggcaaggcgttcgaaaaagaactgcgcgagctcggcgcggacgcccacttcatccaggccgacgtgcgccgcgatgaagaagtcgcgagcctcgtcgatcagacggttgcccgcttcggccgtatcgacgcgcgtgaacaacgccggcaccgaaggtcagcccggcgcgatcaccagccagaccgtcgagagctacagcgcgacgttcgataccaacgtgctcggcacgctgctcagcatgaagcacgaactgcgcgtgatgtcggcgcagaagagcggcagcgtcgtcaacgtttcgtccacttacggccatgaaggcgcggccttcgcttccgtgtacgccggcagcaagcatgcggtggaaggcatgaccaggtcggccgcgctcgaagtggcgtccaccggcgtgcgggtcaacgccgttgcaccgggaccgaccgacaccggcatgctcgaccgctttaccggcacaccggagaacaaggccgcgctcgccgcgcaggtgccgctcggccgtatcggcaagccggacgacgtggcgcgcgccatcgtgttcctggcgtcggatgccgcgtcgttcgtcacggggcagatcgtgactgtcgacggcggcaag

SEQ ID NO: 28518 - DNA, 1443 bp, Burkholderia fungorum
ctcaacgttcttctcgtcgcttccgaagccctgccgctcgccaaatccggcggcctcggcgacatggtcagcgcatacgccgccgctctgcgcgatgccggcgtcgatgtctcgatcctgatgcccgcgtatccggccgcgctcgaacgcgccgtcgacgtcacgcccgtcgcgcgcatgaccggcctgcccggcggcgacgcccggctcctgcgcggccacatgcccgacaccggcgtgccggtgctgcttctgcagatggatcacctgttcgcgcgcgaaggcctctaccgcgatccgcaaggacgcgactatctggacaacctcacgcgtttcgcatcgctcgctgcagcggccgcgcgagtggcgcgcggcgtgcgcaacgtgaagcgccccgacatcgtgcacgcgcacgattggcatgcaggactcacgccgctgtatctgcggcttgcgggcgttgccgccagaagcgtcttcacgattcacaacctggcgttccagggcaaccatccgctcgctatgggcggctggatcggcgtgccgcccgaattgctggcgcccgcgctttccgacgaacgcagcatcgagttctatggctcgctcagcatgatgaaagccggcatcgtccatgcggatcgggtcacgaccgtgagccggcgctatgcgcgcgaaatcctgacgccgcgtttcgggcacggcatggaaggcgtgttgcaggcgcaggcggccaagctgtcgggcatcgtgaacggcatcgacagcgcggtatggaatccggctaccgacaaacatatcgcgcgcccctattccgtcgacgatacggccggcaagcaggcctgcaagcgcgatttgcagcaggccttcgggctgacgcgcgatccgttcgcaccgctcgtcgccatcggcagccgtctgaccgaacagaagctcgccgacgtcgtcgtgcatacgctgccggcgctgctcgaacggcatccgcgcctgcagttcgcgattctcggccagggcgagcaaggcatcgaacaggcgctgcagggcatcgcggccgcgtggccgggacgcgtcggcgtacagatcggttatgacgagcggcgggcgcacatgctgcacgcgggtgcggacattctgctgcacggcagccgcttcgaaccctgcggactcacgcagctctacgcaatgcgctacggcacgattccggtggcctcgcgcgtgggcggcctggccgatacgatcgtcgactatctgccgcacgacccgcgcggcgacagaaaggcgaccggctttctgttcgacggcgaaactccggatgacgtgatgcatgcactcggccgcgcgctggacgcgttcgtggagccgtcgtcgtggcatgtgttgcagcgtaatgcgatgagccgcgacttcggctgggcaacgtcgacttcgaactatctctcgctgtat

SEQ ID NO: 28519 - DNA, 1008 bp, Burkholderia fungorum
atggggtacgtcatggcactttcgtcgcaaaacgccgcaaagctttccggcagacgccgttttctgcgcacaacgggcggtagcgccatcggtctgtcggccgcgctcgcttttccccggctggcatcgtctcaaacgccgggtccgtcacgaaccgagtccaccacgccgctgccgcgcatggcgcaacgcgtgattcccgctacgggcgagcggctgcccgtggtcggctgcggcacgtggcgcactttcgatgtcggcgacgatcccgccgctcgcgcgcaactcgccgaagttctgcgcatcctgttcgaagccggcggttcggttatcgattcgtcgccgatgtacggttcgtcggaagcggtggccggtgcgttgctcacgcaactcggcgcgcacgggaaagccttcgtcgccaccaaagtctggaccgaaggacgcgaggcgggcatcgcgcagatggaagagtcgctgcgccgctttcagcaaccgcgcatcgacctgatgcaggtgcataacctgctcgactggcgcacgcaactcgccacgctgcgcgactggaaagcgcgcgggcggatccgctatatcggcattacgcactacacgtcgagcgcattcgacgaagtcgcggccgttatgcgcagcgacaagcccgacttcgtgcagatcaattacgcagcggacgaccgcgcggccgaagcgcgcatcctgccgctcgcggcgcaattgggtattggcgtcgtgatcaatcagcccttcggcggcggcgggctgcttgcgcgcgtcggtaaaacgccgctgcctgggtgggcggcggaaatcggctgcgcgagttgggcgcaggttcttctgaagttcgtgctcgcgcagccagccgtgacagtggtgattcccggcacggggcgcccgcagtacatggcggacaatgtccgggccggctccggcccattacccgacaaggcgatgtgcgcacggatcgccgaggcggtgaacgggcgtgcctga

SEQ ID NO: 28520 - DNA, 897 bp, Burkholderia fungorum
gacccttccatccgcgtgttcgatccgcgcttcaagccgttgatcctcgcctcggcgtccgtcgagtgtctgtatcagggcgcgcgctggtccgagggcccggtctggttcggcgacggccgttatctgctgtggagcgacattccgaacgaccgcatcctgcggtgggatgagccgggtggcacggtatcgacgtttcgccagtcgtcgaacaatgcgaatggccatacgcgtgatcgccaggggcacctcgtcagttgcgagcatctgacacgccgcgtcacacgcaccgaatacgacggctcgatcaccgtgctggccgaccattatcgcggcaagcgcttcaattcgccgaacgacgtggtcgtgaaatcggacggctcgatctggttcagcgacccgaccttcggtatcgacggcttctatgaaggcaagcagcaggagtccgaactaccggcatgcgtgtatcgggtcgacagtcagagcggcgaagtcagcgtcgttgccgacgacgtgctgggacccaacggcctggcgttttcgccggacgagtcggttctgtacatcgtcgaatcgcgtggcgagccgcgcaagattcgcgcgttcgatgtgggcggcaacggcaccgcgctggcgaacaaccgtgtgctgatcgacgccggcccaggcacgccggacggctttcgcgtcgacgtgcagggcaatttgtggtgcggctggggcatgggcaccgacgagctcgacggcgtgcgcgtcttcacgccgcaaggcgagccgctcggccacatcgcgttgcctgagcgctgcgcgaatgtgtgcttcggcgggcggcatcgcaaccggctgttcatggcggcaagccacgggctctattcgctgtatgtgaacacgcaaggc

SEQ ID NO: 28521 - DNA, 756 bp, Burkholderia fungorum
atggcaggtcgtctctccggaaaacgcatcatcatcacgggcgcaatcggcaacatcggcaaggaagcggcgcgcggcttcatcgcggaaggcgcgcgagtggtcatcggcgatattgccgaagaggctggccgcgccgtcgccgcggaactcggcgcggccgcccacttcgtccaggtcgacgtgaccagcgaggctagcgtcgccaatctgatcgcgcgcggcgtcgaatggctcggcggcctcgacgcgctggcacagaacgccggtttgcagcgctcgggcgcgatcgccggattcgaacaggccaactgggatgcgctcttcgcggtcaacgcgcgcgcccatttcttcggcgccaagcacgccatcccgcatctgcagcgctcgggcaagggctcgatcatcaacatgtcgtcgctggcgggtaagcgcggcgggccgggtctggtcgcttattcggcgtcgaaaggcgcggtgatcgcgttcaccaccgcgctcgcgctcgaactcgcgcccgacaatatccgcgtgaacgcgatctgcccaggctgggtcgataccgcgttcaaccagccggcaatcgacttcatgggcggcgccgacgcccagcaaaagaagatcgcgtcgctcgtgccgctcggccggcaggcgagcgccacggaaatcgcgccgctcttcgtctacctcgcctccgacgaatcggcgtacgtgacggcgcagtcgttcggcatcgacggcggtgtctacaatggc

SEQ ID NO: 28522 - DNA, 1416 bp, Burkholderia fungorum
ctgatgaaccattacgacgtcgtcgtcattgggtgcggcgcggggggttacaacaccgccattcgggcaagccagctcggactttccgtggcgtgtgtcgaacgggcgtcgaatatcggtggaaccggtatgcggaccggctgcattccgtcccgattgctgcttcatacttctgaaatatacgacctggcgaacaaggggaaaaacgctgctttgggaatcggctgcgcaccaacgctcgacctcacgcagatgatggcctataaagcatcgaccgttgaaaagatgtcgaacagtattcacaaactgctacgcaagcaaggcgtgacactcattcatggcgacgcgctgctggccgcggcgggacaggtcatcgtcaggaaaaccggtggggtgcagcaaaccctgtccggaacagcccttgtaattgccacgggctccgtgccaatcccgcttccgttcgccgctttcgatcacatgcggattctcgattcggctgacgcgttgtcactcggcaaggtaccgcgacatctggcgattatcggcgccggcgccgtgggtgtggagttgggctcgatctggcagcgccttggctcgcgcatcacgctgatcgagcgctgcgatcgcatctgccattggctcgaccgcgatgtgacagcgaccctggagcgatcgctcaggcaacgaggcattgacatcagggtgtcgagcgacgttgtcggactcgataagcactccgacagtgtctctgtccaactccgcgccgcggcatccggtaagatcacccacatcgacgcagacagggttctcgtcgctatcggccgccggccatcgactgccgggatgaacctcgcgagcgtcggcatgcaaaccggctacaagagcacattgtctcagcagggaccggcgacacccgtgacatccatgacgaatggctccggaatatgggtgatcggcgatgcaggccctggtccgatgctgatgtccaaagccgaagaagaagcgatagcgtgcgccgagcggatcgccggcctgcccggattcgtcagctatccgtcaattccctatgttctccataccagcccggaagtggccatgattgggaggaccgaggacgaactccggggaaccggcgcagcgtatagagtcggctactatccgctcgcggccaatccacgcgccgcaatctgcggcacctccgaggggtttgtgaaactgttggtcgacgctgatacgaatctgatcgcgggagctcacctcatagggccgggagcagccgatctgatttcacaagtagccattgcgatggaagcctccatgatctgcgaagactttgcgcgaatctgtcatccctacccggtctggtccgaggcactccgtcaggcggcaatggcggcgggcgggtggatgatgcac

SEQ ID NO: 28523 - DNA, 909 bp, Burkholderia fungorum
cagggccgggttctggtagtgggcagcatcaatacggaccttgtggcccgcgcgccgcatttgccgcgcccgggcgagacgattggcggacacgagttctcgcaggttgcagggggcaagggcgcgaaccaggctgtcgcggccgcgcgcatcggtgcgcgggtggccatgatcggatgcgtcgggagcgacgcgaatggtgcgcagcgggtcaaggatctggaggtggaaggcatcgattgcagcggggtcgaggtccatcccacccaaccgaccggcgttgcgatggtcacagtgtcggacgacggccagaatacgatcgtcgtggtcgcaggcagcaacggcgaactcacgccgcagagcgtggctcgccatgaagcggccatcaaggcgtgcgacgtcgtggtgtgccaactcgaaacaccttgggattccgttcacgcgacgctcgcgcttgcccgtcggctgggcaagatcaccgtgctgaacccggcgccggcaaccgggccgctgcccgcggagtggctgccgcttgtcgactacctcgtgccgaatgaagtcgaggccgccattctggccggcctgccggtcgaatcgcaaagcggcgcgcggcgcgcggcgacggagttgcaacaaggcggcgcgcacaatgtgatcgtcacgcttggcgcgcaaggggcttatcttctggtggaaggtggcgagggcaggcattttcccgcgccgcaagtgcacgccgtcgataccacggctgcgggcgatacttttatcggcgtttttgccgcgcaactcgcctcgcggcaaccgctggaaggcgcgatcaatctcgcgcaacgcgcggcggcgatttccgtgacgcgcgccggcgcgcagccttcgataccgactcgcgcggaagtcgataacgcc

SEQ ID NO: 28524 - DNA, 501 bp, Burkholderia fungorum
atgacgacgcaaaccgaaaccgccctcctggccggcggctgcttctggggcatgcaggacctgttgcggcgctaccccggcgtgctgtccacgcgcgtgggctacaccggcggcgacgtgcccaacgccacataccgcaaccacggcacccacgcggaggcgctcgaggtcgtgttcgacccgcgccagatcagctatcgccagatcctggagtttttcttccagatccacgacccgaccacgaagaaccgccagggcaacgacgtgggaacgagctaccgctccgcaattttctatctcgacgacgaacagaagcgcgtggcagagaacaccgtcgccgacgtcgaagcatccgatctgtggcccggcaaggtcgtcaccgagatcgctcccgcgggtccgttctgggaagccgagccggaacatcaggactatctggaacgcattcccaacggatacacgtgccacttcgtccggcccgactggaagctgccgaagcgc

SEQ ID NO: 28525 - DNA, 1353 bp, Burkholderia fungorum
atacgaagcgcaccggcaaccggacctctctccaccactgtgacgacgacacttgaacaactacgggccggacaactcgcgggcgtgcgccgcctcaaactggcatgcggcctgagcgaatttccacgcgagattttcgatctggccgacacgctggaagttctcgacctgtcgggcaacgcgctgtcgacgcttcccgacgatttgccacgactggtcaagctgcgcattctgttcgcgtcggacaatccgttcaccgagttgccggaagtgctggggcagtgtccgcaattgagcatggtgggcttcaaggcgaatcgcattcgccgggtgtccggcaaagcgctgccattgcaactgcgttggctgatcctcaccgacaacgagatcgaagcgctgcccgccgacatcggcaactgtacgcaattgcaaaaactgatgctggcaggcaaccgcctgcgcgcgcttcccgaggaacttgcggcctgctcgcggctcgaattgctgcgtctcgcggcgaaccggctcggcggattgcccgcgtggctgctgcgtctgccgcggctctcctggctggcgtacgccggcaatccgttcagcgaagcgctcgaagcggcggcgctgatcgacgcgccgaccgcagccattgcgtggcatgagttgaaactcgaaaggcagttgggcgaaggcgcctccggtgtcatctatcgcgcggagcttgcgggtcgtcgcgacgcgtcccgcgctgtcgcggtgaaactgttcaagggcgcggtcacgagcgacggtttgccggactgcgagatggccgcctgcattcgcgcgggcgatcactcgaacctgatcccggtgatcggcaaggtcaaggatcatccggcgggcacgcacggcctcgtgatggagctgatcgatccgcaattcggaaacctcgccggccctcccagcctcgaatcctgcacgcgcgatatctacggcgccgatacgcgtttcgatgcggcttccgcgttgggcgttgcgtacggaatggcgtcgacggcgcgtcatctgcatgaacagggcatcatgcatggcgatctgtacgcacacaatattctgtatggcggacaagggcgtgcgttgctgggcgatttcggcgcggcctccttctatgcacccgaagacgggagcaccgcactcgcgcttcaacgtctcgaagtaagggcatatggttgtctgctggaagagttgctcgaacgatgtgactggccgcactcgcaggcggacgccgccgcgctattggtggagttgaaggacaattgcctgagcgagacgatcgaaagccggccgctattcgacgaaatcacggcacgtttg

SEQ ID NO: 28526 - DNA, 480 bp, Burkholderia fungorum
tacaagctgatggattcgcccgtcggccagttgaaactcgttgcgaacggcgagcgcctcgccgccattctgtggcaaaacgacaagccgaaccgggtgcgtctgggggaattgatcgaagcaaatgaccggcctgtcctgatcgacaccgaacggcagctgaacgagtattttgccggtacgcggcgcgagttcgaccttccgctcgccttccagggaacggagttccagaaacaggtctgggccgcgctgttgacgataccgttcggccagacgcgcagctacgcggaaatcgccgtgcagatcggcaacgtcaacgcggtgcgggcggccggcgcggcgaacggcaggaatccgatctccatcgtggcgccgtgccaccgggtgatcggcgcatccggcgacttgaccggctttgccggaggcctggcgaacaagatgtttttgctgtcgctggaggctgggcagacgtcgctcgaa

SEQ ID NO: 28527 - DNA, 762 bp, Burkholderia fungorum
ctcatctcaactcgacggagtttcaccatgaacaacctcacaggcaagaccgcgctcgtcacgggcgcttcacgcggcatcggccgcgccagcgcactcgcgctcgccgaggccggcgcacaggtgctggttcactacagcagtggcgagaaggaagcggatgccgtggtcgcggaaattcgcgcggccggcggcaatgcgcagaaagtcgcggcgaatctgcgcgaggccgacggcccgcacaagctggccgcgcaggtgcgcgcggtgatcggccaccggctggatattctggtggcgaacgccgggatttcgaaggcggccagcatcgaggacacgaccgtggaagacttcgacgatctgttcgccgtgaacgtgcgcgcaccctacttcctcgtgcagcagttgctgccggtgatgtgcaagggcagcagcgtggtgctgctctcgtcgctcgcggcgcgcgccgcggtcggcacgctgccggcctatgccgcgaccaagggcgcggtcgatacgctcgtgaagcatttcgccgccgcgctcggcgaacgtgacattcgcgtgaatgcggtggcgccgggcgtcgttgaaacggacatgtcgaacttcacgaagaccgacgcgggacgcgaggtgacgctcggcatgcaggcgctcaagcgcgtggcgcagccggatgatattggcggcgccgtggcctttctcgcctcggacgccgcacgctggattaccggcgagaccttgcatgtcgacggtggg

SEQ ID NO: 28528 - DNA, 966 bp, Burkholderia fungorum
atgcaataccgcaaattcggccgcaccggcctgaccgtttcgcgtctttgtctcggcacgatgaccttcggcttgcagaccgaagaagatgtctcgcatcgcattctcgacacggcggcggatgccggcgtgaacttcatcgatacggccaatgtgtatccgctcggcggcggcgagagtattgccgggcgcacggaggagatcgtcgggcgctggctgaagggcaagcgcgaccgcttcattctggcgaccaaagcggtcggcaagatgggaccgtcggcgtgggaccagggcgcctcgcgcaaacatctgctggatgccatcgacgcctcgttgcagcgcctcggcacggattacgtggacctctaccagctccactccgacgacgcgaacacgccgctcgacgaaacgctcgaagcactggacgtgatcgtgcgttcgggcaaggcgcgttatatcggcgtatcgaactttcttgcctatcgactcgcgcgcgccctgggtcgcgccgacgttttgcgcgtggcgcgcttcgtctccgtgcagccccgctataacctgctgttccgccagatcgagcgggagttgctgcctctcgccggcgaagagcaattggccgtgatgccgtacaacccgctcgcgggcggcctgctcacgggcaaacatcaactggatgtcacgccggcatccggccgcttcaccgaggccgtcggcaaggccggcgcgatgtatcagcagcggtattggcataagcgcgagttcgaaacgatcgaacagctgaaagccatcgcggcgccgaccggcgaatcgctgacgcgcgtctcgctcgcctgggtgctggcgaacccgctcatcacgtcggcgatcatcggtgcgagccgcgccgagcagttgagcgatacgctcgcggctgccgatttcgtgctcgatccgcagatcaggacgcaactcgatgaagcgagcatg

SEQ ID NO: 28529 - DNA, 1473 bp, Burkholderia fungorum
aagcggcccgcgccgccttgcacgctggtgatcttcggcgcaggcggcgatctgaccaaacggctcctcatgccggcgctgtacaacctggcggtggatagtctgctcgacgacggcatgaaaatcatcggcgtgaatcacggcgcgcgcgagacgagcgagtggcgcgacgatctgcacaaatcgctagaacagttcgccgccgacaaggccagcacctttcacgccggcaagctcgacgaccaggcatgggactgggttgcgcaacggctcgaatacatggccggcgaattcgaaaccgacgataccttcgcgcaaatcaaacagaagctcgagcaaacgccgggcggcaacgtgatcttctatctcgcggtcagctcgcgctttttcgagccgatcgtcgagcgtctcggcaacgcgggtttgctgaaagagggcgatgtcggcggctttcgccggcttgtgatcgagaaaccctttggtagcgatctcgcttcggcacgcgatctgaacgcgcatatcctgtcgttcgcgaaagaaacgcaggtgtatcgcatcgatcactttctcggcaaggacaccgtgcagagcattctcgcggtgcgtttcgccaatgcgctgttcgaaccgatatggcggcgcgaatatatcgacagcgtgcagatcaccgcttcggaaacgatcggcgtggagggacgcggcaagttctacgaacagaccggcgcgttccgcgacatggtgccgaaccatctgttccagttgctcggcatggttgcgatggagccgcccaattcgttcgacgccgaagccgtgcgcgacaggaaagctgaaatcttcgacgcgatcaagccgttgacacccgacgacgtggtgttcggccaatacgaaaaaggcccggccggtgtcggctaccgtgaagagccggacgtcgcgccggacagcacgacggaaacctatgccgcggcgcgggtgttcgtcgagaactggcgctgggccggcgtgccgttttatctgcgcacgggcaaacggttggctggacgtcgcacggaaatctcggtgcaactgaagcccgtgccgttccgcctgttccgcgacacacccgtggacgcgctcacaccgaatgtgctgaccctgcgcatcgatcccgcacacggtacgagcttcgacttcaatgtgaaaacgcctgggccggtcatgcagatcggtgcggtgcagtcgtcgttcgattacggcgacttttttgcggagcgcgccaacgtgggctacgagaccttgctctacgactgcatgctcggcgacgagacgctgttccagcgcgctgacagcatcgaaacgagctggtgcgcggtagacgacgtgttgcaccccgaatccggcggcgcgatgccggtgcatggctatccggcaggcagcgaaggtcccgcggaagcagacgcgctattggcgcgcggcggtcacgcatggcgcccgttg

SEQ ID NO: 28530 - DNA, 2121 bp, Burkholderia fungorum
atgacatcaactagccgtcgccgtttcctgcagaccgtggcttcatccgccggcgctgctgccgcactgaccgcgctgcccgagtcgattcgcaatgcgcttgccgttcccgcgttttcgcgcaccggcacgatccgcgatgtcgagcacatcgtcgtgttcatgcaggagaaccgctcgttcgaccactacttcggccacttgcgcggtgtgcgtggctacaacgaccgtttcccgattccgctttcgagcggcaagccggtgtggtatcaaccgtcgaaggaaaatccggctcagcctgtgctgccgttccatctggacacggcgaccaccagtgcgcaatgcgtcggcgatctggatcactcctggtacaagacccatgccgcgatcgacggcggccgctacgaccagtggccggccaacaagaccgacatgacgatgggctatcacctgcgcagcgacattccgttccactacgcgctggccgatgcattcaccgtttgcgacgcctacttctgctcgctgccgggacccacgcacccgaaccgcgcgtatctgatgaccggcatggtcgatccgtccggcacactgggcggcccgctgctcgacaacaacgatttcgtcgacggcgacggtccgccgaattaccagttgctctcgtggaccacctatccggagcgcctgcaggccgcgggcatctcgtggcaggtgtatcaacaggggttgaccggctccgatccgctgaacggcaactacggcaccaacatcctgcagaacttcaccaacttcatcaacgcgcaacccggttcgccgttgtacgagcgtgcgcaaaccgtgcgcaccatcgacgacctgaaggccgacgtgctggccaacaagctgccgcaagtatcgtggctgtgcccgccggccgcgtactcggaacacccgagctatacgcccgcatacggcgcggaatacacgtcgcagattctggatgcgctgacgtcgaatccggaggtctggagcaagaccgtgctgttcatcatgtacgacgagaacgacggcttcttcgaccacctcgtgccgccgcaaccggccacgacggctgcgcaaggccagtcgacggtcagcaccgaaggcgagattcacaacgtggtcaatccgttgcgcggcggcagctacaccgccgacggcctgccctacggcctcggcccgcgcgtgcccatgacgatcgtgtcgccgtggagcaagggcggctttgtgtgctcgcaggtgtttgaccacacgtcggtgatccgtttcatcgaagcgcgctttggcgtgtatgagccgaacatcacggcatggcgccgcgcggtgtgcggcgacctgaccacggcattcgacttccgcacgccggactcgaaggtgccgccgctgcccgacacgagcaactacaagagcattgccgacaaccagtgcgcgacgcagccgaagccgaccgttcccgcaacgccgggcgcgatcgatccgcaggaaagcggcatccgttttgcgcgcgcgctgccgtatgaactgcatgtgaacggacacgcggacgcgaagaagaacacgttcgaactctcgatcggcaacaccggcgatcagggcgcgcatttctacgtgtattcgacgaaccgcacggatggtccgtggcgctacacggtcgaagcgggcaagtcgctcagcgagacattcgacctgaccgtgacgagcggcgcgtacacgttcgaagtcttcgggccgaatggtttcgtgcgcaaattcgcgggcaacacgcagcagccgaaggcacataacgcgccgttcggcggcggccacggcaacaacaagccggccgaaccggaagtgaaggtgcaatacgatgtcgcgaacggcaacgtgttcctcaagttcagcaacaagggcggcggcattgcgcggttgacggtgacggacaacgcgtacggtgcgcgtccgcgaccggtgctggtgccggctggcgcgcaaatcgaagaagcatgggtgctggcgtcgagccatcactggtacgacttgacggtgacgagcaatgacgacgccagcttctcacgccgtcttgcgggtcacgtcgagaatgggcggccgagcatcagcgatccg

SEQ ID NO: 28531 - DNA, 1647 bp, Burkholderia fungorum
atgccttcgatcatcggcatcgatcttggaaccacgcatagtctcgcggcaatttggcgcgacagccacgccgtcctcatcccgaacgcgttgggcgagaccctcacgccgtcatgcgtttccatcgacgacgacggctcgatcctcgtcggccgccctgctcacgaccgtttgcatacgcatcccgagcgtaccgccgcgaacttcaagcgttacatgggcacgagccgcaccgtgtcgctcggcgcgcaaacgctgcgccccgaagagctctcttcgctggtgctcaaatcgctgaaggccgacgccgaagcctttctcggcgaagcggtgagcgacgcggtaatcgccgtgcccgcctatttcagcgacgcacaacgcaaagccacgcgcattgccggggaactggccggtctcaatgtactgcgcctcgtcaacgaaccgaccgcggcctcgcttgcgtatggcgtgcatcaacgcgatagcgagcgcaagtttctgatcttcgatctcggcggcggcacgttcgatgtttccgtgctcgacttcttcgaaggcgtgatggaagtgcgcgcgagcaccggtgacaatttcctgggcggtgaagacttcaccgaagcattggccgggttgttctgccagcgcaacggcctgaaaatcagggcgctcgcgccggttgcggcacagcgtctgcatcagcaggccgaacgtgcaaaacgtcagttcacgcagaacggcgttgaaagcgtcacgcttcagctcacaatcgacggcaacgagtacgtgctcgaactcgatgcggcgagcgccgagcgcacctgcgagcatttgctgcaacggctgcgcaaaccggtggaacgcgcattgcgcgattcgaagatcgccgttgctgcgctcgacgagatcatccttgtcggcggcgcttcacgcatgccgatggtccgcaagctggtctcgaagatgttcggtcgcctgcccaccgcacacctgaaccctgacgaggtggtcgcgctgggcgcagcggtgcaggccggccttgtgggacgcgacgccgggctcgacgaaatggtgctgaccgatgtcgcgccgtatagcctcggcatcgatacggccatgcagatcggcccgagtcagttcgtgcccggtcactttctgccgatcatcgaacgcaatacgattgtgccggtgagccgcatgcagcgcattttcaccgtgcgcgaccgtcagccgatactcagcatcaaggtgtttcagggcgaagcgcgtttgaccgcggacaacgtatcgctcggcgaattcacgctcgacgtgccgcccaaaccagcgggagaagcaggcgcggacgtgcgcttcacttacgacatcaacggcgtgctcgaagtggaagccactgcgtttccggacggcaggaagcgcgcgatggtaattgaagaaaaccccggcgtgatgacgccggaagaaatccgcgagcgccttgttgcgttgagtgcattgaagatccatccgcgcgatcaactcgaaaaccgcacgctgctgacgcgcgccgaccgtgtctacgaagagacgctgggcgaccatcggcaatatctggccgcgcatatcgctcgcttccaggcggtgatcgagcgtcagaatgcggacgaaatc

SEQ ID NO: 28532 - DNA, 1341 bp, Burkholderia fungorum
cctgtgacccggggctcgatcattgcgcgtctcgagcgcttgcccagaaacgcgatgcaggtgcgcgcgcgcatactgatcggtctcgcaacgttcttcgacggcttcgacgtgatcgcgattgcggccacgttgccgatcctgatcgcgaagtggcatctgacgccgtgggaaatcggctttctgatcggctccggttcggtcggacaactgatcggcgcgttcgtctttccgtggtacgcggagcgcggcgggcgcgtgaaggcgatcgcgttgagttcggggattatcggcatcaccagcattgcgtgcggttttgcgccgacgttcgcagcattcgttgtattacgcgtgattcaggggctcgggctcggcggtgaattgccggtggccgcgacttacatcaacgagatcagccgggcgcatggccgtggacgtttcgtgctgctgtatgaaatcgtctttccggtcggcctgctcgcttcgaacgcattgggtgcgtggatcgtgccgcgtttcggttggcaagccatgtactttatcggcggcatgccgttgatcctgttcttcgtgctgcgcaaactggtgcccgaatcgccgcgctggctcgccgaacgtgaacggatggccgatgcggacacggcggtgcatgcgttcgaacgtgcggtcaaaggtccgcttccgccggtgacgcattcggccgaattcgaggcgatggccaatcgtcacccgaagcgccgcatgagcgacctgttcggtcccgcgtacctgaagcgcacgcttgccgtggcgatgctgtggatcacctgcggcttcattcaatacggcctctcgacgtggctgccgaccatctatcgcacgatctatcacgcgccgctgcaactcgcgctgaatctggcggtggcggcttcggtgctcggcgtggtgggttcgctgacctgtgcgttgctggtcgacaaggtggggcgtaagccgatcatcaacctgtcgttcgtggcatgtgcgctgtcgttgctgctggcgggcgttttccacgattcgtcggtgtatgtggtggcgacgttctgtgcgttctcgctgggctttctcgcgtgcggttttattacggcctatgtgtatacgccggagctgtatccgaccagcatccgtgcgatgggttgcggtgtcggcggcgcgtggttgaaggtcgcggcgatctttgctcccgctatcgtgtccaagacgatgatcggcgggaatttgcaggtagcgttttatattcttgcggctgtgccgttcctcgcggcggtgacagtgcattttcttgggattgaaaccaagggcaaggtgctggagcaactc

SEQ ID NO: 28533 - DNA, 1392 bp, Burkholderia fungorum
tggcggcaagggcgtggcaacccgtacacaagcctgtatccggcggatcagtcggtcaacatggaaatctcgacggccaatgccgacgacgcccgcgacgccgtggaagccgccgatatcgcgtggcggcgcgcggactggtcgggactgaagccgcatcaacgcgcgctgattctgtaccgcatcgccgatctgatcatggcgcgccatgaagcgctcgcgcaattgcagcgccgcgacaacggcaagccgatcggcgaaacacgcgtgctcgtggcgagcgccgcgaataccttccgttatttcgcggcctgcctcgaaacgctcgacgaagaagtcacgccctcgcgcggcgactatctgaccatgagcatctatgagccgatcggcgtgatcgccgcgattacgccgtggaactcgccgattgcttcggacgcgcagaagctcgcgccggcactcgcgggcggtaacgccgtggtgctgaagccggctgaagtgacgccgttggtctcgctggcattggcgcgcatctgcgaagaggcgggtgtgccgaagggcgttctaagcgtgttgccggggaaaggctcggtgatcggtgacgtgctggtgcgtcatcctctcgtgaagaaggtgtcgttcacgggtggcaccgaagtgggccgcggcattgcgcgcatcgcggcggacaagctgatgccggtgtctctggaactcggcggcaagtcgccgaccatcgtcttcgacgatgccgatctcgatcacgcggtcaacggcgtgctgtacggcattttcagttcgtcgggcgaagcgtgcattgcgggttcacgcctgttcgtgcagcgctccatttacgacacgttcatgaagcgtctcgcggacggcgcgcgcaagctgcgcgtgggcgacccgtcgcgttccgaaacacagatgggtccgctgatcacggcggcgcatcgcgaaactgtcgagcgctatgtcgcgctcggcctggaagaaggcggccgtctgctgtgcggcggcgagcgcccggtcggcgacggccgcgaagcgggcacgtattttcagccgaccattctcgaaggcctgaccaacaacgcccgcatctgccaggaagaaatcttcggcccggtgctggtggccatgcccttcgacgatgaagcctcgttgctgaaagaagcgaacaacagcgtgttcggcctcgccgccggcatctggacgcgcgactacaagcgcgcctaccggattgcccgagcgctcgaagccggcaccatctggatcaacacctacaagctgttctcgatctcgacgccgttcagcggctggaaagagagcggcatgggacgcgagaagggccggctcggcatccgcgaatacatgcaacagaagagcctc

SEQ ID NO: 28534 - DNA, 801 bp, Burkholderia fungorum
ggggctctgatgatccaaatcgacttgaccgggcaggtagcggtggtgacgggcggctcgtccggcatcggcctcgccactgccgaactgtttctgcgagccggcgcctcggtcgcgatctgcggccgcgataccgaacgtctcgcgcaagcggaagccgcgctgaaggcgcagttcccgcaggcgcaattgcttgcgcgccgctgcaacgtgctcgacgccgacgacgtaaaagctttcgcggaagccgtgcagagccgcttcggccgcactggcatgctgatcaacaacgcgggccagggccgtgtgtcgactttcgccgacaccaccgacgaagcctggcgcgaagaactcgacctgaagtacttcagcgtgattcgcccgacccgcgcgttcctgccgatgctgcgcgatgcctccgcatcgaacagcaacgccgcgattgtctgcgtgaactcgctgctcgcactgcaacccgagccgcacatggtggcgacttcgtcggcgcgtgccggcgtgcagaacctgctcaagtcgctcgcggtggaactcgcgccgcagcgcatccgcgtcaattcgattctgatcggcatcgtcgaatcgggtcaatggcgtcgccgttatgcgaaagaagcgcagccgggccaaagctgggaagactggacggcagaactggcgcgcaagaaaaacattccgctaggccgcttcggtcgccccgaagaagccgctcaagcgctcttttatctggctacgacgctgtcgtcctatacgacgggcagtcatatcgatgtttctggaggc

SEQ ID NO: 28535 - DNA, 735 bp, Burkholderia fungorum
ctcaacggacgtcgcgtcctcgtgacgggcggcgcgcgcggtctcggcgcggcgtttgtccgctcgctggtgcaagccggcgcgcgcgtggtgttcggcgacgtgctgcatgaagaaggtgaagcgctagcagcggcgctcgccgaaccaggtcatgcggtcacctacgtgccgctcgatctcgccgaccccgcaagcatcaggcaattcgcggagcagggcgcggcgcaactcggcggcatcgatgcactgatcaacaacgcggccatcaccaactccggcggcaagttcgccgacgagctgtcggtagagacgtgggacgccgtgatgaacgtcaacgtgcgcggcacctggctgatgagcaccgccgcgctgccgtatctgcgcgactcgggccgcggcagcatcgtcaacattgcgtcggacacggcgatgtggggtgcgccgaagctgctcgcttatgtcgcgagcaaaggcgcggtgatttcgatgacccgctcgctcgcgcgtgaattcggcgcgcaccaggtgacggtcaatgcgatcgcgccgggactgaccgaagtcgaggcaaccgcgtatgtgcccgccgagcgtcatcagtattacctgcaaggccgcgcgctcacgcgcgcacaagtgcccgacgacgtcaccgggccggtgctgttcctgttgtccgatgccgctcgcttcgtgaccggccaactgctgccggtcaacggcggcttcgtg

SEQ ID NO: 28536 - DNA, 1791 bp, Burkholderia fungorum
ttgccatgtgttacgcacgcagcaggcattgttgcggacggaggaactgcgactacagttgtgtcagctgcaaacggtgggcaaaccgttaatatagcgccagccgtttcaggcgtttcgcagaatacctacagttctttcaatgttggcgtcgccggcgccacactgaataatgtcggcattaatgcccgaaccattgtcaaccaggtaaccagctctaatccgagtttaatcgaagggcaaatctctgtaacgggttcacgggccaacgtcatactcgccaatccaaatggcataaccgtgaacggtgggtctttcgtcaacacgggtcacgtcgccttgacgacgggacaggtcagttttgacgatctgcagatcgctccgggcattttccagcgcaacgtcgtcctgaatacgaccggcggcgcgatcgtcattgggccgcaggggttgtccagcgcgctggtagacctggatctgatcgcgaagaccatccagatcaacggtccagtggcgaataccttcacttcggcgacggcgatcacgcgtgccgtcgccggcaccagcgccgtcacgctgaacacaggtctgtcgccctcggacaatgccaacgactggctaaccttgcaaacaggccaaccgctggccaccgcgaattccttcgcactcgacatcaccgctgcgggcagcgtgacgagcgggcgggttgaaatcatcgtgaccgacaaggggccgggcgtacgcagcgccggtccgcttgacgcatcgctcggcgatttcacgttgagttccaacggcagcgtccagatatcgaacaccacggtgacggccaacgggaatatcaactttcaggtgcaggacggcatctcgctcaccgataccagggtcaccagcggaacagcaacgcttgatgcttccggggccatcacgctgacgggcagcagcatactcaccaacggcggcgccacgctgtccgcaaacggtattacgctgacccccgacagcgcgcagaccgggtccacgctcgcctctgcaaccgcgggcgtggtgctcgacagcacggcagacatcaccaatctcggctcgctgatccaggggcaggcagcgaccagcggcgatgcgcaatcgctcggcgcggtcacgctcgatgcaagcggcaacatcctgaaccagtcgttgcccggcacccctctgggcatcctgtttggcgtcaagggcgacgttgtggtgagcgccggcggcaacatcgtcaaccagaatgcgcgaatcctgtcgaacgagaacgtgacgatcgccgccgggggggacgtcgacaacatcatcgaccacacgagcggcgtcgacaacggtgttgcatccagctattcgagcgatggctggtcgtttctgtttcttgagcaccacagcagcggcatttcggtgaactatggcgaactatccgatcccactgcgctgtcatatatcacggcggacgccggcaacgtgactatcaccggcaacaacatcaacaacgttggcggctcgatcctctcgaacgacggcgcaatcagcatcaccgcgcgtaactcgctgctcgatcagggtgtgttcaccggtcaggcgcagtttcacgagtcctgcttcatcttctgtcattcgtcggcgtcaagcgacgtgcagctatacggcggcgatatcgaggccggtacgagcatttccctgaaggctggcacgcagattctcaacacgggcggcaccgttctggccgagggcgcactgacactgaacgcgccacacgtcgttgcgcagggc

SEQ ID NO: 28537 - DNA, 1248 bp, Burkholderia fungorum
ctgaataaagacgacctcggcccgtggggcaactacctgcgtcaggtcgatcgcgtcgcgccgtacctcggctccctgtcccgctggctcgaaaccctgaagcgcccgaagcgcattctgatcgtcgacgtgcctatcgaactcgataacggcacggtcgctcacttcgaaggctatcgcgtgcagcacaacgtatcgcgcggtccgggcaagggcggtgtgcgttatcaccaggacgtgacgttgtcggaagtgatggcgctgtcggcgtggatgtcggtgaagaatgctgcggtgaacgtcccgtacggcggcgcgaagggcggcatccgtgtcgatccgcgcaccttgtcgcgtggtgagttggagcgtgtgacgcgccgctataccagcgaaatcggcatcatcatcggaccgaataccgacattcccgcgccggacgtgaacacgaacgagcagatcatggcgtggatgatggacacctactcgatgaaccagggccaaacggccacgggcgtcgtgacgggcaagccgatcacgctgggcggctcgctcggccgccgcgaggcaaccggccgcggcgtgttcgtggtggcgtcggaagccgcacgccgtatcggcgtggacatcgaaggcgcgcgcatcgcggtgcagggtttcggcaacgtgggcgggatcgcggcgcgtctgttccaggaagcgggttcgaagctggtcgcggtgcaggatcacaccggctcgctgtacaagtccacgggtatcgacgcggttgcattgctcgagcacgtcgcaaaacacggcggcgtgggcggcttcccggaagcggatgccgtgagcaatgaagaattctggacggtcgaatcggacatcctgattccggccgcgctggaaaaccagatcaccgaaaagaacgcggcgaagatcaggacgaagatcgtcgtggaaggcgccaacggcccgaccactacggcggcggacgacatcctgcacgatcgcggcattctcgtgattccggacgtggtggccaacgccggcggcgtgaccgtgtcgtacttcgaatgggtgcaggacttctcgagcttcttctggacggaagacgagatcaaccagcgtctggagcgtgtgatgcgcgaagcgttcgccgcggtgtggcaggtttcgagcgagcagaaggtgtccgtgcggaccgcggcgtttatcgtcgcgtgtaagcggattctggaagcgcgcgaactgcgcggcctgtat

SEQ ID NO: 28538 - DNA, 459 bp, Burkholderia fungorum
atgggcgtgtcgggcgccggcaagacgagaattggcgaaatgctggcggagcgcctgcactgcgcgttcaccgacggcgacgcatttcacagcgccgccaacaaggagaaaatgcaccacggcattccgctgacggatgaagaccgctggccctggctgaaaacgatccgcgcggcgattgaggagaagcagacggcgggcgagacggcggtgttcacgtgttcgtcgctgaagcgctcgtatcgcgacgttctgcgcgacggcgacaaggacgtgtgcttcgtctacctcaagggttcgcgtgaggtgctggagcagcgcctgaccacgcgcaccggccattttttcgatccgtcgctgctgcaaagccagctcgatacgctcgaagaaccgggcgccgatgaggcgatcacggtaagcatcgaactgtcgccggaagagatcgtcgacagcgtgctg

SEQ ID NO: 28539 - DNA, 1272 bp, Burkholderia fungorum
atttcaatggatatcgaccagtacatgaccgacctcggccgtcgcgcccgccaggcatcgcgggctatggcgcgggcgtcgacggcggcgaagaacgccgcgctcgccgccgtcgccgaggcgatcgagcgcgacgccgcctcgctgaaagaagcgaatgcgcgtgacgtggccaaggctcgcgagaaaggccacgacgccgcgttcatcgaccgtttgacgctgtcggacaaagcgctgaagacgatggtggaaggtctgcggcaagtcgccgcgctggccgatccgatcggcgagatcagcaatctgaagtaccggccgagcggcattcaggtcggtcagatgcgcgtgccgctcggcgtgatcggcatcatctacgaatcgcgtccgaacgtgacgatcgacgccgcggcgctctgcctcaagtcgggcaacgccaccattctgcgcggcggttccgaagcgctcgaatgcaatacggcgctggcgaagctgatcggcgaagggctggaagccgccggtttgccgcaggacgccgtgcaggtggtggccacctcggaccgcgcggcggtcggcaagctgatcaccatgactgaatatgtcgacgtgatcgtgccgcgcggcggcaagagcctgatcgagcgcctgatgaacgaagcgcgcgtgccgatgatcaagcacctcgacggcatctgccacgtgtacgtggacgatcgcgcggatctgaccaaggcgctgacggtctgcgacaacgccaagacgcaccgctacggcacctgcaatacgatggaaacgctgctggttgcgcgcggcattgcagccgaagtgctgccgccgttgggcaagctgtatcgcgacaagcaagttgaactgcgggtggatgcggcggcgcgcgcggtgctggcggatgcgggcgtgggaccgctcggcgatgcgaccgaggaagactggcgcaccgaatatctcgcgccggtgctggcgatcaaggtggtggacgatctcgatgcggcgatcgagcacatcaacgagtacagctcgcagcacaccgacgcgatcgtcacggaagaccacgatcgcgcgatgcgcttcctgcgcgaagtggattcggcgagcgtgatggtcaacgcgtcgacgcgttttgccgatggtttcgaattcggtctgggcgcggagatcggcatctcgaacgacaagctgcatgcgcgcgggccggtgggactcgaagggctgacgtcgttgaaatacgtcgtgctcgggcacggcgaaggccgt

SEQ ID NO: 28540 - DNA, 789 bp, Burkholderia fungorum
aaaattgccattgctggcgcatcgggccgtatgggccgcatgctcatcgaaaccgtcctcaatgattccgacgctacgctgtccggcgcgctcgaccgcgtgggctccccgcagctcggtcaggacgccggcgcatttctcggcaaacagacgggcgtcgtgctgaccgacgacatcgagcgcgtgttcgccgaatccgactacctgatcgacttcacgcgcccggaaggcacgctggtgcatctggaagcggcgcagcgtcacaacgtcaaaatggtgatcggcacaaccggcttcgacaacgagcagaaggcgcaactgcgcgcagcggcggacaggatcgccatcatgttcgcgtcgaacatgagcgtgggcgtgaacgtcacgctgaagctgctcgaatatgccgcgaagcatttcgcgaccggctacgacatcgagatcatcgaggcgcatcaccgccataaggtcgacgcgccgtccggcaccgcattgacaatgggtgaagtaatcgcccacgcgctcggccgcaatctcgacgactgcgcggtctacagccgcgaaggcgtgaccggcgaacgcgacccgtccacgatcggtttttcggcgattcgcggcggcgatatcgtcggcgaccatacggtgctgtttgcgggcatcggcgagcgcatcgagattacgcacaagtcggcgagccgtctgtcgtacgcgcaaggcgcgcttcgtgctgtacgtttcctcgaaggccacgcaaccggctttttcgacatgcaggacgtacttggcctg

SEQ ID NO: 28541 - DNA, 1254 bp, Burkholderia fungorum
tcgctgtttggccgggtcgtcatagcgctggtggcgggtatcgtgatcggcgccgtgtacccgcatttcgcccaatcgctgcgcccgctcggcgacggctttctcaaactgatcaagatggtgatcggcccgatcgtgttctgcgtcgtggtgagcggcatggcgcatgccggcgacctgcgcaaggtggggcgcgtcggcctgaaggccgtgatctacttcgaggtgatgacgacgatcgcgctcgtgatcggcgcaatactcgcgtatgtcacgcagcccggcgtcggcatgaacatcgatctgcgctcgctggatccttcgtcgctctcgacttacaccgaaaacgcgaagagcctgaaggacacggcaggcttcctgctgaagatcatccccgacacggcgatcaacgcgttcgctaccggcgacatcctgcagattctggtgttttcggtgctgttcggctcggcactctcgctgctcggcggcaaggcgcagcgtgtgagcagcctgatcgacgaactgtcgcaggtgtttttccgcgtaatgggcttcatcatcaagctcgcgccgctcggcgtgctcggggcgattgccttcaccaccggcacctatggcgtcgagtcgctcaagcagctcggcatgctggtgctcgtgttctacgtgagctgcttcgtgttcgtggctgtggtgctgggcgtcgtgatgcggctcgccggcttcagcatcttcaagctgatccgctacctgcgcgaagaactgtcgatcgtgctcggcaccgcctcgtccgatgccgtgctgccgcagatcatgcgcaagctcgaatggatgggcgtcaaggactccaccgtcgggctcgtcattccgaccggctactcgttcaatctcgacggcttctccatctatctcacgctggcggtgattttcatcgcgcaggccaccaatacgccgctgtccgtgcatgacctgatcgtggtggtgctggtttcgctggtgacgtcgaagggcgcgcacggcattcccggctcggccatcgtgattctggccgcgacgttgtccgcgattccggcgattcccgtgctgggtctcgtgctgatcctgccggtcgactggttcgtcggcattgcgcgtgcgctgaccaacctgatcggcaactgcgtggcgacggtggtggtcgccgtgtgggaaaacgatatcgaccgggcgcgcgcgcatcgcgtgctgaatcgcgacgaagcgttgcgctacgtgccg

SEQ ID NO: 28542 - DNA, 987 bp, Burkholderia fungorum
atgacgattcgcgtcgcaatcaacggctacggccgtattggccgcaacacgctgcgcgccttctatgaaaacggcaagaagcacgatatcgaaatcgtcgccatcaacgacctcggcgatgccaggaccaacgctcacctgacgcaatacgacacggcgcacggcaagttcccgggcgaagtgtcggtggacggcgactacctggtcgtcaacggcgacaagatccgcgtgctggccaaccgcaacccggctgaactgccgtggggcgagctgaacgtggacgtcgtgatggaatgcacgggctttttcacgaccaaggaaaaggccagcgcgcacatcaagggcggcgcaaagaaggtgatcatctcggcgccgggcggtaaagacgtcgacgccacgatcgtctacggcgtgaaccaccatgtgctgaaggcatcggacacggtcatctcgaacgcatcgtgcacgacgaactgcctcgcgccgctcgtcaagccgctgaacgacaagatcggtctggtgaacggtctgatgaccacgatccacgcgtacacgaacgaccaggttctgacggacgtgtaccacgaagacctgcgccgcgcgcgctcggccacgcacagccagatcccgaccaagaccggcgcggcttcggcggtcggcctggtgctgccggaactgaacggcaagctggacggctacgcgattcgcgtgccgacgatcaacgtgtcgatcgtcgatctgtccttcatcgccgcgcgcgacacgacggtcgaagaagtcaacgcgatcatgaaggaagcgtcggaaggctcgctgaagggcattctcggctacaaccaggcaccgctggtgtcgatcgacttcaaccacaacccggcttcgtcgacgttcgacgccacgctgaccaaggtgtcgggccgtctggtgaaggtgtcgagctggtacgacaacgagtggggcttctcgaaccgcatgctggacacggct

SEQ ID NO: 28543 - DNA, 1980 bp, Burkholderia fungorum
gccaacgcaatccgcgcgctgtccatggacgccgttcaaaaagcgaactccggccaccccggcatgccaatgggcatggccgaaatcggcgtggcgttgtggtcgcgtcatctgcgccacaacccgaagaacccgcaatgggccgatcgcgaccgtttcgtgctgtcgaacggtcacggctcgatgctgctgtactcgctgctgcacctgaccggctacgatctgccgatcgaagagctgaagaacttccgccagatgcattcgaagacgccgggccacccggaatacggcatcacgccgggcgtcgagacgaccaccggcccgctcggccagggtctggcgaatgcggtcggcatggcgctcgccgagtcgctgctcgccaccgaattcaacaagcctgacgcaacgatcgtcgaccaccacacgtacgtgttcgtcggcgacggctgcctgatggaaggcatctcgcacgaagcctgttcgctcgcgggcgtgctgaagctgaacaagctgattgcgttctacgacgacaacggcatctcgatcgacggcgaagtggtgcactggttccacgacgacacgcccaagcgcttcgaggcgtacggctggaacgtgatcccgaacgtggtcggccacgacgtcgaagcagtggacgcggccatcaagcaggcgaagcaatccgacaaacccacgctgatctgctgcaagacggtgatcggcgaaggctcgccgaacaaggccggcagccacgattcgcacggcgcggcgctcggcgacaaggaagtcgcggccacgcgcgaaaagatcggctggaagtgggagccgttcgtgatcccgcaagaggtctatgcagcttgggacgcaacagaagcgggcgcacgcaacgaatccgagtgggacaaggcattcgccgcgtacgctgccaaatatccgcaggaagccgctgaattcaagcgccgcaacgcgaagcagttgccggcggactggaaggaaaaggccaaggcgatcattgccggcgcgaacgagcgcgcggaaaccgtagcgacgcgcaaggcatcgcaacaggctatcgaggctttgtcggccgtgctgccggaactgctcggcggctccgccgacctgaccggctcgaacctgaccaactggaaggccgccaaaccggtacgcgtgaacgccgaaggcaaggctgccggcaactacgtcaactacggcgtgcgtgaattcggcatgagcgccgcgatcaacggcgttgcgctgcacggtggcttcaaggcgttcggcggcacgttcctgacgttctcggactacagccgcaacgcgctgcgcgtcgccgcgctgatgaaagcgccgtcgatcttcgtgttcacgcacgactcgatcggtctgggcgaagacggcccgacccaccagtcgatcgaacatgttgcgagcctgcgtctgattccgcacctgcaagtgtggcgtccggctgataccgtcgagacggcggtggcctggacccacgcggtcgaacatcatggcccgtcgtgcctgatcttcagccgtcagaacctgccgttctcggagcgcacggacgcgcagatcgccaacatcgagaagggcggttacgtgctgcgcgactggaacgacgagatcgtcgcgcgcaagatcatcctgatcgccaccggttcggaagtcgaactggcgctgaacgcggtcgagccgctggcgcgcgaaggtatcgcggcgcgcgtcgtgtccatgccgtcaaccaccgtgttcgacaagcaggacgccgagtaccgtgaacgcgtgctgccgcaaggcgtgcgccgcgtcgcgatcgaagcgggtgtgacggatttctggcgcaagtacgtgggtctggaaggcggcgtggtcggcatcgacacgttcggcgaatcggccccggctggcgtgctgttcaagcatttcggcttcaccgtcgaacacgtggtagagacggcaaaagccgcactc

SEQ ID NO: 28544 - DNA, 825 bp, Burkholderia fungorum
atggctaaggtctggctggttaccggcagcgcccgcggactcgggcgggaaattgtcgaagcagcattgcaggcgggcgagcaggtgatcgccacggcgcgcgatccgcgtcagttggaggatctgttggcgcgtcatggcgaacggattcgcacggtcgcgctcgacgtcaccgatccgcaggctgcgcggcaagccgtgcaagcggccctcgacgcgttcggccggctggacgtggtggtcaacaatgcgggtttcggccatctggtgccgttcgagcaaacctcggaggacgatttccgcgcgcagatcgacaccaacttttatggcgtcgtcaacgtgacgcgcgcggcgttgccggtgctgcggcagcagcgggcggggcacatcatccagatttcgtcggtgggcggacgcgtcgggatcgcgggcctgagcgcgtaccaggcggcaaagtgggcggtgggcggcttcaccgaggtgctccgccaggaactcgcgcccttcggcgttcacgtcaccgcgctcgaaccgggcggcatgaaaaccggctggggcgatcaggcggcgggcgccacgccggaattgctggcggattacgtgccctcggtcggcgccgtgtcggatatgctctcgcagtacatcggccacgaagccagcgatccggcaaaggtcgcgcaggttgtgctcaagctcgcgtatcacgatgccttgccggcgcatcttttgctcggcagcgatgcgttgcattactgtggcgcaggcgacaaggcgcgcgcggccgacgcgcaagcgtggcaggccgtcagcgtgtcgacggatttc

SEQ ID NO: 28545 - DNA, 867 bp, Burkholderia fungorum
agcacagaatttcgcggcatcatttcgtaccccgtaacaccgttcgatctgcacgacggcagcgttgatgtcccgacgctgaaccggttgatcgatcgtctggtcgacagcggctcgcacggcatcgcaccgctcggcagcacgggcgaaagcgcctatctcagcgacgacgaatgggacacggtggccgaggcatcggtcagacgcgtggcgaagcgcctgccggtcattgtcggcatttccgacctgacgacccgcaacgcggtgcgccgtgcgaagttcgccgaatcagtgggcgccgatgcggtgatggtgctgccggtgtcttactggaagctcaacgaagcggaaatcttccgccattacgcgacgatcgccgaggcgatcagcgtgccgatcatggtgtacaacaatccggcgacgagcggcatcgacatgcagcccgaactgatcgtgaagctcgcgagggagatcgacaacgtcacgatgatcaaggaaagcaccggcgacattcagcggatgcaccggattgcgcagctgtcggacgggcgcgtgccgtttttcaacggcagtaatccgctggcgctcggagccttcgcggcaggggcggccgggtggtgcacggcggcgccgaacctcgtgccgcaatggccagtcaagctttatgaggcttgtgagaagggtgatatggagcttgcgcgagcggttttttatcgcttgctgccgttcctgcagtgcatcatgaagggcggcttgccgacgacggtgaaggccgggcttgcgttgcgagggttttcggtgggcgcgccgcgtaggccgcttcagccgcttgcggagccggcggtgcgtgagttggcggcagtgctg

SEQ ID NO: 28546 - DNA, 648 bp, Burkholderia fungorum
ggtaaagacagtttcggcggctaccttgcgctgcccaaaggcggcaagggaccggccgtcatcatcattcaggaaatcttcggcgtgaacagccatatccgctcggtcgcggatcagtatgcccaggacggctacatcgcgctcgcaccggacgtgttctggcgggtgcagccgcgcgtggaattgacgtatgaaggcgcggatcgcgagaagggcatcgagctgatgcagaagaccaacgtcgatcaggccgtagccgatatcggcgcagccgccgccgcgttgcgtgccatgccggaagtgaccggcaagattgcggcgatcggctactgcttcggcggccggctcgcgtatctggccgcggcgcaaggcacgctcgacgcagcggtggcctactacggcggcggcatccagaaccagctcgacgaagcagcgaagatcaaggtgccgatgcaattccactacggcgagctcgacgcgcatattccggtgtcggctatcggacagattcaggagcgcttcgccggccgcaccgacgccgagttccacatctatccgaatgccgatcacggcttcaactgctcggaccgcgcgtcgtataaccagcgcgccgccgcgctggcgcatggccgcacgttgaccttcctc

SEQ ID NO: 28547 - DNA, 1383 bp, Burkholderia fungorum
tccctgtttcgcaagaagagcgtcgagcacatgatcgccgcaagtgctcagaacgccggtttgaagaaagcgctcggcgcgctcgatctgaccttcctcggcgtcggcgccattatcggcaccggtattttcgtgctgaccggcacgggcgccgtgcaggccggcccggcgctgatgatctcgttcctgatcgcggcgctcgcctgcggcttcgccgccctcgcctacgcagaatttgcctcgacgattccggtggcgggatcgatctacacgtactcgtatgcgacgctcggcgaactggccgcatggatcatcggctgggacctgatgctcgaatacgggcttgccacctccgctgtctcggtgggctggtcgggttatctgcaatcgttgctgtcgggcttcggcgtgtccttgccggttgcgttgacggcggcgccaggtgcgttgccaggtcacgacacgctcttcaacctgcccgcgttcctcgtgatgatggcgatcacggcgctgttgtcgttcggcgtgcgcgagtcggcgcggatcaacaacatcatggtcgcgatcaaggtgatcgtggtgttgctggtcatctgcgtgggcgtctttcatgtgacgccggccaactggcatccgttcatgccgaatggctggaacggcgtgttcggcgcggcggcggtgatgttcttcgcgttcatcggtttcgactccgtgtcgtccgcggcggaagaggtgaagaatccgaagcgcgatctgccgatcggaatcattgcgtcgctgggcgtttgcgcggtgttgtatgtggcggtggccgccgtcgtcaccggcatcgtgccgtcggcgcagttcgcgaatatttcgcacccggtctcgtacgcgttgcaggttgcggggcaaaagtgggtggcggggtttatcgacctcggcgccgtgctgggtatgttgacggtgattctggtgatggcttatggccagacccgggtgattttcgccatgtcgcgcgacgggttgctgccggcgcggctttcgcgggtgcatccgcggttcgctacgccgttttttactacgtggctcgtggggattttctttggattgatcggggcggtggtgccgttgaatgtgctggccgagttgatcaatatcggcacgttggccgcgttttcgatggtgtcgattgcggttctcgttttgcggaagacgcatcctgaattgccgcgggcgttccggtgtcctggggtgccggttgtgccggtgttggcggttgcttcctgccttttcctgatgattaatcttcaggctgttacgtgggtggcgtttgtggtttggttgctcgttgggatggttgtttattttgggtattcgcggaggcattccaggttgagc

SEQ ID NO: 28548 - DNA, 1263 bp, Burkholderia fungorum
ctgcgtttcatcactgcgggcagcgtcgacgatggcaagagcacgttgatcggccgcctgctgtacgacagcaaggctgtgctttcagatcaactctcggccctgtcgcgcgcgaagaataagcgtaccgtaggcgacgaaatcgatctgtcgttgctgacggacggcctcgaagcagaacgcgagcagggcatcacgatcgatgtcgcgtaccgttacttcgcgacggcgaagcgcaagttcatcattgccgacacgccgggtcacgagcagtacacgcgcaatatggtgacgggtgcatcgaccgcgcacgcggcgatcattctggtcgacgcgacgcgcgtgacgtttgtggacggcgtcgcgcaactgctgccgcaaaccaagcgtcatagcgcgatcgtcaagctgctgggtttgcagcacgcaatcgtcgcgatcaacaagatggacctggtcgattacagcgagcagcgcttcaacgagattcgcgacgcgtatgtcgaacttgcgcgtcaactgggcttgaacgatgtgcgcttcgtgccggtgtcggcgctcaagggcgacaacatcgtgacggcgagcgaaagcatgccgtggtacgcgggcgaaccgctgctcgacctgctcgaagcgctgccggtcgaagtaccgacgggccaggcgctgcgtttcccggtgcaatgggtggcgcgccaggacggcagccaggccgacgatttccgcggctacatgggccgtgtggaagccggtgaagtgaagctcggcgatacgatcgtcgtgttgccggccaatcgggaagcgacggttgcagagatcatcgcgccggtgccgggcggcacggctgcggtggaccgcgcgtttgccggtcaaacggtgacgattcgtctggcggaagacgtcgacgtgtcgcgcggcgacaccttcgtgctgcgtgaagcggcgccggagccggcgaagaaactggaagccgacctctgctggttcgacgacacgccgctgtcgacgcaacgcaagtatctgttgaagcagaccaccaacacggtgttcgcgcggatcggtgcgatcaaggaagtgctcgacgtgcatacgctgtcgcaggcgaccgatcgaaaggaactgacgatgaacgatattggccgtgtggcgctgacgttgcagaagccgctggtgtgcgacgtgtacgactcgcatcagggcacgggtgcgttcgtgctgatcgatgaggcgacgcatcacaccgttgccgctgggatgatt

SEQ ID NO: 28549 - DNA, 1665 bp, Burkholderia fungorum
atgtaccaatacgatcagtacgaccagaccatcgtcgatgaacgggtcgcgcagtacgccgatcaggttcgccgccgcttgtcgggcgaattgagcgaagaggagtttcgtccgctgcgcctgcagaatggcctgtatatgcagcgtcacgcgtacatgcaccgtatcgcgattccgtacggcaacctgcgcagcaaccagatgcgcgtgctggcgcagatcgcgcgtgagcacgaccgcggctacggccacttctcgacgcgctcgaacatccagtacaactggatcaagctcgaagaaacgccggaaatcctgcgcaagctcgccgcggtgcagatgcacggcatccagacctcgggcaactgtatccgcaacatcaccgccgaccagttcgccggcgtggcgccggatgaagtggtcgatccgcgtccgtgggcagaaatcctgcgccaatggtcgacgttccaccccgaattcgcgtggctgccgcgcaagttcaagatcgccgtgtccggttcgaaagaagaccgcgctgccgtgcagattcacgacatgggcgtgtatctgaagaagaacgagcagggcgaactggtggccgacattctggccggcggcggcatgggccgcacgccgatcatcggcgcgatcatccgcaaggatctgccgtggcagcatctgctgacgtactgcgaagccgtgctgcgcgtgtataaccgctacggccgccgcgacaacatatacaaggcgcgcatcaagattctcgtgaaggcgttgagcccggagaagttctcggcgcaagtcgaagaagaatggcagcacctgaaggacggtccttcgacgctcacgcaagccgaagtggatcgcgtgtcgcaatacttccagccgccggtctacgaaaagctcgcggatacggacgcttcgtacgaaaagcatctgctggaaaatcgcgcgttcgcccgttgggtcgagcgtaatgtgcgcccgcacaaggtgtcgggttatgcgtcggtcaccttgtccttgaagccgaccacgatcgcccccggcgatgcaacggacgcgcagatggaagcggtcgccgattgggccgacgagtactcgctcggcgaaatccgcgtgtcgcacgaacagaatctgattcttgccaacgtgaagaagcgcgacctgttcgcgctgtgggaaaaggccaaggcgcaggggttcgcgacgccgaacatcggtttgctgaccgacatcatcgcgtgcccgggcggcgacttctgctcgctcgcgaatgcgaagtcgattccgatcgcgctcgccattcaggagcgtttcaacgatctggactacgtgtacgacctcggcgacgtgtcgctgaacatctcgggctgtatcaatgcgtgcggtcaccaccacatcggcaacatcggcattctgggcgtcgataaggacggctcggagtggtatcaggtgacgctcggcggcgagcagggcacgggcgccagcggcgcgcaactcggccgcgtgatcggcccgtcgttctcggcggaagaaatgccggacgtgatgagcaaggtgatcgatacgttcgtggaaaaccgccacgaaggcgagcgcttcatcgaaacgtataaccgcatcggcatcaccccgttcaaggaacgtgtgtacgcttcgcgtcaa

SEQ ID NO: 28550 - DNA, 1356 bp, Burkholderia fungorum
atctccaagtctattttcaaggcatatgacattcgcggcgtaatcggcaagacgctcgacgccgacgcagcgcgttcgatcggccgcgcgttcggcagcgaagtgcgggcgcaaggcggcgacgccgtggtggtcgcgcgcgacggccgcctgtcgggtcccgaactgatccaggccctgtcggacggcctgcgcgcggccggtgtcgacgtggtcaacgtcggcatggtgcccactccggtcggctatttcgcggccagcgtgccattgaagctcgaaggcggcgagcgccgcgtcgattcatgcatcgtcgtgacgggtagtcataatccgccggactacaacggcttcaagatggtcctgcgcggcgcggcgatttacggcgaacagattctcgcgctgcatcagcgcatcgtcgacgagaacttttcggcaggcagcggcacgtacaccgagtacgacattgccgaggcctatctcgatcgcatcgcgagcgacatcaagctcgcgcgccccatcaagatcgtggtggacaccggcaacggcgtggccggcggcctcgcgccgaagctgttcaaaaagctcggctgcgaactggtcgaactgttcaccgagatcgacggcaacttcccgaaccatcacccggacccggcccacccggaaaacctgcaggacgtgatccgcgcgctgaaggaaacggacgctgaaatcggcttcgctttcgacggcgacggcgaccgcctgggcgtagtcaccaaagacggccagatcatctacccggaccgccagctcatgctgttcgcggaagaagtgctgtcgcgcaacaagggcgcgcagatcatttacgacgtgaagtgcacgcgcaacctcgcgaagtgggtgaaggacaagggcggcgagccgctcatgtggaagaccggccactcgctcgtcaaggccaagctgcgcgaaaccggcgcaccgctcgccggcgaaatgagcggccacgtgttcttcaaggaccgctggtacggtttcgacgacggcctgtacacgggcgcgcgtctgctcgaaatcctcacgcgcgtggcggatccgagccagctgctgaactcgctgccgaactcgaactccacgcccgaactgcaactgaagctcgaagaaggcgaaaacttcgaactgatcgcgcgcctgcagcagaacgcaaagttcaccggcgcggacgacgtcgtgaagatcgacggcctgcgtgtcgaatatccggacggcttcggtcttgcgcgttcgtcgaacaccacgccggtcgtggtgatgcgtttcgaagccgataacgacgcggcgctcaagcgcattcaggaagacttccgccgcgtgatc

SEQ ID NO: 28551 - DNA, 929 bp, Burkholderia fungorum
ctgccatcatcgattccatgcagccaatcgtctcggtcacgaacctgtcgaaaacctatgccagcggttttcatgcactcaagaacatcaatctggcgatcaaccgtggggaaatctttgcgttgctcggcccgaacggcgcgggcaaaacaaccctcatcagcattatctgcggcatcgtcaatgcgagcgaaggcagcgtaacggtggacggccgcgacatcgcgaccgactatcgcgccgcgcgctcgctgatcggcctcgtgccgcaggagttgaccaccgacgccttcgaaaccgtctgggcgaccgtgtcgttcagccggggcctgttcggcaagccgaaaaaccctgcatacgtcgaaaaggtgctgcgggacctgtcgctgtgggaaaagcgcgatagcaagatcatcacgctttcgggcggcatgaagcgccgcgtgctgatcgccaaggccctctcgcacgaaccgcgcgtgctgttcctcgacgaaccgaccgcaggcgtggacgtggagttgcgccgcgacatgtggaagctggtgcgctcgctggcgcagagcggcgtgacgatcatcctcaccacgcactatatcgacgaagccgaagaaatggccgaccgcatcggcgtgatcaacgcgggcgaaatcatgctggtcgaagagaaaacggagctgatgcgcaagctcggcaaaaagcagttgacgctgcaactggagagcccgcttgcgcaagtgccggtctcgcttggcggctacgggctcgccgtcgcgaaaggcggcaacgagttgatctacacatacgagagcgagggcgggcgcaccgacatcatcgcgctgctcaaggcgctcgacgacgccggcatccgcttcaaggacctgcagaccacgcaaagttcgctcgaagacatcttcgtcagtctgctc

SEQ ID NO: 28552 - DNA, 1422 bp, Burkholderia fungorum
cgccatgatctgctgatcgacggcaagcgcttgccacccggcaccggcgagtattccgtcgacatcgaccccgccaccgaagagccgatcgcgctggtagcgcaaggcagcgccgccgacgtggacgcggccgtgcacgcggcacgtgccgcactgaaagtgtggaacgcgatacggagcgccgagcgcggccgcattctgatgcgtcttgccggcctgatgcgcgcgaatctcgaggaactcgccgcgctcgaaagcctcgatgccggcaagccgatcgccgcggtgatgcgtcaggacattccggccgcgatcgatacgctcgaatactacgcaggctggtgcgacaagatcaacggccaggtcgtgccggtgcggcccgatgcattgacgtacacattgcgtgaaccggtcggtgtggtcgccgcgatcgtgccgtggaatttcccgctgatgatcggcatgtggaagatcgcgccggcgctcgcgtgcgggtgcacgctgatcgtcaagcccgcggagatcacgccgctgagcgcgctgcgcatcggcgaactcgcactcgaagcgggcgtaccgccgggcgtgctgaatatcgtcacgggcaagggacgcgtggtcggcgacgcgctggtcgcgcatcccggcgtcgacaaggtgacgttcacgggctcgccttccgtggggcgcggcattctgcaaggcgcggccggcaatttcaagcgcgtcacgctggaactcggcggcaaatcggccaacctgattttcccggatgccaatctcgacaacgcggtgcgcgcggcggcggcgggcatcttcttcaataccggccaggtgtgttcggccggctcgcgcattctcgcccatcgcgatgtgtacgacgaagtagtcgagcgcctcgccgcccgagccaggtcgatcaaggtcggcgatccgtcgtcacgcgaaacgtcgatggggccgctcatctccgcggcgcagatgaaaacggtgctgggctatgtcgaaacggggcgcgccgaaggggcgtcgctcgtgaccggcggcgcgcgggtgggcgagcgcggcttctttgtcgagccgactgtctttgccgacgtcgagcatgaaatgcgcatttcgcaggaggaaatcttcggtccggtggtgagcgtgatccgcttcgacgacgaagccgacgcgatacggattgctaacggtacgttatatagcctcgccgcgggcgtgtggagcgcggatatcggccgcgtacaccgggtggcacgggatctgagggcggggaccgtgtggatcaatacctatggctacaccgatgtgcgcctgccgtggggcggatccggcgactcggggttcggccgcgaacacggtgacgtcgcgattgagaatttcaccgaacccaaggcggtgtggctcgctatcgac

SEQ ID NO: 28553 - DNA, 1233 bp, Burkholderia fungorum
gaaatggattttgaaactgtttcggtggttggcctcggctacattggacttccaacagcggccgcatttgcggcacgccgcaagcgtgtcatcggcgtggacgtcagccagcatgcggtcgacacgatcaaccgcggcgccattcacattgttgagccggagctcgacatgctggtgcacgcggccgtaacgcaaggctatctgcgcgcaacgatcacgcccgagccggcagatgcgtttctgattgcggtgccgacacctttctcggacggctacaagccggacctccgtttcatcgaggccgcgagccaggcgattgcaccggtgctcaagaaaggcgatctggtggtgctcgaatcgacttcgccggtcggcacgaccgaacagatggcagcgtggatggcgcaattgcgtcccgatctcactttcccgcaacaggcaggcgaacaatcggatatccgcatcgcgcattgtccggagcgcgtgctgcctggtcacgtgattcgcgaactggttgagaacgaccgcgtaatcggcggcatgacgccccggtgcagcgaattggcgcgcgaactctatcaaagctttgtgcgcggcgaatgcatcctgacggatgcccggacagccgagatgtgcaagctcaccgaaaattcattccgcgacgtcaacatcgcgtttgccaacgaactctcgatcatctgcgacaagctggatatcaacgtgtgggagttgatccgccttgcaaaccggcatccgcgcgtgagcatcctgcagccggggcccggcgtgggcggtcattgcatcgccgtggacccctggttcatcgtggattccgcaccggagcaggcgcgcctgattcgtaccgcgcgaacggtcaacgactcaaagccgggctatgtgatcgaccgcgtggaacgcgcggcgcggcgcttcaaggatccggtgattgcgtgcctcgggctggctttcaaagcggatatcgacgacctgcgcgaaagtccggcggtcgaaatcgccgacgaactcgcggagcgattcgcgggccaggtggtggtcgtcgaacccaatgtcagaacgctgcccgcagcgctcgacggaaaggtccggctctgcgaattgaacgaagcgctgctggaggcggacattatcgtcattctggtcgaccacgcgcagttccggcgggtggatccggttcgattccaggcgaaggtggtgatcgatacgcgtggcgtt

SEQ ID NO: 28554 - DNA, 789 bp, Burkholderia fungorum
cttcgaatcgcaaccttcaatatcaacgggatccgctcgcgcctgccggcgctcttgcaatggctcgaacgcgaggcgcccgacattgtctgtttgcaggaattgaaggcggcggacagcgcctttcccgtcgagcaactgcgtgacgccggctatggcgcgatctggcaaggtcagagcgcatggaacggcgtggcgatcctgtcgaaaggcgaggcgccgctggagagccgccgcggcctgcccggtttcgaggacgacacgcacagccgctatctcgaagccgctgtcggcggcatcgtggtggcgtgcctctatctgccgaacggcaatccgcaaccggggcccaagttcgactacaagctcgcgtggttcgatcatctgatcaggcacgcggcgaagctgtacaggagcggtcatccggtcgtgctggcgggcgacttcaacgtggttcccaccgacgaagacatctacaacccgcgctcctggctgaaggacgcgttgctgcaacccgagagccgcgagcgctaccggcaactgctcgcgcagggctggaccgacgcgctccgaacgcgtttcggcaacgaacgggtctacaccttctgggactatttccgccggcattgggagaccaattccggtttgcgtatcgaccatctgctgctgagcgccgacctcgcgccgcgcttgcgcgatgcgggcgtggaccgctgggtgcgtggagagccgcacgcgagcgatcatgcgccgacgtgggtcgaactggagatgggcgcgggacgccgcaag

SEQ ID NO: 28555 - DNA, 1404 bp, Burkholderia fungorum
atgagcaaacaggcaatcggcgtggtggggctggcggtcatgggccgcaatctggcgctcaacatcgagagccgcggccatgcggtgtcggtgttcaaccgtagccgcgagaaaaccgacgaactcatcgccgaatatccggacaggaagctggtgccggccttcacgctggaagaattcgtggagtcgctggaaaaaccgcgccgcattctgctgatggtcaaggcgggcgagggcaccgacgccacgatcaaccagttgaaaccgctgctggacaagggcgacattctgatcgacggcggcaacacgcatttcaccgacaccatccggcgcaatcaggatctggctaaatccggcctgcatttcatcggcacgggcgtgtcgggcggcgaggaaggcgcgctgaaaggcccgtcgatcatgccgggcggccagcgcgacgcctacgacctcgtcgctccgatcctcaccgaaatcgccgcgaaggcgccggacggcgagccgtgcgtcgcctacatgggaccggacggcgcgggccacttcgtgaagatggtgcacaacggcatcgaatacggcgacatgcagctgatcgcggaaagctacgcggtgcttaagcaggtggttggactctcgaacgaggaactcggcaaggtctacacggagtggaatcagggcgagctcgacagctatctgatcgaaatcacctcgaagattttcagcaagaaagacgaagaaaccggcaaggatctggtcgacgtgattctcgatcgcgccgcgcagaagggcaccggcaagtggaccagccagaacgcgctcgacctcggcgcgccgctgccgctgattaccgaagccgtgtttgcgcgcgtgctgtcgtcgctgaagacgcagcgcgtggccgcgagcaaggtgctggagggcccggcggccaggccgctcggcgccgagcgcgaggctttcatcgaatcggtgcgccgcgcgttgtatttcagcaaggtgatttcgtacgcgcaaggcttcgcgcaactgcgcgcggcgtcggaagaatacaagtgggatctggactacggcacgatcgcgaagattttccgcgccggctgtatcatccgcgcccgcttcctgcagaagatcacggacgcttatacgaaagacaaggcgatcgccaatctgctgctggacccgtatttccgcgacatcgcgaagaactaccagtcggctctgcgcgaagtcgtgatcgcggcgatcaacgcgggtgtgccggtgccggctttcgcgtcggcgatcgcgtatttcgacgcctaccgttcggaacgcctgccggcgaacctggtgcaggcgcagcgcgatttcttcggcgcgcatacgttcgaacgtatcgacaagccgggcagtttccacgcgaactgg

SEQ ID NO: 28556 - DNA, 2409 bp, Burkholderia fungorum
accgtcgacgcgctacggcgctcaatttccaaccgcatgatgtacggcgtcggcaaagacgccgtcaccgcgcatccgcacgactggctgcacgccgcggcgctcgccgtgcgcgaccggctggtcgcgcgctggatgaagaccacgcgcctgcaatacgaacaggacgtgaagcgcgtctactacctgtcgatggaattcctgatcggccggacctttacgaacgccttgctggcgctcggcatccacgaccagatgaaggaggcgctcgcgagtctgggcgtcgacatgcagatgttgaccgatatcgagccggacgccgcgctcggcaacggcggcctcggccggctcgcggcctgttttctcgattcgatggcgacgctcggcattccgggcttcggctacggcatccgttacgagtatgggatgttccgtcagcagatcgtcaacggcgagcaggtcgaagcgccggactactggttgcgcgcgggcaatccgtgggaatttccgcggccggaagtcacgtacatggttcatttcggcggccgcacggtgcagcgcggcgaccatgtcgaatggatcgacaccgagcatgtgaacgccaccgcgtacgacacggtcattcccggctacgacacggacgcgaccaacaccttgcgcctgtggtcggcgcgtgcgaccgaagagctcgatctgggcgcgttcaatcgcggcgactaccgcaacgcggtcgacacgaagaacatgtcggagaacgtgtcgcgtttgctgtatccggacgactcgacaccggccggccgcgaactgcgtctgcgtcaggaatactttttcgtttcggcgaccatgcaggatctgattcgccgctatcagcgcacgcacagcacgttcgggcgcttctccgaaaaagtggcggtgcatctgaacgatacgcaccccgtgctggcgattcccgaactgatgcgtttgttggtggatgtgcaccgtctgcaatgggacaaggcgtggaaccatgtcacgcagatcttctcgtacaccaaccacacgttgatgcccgaagcgctcgaaacgtgggacgtcgagatgcttgcgcgcctgttgccgcggcatctcgagatcatcttcgagatcaacgcgcagtttctcaagcacgtcagcgagcagtcggatcatgacggcgagatgatccgccgtatttcgctcgtcgacgaatatgggcagcggcgcgtgcggatggcgtatctggcgatcgtggcgagccagaaggtgaacggcgtctcgaagttgcattcgcaactgatgacccgcgatatctttgccgacttcgcgcgtatctatccagaccgcttcaccaatgtcaccaacggcatcacgccgcgccgctggctcgcccaggcgagcccgtcgctgtcgtcgctgatcgaccagaagatcggcaggcactggcgcaccaatctgttcgagctggagcagttgcgcgaactgcgtaacgacagcggctttatcgatgctttccgtgaagcgaaacggcagaacaaactaaggctcgtgcaccgcctcgcgcatcacaccaagctgcatttcgatccggatgcgttgttcgatctgcaggtcaagcgcattcacgaatacaagcggcagttgctcaacgtgctgcatgtgatcgtgcgctacaaccagattcgcgcgaaccccgagcgtgactgggtgcctcgcgtggtgctgttcgccggcaaggccgcgtccgcttaccggatggccaaaagcatcatcaagctgatcggcgacgtgagccagaaggtcaatcacgatccgctgatcggcgaccgcatgaaagtggtgttcgtgccgaactacggcgtgagcgtggcggagctgatcattccggccgcggatctgtcggagcagatctcgatggccggcacggaagcctccggcaccggcaacatgaagctcgcgctcaacggcgcgttgacgatcggcacgatggacggcgccaacatcgaaatctgcgacgcggtggggcgtgagaacatgttcattttcggctacacggcggacgaagtggaccgcctgcgtgccaccggctaccggccgcggcagatctacgaagagaatccggaactgcgcatggcgctcgatcagatccgctcgggcttcttctcgccggacgatccgctgcgcttcgcggatattttccatacgctggtggactggggcgatcactacatggtgctggccgatttcgccgcgttcgcgaaggcgcaggacgaggtggacgcgcgcttcgtcgacaagcgcgcgtggaccgaaagcgcgatcgagaacgtggcgggcatggggcagttttcgtcggaccgcaccatcggcgaatatgcccgcaacatctggcatgtgagtccgctcaatatc

SEQ ID NO: 28557 - DNA, 654 bp, Burkholderia fungorum
cagaccatcgaaatcgaaaccgcaccgaatcctgaattcgccgtgatcctgctgcatggtctcggcgccgacgccaacgacttcgtgccgctggttccggaattgcgtctcgccaatggacccgccgtgcgtttcgtgtttcccaacgcgccggagatcgccgtgaccgcgaacaacggctacgtgatgcgcgcgtggtacgacatccgttcgttccagtcgatcgaacggcaggtcgacgaggcgggcatcgaggcgtcgtgcgcgaccgtgaggcaactgatcgccgggcagaacgcgcgcggcattccgaccacgagaatattcctcgcggggttttcgcaaggcggggcgatgacctactcagcggggctcacacatccggccacgctcggcgggttgatcgtgatgtccggttacctgccctccagagccttcatcgagagccgcctcgcgcccgcgaaccacggcacgccgatctttgccgcgcacggcgagtacgaccaggtgttgccgatccagctcggcgaggccgcgcgcgacttcgcgctggcgcagggcagcaaggtggagtggcatgcgtatgcgatggagcattccgtatgcggcgaagaagtcgccgcactgcgcgcatggcttggtgcgcgcatcgcg

SEQ ID NO: 28558 - DNA, 855 bp, Burkholderia fungorum
atgctgaaagtcaccaaagccgtgtttcccgtagcgggcctcgggacacgattcctgccggctaccaaagcgagtccaaaggaaatgctgccgatcgtggacaagccgctgattcaatacgcggttgaagaagcgattgccgccggcatcaccgagatgatcttcgtgacgggccgcagcaagcgcgccattgaagatcatttcgacaagtcctacgagatcgaagccgaactcgaggcgcgtaacaagcagaagctgctcgatctggtgcgcagcatcaagccggccaatgtcgactgtttctatgtgcgccaggccgaagcgctcggtctcggccatgcggtgctgtgcgccgagaaactggtgggcgacagcccgttcgccgtgattctggccgacgacctgctgcacagctcgaagccggtaatgagccagcttgtcgatacgttcaaccactatcacagctcggtgatcggcgtggaaaccatcgcgcgcgaagacagccgctcgtacggcgtggtggacggccgcgaatgggaagacaacgtgatcaagctgtcgggcatagtcgagaagccggcgccggacaaggcaccgtcgaatctcggcgtggtgggccgctatgtgctgatgccgaccatcttcaagcatatccgcgcgttgaagccgggtgcgggcggcgagttgcaattgaccgacgcggtgcaatcgctgctgaccgaagagcaggtgcttgcgtatcgctatttcggcacgcgtttcgattgcggcagcaagctgggctatctgaaggcgacggtggaattcgcgctgcgtcatccggaagtgaaggcggaattcgaagcgtatttgcag

SEQ ID NO: 28559 - DNA, 1497 bp, Burkholderia fungorum
atgagttaccaatacgatgaacgcgtcgacggcccgctcgcgacgcacgacaaagccaccgtcgtcgcacaattgcaggcgctgatccccgatctgccactccttcacgaacaggaagacctgcgtccgttcgaatgcgacggcctcgccgcctatcgcgcaacgcccatgatggtcgcgctgcccgacaaggtcgaacaggtcgaggcgctgctgaaattcgccaacgctcacaagattccggtggtcgcgcgcggcgccggcacgggtttgtcgggcggcgcattgccgctggacaaaggcattctgctggtgatggcgcgctttaaccggattctcgaagtcgatcccgaggcctgcgtggcgcgcgtccagcccggcgtgcgcaatcttgcgatctcgcaggccgccgcgccacatggcctgtactacgcgcccgacccgtcgtcgcagattgcctgctcgatcggcggcaatgtcgcggaaaacgcgggcggcgtgcattgcctgaagtacgggctgaccgtcaataacatcctcaagctcgagattctcaccatcgacggcgagcgcatcacgctcggctcggacgcgctcgacgcgccgggtttcgacttgctcgcgctcttcaccggatcggaaggcatgctcggcatcgtcaccgaagtcaccgtgaagctgctcaccaagccacaaagcgcgaaagtactgctggccagtttcgacgacgtcgaaaaagccggcgcggcggtcgcgcagatcatcggcgcgggcgtgattccgggcggcctcgaaatgatggacaacctcgcgatccgcgcggcggaagacttcatccacgcgggctatccggtcgatgccgaagcgatcctgctgtgcgaagtcgacggcgtggaaagcgacgtgcgcgaagacgtggcctgcgtggaagcgctgctgcgcgcagccggcgccaccgacatccgtctcgcgaaagacgaggccgaacggcagcgcttctgggccggccgcaagaatgcgttccccgccgtgggccgtatctcgcccgactactactgcatggacggcacgattccgcgccgcgaattgccgcgcgtgctcaaaggcatcgaagacctctcgaaggaatacggcctgcaggtcgccaacgtgtttcatgccggcgacggcaacatgcatccgctgatcctgttcgacgccaacgcgcccggcgaaaccgaacgcgccgaggcgatcggcgcgcgcattctcgaactgtgcgtggcggtgggcggcagcatcaccggcgaacacggcgtgggccgcgaaaagatcaaccagatgtgcgcgcaattcaatagcgacgaactcaccttcttccacgcactgaaagccgcattcgatccgcaaggtctcctcaaccccggcaagaacgtaccgaccttgcatcgctgcgccgaattcggctcgatgcacgtgcatcacggcgcgctgccctttcccgaactggagcgtttc

SEQ ID NO: 28560 - DNA, 2154 bp, Burkholderia fungorum
tccaccagtgtaaaaaccgtgtgcccctactgcggcgttggctgcggcatggtgctgcacgtcgaggacggccaggtggtgaaaatctccggtgacaaggagcacccggccaatttcggacggctgtgcacgaagggccagtcggcgcacgtcgcgttgcgcaagtcgggacggctggagggggcgttcgtgcgtcatgcgcgcggtcgggacccggcgccgttgcccatgacgcaggcgatcagcgccacggcagcgcgtttgcgcggcctgctcgatgaacatgggccggatgcgctgtcgttctatgtttccgggcagatgtcgatcgaggcgcagtacctcgtcaacaagctcgccaaaggcttcgtgggcaccaacaacatcgaatcgaattcgcgcctgtgcatggcgagcgcgggcagcggctacaagctctcgctcggcgcggatggtccgccgggatcgtacgaagatatcgaccacgccgacctgttcttcgtgatcggcgcgaatatggccgactgtcacccgattctgttcctgcgcatgatggatcgcgtgaaggccggcgccaaattgatcgtggtcgatccgcgccgcaacacgacggcggagaaggccgatcttttcatgcagatcaagccgggcaccgatctcgcgttgctcaatggcctgctgcatctattgcacgaaaacggccatacggatgccgcttttatcgccgaggccaccgaaggctgggaggcgatgcccgcgtttctcgccgactacacgccggagaaagccgcgcagatcaccggccttgccgtcgaggatatccgtgcggccgcgcagatgatcggcagcgccaatgagtggatcagttgctggacgatgggcctgaatcaaagcacgcacggcacatggcacaccaacgcgatctgcaatctgcatctcgcgacgggcaagatctgccggcgcggcagcgggccattttcgttgaccggccagcccaatgcaatgggcggccgcgaaatgggttacatggggccgggtttgccgggccagcgttcggtgctggtggaagaagaccgcgcgtttatcgaagacctgtggcgcattccaaagggcacgctcaagcccgaagccggcaacggtacgatcgacatgttcacgcgcatggcggcgggcgagatcaaggcgtgctggatcatctgcacgaatccggtggcgagcgtagcgaatcgtcagaacgcgatcgacggattgcgcgcggcgcaactcgtgatcgcgcaagacgctttcctcgacaccgagaccaaccgttacgccgacgtgctattgcccggcgcgctctgggccgaagcggaaggcgtgatgatcaactcggagcgcaatctcacgctgatgcaaaagggcgtcgagccgccgggcgccgcgctgccggactggcagatcatcgcgcgtatcgcctgcgaaatgggttacgcagaaggcttcacctacgcgagcgccgaggaagttttcgcggaaatcacccgcgtgtcgaatccgaaaacgggctatgacctgcgcggtgcgagccatcgccggttgaaggaaacgccgttgcagtggccgcttgcatcggacgaatcagcggagcgcaatccggttcgctatctcaacgacggcgtgagccagacactcaaggaactggcggacggcagccgtccgcggcttgtttttcccacggcgagctgcaaggcggtgttcttcgcgcgtgcttatgcagcgccggccgaattgccggatcgtgaatttccgatcgtgctgaatacgggccgcttgcagcatcaatggcacaccatgaccaagaccggcaaggtcgcgatgctcaacaagctgaacccggcgccgttcgtcgagattcatcccgaagatgccaccacgcttggtatcaaggcacaggacccggtggagatccgttcgcgccggggccgcgcggtgttgccggccgtcgtgaccgaacgcgtgagcgcgggcagttgctttgcgccgatgcactggaacgatgtatttggcgacgacctgtgcatcaacgccgtgacgagcgatgccgtcgacccgatctcgcagcagcccgaactcaagttctgcgcggtcgcgttgagtccggtggcggcggacagc

SEQ ID NO: 28561 - DNA, 1780 bp, Burkholderia fungorum
aacgcgccgttcgatacgaccagccgtctgtacgtggatggcttgcttgccggtctgtatagccgcagcgcgatggttcccgccgcgtcggcccctacgcttgcggtgtcgcatgcggagacgtcgcacgcatccggcgtgcggatcgtgcgcgcacgtcccaaggtcacactgctgtgggcctcgcaaaccggtaacaccgagtcgctgaccgaaggctatgccacccgtctgatggaatcggggtttgaaatccgcacgtcgtgcatggcggattatccggcttcggcgctcgccaaagcccaatacgtgctgctgatgacaagcaccttcggcgatggcgacccacccgacaacgcacaaagtttctggacgcaattgagcggcgagggcgcgccccggctcgacggcgtgcgcttcgcggtgctcgcgctcggcgatcgcaactatgaccagttctgcggtcacggccgccgtctcgacgagcggctcgccgggcaaggcgcgcagcggctgatggatcgcgtcgattgcgatagcgagtatcaggcaagcgcggacgcgtggctcgaacgcatcatcgtgcggatcaaggaagaagatgccgcgctgtatgccgtgccggcgggtggcatggtcaacgccgtggtgccgggcacggtgccgaccaaaacgcggccggccgcctcgcggctcgtcagcaatctgcgcctgaacaagcagggcgcggcgaaagatacgcgctacgtctcgctgcatacgggcgactcggggctcgaatacgaagcgggcgacgcgctcggtgtctggccgagcaactgtcccgaactggtcgatgaattgatcggcctgagcggtctgcacgcggacgccgccggtaaacgtggcgggcgccggagagatgcgtcttgccgatgcgctcggcaagcactacgagatcgcgcggccgaatccggacctgcttgcgtttgtcgccgcgcgcagcaataacggcgcgctgcgtgatctgctggcgccggatcgcaaggccgacctcaaacaatggttgtggggccagcagattgccgacgtgctgcatgaatttccagtgagtctcacggcaagcgaattaaccggcatgctcaagcgtctgcaaccccggctgtattcgattgcatcgagcccgaaagcgcatgccggcgaagttcatctgacggttgccgctgtgcgttacagcaacggccgccgtcatcgcaaaggcgtctcgtcgacttttctcgccgaccgcgcgggcgatgtcaacgtgcccgtgttcgtgcagaagtccgcacactttcgtcctcctcacggttcggaaacgccgatgatcatggtcggccccggcaccggcgttgcaccgtttcgcggctttctgcacgagcggcgtgcacgtggcgacactggacgcaactggctgttcttcggcgagcagcacgccgcctctgatttctactatcgcgacgaactcgaatcgatgcgcgacagcggtgtgctgacccggctcgacgtcgccttttcacgcgaccaggcggacaaggtctacgtgcaggaccgcatgcgcgagcagggtgcgcagttgtgggcatggctcgaagacggggcgcatttctatgtgtgcggtgacgccaaccggatggcgaaagatgtcgatgcggcgcttaaggaagtggtcgcgcgacacggcggcatgagcgacgacaaggcactcgaatacgtgagccgcctcgcgcaggaaaagcgctacgcgcgcgatgtttattga

SEQ ID NO: 28562 - DNA, 975 bp, Burkholderia fungorum
aggcttgaaacaaccgtgatgggcttcggcgcggcgccgatcggcaacatcttcaggccggtcagcgaggaggattcggcagcgctcatcaaggcagcgtgggacgcgggcgtgcgctatttcgacaccgcgccgatgtatggccacggcttgagcgaggtgcgctgcgggcagggactgcgctggtatccgcgcgaccagtatgtgctgtcgacaaaggtcggacggctcctgaaaccacgcaggcgcgccgagatcgacttcgcgccgtgggtcgacggactgccgttcgagcctgttttcgattacagctacgacggcacgatgcgctcgatcgaagacagcctgcagcgactggcgctggagcacatcgatatcgcgctgatccatgacatcgacgtctttactcacggtgagcgtcagcctgagatgttcgaggccgcgatggcgggcgcgtcgaaagccctgcttaaactgcgtgacgaaggggtggtgaaagcggtggggctgggtgtcaacgagtggcaggtcgcgcacgaggcgattcggcggcaggatttcgactgcctgctgctggcgggtcgctacaccctgctcgaacaggatgcgctggacgggtttctgccgctttgcgagaagaaacaggtgtcggtgattctcggcggcggctacaacagcggcattctcgcaacgggcgcggtgcccggtgcgaaatataactacgcgcccgcgccggaagccattctggaacgcgtgcgcaagatggagcaggtatgccgcgagttctcggtgccgctgaaggcagcgtcgctgcaattcgtgctcggtcatccggccattccgaccaacattccgggcgtgcgcacggttgctcaactggaagacaatcttcaaaccttccgggctgaaattccggcggagttctgggcggaattgaagcgccgcgagttgatccgcgacgacgcgccgacgccg

SEQ ID NO: 28563 - DNA, 1233 bp, Burkholderia fungorum
atgtcctttgccttgcttggcctgatcgatcctttgctgcgtaatgtgcaggacctcaattaccagacacctacgccggtgcaggtcaaggcgattcctgccgtgctgggcggcagggacgtcatggctgcggcacagaccggcactggcaaaacggcgggttttgcgctgccgctattgcaacggctggtgcaacacggcccggcagtgtccagcaaccgcgcgcgtgttctggtactggtgcccacgcgtgaactggccgaacaggtgctgcaaagctttatcgattacggcaaaggcctcgacttacgatttctggccgcctatggcggcgtgagcatcaacccgcagatgatgaagctgcgcaaaggggtggatgtgctcgtcgctacgccgggccgtttgctggatctcaatcgccagaacgccgtgcagttagatcaggtgcaaacgctggtgctggatgaagccgaccgcatgctggatctgggctttgcgcgcgagctcaacgccgtttttgccgcgttgcccgttcggcgccagaccttgctgttctccgccacgttcaccgacgatatccgcgcgatggcggcgggcattctgcgcgacccggtcaatatcagcgtcagcccgcccaatgccacggccagcaagatcaggcagtgggtggtgacggtggacaaaaagaacaagcccgaccttttcatgcacctcgtggctgggaacaactggcggcacgcgctggtgttcgtcaaaacccgcaatggcgtggattacctggcggccatgctggatgcagcgggctatgcggtcgacaccatccacggcgacaaaccgcaacccgcgcgcctgcgtgcgctcgaacgtttcaagacgggcgaagtgcagatgctggtagccaccgatgtggctgcgcgcggtctggatatcgacgatctgccgctggtgatcaacgtcgatctgccgatcgtggcgcaggactatgtgcaccggattggccgtaccggccgcgcgggcgccagcggcgtggcggtgtcgctcgtgtgtgccgatgaagcgccgcaactggccgcgattgaagcactgatccggcaaacgctgcgccgtgaagaagaaccgggttttgaagcggaacaccgcgtgccgcaaaccagcgcgacgggcgagatcatcaggaagccgaaaaaacccaagaaatctaaagtgccgcaagctgcgccgcgcgagatgcag

SEQ ID NO: 28564 - DNA, 534 bp, Burkholderia fungorum
tcgcgacttatcgaaatcacccccgccacgcatggcgtcgacatcgacctcgtctatgccaccgggcgcaacctgaccggcaagcccatttacaaggaagctcactgtctgctgctcgaacccgccgaagccggcttgcgcaacgcaatcgggattgcccgcgacgccggtctgaggctgcggattttcgacgcctaccgtccgccccaggcgcagcaggtgctgtgggatttcctgcctgattccacgtacgtcgccgagcctgagcgtggttcgaaccacagccgcggcacggcgatcgacctgacgctgctcgatgccggtggccacgaactcgacatgggcaccggcttcgacgccatgaccatcgagtccgagcacttccatccaggcttgcccgtgcacgtgcagcgcaaccgcctgttactgcttggcatcatgcacgccgccggttttgcccacatcaagaacgaatggtggcattacgagctgccaggctcccgtgcgctaccgctgatcgacgacagcgaaagc

SEQ ID NO: 28565 - DNA, 2376 bp, Burkholderia fungorum
cgcgtagcgcatttgcttagcgttctgtttgcctcattgtcgggggtgtacctgctggtcggcgggatctggctagcggcgaccggcggatcgctgtactacgttttcgccggtatcgtcatgctcgttacggcggttctgatttatcggcgttccccactagcactcggcctctacgcattactgctgttgtgcacgatcgtgtggtcgctgtgggaggtcggcacggatttctgggctcttgccccgcgtctggacgtactggtcgtcttcggcatctggctgctgttgccgtatgtctatcgcgcgttcgagccgtccgcaaaaacgcatggtctcgcgctcggggccacgttgatcgtgagcgtcgcagtgctggtttttgcagtcttcaacgacccacaggaaatcaacggcacgctggcgagcgcgcctgcccaggcggcggcgacgcccgccggcgagcgcgtcgccgagggcgactggcccgcctacggccgtacccagcacggtacgcgctactctccgctcaagcagatcaacgcggataacgtcaaggatctgaaggtcgcgtggatattccggaccggcgacatgaagcgctccaccgacccaggtgaaatcacgaacgaagttaccccgatcaaggtgggcgacatgctgtatctgtgctcgccgcaccagatactgttcgcgcttgacgctgccaccggccaggaaaaatggcgcttcgatcccaagctgaagaccgatcccagttttcagcatgtcacgtgccgtggggtgtcgtaccatgattcgaccgcttcgggcagtaacaacgacagcccggaccaggccccggctacggcgcctgcaatctgcgcgcgccgcgtctacctgcctgtcaacaacgggcatctgtacgcgctcgacgcgcagaccggccagctatgcccggacttcgccaatcacggcgacctcgacctgcaagtgggccagcccgtgacgaccgcgggtcaatatgaacccacttcgccgccggtcatcaccgggaaggtgatcgtaatcgcaggctcagtcgaggataactattcgacgcgggagccctcgggagtgatccggggtttcgatgtcaacaccggcaaactgttgtgggcgttcgatccgggcgcgaagaacccggaagcggtgctcggcgcaggccagcattattcggtcaactcgccgaactcctgggcaccggctgtttatgacgcaaagctcgatcttgtctatctgccgatgggcgtaagcacgcccgacatctggggcggctaccgcacgccggagcaggaacgctttgcgagcgggctgctcgcgctcaacgcgacgaccggcaagctcgcctggttttatcagacggtccaccacgacctgtgggacatggacctgccggcgcagccgacgctcgccgatatcacggaccggtcgggcaacctcgtgccggcggtctacgccccggcaaagacgggcaacattttcgttcttgaccgccgcacaggcacgccgatcgttcctgctccggagaagccggttccgcaaggcgcggcgcaaggcgatcacgtgtcgcccacccagccgttttcggcgctgaccttccggccggacaggaaactgaccggcgcggacatgtggggcgcaacgatgtttgaccagctcgtgtgccgagtgatgttccagcgcctgaactatgacggcacgtttacccctccgtcggtgaagggcaccctggtttttccgggtaacctcgggatgttcgagtggggcggcatagcagtggataccgatcgccagatcgcgattgcgaacccgatcgcactgccgttcgtgtccaggttgatgccgcgtgggccgggcaacccgatcgaaccggccgccggcggcacgggcggcagcggtaccgaatccggtatccagccgcagtacggcgtgcccttcggtgtgacgttgaatgccttcatgtcgccgctcggcctgccgtgcaagcagccggcgtggggctacatatccgcggtcgatctgaagaccaaccagattgtctggaaaaagcgcattggcaccgtgcgtgacagttcaccgctgccgctgccgttcaagatggggatgccgatgctcggcggcccgatgacaacggccggcgacgtgttcttcatcggggccaccgccgacaactacatccgcgcgttcgacaccaacaccggcaagcagttgtggcaagcacgtttgcccgcgggtggccaggcgacgccaatgacctacgaggcgaaagggaagcagtacgtggtcatcgcggccggcggccacggctcgttcggcaccaggttgggcgactacgtgatggcttatgcgctgcct

SEQ ID NO: 28566 - DNA, 1668 bp, Burkholderia fungorum
aacctgctggaagtacgcgacctgcgcgtgagcttcggcgcgcacgaagcggtgcgcggcctgaatttcgaggtcgcgcaaggcgagacgcttgccctcgtaggcgaatcgggttgcggcaaatccgcgaccgcgctttcgttgatgcggctcgtgcccgccccagcgcaggtgaccggcagcgtgtgtttcgatggccgcgaactgctcgatctgtcggcgccggagattcgcgcggtccgtggccggcagatttcgatgattttccaggagccgatgacgtcgcttaatccggtgctgtcgattggcgcgcagatcgtcgagacgctgcgccagcatgagcgtctgtccaaagccgccgcgtggaagcgggcgatcgaattgctggagctggtgcggattcccgaaccgcaacgacgcgtattcgattatccgcatgaactctccggcggtcagcggcagcgcgtgatgatcgcgatggcggtggcctgccggccgcgtctgctgatcgcggatgaaccgaccacggcgctcgacgtcacgatccaggcgcgcattctcgagttgctcgacggtttgcggcgcgagttgtcgatgtcgctgctgctgatcactcatgatctgggcgtggtcgcccagcatgcggatcgtgtcgcggtcatgctggcgggcgaattggtggaagaagcaccggtcgagcaactcttcacgcggcccggtcacgcctacacccagggcttgctcggcgcttcgttgaatctcgccgacgatctgcattaccagggctggaagctgcctgagatccgccacggtattgccgatgacggcaagccgacgtttgccgtcgtaccgcgctcggcgcgcaccgggcagtatgtcacgcagacggctgttcgcagcgcggcgcatgacgatgcgccgctgctggcgttgcatgacgtgcggatcgactatccgcatcggcatggcaagtcgacgctgcgtgccgtcgacggtgtgtcgttgcagatcgcgcggggcgaaacggtggggctcgtcggcgaatcggggtgtggaaagtcgacgctatcgaaagcgatcctgcggctcataccggccacgcgcggtcagatccgtttgcgcggcaccgacctggtgccactacgcgagcgcgaattgcggccgttgcgccgccacgtgcagatggtgtttcaggatccgtatgcgtcgctcaatccgcgccgcacggtgggagaaattctgaatacggtgctggtggtcaatggtgtggacgacgcacggcaacgccaattacgcatcgccgcgatactcgaccgggttgggctgcccggttcggcattgggccgctttccacatgaattctcgggcggacaacggcagcgcatcggtatcgcgcgagcgctcgtgctcgaaccggatctgctgatctgcgacgaaccggtgtccgcgctcgatgtgtcgattcaggcgcaaatcctgaacctgctggtggagctcaaacgcgatctcgggctggcctacctgttcatctcacacgatctttccgtagtgcgctatatcgcggaccgcgtgcatgtgatgcaggcggggcgtatcgtcgaaagcggcgatcatcgcgagatctggcgtgcgccgcagcacgcgtacacgcgcacgctgctcgaagcg

SEQ ID NO: 28567 - DNA, 2562 bp, Burkholderia fungorum
tggcatgcggagacggcagagtctacgattgaacgcttcggcaccgacgcgacaaggggactcgataccgccgaggcggcgcgtcggcgcgcggtctacggacgtaacgaaatcatcgaaacggaacggcgtcggatcatcacgatgctgatcgagcaattcaaggatttcatgatcctcgttctgctcgctgccgcaatcgtgtcgggactcgtcggcgaccttgaagacgcgctcgtgatcgtcacgatcgtcgtattgaacggaacgattggcttctttcaggactttcgcgccgagcacgccatggcggaactcaagcggctggccgcgtttcacgcgtcggtagtccgtgacggacacccgttgacgattgccgccgccgaagtcgttcccggagatatcgtccttctcgaagcaggcggcgccgttccagccgacctgagagtgatcgaagcaccccagttaagggtcagtgaagccacgttgacgggcgaggccgcccccgttgacaagcatccgcagccgctaacaggcgatgcgacgctccccatcgccgatcgcaccaacatggtctacaagggcactgtcgtgacctatgggcgggcgcgcggcgtcgcagtcgcaacggggatgaacacggaactcggcaagatcgcggcgctgctggagtcggctcccgcattgcagaccccgctgcagcagcgcctgagtcgattcggcaagcaactcgccattgccattctcgcaatctgcgcgctgatattcgtgttcggcgtatcgagtggagagccgccaatactcatgttgctgaccgcactgagccttgccgtcgccgccattccagaagcattgcccgccgtcgtcacgatgatgctcgccctcggtgcgcgcagcatggcgcagcgcgctgcgctggtccggcgccttcccgcggtggaaacgcttggctccgtaagcttcatctgcacagacaagacgggcacgctgacactcaacgcaatgcgcgtggtcgaagtatgtccggcgggaacgcagcggctgcaaaccgcgaacatgggcgtcgacgatattaccgggcagctgctgcgggccgtttcgctgtgcaacgacgcgacgtacgatgcatccggcaagctagccggcgatcccactgaagtggcactgtgggaggtcgccgcggacgccggcatcgatcgctccgctctcgacagatcgatgccgcgctgcacggaaatgccgtttgattccgtacggaaacgcatgaccaccgtgcatcgcgctgaagactcatttatcgcgtataccaagggcgcgcctgaaaccgtgattgaacggtgtacgtcggttgtcggacaggacggcacgccgttcgacacgacaaccttgacgtcgatggcgggtgcgatggcggcggatggactgcgtgtgcttgccgtggcaatgcgccgctggccgcaaaagccaccggccgacaccgacgaactcgaatgcgacctgacgctactcggctttatcggcatgctcgatccacctcgcccggaggccgcgggtgccgtcgcattgtgcaggcaggccggcatcactgtggtgatgattacgggagaccacccgatcaccgcgttggcgattgccaggtcagtgggcattgccagcgatgaagcacaggtgatgaccgggtacacgctgggcaagctgtcggacgaggcactgctcgaagcgacacagcgcatccgcgtctacgcaagggtggatccctcgcagaagatccgcatcgtaaaggcaatgcagtcgacggggcactacgtggcgatgaccggcgacggcgtcaacgatgcacctgcccttgcggcggcaaacatcggcgtggcgatgggcaaagtcggcactgacgtcgcgcgcgaagcggccagcgtggtcctgctcgacgacaatttcgcaacgatagtcgcggcagtccgtgaaggccgacgggtttatgacaacgttcgcaaattcatccgttacgtattgaccggcaatctggcggaactctgcgccatcgcgctggcaccgctttttggccttccgatccccctgctgccaatccagatcctgtggatcaacctgctgaccgatggcttgccggggcttgcactggccgccgagcctgccgaaccgaccatcatgcaacgcccgccaaggccgcccgacgacagtctgttcgcacatggactatggcagtacatcgtgcggatcggcatcgcgatagcagccgtaacgatgggcacccaatggttcgcgatgggactcgacgacgcacactggcgcaccatgaccttcaccgtgctggccttgtcccagatggggcatgtgctcgcgatccgttccgggcagacctcgatcttcacccagggtttgctgtcgaaccgcccgctcgctgccgcggttgcactgactgtcgtgttgcagctcgccgcgatctacgttcccgtgctcaacaacatcctcgataccgcgccgctgagcgcgccggaactgggtttttgcatcctcgtgtccgcgctgatcttcgttctggtg

SEQ ID NO: 28568 - DNA, 861 bp, Burkholderia fungorum
attttttcgggtatctgggttccgctcatcacgcctttcgccgacggcgccgtcgatcacgccgccttgcgcgcactggtgcgccgctatgccggcgcgggcatggccggactggtcgcgctcggcaccaccggcgaaccggccgcgctcgatgccgccgagcaggacgccgtgctggcgacgattctcgacgaagcgcaggccgccgctcgccactcgcatgacgcgcgggcgctgccggtgctggtcggcgtggcgggcaatcacacggcgagcatgcgcgagcgtatcgggcaactgaatccgctgccgatagcgggtgtgctgatggccgcgccgtactacatccggccttcgcaggccggtatcgtcgatcacttcacggcgcttgccgatgcgagcgcgaagccggtcgtgctgtacgacattccctatcgaaccggcgtgcggctcgaactcgacacgctgctcgcactcgccgcgcatccacggattcaggcggtgaaggattgcgccggttcgctcgacaccaccctcgcgctgattcgcgatggtcgcctgcaagtgcttgccggcgaggacatcaatattttcaacaccttgtgtctgggcggcagcggggcgattgcggcgtccgcgcatgtgcggcccgagcgctttgtcgcgctgtatcgcgcgctcgcggcggggcggctcgacgaaggccggcgcatttttcacgcgctcgcgccgctgatccagacgctgttcgccgagccgaatccggcgcccgtcaaggcactgctggccgcgcaagggttgatacgcgacgaactgcgcatgccgatgacgcgtgccggcgacgcgctgcgcgagcggctc

SEQ ID NO: 28569 - DNA, 1256 bp, Burkholderia fungorum
tatacgcaaagcgtacaccgcgaccaccctccctcctcccgacaggtgcctccatgagcgtcccgcaacaagccttcctacgcgacgcgatgcgccgcctgaacatgacgcgcgacacgttcgcgagccgcatcggcgtgtcgcgccgggcgctcgatacctggctcctgccggacgactcgcaggaatcgcgggccatgccggaaatcgtggagcgcttcgtgtcggagatcgtggtgcacggcgagccgggcgaaaaacatacgcagagcgtagactcgcagtcgctcgcgagccagatgcttttcgagggcaagccgcagttgctctcggtggatcaattctcgcgcgactcggtggaggcgctgttccgcgtggccgacatcatgcagccgatcgcccggcgccgcaaaatctcccgcgtgctggaaggcgcggtgctcggcaatctgttcttcgaagccagcacgcgtacccgcgtgagcttcggcgcggcgttctgccggctgggcggctcagtttgcgacactaccggtttcacgttttcgtcaatggccaagggcgaatcgatctacgacaccagccgcgtgatgagcggttatgtggacgccctggtaatccgccatccggagcaaggctcggtggccgaattcgcgcgcgcgaccaatgtgcccgtgatcaacggcggcgacgggccgggcgaacacccgagccaggcgctgctcgatctgtacaccattcagcgtgagttctcgcgcctcggcaagatcgtcgacggcgcccatatcgcgctggtcggcgacctgaagtacgggcgcaccgtgcactcgctggtcaaattgctggcgctttaccgcggcatcaagttcacgctgatctcgccgcccatgctcgaaatgcccggctatatcatcgagcagatttcgcgcaacgaccacgtgatcgagcagactcacgatctgtccaccggcctgcgcggcgccgacgtggtgtacgccacgcgcatccagaaagagcgcttcaccgacgaatcgttcgaaggctatacgccggatttccagatcaatcaggcgctggtggacagcgtgtgcggcgtcgatacgctgatcatgcacccgctgccgcgcgacagccgccccggcgcgaacgatctgagcgtggacctgaaccacgattcacggctggcgatcttccggcagaccgacaacggcattccggtgcgcatggcgattttcgcggtgctgctgggcgtggag

SEQ ID NO: 28570 - DNA, 1302 bp, Burkholderia fungorum
gactggcgtggccacctgcatggccgatcactcgccgtggtgtgtccatcgcgagtcgaagacgtaggcgagacgatacgcatcgcgaggcgacatcaaatttccatcgttccacaaggcggcaataccggcctcgctggcggagcgaccccggattcgaccggcaggcaactcgtgctatgcacacgccgcctgaatcgcattcgcggcgtcgacctgctcggcaacttcatcacggtcgacgccggctgcatcctgcagaacgtgcaggatgcggcgcaaagtcatgaccgtctctttccactcagcctcgccgcgcaaggcagttgcacgatcggcggcaatctcgccaccaatgcgggcggcaacgcggtgctgcgctatggcaatatgcgcgaactatgcgttggcatcgaagccgtcgacgcgcaaggccgccttatcggcgacctcaaatgcgtgcgcaaaaacaataccggctacagcctgcgcgatctgctgatcggtagcgagggcacactcggcatcatcaccggcgcggcgctccgtctgttcccgcgcccctttgcttacgcgaccgcgctggtcaaatgcgcggacatcgaccatgcactgcaagtgctcggcatattgcgcgctcactgtgcggactttctgagtggtgtcgaatggatgtcgaacggttcgctctccaatgtatcgaagcagttcctggacacgagaataccgcccggcttcgacgaatcgtgtctgtgcctcgtcgagctatcgggatccacgccgcccggtctgctggacgacatactcgccagtgcgctcgatcaggccatcacgtcgggcttcgccgcggacgccgcactcgcgtcgaaccttgccgagcgcgacgcattctgggccctgcgcgaacgtctcccactggccgaagcacggtgccgctcgttgaaacacgacgtctccctgcccgccggcaatatgagcgaattcgtcgcgcatctcgaaggctatctttcgagcatgacgctgcgctgcgcgtgggccggcttcggacacctcggcgacggcaacctgcacgccaacgtgctgattccggataccatgccggatgcactttgcgactgcattgacgagttcgtgtacagcgaggtgctgcgactcgagggcagcatttcggccgagcacggcattggcagccgaaaaaacgatctgctgcaccgggcgctcgacgtcgccagccttcaggccatgcaagcggtcaggaacgcgctcgatccgcacaatctgttcaaccccggcaagctgctc

SEQ ID NO: 28571 - DNA, 801 bp, Burkholderia fungorum
gtctggttgatcaccggatgttccaccggcttcggccgtgaactggctgccgccgtgctcgcgcgcggctggcgcacggttgtcacggcgcgcgatccggcatcgatcgcggatctggtcgagggccgtgaaacgcacgcgcttgccgcgcggctcgacgtcaccagcgcaagcgatatcgaaacggtcgtggcccggacgctggacgcctacggccagatcgatttcctcgtgaacaatgcgggctacggctatctcgccgcagtcgaagaaggtgaagacgccgagatgcgcgccatgttcgaggtcaatttcttcggggcggtcaatatggtcaaggcggtcttgccgtccatgcgcgcgcgccgctcgggccatatcgtcaacgtcacgtcggtcggcgggttcgtcggcaatccgagtagcgggtactatgctgctaccaaattcgcgctcgaaggattgagcgagtcgctcgcgcgcgaaacggcggagctcggcatccgggtgacggccgtcgaacccggtccattcagaaccgactgggcgggacgatcgctgaagcagacgggaacgccgatcgacgactacgcgtcgattgccggcaagcgacgcacgcaggtggtcgagcgcagcggccggcaaccgggcagccccgagcgcgccgccgaagcgatcatcgccgcagtcaccgaccgcgaaccgcccgagcacctcgtgctcggcagcgccggtctcgcgatggtgcgaagcaaactggcgcgcgtggcagcggacctcgatgcgtgggagagcacgacc

SEQ ID NO: 28572 - DNA, 840 bp, Burkholderia fungorum
gaaacgaccgatattctcggcgaatgcccgctatggagcgaggctgaacaggcgctgtactggatcgacatccggcggccgggcatccagcgctggcatcccgcaagcgacgcgctgcgctactggcccatgcccgacctcgtcggctcgattgcgttgtgccgcgacaaccgcttgctggtcgcgtcgcgatcactgttttacctggacacgcgcacgggagaaatgacccgcttcgcgccgcagcgcgccgaagatgcggcgctgcgctttaacgacggcaaatgcgaccgccagggccgcttctgggtcggcacgatgaacgaccgcacgcgcgagccggtgggagaactgtttcgcgtggatgagcgcggcgccgtcagtatcgaggcggacatccgggtgccgaacggcacctgtttcagtcccgatggccgcaccatgtacttcgccgattccgatctacagaccattttcacttacgcgctcgatcccggaacgggcgcgctcggtgaacgccgcgagttcgcgaagacgacactgcccgccgtgccagacggcgcgacggtcgacgagcaaggccatatctgggtcgcggaatacggcggctggtgtatcaagcgctatgcgccggacggcagtgtggaccgtgtgttcgacatgcccgtgcagaacccgaccagttgcacgttcggcggacgcaatctcgatacgctctacatcaccaccgcttcgcaaagactcacgccggatgaactggcgaagcagccgtttgccggcgccctcctcgcgttccaacccggcgtgcgtggcctgccggagccgcttttccgcggcaat

SEQ ID NO: 28573 - DNA, 1422 bp, Burkholderia fungorum
ctgacatcaagctctgtttcactattgcccgaggtcgcgcgctttctcgatgcggggccgctcggcggcgtgatcgacggccgcgatgaacaggccgccgacggcgccaccttcgagacgctggaccccggcaccggcgaacatctcgcgacggttgccgcgatgggacccgcggacgtcgatcgtgcggtcgacgcggcgcggcgcgcgttcgcccggtcgggctgggccacgatgcacccgaacgaccgcgcgatctggctgcaccggctcgcggacgaagtcgaacggcgcaaggcgatcatcggccagatcgaagcgctcgacgccggcaagatcgaacagcaggcgcaaggcgacgtgcagagcttcgtcgatacgctgcgttacttcaacgaactggccctgaacacggagcgccgctcggcattgccggtatccggctacgaggcgtggaccacgcggcagccctggggcgcgtgcggattcatcgttccgtggaacttcccgatggtactgatcggatggaatatctctccggcactcgcggcgggcaatacggtggtcatcaaaccggcggaggacacgccgctgtcggccatttacctggctcggctcgcgcgcgagatcggcttcccagatggcgtcatcaacgtcgtgacgggtctgggtgagatagcgggcgctgcgttgtcgcgccatcctggactcaggcgcatgtcgtttaccggttcgccggaagtcggacgcatggtggcggaagcttgcggcagaaatctcgtgccatgcaaactcgaactgggcggtaagggcgcagccgtgattttcgacgatgtgaatatcgaggagaccgcggacaaacttgcgcgcgcaatcacattccacacgggccaggtctgctgcgatgcgactcgctggctcgtgcacgaatcgatcttcgagcgtttcgtcgatgcgagcgtcgctgcgttgcagcgcacaaagatcggttatcaactcgaccccggcgcggagatgggaccggtcgtgagcgcgaaacagcgcgagcgggtgctgggctatctggagcgtggacaacgcgacggcgcgcgagccgtgctcaagggcggcgcagtcgacgtggccgggcacgacggtttctacgtgagccccgcgttgctcgcgggctcgctcgagaacgtggccgcgcgcgaagagattttcggtccggtcgcctttcttgcgccgttcagggacgaagcgcaagccgtcgaactcgccaacgacaccgactacggccttgccaacagcgtatggagccacgacccgagacgcgcgtcgcgggttgcggaagcgatggtggcgggcaatagctggatcaacgcacacaacctgtttccactcggcgtgccgtatgccggagtgaacaggagcggcatgggt

SEQ ID NO: 28574 - DNA, 747 bp, Burkholderia fungorum
atggacctcgaacttcgcggacgcacggcgctcgtcacaggcgcgagcacgggcattggaacgggcattgcaagggcgctggcgagcgagggcgtgcggcttgcgatcaccgcgcggcgcgatgcgctgctggaggaggtggcggcgtcgatcgtggcggagggcggcgtgcggccgatcgtgatcgtcggcgatctcaccgcgcccggtcacatcgagcgcattcttgcgcaggcgaccgacgcgctggggcagatcgatattctggtgaacaatgcgggcgcgtcgcggcccgcgccgctcgattcgggcgaagacgtctgggaagaggcgttcgcactcaatttcaccgcggcgcgacgcatgacacatgcggttctgccggcaatgcgctcgcgcaaatgggggcgcgtgatcaatatcagcggttcgatggaaccgcgtggactcaatcccagtggtccggcgaaggcggcgctgcatctatgggccaagagcctctcgcgcgaaattgccgcggacggcatcacgatcaacactatcccgccgggcagaattcatagcgagcaaatcgaaaagcgcctgcatcccaccgaagaatcgaaacaggcattcattgcgcgaaacgtgccgatcggctacttcggcgatccgctcgacatcggttatctggcggcatttcttgcgtcgccgcgcgcgaggtacatcacgggagatgtgattccagtggacggcggcatgcatttt

SEQ ID NO: 28575 - DNA, 1194 bp, Burkholderia fungorum
gaagcattcctctgcgacgcgattcgcacccccatcggccgctatgcgggagcgctgtcgtcggtgcgtgccgacgacctcggcgccgtgccgctcaaagcgctgatggagcgcaacaaagaggtcgactggaacgcgatcgacgacgtgatctacggctgcgcgaaccaggctggcgaggacaaccgtaacgtcgcgcgcatgtcgctgctgctggccggcttgccgcaaggcgtgccgggcacgacggtgaatcgcctgtgcggctcgggcatggacgcggtcggcattgccgcgcgcgccatcaaatcgggcgaggccgcgttgatggtggcgggcggcgtggaaagcatgagccgcgcgccgtttgtgacgggtaaggcgaccagcgcgttctcgcgccaggccgagatttacgacacgaccatcggctggcgcttcgtcaatccgttgatgaagaaactgtacggtgtcgattcgatgccggaaaccggcgaaaacgtcgccaccgactacaacatcagccgcgccgatcaggacgctttcgcgttgcgcagccagcagaaggcggcgcgcgcgcaacgcgacggcacgctcgcgcaggagatcgtcggcgtgacgatcgcgcagaagaagggcgatccggtcaccgtgtcgcaagacgagcatccgcgcgagacgagtctggatgcgctcgccaaactcaagggcgtggtgcgtccggacggcacggtcacggcaggcaatgcgtcgggcgtgaacgacggcgcagcggcgctgctgcttgccaacgaggaaaccgccaggcgcttcggcctcacgccgcgtgctcgcgtgctgggtatcgcgacggcgggcgtcgcgccgcgcgtgatgggcatcggcccggcgcccgccacgcagaaactgctggcgcgcctgaacatgagcctcgatcaattcgatgtgatcgaactgaacgaggcgtttgcttcgcaaggtatcgcggtgctgcgcgcactcggcgtggccgacgacgacactcgcgtgaatccgaacggcggcgcgatcgcgctcggccacccgctcggcatgagcggcgcgcgtctggtgaccaccgcgatgtatcagttgcatcgcacgcagggccgttttgcgctgtgtacgatgtgtatcggcgtcggccagggcattgcgatcgcgattgaacgggtg

SEQ ID NO: 28576 - DNA, 906 bp, Burkholderia fungorum
tttccgggacaaggcgcgcagaccgatgggtttctgcatcgtctgccgcggcaccgtgccgtgcgcgacacgctggaggaagcttcgcaggtgctcggcgccgatgtgctcacgctggacacgccggacgctttgcgctcgaccgtcgctgtgcagatcggcctgacggtcgcaggcgtggcgatcacgcgcgcactggctgacgaacaactcgtggcggagatcagcgcgggtttgtccgtcggcgcgtacgccgctgcagtcggttgcggtgcgattcatttcgcagacgcgttgaagatggttcgccgccgcgccgagttgatggagaccgcatacccgtccggctacggcctcgcggcaatctcgggtttgaccgaatatcaggtggaaacgctcgccgcgcggcatgcggatgaaaaccggcagcatgtctatatcggcaacgtgaacgcgccgcgccagatcgtcgtggcgggcgcaaacgacgcgctcgacgcgttcgccgcacgcgcgctggccgcaggcgcgcgcaaggccgcgcgcctcgcggtgagcgtcccctcgcattgcgaattgctcgcgcaggccacggacgggttggtggcgtacgcaaaggaaataccgtttcatgcgccgcacagcacgtatgtcggcaatcgcggcggccgccctctatacacggcggacgcgatccgcgacgatctcgcaaccaatatgcgctacaccgtacgctggttcgacgcgctcgcggtcatgcaggaaatgggcgcgcgcgtactgatcgaagcgccgccgggccaggtcctgaccgacatcgcgcgcgaatactttccggacagcacggcgctcgccgccagcacctttccgttcgatcgactcgtcgccaccgcgcggcggcgtctg

SEQ ID NO: 28577 - DNA, 765 bp, Burkholderia fungorum
ctggaaaactacttcgcccgcataggctacgacggtccgcgcgcggcaacgctcgaagtgcttcacacgcttcaccgcctgcacccgcgcgcgatcccgttcgagaacctgaacccgttcacgcggcgtcctgtgaaactggatctcgacgcagtggaacgcaaactcgtcaccgggcgccgcggcggctactgtttcgaacagaacgcgctattcgccgacgtgctgctccagttgggcttcgcggtcacgccattgctcgggcgcgtgctctggggccgcgaatcggacgcggttccgccgcgcacgcatatggtgttgcgcatcgacctgaacgacgaagcctggatcgccgacgtcggcttcggcagcgtgacgctgaccgcgccgctgcggctgaccgcgggcctcgcgcagcccaccgaactcggcacgttccgtcttgccgatgcatcgcgcgacgcactctttctggaagtgcaggcgcgtgacgaaagctgggcgcgggtctaccgcttcgatctgcatccggtcgagtggatcgattacgaaacctcgaactggtacacgtcgacctcgccggaagcgatttttgcgagcaccctgattgtgtgccgcgtgttgcccgaagcgcggctcgcgttgctcaacgatcaactgagcgagcgcgccgcggacggccggctcatcagcgagcggcaacttcgcagcgccgctgaacttgccgcgtgtctgcgcgatcagttcggcttgaacaccggcgag

SEQ ID NO: 28578 - DNA, 951 bp, Burkholderia fungorum
cgcattccgatcatcgatctcgccggcgttcgcgcgggcgacccgcaggctttacagcgcgtggcgcaggaaattcgtgaagcgtgcacgacgatcggcttcttctacatcgtcaatcacggcgtgccgcaagcgctgatcgacgccgccgcgcaggcggcgcgccgcttcttcgcgtttccggtggagaccaagcggcgcgcggcggtcaatcaccgccatcggggtttcaatgcgctcggcgacgcgaccatgtaccaggccaaacgtcccgactacaaggagttcttcagcatcggcctcgaattgccggaggacgaccccgacgtgctggccggtcaggcgctgcgtggaccgaataactggccggacttcatgccggagttgcgtcccgcgctgtacggttactatgaagcggtaggggcgtgcggcgccgatctgctgcgcgcggtggcggtgagcctcggcgtggaggaacaattcttcgcgccgcgttataccaagcggatgcagcgcacgcagatggtctactatccgccgcagccgccccaatcggacgaagatcagttcggcgtcgcgccgcacaccgactatggctgcatcaccttgttgtggcaggatcaggtgggtggcctgcaggtgcgggaaatcgccaacgatacgtgggtggatgcaccgccggtcgaaggcagcttcgtggtcaacgtcggcgatctgctcgcgcgctggaccaacgaccgctttcgctccaccctgcatcgcgtgatcaatgcgtcggggcgcgagcgctattcgatcgcgacgttttatgatccgacttacggtgcgcgggtcgatccacgcgatctcggtacgaacgaaaccgacctcaagtatcagccggtcgcagcgggcgactatattctcgggcgtatcaacgactcgatgggctatcggaagaaacgcgccgct

SEQ ID NO: 28579 - DNA, 1305 bp, Burkholderia fungorum
agcgaacgcgcgatgaccgactggacacgccacgagccgacgcggcctgcggcattgctcctgccgcgcaccacggagcaggtctcgcgcgcgctggccatctgtcacgcggcgcatcagccggtggtgccgcaaggcggcatgaccggcctcgcgggcggcgcgattgcgcgtgccacggatattgcgttgtcgctcgaacggctggacggcgtcgaagaagtggacgccgcttccgccaccctgaccgtgcgcgccggcacgaccttgcaagccgcccaggaagccgccgccgaagccggcttcgaactcgcgctcgatctcggcgcgcgcggctcgtgccagatcggcggcaatctcgcgaccaacgcgggcggcaaccgggtgatccagtcgggcaccgcgcgcgaccaggtgctgggtctcgaagtggtactggccaatggcgacgtgctcacgtcgctcggcaagatggtcaagaacaataccggctatgacctcaaacactggttcatcggctcggagggcacgcttggcgtaatcacgcgcgccgtgttgcgcttgcatccgccgcgtgccgcgcgccataccgcgctggttgcgctcgacggctacgatgccgccgtgaacctgctgcgccgcttgtccacgcgattcggcaacgacatcggcgcgttcgaaatcatgtggccggacttctacgacttcggcgtgaagctgaccggcacgcgctcgccatttgccgacgcgcatccgctctatgcattgatcgaacacgccagcttcgattcggacgacgacggcgaacgcttttccgccgcgctgaccgaagcgctggaagccggcgcgatccgcgacgccgtgatcgcgcagtcggtggccgacgtgcgcgcgctatgggcgattcgcgaatgcacggcggagtttccggtgcggctcgacgcgatcaacttcgacgtgagcctgccgatcggcgcgatcggcgccttcgtcgaccgctgccgcgcggcgctcgatcagcgctggccgggcaatgcgtcgtatttcttcgggcatatcggcgattcgaatctgcatgtcaccgtggacggacattcgatccccggcgtcaatcatcatgcggtgtacgcgttcgtctacgacatgctcgggccgctgcacggttcggtgtcggcggaacacgggattggtttgctcaagcgcgagttcctgccgatttcgcgctcgccggcggagttggcggcaatggctgcgatcaaacacgcgctggatccgcacggcattctgaatccgggcaagctgttc

SEQ ID NO: 28580 - DNA, 1755 bp, Burkholderia fungorum
tacgacgtggtcgtggtgggttccggctacggcggcgcgattgccgcgtgccgcatggcgcgcgccgggcgccgcgtatgcgtgctcgaacgcgggcgcgaattcatggccggcgaattcccccgcacgccgtttcagggcgccgcgcaggtgcaatacaacacggcggcggcccatatcggctcgccgctggccttgctcgaagtgcacgtgaacgaagacgtgaacgcggtagtcggctgcggtctgggcggcacctcgctgatcaacgcgaacgtcgcgctcgaagccgacccgcgcctgtgggacgacgcacgctggccggccgcgttgcgtgccgacaaggccgcgcgcgacaaaggctatgcgcttgcccgagcgatgctgcaaccgtcgccggtgccgaaggattatccggtgttgccgaaactgcaggcgctcgaaaaatcggcgcaggcgctcggcatggaagaccgcttcacgcgcccggatatcaccgtcacgttcgaggaccgcgtgaacgccgcaggcgtcgcgcagaaggcttgcgttggctgcggcgactgcaattcgggctgcaattacgatgcgaagaattcgacccacatgaactatctgcccgacgccgtggcccacggcgcgcagattttcaccggcaccgctgtccattcggtgcggcgcgacgcgaccacgcgcaaatggatcgtgggctaccagttggtgagcctcggccgcgaaagctatggcgcgcccgatctgttcgtgagcgccgatatcgtgatcgtctcggctggcacgatcggctcgaccgcgctgctgctgcgctcgcgcaatcaggggttgagcgtctccggcatgctcggcaaacatttcaccggcaatggcgacgtgctcgcctttgcgtacaacaccgagcccgtgatcaacggcgtcggctggggttcgcacgagccgggcgatatcccgccggtcggcccgaccattaccggcctcatcgatcatcgcaatacggccaacgtcagggatggctatgtgatcgaagaaggctcgctggccggtccggtgggcgcggcgctggtcggcctgctcggcgccgccgcgccgctcgaaggcgtggatgtcgcgccgcgttcgctcccggaacagatcgcttacgacgcccgcatgtccgagagctttctgcgcggcccctatcacggcgcgctcaatcacacgcaaagctacctcgtcatggcgcatgacgacgaagacggccagatcgacgtggacgacacaggccagccgcgcatcgtgtgggaaaacgccggcaagcagccgatctttcaggtggtcgaggaggcgctcaagcaggccaccgtgccgctcggcggcaaatacctgcgcaatccgatctccaccgatatcatcggcaaccgcaccgtcaccgtgcatccgctcggcggctgcggcatgggcgaggacgcggagcacggcgtagtcgaccacatgggccgcgtgttcagcggcgccacgggcaacgcggtgcacgacggcctgtacgtgatggacggcgccgtcatgccgatgtcgctcggcgtcaatccgctcctcaccatttccgcgctggccgaacgcaattgcgagctgctgctggccacgcatcccgtgaccgccgccccggccgacggcgcggccgccacgccgagcttgccgcctgcgccgacgcccgagctcgcgtcgtcgtcgttgacgccgtcctcgccgcagaagatcggc

SEQ ID NO: 28581 - DNA, 1569 bp, Burkholderia fungorum
atgttcattaccggcgaaatgctgatcggtcgcaaagcggtacgcggcgaggaaaaaccactgcatgcgttcaatcctgccacgggatcggacatcgcggagccggttttcggcagcggttcggtcgcccacgtcggcgaggcctgcgagctcgcgcggcaggctttcgatccgtaccgtcagttgccgttgacggtgcgcgccgaatttctcgaccgtatcgccgacggcatcacggcattgggcgatgcactgatcgagcgggcgcaccaggagtcgggtttgccgaaggcgcgtctcgaaggcgagcgcggccgcacgacgggccagctcaaactgttcgcgcaagtcgttcgcgccggacaatggctcgccgccacgctcgattcgccgctgccggagcgcaagccgttgccgcgttccgatctgcgcatgcagaagattccgctcggcccggtcgccgtgttcggcgccagcaatttcccgctcgcgttttcggtggcgggcggcgacaccgctgcggcgctcgcggccggctgcccggtggtggtgaaggcgcatggcgctcacctgggcacctcggagatggtcggccgggtgatccagcgtgtcgcgcaggaaatggacttgcctgaaggcgtgttctcgctgatcgtcggtgccggcaattctgtgggcgaggcgctggtcgcgcatccggcgatcaaggcggtgggcttcaccggttcgcgcgcgggcgggacttcgctgatgcgcgtggcggcggcgcgtgccgagccgattccggtctacgcggaaatgagcagcatcaatccggtgttccttctgccgaatgcgctggctcagcgcggcgagagcatcgcgcgcggtttcgtcgattcgctggtgctcggtgccggtcagttctgtaccaatccgggtctcgcgattgcaatcgacagcgacgcgctcaagggcttcgtcgcgaccgcgtccggcgcgctgagcggcaagcccgcgcaaaccatgctgacgtccggcatccatgccgcttatgaagaaggcgagggcaagctggccgcgacgaaaggcgtggaggccgtggcgcatggcgtcgaagcaagcggcccgacgcaggctcgcgcggcgctgtttgtgaccgacgcgcaaacgttcctcgccacgcccgcactggaagacgaagtgttcggcccggcgtcgactatcgtgcgttgcagggacgagcaggaaatgctcgcggtcgccgaacatttcgcgggtcaactgaccgccacggtgcagatggacagcgccgatctgccggcggcgaaaaagctggtgccgattctcgaacgcaaagccggccggcttctggtgaacggcttcccgacgggcgtcgaggtctcgcacgcgatggtgcatggcggcccgttcccggctacgtccgatagccgtgcgacttcggtcggtacgacttcgatcgagcgcttcctgcgcccggtgtgttatcaggatttcccggccgacctgttgcccgaggcgctcgccgacagcaacccgctgaacctgtggcgccgccgcgatggcgag

SEQ ID NO: 28582 - DNA, 1326 bp, Burkholderia fungorum
gcgagtgccgcccacgtcgcgaagcgcacccgagtccgctacgccatcctgctgctgatctttctgatcacgaccttcaactacgcggaccgcgccacgctgtcggtcaccggctctgccatgcgagccgagttcggtctcgacgcgatccgcatgggctacattttctccgcgttcagctgggcgtacgtgctgtcgcaactgccggccggctggctgctggaccgcttcggcgcgcgccgcgtgtacgcggcgagcatctttttctggtcgctatttacgttgctgcaaagctcgatcggcttgctgggcagcgcggccgccgccgtcaccgcgctgttcgcgctgcgctttgcaatgggcgcggccgaatcgccggccttccccgccaacgccaaggtggtggcgagctggttccccaccaacgaacgcggcacggcatcggccattttcaattcggcgcaatacttcgccgccgtggtatttacgccgttgatggcgtggctcactcacgcgttcggctggcacatggtgtatgtcgtgatgggcgtgatgggactgctgctcgcgctcacctggctgaaggtgatgaagaaccccgccgaccatccacgcgtgtcgcgcgccgaactggagtacatcgaacagggcggcggcgtggtcaatgggcagaagaaagctcgcgccatcgacagaatcgaaaataccggcggctggtctctggtgcgccaactgttgagcaaccgcatgctgctcggcgtctatctcgcgcagtactgcatcaatgtactgacctacttcttcctcacctggtttcccatctacctcgtgcaggcgcgcggcatgaccattctgcaagcgggcctcgtggcttcgctgcccgcgatctgcggtttctccggcggcgtgctcggcggcattctgtccgacgggttgatccgtcgcggccattcgctcacgatcgcgcgcaaggcgccgattgtcggcggcatgctgctgtcggtgtgcatcatcggctgcaattatgtgtcgaccgattgggtcgtcgtcgccctcatgtcgctcgcgttcttcggcaaaggcattggagcgctcggctgggccgtggtcgccgatacgtcgccgaaagaagcgctcggcctgtccggcgcgatcttcaatatgttcggcaacgtggccggcatcgtcacgccgatcgtgatcggctatctcgtcgcgaagaccggctcgttcaatggcgcgctggtattcgtgggcatcaacgcgctgctcacggtgttcagctatctcgtgatcgtcaaagacatcaagcgggtggagttgcgc

SEQ ID NO: 28583 - DNA, 906 bp, Burkholderia fungorum
ccgcaggaactgaagcagatcgtttccgaaggccttctgtccttccccgttaccgacttcgacgaacaaggtgatttccgcgccgacacctatgccgagcggctggaatggctcgcgccttatggcgcttcggccctgttcgtcgccggcggcacgggcgaattcttctcgctcacgcacaccgactattcggacgtcgtgcgcacggccgccgaagtctgtaaaggcaaggtgccgattctcgccggcgcgggcggcccgacgcgtgtcgcgatcgcctacgcacaggaagccgagcgtcatggcgcgaacggcattctgctgatgccgcattacctgacggaagcctgccaggaaggcatcgccgcgcatgcggaagaagtctgcaagtccgtgccgaacatgggcgtgatcatctacaaccgcgcgaattccaggctcaacgccgatatgctcgaagggctggccgagcgctgcccgaacctgatcggcttcaaggacggcgtgggcgagatcgagaacatggtgtcgatccgccgccgccttggcgaccgtttctcgtatctgggcggcctgccgaccgccgaagtctatgccgcggcgtacaaggcgctcggcgtgccggtgtattcgtcggcggtgttcaacttcattccgaagaccgcgatggacttctaccgcgcaatcgccgcggacgaccatgccacggtcggcaagctgatcgacgaattcttcctgccgtacctggcgatccgcaaccgccgcgcgggctacgcggtcagcatcgtcaaggcgggcgcgaagctggtcggccatagcgccggtccggtccgcgcgccgctgaccgatctgacggaagaagaaatggccacgctcgacgcgctcatcaagacgctcggtccgcag

SEQ ID NO: 28584 - DNA, 885 bp, Burkholderia fungorum
gaggtggcggggcaggcgccggcttcggtcggcgaaagtccggtgtggcgcatcgcggaacaggcgctctactgggtggacattccggcgcagaagatcgtgcgtttgcggatcgattcgggcgaacgctccgaatggcggatgccggagaaagtggcgtgcatcgcgttcgatcatcgcggcacggtgctggccggttgcgagacggggctcttcgccgtgacgctcgctggggccacggccaccggcgaagccgtgcaggtgacagggcgcaagctcgccgcgcccgacttcgcatgcgacgacatgcgtttcaacgacggccgttgcgaccggcaagggcgcttctggtccggcacgatggtgcaggacatggcggccgccaggccggccggtgcgctctatcggttcgatgcgcgcggtgttctgtccgcgccggtcgtcgacgggctcatcacgcagaatggcctcgcgtggtcgccggacggcgcgaccatgtatctgtcggactcgcatcctttgcgccggcagatctgggcattcgactacgacggcgagaccggcgagccgcgcaaccgccgcgtgtttgccgatctgaatcatcatgcgggccgccccgacggagccgcggtggacgccgacggctgctactggatttgcgccaacgacgcgggcctgttgctgcgcttcacaccgcttggcaagctggaccggcagatcgccgtgccggccatcaaacctgccatgtgcgcgttcggtggacgcgatctggatacgttgttcgtgacgtcgattcgtcccgcggcgaacgcaagtgagcacgacggccatctgttcgctgtgcgccccggtgtcaccggcttacccgagccggaattcgcgggc

SEQ ID NO: 28585 - DNA, 624 bp, Burkholderia fungorum
atgattacgatctggggacgcaccaattcggtcaacgtccagaaagtgttgtggtgctgcgacgagctggtgctgccgtatgaacggatcgacgccggcctgcaattcggccgcaacgacgaacccgcctatctggcgatgaacccgaccggcaagattccgacgctggtcgacgacgacttcgtgctgtgggaatcgaactcgattttgcgctatctggtgctgaactacggcgaaagcagtctgctgtatccgtctgaaccgaaagcgcgtgccagcatcgaccgctggctcgactggtcgttgtccacgctgcaacccgccgagcgtcccgtgttctgggcgctcgtgcgcacgcccgccgccgcgcgcgacaccgcgaagctggccagcgacttcgacgccgtcgccctgctgtggcgcatgctggactcgcatctgcaagggcgcttctttctcgaaggcgagaagttcacgctggccgacatcgtgatcggcgcctacgcgaaacgctggttcggcgtggagggcgtcgagcggccgccgctgccgaatctggagcgctggtattcgcgcattgcaacgcgtacggggttcaagaagtatgtggactttccgctgacc

SEQ ID NO: 28586 - DNA, 1440 bp, Burkholderia fungorum
ctcgacatgatcattttcggcggcaccggcgacctgtcgtttcgcaagctgctgcccgcgctctatatggcgcatctgcactgcaacctgccgccggacacccgcattctcacaatcggccgcaagccctggtcgcgtgaggagtacatcaacgaattcatggagcagaaggcaaagcccttcattgaaaagaaagcgttcgatgccgccgcctgggacaagtttctggcgctgttcgaatacgtgcgcatggacgtggattcagtcgaggactatcaacggctgaaggaggcgtcgcgcgagggcgtgcgccgcgtgttctatctcgcgacgtcgccggacctgttcacgaacatctgcgataacctcgcggcggcgggattggtcgacggcaactcgcgggtggtgctcgaaaagccgctgggccacgatctggcgtccgcgcaggaaatcaacacggcggtcggcaagcatttcagcgaagcgcagatctaccggatcgaccactacctcggcaaggaaaccgtgcagaacctgatggtgctgcgtttcggcaatccgattttcggcccgttgtggcaggcgccgtatatcaagagcgtgcagatcacggtggcggagacggtcggcgtgggcagccgcgcgggcttctatgacaagaccggcgcgctgcgcgacatggtgcagaaccacttgctgcaactgctgtgcattgtcgcgatggagccgcccgtgtcgctcgacccggacgcggttcgcgacgaaaagctcaaggtgctgcgctcattgcggcccatgacgccggaagacatcgcgcgcgacaccgtgcgcggccagtacaccgccggcgcggtggacggcgaggcggtgaagggttatctcgaggaagacaacgtgccggcaggcagccgcgccgaaaccttcgtcgcgttgcgcgcgcatatcaacaactggcgctgggcgcatgtgccgttcttcctgcgcaccggcaagcggatgcagaagaaagtatcggagatcgtcatcgagttttccgaactgcctttctcgatcatcccgaacgggaatagcgggcgcaactacggcaaccggctcgtgatccagttgcagcctgaggagtcgatccagttgcaggtgctcgccaaggaaccgggcagcggcatgcatatgctgccggtgaatctgaatctggatttgcagcaggcttttaccgagcgtcgcgcggaagcgtacgagcgtttgctgatcgacgtgattcgcggacgcctcacgcacttcatgcgtcgcgacgaactcgaagcagcatgggcgtgggccgagccgattctggcaggctggagcaagtcgggcgagaagccgcgtggctatacggcgggcacgttcgggccggctgcatccaccgcgctgatggcgcgggaaaatgcagtgtgggcggaagag

SEQ ID NO: 28587 - DNA, 516 bp, Burkholderia fungorum
atcaaaagccacatccgcacggtgcccgactggccggagccgggcgtgcagttccgcgatatcacgccgctgctgcaggagccgaagtcgctgcgcgtgctgatcgatctgttcgtgcagcgctatatcgacgcgaagctcgactacattgccgggctggacgcgcgcgggttcatcatcgggccgattctcgcgtatgagctgaacctcggcttcattccgatccgcaaggcgggcaagctgccctacaaccggctcgcgcaatcttatgaactcgaatacggctgcgcaaccgtcgagattcacgaagacgcctgcaagcccggcgaccgcgtggtcatcatcgacgacctgatcgccacgggcggcacgatgatggccggcaagatcctgctcgaacggctcggcgcggtcgtggtggaaggcgcggcgatcatcgatctgcccgaactcggcggttcgaagctgctgcgcgacagtgggctggcgctctatacggtgaccggattcgagggt

SEQ ID NO: 28588 - DNA, 1218 bp, Burkholderia fungorum
atgttcaccggtacgacaggcagggtttttctgctgatctgcgcgatgtatttcatcgaatacgtcgaccgcgtgaacctttccattgcggcgccgctgctgaagtcggagatgcatctgtcgaatacgcagcttggtatcgcgctctcggcgttcggctattgctatgcgatttttcaggtcgtcaacggttatctgggcgaccggatcggaccgcgccggatgctggcgttctccggcattctgtgggcgctcggcacgctcgcgaccggtgtcacaggcggcctcgcgacgctggtgctctcgcgcgcgctggtcggtctcggcgaagccggcacgattccgaacgccacgcgcgcaatggccaactgggttccgctggcaaaacggggcttcgcgcaaggcttcacgcactcggccgcgcgcgcggcggccaccgtcacgccgccgctgatcgtgctgctgattccgctgctcggctggcgcggcgcgtttatcgcgctcggttgcgtcagcgcgatctgggtggtggtctgggcactgtatttccgcgacgacccacgcacgcatccgtcgatcactgccggcgaagtcgacacgttgccgccgtatgccggcccgcgccatcgcacggcggtgccgtggtgggcgctgatccggcgcatcctgccggtcacgctggtgttcttctgccacgcatggacgctgtggctgtatctgagctggctgccgagcttctttgtcggcgtgtacgggatcgatctgaagagcacggcgctgttcacgtcgggcgtgtttctcgccggcgtggtcggcgatacggcgggcggcctgttgaccgatgcgatctaccgccgcaccggcaatctgaatacggcgcgccgcaacgtgatcatcatgggctttgcgggctcgctgctgtttctcacatgcgtgctgttcgtgcgcgaccgcaccgtgatcgcgttgtgtctggccgctgcactattctgtctcgaatccaccgaaggcccgatctgggcggtgccgatggatatcgcgccggccttcgcgggcgtcgcgagcggcttcatcagcacggcggccggactcgcggccgtggtgtcgccggtcgcgttcggcctgatcaccgacatgacgggcagctaccgcctgccgttcgtcatgtcgatcgcgctgctgctggtgggtatcgggctgtcgttctggattcgccct

SEQ ID NO: 28589 - DNA, 723 bp, Burkholderia fungorum
gcggtcgtcaccggcgcggcgcgcaatattggccgcgagatcgcgttgcaactcgcggcggcgggcaatgcggtgatcgtcaatgcgcgcagttccgccgccgaggccgccgaagtcgtgcgcgagatcgaagcggcgggcggccgcgcggccgcgcatctggccgacgtcagcgaaccggcaggcgcgcgaagtctgatggaagcggcgattgaccatttcgggcagatcgacattctcgtcaacaacgccgcggtacgccgcgaagtgccgttcgcggaactggattttgcgcgctggcgcgaagtgatgtcggtgattctggacggcgcgtatctttgcgcgcacgcggcgctgccctatctgcggcagtcgaaggccggcgcgatcgtcaatatcggcggcatgtccgcgcatgccggttcggccggccgcgcgcacgtcattgccgcgaaggcgggactcgtcggtctgacgcgcgcgctcgcgcacgacctgggtccggacggcatcaccgtcaactgcgtcgtgcccggtctgattgcgaccgtgcgcgggggctcggcgggcaataccgaacctgcgcatcacgccgaacgcaccacgttgctcggccggcgcggccagcccgacgaagtcgcgagcctcgtgcagtttctatgcggcccgacagcacgctatctgacgggacaggcgattcatgcgaacggcggcgcctttcta

SEQ ID NO: 28590 - DNA, 1368 bp, Burkholderia fungorum
agcgtttcggcgcggctcgaccgcctgcccccgacgcgctatttcagcggcctcgtcgcacgcatcgcgatcggcggctggttcgagttttatgaaatgttcatggcggcctatatctcactgggactcatcagcagcggcctgtatcgcgccaccacggccggcctgttcgacgtcgacggcttcgccagctttctcggctcgtttttcgccggaatgttcgtgggcacggtggcgctcggcggcttcaccgaccgcttcggacgccgcgccgtattcacctgcgcaatgctgatctattcggtcgcgaccttcgccgcggcgttccagcattcgccgcaagcgatggatctctggcgcttcgtcgcgggcctcggcatcggcgtgcagctcattactgtcgacacttatatttccgagctcacgccgcatcacacccgcggccgctacagcgcgttcagcatcctcgtgatcctgacttccgtgccgaccgtcgccgtactgtcgtttctgctcgtgccgcacaccatcctaggtctcgagggttggcgctgggtgatgatcatcggctcggcgggcgccgtgctgatctggttcatgcggcgcggccttccggagtcgccgcgctggctcgaaagcaaaggccggctcgacgaagcgcgcgcgatcgtcgacgcgatcgaggctcgcgtggtcgcggaaaccggccgcgcattgcaggcgccggcacagcgcgcgccgcaaccgttgaccggcgagcacggcggttcctggtcggagatgtggaaaggccgctatctgagccgcaccatcatgctgtcgttcttcaacttcttccagaccttcggcgtgtacggcttcggcgcgtgggtgccggtgctgctgtacacgaaaggcatcacgatcacgcattcgctgctctacacgatggtgatcgcgttcgcgacgccgctaggcgcgctcggtgcgatggcgtgtgcggagcgcatccagcgcaagtggcaactggtcggctgcgcgatcgtcgtggcggtggccggcgtactgttcggcatggtgcgcgagccgttgctgatcctgctgttcggcagcgccgtgaccatcgcgaacaactggctgatcggtatctttcacacctatcaggccgagctgtatccgacccggattcgcgcccgcgccgtcggtttcgtgtttagctggagccgtctgagttcgatcttcgtcggtttctgggtggcggcattgctcaagcattcgggcgtgcccgccgtgttcgtgctgatttcgtcagccatgttcgtgatcgtcgtgatggtcgggctgctagggccgaagaccaacggcattcgtctggaggagttgtctcaa

SEQ ID NO: 28591 - DNA, 1311 bp, Burkholderia fungorum
ggcgcgcgactcgatcgcctgcccatcgcgtcctttcactggaagattctcgggctcatcagcgcgggcgcctttctcgacgccttcgacatctatctcgcggccggcgcgctcggcgcgatggtgaaagcgggcttttcggatctgaagctgaacgcgctgttcatctcggtgacgtttctcggcatgctgatcggcgcgggctttgccggttatctaggcgaccgcttcggccgccgctcgtcgtaccagaccaatctgctgatcttcggcattgcgtcgatcgccgcgtgcttcgtgccgaacatgatgtggctgatcgtgctgcggctgatcatgggggtcggcctcggcgccgaactggtggtcgcggcgggcaccttgtgcgaattcatcccgcccgcgtcgcgcggacgctggaccgccttgctcgcgctcatcatcaattccggtttgctggtgtcgactgccgtgggttacgtggtgattccgcatctgggctggcgctatatgttcgcgattgccggcgtcggcgcgattatcgtgtgggtgctgcggcaccgcatgccggaatcgccgcgctggctcgaatcggtcggacgcagcgacgaagccgaggccaccgtttccgccatcgagcacgaggtacagcgacagaaaggttcgttgccgccggtcgagcgcatcgaaaatctggaagtgccgaaagcgccattctcggcactgttctcgcacgccatgctcggccgcacgctggttgccattctcacggcagttgccgtgaatatttcggtgtacggctttgttgcctggctgcccaccttcttcgtgaaggaaggtctcaccatcgtgcaatcgctcggctttacgacgctgatggcgttcggcgcaccgggcggcgcgttgatcggctttctctgcgcggatcgtgtgggccgtgcgcgtggcctggtgatcttcgcgatcgccacgatcgtggtcggcttcatctatccgaacatgcacgcgggttgggcgatcagcagcgtcggtttcgtgctggtcacctgcatctatacggtcaccacgctcggcctgttcgcctacattcccgaactctttccgaccgaactgcgtctgcgcggcacgggcacggcaggcgtatgcggccgcgctgcctcgatgaccacgccgtatctcgcggtggtgctctacaactcgttcggtgtatccggtgtgctggcgatggtgagcggtgttctcgcgctgctggtgctcggcattctgctgctgcgtgtggaaaccaatcagcacgcgctcgagcggatctcg

SEQ ID NO: 28592 - DNA, 1038 bp, Burkholderia fungorum
gaaaacgatcaactgattctcgacatgctggaccgctttctcgaaaccgaggtgcgtccttacgtccacaagttcgatcatgacgatatctacccggcggagatcgtcgagaagatgaaggagatgggcctgttcggctgcatcatcgatcccgagtatggcgggctgggtctgtcgacgcggacctacgcgcagatcatcgcgcgcatctcgcgggtctggatgtcggtgagcggcatcatcaactcgcatctgattctcgcaatgctggtgcaacgcaacggcacgccggagcagaaaagcaaatacctgccgaagttcgccaccggcgagtggcgcggcggcatcggcctcaccgagcccgattgcggcaccgatctgcaggcgatccgcaccaccgcgaaacgcgtgggtgacgaatacgtggtgaacggcaacaagacgtggatcaccaacagcaagcatggcaatacgctggcgctgctggtgaagacggatacgacggcgcagccgcggcatcgcggaatgagcctgttgctggtgcagaaagggccgggattcgaggtcagccgtcagttggaaaagctcggctataagggtatcgatacctgcgagttgtcgttcaacggttaccacgtatcgaccgacgcgctgatcggcggtgtggaaggtaagggcttgcagcagatactcggcggcctcgaactcggccggatcaatgtcgcggcacgcggcgtcggcgtcgcgcaagccgcgctcgacgaatccgtcagttattcgcagcagcgcaaaaccttcggcaagccgatctgcgagcaccaggcgattcagttgaagctcggcgagatggcgacgcgtgtcgaagcgggccgcctgctggtcgacgccgccgcgcagaaatacgaccgcggtgagcgctgcgatatggaagcgggcatggcgaaatatttcgcgaccgaagcggcgctggaaaacagcatcgaggccatgcgcattcatggcgcgtacggctattcgaaggagtacaacgtcgagcgg

SEQ ID NO: 28593 - DNA, 1455 bp, Burkholderia fungorum
atgcgttttctgcgtttcctcaagatttttttcacggtcatccgcttcggtctcgatgagatgatgctcagccgcgtcaacgaccggcgcgtgcgtctgctgttgcgcatcaccaccatcggccgcaagttcgacgcgccgccgggcgtacgtttgcggctcgcgctggaaagcctcgggccgatcttcgtcaagttcgggcaggtgttgtccacccggcgcgatctgttgccggtggatatcgccaacgaactggcgaaactccaggatcaggtgccgccgttcgattcggcggtggcgatcgggctggtcgagaagtcgctcggcgcgccggtcgacgtgctgttcgacgatttcgagcgggtgccggtggcgagcgcctcgatcgcgcaggtgcacttcgccacggtgaaggcggggcaacacgcgggcaaggccgtcgccgtgaaggtgctgcggccgaacatgctgccggtgatcgattccgaccttgccctgctgcgcgacatcgccgtgtgggcggagcggctgtgggccgacggcaagcgtctgaagccgcgcgaggtggtcgccgaattcgacaaatacctgcacgacgaactcgacctgatgcgtgaggcagccaacggcagccagttgcggcgcaactttgccggactcgatctgctgctggtgccggagatgtactgggagttctgcacacccacggtgctggtgatggagcgcatggtcggcgtgccgatcagccaggtggagacgctgcgcgcggcgggcgtggatattccgaagctggcgcgcgaaggcgtcgagattttctttacccaggtgttccgcgacggctttttccatgccgacatgcatccgggcaacattcaggtgagcctcgatccggcgcatttcggccgctatatcgcactcgacttcggcatcatcggcgcgctgtcggacttcgacaagaactacctcgcgcagaacttccttgcgttcttcaagcgcgactaccatcgggtcgcaacgctgcatctggagtcgggctgggtgccgccgactacccgcgtcgaagaactcgaaagcgcgatccgcgcggtctgcgaaccgtacttcgaccgcgcgctgaaagatatttcgctgggccaggtcctgatgcgcctgttctcgacctcgcgccgcttcaacgtcgagatccagccgcaactggtgctgctgcaaaagaccatgctgaatgtagaaggtctcggccgctcgctcgatcccgaactggatctgtggaagaccgccaagccgtacctcgaacgctggatgaacgaacagatcggcctgcgcggctggtacgagcgcctgaagatcgaggcgccacaatggagcaagacgctgccgcaactgccgcgcctgatccatcacgcgctggccgagcgccacgaccacacgcgcggcgcgaacgacgaaatgattcgc

SEQ ID NO: 28594 - DNA, 1179 bp, Burkholderia fungorum
ttgcaagacgcatacatcgtcgccgcgagccgcacgccgatcggcaaggcgccgcgcgggatgttcaggaacacgcgcccggacgaactgctggtccacgcgatcaggtcggctgtggcgcaagtgcccggcctcgacaccaaggtgatcgaagacgcgatcatcggctgcgcgattccggaagcggaacaaggcctgaacgtggcgcgcatgggcgcgctgctggccggcctgccgaataccgtcggcggtgtgacggtgaaccgcttctgcgcgtcgggcctgacggcgctggcgatggcggcggaccgcatccgcgtcggcgagtcggacgcaatgatcgcgggcggctgcgaatccatgagcatggtgccgatgatgggcaacaagccttccatgtcgccgcatatcttcgatcgcaatgaagatatcggcatcgcgtacggcatgggcctcacggccgagaaggtcgccgagcgctggaagatcagccgcgaagcgcaggacgcgttctcggtcgaatcgcaccgccgcgccattgccgcgcagcaagccggcgagttcaacgacgaaatcgccgcctacacgatcaccgaacgcttccccgatctcgccaccggcgaagtccgcgtgaagacccgcgaagtctcgctcgacgaaggtccgcgcgcggaaacctcgctcgaaggtctcgccaaactgcgcgcagtgttcgcgaacaagggttcggtgacggcgggcaacagctcgcagacctcggacggcgcgggcgcgctgatcgtggtgtcggaaaagatgctgaaggaattcaacctgacgccgctcgcgcgtttcgtcagcttcgccgtgcgcggcgtgccgccggagatcatgggcatcggtccgaaggaagcgattccggccgcattgaaggccgccggcctgaagatcgacgacctggactggatcgagctgaacgaagcgttcgccgcgcaatcgctggcggtgattcaggacctcggtctcgatccggcgaagatcaacccgctcggcggcgcgatcgcactcggccacccgctgggcgcaacgggcgcgattcgtgcgtcgaccgtggtgcatggtttgcgccgccgtaactacaagtacggcatggtgacgatgtgcgtcggcacgggcatgggcgcggcgggcatcatcgag

SEQ ID NO: 28595 - DNA, 1485 bp, Burkholderia fungorum
ctggcgctgaaagtgttccgccatctgcatgcgctgtcgctgcgctttcatctcgaacggcagaccggcggcatgtcgcgcgatatcgagcgcggcacgcgcggcatcacgcagctgatctcgtattcgctgtacagcattctgcccacgctcgtcgaagtcgggctcgtgctcggctttttcgtcgtcaaatacgaggcgtattacgcggtggtcacgttcatcgcgctcgcggtgtacatcgtcttcacggtgaaggtcacggaatggcgcacgcattttcgccgcaccatgaacgatctcgattcgaaggcgaattcgcgtgcgatcgattcgctgctgaactacgagaccgtcaaatacttcggcaacgaagagtgggaagcgagccgttacgacgaaaacctgaagcgctaccgcacggcggcgatcaagtcgcagcgctcgctgtcggcgctgaacttcggccagcaggcgatcatcggcaccgggctcgtgttcattctgtggcgcgccacgcaaggcgtgatggccgggcgtctcacgctcggcgatctggtgctgatcaacaccttcatgctgcagctttatattccgctgaattttctcggcgtggtgtatcgcgagttgaagcagagtctcaccgatatggaccgcatgttcacgctgctcggcgcggcgcaggaagtgcccgacctggaaggcgcgcccgcgctgcgcgtgagcggcgctcaggtgcgcttcgaacacgtgaacttcgcgtatgaaccggcgcgccagattctgcacgacgtgagcttcaccattgcggcgggcaccacgacggcggtggtcggccatagcggctcgggcaaatcgaccctcgcgcggctgatgttccgcttctacgatctggaccgcgcgacgggcggcgcgatcacgatcgacggtcaggatattcgtgacgtcacgcaggattcgctgcgcgcgtcgatcgggatcgtgccgcaggatacggtgctgttcaacgactcgatctattacaacatcgcttacggccggccctcggcgacacgcgaggaagtgatcgcggcggcgcgcgcggcgcatattcacgagttcatcgagggcttgccgaagggctatgacacgccggtcggcgagcgtggcctgaagttgtccggcggcgaaaagcagcgcgtggcgattgcgcggaccatcctcaagaatccgcccattctgctgttcgacgaagcgacctccgcgctcgattcgcgttccgagcgggccattcagcacgagctggatcagatcgcccgcgagcgcaccacgctgatcatcgcgcaccggctgtcgaccgtcgtgcatgcgcagcagatcatcgtgatggacaaaggacggatcgtcgagcgcggcacgcatgccgaactgttgcgcgcgaacgggctgttcgcgcagatgtgggcgttgcagcagcagcgcacgacagaggcgccggaatcggcg

SEQ ID NO: 28596 - DNA, 1506 bp, Burkholderia fungorum
actatccgttcggtcggcattgtcggctccggtgcgatgggccggggaatcgcgcagattgccgcgctcgcgggactgaacgtacacctgtacgacatcaggcaggacgccgtggaggccgcccgacaccatctccgcgatacgttcgcgacgcttgcgacgaaaggcaagattgcggtcaacgcggcaaccgacgcggtggcacgcatccggtccgcgacttcggtggacgcgttgaagaattgcgacctcgtgatcgaggcgatcgccgagaatctcgacgcgaagcgggatctatttacccggctcgacgcggtggttcgggaggactgcatcctcgcgtcgaatacctcgtcgctgtcgatcaccgcgatctcgaccgcgtgttcgaaaccgtcgcgcgtcgcgggattccacttcttcaatcccgttccgctgatgaaagtcgccgaggtcatcgacggtctgcatggcgtgcgggagaccggtgatcgcctgatggagctggcgcggcggatgggacatacgccggtgcgggtgaaggacatgcccggctttatcgtcaaccacgcggggcgcggaatgaacaccgagggcctgcgtatcgtgagcgaaggggtggcggacttcgtcgatatcgaccgtatcgtgcgcgagcaggccggcttccgcctggggccattcgaactgatggacctcacgtccctcgatgtatcgcatcctgtcatggagtcgatataccaccagttctatgaggagcctcgcttccgtccatcgccggtcaccgcggtccggctcgcgggcggccttgtcgggaggaaggccggcgaaggcttctaccgataccctggcggcaggaaggagatcccggacgaggggctcgttcatgccgcgttgcccgaacgcgtatggatcagttcgcgttcaatcgacgcgcaccggcaggtcaccgatctggtagcgccgaccggtgtaacgatcgagtcgggcgagcgaccgtcggaaagcgcattgatcctcgtgatgccgtatggcaaggacgccaccaccgccgcgctcgaagaagggctggacgcgagccgggttgtggcgatcgattgcctgttcccgcttagcgcatcgcgccgtcgcacgctgatgaccacgccgctgacgaatccgagctttcgcgacggcgcgcgcgcgctctgctcgcacggcggtgccgccgtgaccgttattcgcgactcggcgggattcgttgcacagcggatcgtcgcgatgatcgtcaacatcggttgcgatatcgcgcagcagagaatcgcgtcgcccgacgatatcgatctcgccgtgacgctcggtctcggctatccgaacggaccgctcgcgatgggcgacgctgtcggcgcggcgaggattctggagattctgcgcaacatgaccgcgctgctcggcgatccgcgataccgaccctcgccgtggttggcgcggcgggcgcaactgggaatgtccttgacccaggcggat

SEQ ID NO: 28597 - DNA, 852 bp, Burkholderia fungorum
gttaagacagtagcagtcgcgggcagcggcacgatgggcaccggcattgcgatcgtcgcggcccgcgccggtttccggaccatcgtgttcgacacgcgtcaggacgcactcgatcgcgcacgcgggcagaccgaagccttcctgcggaagtcggtcgcgcgaggcaagctcagcgtcgaggacctcgacgctattctcggacgatggtcgtcgacgacgaagctcgaggatctcgcgtcaggcgacgtggtcatcgaggccgtgttcgaggacctgcgtgtgaagcacgagctgttttccgcactcgacagggtctgcgccgccgacacgatcttcgcgtccaacacgtcgaccatttcgatcaccgaaatcgcaggcggctcggggcgcccggaccgcttcgtcggcatgcacttttgcctgcctgcccagttgatgaaactgatcgagatgtcgccgggtctcgaaacgagcgacgacacgtggcagcgagcgtgggagttcgcgttgcagatgggccagcagccggtcaagacgaaggacacgccggggttcatcctcaactatttcctgattccgtacaacaacgatgcgatccgtctcgtcgaggccggcgttgcggaaccggcggagatcgacagggcgatcaggacggcactgggctatccgatgggtccgctcgaactgctcgacctcgttggcatggacacccagcgcctgttgtgcgaggcgatgcacggcttgacgaacgaagaccgcgccgcgtgcccgccgctcgtgaagcggatgatcgcggcgaaacggctcggcaagaaaaccggccacggtttccatcgatacaccgacacgaag

SEQ ID NO: 28598 - DNA, 1377 bp, Burkholderia fungorum
atgaaagtcactatcgtcggaacaggttatgtcggtcttgtcaccggggcatgcctcgcggaattgggcaatgatgtgctatgtctcgatgtcgatgcagccaagatcgaagagctaaacaacggcggcgtagccatctacgaaccgggactatcggaagtaatcgcgcgcaatcgcgacgccgctcgcctgacgttttccactgatatcgccaaaggagtggcacacggcgacattcagttcatcgcggtcggaactccgcccaacgaggacggttccgcggacctgaagtacgtgcttgctgccgcgcgcagcatcggccagcatatggattcgttcaaggtcgttgtagataagtcgaccgtgccagtaggtacggcggacaaagtgcgtgagacgatctcgcgggaattggcggcacgcggtcatggcgcacagttcgccgtggtctcaaacccggagtttctcaaagaaggagcggctgtagaggacttcatgcgaccggatcgcatcgtattgggatacgatcccgacgtcgcggggctgcgcgcgaaaagcctgatggagcagctttacgcaccgtttaaccgcaatcatcaacgcaccctgtgcatggacgttcggtcggccgagttcaccaaatacgcggctaatgcaatgctcgccacgcggatttcgttcatcaacgaactcgcgaacctggcggatcgcgtcggcgctgatatcgaacatgtccggcgcggcattggctccgatccacgcattggttacagcttcctgtacgccggctgcggatacggtggctcctgctttccgaaggacgtgcaggcgctgatgcataccgcgaacgaaaacggcatggagctgaacattctggcttcggtcgagtatgtgaacacgctgcaaaaaacagtgttattcgacaagatcaaacagcatttcaataatgcgcttaatggcaagcactttgccgtttggggccttgctttcaagccgaacaccgacgatatgcgagccgccacgagtcgccaactgattgcggcattgattcgtggtggagcgtcggtaagcgtgtacgatcctgttgcgcttgaccaggcccggcgtagcctggcagcagacctcggtccggataatttcgagcacgtcacttttgcgaaagagcgcgatatggcactccagaatgccgatgcgctagtgatcctgaccgaatggaaggagttccggagtcccgatttcgagcagatgaacgaagcactcaatgacgcggttatattcgacggacgcaacctgtatgacccgactgcgatgagggatagcggctggaagtactacacgatcgggcgagatgcggcccattctacttcccggtaacga

SEQ ID NO: 28599 - DNA, 1089 bp, Burkholderia fungorum
aaagttgccttgattaccggcgttacaggtcaggacggctcgtaccttgcggaattactgttaagcaagggctatgaagttcacggcataaagcgccgttcgtcgctgttcaatacggaacgaatcgatcacctgtaccaggagccgcatgcgtccgatcgccgcttcgtcctgcaccacggcgatctgaccgattcgacgagcctcgtgcggatcatccaacgcgcgcagcccgacgagatttataacctcggggcacaaagccacgtcgcggtctcattcgaggagccggagtatacggcgaacgtcgacggtgtcggcgcactgcgcattctcgaggcgatcaggattctcggcctcgaaaagaagacgcgcttctatcaggcctcgacgtctgaactctatggattggttcaggaaatcccccaaaaggaaaccacgcctttctacccacgtagtccgtatgcggtagccaagctgtacgcgtactggatcacggtcaactaccgcgaggcgtatggcatctacgcgtgcaacggcattctgttcaatcacgagtccccggtgcgcggcgagacctttgtgacgcgcaagatcacgcgggcgatctcccgcattgcaacaggcctgcaggagtgtctgtacctcggcaacatgtccgcgctgcgggactggggccacgcgcgcgactacgtcgagatgcaatggttgatgctgcaacaggaacagcccgaagactttgtgattgccaccggcgtgcagtacagcgtgcgtcagttcgttgagcaggccgctgcggaactggggatccatttgcgctttgagggatcgggcgtcgacgaggtgggcattgtcgagcgtgtcgtagggggagacacgaaagtagtgcggggtgacgtgatcgtgcgtgtggatccgcgctatttccgcccggccgaggtggaaacgttgctgggtgatcccaccagggcgcacgaaaagttgggctggaaaccggctacgtcgttcgaatcactggtcacggaaatggtgcgcgccgactatcaggtcgcgaagcgggatgcgttggtgacgctggcgggtttcaag

SEQ ID NO: 28600 - DNA, 873 bp, Burkholderia fungorum
atgctgaaagttaccaaggctgtgtttcccgtagcgggtcttggcacccgatttcttcctgctacaaaggcgagcccgaaagagatgctgccgatcgtcgacaagccgctgattcagtacgcggtcgaagaggccatggcggccggcatcaccgaaatgattttcgtcactggccgcagcaagcgcgcgatcgaggatcacttcgacaagtcctacgagatcgaggccgaactggaagcgcgcggcaaggacaagctgctcgaactggtgcgcagcatcaagccgagccatgtcgattgcttttacgtgcgtcagtcggaggcgctcggcctcggccacgcggtgctgtgcgcagaaaagctggtcggtgacaacccgttcgcggtcattctcgcggacgatcttctgcacggcacaccgccggtcatgaggcagatgatcgaagcgttcgatcactaccatagctcaatgataggcgttgaggaaatcccgtcgcaggataccggctcgtatggcgttatcgatggatcggaatggggggactcgatcatcaggatggcgggcatcgttgaaaagcctgagccgaatgtggcgccttcgaacctgggtgtagtggggcgatacgtgctgaagccgcgaattttcaagcatctgcgcgccatcaaggccggcgccggtggggaacttcagttgacggatgcgatccagtcgctgcttgccgatgaacaggtgctggcatacaagtaccacggcacacgctttgactgcggtagcaagctgggttatctgaaggccacggtggaatttgcgttacggcatcctgaggtacgttccgaattccgtgcgtaccttgagaaacatctatctctcctg

SEQ ID NO: 28601 - DNA, 1341 bp, Burkholderia fungorum
atacatgcaacgaaaggaaacacgatgacgtctatcgcagttcgcaatcctcgcaccggcgagcttgactatcaaatcgacgacatggacgcagcgcatatcggcgccgccgtggctgcggctcgcaaagcccaacgcgcgtgggagcaaggtggcctcgcgcatcgcaccacggcgctgctcgcgtgggccaacgaacttgaaaagaatggtgcggaggttgtcgccgcgctgtcgatcgacacggcgcgccaccgcatttcggcggaagagctaggcgcggtgatccacttcatccacggtttctgcgagcatgcgcctgccgtgctggctacgccatttcgcaagctggaagcgcacccggacgtcgtgttcaaggtcacgtatgcagcctatccggtagtcggcgtgatcagcccgtggaacttcccgctggtgctgtcgttcatcgacgcaattcccgcgctggtcgccggagccgccgtcatcatcaagccgagtgaagtgacgccacgcttcatcgagccgctgcgccgaagcatcgaggccgtgcccgctctcgccaacatcatcacactcgtgacgggcggagcggagacgggcgccgcgatcgtcgcgcagtcggacgccgtggtgtttacgggcagcgtgccgaccggccagaagattgcgatagcggccgcgcaggccttcattcccgcgttcctcgaactcggcggcaaggacgcggcggtcgtgctcgcgggcgccgatgtcgagcgcgcggccaccagtattctgcgcagcgcgctttataactcggggcaggtctgctatgccattgaacgtgtgtatgcacacgattcactgtatgacgcgctcgtcgaggaactgcgcgcgcaagcgggcgcgctgaagcgcagcaacgcggcgggcgacggcggccattacggcccgatgattttcgaaaagcaggcgaccattatcgacgcacaactggacgatgcagtgaacaagggcgcgtcgatcgtgctgggcggcaagagcgagcgcgtgaatggcgcggtgtggatcgacccgacgatcgtgacgaacgtcgatcacacgatgacgctgatgaccgacgagacgtttgggccgatcgtgccggtcatgcgctttagcgacgacaccgaagccgaacggttgatgaacgactccctgtttggattgagcggtgcggtgtttggtcctgacacccacattgccggtgacttcgcgacgaagatggaagcgggtggcgtcagcatcaacgacacggagttgccacgcgtgatgatgttcgatggggagaaaaccgcgttcaaaaagtcgggtatgggc

SEQ ID NO: 28602 - DNA, 1101 bp, Burkholderia fungorum
gtgaacgtgccggtcgtacgtgccagcacggttcgcttcgagcgcgacgcggagcgcgccacgttgcatcgccggcgcgaggcgggcgaagccgtcagcacttacgggcgacacggcatggcgacgcatcgcgcgctcgaagcggcgctcggcgagctcgaaggcgcgagcgatgtgctgcttgcgccgtcgggactcgcggcgatttcgctggtgttcatcgcattgttgtcgccgggcgatcatgtgctcgtgcaggacagcgtctatggtccagtgcgcgaacgcatcgagccgctgctgacgcggctgggcgtgtcgttcagctacttcggcgcgagcgacggcgtgcctgcggcgctgctgcggccgcaaacgcggctcatctatgtggagtcgccgtcgtcgttcctgtatgaagtggtcgatctgccggcgctggcggctttcgcgcgcgaacacggcgtgttgctcgccgcggacaacacgtggggcgcagggctgctgtatcggccgctcgcgctgggcgcggatatttccgtgcaggcgacgaccaagtatcccggcggtcactccgatctgatgcaaggagcggtctcgacagccgatgcgaagctggcgaggcgtctgcgcgacacgcacgacgcgcttggtctgagcgtcggcgccgacgatgcctatctggcgcttcgcggcctgcgcacgctcgccgtgcgcctcgcgcagcacggccgcaatgcgctcgaagtcgcgcgctttttgcaaaccgggactcgcgtggtcgcgcgggtgtttcatccggcgttgcctgaccattccggccacgcactgtggcagcgtgatttcaccggcgccaacgggctcgtttcatttgcgttccgtcacgcgcaaccggccgacgcgagcgcattcgtcgacgcgctgcggctattcggtatcggtgcttcgtggggcggctatgaaagcctggcgttgatcgcgccgtccgcacggctgcgcgagcacagctattggcgcggcgacgtacccgtcgtgcggctgcatatcggcctcgaagatccggccgatctgatcgacgatcttagccaggcatttcgccgc

SEQ ID NO: 28603 - DNA, 2052 bp, Burkholderia fungorum
atgttgcagactcaggccgccgagtgcggactggtttgtgttggcatgatagccaactacttcggccacgatatggatctggcaagcctgcggcgccgtttcacgacgtcgctcaaaggcgccacgctgaatgacatcatgcagatgtccaaccagctcggcttgacgccgcgggcattacggctggatctgaatgatctggcaaagctgaatcgtccgtgcattctccattgggagatgaatcactttgtcgtgctcaaggaggtttcgcgcgacaagatcacggtgcatgatcctgcgcgcggcattcgcgatattccgatggacgaggtatcgcgcggatttaccggcgttgcgctcgagctgatgccatcggcgtcgttccagccggttgcggaaaagcagtcgatctcgatgcttaaacttatcggcggcgtaatcggcatacgttcggcgtttgtacaggttctgcttatttccgccgccctggaggtgtgcggcatcatctcgcctttctatatgcagtgggtgatggaccaggttctggtatccgccgacgtggatctgctgacgctgcttggcatcggtttcctgatgctggtggtgttccagaatgcgattgcggcgctacgttcctgggtcgtaacgtggttctccagcctgttgagcgtgcagtggacagcaagcgtctgttcgcatttgctgaaattgccgatgtcgtatttcgagcagcggcatatgggagatattgtttcgcgcttcggttcggtcggaacgatccagagcatgctcacttcccgttttatcagcacgctgctggacggcgtgatggcgagcattaccctcgtgatgctgttcgtctatagccccatgctcacgtggcttgtgcttgggctgtttgccgtctatgcgctgatccggtggattgcctacagaccgctgcggcgagccaatgaagatcagatcgcgtattcggcacgcgcgcagtcgcaactgctggaatccattcgtggcgttcagacgatcaagctcgggaacaagcaggaagcacgcgtggctacctatacgaactccgtggtcgatatgaccaatcggggcattgccatccagcgcctgtcaatcagcttcagtacgctgcaaggcgtcatttcggggatcggccgcgtggtgctgatctggctggccgcccgtcaggtcctgcagaacgagttctccgccgggatgctggtggcgttcatcagctttgctgaccaatttacgtcgcgcgcgtccggcctgatcgacaccgtcatcgatattcgtatgttgcgtctgcatggggagcgtctggccgacatcgtcctcacggaaccggaaagcaacatggaggggtccgtcactcgcgcgaacctggttgaagaagccaaagaccgtgcgcccggcatcgaagtctccaacctgcgtttccgctatgctgatacggaaccctgggtgatcaaagactgttcgttcacagtcgagccgggggaatcggtcgcactgattggcccgtccggccagggtaaaaccaccatggctaaactgctgctcggtctcctgatgccgcaaaaaggcgaaatcagggtggatggcgtggacatcaaaaagctggggatgcttggctaccgcgacatgattggctcggtcatgcaggacgacattctctttgccggttccattgccgacaacatcagctttttcgatacccatcctgattacgcgcaagtcgagagagtggcgcgaatcgcgcagattcacgacgaaatcacggctatgccgatgggttatcaaagcctggttggcgacatgggatcgtcgctttccggtggtcaggcccaacgcgtcctgcttgcacgggcgttgtaccgcaacccgtcaattctgattctcgacgaagcgacaagccacctggacgtggatcgcgaacggctgatcaacgatgcgatccgcaatatggaggtcacgcggatcatcattgcgcaccggccggagaccatccgcagcgcggatcgcatcattgccatgcagcaaggc

SEQ ID NO: 28604 - DNA, 1419 bp, Burkholderia fungorum
atgtatatcggcggcgagtgggtagagccggcgtcgggcgaatatttcgaaacggtggatccattcacggcgaagccctgggcgctgatcccgcgtggtaatgccgaagacgccgaccgcgcgatacgcgccgccgacaaggcgttccgcgacggcccgtggcgtgccatgcatccgtccgagcgcggtttggtgctgcagcgcttcggccaactcatcgggcaacatgccgacgaactggccgggatcgaggtgcgcgataacggccggctgttggccgagatgcgccatcagatcagaggcatcccgaaatggtattactactacgggggactggcggacaagatcgaaggcgccgtacacccggtcgagcagccggcgctcagcttcacgcggcacgagccgctcggcgtgtgcgtaggcatcgtgccgtggaatgcgccgctgctgctgctctcgctgaaggcggcgccggcgctcgcggccggcaacaccatcgtgctgaagccggccgaatttacgtcagcgtcggcgctcaagctcatggaactggtggagcaagccggttttcctcccggcgtcgtcaacgtggtgaccggcttcggcaaagaggtgggcgagccgctggtcgcgcatccgctgacgcggcatctgggtttcaccggctcaacggccaccggctctcacctctatgcgctcgccgcgaaggacgtgaagcgcgccagcctcgagctgggcggcaaatcggccaatctcgtcttcaacgacgccgatctgaacaatgccgtgcgcggggtggtcggcggaattttcggggcagtcgggcagacctgcattgccggctcgcgcctcctggtgcagcgccgcatccacgacgaattcgtggacaagctcgcggctttcacgaaaacggcgcgcatcggcgacccgcgcaaaccggaaacccagatcggtccgatcgccaaccggatgcagtacaacaagatcctgggctatatcgacatcgcgcgcgaggagggcgccgagctggtgatgggcggggcgcgccccgatatcgccgagtgcggggaaggattcttcatcgagcccaccatctataccggcatccgcaacgacatgcggatcgcgcgcgaggaagtgttcgggccggtgctcgccaccattcccttcgatgatccggaagaagccatcgccatcgccaacgacagcgacttcggattgggtgcgggtgtatggacctccgacatgcgactggcactcaggatgagtgagcggctggaggccggcagtgtctggatcaacacctatcgcgacatttcgtatacgacgcccttcggcggctacaagaaaagcggcatcggccgggagaacggcatcgagggcattcgcgaatatctgcagaccaaggccgtctggatc

SEQ ID NO: 28605 - DNA, 1164 bp, Burkholderia fungorum
gcggcgcttcagaccagcgttgccccgcctactttgctgccgcacccgcttctcgagaccataggcgcgcgcgccgcaggctatgaccgcgaaaaccgcttcttcgccggtgacctcgaagatctgcaacgcgtcggcttcctgcgcgcgagcgtacccgtcgaactgggcgggctcggcttgacgctgccgcagctgctgcgcgagcaggtccggctcgcgacgcgcgcacctgccaccgcgctcgcgctgaacatgcatttatactggatcggcgcggcgctgcatttgtatcgacgcggcgacgcgtccgcgcgatggatcctcaccgaagccgccgcgggcaaggtctttgcagccggccacggcgagcccggcaacgatctcggcctcgctcattcgttcgtcaaagccacgccgctgggcgacggcggttatcgtttcgacggccgcaagatcctgacgtcgcttgcgcccgcatgggactggctcggcgtgcacgggctcgacgactccgatcctgccgcgccgaaaatcgtccacgcgttcattcatcgcgacgccgccggacatcgaaccgtggaaacgtgggacgccctcgggctgcgtgcaacccgtagtgacgacacctatctggaaggtgcaatcgcgcagcaccagcatgtgattcgcgttttgcccgcgggcattccggacgacccgttcgtcgacggcattctgggcgccgtgctgcccggccttgccgcggtgtattacggcatcgcaaagcgggcgctcgaactggccatcgcgacggcaaagacgcgcacctcgcaggcgctggccggaaagacgtatgcatacaagccgttgacgcaactcagcgtggcacaggcggccatcgaactggacagcatcgaagcgctcgtcgaacgtgtggcggcgcaatggtggcaaggctatccggacggcgagccgtggatcgccagattgctcgcgtcgaaacagcatgcggttgacggcgcgttgcgcgtcgtcaacctggcgctgaaaatcgcgggcgccggcgcgctctcgaagaacaacgaactggaacgactctatcgcgatgtgcgtgccggcgcgtttcacccgccaaacgccgatgcgacgcatgaagtgatcggccaggcgtggttaggcgta

SEQ ID NO: 28606 - DNA, 2196 bp, Burkholderia fungorum
atccaggaaaaagcgccggtcgaaacgagccgtgtgctcgtgcatcaaaacaagccggacggcttcatgtgcgtcagctgttcgtgggcgaagcccgcccatccgcataccttcgagttctgcgagagcggcgccaaagcgaccgcctgggacctcacgtcgcgccgcgtgaatcccgaattctttcagcagcacacgctggctgaactggagcaatggcacgatcaggcgctggaagacgcgggccgcctctgcgcgccgatgcggtgggacgcggcactcgacaaatatgtcgaggtcacatgggaacacgcgttcgcagagatcggccgcgagctgcgcgcgatcaagcccgacgaagcggtgttctacacgtccggccgcgcatcgcttgaaactgcgtatatgtaccagctttttgcacgcatgtacggcacgaacaacctcccggacagctcgaacatgtgtcacgaaagcacgagtgtcgggctcaagcaggcgattggtgtcggggttggcacgatcacgctggaggacttcaagcataccgacctgatgttcttcttcggccagaacgtcggcacgaacagcccgcgcatgctgcacgatctgcaggaagcgagagagcgcggcgtgccgatcatcacgttcaatccgatccgcgagccgggcctcgtgagcttcgtgaatccgcagtctcccacgcaaatgctcaagcccggcgcgacgcagatcagcacgcaataccatcagctcaaagcaggtggcgattcggcggcgatagtcggcatctgcaaggccgtgatcgaagcggacgaccgcgcgcaagccacaggcgcggcacggatcgtcgacgccgggttcatcgcggaacatacgagcggctttgacgatttcgcgcgctatgtaagaaatgcccgctgggacgagctcgagcgcatctgcgggctgacgcgcgccgcgctcacggcggccgccgacgaatacatgcgcgccaaggctgtgatcatccactatgggatgggtctcacccagcaccggatgggcgtgcagaacgtccgcatgatcgtcaatctgctgctcctgcgcggcaatatcggcaagcctggggcggggccgtcgccgattcgcggacattcgaacgtgcaaggacagcgtacggtcggcgtgacggagaagccggaactggcgccgctcgacaagctcgccgagcagtaccacttcacgccgccccgcaaggaaggcatggcgaccgtcgacgcatgcaaaggcgtgatcgacggcaaggtgcgcgccgtcttccagctaggcggcaacctcgtgcgctccgtgcccgatcgctatgcgatcgagcccgcgtggcgcaagctgcgtctgactgtcagcatcgcgaccaaactcaatcgcagccacctcgtgcatggcgaagtgtcttatctgctgccttgcctgagccgtatcgaaatcgacgaacgcatgggcaacgcgcaggcggtcgcaatggaagacagcaccggctgcatgcatggctcgcacggcgtcgcgcagccggcaagcgaccagctgttgtccgagccggcgatcgtcgccgggatagcgaaggcggcgctcgattcgacgtcggtggactgggacgcgtggagcaacgactacgcgctggttcgcgacgccatcgccgagacttatccggaaatcttccacgacttcaacgcgcggatgtggacaccgggcggttttcatcgtccgctgcccgcacgcgagcgcaagtgggagacgaaaagcggcaaggctgagttcatggtgccgcaaacgctcaacgaagatcccgacatgcccgaacgccagcctgacgacttgcgcctcttcacgctgcgcagcgacagtcagttcaatacgacgatctatacattggacgaccggtttcgcggcgtccggggcacgcggatggtgctactgatgaaccggcgcgacatcgagcggcatggcctcgaggctgacgccgaggtgtcgctggaggcggtctcgccggacggcatcccgcgccgggtcgacggctttcgcatcatggagttcgacctgcccgccggctgtgtggccggctactaccccgaatgcaatccgctgattccgctgtcgcaccacgcgaaggaaagcaaggtgcccgccgcgaaggcgattccggtgagaatcgtcgcc

SEQ ID NO: 28607 - DNA, 1086 bp, Burkholderia fungorum
aaagcattggtatatgaaggtccgcgcaaagtcaccgtgaaggaaatgccggatgcgaaaatcgagcgccccacggacgtgctcgtcaagatcaccaccaccaatatttgcggctcggacctgcacatgtatgaaggccgcacgaacatggaaacaggccggattctcgggcacgaaaatctcggcgtagtcgtggaagtcggcgcaggcgtcgaacggatcaaggtcggcgatcgggtctgtttgcctttcaatatcggctgcggtttttgcaagaattgcgagcgcggcttgaccggcttctgcctgaccacgaaccccggcatggcgggcgcggcttacggattcgccggcatgggcccctatagcggcggacaggccgaatatctgcgtgtgccgttcggcgatttcaattgtctcgtgctgccgcccgacgcggaagaaaaggaaaacgactacgtcatgttgtccgatatttttccgaccggctatcacgcgacggttctcgccggagtcgaacccggcgacagcgtggtgatctacggcgcgggaccggtcggtctgatggcggcgttgtccgcatcgatcaagggtgcgagcaaaatcatggtggtggacagccatccggaccggctcaagctggcggaaaaaatcggcgcgattcccgtggacgatactgacggctcatcggccgagcggatcctcgaaatgaccggcggcgagggcgcggaccgcggctgcgaatgcgtcggctatcagtgcagctgcaagggccatgaagtgccgaacctgaccatgaacaacctcatcaaggcggtgcgcccgacgggcggcatcggcgtggtcggggtattcgtcgccgaggacccgaaggccggggatgagcttgcgaagaagggccagctcgccctcgacttcgggcagctatggatgaaagggcagcacatcgcgaccggccaggccaacgtcaaggcatacaaccgcaagctgcgggatctgatcgcagccggcaaggcgcggccctcgcagatcatctcgcacgaactgccgctcgataaagcgccggacggctacaagcacttcgac

SEQ ID NO: 28608 - DNA, 1077 bp, Burkholderia fungorum
gagttcatagcgatgcttgggcacgagttgcgaaatccgatggcgccgatcgacagcgcggtcggtgcagcgaagcagctgtgctcggacaacgaaaaagcggttgaagtgctgaccattgcgcagcggcagatgaggcatctgcgaaccctcgtcgacgatctcctcgacgccgcgcggctcaaacacggcaagcttgccatcaagcacagcaacacctcactcaacgagatcgcgttcgacgccgtcaccgcagtgaggcatcacatcgaatcgcggcggcattcgctcaaggtgaccggccttgacgagcaggttccggttcgggccgatcatgtcaggctaagccaggttctgggcaacctgctgtccaatgccgcgaagtacacgccgaccggcggaacgatcgagctcaccgtgaaagtggcggccgacgaagaaccggcgcagccagacctggttgtcattgaagtgaaggacaacggaatcggtatcgacagctcggtccagccgcacgtgttcgagctcttcgcgcagtccgcgcgcggcaatgcgcgggccgagggcggattggggatcggcctcgccgtcgccaagcggatggtggaacttcacgacgggacgatttcgctgcaaagcgatggaagtggccggggcacttcggtcacgctgcgtctgccgatactgcgctcgcgcgacgactcgccggcaaccgtcgataccgcacagcctcgcgagctgcgacccgtgcgtctgctgctcgtggacgacaatgccgacgcattgcaatcgctggggatgctgcttgaactcgaaggccatcaggtcacgatgtccgccagcgggcgcgaagcagtccaactcatcaggcagacattgcccgaggtcgccatcatcgacgtgggcatgcctgacatggacggcttcgatgtcgccaccgcggtacggtccgacagccggctcgatgacgtcacgctggtcgcgttgacgggctacgccgcggagtccgacaaatcgcgggccctggctgccggctttgactatcacctcacgaaaccgctttcgctcgagaaattg

SEQ ID NO: 28609 - DNA, 1275 bp, Burkholderia fungorum
atcgtgaccggcgcgcaaggcatccgcatcgaagaccatcagggcaagtcgtatatcgacgcgttcgccggtctgtactgtgtgaatatcggctacggccgcaccgaggtcgccgaagcgatctacgagcaggcgaagaagctggcctactatcacacgtatgtgggccactcgacggatacgattatcgaactgtcgtcgcgcatcatcgaatgggcgccgcagggcatgaagaaggtgtactacggcatgtccggttcggatgccaacgaaacgcagatcaagctcgtctggtactacaacaacgtgaaaggccgtccggacaagaagaagatcatttcgcggcagcgcggctatcacggctcggggatcgtcaccggcagtctgaccggcctggcgagttttcatcaatacttcgatctgccgatcgggcgcgtcaagcataccgtgtgtccgcattggtaccggcacgcgcctgccggtatgaacgaggcgcaattcgttgcgtactgcgtcgaggaactggaaaagctgatcgcgcaggaaggcgccgatacgatcgccgccttcatcgccgaaccggtgatgggcaccggcggcatcctgccgccgccggccggttactggccggccatccagcaggtgctgaagaagcacgacatcctgctgatctgcgatgaagtggtgtgcggcttcggccggctcggctcgaagatgggtgcgcagcactatggcatcgcgccggatctgattaccgtggcgaaaggtttgacgagcgcgtacgcgccgctctcgggcgtgatcgtcagcgagggtgtgtgggatgtgatcgacaaggcgtcgcaggaattcggcgcgatgggtcacggctggacttattccggtcacccgatctgcgccgcggcggcgctcgcgaacctcgatattctcgaacgcgagaatctgacgcagaatgcggcgcaaaccggtgcgtatctgctcgagcaacttcacgcggcattcgactcgcatccgctggtcggcgaagtgcgtggcgcgggcatgctggccgcgctcgaattcatggcggacaaagacggccgtcaaccgttcgatgcagcgttgaaggtcggtccgcgcgtctcggctgccgcgttgcagcgcggcttgatcgcgcgcgcgatgccgcatggcgacattctcggcttcgcgccaccgttgatcacgtcgcgcagcgaggtcgacgagatcgtgaagctggcgcgcgaggcggtggacgaagttgcttccgcggta

SEQ ID NO: 28610 - DNA, 1443 bp, Burkholderia fungorum
atgttgctgggtcatccggttctcttcaaatcgttgtgctacgtcgatggacgctgggtgcacagcgcgagcgcggcgagcgtcgccgtgcacaatcccgccgatcagcaggtgcttggccatgtgccgatgctcgacgccgcgcagatcaccgaagccgtcggcgccgcgcagcgcgcgttttccacgtggcgctggctgccggtcagccagcgttcggcgctgctgttgcgctggcacgagttgatcctgcgccatcagcatgatctggccgcgattctgtcgctcgaacagggcaagccgctcgccgaagcgcgcggcgagatcgcctacggcgcgagtttcgtcgaatggttcgcgcacgaggtgcgtcgtttgaacggccggacgattccgacgcatatcgacggcgcgcatctcggcacgatgatcgagccggttggcgtcgcggcgctgatcaccccgtggaattttccttgcgcgatgatcacgcgcaaagcggccgccgcgctcgccgccggttgcacggtggtggtgaagcccgcgcacgaaacgccgttttccgcgctcgcgctcgcgcaactggcggaagaggcgggctttcccgccggcgtgttcaacgtcgtgctcggcgagccgcaaatggcgatggaaagactggtcggcgacagccgggtgcgttcggtgagcttcaccggctccacgcgcgtcggcgcgctggtcatgcaggcggcggcgcgcgccggtatcaagaagacggcgctggaactcggcggcaacgcgccattcatcgtgacgggcgacgccgacctcgaccaggccgtgcgcgtggcggtcgcggcgaagtttcagacctcggggcaggattgttgcgcggcgaatcgcattttcgtcgcgcggccgctgtacgaagcgttcgtcgcccaatacagcgacgccgtcaaggcgctgaaagtcggcgctgcgttcgaagcgaacgtggacgtcggcccgttgatgcatcaagccgcgttcgacagcacggcgcaacgcgtcgcggacgcgaaggccaggggcgcgcgcattaccgccggcggcggcgcgcacgaacgcggcggctggttcttcgagccgaccgtggtcgcggacgccgcgcccggcatgcgcatctacgacgaggaaaatttcgcgccgatctccgcggtgtcgcctttcgattcgctcgatgaggtcgtcgaacgcgcgaacgataccgaatatggcctcgccgcttatgtctgcgcgcgggacctcaacacggtgtttcaactgatccgccgtctggacttcgcgatggtgtcggtgaacggcgcgaagttcactggagcgccgattccattcggcggcatcaaatcgtcgggcctcggccgcgaaggcggggccgagggcttcgagccgtttgtcgaaacccgctatttctgcctc

SEQ ID NO: 28611 - DNA, 753 bp, Burkholderia fungorum
ttatccggcaagcgcggactggtcgtcggcatcgccaacgagcacagcatcgccgccggttgcgcgcgcatgttccgcgccatcggcgccgagatcgccgtcacctatctgaacgacaaagccgagccttatgtgcgcgccgtcgccgaaacgctgccggcgagcctcgtgatgccctgcgacgtgaccgtgccgggccagctcgaagccgtcttcgcgcgcatcagccgggagtggggcaagctcgacttcgtgctccactcgatcgccttcgcacccgccgtcgatttgcacgcgagcctcgtcgattgttccgccgagggtttcgcgctcgcgatggacgtgtcgtgccattcgttcatccgcatgacgagactcgcgttgccgctgatggccgaaggcggcagcctgatgaccgtgagtttctacggtgccgagcgggcggtcgaccactacaatctgatgggtccggtcaaggcggcgctcgaatcgagcgtgcgttatctggcggtggatctcgcgcctcgccgggttcatgttcacgccatttccgccggtgccgtcaaaacccgcgcggcgtccgggctcgatcatttcgatgtgctcctcgacgaagtccgcgcgcgcacgccggccagacaccttgtcacgatcgacgaaatcggccgcatcgcggctgtgctcgccagcgacgccggcatgacgctgaccggctcgaccctgtacgccgacgccggctttcacgtggtggcc

SEQ ID NO: 28612 - DNA, 1461 bp, Burkholderia fungorum
cgcgcaacgcttgcaaaagcacagccgggcgcgcgcgccgaagccgtcggccgggtcgagcacgtcgccgacggcatcgcactcgtttccggcctccccgacgtgcgcctgaacgagttgctgcgcttcgagggcgaccggttcggcttcgcgctgacgctcgacgccgacaccatcggcgcggtattgctggacgacgccgacgcgattaccgccggttcgatcgtcaccggcaccgggcaggtcgtccaggtgcccgtcgggccgggcctgaccggccgcgtcgtcgatccgctcggccgcccgctcgacggtcgcggcgctgtgcatgcggacgcgcggatgccgatcgaaaggcccgctccgagcatcatcgagcgcgatctggtggccgagccgctcgccaccgggatcctgttgatcgatgcgttgttcgcaatcgggcgcgggcagcgcgagctgattatcggcgaccgggcgaccggcaagaccgcgatcgcgatcgatgcgatcgtcaatcagaagaacagcgacgtgatctgcgtctacgtggcgatcggccagcgcgcatcggcggtcgaacgcgtgatcgcagcggtgcgcgagcacggcgcgcccgaacgctgcgtcttcgtgttcgcttcgtcggccgcctccgcggggctccagtggatcgcccccttcagcgcgatgacgattgccgagtacttccgcgaccgtggccagcacgcgctcgtcgtgatcgacgatctgacgaggcatgcggccactcatcgcgaactggcgttgctcacccgcgagccgccgggacgcgaggcttatcccggcgatatcttctatctgcatgcgcgccttcttgaacgcgcggcgaagctctcgccggagcgcggcggcggttcgttgacggcgttgccgatcgcggaaaccgatgcgggcaacctgtccgcgtatatcccgaccaacctgatttcgattaccgatgggcagatcgtgctggataccggcctgttcgccgccaaccagcggcccgcaatcgatgttggcttgagcgtgagccgcgtcggcggcaaggcgcagatgccggcgttgcgaaacgtgtcggggcgcttgcgtctggactattctcagtttctggaactggagatgttctcgcgcttcggtggcctgaccgaggcccgtgtgaaggcgcaggtcgtgcgcggcgaacgtatccgcgcgctgattacccaaccgcgcttcacgccgctgcgtcccgtcgacgaggtcgcgcttcttggcgcgctggccgaaggcgtattcgacgcgctcccggtcgacctcctcccggcgatacgaacgcgcgttgcagcgcatctcgatgcgcatggtggaaatgccggcgccgtgctcgaagacaccggcaccctcgacgctacggcgcaagcactgctcgtggcggccgtccggaccctcgcccaggat

SEQ ID NO: 28613 - DNA, 816 bp, Burkholderia fungorum
gaagttcagggccggatttcgagtgtccatgaactcgaatcggtagtgagcgcaatgcgcggcatcgctgctgcccgttcgcgcgaagcgcaaagccgcatcgaagccattcgcgcgtgcgcccgcacggtcggcaacgccatcggcgacgcgctgatgttcgaacagcatgacgaaccgcaagcgccgccaggacatgccgccggtaacgaggtcgtcattgttctgtgcgctgagcagggtttcgtcggcaccttcaacgaacacgttatcgaagccacggcgcgccgcgttgcatcgcgttcgaccgaattcttcctgatcggtgcgcgcggcatcgcagtcgccgccgaacatggtctgacgatcggctggtccgcgccgatggtcgcacacgccgatgaagtgcccgcgctggccgaccgcatcactgcggcgctgtacgagcggttgaacgcgggacaggcgacgcgcgtgacactgctgcatgcggtaccgaatccgtcggtgacgatcgaggtggtcaaaaccgctttgtggccattcgatttcacccgcttcaaacaggcgcttcgggccaatccgccgctcatcacactgacgccggaaatactgctggcaaagctcgccgaagagtacatcttcgcgcagctttgcgaggcgatcatgctgtcgttcgccgcggagaacgaggcccgcatgcgcgcgatggtcgccgcacgtaccaacgttcacgacaccctcgacgaattgatcggagagtcccgccgcctgcgacaggacgaaatcacgtcggagatcgtcgaattgtcgtcg

SEQ ID NO: 28614 - DNA, 1137 bp, Burkholderia fungorum
agccggccggcgttgccggctttcgtcacatcgcgcgtcgagcggtattaccgtgagcgtgtgcaggaaacatggggcggggggcatatcatgcgcggccgtatcgcggggcccgatgcgctgcacctgtcgagcaacgactatctcgcgatcgcccggcacccggacattatcggcagcatggccgcgacgctgcttgagaacggcaacgggttgttgatgtcgggcattttcctgcacggcgattgccctcaactccagttcgaaaaccggcttgcgacgttcatgcaggcggaggcgggcgtgctgtgccagtcgggctacgcggccaataccgggctgatccagtccatcgcgtcggagcagacgccggtctatatcgacatgatggcgcacatgtcgttgtgggaaggcgttcgcagtgcgggcgcggtgccggtcgcgttccggcataacgacgccgcgcatctcgagcagcagatcggacgctatgggcaaggcatcgtgctggtggactcggtgtacagcacgactggcagcgtatgccggctcgtctcgctcgcggacgtatgcgaacggcacgcgtgcgtgttcgtcgtcgacgagtcgcattcgctcggcacgcacggtccgcgtggcgcagggctcgtcgtcgaactcggactgcagtcccgtgtcgcgtttcgcaccgccagtctcgcgaaggcgtttgccggcagagctggtttcattagctgtccggtcgatttccaggagtacttcaagttcgaatcgaatccggccattttcagttccacgctattgccgcatgaaatcagcgggctcgatgcgacactgtcggtgatcgaatgcgccgaccggcggcgcacgagactcgcgtcgagcgccgcatggctgaggcagcggttgacggaactcggatacaacctgaacggcagcaggagtcagatcatcgccctcgaagccggtacggagcagcgcacgatcgtgttgcgcgacgcattggagtcgcgcggcattttcggctcggtgttctgtgcgcccgcgacggcacgaaatcgggcgctgatccgcctgtcgatccacgcggcgctgagcgacgcccaggtcgaaaagattgccagcgtctgccgtgac

SEQ ID NO: 28615 - DNA, 735 bp, Burkholderia fungorum
ttgattctgataacgggcggaggccgtggcataggcgcggcgactgcgcggcttgctgccgcacaaggttacgatgtagcgataagcttcgtctccaacgagtctgccgcccttgcggtggcggccgatgtggaggctgtcgggcgccgggctttacccatgcgcgcggacagcgccgatccggagcaggtcgctcagctattcgccgcgctcgaccggcagttcggccggctcgatgtgctggtgaataacgccgcgatcattgcacagcagtcccggctggaggatctcggattcgagcggctgcagcgtattttcgcggtcaactcgatcggccctatcctctgtgcgcagcaggcggtgaagcggatgtcgcgtcgtcacaatggtcgcgggggcgccgtgatcaacatctcatcggcatcggcccagctcggcagtccaaacgaatatgtcgactatgctgcctcgaagggtgctcttgagacattcactaccggttttgccaaagaagtcgcgcgggatgggatacgcgtcaactgcattcgcgccgggcacatctacaccgacatgcatgccagtggcggcgagccgggacgggtggatcgcgtcaaagactcgatccccatgggaagaggcggccaacctgaagaggtcgcgcgggcgatcctgtggctagcgggcgccgaggcgtccttcatcaccggcacgttcctcgatgtcactggcggcaag

SEQ ID NO: 28616 - DNA, 2051 bp, Burkholderia fungorum
ctgcttgccattgcattcggcttgcccgccgcgtatgccgcggacgaagttcagaacagttcgaccaccacgagctcgccggtgccgtcgacgctgcaacccgtgagccaggaacagctcgaccgggcagccaccacgtcgaacgactggctgctttcgaacggttcgtacgcgcagacgcgctactaccgcggtgcacaaatcaacaaaacgaacgtgtcgaaactcaggccggctttcatcttccagacagccgtcaacgagtcgatggaaacggcgccgatcgtatcgaacggcgtgatgttcattaccacctcgtttaatcacgtgtatgcggtcgatgcggtgacgggcaaggaattctggcactacaagcacaagatgggcgcggtcactacgttttgttgcgggcccaacaatcgcggcgtggccatagccggcgaccgtctctacatgggcaccctcgacgcgaagctcgtcgcgctcgacgcaaaaaccggcagcgtgttgtggcaaacgcagatcgccgatcccgatgaaggctattcggaaacgatggcgccgaccgtggtcgacggcaaggtgttgatcggcacgaacggcggcgaatatggcattcgcggtttcctcaaggcgttcgacgcaaactccggtcaattgctgtggaccttctatacgattccggaaaccggccaggaaggtgtgtgggccacgaaggacgctaccggccgcgacgggaagcgcgacatcgacgccgagaaaaagcagcttgccgagaaaggcggcgacttctacaagacgctcggcggcggcgtgtggatggcgcccgcaatcgatcggcagacgcatacggtgttcttcgtcgtcggcaatccctcgcctgacctgtatggcgcaatccggccgggagacaacctctatacggattcgctcgtcgcgatcgatctggacaccggcaaatacaaatggcactaccagtatgtgccgcacgacgtgtgggacctggacgccgtgagcccgccgatgctgatcgacgtacgcgacaacaacggcaggatgattccgggcgtggtgcacggcggcaagaccggtcacgtgtacgttcacgatcgcgcgactggacggctgatccgctattcgcaggcgatgattccgcaggagaacatgtggacgttgccgaccgccgccggcgcgcggatgctgcctggcgcgaacggcggagtcgagtggtcgcctatggcattcgatccgcacacgcgtctcgtgtatgcggccaatctgcatcagccgatgacgtatcaggtcgaggacgccgcctatccgggcggcagcaagctgtggctgggcggcgcgttcaagacgatcgcgtccgaacagcaatggggcaagctgtccgccgtgaacgtcgatacgggtaaggtcgcgtgggactacaaaaccgagcagccgctcatcggcggcgtgctgacgacggcgggcggcctcgtattcaacggcgaaggcaacggcctgttccgcgcattcgattccgccacgggcaagaaactctgggagttccagtgcggcgccggcgtcaatgcgcccgcggtgtcatacatggtgcacggcaagcagtacatcgcggtcgcggcgggcggcaatacgcagctcgacttcaagcgcggcaacaccgtgctcgtctttgcgttgccatgacgatgccgatgctgcggggaacgccggggcgggcgcgccgctcatggacggcagtgctgtgcggctggttcgccgccgcatggctgccgttgaacgcgcacgccgacgccgaggccggcaaggcgaaagcgcaggtgtgcgtggcctgtcacgggccgatgggcaattcgacgaacccggactatccgatccttgccggtcaaaccgcgcgctatatttatctggagctcaaggacttcaaggaagggcggcgcagcgacccgcgcatgtcgccgatggccgccaacctctcgcgtgaggacatgcaggatctggccgattactttgccgcgcaaaaggcggcgtccgttccgttc

SEQ ID NO: 28617 - DNA, 1803 bp, Burkholderia fungorum
atgaacttacgcaccacggttcttgggctcgcgatcctcgcgtcggcagccttgagttcgttcgttgcacaggccgattcgcagctcgacgggctcatgaagaatccgtccaactgggccgcgcaggcgggcgactatgccaaccatcgctacagccctctcaagcagatcaacgaaaacaacgtcgggaaactacaggtcgcgtggaccatgtcgaccggcgtgctgcgcggccacgaaggcgcgccgctcgtgatcggcgacaccatgtatatccactcgccatttcctaacaaggtaatcgctatcaacctgaaggatcagacgttcatctggcagtacctgccgaaacaggacgatcaggtggtgtccgtgatgtgctgcgataccgtcaaccgcgggctcgcgtatggcgacggcaagatcttcctgcagcaggccgacaccaaactcgtcgcgttgaacgccaaaaccggcgacgtggtctggaccgcgcaaaacggtaatcccaaggcaggtgaaaccaacaccaacgcgccgcacgtattcggcgacaaggtgcttaccggcatttccggcggcgagttcggcgtacgcgggcgtctcatcgcgtacgacatcaagaccgggaaaccggcctggacggcctacagcacgggcccggacaaggacatgctgatcgatcccgacaagacgacgacgtatgccgacggcaagatggtgccggtgggcgcggactcgtcgctgaagtcgtggaagggggaccagtggaaactgggcggcggcaccacctggggctggtacgcgtgggatccgaaactcaaccttgtctactacggcaccggcaatccgggtacatggaatccgacgcagcgtccgggcgacaacaaatggtcgatgtccatctttgcgcgcgatctgaataccggtcaagccagatgggtctaccagatgacgccgcacgacgagtgggactatgacggcgtcaacgaaatgatcctgtcggacctgtcgatcgacggcaaaaaggttccggctatcgttcacttcgaccgtaacggtttcggctacacgttgaatcgcgagaccggccagttgctggttgcgcagaagttcgacccggcggtgaactgggccgatcacgtcgacatgaagagcggcaagccgattcgcaacgccgcctattcgacgcaggcagccggttcggaccacaacgtgaagggcatctgtccggcggcgctcggctcgaaggaccagcagcccgcggcgtacgaccccggttccagcctcttcctcgtgccgaccaaccacgtttgcatggactacgaaccgttcgatgtcgactacgtgtcgggccagccgtatgtgggcgccacgctgtctatgtatccgggcccgaacgacaacaactcgatgggtaacttcattgcctgggatgcttcgaagggcaagatcgtctggtccaagccggagcggttctcggtatggtcgggcgtgctggccaccgcaggcggcgtggctttctacggcacgctggaaggctacatcaaggcagtccgcatcaaggacggcaaggaactgtggcgcttcaagacgccgtcgggaatcatcggcaacgtctttacctacgagtatcagggcaagcagttcatcggcgtctactcgggtattggcggctgggccggtatcggcatggcggcgggtctcgagaagtcgacggaaggcctgggcgcggtgggcggttatcgcgagctcgcgaagtacacggcattgggcggcacgctcttcgtgttcgccattccc

SEQ ID NO: 28618 - DNA, 1032 bp, Burkholderia fungorum
atggccttcatagcactgcggcaactattggaccacgcggccgagcacggctacggcgtgcccgccttcaacgtcaacaacatggagcagatccacgcgatcatgcaggccgccgaggcgacgtcgagcccggtgatcttgcaggcgtcggcgggcgctcgcaagtatgcgggcgagccgtatctgcgccatctggtgctcgcggcgctcgaagcgcatccggatatcccgctcgtgctgcaccaggatcacggcgcgagcccggcggtgtgtcagcaggcgatccgctcgggcttcacgtcggtgatgatggatggctccttgctgcccgaccagaagacgcccgccgcgtacgagtacaacgtcgatgtgagtcggcgggttgtcgaggcggcgcacgcagtgggcgtttccgtggaaggtgaactgggttgtctcggctcgctcgaaaccggcacggcgggtgacgaggacggcgtcggcgccgaaggccaactctcgcgcgacgatctgctcaccgatccgcgcgaggcgcagattttcgtggaggcgaccggcgtcgacgcgttggcgattgcgatcggcacgtcgcatggcgcgtacaaattcagccgtcagccgaccggcgatattctggccatcgaccggatcgtcgaaattcacgagcggattccgaatacgcatctcgtgatgcacggttcgtcttcggtgccgcaggagtggctcgcggtgatccgcgaatacggcggcgagattcccaccacctacggcgtacccgtcgaggaaatccagcgcggcattgcgcatggcgtgcgcaaggtcaatatcgacaccgacatccggctcgcaatgagcggcgcgatgcgcaagtcgatggcgaatgcgcgcgccgagttcgacccgcgcgcggcattgaaggcggcgacggcggcggccagcgcgatttgcgtcgaacggttcgaagcgttcggctgtgcgggccaggcctcgcgcatcaagccgctgccgctcgatgcgatggcgcgccggtat

SEQ ID NO: 28619 - DNA, 1980 bp, Burkholderia fungorum
atggccgacgcgctgcgcatgctcgcgatcgacgcggtcgaagccgcgaagtccggtcatccgggcatgccgctcggcatggccgagattgccgtcgcgctgtgggaccggcatctgaagcacaacccgcgcaatcccgcgtggcccgatcgcgaccgcttcgtgctgtcgaacgggcacggtgcgatgctgttgtatggcctgctgcatctcaccggctacgatctgccgatcgacgaactcaggcgcttcaggcaactgtacagcaggacgccggggcatccggaggtgggcgtgacccctggcgtggaaacgaccaccgggccgctcgggcaggggctcgccaatgctgtcggcatggcgctcgccgaggcgctgctcgcgcgcgaattcaaccggcccggccattcgatcgtcgatcaccgcacgtatgtgttcgtcggcgacggttgcatgatggaaggcatttcgcacgaggcggcttcgctcgccggcacgttgaagctcgacaagctcacggtgctgtatgacgacaacggcatctcgatcgacggccacgtctcgcagtggttcagcgacgacacgcccgcgcgttttgcggcctacggctggcatgtggtacgcgaggtggacggacatgacgtggacgcggtcgatcgggctctctcgcgcgcacgcgcagccggccggccgacgctgatctgctgccgcacggtgatcggcaaaggctcgccctcgaaagcgggcacgcacgacgtgcacggcgcgccgctcggggccgacgaagttgcgaacacgcggcgcgcgctcggctggccgcatgcgccgttcgctatgcctgccgaggttcgcacgctgtgggacgcgagcgagcgtggcgcggccacagaagccgactggaacacgcgtttcgaagcgtatcgcaagcactatccgcatgaagccgccgagttcgagcgaaggacgcaacgcacgctgcccgtgcagtggcgcgacacggtccgcgcgatggtgagcgacgcggaccacgcgggcgaatcgatcgcgacccgcaaggcctcgcaacaggcgattgccgtgctggctcgcgcattgccggaattgctgggcggttcggccgacctgaccggctcgaacctcaccaactggaaaaccgcggtcgatgttcatgccgacgacagcggcctgcaaggcggcaactatctgcacttcggcgtgcgcgaattcggcatgagcgcggtgatgaacggtattgcgctgcatcgcggacatattccgttcggcggcacctttctcacgttctccgactactcacgcagcgcgctgcgcatggccgcgctgatgaagacccgtgcgattttcgtgttcacgcacgactcgatcggcctcggcgaagacgggccgacacatcagtccgtggagcacgcggcgagcttgcggctcattcccgggctcgacgtctggcgtccgtgcgacacggtcgagaccgcgcaggcgtgggcgagcgcggtggaacgcgatgggccgtcgtgcctgctgctgagccgccagaatctgccgttcgccgcgcgcagcgctgaacagatcgacgcgatcgagcgcggcggctatgtgttgcgtgactggcctgcggaacgggcgcaaacgcggatcgtgctgatcgccaccggttcggaagtctcgctcgcgctcgatgccgtcgcgccgctcgcgcaagccggcatcgccgcgcgggtcgtgtcgatgccgtccaccagcgtattcgaccggcagcccgccgcatggcgcgacgcggtgctgccgccgcgggtgccgcgcgtcgcggtggaagcgggcgtgcgcgcgttctggcggcaatacgtgggcctcgaaggcggcgtggtgggcattgatacgttcggcgaatccgcccccgccgcggcgctgttcgagcatttcggtctgaccgcgcgcgcggtggtggacgaagcccgccgtgtc

SEQ ID NO: 28620 - DNA, 1038 bp, Burkholderia fungorum
accctttcgaaatttctgatcgacaccctcgaccgccagccctgttcgacggaaacggcgcgcaacgccggcctttcggcgctgctgatcgacgtcgccgccgctatcaagtcgatctccgcgatgctcaccaaaggcgcgctcggcggcaactacggctccgcgcagagcatcaacacgcacggcgaggaacagaagaagctcgacgtcgcgaccaatgaaatcttcgtgcagcaatgcgagtgggacggactgctcgccgcgatggtgtccgaggaaatggagagcgtctatgcgattccgccgggctatccgcgcggcgattatctgctcgctttcgatccgctcgacggttcgtcgaatatcgacatcaacggcgtggtggggtcgatcttttcggtgctgcgcaatggcgagggaaatggaaatgccaatgaaaaaaacggcagcgatccgcgcggcacggtcggcgagtccgcgtttctgcggccgggctgcgagcaggtggccgcgggctacgccgtctacgggccatcgaccatgctcgtgctctcggtcggcaacggcacgcatggtttcacgctggagcgcgagatcggcaacttcgtgctcacgcattcgaacatccgcattcccgaagacaccgtcgagttcgcgatcaacgcctcgaacgaacggttctgggaaccgccggtgcgccgctatgtgcaggaatgcaaggacgggcgcagcggctgccgtgcgagcgacttcaatatgcgctggatcgcgtcgatggtcgccgaggtgcatcgcatcctgatgcgcggcggcgtgttcatgtacccgcgcgactcgaagacgcctgcgatggaagggcgcctgcggctcctgtatgaagccaacccgatgagctttctcgtcgaacaggcgggcggtctttcgatcaccgggcgcgagcggattctcgacgtcgtgccgcgcgcgctgcatggacgcgtgccggtgatcctcggttcgaagcacgaggtggagcgtattggccgctatcacggcgaa

SEQ ID NO: 28621 - DNA, 1167 bp, Burkholderia fungorum
atgagagcactacgttggcatggcaaacacgacatccgctgcgatacggtccccgacccgatcatcgaagaaggacgcgacgcgatcatcaaggtctcgacgtgcgccatttgcggctcggaccttcatctcttcgacggctttatgccgaccatggaaagtggcgacatcatgggccacgaattcatgggcgaagtggtcgaagtcggcaaggacaacaaggcgttgagcgtcggcgatcgggtcgtcattccgttcacgattttttgcggcgaatgtgatcagtgcaagcgcggtaatttttccgtttgcgagcgcagtaaccgcaacaaggaaaaagcagacaaggtctttggccatgcaacggccggactattcgggtactcccatctgaccggcggatatgcaggcggacaggcggaatacgtgcgtgtgccgatggcggacaccacgcacgtcaagattcccgacggactaaccgacgaacaggttctttttcttggcgacatttttccgaccggctggcaggcggcggtgaactgcgacatccagcccgaggacacggtcgccatatggggtgcggggccggtcggccagatggcgatccgtagcgccgtgctattgggagcccggcaggtggtggtcatcgaccgtgtaccggagcggctcgtcatggccagggccggcggtgcgatcaccatcaacttcgacgaggagagtgtgctcgaccgtctgaaggagttgacgaacggcaagggcccggaaaaatgcattgacgcagtcggcatggagtctcacgccacccgctcgttcgatgcgatgtacgaccgtgtcaagcaggccgtgatgctggagaccgaccggccgcacgtgctgcgggaaatgatctacgtgtgtcgcccggcgggcatattgtccgtgccgggagtgtatggcgggctcatcgacaagatcccgttcggtgcctccatgaataaaggcctcacctggaagatgggacaaacccacgtcaaccgctggacagacgatctgctgcatcgcattcaggaaggacagatcgatccgtcctttgtgattacgcacacggtttcgctcgaacaaggacccgatatgtataagacgtttcgtgacaaggaagacggctgtatcaaagtcgtcatgaagcca

SEQ ID NO: 28622 - DNA, 1392 bp, Burkholderia fungorum
caactgctgattgacgggaagtgggtggacggagaatcagcccagtcacttactgacaagtatcacggcaacgaatatggccggatggccgtggcctccgccgcgcaagtcacccaggctgtcgacggcgcgctggccggcttcagggcgtccaccctgtcgccttacgagcgcttcaggattctgatggaagcggcccggatcgtcgaaagccgcatgccgatgctgatcgacctgatgcgcgatgaggcgggtttcacgcacgccgacggcgagaacgaagtgcgccgctgtgtgcagacattcgaactgtcggcggaagaaggcaagcatctggcaggcgaactggtcccgatggaagccgccgcgggagtcaggaaccggatgggcttcacgattcgtgtgccgcgcggcgtggtctgcgcgatcacgccgttcaactcgccgctcaacacgctcgcacacaaagtggggccggccattgcgggcggcaacgcggtggtgatcaagccgtcgaacgtaacaccgctgtcggccgtcgagttgtgcaaggttctgatcgacgcgggactgcccgcgaatctgctggcgctggtgcatggttcgggcagcgcgatcggccgccagttgctggccgatccgcgcatcgcgttctatgcgttcaccggcagcacgcaggtgggccgcgaaatccagcaggccgcgggcttgcgcggaatgcagctcgaactgggcagcattgccagcaccatcgtttgcgaggacgccgacatcgacctcgcgattcccaagatcgtcaacgcgggttttcgcaaagcagggcaagtctgcacgtcggtgcagcgcctgttcgtcgcccgcggcattgccgacgaattcattcccaggttcgtggcggcggtcaaggcgactccctatggcgacccggccgatccgaaaaccattctgggcccgatgatttccgtccagcatgcgcagcgggcggcggcgtgggtcagggaagcgcttgacggcggggcgcggctgctcaccggaggcaagtgcgaaggcgcgttgttcgagccgaccgtgcttcacggggtcgacgcgacaatgaaggtagtttgccaggaagtcttcgcgcccgtggtgtcgatcattgaattcgacgatatcggcgaagcggtggcgggcgccaacgccagcgatttcggccttgcagcagggctctttacgtcggatctgaagacggcgttccgtacggcgcgcgagctcgcgttcggcggggtgcacatcaacgaggcttcgagcgcgcgcatcgacgtgatgccgttcggcggcgtcaaggacagcgggttcggccgcgaaggcccggcttacgccatccgcgaaatgaccgaagaacgcctgatc

SEQ ID NO: 28623 - DNA, 1359 bp, Burkholderia fungorum
tatccgacttttcatgcgtcttgcgacgcgatcgcgcgcggcttcgttgcgcgtggatacgggaaaggtacgcgcatcggcatcttctgctcgaatcgcctcgaatttctcgaggtgttctatggagcgatgcgcgccggcgtcattccggtaccgatgggaatcctgctgccgaaggatacgatcgaatggattatccgcgacgccgaattgaagcttgttttctgcgactcggaactgcgcgcgaaactgccttccaataccccgcacatcgtcgtcgagagcgaggagtacgaggcgttcaaggtacccggtccgttcgaagccattgtgccgaccggcgacgacgtggcgttccagccctacacgtccggatcgacgggccggccgaaaggcgtcgtgctgtctcaccgtgcgcacgtctgggttgccgaaacgatctcgaaggatcggggcttctgccggaccgaccgcatgatcgttgccgcaccgctttatcacaagcatgcgatgaacgcgatcaagtcggtgttcgtcggcggctcgacggtcgtattgatgaagaaattcgaaccgcgcgcgtatctcgatgcggtgagccgttaccgtgtttccgtgctctccggcgttcccaccatcttcgcaatgatcctgcagcagcgcgacctgatcgagggtaaagatttttccttcgtgcggctcgccactatgggcggtgcgccggcctcggatgaactgatcgatgccgtagcgaagatcctcccgaatgccgacatcatctcgatcttcggcattacggaaaccagcgccgcgctgttcggatcgcatcccgggaatctgacgagaccccggcattcggtcggttggccgattgccggtaacgagttcaagctgatcggcggtccggacgagaatttcggtgtattgcatgtgcgtggcccgggcatgatgaacggttaccacaacaatcccgtggagatggagcggcggctcaaggatggctggttcaataccggtgatgtgctacgcaaggacgccgacggctggtattactttatcggtcgctcggacgacatgttcgtgtgcagcggcaacaacatttatcctggcgaagtcgagttgatgctggagcggcatccagatatcgagcaggcggttatcgttccggtgcccgatgaaatcaggcatcagattccttacgcctatgtggttcggcgcaagggctcggcgctgtccgagaaagacgtgaaggaacacgcattgaccaatgcgccgccttatcaatacccgcgtaaggtcattttcgtcgaccagttgctgctcaacggcgtgggcaagatcgaccgcaaggcgctccag

SEQ ID NO: 28624 - DNA, 1512 bp, Burkholderia fungorum
ctgcccgagtcgctcggacagttcgtgcgcgagcaggccgcgcttcacggcgaacggatcgccgcggtatggttcgaccgcggtatcagcatgacgtatgcgcagatcgacagcatggcttcgcagctggcggattcactcgtcaaacgcggcatccgcaagggttgtcatgtcgcgctgatgttgaagaacgcgcccgaattcgtgatcacgtggatcgcgcttggacggatcggcgccgtgatggtgccggtcaacacgtcctatacgcaggacgagctggtgttcgtgctgaccgacgccgacgcgcaatatctcgtgatcgacgccgaattcctgcctcgtcttgccgccgcgccggcactgcccgggctactcgcgtgggagcgcgtgatcgtctgcggcgagagcgagcatccgttgcgatgggcggcgctgctcgaggccggcagtgccgatttcaccgcgccgagcgcggtgtcgcgccacgatctgctcaacctgcaatacacctcgggcacgacgggttttccgaaaggctgcatgcttagccacgactactggatgattcattgtcacggcgcggcgcggcatcggcgcggccctgaggcgggtatcgaaaacgtgctgatctgggcgccgttcttttatatggacccgatgtggcagttcctcatgacaatgaaactcggcggcaccgcgtacattgcggagcgtatgagcctgacgcgtttcatgtcgtggctgatcgactatcgcattcactactgcatctttcccgagcctgcgttgagccagcatccgcgcggcccgcgtgacgcggaggtgcatctgaagtacatcagcatctacggctggacgaggtcggcgcgggaagaagtgcaggcacgcttcggtgtgatcgcgcgcgagggttttggcatgaccgaagtggggacgggcgcactggtgcccgcctgggcccacgacaaggcgctcgagcgtacctgcggcttgcccgcgccgtttcgcgaactgcagatcaggcgtgaggacggcagcgtggccgaagtcgatgaagtcggcgaactctggattcgcgggcgcggcatcctgtggggttattacaaacgccccgaggcgaacgcggaaagtttcgacggcgactggttccgtaccggcgatctattccggcgcgatgcgcaaggcttttatttcatcgtgggccgcatcaaggagatgatcaagcgcgcgggagagaacgtctcggctaccgaagtggagaccgtgctgcgcggcatggatgcgatcgacgaggccgcagtggtggccgtgcccgatccgctgcgccgcgaggaagtgaaggcctatctgaaactgcgcgaaggactcacgcaaggggacgtgccgcccgcggccgtgttcgagcattgcgcgcgccatctcgcgccgttcaaggtgccgcgctatctgcagtacatagagggcgattttccgcgtacgccttcgcgcaagatcgccaagaagcggttg

SEQ ID NO: 28625 - DNA, 1551 bp, Burkholderia fungorum
tacgacgcagtgatcatcggggcgggacataacgggctcgtgtgcggcgcctatcttgcgcgcaaaggcttcaaggtctgcctgctggagcggcgtgagctcgcgggcggcgcggccgtgagcgaagcggtctggccgggctatcgcgtgtcgacggcgtcttacacgatggcgctactgcagccgcgcatcatcgacgaactggaactggcgaaatacggctatgagatcgtggtgccgccgccgatgctgcatctctacggcgacggtcgcagcctcctgttccgcccggagggcgagcgtctgagcgcggacatcgcgcgcttcagcgaggcggatgcggatgcctacggcaagtaccgggcgcacatggcgcgcctcggcaagatggtcgccgggatgctgtgggaaacgccgcccgatcccgccgacagcacgctcagtgcgcgcagccgcctgttgggtttcgcctggcgcttccgcgacatgggcgagcagttctacgacctttacgacgtgctcacgttgagcgcacgcgactatcttgcgcgctggttcgagtcggacgaaatgatcgccgcgctgggtttctacgcgtcgtgcggcggtgcggcaacgagcatctgctcgcccggctcggcgtatgtgctgttgcgcggcttcattcgcgaccacaccacgagcgcggggccggccggtttcgtacgcggcggcatgggctcgatctcggaggcgatcgccgcatcgggcaaggcgtacggcatggaagtgcgctgcaacgcgccggtcgcctcggtcgagatcagcggcgagcgcgcgacgggcgtgcgtctctcgtcgggcgaattgatcgaagcgggctgcgtgatctccaacgtcgccaccaaggtgttgttccagcaactggtgggcgcgcagaacgtgccgccggaatttcttgcccgcgtgcggcagattcgcgaccgctcgaccgccttcaaggtcaatctcgcgctccggcgtctgcccacgttcaaggacttcgacgcgcggtcggcaggcttcgcctatccggcgcaagtgcgcctcgcgccttcggtggagtatctcgaacgcgcgtgggacgccgccaaatacggcgagatctcgccgcggccgccgctcgtcgtgctgactcccagcgcggtggacccaggcgtcgcgcccaaaggcaagcacctgatgagcatcttcggccaacacgcgccctatgcgctgcgcgacggcccgtgggacgacgcgcagcgcgagcggctctaccagatcacgctcgacacgctggcggcctacgcgcccgacatacgcgagtgcatcgacgatgcgcaggtgttgtcgcccgccgatctcgaacgcattttcgcgctgccgggcggccacgtgcatcacggcgaactgagcgcggaccagattttcttccggcgcccggtgcaaggtgccgcggactattgcacgccggtcaaggggctctaccagtgtggtgcatcggtccatcccggcggcggcgtcacgggggtgccgggttacaacgcggcg

SEQ ID NO: 28626 - DNA, 1461 bp, Burkholderia fungorum
tggcgcgcccgcgcgcaggagatccggcccgaaggccgcgcgttcatcgacggaaactacgtgggcgcgctgtcgggccgcacctttgccaccgtcaacccggccacggggcaggtgatcgcgcaagtcgcggagtgcggcgaggaagacgtgaacctggcggtcgcaagcgcgcgcaaggcgttcgaatccggtgtctggtcgcgccgtgcgcccgccgaacgcaaggccgtgatgctgcgcttcgcgcaactcatgatggaacaccgcgaggagttggcgctgctcgaatcgctcgatgtcggcaagcctgtcgctaacgcctataacggcgacatcgtcagctcggccacctgcattcaatggtacggcgaggcgatcgacaagctgtacggcgagaccgcgcccgccgcccccgacatgaccacgatgatcgtgcgcgagccgctcggcgtggtcgccgccgtggtgccgtggaactatccgctttcaatggcgagctggaagctcggtcccgcgctcgctgcgggcaattcggtcgtgctcaagccggcggaacagtcgccgctgagtgcgatccgcattgccgcgctcgcaatggaggcggggctgccggccggcgtgctgaacgtgctgcccggctacggcgaaacggcgggtcgcgcgctcggcctgcatatggacgtggacgcggtcggattcaccggttcgacggcggtcggcaagctcttcatgcagtactcgggccaatcgaacatcaagcgcgtggggctcgaatgcggcggcaagagcccgcatatcgtgctcgacgattgcgccgatctcgacgcggccgcgcgcgccgttgcggcgggcatcttcggcaatagcggccaggtatgcaatgccggctcgcgcctgatcgtgcaggcggccgtgcgcgacgaactgctggaaaaggtcgcggccatcgcgcgtgaactcgtgcccggcgatccgctcgatcccgccacgaagatgggcgcgatcgtgagcgacgtgcagcacgcctcgatcatgtcgtacatcgacgcgggccgtgccgacggcgcgcgggttgtcgcgggcggtcgcgcggcgcggcccgaatcgggtggctacttcatcgagccgacggtcttcgacggcgtgaacaacgacatgcgcatcgcgcgcgaagagattttcggacctgtcctttcggccatcacggtcgactcgccggaagaagcggtgcgggtcgccaacgacaccatctacggtctcgccgccgcggtgtggacctcgaacgttacgcgcgcgcagcaggtgtcgcggcaattgaaggcgggcgtcgtgtgggtcaattgtttcgaccgcggcacgatgtcctcgccgttcggcggtttcaagcaatccggcttcggccgcgacaagtcgatgcatgccttcgacaaatacatggactggaaggcgatctggatc

SEQ ID NO: 28627 - DNA, 3057 bp, Burkholderia fungorum
catatgtcccggcgacaatttctgaaggtctccgccaccacgctagccggatcgagtctcgccctcatgggcttctcaccgacgcccgcgttagcggaagtccgtcagtacaagttgtcgcgcacaaccgaaacccgcaatacctgcccgtactgttcggtaggctgcggcatcctgatgtatggacttggcgacaacgccaagaacgcgaagtccagcatcatccacatcgaaggcgatcccgaccatccggtcaatcgcggcacgctgtgcccgaagggcgcgagcctgatcgacttcattcatagcccgagccgtctgaagtatccggagtaccgcgcggccggctcgaatgaatggaagcgcatttcgtgggaagacgcgctcgatcgcatcgcgaaattgatgaaggaggaccgcgacgccaacttcgtcgagacaacggaagacggcaagaaggtcaaccgctggctgaccaccggcatgctcgcggcatcggccggcagcaatgaagtcggttatttgacgcacaaggctgtccgcagtcttggcatgctcgcattcgacaatcaggcacgtgtctgacatggcccgacggtggcaggtcttgccccgacgtttggccgtggagcgatgacgaaccattgggtcgacatcaagaacgcggatgtgattctcgtaatgggcggcaatgcggccgaggcacacccatgcggtttcaagtgggtcactgaagccaaagcgcatcgcaaggcaagattgatcgtggtcgatccgcgctttacgcgtacggcatcggttgcggattattacgcgcagattcggaccggctcggacatcgtgttcctgggcggggtgatcaactatttgctcaccaacgacaagatccagcacgagtatgtaaaaaactacacggacatgccgttcatcgttcgtgaggatttctcgtttaccgacggtctgtattccggctacaacgccgacaagcgcaagtacgaccagagttcgtgggactacgaacgcggggacgacggctttgccaaagtcgatcctacgttgcagcacccgcgctgcgtctatcagctgatgaagcagcactactcgcgctatacgcccgagcaggtcgagaaagcgtgcggcacgccgaaggaaaaattcctcaaggtgtgcgagatgctggcatccacggcggtcccggggcgcgccggcacggtcctgtacgcgctcggctggacccatcattcgatcggcgcgcagatcatccgcaccggcgcgatggtgcaattgctgctgggcaatatcggcattgcgggcggcggcatgaatgcgctgcgcggtcactccaacattcaggggttgaccgacctcggcctgatgtcgaacctgttgccgggttacatgacgctgccgctggaagccgagcaggacttcgacgccttcatcaagaagcgcgcgagccagccgctgcggccgaatcagttgagctactggcgcaactatcgggcgttccatgtcagcttcatgaagtcgtggtggggcgataacgcgaccgccgagaacaacttcggttttgactatctgccgaagctcgacaagtcgtacgacatgctgcaggtcttcgagctgatgaatcaaggcaagatgaccggctacatcgcgcagggcttcaatccgctcgccgcggcgccgaacaaggcgaagatcggcgcgggtctggccaagctgaagtggctcgtcgtcatggatccgctcgccactgaaacgtccgagttctggaagaatttcggcgagttcaacgacgtcgatccggcttcgatccagaccgaggtgttccgtttgccgaccacctgtttcgcggaagagcgcggttcgctggtcagctccagccgcgtgctgcagtggcactggcagggcgcggacggccccggagaatcgaggagcgatctggagatcatgtcggggctgtggctgcgcattcgcgaggcttacaggaagaacggcggcaagtatcccgatccgattctgaacatgagttggccgtacgccaatccggagagccccacgcccgaagaaatcgcgatggagttcaacggcaaggcgctcgccgacgtcaccgacgcaaccgacaaaaccaaggtgctcgcgaagaagggcgagcaactggcgagcttcgcccagttgcgcgacgacggcagcaccgcgagcggttgctggattttctgtggctcgtggacccaggcgggcaaccagatgggccgccgcgacaactccgacccgaccggcatcggcaatacgctgaactgggcatgggcgtggccagcgaaccggcgcattctgtacaaccgcgcttcgtgcgacgtcagcggcaagccgttcgatccaacgcgcaagctgatcgcgtggaacggcaaggcgtgggcgggcgcggacattcccgacttcaaggtggatgaaccgcccgaaaacggcatgaatccgttcatcatgaatccggagggcgtggcgcgcttcttctcgcgtgacgggctggtggaagggccattccccgagcactacgaaccgttcgagacgccgatcggctacaacccgctgcatccggacaacaagctggtggtcagcagtccggctgcgcgcgtgttcccggacgaccgggctgcgttcggcacgcacgagaacttcccgcataccgcaaccacgtatcgtctgaccgaacacttccactactggaccaagcacgcgcgtctgaatgcgatcgtgcagccgcagcagttcgtggagatcggcgaggatctggcgaaagaggtgggcgtggtggccggcgatcgcgtcaaggtgtcgtccaatcgcgggcacatcattgcggtcgcgctcgtcaccaagcggatcaaaccgctgatgatcgaaggaaagaaagtccagaccgttggcttgccgttgcattggggctttaagggactcacgaagccgggctatctcgtcaatacgctgaccccctccgtgggcgatgggaattcgcaaacaccggaattcaagtcgttcctcgtcaaggtcgaaaag

SEQ ID NO: 28628 - DNA, 1149 bp, Burkholderia fungorum
atgaagtactcgaatctggtcgagcgcctgcagggccggcgcacgtccgcgtgggaaatccatcgcgtcgcgcaacaggcggcggccaacggtgaagacgtgatcgtgctgagcgtcggcgatcccgatttcgccacgcccgcgccgatcgtcgaacgcgcggtcgaggccttgcgcggcggcgacacgcactacagcgcggtgtccggtcgtgagccggtgcgcgccgcgattgccgaagagcatgcgcgcaccacaggctgtgccgtgagcgccgccaatgtgatcctgaccgcgggcgcgcagaacggcgtattcgcttcgtcgctatgcctgctggaggcgggcgacgaggtgatcgtccccgagcccatgtacctaacctacgaggcctgcgtgcgcgcggcgggcgccacgctcgtggcggtgccggtcgatcgggcgcgggcgtttcacgtcgattgcgaggcgctcgaagcagcggtcacttcgcgcacgaaggccattttcttcgctacgccgtgtaatccgaccggcgtggtcatgccgcgcgccgatctcgaacggatcgcgcggatcgcgtgcgagcatgatctgtgggtgctgtccgacgaggtctacgccgagctcacattcgagcgcggacacctgagcattgcagcattgcccggcatggcggagcgcaccgtgacgctcggcagtctgtcgaaatcccatgctatggccggttggcgcgtgggttgggcgatcgggcccgcggagctgatcgaacatatggggcggctcgcccttgcgatgctgtacggcttgcccggcttcatccagcaggccgcattgaccgctttgcagaacaaggcacagatcgccgccgggatgcgcgagatttaccgccgccggcgcgacgtggtgttcgagcgtttgcagcgcgtgccggggctgcggtgcgtgttgcccgaagccggcatgttcatgatggtcgacgtgagcggcacgggtctcgatacggtcgacttcacctggcagctatttcgcgcgcagggtgtgtcgctgctcgacgcgagcgccttcggcgagacggcgaatggtttcgtgcggctgggtttcgtggtcgaggaagcgcgactgatcgacgcgtgcgagcggattgcc

SEQ ID NO: 28629 - DNA, 1245 bp, Burkholderia fungorum
ctgccggtcgccgtcgcgggcgagggtatcgagatcatcgattccacgggcaagcgctatatcgatgcatccggcggtgccgccgtttcgtgtctcgggcacagcaaccagcgcgtgatcgatgcgatcaaacggcagtcgcagcagctgccgtatgcgcatacgtcgttcttcaccaccgagcccgccgaagcgctcgccgaccgcctggtggcgagcgcgccgcaagggctcgaacatgtgtatttcgtctcgggcggctcggaggcgatcgaggcggcgctgaaactcgcgcgccagtatttcgtggagaagggcgaaccgcggcggcgccatttcatcgcgcgtcgtcagagttatcacggcaacacgctgggggcgctggcaatcggcggcaatgcgtggcgccgtgagccgttcctgccgattctgatcgaagcgcatcacgtgagcccgtgttacgcgtatcgcgagcagcgcgcggacgaaaccgaagaggccttcgcgcagcgtctcgccgacgaactcgagcgcaagattctcgaactcggcgcggacacggtcgccgctttcatcgccgaaacggtggtcggcgcgacggccggcgccgtgccgccggtgcgcgagtacttccgcaagattcgcgcggtgtgcgaccgctacggcgtgctgctgattctcgacgagatcatgtccggcatgggccgcaccggctatctttatgcctgcgaggaagacggcgtggcgcccgatatcctgaccatcgccaaagggcttggcgcgggttatcagccgatcggcgcgacgctcgtgagcgagcggatttatcaggcgatcgtcggcggctcggggttctttcagcatggccatacctatatcggccatgccaccgcctgcgccgcggcgctggaagtgcaacgcgtgatcgaggaagacaatctgctgcccaacgtgctggcgcgtggcgaacagttgcgcgtccggttgcgcgagcactacgcgcagcatccgcatatcggcgacgtgcgcggacgcgggttgttcgtcggtgtggaactggtcagggaccgcgccggcaaaacgccgttcgacgctgccctcaagctgcacgctgcaatccggcgcgaagcgtttgcgcgcggtttgatggtgtatccgatgggcggcacggtcgacggcaagatcggcgatcatgtgctgctggcgccgcctttcatctgtaccgcgcgcgacatcgacgaaatt

SEQ ID NO: 28630 - DNA, 1284 bp, Burkholderia fungorum
acacacgcaacgctgagcttttccgacagcgaccagactattgatctgccgatttatcagggcgcgctcggaccggatgtgatcgacatccgcaagctgtacggccagaccggcaagttcacgtacgacccgggcttcatgtccacggcggcatgcaattcggcgatcacctacattgacggcgataagggcgaactgctgtatcgcggttatccgatcgacaacctcgcgcagaacgccgacttcctcgaaacctgctatctgctgctcaagggtgaactgccgaacgcgcagcagaaggaagagttcgtcaaaacggtcacgcaacacacgatggtgcacgaccagatgcacttcttcttccgcggtttccgtcgcgacgcgcacccgatggcgattctggttgccgctgtcggcgcattgtcggccttctatcatgactcgctcgacatcagcaatccggagcaccgcgaaatttccgcgatccgcatgatcgcgaagctgccgacgctggtggcgatggcgtacaagtacaccgtgggtcagccgttcgtttatccgaagaacgacctgtcgtacagcgcgaatttcatgcgcatgatgttcgccaatccggcggaagagtacaaggtcaacgacgtgctggtgcgcgcgctcgaccgtatcctgatcctgcacgccgaccacgaacagaatgcgtcgacctcgaccgtgcgtctcgccggctcgtcgggtgcgaatccgttcgcgtgtatcgcagccggtattgcgtgtctgtggggcccggcgcacggtggcgcgaacgaagccgcgctgaacatgctggaagaaatcggttcggtcgacaacattcccgagttcatcgcgcaggtgaaggacaagaattcgggcgtgaagctgatgggcttcggtcaccgcgtctacaagaactacgatccgcgtgcgaagctgatgcgcgaaacctgccacgaagtgctggaagaactgggcctgcacgacgacccgctgttcaagctggcaatggcgctggaaaagatcgcactggaagacgattatttcgtgtcgcgcaaactgtacccgaacgtcgacttctactcgggtatcgtgcagcgcgcactcggcattccgacggccatgttcacgtgtatcttcgcgatggcgcgtacggtcggctggatcgcacagtggaacgaaatgatcgcggatccggaacagaagattggccgtccgcgtcagctcttcgtgggcgagacgcaacgcgaagcgaagccgctcgcgaagcgg

SEQ ID NO: 28631 - DNA, 1437 bp, Burkholderia fungorum
gcacggcttgcgatgcccgaatgacccgcttctcgcgggcaataccacgcaacgaaaggaaacacgatgacgtctatcgcagttcgcaatcctcgcaccggcgagcttgactatcaaatcgacgacatggacgcagcgcacatcggcgccttcgtgtccgctgctcgcgaagcacaacacgcctgggcgcaaggcggtctcgcgcatcgcacgaaggcgctgctcgcgtgggccgacgaactggaaaagaatggtgcggaggttgtcgcggcgctatcggtcgatacggcacggcaccgcatttcggcggaagaactgggcgcggtgattcacttcatccacggtttctgcgagcatgcgcccactgtgctggccacgccgttccggaagctggaagcgcacccggacgtcgtgttcaaggtcacgtatgcggcctatccggtggtcggcgtgatcagcccgtggaatttcccgctggtgctgtcgttcatcgacgccattcctgcgctcgtcgccggagccgccgtcatcatcaagcccagcgaagtgacgccgcgcttcatcgagccgcttcgccgcaccatcgaagccgtgcccgcgctcgcgaacatcatcacgctggtgacgggcggagcgcagacgggcgccgcgatcgtggcgcaatcggacgccgtggtgtttacaggcagcgtgccgaccggccagaaaatcgcgacagcggcggcgcaggctttcattccggcattcctggaactgggcggcaaggacgcggcggtcgtgctcgcgggtgccgatgtcgtgcgcgcagccaccagcatcttgcgcagcgcgctttataactcggggcaggtctgctatgcgatcgaacgcgtgtatgcgcacgattcgctccatgacgcgcttgtcgaggaactgcgcacccaggcggccgcattgaagcgcagcaacgctgcgggcgacggcggccactacggcccgatgattttcgaaaggcaggcggccatcatagacgcccaactggacgatgcggtgagcaagggggcgtcgatcgtgctcggtggcaagagcgaacgaattaacggggctgtttggatcgacccgactgtcgtaacgaacgtcgaccacacgatgacgctcatgacagaagagacatttggtccgatcgtgcccgtcatgcgctttaatgacgacgctgaagccgaacgcttgatgaacgactccatgttcggattgagcggcgcggtgtttggtcctgacacacacaccgccggcgacttcgcgacgaagatggaggcgggtggcgtcagcatcaacgacacggaattgccacgcgtgatgatgttcgacggtgagaaaaccgcgttcaagaagtcgggcatgggtgggtcgcgttatggcgccaccagcatcatgcggtatgttcgcaagcgtgcattg

SEQ ID NO: 28632 - DNA, 732 bp, Burkholderia fungorum
atgaccagactgaatggaaagaccgctgtgatcacaggtggcgctaccggcatcggccgcgccgcggccaggcgcttcatcgaggagggcgccttcgtcttcatctacggccgccgacaggaagcgctcgatgccgctgtggccgagctcggccccaatgcccgcgcagtgaagggctcggtctcggatgaggccgacctcgaccgactctacgcggcggtgaaagccgaacgcggaaccctcgacatcgtcttcgccaatgcgggggcgggaagcccgcttgcgctcggcaagatcaccgcccagcacattgacgaaaccttcgacaccaatgtgaagggtacgattttcacggtccagaaggcgctgccgctaatgggccagggcggttcgataatcctgaccggatcgagcgccggcaccacgggcgccccgggaatgagcgcctacagcgcgagcaaggcggcagtgcgcaacctcgcgcggacctgggccgaggacctgaagggcaccggcatccgggtgaacgtgttgtcgcccggggcgacggcgaccgaactcgcgaaggcagcgctcggcgaagaaggccagaaggtctacgcggctatgactccgctccagcgcatggccgatccgtcggagatcggggccgtggccgcctttctcgcgtcgtcggacagcagcttcatgaccgccagcgaggtcgccgtcgacggtggcctggcgcaactc

SEQ ID NO: 28633 - DNA, 1428 bp, Burkholderia fungorum
ttgatcaacggtgaattcgtcgaatcgaagaccaccgaatggcgcgatatcgtcaaccccgccacgcagcaagtcctggcgcgcgtaccgttcgccaccaccgacgaggtgaacgaagcgatccgttccgcgcacgccgccttcaaaacctggaaggacacaccgatcggcgcgcgcatgcgcatcatgctgaagtaccaagcgctgattcgcgagcatatgccgcggatcgcgaagaccttgagcgccgagcagggcaagacgattcccgacgccgaaggcgatattttccgcggcctcgaagtggtcgagcatgcgtgttcgatcggcacgctgcagcagggcgaattcgcggagaacgtggcgggcggcgtggacacgtacacgttgcgtcaaccgatcggcgtgtgcgccggcatcacgccgttcaacttcccggcgatgatcccgctgtggatgttcccgatggcgatcgtgtgcggcaatacgttcgtgctcaagccgtccgagcaggatccgctttcgaccatgcaactggtcgaactcgcgctcgaagccggcgtgcccaagggcgtgctgaacgtggtgcatggcggtaaagaagtggtggacgcgctgtgcacgcacgaactcgtcaaggccatatcgttcgtgggctcgacggcggtcggcacgcatgtgtaccgcctcggcagcgaacacggcaagcgcgttcaatcgatgatgggcgcaaagaatcacgcggtggtgttgcccgatgcgaaccgcgagcagacgttgaacgcactggccggcgcgggttttggtgcggcgggccaacgctgcatggcgacttcggtggtcgtgctggtgggcgccgcgcagcaatggttgccggagttggtggcgaaggcgaagacgctcaaggtcaacgcgggcaacgaaccgaacacggatatcggcccggtcgtgtcgcgcgcggcgaagcagcgcattctcggtttgatcgaaacaggcgtgaaagaaggcgccacgctggcgctggacggccgcgacgtgaaggtgccgggctacgagcagggcaacttcatcggccccacgctctttaccgacgtcaccactgaaatggaaatctatcgccaggaaattttcgggcccgtgctggtggtgttgagcgtcgccacgctcgacgacgcgatcgaactcgtcaaccgcaatccgttcggcaatggcgtgggcctcttcacgcagagcggcgcggcggcgcgcaagttccagagcgagatcgatatcggccaggtcggcatcaacattccgattccggtgccggtgccgttcttcagcttcaccggctcgcgcggctcgaaactcggcgacctcggcccgtacggcaaacaggtcgtgcagttctacacgcagaccaagaccgttaccgcccgctggttcgac

SEQ ID NO: 28634 - DNA, 1596 bp, Burkholderia fungorum
gacgcgcgcgacctgctattgcgccatcgaaccgactacgaccgcgcgtaccgcgaattcgcgtggccggcactgggcgagttcaactgggcgctcgactacttcgacgtgatcgcgcgcaataacgacaatcccgcgctgtggatcgtcgacgaccccgccggcgacggcctgcgcctgtcgtacgcgcagatgtcggagcgttcggcgcgcatggcgaatttcctgcgcggtgtgggcgtgggccgcggcgaccgtctgctgctgatgctgccgaaccgcgtcgaactctgggacgtgatgctcgcggccatgaagctcggcgcgatcgtgctgcccgccactacccagctttccgccgacgacgtacgcgaccgcgtgcagatcggcggcgcgaagttcgtcgtggtggatagcgcggagctggccaaattcgatacgctggagacgccgctcacgcgcctgtcggtcggcgcgccgcgcgagggttggatcgatctgtccgcagcctacgacgcatcgccgcaattcacgccgcaaggcgtcacgcacgccaccgacccgatgctgctgtacttcacgtcgggcaccacctcgaagcccaaactcgtcgaacacacccatcaaagctacccggtcggccatctgtcgaccatgtactggatcggcctgcaaccgaacgacatccattggaatatcagctcgccgggttgggccaagcacgcgtggagctgctttttcgcgccgtggaatgcacaggcctgcgtgttcgtcttcaacttcccgcgcttcgtggcgaaagacacgttgaacgtgctggtgcgtttcaacgtcaccacgctgtgcgcgccgcctacggtgtggcgcatgctcgtgcaggagcatctgaccgactacccggtcaggctgcgcgagatcgtcggcgccggcgagccgttgaatccggagatcatcgaacgggtgaagcacgcgtggggcattacgattcgcgacggcttcggccagaccgaaaccacctgccagatcggcaactcgccgggccagccagtcgtgcccggttcgatgggacgtccgctgcccggctacagaatcgagttgctcgatgccgacgatcagcccgtcaccgaaggcgaaatcgcgctgccgctggccgagcggccgctcggcctgatgaccggctatgcgaacaatgccaacgccaccgcgcaggccatgcgcaacggtttctatcgcacgtccgacgtcgcgctgcgccgtgacgatggctattacgtctacgtcggccgcgcggacgacgtgttcaagtcgtccgactaccgcctgagtccgttcgaactcgaaagcgtgctgatcgaacacgaggcgatcggcgaagccgccgtggtgccgagcgccgacgcgctgcgtctgtcggtgcccaaggcgttcgtcaccgtgcgccagggctacgaagccgggcccgaactcgcgcgcgccgtgttcgcgttttcgcgcgaaaaactcgcaccgtacaagcggattcgccgcctgcaattcagcgaactgcccaagaccatctccggcaagatccgccgcgtcgagttgcggcgccgcgaa

SEQ ID NO: 28635 - DNA, 1125 bp, Burkholderia fungorum
atggacagcttctacaccgacgaacaacgaatgatccgcgacgccgcgcgcgactttgccaccgagcgcctcgcgccgtacgcgggtcagtgggaccgcgacgcgcaactgcccgccgaggtcgtcacgcaaatgggcgaactcggctttctcggcatgatcgtgccggcggaatggggcggctcctatacggactacgtggcctatgcgctcgcgctcgaagagatcgccgcgggctgcgcctcgtgcgccacgctgatgagcgtgcataactcggtcggctgcgggccgatcctcaacttcggcagcgcagcgcaaaaagaccgctatctgcacgacctcgcgaccggccgccgcatcggcgcgttctgcctgactgagccgcaggccggctccgaggcgaacaatctgcgcacccgcgccgtgctgcgcgacggcaagtggattctcaacggcagcaagcagttcgtgaccaacggcgctcgcgcccatgtcgcaatcgtgttcgccgtcaccgatcccgatcgcggcaagcgcggtctgtcggccttcatcgtgcctaccgatacgccgggcttcaacgtcggcaagccggaacacaagctcggcattcgcgcgtccgacacctgcccgatctcgctcgacgactgcgccgtgcccgaagccaatctgctcggcgagccgggcgagggcttgcgcatcgcgctgtcgaatctcgaaggcgggcgcatcggcattgccgcgcaggcgctcggcatcgcgcgggccgcgttcgatgccgcgcgtctctatgcgagcgaacgcatccagttcggcaaggcgttgaaggagcatcagaccatcgccaacatgctcgccgacatggccacgcgtttgaatgctgcgcgcctgctcgtgcatcacgcggcgcggctgcgcacggaaggcaagccgtgtttgtcggaggcttcgcaggcgaagctgttcgcctcggagctggccgaggaaatctgctcgaacgcgattcagattcacggcggctatggttatctggaggactacgcggtggagcgccactaccgcgatgcacgcatcacgcagatttacgaaggaaccagcgaagtgcaacgcatggtgatagcgcgc

SEQ ID NO: 28636 - DNA, 990 bp, Burkholderia fungorum
gcagtgcaggtggcgcaggctggcggacccctggaactcgtcgaacgggacgtgccggaaccgggtgccggacaggtgctcatcaagatccaggcgtgcggtatctgccacagcgacgtgctaacaaaagaagggcagtggccgggtctggaatatccgcgggtgcccgggcacgaaattgcaggcgtgatcgatacggtcggcgcaggcgtcgaagaatggcaggcgggacagcgcgtcggcgtcggctggcacggcggccattgcggacactgcgagcattgccgccgcggcgattttgttctgtgccagcgcgcgctcgtgcccggcatcagctacgacggcggctatgccgagttcatgctggcgcccgtcgaggcactggcgcgcattcccgacgatctcgccgatgtcgatgccgctccgcttctatgcgcgggcatcacgacattcaacgcgctgcgcaatagcggcgcgcgcgccggcgatgtggtcgccattctgggcattggcgggctcggccatctcggcgtgcagttcgcgcgaaagatgggcttcgtcaccgtggccatcgcgcgcgggcaggacaaggcaagtcttgcgaaacaactcggcgcccatcactacatcgacagcacggcggcgaatgtggcgcaagcgttgcaggcgctgggcggcgctcgcgtcattctcgccaccgtcacgagcggcaaggcgatgagcgccgtggtgggcggcctcgggctgaacggtaagctgatcatggtaggactctcggacgagcccgtcgaagtgccggtcgcgcagttcatcatgggacgaaattcggtgcagggctggccgtcgggcacgtcggcggattctcaggacacgcttgcgttcagcgcactctcgggaatcaaaccgatgatcgaagaattcccgctaacgaaagcggccgaagcctacgagcggatgatgagcggcgccgcgcggttcagggtcgtgctc

SEQ ID NO: 28637 - DNA, 762 bp, Burkholderia fungorum
ctgctcaaggacaaggtcgtgatcgtgaccggcgcttcgcgtggcattggccgcgcgatagccgttgcatgcgcaaccgaaggcgcggacgtggcgatcaactactggggcgataacgacgcatcgtacggacgccgttccgccgtcgccgaagtggtcggcgaaatcgaggcgctggggcggcgcgtgattgcgatcgaaggcaacgtcgccgcgcgcgagaccggccagcaactggtgcgccatacggtggaagccttcggcaaagtcgacgtgctcgccagcaatgcgggcatctgtccgttccatgcttttctcgacatgccgcctgaagtgctggagtcgacagtggcggtcaatctgaatggcgcgttctacgtgacgcaagccgccgcgcaacagatgaaagcgcagggcacgggtggcgcgatcgtggcgacgagttcgatcagcgcgctggtgggcggcggcatgcagacgcattacacgccgaccaaagcgggcgtgcattcgctgatgcagtcctgcgcggttgcgttgggaccgtatggcattcgctgcaactcggtcatgccgggcaccatcgccacggacctgaacgcgcaagacctcgccgacgaagccaaaaaagcctacttcgaaaaacgcattccgctcggcaggttgggccgtccggaagatgtcgccgattgcgtgacgttcctcgcctccgaccgcgcgcgctatgtgaccggcgcagcgttgctggtggacggcggcctc

SEQ ID NO: 28638 - DNA, 723 bp, Burkholderia fungorum
ctggaggggcgcgtagtcgccattaccggcggcgcgcgtggcatcggctacgcggtcgcgcagcgggcgttgaactcgggcgcatcggtcgcgctatgggacgtggacgccgaacgtctcgcccgcagccagcgtgagctgagcgagctcggcaaagtcacggcagtcgccgtcgaactgacacaggaagccgccgtcgcgcaggccgtggcgcaaaccgtcgccgatcacggcgcgatcgacgtgctgatcaattgcgccggcatcaccggcggcaacggcaccacctgggaactggaacccgacatctggcgccgcgtgatcgacgtgaacctgatcggcccctatctgacctgccgcgcggtcgtgccgcaaatgctcaggcagggctatggccggatcgtcaatatcgcttcggtggcgggcaaagagggcaacccgaacgcctcgcactacagcgcctccaaggccggcctcatcggcctgaccaaatcgctcggtaaagaactcgcgacgaagaacattctcgtcaacgccgtcacacccgccgcggccaaaaccgagatcttcgattcgatgtcgcagcaacacatcgactacatgctgtcgaagattcccatgaaccgcttcctgttacccgaagaagcggcgtcgctgatcttgtggctctcctctgaggactgcgcgttcagcaccggttcggtattcgacctgtccggcggg

SEQ ID NO: 28639 - DNA, 1287 bp, Burkholderia fungorum
caccggaccattttcatcatcattgcgatcgcgttctttttcgattccgtcgatctcggcacgatgaccttcgtgctcggctcgatcagaacggagttcggcttgtcgagcgcgacggcgggactggtggccagcgcgagcttcttcggcatggtgatcggcgcggcgattgccggcttgctggcggatcgcttcggacgccggccggtgtttcagtggagcatggtgttgtgggggctcgcgtcgtatttgtgttcgacggcgcagagcgtcgaagcgttgatcttttatcgcgtgctgctcggtttcggcatgggcatggagtttccgattgcgcagacgctgctgtcggagttcgtgccggcagcgtcgcgcggccgtctgattgcgctgatggacggcttctggccgctcggcttcattgcggcgggcgtggtgtcgtacttcgtgctgccgacgttcggctggcgcacggagttcgcgctgctcgcgattcccgcggtgttcgtgctgatcgtgcgccgcatggtgccggaatcgccgcgctggctcgaacatcgtggacgtttcggcgaagcggacaagattctcgcggaagtcgaagtgaaggtgatgaaagcggccgggctgagccagttgcgcccgcccgcgatgctcgccgagccgccggccgcgcagggcacgggcgcgtttcgcgagatatggagcatagcgtaccggcgtcggacgatcatggtgtggacgctgtggttcttcgcgctgctcggtttctatggactgacgtcgtggcttggcgcgttgatgcagcaggcaggcttcgcggtgacgaagtcggtgctgtacacggtactgatttcgctcggcggcattccggggtttatctgtgcggcctggctggtggaacgctggggacgtaagccgacctgcattgcgtcgcttgcgggcagtgcggtgatggcttacgtatatggacaaaccgcgctgcacgcgcagacgccgaccttgctgatctgtgccgggctcgcgatgcagttcttcctgtttgcgatgtgggcggtgttgtacacctacacgccggagttgtacgggacgggtgcgcgggcaacgggttcgggtttcgcgtcggcgattggccgcgtgggttcgttgatcggaccttacgtggtgggcgtggtgctgccggtgttcgggcagggcggcgtgttctcgctcggtgcgatgtgtttcgtgatcgctgcggcggcggtgtggatactcggtatcgagacgcgtgggttggcgctggaa

SEQ ID NO: 28640 - DNA, 1656 bp, Burkholderia fungorum
gcgaacgaatacgactacatcatcgtgggcgcgggttcggcgggcaatgtgctcgcctcgcgcctcgccgaagacgcggacgtgaccgtgctgctgctcgaagcgggcggccccgactaccgcttcgacttccgcacgcagatgccggccgcgctcgcctatccgctgcaaggacgccgctacaactgggcgtacgaaacggaccccgagccgcacatgaacaaccggcgcatggaatgcgggcgcggcaaggggctcggtggctcgtcgctgatcaacggcatgtgctatatccgtggcaatgcgctcgattacgacggctgggccgcgcacgcgggcctcgaaaactggacctatctggattgcctgccgtatttccgcaaggccgagacgcgcgatatcggtgcgaacgcgtatcacggcggagacggtccggtgcacgtcaccaccagcaagcccggcaacaacccgctctttgccgcaatggtcgaagccggtgtgcaggcaggctttccgcgtaccgacgatctgaacggctatcagcaggaaggcttcggcccgatggatcgcacggtgacggcaaacggccggcgcgccagcacggcgcgcggctatctggatcgcgcgaaagcgcggccgaatctgaccatcgtcacgcatgccgtgacggatcgcgtgctgttctcgggcaagcgcgcagtcggcgtctcgtatctgcatcatggcaatgtgctgaatgcgcaggctcgccgcgaggtgctggtgtgcagcggcgcgattgcttcgccgcaactgctgcagcgctcgggcgtgggccgctccacgtggctgcgcgaactggacgtgccgctcgttcacgatctgccgggtgtgggcgagaacctgcaagaccatctggagatgtatatccagtacgagtgcaaggagccggtttcgctttatccggctttgcagtggtggaatcaaccggccatcgggctcgaatggatgctgaacggaaccggcatcggcgcgagcaaccagttcgaagcaggcggctttatccgcacgcgcgacgacgatccgtggccgaacatccagtatcacttcctgccggtcgcgatcaattacaacggttcgaacgcgatcaggatgcacggttttcaggcgcacgtcggttcgatgcgctcgccgagccgtggccgcgtgaagctcacctcgcgcgatccgaacgcgcatccgggcatcctgttcaactatatggccgatccgctcgactggcgcgagttccgcgacggcattcgcatcacacgcgagatcatgcggcaaccggcgctcgaccgttatcgcggccgcgaactgaaccccggcgccgaactgactaccgacgaacagctcgatagtttcgtgcgcatgcgagcggagacggcgtttcatccatcctgttcctgcaagatgggctacgacgacatggccgtagtcgacaacgagggccgcgtgcacggcatgcaaggactgcgtgtggtggatgcgtcgatcatgccgcgcatcaccaccggcaatctgaacgcgccgaccatcatgctggcggagaagatcgccgaccgtattcgcggacgcgaggcgctggcgcgggtggatacgccctatttcgtggcgaatggcgtggcttcgcgc

SEQ ID NO: 28641 - DNA, 1467 bp, Burkholderia fungorum
atggcggtattcgcaatacaacgcctctacatcggcggcgcgtatgtcgacgcaaccagcggcgaaaccttcgatacgctcgaccccgccaccggcgagacgctcgcgagcgtgcagcaggcttcggcggcggacgtcgagcgcgcggtgcaatccgcgcgggaaggccaacgcgaatgggccgcgctcacggccatgcagcgttcgcgcgttctgcgccgcgccgtcgagattctgcgcgagcgcaacgacgaactcgccgcgctcgaaacgcgcgacaccggcaagccgattgcggaaacgctcgcggtggatatcgccaccggcgcggacgtgatcgagtactacgcgggactcgccactgccattgaagggcaacagattcccttgcggcccacctcgttcgtttatacgcggcgcgagccgcttggcgtttgcgcgggcatcggcgcatggaactatccgatccagatcgcgtgctggaagtcggcgcccgcgctcgcggccggcaacgcgatgatcttcaagccgagtgaaatcacgccgctatcggcgttgaagctcgccgagatctataccgaagccggcgtgcccgcgggcgtgttcaatgtcgtgcaaggcgacggacgcgtcggtgcaatgctggccgcgcatccggacatcgagaaaatctcgtttaccggcggcgtggaaacgggcaagaaggtgatgtcactggcgggcgcatcgtcactgaaagaagtgacgatggaactcggcggcaagtcccccctgctcgtattcgacgacgccgatctcgaacgcgccgccgacattgcgatgagcgccaacttcttcagctccggccaggtgtgcaccaacggcacgcgcgtgttcgtgcaacgcggcgtattggaacgcttcgaggcgttagtgctggaacgcgtcaagcgcattcgcgtgggcgcgccaaccaacgccgccaccaacttcggtccgctcgcgagcgccgcgcaattgcagaaggtgctggggtacatcgaaagcggcaagcaggaaggcgcgcggctcatggcgggcggcaagcgtctcaccgaaggtcacttcggcaacggccagtacgtcgagccgaccgtattcaccggctgccatgacgacatgcgcatcgtgcgcgaggagatcttcggcccggtcatgagcattctcgtgttcgacgacgaagacgaagccatcgcgcgcgcgaaccgcaccgcttatggtctcgccgcgggcgtcgtgaccgggaatctggcgcgcgcgcatcgcgtgattcatcgtctggaagcgggcatctgctggatcaacacgtggggcgagtcgccggcggaaatgccggtgggcggctacaagcaatcgggcgtgggccgcgaaaacggcctcaccacgctcgagcactacacgcgcatcaagtccgtgcaggtcgaactcggcccgtatcaaccggtgttc

SEQ ID NO: 28642 - DNA, 954 bp, Burkholderia fungorum
ttgcacgacaacagcatcatcatcgacggtctgaacatttcgaagttcgagcactcggtgttcgaggacatgcgcaagggcggcgtgaccgcggtgaactgcacggtgtcggtctgggagagcttccagaagaccgtcgacaacattgccgagatgaagcagcagatccgcgagcacagcgagattctcacggtcgtgcgcaccactgacgacattttccgcgcaaagaaagagaacaagacgggcatcattttcggtttccagaacgcgcatgctttcgaggacaacctcggctatatcgaggcgttcaaggatctcggcgtgaacgtggtgcagctttgctacaacacgcagaacctcgtgggcaccggctgctatgaacgcgacggcggcctgtcgggctatggccgcgaagtgatccaggagatgaaccgcgtcggcatcatggtcgatctgtcgcacgtgggcggcaagacttcttccgaagcgattgcggcttcgaacaagcccgtttgctactcgcattgctgcccgtcggccctgaaagagcacccgcgcaacaagagcgacgagcaactgaaagagatcgcggacgcaggcggattcgtcggtgtgacgatgttcgcgccgttcctcaagcgcggtcccgacgcgactgtcgaagactatatcgaagcgatcgagtacgtggtgaatctgatcggcgaagaccaggttggtatcggcacggacttcacacaaggctacagcacggagttcttcgactggatcacgcatgacaaaggccgctatcgccagttgacgaacttcggcaaggtcgtgaatccggaaggcatccgcacgatcggcgagtttcccaacctgacggccgcgatggagcgcgccggctggagcgaaacgcgcatcaaaaagatcatgggcgaaaactgggtgcgggtattcggcgaagtgtgg

SEQ ID NO: 28643 - DNA, 1530 bp, Burkholderia fungorum
cttgagaccaaaaagaatattcttatcctgatggcagaccagatgacgccgttcgcactagccgcgtacggacaccgtctgacgaaaacccccaatctggatcgcctcgcgaaacaaggcgtggtattcgaatcggcctactgcgccagtccgctgtgtgcgccttcgcggttttcttttctgtcgggcaagttgccttcggcaatcggcgcctatgacaatgcagcggagtttccgtcgcaaacgctgaccttcgcacattatcttcgcgcagaaggatatcgcaccattctgtccggcaagatgcatttctgcggcgccgatcagttgcatggtttcgaggagcggctcaccacggacatctatccggccgacttcggctggacgcccgactgggagcattttgaaacacgccccacgtggtatcacaacatgagttccgtgatcgacgccggcccgtgcgtgcgtaccaaccagctcgacttcgacgacgaagtcacgttcacgactcgccagaaactcttcgatatcgcacgcgaacgtcatgcgggaaaggatgcgcggccgttctgcctggtcgcctcgctgacgcatccgcacgatccctacgcgattccgcaaaagtattgggacatgtatcgcgacgaagagatcgacatgcccgcgtttcgcgattcgttcgaagacgccgacccgcactcgaagcgcctgcgccatgtctgcgaaaccgaccgcacgccgcccaccgatcagcagatccgcaatgcgcgccgcgcgtattacggcgcgatctcctacgtcgacgatcagttcggcgcgatcctcgaagcgctcgaacaatccggcctcgcgaaagacactgtgatcgtggtgacttccgatcacggcgagatgctcggcgagcgcgggctctggtacaagatgaccttcttcgaaggcggttgccgcgttccgctgatcgtgcacgcaccgcagcaattcgacgcgcatcgcgtagaggcgagcgtctcgcatctcgatctgctgcccacgctggtcgagttggcacgcggcgaacaaccggccgtgtggcccgattcgctcgacggacaaagccttgttccgcatcttatgagcgggcaaggcgggcaaggcggccatgacgaagcgatcggcgaatatctggccgaaggggccattgcgccgatcgtgatgttgcggcgcggccgcttcaagttcattcacacaccggccgatccggatcaactctacgatgtcgccgcagacccgctggaacgcgagaaccttgccgcgcgcagcgaatacgcgtcacaggtcacggctttccgtgaggagatcgcgcaacgctgggatctcgccgcgctgcaccacgaagtgctgcaaagccagcggcgccgtcattttcattttgcctccacgacgcagggcgtggtcgcgtcatgggactggcagccgcacgtggatgcgagccagcgttacatgcgcaatcacatcgatctggattcgctcgaagcgatggcgcgctttccc

SEQ ID NO: 28644 - DNA, 1149 bp, Burkholderia fungorum
atcgcagacgacgcgcaggcgcttctcgccgcacggcgtctcgccgaggcgttcgcaccggacgctgcgctgcgcgatcgcgaacggcggcttccgtgggccgagctcgacgcgttcgtggcgagcggcctgtggggcatcaccgtgccgcgcgaattcggcggcgcgggtgtgagcaacggcacgctcgcggaagtcaccgcgacgatcgcggcggccgacggctcgctcggccagatcccgcaaaaccatttctatgcactggaggtgttgcgcgtcggcggcagcgtcgaacagcagcgctttttctacggacgcgtactcgccggcgagcgtttcggcaacgcgctcgccgaaatcggccacaaggatttcaaacgccgcacacggctcacgcgcgaggcggccggctggcatatcgacggccgcaagttctattgcacgggcgcgctatacgcccactggattcccacgctagtcgtggccgaagagcagggccgcgacgtcacctatctggcgttcgtgccgcgcgacacaccaggcgttaccgtaacggacgactgggatggcttcggccagcgcgtcaccggcagcgggtcggtgcagttcgattacgtgcgcgtcgagcccgaatgggtcgtgccgtttcaggcgtcgttcgagcgccccacaacgatcggaccgcttgcgcagatcattcacgcggcgatcgatctgggtcaggcgcgtggcgcgttcgaagccggcctgaagttcgtgcgggaacgctcgcgcccgtggatcgacgcgaaggtggaacgtgccgccgacgatccgctgacccttgcgcagttcggcgacatctcggtgcggctgcgtgcggcggaagcgttgctgcgccgcgcgggccgcttcgtcgacgcggcgcaggcgcagctcacagagcagtcggtggcgcaggcatcgattgccgtggccgaggcgcgcgcgctcaccaccaccgcatcgctggatgccggctcgcgtctgttcgaactcgccggcaccgccgccacgctcgacggtctcggcctcgaccgcttctggcgcaacgcccgcactcatacgttgcacgacccggtgcgctggaagtatcacgccgtgggcaacttctacctcaacgacaagctg

SEQ ID NO: 28645 - DNA, 765 bp, Burkholderia fungorum
agccccgtctgcgtggtgacgggctcggcttcgggtatcggcgcggcgaccgcgctgcgcttcgcgcaggcaggctggtcggtggcgataggcaacttcgacgacagcacgcgcgaagcggcgctggcggtcgaagcggcctgccgggacgccggcgcgtccacgctggtattcgacgcggatgtcggcaacgacgcgcactgccgccgcgcgatggataccgtggcgagccgctggcaacgtgccgacgcgctgatcaattgcgcgggcacgacgcgcgtgattgcgcataacgccttcgacgagatcgacgcggtcgaattcgagcgcgtgtaccgcgtgaacctgatcggtctgtatcagatgacgcgcgcagccgtgccgttgctgcgcgaatcggccggtctgtcggcggtgaaacgcagcaccagcgtggtcaatatttcgtcgctggcgggcctgaacggtaccgggtcgtcgattgcgtatgcggcgtcgaaaggcgcggtgaatacgctgacgctctcgcttgcgcgcagtctcgcgccgtatgtgcgcgtcaatgcgatcgcgccgggcatggtcgacgacgggctgttgctgcacgtgctcgacccgcaagcctatgacggcgtgctcgccagaatgaccgaacaggcgccgctcaaacgggtgtcgatgccggcggaaattgcggacctcgcgtggtttctcgcgacgcaggcgccggcaatcaccggccaggtgatcgccacggaaaacggc

SEQ ID NO: 28646 - DNA, 1146 bp, Burkholderia fungorum
cgcgaactcaccgatcgcagtctgagtaacacccagcttcgggagcgcgctgaacgtctggcgcaggccgaccggcgcaagaacgaattcctggccatgcttggtcatgaactgcgcaatccgcttgccgcgctgtgctcagccggcgacctgctcgcctcggaatccgtcgatgcgcgccagaaggtctgggccgtcggcgtcatacagcggcaaggccaggcaatgacccagctggtcaacgagatgctggatctcacgcgtattgcgagcggcagcatcaagctgaatcgtcaggcggtgacgctggaaacggtcgttcagagcgcgctcgaggtgtgccggccgattgtcgaagaacggcatcacaccttgtcggttgcgctgccggaagaaccggtgctgatgtttgtcgaccccacgaggctatcgcaggtcatcgagaacatcgtgatcaacgcggccaaatacacggagcccggcggcaaaatcgatctcagcgcgacgagaaccggccgccggctttcgcttcgagtcagggataacggtgcgggaatcgccccttcgatgctcaacacgcttttcgacatgttcgtccagggtccgttgccccacggtcagcttcataacgggctcggagtaggcctgtccgtggtccggcggctggtcgagttgcatggcggaacggtcgaggccgtcagcgacggcaagacaggcagcgagttcatcgtcgatctgccgttgggcctgatcccggccagcccggatcaggccggttcaccgcagaacccgggcaaggcgcccccccgcagggtcctcatcatcgacgacaacgccgacgccagcgaggcgctggcgatgattctggcaagcgaagggcatgtggtggcgacgcggctggatggccagcaggggctcgaagcttccacgactttcaggccggatgtcgtgctcctcgatatcggactgcccggaatggacggctacgaggtggcgcagaaattacgcgggtctgccgcgacccgagacacgctgctggtagccgtcaccggctacgggcagccgggcgaccagctcagatccgcggcggcgggattcgaccaccacctggtcaagccggtggatatcgaggcgttgaagggtctg

SEQ ID NO: 28647 - DNA, 1617 bp, Burkholderia fungorum
gccggcaagccgcttccgccggcactgctggtcaacgtgccgcgcctcgtcgcgagctactacaccgggacgcccgacccgtcgctcgccgccgagcgcgtcaaattcggtacttcgggacatcgcggatcttcgttgcagcgcagcttcaacgagtggcatgtgctcgcaatcacgcaggctatctgccgataccggaaattacagggaatcgatggaccgctgtttctcggcatcgacacgcatgcgctgtcggagccggcctcggccagtgcgctcgaagtgctggcggccaatggcgtggaggtcatgatcgcgccggatggcgaatacacgcccaccccggccatatcgcacgccatcctcacctataaccgcggccgttcgtcgggcctcgcggacggcatcgtcatcacgccttcgcacaatccgccgggtgacggcggcttcaaatacaacccgcccagcggcggacccgcggacgaaacggtgacgggctggatcgaagtcgcggcgaacagcctgctcgagaaccggctcgacggtgtcatgcgcatgccgctcgccaacgcgctgcgtgcctcgaccacgcactatcacgacttcctcagaatctacgtcgccgatctcgacagcgtcatcgacatgagcgtgctgcgcggtgcgccgatccgccttggcgtcgatccgctcggcggcgcgggcgtgcactattgggccgcgatcgcggaacgctatcggctgaacctcacggtgacagacgaagacgtcgatccgactttccgcttcatgagcgcggattgggacgggcagatacgcatggacccgtcgtcgccgtatgcgatgcagacgttgatcggcaaggccgaccgcttcgataccgcgtttgcatgcgataccgatcacgaccggcatggcatcgtcacgcccacagccgggctattgccgccgaatcactacctcgccgtcatgatcgactatctgtgcgcgcatcgtccggattggcccgcgcatgccgcgatcggcaagacgatggtcagcagccggctgatcgaccatgtggcggcaaagcatggccgcgcgctctacgaagtgccggtgggcttcaaatggttcgtgggcggcctgctcgacgggtcacttggttttgccggcgaggaaagcgcgggcgcgacctgtctgaggctcgacggccgcgcgtggacgaccgacaaggacggcatggtgcccgcgctgctgtcggcggagatcgcgacgcgcaccggccgcgatgtcgcggagcattaccgcgccctcaccgaacgcctcggcgagccgcgcgagcgtcgcgtgcaggcggcggcgagtgcgtcccaacgcgcgctgctcgggcgactgtcgccggcgcagttcgctcacaccgagcttgccggcgaaaaaatcgattccgtgctcgaccgcgcgccggccaatcaggcgccgctgggcggcatcaaggtgagtacgaagagcggctggttcgccgcgcgaccctcgggtaccgagaatatctacaagatttatgccgagagttttctcggcgacgaccacctggcgcgcattgtcggcgaagcgcagagcatggtcgacaacgcgctg

SEQ ID NO: 28648 - DNA, 1668 bp, Burkholderia fungorum
gactatctgattctcggcggcggctcggccggctgcgtgctggccgcgcgcctgtccgaagacgaaggcagcaccgtctgcctcgtcgaggccggccgcaacatctcgcgaacggacatgcccgctgcggtgcgcagccgctatcccggccgcgcctatctcgacaccgcgaacatctggcagcatctgaaggcacgcatgaacacttcggccgcgacacgccgttacgagcaggcgcgcctgcttggcggcggttcggcgatcaatgcgctgatggcgaaccgcggcgcgccggccgactacgacgaatggcacgcgcgcggcgcacacggctggaactgggccgcctgcctgccgtacttccgcaagctcgaaaccgattgcgacttcggcggcgcgctgcatggcgcgagcggaccggtgcgcatccagcgcacgccgtgggcgcgcatctcgccattcgtacgcgcggtgctcgccacgctcgacgcgcgcggccacacgcggcgtgacgaccagaacggcgaatggcaggacggcacgttcatcggctcgatcgcggtgagcgaagcgggcgagcgcatcccgacctcggtctgctatctcgacgacaccgtgcgggcccggccgaatctgaccatccgcacgcaaacgctcgtcgaacacgtgctgttcgacggcgggcgcgcgatcggcgcgcgggttgtcggcgaaaacggtgcgagcgaaacattgcacgccagacaggtgatcgtttgcgcgggcgcgattcacagcccggcgcttctgatgcgaagcggcatcggaccggcgtccgaactggccgcgctcggtatcgaggtggtggccgatcgcggcggcgtgggcggcaatctgatggagcatccgtcgattgccgtgtccgcggttctgccgcgcgcggcccgcgcgttatatcccgacgagcatcacgaacaggcgatcgtgcgtttttcgtcgggcgtgagcggagcggtacctggcgacatgcacggcgcgatcctgtcgcgatcgggttggcattcggtgggctaccggctcggcacgctgtttttctgggtcaacaagtcgtactcgcgcggccgcgtgagtctcacgtcggccagtccgcacgacgaacccgccgtcgacttcaacatgctgtccgacgcgcgcgatctcgaacggctgaaactcgcgctgcgcttcggcgcccgaacgctggccgatccgatgatggcgcagcaccgcaccacgctgctgccttcgagctattcgccgcgcgtcgcgagcgtggccgtgccgggcgtgtggaacgcgttgcagcgcggcctgctgagcgcgctgctcgacattgccgggccgttgcgcgggtggctcgtgcgccgcgtggtcacgcaaggcgtgacgctcgacgaactgctcgccgacgatcacgcgctgacgcgtttcgtgacgcgctcggcgggcggcacctggcatccgtgcggaacctgctgcatgggtgccgccgacgatccgctcgccgtctgcgacgcgcgcggcgcggtctatggcgtcagcggactttatgtaggcgatgcgtcgttgatgccgtcgatcccttgcgcgaacacgaatgtgccgaccatcatgatcgcggagcggattgcggatatgttgcgaggacgg

SEQ ID NO: 28649 - DNA, 1425 bp, Burkholderia fungorum
atcggcggtgaatacgtggaggcgggcgggcgccgcatcgaggtcgcgcgtccctcggacggcgtggtatatgccacggtgccgcttgccgatgccggcatggtggaccgcgcggtcgaaaacgcatggcaggccttcagacacagtggctgggcgcgcatggcgccgcgtgaacgcgcgaagatcctgcgccgtttcgccgaactggtcgaagccgatgcgcccacgctcggccggctcgaagcgttgggatcgacacgtccgatcgctcaggcgatcggctgggacgtgccgttcaccgccgagggtatccgcttctacgccgagttcgccgacaaactgggcggcgacgtggcggccacggatcacgatcatctcggcatgacgatcgccgagccgtacggcgtgatcggtgcgatcgcgccgtggaatttcccgctggtgatggcttcgtggaagatcgccccggcattggcagcgggcaatgcggtggtgctcaaaccttcggagatgacgccgttctcggtcttgcggcttgccgaactggccgtgcaggcgggcgtgcccgcgggcatcttcaacgtgatccagggcgatggcagggtgaccggcgacgaactggtgcgtcatccgaagatcagcaaggtgaccttcacgggctccacgcgcacgggcgcgtcgatcatggccgcctgcgcgaatagcggcaccaggccggtcacgctcgaactgggcggcaagagcccgcaaatcgtgttcgccgacgcgccgcgtctggatgacgtggcacgccgtatcgccggcgctattacaggtaatgccgggcaggtgtgcgtggcgggctcgcgtctgctggtcgagcgaagcctcgctgaaccgctcgccgagcgcatcggcaagatcttcgcggagttgaagcccggcgcgacgtgggccgccggcacgacactgtcgccgatcatctcggcgccgcaggcggcgcgcatagagggcatcgtggggcgcacgctggaagccggtgcgacgctgcgctacggcggcgtcagggccgatgtcggctccaacggcgcgttctacacgcccaccttgctgacgaacgtcaccgctcattccgaagcagtgcgcgaggaaatcttcgggccggtgctgacgctgcaaaccttcgataccgaagaagaagcgctcgcgctcgcgcagcaccccgaatacggcctcgcggccggtgtgcataccgccgacctcggccgggcgctgcgtttcgtgcgcgggctcgaagcgggcacggtgtgggtgaaccgctatggccgcacctcggacttcatgattcccaccggcggctacaagcgttccggtatcggcaaggaccttgggcggcaggcctatgaggcgaacctgcgtttcaagagcgtgttgatcgacctgcgg

SEQ ID NO: 28650 - DNA, 1299 bp, Burkholderia fungorum
catctgattcacccggtcatcaactaccgcgtgcacgaagcgcgcggcgtcaccgttctcgaatccgccagcggcgcgtttctgcgcgacgcggccggcaacgaactgctcgacgcgttttccggactctggtgcgtgaacgtcggctacggtcagcagagcattgtcgaggccgccaccgcacagatgcagaaactgccctacgcgaccggttatttccatttcggctcggagccggccatcgaactcgcgcaaaagctggtcgaggtgtcgcctgcttccctgcaacacgtgtacttcacgctcggcggttccgacgcggtggactcggcactgcggttcatcacgcattacttcaacgccacgggccggccgtcgaaaaagcacgtgatcgcgctgcaacgcggctatcacggctcgtcgtcgaccggtgccggcattaccgcgttgcccgcgtttcaccgcaacttcgatctgccgctgccgaaccagcatcatctgccctcgccgtacgcataccgcagccatttccccgacgacgccgcgctgatcgccgcctcggtggccgcgctcgaagcgaaggtggccgaactcggcgctaacaacgtcgccgcgtttttctgcgaaccgatccagggctcgggcggtgtgatcgtaccgccggccggctggctcaaggcgatgcgtgaaagttgccgtaagctgggcatcctgttcgtcgccgacgaggttattaccggattcggccgcaccggtccgctgttcgcctgccagggcgaaaacgtcgaaccggatctgatgacggtggcgaagggcctgaccgcgggctatgcgccgatgggcgccgtgctgatgtcggacgaaatctatcagggcattgcggacggcgacgccgaagcggtggtcggtcacggccacacgtattctgcgcacccggtgagcgcggccattggcctcgaagtgctgcgcctctatcacgaaggcgggctgctggcgaacggcgtggcgcgtgcgccgcgtttcgcgcgcggcctcgacgcgctgctcgcgcatccgctggtgggcgattcgcggcaccgcggtctgctcggcgcgctcgaactcgtcgccgacaaggacagcaaggcgggcttcgacccggcgttgaaactgtccgaccggatcgccgcggccgcctatgaaaaccgcctgattttccgggccttcggcgacaacattctcggcttcgcaccggcgctttcgtacaccgagggcgagttcgatctgatgttcgagcggctcgaaaagaccctcgacgac

SEQ ID NO: 28651 - DNA, 1080 bp, Burkholderia fungorum
aagaaatatcggatcgcggtcattcccggcgacggcatcggtgtcgaagtcatgccggaagccattcgcgtgctcgaagcggtgaaagcgcgcttcggcatcgagctggagtatcagcacatcgaatgggcgagctgcgagtactacgcaaagcacggcaagatgatgcccgacgactggaaagcccaactgctctccgccgacgcgatcctgttcggcgcggtgggctggcccgacaccgtgcccgaccatatttcgctgtgggggtcgctgctgaagttccgccgcgaattcgaccagtacatcaacctgcgccccgcccgcctctttgccggcgtgccttcgccgctcgcgggccgcaaggccggcgacatcgatttctggatcgtgcgcgagaacaccgagggcgaatactcgtcggtgggcggcgtgatgttcgaaggcacggagcgcgaattcgtgctgcaggaatccgttttcacgcggcacggcagcgagcgcgtgctgaagttcgccttcgatctcgcccagcggcgcgcgcgcaagaagatcacggtggccaccaagagcaacggcatcgcgatcagcatgccgtggtgggacaaggtcgcggccggcatcgccgcgcagtatccggacgtgacgtgggacaagcagcacatcgacattctctgcgcgcgcttcgtgctgaacccggatcgcttcgacgtggtggtggccaccaacctgttcggcgacatcctgtccgatctcggccccgcctgcaccggcacgatcggcctcgcgccgtcgggcaatctgaatcccgaccgcaagtttccgtcgctgttcgaaccggtgcacggctcggcgcctgacatcgcgggcaagaacatcgccaatccgatcgcgatgatctggtccgccgcgatgatgctcgacttcctcggcaatcacgccggcaaggagcgcgaggcgcacgacgcgattctcgccgcgatcgaagcaacgctgatcgaaggcccgcataccggcgacctgggcggcaaggcgaacacgaccgaggtcggccaggcaatcgcaaagaaactcgcttgaagc

SEQ ID NO: 28652 - DNA, 1428 bp, Burkholderia fungorum
ttgatccgctccgacaatttcatcgacggcgcatggacgcccgcgcaagacaacctgcgctttgccgtcaccaatcccgcgagcggcgagatcatcgctgaagtggcggacagcagccccgccgacgcccgcgccgccaccgacgccgccgcccgcgccctgcccgcttggcgcgcgcgcctgccgaaggaacgcgcggccgtgctgcaccgctggcatgcgctgatcatggcgaatctggatgcgctcggcgcgctgatctcgctcgaacagggcaagccgctcgccgaaggcaaaggcgaggtcgcctacggtgcctcgtatgtcgcgtggttcgcggaagaagccacgcgcatctacggcgatctgattccgcagcagcagcgcggcaagcgcatgacggccgtgaaggaaccggtcggcgtcgtcgccgcgatcacgccgtggaatttcccgctcgccatgatcgcgcgcaagatcgcgccggcgctcgccgccggttgcacggtggtggccaaaccggcggaagatacgccgctcaccgcctcggcgctggtcctgctcgcgcacgaagccggcgtgccgccgggcgtgctgaacctgatcacggcctcgcgcgatcatgcggtcgccgccgtcgccgagtggctgcacgacgcgcgcgtgcgcaagatcaccttcaccggctccacgccggtcggcaaatatctggcgcgcgagtcggcggaaacgctcaagaaactgtcgctggaattgggcggcaacgcgcccttcatcgtattcgacgacgccgacctcgaagccgccgtcgccggtctcatggcagcgaaattccgcaacggcgggcagacctgcgtgtgcccgaaccgcgtatatgtgcaagccggcgtctacgaacggttcggcgcgctgctggccgagcgggtcggcgcgctgaaagtggcgcccgccaccgacccggccgcgcagatcggcccgatgatcaacagccgcgcgctcgacaagatcgcccgccatgtggacgacgccgtggcgcacggcgcgcgcgtgctgaccggcggcaagcgccttgccgaactgggcccgcactattacgcgcccacggttctcgccgacgccaccgccgcgatgcagttgaatagcgaagagaccttcggcccgatcgtgccgctgttccgtttcgaagacgaagccgaagcggtcaacgccgctaacgacacgccattcggcctcgccgcgtatttctacagtgaaggcgtgaaacggatcgaccgggtggcgcgcgcgctggaagcgggcattgtcggcatcaacgaaggcgcggtcgcgagcgaagccgcgcccttcggcggcgtgaaagaatcgggctatggtcgcgaaggctcgaagtacggtctcgacgactatctgtcgatcaaatacctctgc

SEQ ID NO: 28653 - DNA, 1557 bp, Burkholderia fungorum
atgccccaatccgcagacaggattctcgaccacgaactgctgttccgtgagcccgagtaccaggaaattttccgcacaaaaaaggaaaacttcgaattcaaccatccggacgagcaggtcagtcagatcgtcgaatggaccaaaaccgaggactacaaacagaagaacttcgcgcgcgactcgctgaccgtcaacccggccaaggcttgccagccgctcggcgcggtgtatgtcgccaacggctttcacaagacgctgagtttcgtgcatggctcgcagggctgcgtcgcctattaccgctcgcacttttcgcgccacttcaaggagccgacctcgtgcgtcagttcgtcgatgaccgaggacgcagcggtgttcggcggcatgaacaacatgatcgacggtctcgccaacgcgtacaacctgtacaagcccgagatgatcgcggtctcgacgacctgcatggcggaagtgatcggcgacgacctcgacgcgttcatcaagaacagcaagcagaagggcagcgtgccggaagactacgatgtgccgttcgcgcacacgccggccttcgtgggcagccatgtcaccggctacgacaacgcgcttctcggcatcctcaagcacttctgggacggcaaggccggtacggccgcgccgctcgaacgggtggccgatgagagcgtcaacttcatcggtgggttcgacggctacgtggtcggcaacatgaaggaaatccgccgcatcttcgatctgttcggcgtgcaggtgaacatcctctgcgatccgtccgaaacgtggaatacgccgaccgacggcgagttccgcatgtacgaaggcggcacgaccaaggatgaggtggagcgcgctttgaacgcgaaggcgaccttcgtgttccaggaatactgctgcgagaagaccagcaagttcatcgccgagcatggtcaggaagtcgtggtgctgaacgcgccggtcggcgtggcgggcaccgatcagtttctgatggaaatctcgcgtgtggccggcaagccgattccggcgcaactggagaaggagcgcggccagctcgtcgacgcgatggccgatagccaggcgcatctgcacggcaagcgtttcgcgctctatggcgacccggaccagatgctcggctacacccagttcctgctcgaactcggggccgaaccggcgcacgtgctggcgaccaacggcggcgaaacctgggctgcgaaggtgcaggcgctgttcgacgcgtcgccgtacggcgcgggctgcaaggtgtatccgaaacgcgatctgtggcatatgcgctcgctgctgttcacggagccggtggatttcctgatcggcaacacctacggcaaatacctcgagcgtgatacgaaaacgccgctgatacgcatggtgttcccgatcttcgatcgccaccactatcatcgcttcccgacgtggggctatgaaggcgcgttgcgcgtgctggtcacgctgctggacgaattcttcgaagcgctcgacgccaacacgatcgtcgcggcgaagaccgactacagctacgacatcatccgc

SEQ ID NO: 28654 - DNA, 348 bp, Burkholderia fungorum
ctgatgcgtgccgcgcggcatggcgaagacgcggtggtcgaagcattgctcgcattcggcgcgcgggccgacgcgctcgacgacgacggcaaccatgcattgtggttcgcatgcctgcgcggcggccctgcgacgatcctgcgattgatcgaagccggctcgcccatcgaccatgcgaacgacgacgacatcacctgcctgatgcaagccgccgcgagcggccggctcgacgtcctgcgaatgctgcttgcgcagggcgcaagcgctgaactgtgcgcgcccgacggacgcagcgcgctcgacatggccgccgacctcggcctgcaactgctgcgcgcggcacgccag

SEQ ID NO: 28655 - DNA, 1869 bp, Burkholderia fungorum
atggccctcctgcagatcgccgaacccggccagagcgccgctccgcaccagcaccggctggcggcgggaatcgacctcggcaccacgaattcactggttgccacggtgcagagcgcagtggcccgggcattacccgacgaggacggtgcctgcctgctgccgtcggtggtgcgctacacgcgcgccgccgaacccgaggtcggccgcccggcccaggcgcgccaggccgaggacccggtcaacacgatcgcgtcggtcaagcgcttcatgggacggcgcctcgccgatctgccggaagccgcctcgctgccctaccgcttcatcgaccagacaggcatggtcggactcgctaccgccgctggcgagcgctcgcccgtgcaggtgtcggccgacattctgcggaccttgcgcgtgcgcgccgaggcatccctcggcggcgaactggcgggggttatcatcacggtgcccgcctatttcgacgacgcgcagcgtcaggcgacgagagacgcggcgcacctcgccgggctgacggtgctgcggctgctcaatgaaccgacggccgccgcgatcgcgtacggcctcgaccgcgctgccgaaggcgtcttcgcgatctacgacctgggcggcggcacttttgatatctcgatcctgcggctgtctaaaggcgtgttcgaagtgctggccaccggcggcgactcggccctgggcggcgacgacttcgatcgcgccattgcgcagtggttctgcaacgggcacggtgtcgaaggcctcgccatgctggcgccctccgcgcagcgcagtctgatgatggcggcccgcgcggcgaaagagacgttatcgcacgccgggtccgcggtgatcgcgcttgcgcacgccgaccgcagcatctggcaggcggcgctgtcgcgtgcgcagttcgcggaattgggcgccgcgctcgtcgcacgaactctcgcggccacgcggcgtgcgttgcgcgacgcgaaactcggcacgggcgatatcgacggcgtggtactggtcggcggttccaccaggatgccgctggtacggcacgccgtgcaggaatttttcggtcgcgaaccgcttgccgatatcgatccggatcaggtggtcgcgctcggcgcggcgatccaggccgatgtgctggccggcaaccgcaatggcgacggctggctgctgctggacgtctgccctttgtcgctcggcatcgaaacgatgggcgggctggtcgagaaaatcatcccgcgcaattccacgctgccgaccgcgcgcgcccaggaattcaccaccttcaaggacggccagacggccatgtcgctgcatgtcgtgcagggcgaacgcgagagcgtggcggactgccgttcgctcgcccgcctggagttgcgcggtatcccgccggcggttgccggcgcggcgcgcgtgcgcgtgagttttcagatcgacacggacggcctgctcgcggtcaccgcgcgcgagcagaccaccggcgtcgaaacgcacgtcgaggtcaagccgtcctacggactgaccgatgtcgagatcgccgcgatgctgcaacaggccatcgacgcgtcgctgcccgatatgcagttgcgcacgttgcgcgaggcgcagatcgacgcacgccgtctgctcgatgcaaccgaagcggcactggacagcgacgccgcgctcctgtccgccgacgagctggcggccgtgcggcgcgcaatgttccaggtcggcgaggcgctggagaccgatgcgtgcgtcgatctgctcaaggctgcggcgacggatctcgcgggcgcgaccgaaaccttcgccgcgcggcgcatgaacgcgtcgatccgcaatgcgctcgccggacgcaacctcgatacgctg

SEQ ID NO: 28656 - DNA, 1293 bp, Burkholderia fungorum
cagttcgatgcgatcgtggtcggcgccggtccgtccggcaacgccgccgcctatacgatggccagggccggcctgaaagtgctgcagatcgagcgcggcgaatatcccggcagcaagaacgtgcagggcgcgatcctgtacgcgaaggcgctcgaagaaatcatcccggacttccgcgacgacgcgccgctggagcgccacatcatcgaacagcggatatggatgctcgacgacacctcgttcgtcggcacgcacatgcgcagcgaggaatacaacaagccgccctataaccgctacacgatcatccgcgcgcagttcgacaagtggttttcatcgaaagtgcgcgaagccggcgccttgctgatctgcgagaccacggtcaagcaactcatcatggacggcgatcaggtggtgggcgtgcagtgcgatcgcgagcatggcgacgtgtacgcggacgtggtggtgctcgccgacggcgtgaattcgacgctcgcgcgcaaggcgggctttcatggagagatcgaagccggcaacgtcgcgctcgcggtcaaggagattctcttcatgcccgaggagacgatccgccagcgctttaacatcggcgaggacgacggtgtcgtgatcgagatggtcggcaggatcaccgacggcatgacgggcaccggctttctttataccaacaaggaatcgctcaccatcggcgtgggctgcatgctgggcgacttcaagaagaaccccaaccgcacgagcccctacgtgctgctcgaaaagatgaagcagcacccgtcgatcgcaccgctgatcgcgggcggcgagatgaaggaatattgcgcgcatctgattccggaaggcggctttcacgccatcccgcgcgtctacggcaacggctggatgatcgtcggcgactcgggtggtttcgtgaacgccgcgcaccgcgaaggctcgaatctcgcgatgaccaccgggcgcctcgccgccgaaacggtgattcacgcgaaagccgcgggcctcggctatcgcgcggccacgctcaaggcctacaaggccgcgctcgaccagagcttcgtgatgaaagacctgcacaagtaccgcgacatgccggccgtgctgcaccagaatccgcagttcttcacgacctaccccgatctcgtggcacgcgccgcgcgcacgatgctcacggtcgacggcaaggacaagaaaagcaaggagcgcgaaattttttcgagcttccgcaaagcccgttcgcttgccggcatggtgggtgacgcctacaaactcctgagggccttccga

SEQ ID NO: 28657 - DNA, 836 bp, Caenorhabditis elegans
ttcattggagactattctatcaactatggtacataccgtctggctaacattatgacggatcttcaacacgatgtatacttctatcagtttgactatcataactctgcaggattcggagtgttccggtggcttcttccgtttttgggtgagtttaggcaggatgggtcagattttctaagctctgggccacatgctttttggtagatcagttttagaaattctaagctagaaatgtatgagtatggtaaaacttttaaatcagattgaaaagaaattttccaaattataggactttgtaaaaactccgattgcttaggctacttcatccgtacgaccgtaacctgtcactaacgattctaatagtgtaccttatctgaacagtattgccgaactaattgaaattaatcctgagactccgagattacctagcggtccctatcgctgtggcccagtgcccatttggctcaatatccaattttcaggctccacacattgcacggaaatgagatatgtgctcggcaaaggaataatctcgaaattccgaccaaatgataatgataagaagatgcttcacgttatgacaacttattttacaaattttgcaaaatatgggtactttttttgtgaacactttcgaaaaaaattaagctgctttcagaaaccctaatggagaaaaccaggagactggagaatggcaaaagcacgactcggcacacccgttccgccatttcaagattgatctggacgattctgaaatggttgaggactatcaggaacggagagccgagctatgggataaactgagagcattaaatgttagcagggctcagatgtga

SEQ ID NO: 28658 - DNA, 553 bp, Caenorhabditis elegans
atgggctctcgtgacgatgaatacgactacttgttcaagggtaattttgtttttcatttttcaattcccaaacgaaaaattgtttcagttgttctgattggagactcaggcgtcggaaagtcgaatctcctgtctcgtttcacaagaaatgagttcaacttggaatcaaaatcaacaatcggagtcgagtttgccacgagaagcatctcggtgaggaacttcattagaatacacttatgattcaaattattatttttgtaggtagaaggcaagacagtgaaggctcaaatttgggatactgctggacaggaacgttaccgtgccatcacatccgcttactatcgtggggctgtcggagctctcctagtctacgacatcgctaagcatgtgacgtacgagaatgttgagcgatggttgaaggagcttcgtgatcacgccgatcagaacattgtgattatgttggtcggaaacaagagcgacttgcgccatttgcgtgcagttccaacagacgaggccaagatctacgccgaaagaaatcaattgtcgtttattg

SEQ ID NO: 28659 - DNA, 526 bp, Caenorhabditis elegans
atgcctcctcatcgggctttcagcgtaatgtcatgtgcacttgtaatcggggcaacgtccacactgggtaaagccgtcgtgagaagactcgcgttcaccggctacaaggtcgccgccgccgcagactgtccgaatagtgtgggaaaggttgcagaggacaatataaaggtttaggcagattttcagaacttgacaaagagaaattcgggaataaattcaggttggaggtgacgtcacagctttctcattagacgtggcaaatgccgagcacaggaaggagctgatcacgaaagtggctgagaagctcggcggtctggacactttaattatagttccaccacagaatgaggtgctcggcgagattattgagacatccggcgaggattttgataaggttcgagagtgctgaaatttgaattccacgtggaaaattgacctcgaaaaaccaatttcagcttttcgccaacaatctgacaacaccgttccgtctttcgcaagccgctatgtcgacgctcgccaaatctca

SEQ ID NO: 28660 - DNA, 1509 bp, Caenorhabditis elegans
atgaattcgacggtggcttcccgtttctcatggggactcattctggcgtcgatcgattttttggcgtgcctactgttcgcctgcctgcatgatggaactttcaaattcgcgaattttacttcgcaatttggcgatttttcgttttttacgaggttcgattgattggtggccgagttaattttaggccacgaaaaatgaaaattgaagccgagtgtcattttcgctggaattctaattttcagtgtgtaaaaatatagaaaactgcaaaaaattttgaattcccgccaaaaactaacgttacgagacccaagtacagtggagcgcagttgcaaaaaaaaatttttaatgattttttgcaactacgctccacagtccttgggtctcacaacgttgaaactaaaattttggaatttctcccataacttcttataataacgatattcggtggtctcgacacgacatattttcattaaataaaacgggtgtgcgcctttaaagagtactgcagtttcaaactttagttgctaagcgtattttcaacaaagcaacgaaaatttgaacttacagtactctttaaaggcgcacgcccgtttttattaaaacaaaaacttgtcgtgtcgagaccgggcaccgtagttttgacgctaaaaataagatttatgaaaaagcgggtttccagaaaatttcacttttcaaactttgatgaaaatttgaagtttccagccaaaatcgctgcgagacagtggaacgagtgcagtagagcgaaattgctgtaaaattttgaaaaaaaagtgagaaatttaaaaacacggatttctggcctcccccgtaaattgaaatggaagagtttgccgaactaggccactttggctcgcccatatctggggtagatttacggcgcgttgcgtgtcgcgacgcgattttagttggaaaactaaatgtttttgcccgtgtggagtacacgactttcccacgtgttgtcctctaggtgattgtcaatggagcgcaaaaaatccaatgaggaaggccagaaccccgtgaaaaagtacgcgtttttgaagcaattcatcgaaagaagacagtaaaaaaaaagtcaaaaattcaaatttccaatagaaaaaccaccaaacccaacaatttttccagcacaatcgacctattcttgctgcaatttttccgttttgcactatggatggtgccggcggcaatccacgtggccaacaaggcggacacgttgacaatgtggaaagaggtcggtggccgcgtggcctagaaatcccgaaaatttcaaattttcagccaattttctgctcggcactgctcatctgcgcggcgagccccacaaaattgctcctcctcacagaaaagctgaagcccgatgagttcctcactttcggcgacactgccttccttgtctggaatttcatttccgcgatcattttgaactcctcgtggacaagatacttctcgcgaactccgtcttcatatataattctggaggatgaggat

SEQ ID NO: 28661 - DNA, 1419 bp, Caenorhabditis elegans
gtatcagcaaacttgcgaaaaattgaagagcaccgtcggaatagtgaaccatcgaaattttcgccgaatattgggactgcaaagcaattgttcgaggaacaactcgaattcttgggaaagcaaaagtaagggtttcagtaaatttttcaaactagagaaaactattcttgcggatttcaactaccagggatcctcgcgttttggctttttttattgtgcgaattatattgaaatccaatgaagacttcaggaagttgaaatccgcggaaactaatttccatgaaacctcgggaaaggtaatttctagaaattcgatccgcggaaactatgaaaatttagaaatttaggattccaacactctgattttttttaactgaagaacatgtcacaaaaactggatgttttttaaagattgaattaaaatttcgggtagttgaaatccgcggaaacaaatttccatgaacctcgggaaagctagtttctagaaatccagatttccggggattttttagctttcgcccaaaacaaataattgtagtttcttatgtcaattatgatgaaattgatgtaaaacactcgggtagttgaaatccgcgaaaacaaatttccatgaaacctcgggaaagctaatttctagaaattcaactttctggggttttttaaagtttccccgaaaacaaataattgtagtttcttatgccgattatgtgtgaaatcgagataaaaaactcgggtagttgaaatctccggaaacatatttccatgaaacctctggaaagctacttccgcggattaaagaacccgaatttttgtgtaaaacaacaaaactggttagaattattcaaatttacttgaaatttgttaaaatcgaggtaaaaaaattgggtagtttaagaccttgaatacatatttccatgaaacctctagtgacctctctctatggaaatctgtttccggggatttcggatactttaattaaaaaaaacaatttctcgtgtaatttttttcataaaatcgaataaaaactcggcaagttgaaatccgcggaattaaatttccatgaaaccccgagaaaattaattccgcggacatcaactactcggatttcccatcgcatttccccttaacaccactatttgtttcagagaacgccttttacaagagctcccaccactggctccggtcgcctcctcagaagatctttcctcatccgacgagaacgcaatccacgcgtcaagctccctttccgtcgaggagtacgcacttgatctcgacgcaccgcccgtattttgtctgctgcgctatccgactaagctccgcccaccgggtcccgcccatcgacgacgtcctgacttggatcttcggagaaaagcgttcgccaactcgcgtggcatcgtctcattttattcaccggtctaa

SEQ ID NO: 28662 - DNA, 1971 bp, Caenorhabditis elegans
atgtcttataacacttccttgctcatttttctctgcttctctgccgtctctctatccacacagtctttcgccgtttatcgattattacccaaatcacagacggattttcaagctatacagaggttatacaaaaatgcgacggatcatgatgtgagttttgttttcgcatttttgagcagatacaatttctaggccacgaaaaatttttctaggccgttgaaaaaatcactaagttttctaggtcacaattttgagcaagttctaggttattagattattacgccatggtgcatttttctaggccatcaggaaattttgcaggccaccatgagtttttgatgcagttgaactaagttagtggcctagaaaaacctttgttagcctagaaatattttcgccggcctaaacacatttttggtggcctagaaacactaacttttggtagcctaaaaattttctgtgacctggaaacattgttggtggcctgaaaacatttttggaggcttagaaatattcttggcaatttgaaaacatttttggtggcctagaaatatttctgatggcctagaatgtttttgtggtctataaataattttggcggcctaaaaaaatttggaatggcttagcaaaatttttttggtggtctacagccatttttaacgaccaagaaacatttttggtggcctgaaaacatttttggtggcctagaaacattcttggtggcctgaaaaaacattttcggtggcctagaaccatttttggagacctggaaatgttttggtggcctagaatatttttggtggcctagaatatttttgttggtctagaaatatttctgatggtctagaatgtttttgtggtctataaataattttggtggcctagaaatattcttggagacctgataacatttttggtgacctataaatatttttgacagcctaaaaattttcggtggcctagaaatatttctgatggcctataatgtttttgtggtctataaatatttttaatgacctagaaacatttttggtggccttgaaacattcttggtggcctagaaatgtttttggtttcctagaaacattcttggagacctgaaaacatttttggtggcctagagacatttttaatggcctagacacatttttggtggcctagaaatgttgctgatggcctataatgtttttgtggtctataagtattttcggtggcctaaaatatttttggtgacctaaaacatttttggagacctggaaatgttttgatggcctagaaatatttgtgctgtgctgaaacattgtcggtggcctagaaatattcttggagacctgaaaacatttttggtggcctagaaaaatttttagtgacctaaaaactttgggaattacctggaaccaattttggcgacctagaaaaattttccgtggcctaaaaattcccaataattaacaaatttttagttaaacttctggaaaacgggcaaggacaagcacgggttttgggatgtgatggtggatatgaagaattcgaaatattttttggactttctacaagtaaatgatatttcttacataaagacgattgatgacgtggaggggtgagctttttctgaaattttgaaaattacataaagaatatgtgctctattgataaactgttaggatcaccgtaaatcgacaagaatctccgtaaatccacaacggccccatctcaaaaattcctaggccacacgtgtgacgtcatttttcttccagattaataacaaagcacgagaacaacaagaccctctcgaacatgttcccccgtctgtgggatgactcctcgtctgctcactatgacttccacacctatggatcctatcagcgaatgactgattggatgaagcagctggtggtgaagtatccaaagatggttcagtatatatcgattggaaaaactacggagggcaggaatatcgatggagttgag

SEQ ID NO: 28663 - DNA, 1025 bp, Caenorhabditis elegans
atgacaaaatgtcaaattttggcgtctctcctgacttggagcttctgggtcttcagacacgttcttgtgtgtgaggcgagatgcgattaccctctatattattgatttttggagcattttttggttttctaggggctattcataatacagatgataatgccggctatcataagtaagtccccaaaatacccatatggcctagaaattcggaaaactcttccatttcacttttggtagggacatttggtttctgtgctagcttttatgctgaacatggtaatttaaatttcctaggccagtgtatatgtttttctaggctacgacatacaattttttaggccacaaaatatttttttttaattgcggcttataaaaatgttccataaattatctatttttgaattacagtctgaaaatttccatttttcaagggcacctttctaggtcacaaaaacggattttttcaacataggcatttttcaactttttctaggccacgacagatggaagagcttttcgtaaaaaaagctcggccaccaccccacctaaccaaaaaacttccagcttcaaactaatccgaatcaatccggaaactgaaggaagtgtgaaatatcttcgaagtctgtacgaggatccctctccgtacgagctggatttctggcagcctcctacgaatatcggttagtgtgacttacccacgtgatgttagcgtgctccattttagtttgatctacgtagatctaccaaaaatgcgggagaagagacgcaaagttctcaactgattctgcatggttaagaacgcactgacgtcacattttttgggaaaaaaatttccgcattttttgtagatcaaaccgtgatgggacagtttgccaccacgtgcttacccaggaaaatctgaaatttttcgaattttcaggagctatcgtagacttgacagttgctccggcggatgctccaagatttgtgaaggatttggaatcgaagaagatcagctacatcgtggcggttaatgatttgtcaaa

SEQ ID NO: 28664 - DNA, 839 bp, Caenorhabditis elegans
gtaaagacattaccaggctacacccctgaactgttccccaggtatcgggagttgtcgttcatcgcggtgaacccgatgttcacgaagattctgaagactggtcaggaacttctggggatgcttcttcaggtaagtagacttgtaaaaaccactcctttagtcccgaaaagaccgaatatcataataaaacgtttcaaaaaaattttgaaaattttttatttactgtaattttaccactcataattttggaagtcgaccaacaaaaaaaaaattttttttcctacatttttatactgtaattgtgttttaattatttgtattaaaatattgtaggggtcggaacatgcgacattgctctagatttcctcaattgctcatttttcaaaattttagcagtttgccaaaaatttgacctgaaattgtgaaaaatctaattttttggattgttttattatgaaatttggtttttttttcggatcattatgtatgtattttgacaaaattttcactggcgctactccacctttaagtcagtccaggcctactagtctaatctttgacaaatcagtcttcgcgagctatattgagcagcaatctttgagtgcaagctcaagccgaaagcttaagccctggctgcaatgctagtctaaatgaatcgacatcgagctacacctatcttgtaaccctcaaaattacagctccgcccggaaagccgtgtctccgcagccagtgcaatgcttcacccctactttgcctcattcccccgcgaggttcatctcctggctccaagccagtcaatattccggctcaaagagctgaaagatctgcgatcactataa

SEQ ID NO: 28665 - DNA, 1501 bp, Caenorhabditis elegans
atgcgccttatggggtgcgtcggcgctggcgctgatgccgaaggccgagaagcacgcaaggtcaacaagcagatcgaggagcagttggctaaggataagcaggtatgtttaggaattggtgggtttttgtggtttttgttcatcgtcttccccccgcccccgcgtcgccataatttccctcccttccaaatgatctgccattaaaccggtaagcctctagcaacacatcgttgaaatattgatcgatgggtggaaaggaggggggagagggagggcttcgaattttggaggccgccaggcggcgaggggcgaagagttcgtcgctctgccccgggggcccccctccggcggacgatgaacaaaaacgcgttgtaacagatcccatcctcaacacatacacacacacacaccaaacccagttttgtaggtgatgcgagcgactcatcgcctgctgcttctcggcgccggagagagcggcaagagcacaattgtgaagcagatgcggattctgcacatcaacggattcaacgaagccgagaagcgcgagaagatcaccgacatccggaggaacgttcgcgacgccatgcaggtctctgaaaaagattccagagtacttggtagtagtagtagtagtagttaaggtggtggtggtagtgtgggcagttgataaacaaatcaagcagcaggagcaccatgtgtctcgcggcgcccgtcgtatcggtggagccgctgctgctgctgctgctgctgtgctgaaagtgtctgggagagcgtgtgtgtgtatgctatttttagcctcgcgcggtgttatcgattttaaggcatataatgcatacaaatgtgtcagctggctgatatttctccctttgcggacgctaggcgcgctctttttcgagacgtgtgtgtgtgtgctcctgtctttctctactctcgcccgcgcgcccccagaatttccgtctttcttcttcttcttcttcttcatcttcttcttcttcttctacatcttcttcttcttcttgcttgccgcttggccggggccgcgccccgcgcaagagctgtgtgcatgtgcagacagaagatggaggaggaggaagaagaagagagagagagagagagagagagagagagagagagaaaagaaaaagaaaaagaaaaagaaagagaagtgtgattttgtggaagagacaagactctatgtgtatgtgtgtgtgtgtgccccccctatgataaattgaattttactgacagagcagcactttttgtatagagagccctattgagaccaattatatcaatataaatcaataaagctctaatttgagctacacaagggaaactgagcaaaaaagaacgagcaacaaaaaaaacgagatgattgcaggtaatcttgcgagcaatggacgagatcgtgccgaaagtgtcgttggacgacccgagcacggcgattagccgcgattatattcttcgaatcaccaacgatccggaagataactacccttca

SEQ ID NO: 28666 - DNA, 555 bp, Caenorhabditis elegans
ttctggtcgggatccgagttggccaaacagttcgtcgactccctcctcgaaaccaattcagtggagcgcctcagctcatcggcggccatgaaacacgagtggctcaccggagagcggccctcgacgacgcagagcaggccgccgaccaggcctacgtcagagtataatagcatgcaaagggtaagttttggcaatgcacgtggtgtcagagtgtatcatttcggcttgatctacaaaaaatgcgggaaaagagacgcagagttctcaactgattttgtaaggttaagaacgtgctgacgtcacatattttttggcgaaaagttcccgctttttttgtagatcaaactgtgatgggacaacctggcacaacgtggcaatggaaactttttgaaaaataaaaaaaaatcaaaatttatccagaccaaatctactcgttcaatacgatcggtcacacgatccgatcacggacatcgcgtggatccacgtgaagttgacgagctggcaaatgacttgaaacgggtcgcgcagacgactaaaaattacggtgttttttga

SEQ ID NO: 28667 - DNA, 1400 bp, Caenorhabditis elegans
acttgccatcttccgcaaggcatgtgctctgctcgagaactctcgtgaaatgactgacgtaggtttttctttgatcttcgaaaattgcgcgccaaaatttgaaatttaattttttaaaataacgagaagtttcaagtggaacacgaaaaatcagccgagaaacgggcggaacgtattatcgattttcttcgaaactctcaaaatttttcataaaatcaaaattgccgaaaaatcgataatagaccccgcccttttctttgttttacttttttcaacggaatttgagagtttccagtttaattgtttgtccattcagattttggctcgtatgaatgaatcgagtcaggataaatggcgtgaagcggccgactcgacgaccggtgagctcgatgagcttgtcaagacaatcaagaatgacgatttaaacacggaaattgatcgagctgtcaagtgctatgaggattgcgttaaacgcgtcgattccatcattgccgacttgaagtgagcaatttttttagggagctcttagagggagaatctcagaaatttggttgaaaaaaacatatttttaatgtgaaaatagaaattttccaaccgaaaactgaaatatctcaccacagaagcactttgttcgttagagcacgtctgcagaacaacgggctcacgggaattcaaattttttgtcaattctttggattaagagtgagaaaaatggttttgtaaaaagcgtttttccggaatttttcctcattgtatgtttttggaatgtgccaatttttgagagaaaactcaatttttacccgccaacagatttagttcaatagttcaatagagcgcaccggcagacgcgcgggaatttgaacttctctgttagcttgcaatgccacctggtgccaggctgtcccatgaaggtttgatctacaataagcgcggaaattttttgcccaacaaaaatgtcacgtcagcgcgttcttaactatacgaaatcagttgaaacgtctgcgtctcttctcccgcattttttgtagatctgcgtagatcaaaccgaaatgagacactctgacaccacgttatcgatttttcacaaaaccaacgatttttgtttaaaaaaaattaggtagctagcttctgaacaaactaacgattttttacaaaattcttgatttttcgaataaattatcgattttttacaaagttatcgatttttcataaaattaggttgcttctgaacaaattttgtaatccaacatttgttttcattcgtaaaattttcaaaaatattccaggttgcaattggaaaatgacgagctggccgaggtggagcgtgctcgcaaagaagccgaggataaggaacgtcgggaggctgaggagaaggcggctgccgagcaggagaaaatttt

SEQ ID NO: 28668 - DNA, 1494 bp, Caenorhabditis elegans
attttcaaacaaaaattcaatatcacaagtggctcatttcgcctcaaagaaattcaaaccttaagcggaaaatcgttcaaggaaattttgaaaattgtcgaggagctaccggatgaagtcaataaagagcaagttattgatctaattggtgccgataaattggaagaatgtcttacagagaatacaagatcatgtaagcacagtgttttagcagaaaaaaatagagatttttcgcgctccattgacaatctcctgccggacaacgcgtgggaaagtcgtgtactccacacggacaatcacaattagttttacaactaaaaccgagccgcgacgcgacacgcaacgcgccgtaaatctaccccagatatggtcgatcaaaaatggcctagttcggcagaaactcttccatttcaatttatgagggaagctagaaatccgtgtacagaaatttgagaattttcaaaaaaaaatagagcgtggcctagaaaaagcgagacatcggccactgatattttaacaattctaattttgttttcaaattttttgatttccgaaattttcttttaatcagattttttcaaaaaaagatttaaaaaattcagaaatgtttctttttcgaattttttggtttccaaaaaaacaaaaaaaaaccatttttttgagttatttgaaaaatttaaaaaaaaaaaatttcttttattatttgaattccgtaaaattcagaaaaaattcatattaaaaaaaatattcgaactccgaaactccgaaaaaattgtttcgaattttttaaaatggatttctggcttccctcataaattgaaatggaagagtttttgccaaactaggccattttggctcggtcgtatctggggtagatttacggtgcgttgcgtgtcgcgtcacggctcgattttagttgacgactttcacaggcgttgtccggcaggcgattgtcaatagagcgcgaaaagttaaataaggatggccagaaccccgtgagaaaattgttaaatttttatatatttttttaatgtttttttaatctgaaaaaaaaagcatttttcgaatttttttcagaaattaaacaaaagaacattaggatgtgaaaaatcgaaacaagacccaaaatataattttttttcagtccaaaaattcaaactccgcccccgcgctcgtcacgtgttcagtgaggcctatcgtgtggaacaattcgaatcggcgtgcgcccagaaaaacattcaagaaatgggacgtctaatgaacgagagtcatcgcagttgtgccattgactacgagtgcagttgtcgggagcttgacgagatttgtcggctctatttggaccatggagctctcggagcacggcttaccggagccggttggggaggatgtgccgtcgtgttgatggccgctgatgacgtggatcgggtggttgccgagttgccgtcgttgttcgtgtcgaagcctgctcaaggaattcggcttcaacgattttaa

SEQ ID NO: 28669 - DNA, 570 bp, Caenorhabditis elegans
gacccccacgcgatccgatcgccgcccgcgagtttattctcaaaatgtttgtcgacttgaatccggacgccgacaagattatctactctcattttacgtgcgcgactggtatgtcttttctttgtttgctaggtggaaaatattcgagcacggggttctagccttcttcattgaattttcgcgctccattgacaatcgtgtctgccggataaagtcgtgtactccacacggataaataaattcagttttacaactagaattgagccgcgacacgcaacgcgccgtaaatctactccagatatgggcgagctaaaatggcccaaactcttccagggaagccagaactccgtgttcgagaaaagcacttatggtagccacgggttaccgattcggtgtcccatggacacttagagttgctcatggcgaattactaaaaaattgtttaaaaatatctaaaattttcaaataaaagggacctctatttcagatacggaaaacattcggttcgtgttcgccgccgtcaaagacacaattctacagcataatctgaaggagtacaacttggtgtaa

SEQ ID NO: 28670 - DNA, 977 bp, Caenorhabditis elegans
gtcggctatcgatgaagtcttagatccaatcgatgaagacgcagtagaaacatcaaatccatcaacttccacacatatgttcgtaacgaacaaggatgagctgattgcgaagttcaaggaacttggtcacgtatcagatgagccgtcagcaaagccagtcatggttggaatggttggctatcctaacgttggaaaaagttctacgatcaacaagctggctggtggaaagaaggtttcagtatcagcaacacccggaaagacgagacatttccaaaccattcacatcgacagccaactatgcctttgtgattgtcccggacttgtcatgccttctttctcttttggacgaagcgaaatgtttttaaacggtaactcgtagttttaaaataatattttccaaattcgattcgattgcaggtattcttcccgttgatcaaatgcgtgaccacttcggcccaacgtcgcttctactctcccgtgttccagttcatgtcatcgaggcgacatactcgattatgctgccagagatgcaaagtccttctgcaatcaacttgcttaactcgctcgcgttcatgagaggatttatggcgtcgtcgggaattccggattgttccagagccgcgaggctgatgttcaaggatgttgtcagtggaaaattgatttgggcagccgcacctcccggagttgagcaagaagagtttgaccgaatctcctatccagacaagaagactcgtgatattggtcgggtgcagatggaaaagcttgccaagcttcagcttctcgagggtgatgagttgaagggatcacaatttgactctcaacactttgtcggatcaatcggagttgctcatgtcagagattcaaaagcattgcctcaaacgttaggaaccgtcattccaactgctcctaccgaaaacaatggaaagaagcattacaagggaaagaaggacaaattgaggaggatttataatgaataa

SEQ ID NO: 28671 - DNA, 789 bp, Caenorhabditis elegans
atggacagtaagagcaacccgttcagcagagacaagccccttatcgacctcaaatatatcacctttggattctcatttcttcaaggtagctggccaagtttggagcaaaaatctaaaagccaaaaactttcagagtcaatagaccgagcaataatgagtgagctcaccaatcagacggacgcaaatctgggagtatatgctcagcaagagccctatccctgcacagtgaaggatacgtaagtgactagagacgcacgtggtgtcaggctgtcccatatcggtttgatctacaaaaaatgcgggaattttttccccaaaaaatagtgacgtcagaacattcttagttctgcgaaatcagtttaatttcccgcgattctcgtagatcaaagcgatatgaaacagcctgacaccacgtggaggcgcatacaatttttcggaaaagtttccagattcaacgtggcactgttcatgcccctctttctccttatctccttcatttttccatcggcacttcttgtcaagaatattgtctacgagaaagagcagaagattaaggtattattttttcttcacctatacctttacctacaatacccttccaggaacaaatgcgcgcgatgggtcttggagacgccgtgcacttcatctcatggggcttgatctcactggtgctcaacttcatctcggtgctcattatttcaatcatctcaaaagtcgcaaaaatctttgactacacagactacacacttttgctctttgtgctaattttgttcttgttttcttctatag

SEQ ID NO: 28672 - DNA, 308 bp, Caenorhabditis elegans
ttcaccgcattcatttcgtcgtatgctcagctgtacgcacaaattgcatcaacacttgcaccgatcgttatcggacggattacgagtcatgtgagcgcttttagaccacccaaatgtcgtccattatatgatttcagggcacaatttacgagtggaagtgtgcattttatagtttggccggagttttggcagtgacggggctcattttccaaattttcgggcatggtacggaaggcggcacgcaacgcagcacgcaacgctgcacgcagcgcagcacgcaacgcagcacgcaacgtgacacgcaatga

SEQ ID NO: 28673 - DNA, 1142 bp, Caenorhabditis elegans
ttcggaaacatcatccgatccctgccaccagtctcctatgtaaaagccatcgatctctggatgtgcacctgcgtcggcttcatcttcgcctccctcctcgaactcgccttcgtcgcctatcaggacaaaaagctcatcttaaaatccggaaaatcaaatgcagcaatcagcactttggtcagctatctgaaacactttgagccataccatgacgtgtcgtctccgccaccaccggctccgcttgatgagaaaaaatcgatgagccgaacgacatcgactggtacgaatcgatcgagaagtgaacttgatggtttggatacgaaggatttggaggaggaaattgcggagtatcggaagttggcgtatgccaggaagaaatggagattgttggattttggagcaaatgttgataggatctcgtttattgtttttccgttggtaagttggaagagtaatgtagggttactgtagggtagctgaggggttactgtagaaatgctgtcggaatactgtatggttactgtagggttactgtagggctgctgtaaggttaatgtaggaatactgtaggattgctgtatggttactgtagggttactgtaggaatactgcatggttactgtagaaataatgtagggttactttaagattactgtaaggctactgtaggagtactgtgtggctactgtaggaatactgtagggatactgcaggattactgtaggtctacttaagggttacagtagggttgatgtgaggttgctgtaggaatactgtagcactactgtaagcttgctgtaggagcactgtaggaattatgtagagcaacagtaaggttactgtaccgttacagtgaaattattgaaaggtatgaatgactactctagggttattgtaaagtactttaagggtacagaagggtagcttaatatttattaaattaccaacacctatcttgcatggtggagtacggtaggattactgtacttttctccaatttctgaattttcagactttcgcagcgttcaatgtggtttactggacatattaccttcaagacgtgcggatatccacttggacctgattttaatttttttttttttgtaatttttgtgctcacttgttcacgaatttctcaataa

SEQ ID NO: 28674 - DNA, 391 bp, Caenorhabditis elegans
gaataatggcttgggagatcactgagaatgggaaggagccgtacccagacatgagagttgctgacgtcgtcggaaaggtccgtaatggataccgcatgcggtttgatccggtctttgtggacttcagattcggcgactatgtcacggttggtttgaatctgaaattatagctaattactaatttctcatttttcagaagcactgctgggctgaaaatccggcggatcgtgtgagcatggcggatgttctgcgctatcttcagacaacttttgggatgaagccagtggttctatcgattctatcgagcaatcgctcgaccgaggaggagatgaagacgatgaagccgccaatgttctcggtgaagagaaacaacaagaagaagccgaagtga

SEQ ID NO: 28675 - DNA, 351 bp, Caenorhabditis elegans
caacaagccaccgacttctgcaaggccaacaatctgaaatgcattgtacgaggacgtcaaatggtggatgaaggttatctgaacaagcctagagaagtggtcactttgatttccgccgtcgcctatctcgacaacttccggaatcacgcggcagtgttgcaagtggataatgataaggtgagcaggcacaaaaatgttctacagtagttttagtgagtactgtaggactaatgtagatatacagtaactttgttctttcagggaaaagtgatccgctacaaaatggaagaaggcgagcaactgtcgctggagctggtcaagcctggaatgggaagaaatgcagtttcttaa

SEQ ID NO: 28676 - DNA, 1196 bp, Caenorhabditis elegans
gagccaccagcgcactagctgatcgtatcaatatcaagcgaaagaacgcgtggccacaagcctatctgtcagttcaagaagttatcgattgctccggtgcgggaacttgtgtgatgggcggagagccgggcggtgtctacaagtatgctcacgagcacggaattccacacgagacatgcaataactaccaggcgagagacggaagtaagtgtgtgtgtgtgtgtgtgtgtgtgtgtgtgtgtgtgtgtgtgtgtgtgtgtgtgtgtgtgtgtgtgtgctgttttgagggtgggggaccaaactacgaaaatgctaaatttcatgacgtttttgcggatttttttgttggaaaagtgcaaagtttttcggttgaacagactagtgcaagaatttagaatttccaagcttcgcatgatttctgtggaaagctgcaaaaatggcgcaactggtaacgcatttgcctcccatgcgcccctttccaagttcgaccccccccaacgctgggcgcccggaacaggttatgcgccaagtggtgccagagtgtccctgatctttgagaattgcggaaatttagacgcgtcgaaagttcccgcatttattgtagatcaggccgttaagacacagcctaactaatttcgcatgggttaagaacgtgctgacgtcaaaatttttgggagaaaaattcccacgttttttgtagatcaaaccgtgatgggacagcctgactccacgtgcttctcaaaattcggtaacaatcaaaaactaattttccagaatgcgacccctacaaccgttgtggctcctgctggcccggcgagtgcttctccatcaaaaactacaccctctacaaggtctccgagtacggaaccgtccatggctacgagaagatgaaggccgagatctaccacaagggaccaattgcctgcggaatcgctgccaccaaagccttcgagacctatgcaggaggtatctacaaggaggtcactgatgaggatatcgatcatattatttcggtgcatggatggggtgtagatcatgagtctggagttgaatattggattggaagaaactcgtggggagagccatggggagagcacggatggttcaagattgttacctcgcagtataagaatgctggaagcaagtataacttgaagattgaggaggattgtgtttgggctgatccgattgtttaa

SEQ ID NO: 28677 - DNA, 1372 bp, Caenorhabditis elegans
atgaaaaaagctcagattggttattaccgaagaagttctcgtttgaaattcgattcttctcactcaactcttcgtctcgtcgaaatggcatcgcaatttctccgttcaacaaactcgcggtatgtcgctggagtgctcgctgctcttggagccggatccgcagtctacacactcactccacaggtaattctaaagccaaaaaagggcaattttcagaaatatttccttgctccctttaatcagggaccgcgcaactctgaagccaatttgagggggctcccagcgcagctgcgtccggagcggtatgcccagaacacgtgatttgtcatcattttgaagtttgtaaatcaacttttctgtttgagccgttccacgcgcgagctgaaactctgacatgagaatatatattctgggagtcgatttttcagaaaaagctttacaaatctctaattataatttttcagcaacttcaagccaaatccgaagtcgacgctgccacgatcaagaagatcgaggaggcctacgccaagctcaatggtccagaaggagccaagtgcaagtcgctgctcaagaagcatttgaccaaggaagtcgtcgagaagcttaagacaaagcgcacaaaggtcggagcaaccctttacgactgcatccggtcaggtgtctacaatttggacgccggagttggagtctacgctccggacgctgaagcttacactttgttcgctccattgttcgacaagatcattgaggattatcacggattcagtccaaagcagaagcaaccaccagttgatcttggagagggaaagactaaggaattcccaccattggatccaaaaggaaagtacatcaagtcgacgagaatccgatgtggacgttctttgaagggatatccattcaatccatgtctcactcaggacaactatcttgagatggaaggaaaggtgaagaaggcgttctctgaatattcggacaaggaactcaagggcaagtactatccattggatggtatgggcaaggatactcagaagcagctgattgctgatcatttcctgttcaaggagggagatagacatcttcaatacgcaaatgcctgcaacttctggccaaagggacgtggtatcttccacaataacgacaagactttcctgatttgggtgaacgaggaagatcatatgagaatcatttcaatgcaagaagggtctgatgtcggagctgtgcttgacagacttatcaagggagttcgcggaattgagaagcaggttgattttctaataaggctccgaaactcaacatattatgttttccaggttccattctcccgtgatgaccgtctcggatggctgacattctgcccaacaaacctcggatc

SEQ ID NO: 28678 - DNA, 353 bp, Caenorhabditis elegans
gttccattctcccgtgatgaccgtctcggatggctgacattctgcccaacaaacctcggatcaacagttcgtgcatccgtccacattgctcttccaaagctcgccgcccgcaaggacttcatcgagatttgcgagaagctcaatctccaagtgcgcggaatccacggagaacactcggaatctgttggaggagtctatgacatttctaacaaggtaaataaaccacgttttttgttgaaaaatcaacatttccaacttctcaggctcgcctcggactctcggaatatcaagctgtgaaacaaatgtacgacggagtgaagaagctaattgaaatggaggagaagcagaagtaa

SEQ ID NO: 28679 - DNA, 1318 bp, Caenorhabditis elegans
atgacttcttcgaatgaggtaagtaatgttttgggcctacctgcttgaaggtctacaagcctgcttacaagccttgtgcggcgagtcggcgccttacttgcctactttcgcaagccattaaaatgcaaaaaataggcggcaggcgggaacataggcagggaaccagagacttgagcctaagcctaggctatgcctaagcacaagcctaagcctaagcctgagatcaagcctaagcccgaatctaatattaacattttcagaaacttccaaaaatcaaccatgacaacgaagttttcgcgttgctgtacaagatattgtcatccgaagttcagactataaaaggagaagacaatgagaaagtcaatcaactgagagtggacattaccatctcagaaatctcgcagctcaccgacaagatgaaaaaagcgtttttggagcagccagctctcctggaaattagcaatgagccaatcacagtggtcgccgatatgcacggccaatcgattcacctgctccgaatcttcctgacaaatgaggctcccccgaatcaaaagtacttgttcctcggggactacgtggaccgtggatcacaaagtgtggtggtgatgtgtcttctgttctgcatgaaacatcgctatcctcagcatgttttcttgctgcgtggcaatcatgaagacgtcaatactacgctgaactacggattctatgatgaatgcctggagcagtggaagaacgatgaaggagagaaagtgtggagaatgttcattgatactttcaattgtatgccgttggcggcggttattggagggaaggtgttctgtgcacatggtggaatttcgccttggctggaaagtttggaggatattaattcggtaaggaaaatttttagccaattactataatttcggatcctaaattggatccctcgccatttgatctgcaaaaattgcgggaaattaattgttacatggtgtgacgtcaccggcgtcgtgtagtatagttttcccgcgatttctgtagatcattgacgcatcatttttcaatggaagaaaaatcgccgcaaatttccagaaaatccaattaactttgaaatatgttgataaaaaatcttgattttcagatcgagcgtcccttggtggtcccaccgtacggcctagcgtgcgatcttctctggtcggacccggctcagccggaacgcaacggctggggcctcagtcaccgtggaatttcattcacttatggcaaaagtgttgtcgaagagttttgtgcgaaaaatgacattgctctggtgattcggggacatcaactgtttaaggag

SEQ ID NO: 28680 - DNA, 3475 bp, Caenorhabditis elegans
atgattttttttcaaaattttgatcacacgaaattgaagatcccaaaaaatcaatttttgtcgaaatttcaactttttccaacgcattttccatttttcgacagcaaaaccgtcctattttcagaagaaatgacactggaagaaaaagaagaagtatcaacgtcgacaagccaaagcccccagtcttcttcgtttgaaaacgttttttgcgcgatttgcggagatagagcaactggaaaacattacggagcgatgagttgtgacgggtgtaaaggtaattggagtttagttttttgattttaaaacgtgattattctgcttaatcacactcaaaattgcccaaaaatgacttcttaagaaggttttttaaagaaaaatactgaaaaaatggcataattatagctaaaatccaatatttggcaacttacagccgcccgaaactgatttttatttgattttagcactattttgcatattttttgtcgttatttcgttaacttaagagcactttcagacgataggtaattgatagacaaatatcggctagaaattacctaagtcgccgaaaaaacgtcacaaattacataaaatatgcaaaaaacagccaataaaatcaatttccgaccggtgtacatcggaaaatgggaaaaattgcagatttttgctaaaactaggaaaaattccgtatttttgagattttcagtcaaaaaatacctcaaaatctggcaaattgctcaaaaatgaacatttttatacagaaaaatcaggaaaaaacggtccagcaagaaccagggcggaatattcgattttcttgattttaaacaatttttttctaatttttactgcattttcgggtaatttcgaccaaattatagcaaaatccgctgaatttcgagctaaaaacaaaacaaaaagtgttggcgtgacacatgtgtgctgtgactaccatctaaacaatgcactaatgcgttatggcacatagtaaatgaagtgaactgagaatttggaggagaaagcttgtgtgagccctctccagagagaaaagggtttctctttttaatgctccaacggctcttgaaatcttgggggggggggtcacatttcgttccggaataacaaaagatgtatagagaaaccgattttttagacgatttccttttcggaaagcaaaaaaggcgggaaaagaggcgcggagcggctttttaacggagaattcttgggatagagtagcgcagaagacgataattataagtttttcatactttgagaagaaaaatgcaaaaaaaaaaatacaaaaaaagcggagaaaatctaaagaaatcgaaaaaaagagcgaaaaattccgcgaaaacaatttaaacacttcacagtaccacctgttaaaggcgcatagccaattattttcagtgggtctcggcacgaaaactttttaatagcgcccaagactataagatgtggcttaaatgttttgataaaattgaaaattgaaaattgaaaattctaagttttaaataacaaattcttcaaaattttgcagttatatttctgtaaaatcaacgaagcaaaattaaatgcggtacagtacgtttaattaaaggtgcattacaattaatgtgttgataggcctcaccacgaaaacctttaaacggctcctaaaagcttttcaggtcgattaaaacatttttaaatattgtattaaattcctaaataccaaaccaaagttttaacttcagattgaactaatttgacatgtgaaaatagagatacagacgtcaaaaaaactgaacggtgcactgtaccagtaattaaagatgcattccgataacatcttgatgggtttcgccacgaaaatctcgttacagtgtgcaaaaggagggaattcaaatactttatggcaaaaatccatgcttttttttcaggatttttccggcggacaattcgaaaacggcactcatacgtctgccgattcggagaaaagtgtcaagtggataaaggtgagttctagaaaatcgtggcgggacctgatttttctcgttgtcacaattaaaataaggggttactgtattaattaaaggcgcatatactttttcgcggagcctacattttaataaattgctttcgtggcgggaccggctacagtaattttttttttacgaaaaaacacgaaaattcgcataataggaaagaaaatgtgtagtttctgttttatgtcaaaacagtgttccgccgggagctcaaaactcggaaatgtttgccattcctgtctacgaattccataatcatcatcattttcttcttcttcttccgcagtgtcctccttccactcgatatactagtgtatttgtattttcggtacaatgcatcacaccgctgcgctcatcttttttcataatcctcttggcccgcgacggaaatagtgtgcaatgagtggaggcgcagagacattttgcattcaatcatctctcgacatatgccatcttattggctactacttcagagggactgataaattatttgaaaaattttgcatttttttatgaatagtgagaggtaaagaaaatcggacatccttaaaaaatgtttaaaaacattaaaaatgtgaaacttttctcagttgacagttttgcctaatctaggggtggggggacaattgcgatccggcaaattgtcacattgtacaattttccgatttgccagaaatttcacttccggcaatttgccgatttgccgtaaaatatcaattccggcattttgctgatttgccgaaaattttcaatttcggaaaattgcgatttgccggaagttctcaattccgacaattttccgatttgccggcaaatttcccgaattgaaatttccggcaacttgccggaatttaaatttctgacaaattgccggaattaaaaatttccggcgaatcggaaaaatttttgtaattgaaaatttccggcaaattggcaaaccggcaatttgctggaattgagaatttccggcaaatcggcaaaccagcaaattgcaggaaattacgattccaacaatttgctggtttgccgattgccggaaattttgaattccggtaatttgccgatttgccggaaattttcaattccggtaatttaccgatttgccaatttgccggaaatttttaactccggcaatttgcctatttgccgaaaaaataaactgaccaaccaatcagcaaaaaaacccgttgaaagttaacattcaatcttaatttattaagacatgttgaacgatctgaaatcaaattcattgcagcgaaacgaaattcgtgtcgaaaatgccgattcgacgtgtgcctgcggaaaggaatgcgacgggatgcggtacaaacagaacgggatagaattcgaccagcaaatccgttaagcaacggaagtaatggaggaatagttccagatgatccccttcttgacacacttatcagagccgaggcatcgacaagaggattacg

SEQ ID NO: 28681 - DNA, 1230 bp, Caenorhabditis elegans
ggcgacgtattccaaaaactggcgaataagcaattcaaaaaagacgtgaacataatattcggaagtgtaaaagacgaaggaacatactggctaccctattacatgtcacttcccaaatatggatttgcattcaatcacacaatatcggctgaagatcctcataatcgagccctgattacacgagatcattatgaagaatcaatgagagcattcatgccatattttgctggttcgaaacttgtattgaatgcatttatgaattcttatgagcatgtatcgactagtaatgtacctgaagaacgatatcgggatggagttgctcgattcttgggagacttgttttttacttgctctcttattgattttgctgatttgatatcggataacatttttggaaatgtttatatgtactactttacctacaggtgagatattgcttggagtatttgtatttaaaaatcgattgatcagaaattctgaaaaatatcaggaaaaatgtaaaaaaaaaatgtttttgagggatttgatgcggctacttttcacttttttctaccatattttttccgaaaatttccaaaaaaatcgttaatttttaaacaaatttatcgattagtttatgacaaaaattgatatttttcatgaaaatcaataatttgaaatacattttttttgttttctatggaaaatcaataaaaatacatcttatgaaaaatataatttttatcaatagattgatatgttttcaagaaattgtatgttcttaaaacaaacaatcaagaacttttttaattttcaataaaaaatcgataatttattcacaaataacatcactgaaattggttaatttcttttcaaaaatcgataattttcccacaaattttccaagaaaatattggataatttgataagaacaaaaattaacattcttaattaaaaaaaattattttcaggtcaagcgcaaatccatggccaaagtggatgggtgtaatgcatggatatgaaatagaatatgcatttggtcaaccatattggagacctcacctctatgatcagactcacctggaagatgagaaacgactttcttctattataatgcaaatttgggcaaattttgcaaatactgggttagtttttgaatacagccaagaattgagcggagccgacaaattagtccccgccgatattttggctgttttccggtattcacaacatctcattttgccggtttga

SEQ ID NO: 28682 - DNA, 2318 bp, Caenorhabditis elegans
atgagccgagagattcggtcactcgaatccatcatctcggacgctcgagaaaacacacacgaaaaaatgctcatcaggtgttacaagttctttgtgcaatcaggcgtctgtgtccaatattcttagagggggtaaaagtgtgtgtaaagtaacgggagcaacaaaaaaaatccataaaatcaggagaaattacaagaagaaatgcatgaatgtagaccggcgagtgtggagaaaaatgaaaaacgaggagaagtggagagggagacatctggaaattgccgattttaattgaaaattcggaggaaaaatgaaaaaagttgaaagaaagtgcattttttcattcaaattttgacttaaaattgcgatcttgggtcttgaaacgaaagaaagttttccgttaccgtaacccgttctactaaaggggcacgggtctcgccgcgatgaaaagttatggtagctttttttcagaatttttgggattctcttgattttaaatgattttttaaaagtttttttcaatagatattttcaaaaaactaccaaaaactaccaatacgtgaacacaaaattctgagaatgcatcctgcacaacatatttgacgcgcaaaatatcaaaactacagtaattctttaaatgactactgtagtgcttgtgtcgatttacgcgagcgatttttgaaatgaaacttaattttaatactctatcgttgaataaaaaaatattttaattcatttcaaaaaatcgagcccttaaatcgaccaacagtagtcatttaaaaaggattactgtagttttcgctacgagatattttgcgcgtcaaatatgttgtgcaatacgcattctcagaatattgtgctactgtaatatatttgtgtttcttattcagaaaaaaccaatattattaaattttcgaatgcatttttttaactaagaattattcaaaaaacatgcctaaattctaaaaatagaaaaaaatccgcagcaatgaaagtttgaaattacagtattctttaaaggcgcgcacccgtttgcatttcactaaaatttgtcgcgtcgagaccaggtagtgtgtttttttgcgaaaaatcgctaaattgcccgtaatagtagtagtaattcgatcgtaccaggaccccattttaacttgaatttactcgagaaaataggagtctaagcctgaaaaaaaaacaaataaatacattcaatatatatatacacaaaatcttagaaagctgttctttcgaaaagacggcgcggttaattgagagtttccgaatgcgtccagatgcaaaataattggatgttggagatttattgacttccttttttgtttttttattccccatttcgaggggggagaagaaagtcaataaactgcgtttatagaattctcgttttaatattaaaatttaatgtcgaaaataattagatttttattccaaaatcgcctttaatttaacgacaaataaatatattccagaatatcctttggaatttgaattccctcggtttttcgcagagaaggattatcagtggagcgtgattgcggcaattcctaaaaacaatttttaatttggttcgcagaggcgttaaaacgtttttttagcgattattaagcctaggaaagtatataattttaagaattttaagtttttcatcaaataattattgaaatttaattttttttttcatatttttaaatgatcactacgggtttccctgttcaaaagtgtttttttttaattaaaaaaaattgttaaatgtatcgattcttgtgcaattttatttaataccgcgtcctttccttaccacattacaccggtcaccccccgtagaccgtctcatttgcccttttgtctaacctgctgcgtctcttgttctttttcgtgtagcgcgggaaaacagaattcaaaacccgtcattctttgagaaactctttaccgttaaatcctttttgaaaatcttaattatcttccagaaaacaacgggatatgacaaccgatatcgctccaggtaagcttttttccgagattttcattttttcaatatttaataaaaaataaataattaaaataatttcccatttcagaaagagacctgcaaggtcgcttttgctcactccggcgaatcggcgaaggaacgtacggagtcgtgttcaaggcgatccacgtgcgtgacaacgtgaaatgcgctctcaaaatgattcgcaccgatcgcgacgaggaaggcattccgagcacgtgccttcgtgaaatttcgtgtataaaagaccttcagcacgataatattgtgacacttttcgatattatctacgcaa

SEQ ID NO: 28683 - DNA, 793 bp, Caenorhabditis elegans
aattttggaagtacatattggtgttcgctgtcggtgttctaacaggttcaatcttccactactgttatttctatttcagcaggtatctaactttccgatagtcaatttgcatgcattactaacccttactaacacagaaaagagtctcctcgactgaccaccaatcacgacacttcaaagcagtatctactgtgagcaagtttttctttggatttcgaaaggttttgatttttgaaaataaaaagaattgagttaaggctctaacatcccaagcatcacggataaattgtaaccaaaagaaatttcagttttggttacctatcagcttttaatgtaccaaactatcaaaaaataatatgaaattgaaaataaacaatgaaagatggtaaactaaaacagataaattacaacagctgtgacacagaaaagttggtaaaatatgtataagattagattatcatcatttgcgcacatttttggaatgtactttcaaaatacctaaaaaccagagattaatgacggtttttaaaacctaaaacaataattttcaagtccagtttcttcaccaaaattcataaattaaatttacaggcatattggtgacaaggcatcttcatcatctcgttcgtcatcatcaatgactcgaccaatcactacctcgtcttcagcacgcctcccaatcgacgctttcaccacgtcatcaattgcagacgaaatgttctcatcgactctttcatctgcaaatcgtttcaactcggtttcaatgcattcctctattcgtacctattgctga

SEQ ID NO: 28684 - DNA, 499 bp, Caenorhabditis elegans
ggaatcattctggtgtacgatatcaccaacgagcgatcatttgaaaacatcaaaaactggattcgcaatatagaagagcatgcggcttcggatgtcgagaggatgatcatcggcaacaaatgtgatattgaagaacgccgtgaagtgtcgcgggaccgtggagagcagctcgcaatcgagtacggcacgaaattcctggaaacgtcggcgaaggccaatctgaatattgatgaagctttcttcacactggctcgtgatatcaagagcaagatggagcagaacgagatgcgtgccggtggatcagtttcgaatacgggtcgtgtgaacgtcggtggatcggggacacagaagaagagcttcttcagcaactggagctgcaatttgctttaaatttattgctctctcgccatgttctgcccttttcgaagttgattgtgattcaattcaattcaacttcaatagtgtaccatatctcttttcatattttctttccgtttga

SEQ ID NO: 28685 - DNA, 712 bp, Caenorhabditis elegans
atcgaaacattgaagaaacccgaaagctacttctagatatgcgtgatcgagttttcatccgtggagctgacaaagccgttccaaaatatagttcaaacggtatggagtacatcgcccgccacgtcacaacttgggaagattcgaaaatgtcgagtatcaaaagacaccgagcaattgttactgtagctgatactcgaatggttccacctcaacttctcctcttccgatcctatcgtccagaaatgccagaggaagcgtgtgaacactataagttcctggatccaacgaaggttgagctgtggaagactctgagatgcacaacgtacgactctagttttttttgaaatataaaaaaaaaattttcagcgcggctccatacttcttcgagtcattcaatgggctttctgatggtggtttgattgcgaacaatccgacgcttgcactgatctctgatttcttcctcacgaataaacttgaaaaatcgtttgcgaaaagctcatctgaacgagaaaaccgtggaaactggaagattggatgtgtcatttcacttggaacaggagtatttccaacggaaaagattgatggaatcgatttgattgtggcgcatgcggttagtacgcccttttacacgtccttttacgagaaatttgcaagagcgccgcacatttttttttcagctggttttaaattaaatttaaaacataatagttga

SEQ ID NO: 28686 - DNA, 419 bp, Caenorhabditis elegans
atgagtggaggaaaagacgaagccagcgacaaagcgctcctaaaaatcctaaaatctaaatcaccgaacacaattgccattttctcacgaggcgaatacttttctgtgtatggcgatgacgccacctttgtcgctactaacattttcaagagtgatgtttgcgtcaaaacgttcactttatcaagtaagactcgaaaaatcaaaataaaatctgtaaatgtgaaatttcagccgacaattctcaacaaatgaagtacatttccgtaaatcgtggacaatacgagaaggtcgttcgtgaaaccatcgtactgctcagatgctccgttgagctatactcgagtgaacagggagagtggaaaatgacgaagcgtggatctccaggaaatactgtggattttgagcaagaaattggagtgtca

SEQ ID NO: 28687 - DNA, 366 bp, Caenorhabditis elegans
atgatgcgaaatttcggtcgtgaatttcttgaagaaacgtctatttttgagaacaaaacgtgtttggtaagcttcaatttttgagcccaacttcaagaaataacatgttttcagatctggagagacagggaaatttcttttaaagaatttcacgaatacattggaaaatggaagaacgttctagatgagcaaaagacaaagtgagaaattatgttgtttttttttgaacgtgtataatttttagaacaacaaatccgctccgtattgcactattctgcacgaattctccagatattttagcaataattgtggccgggcaactttccggagttacagtaattccactaaatccatcttataaaaaat

SEQ ID NO: 28688 - DNA, 1093 bp, Caenorhabditis elegans
atgtcatatgcctaccttttcaagtacattatcatcggggatactggagtaggaaaatcctgcttgctccttcagtttaccgacaaacgtttccagccagttcatgatttgacgattggtgcgatttttaaattttattcaagtttttttttcaaaataattattttccaggcgtcgaattcggagcccgtatggtgacaattgacggaaagcagatcaaacttcaaatttgggacacagccggacaagaatcattccgctccatcactcgttcctattatcgtggagccgccggagctcttctcgtctacgacattacacgacgcgacacattcaatcatttgacatcttggcttgaggatgccaggcagcacagtaattccaatatggttattatgttgattggaaataagaggtaacatttttttaaaatatagattattggtttttaatatatcgaaaaataggttaactactgttgaaattcaacgatcgatccttgaattttgaaaataaaaattttcgccggttttccactgcattctcattcgaaaaaaaagaacaaaactaaaaaaatagtaaaatcgaaacctttttgattaaaagctgtgaaaaaaaggagaaaaaacagtgccactgggttgcgaattcacgctccgcatctctttctgtgtgaagtgtcaagttgccttttgcaaaattcaaggatcgattgttcaaaaatttctctacaaaatcgaacaatttatagaaatttggttttccaaataaacacatttttattcaaaaaaataaaataaatgttttcagtgacctggaagcccgtcgcgaagtgaaacgtgaagagggagaagcattcgcacgagagcacggactcgtattcatggagacatctgccaagacggctgccaacgtggaagaggcgttcatcgacactgccaaagagatctaccgtaagattcaagaaggcgtgttcgacattaacaatgaggcaaacggaatcaagttgggaccacagcactctccaagctcaccaaattctccaggtggaaatgcgacgggaggattgggcggtggatctggatgctgttaa

SEQ ID NO: 28689 - DNA, 1545 bp, Caenorhabditis elegans
atggtgagacaccgccttccttcgtctacctactacactccggctggcgagccggaatggtctcgtgagatgttcggtgagcaatcgattgccgttctctctggagcctaccgtaatccaatcgaaatggctcgccacgtcgccgctcgttgtggttcctatcaaccattttttgtgatggatgtcgctgccatcgaacgacgtcttgaagcacttcgtgtgatgcttccaagagttcgtcccaactatgcagtcgcttgtaatgctgatccagtgttggctagagttctctcgaacaacatcgatgtcaactttgaagtgtcgaatactgcagaactcgagttagtcagcatgaatgtcgaaccatcgagagcagttttctgctcacaactgatgactcgtaaagctatcaaaaatgctgttttggctggatgctccacttttgttgtagaaagcgagaaacaagttaccgatgtgatgaatgcatcaccagaagctgaaatcatcctagctgtctgtcttccatactcgactggagaagttccattcggatgctcagttgatgagattgaggagattctagatatggctcatcttcttggtgcaaatgttaccggaatctagtaagttaaactttttttaaaatttccaaatcatatcttaacaaaagtacatattttcagtctcgaacttggacttcgtgccaccctggaggactacatcacatcagttcacgatgctcgctcgatcttcgaaactgctgatcaaaagttcctgacactccgtcgtgtctgctttgggaatctctctgttccaactggagccgatggagctgtgaataatgaattcatgtcattttgcaactctctcaacaatgtcattgatgacctatttgaatctaatattgatttctctgcaagcatcggacgtttccttgtgacaaatgcattcacattgtgcacaaatgttattggaaaacgtgcaatggacgccaaatttattacaaacgatgatttcgatgatggagttggatttgtatatcaaaccaatgatggtgtatatggatcatttggatgcaagcaaatggatattaaaccattgtgtaaaccattggatgttgagaatgactctgaagagcaactacatttcggaacgattctcggcccaactttggatggaaccgatgttgctcaaagactcatgaaaagccgtcaattgcgtgtcggcgagtggctcgtttgggaacaaatgggcgctttcacaattcctgttgacagtgagcattcggtgccgcctgtgtattactattctggaaaagaatgctggtgagaacttttgaaccttgagattttgaaattaaatttgaattattccaggcaaaaactaatccacaaagatgaacaacgccgttctccatcgccaagtgtcagtgacaacgaagatattggaagtgatggtgaaggtggctacgcatcttcatgtgaggattcggaggcggagatggctttggagccattgatcgaggatttgaacgaattcttttga

SEQ ID NO: 28690 - DNA, 508 bp, Caenorhabditis elegans
gacacgttcaactggatgcctctctgtggactcattggttcccgcatcctctgcatgcatggtggcctctccccacacctccaaactcttgatcaactccgtcaacttcctcgccctcaggatccaccaaatccatcgattggaatcgacttgttgtgggctgatccggatcaatgggtgaagggatggcaggcaaatactcgtggagtctcttatgtctttggacaggatgttgttgctgacgtttgctcgagacttgacatcgacttggttgctcgtgcacatcaagtcgttcaagacggctacgagttcttcgcctccaagaagatggtcaccattttctcggcgcctcactactgcggacagtttgacaattcggctgcaacaatgaaggtgagattctttattataacttctctgtgaaaattgaatattataggtcgatgagaacatggtctgtactttcgtcatgtacaagccaactccgaagtctcttcgtaaaggatag

SEQ ID NO: 28691 - DNA, 4082 bp, Caenorhabditis elegans
atgacgtccgacgaatggtcaattttcttatttctccgtggactcaattcgccaggagacgagaaagcgaaactgtatttaatgcagtacgtggaagcttccgaaaagaagaacgagaagctgaaactttcggacgttcacgatgagtggatgaagttcattcaaatgcatcagcaatcgaagatcgtgtctgtcaaaccttctaagagcagccagcaagttgatgtcaacaaggttgacacaaaccgatcaaagaagaagaagaaacccattcctaggaaacccgagaagtcgtctcaagattcgaagaagaaaggagaaattccaacgtgtttctactgcaacaagaaagggcattatgccacaaattgccgcagcaatccgaagacaggcaatcaggggggaaataaggggaaaagcaaaggttgcgacagtgtccacgtagatggactagacgtcaaaaccgagcatcaagctaagcatagaatgagcgtagaggtttgcggtaaggatgtagctttccagctagatactggtagcatgatcactttaatcagctttaagtgttgggaaaaagtaggtagtccgccgcttgagaaggttccgcatagattttcgtgcgcgaatggtacgcctatggccgtcaagggtcgatgtcttgtcaaattcaaattgaaaggcatagaatacactgaatacgtgtatgtttgtgatcgacaaacaaatttgcttggaacaagttggttaaatttatgtccacaaatgagaagtgctctggcacaaattgtcaatcaagtctccacgtctgaaactgaagcatctcgtctggaagttatgctcaaaaatgacttcccagaagtcttcaaagatggattaggtctatgcaccaaagagaaagctgaatttaggacagaagaaaatgcagttccggttttcaagagagcacgccctgtgccttacggatctctggaagcagtcgaaaaggagttggatcgtcttcaagaaatgggtgtcattgtgccgatcacatatgccaaatgggcagcaccaattgtagtcatcaagaagaagggcactggaaaaatccgtgtttgcgcagacttcaagtgttctggactgaatgcagcactcaaagacgagttccatcccttgccgacaagcgaagacattttcagtagattaaagggtaccgtgtactcccaaatcgatctcaaagatgcatacctgcaagtggagctggatgaggaagcacagaaactggccgttatcaacacacaccgtggcatcttcaaatatctcaggatgaccttcggactaaagccagcacctgcctcgttccaaaagatcatggacaaaatggttagcggtttaacaggagttgccgtctatttggatgatatcatcatctctgcgtcctcaatcgaagaacatgaaaagattcttcgtgaactgtttgaacgtatcaaggaatacggttttcgagtgagtgctgaaaagtgcgcctttgcacagaagcaagtgaccttcttggggttcatcgtggatgaacacggtcgccgacctgacccaaaaaagacggaagtcatccgttcaatgaaggctccaaccgatcaaaaacagttagcatcatttcttggagcagtcagcttctacagtcgattcgtaccaaaaatgagcaagttgagaggaccactggattcgcttatgaagagagacgtcaaatggaattggacagatattcatcaagaagctttcaatactttgaaaaatgccgtcgcggacagcactatgctctcacacttcaacgaatcttggccaattatcattgcggcagatgctagccaatatggtattggtggagtgctgttacatcagactccggagggacacgaagttcctgtagctcacttcgcaagagctctgactgacactgagaaacggtacagtcaaattgagaaagaagctgtggcccttgtctacactgtaaagaaggctcataagttcatcttcggaagaaagttcttacttcaaacagatcacaagccacttctagcaatttttggaccgaagaaggatcttccggttcattcacaaaatcgtctcgtccgctgggcaacaactttgatgacctataactttgagttgagttacgtatccacatcgaaaattttcaaggcagattggctgtcgcgaatgatgcaggatcaccaacaaaacgcggatgacgtcgtgattgcggaaatatacgacgacgacgacgatgaggatgattccatcatccaaaagttgaatccagtaactgaaacagacattcggtttgagtctcaaaaagaccacgaagtttcatcggtgatcaaattggttcgcaacgactcttggaagcctaaaccatccaccgaaattgagaagcattggattcgctatagagatcgactgaagttaattcatgattgtctcttgcttgatgaccgcgtcatcgtttccaagtcgcttcagcaaatcgtactcaaacaactgcatgaaggacatccgggcattgtacagatgaaacaaaaagcgagagcatttgtattctggagaggattggattccgacattgaaaagatggtacgtcattgcaacaattgtcaagaaaactccaagatgccacgtgtcgttccgttgaatccatggcctgtacccgaaactccatggaaacggattcacattgattttgctggtcctttgaatggatattacctgctagtagtagtcgacgcaaagacaaagtatgcggaagtcaagttgacgagaagcatctctgctgttactaccattgacttattggaagaaattttttctattcatggttatccggaaacaatcattagcgacaatgggacccagctcacaagtcatctctttgctcaaatgtgccaatcacatgggatcgagcacaaaacatcagctgtctactacccaagatctaacggagctgctgaaaggttcgtggatacactcaagagaggtatcgcaaagatcaagggagaagggtcagtcaatcagcagatcctgaacaagtttctgatcagctatcggaacacaccacattctgctttaaatggttctacaccagcggagtgtcacttcggaagaaaaatcaggacgacaatgtcgcttctgatgcctacggaccgcgttttaaaagttccaaagctgacgcaatatcagcaaaacatgaagcatcattatgatctgcgaaatggggcgcgcgcaaaagcttttcaggtaaatcaaaaagtttatgtccaagtacaccacggcaacaagtctcaatggaagcatggtgttattcgaagaaagtttggtggtgttctctacgaagttcaagtcggagacagaatccaaaagtctcacgttaatcagattcggactcgttatggtgactacagtcgtgaagacatttttgaggaaactatctatcctctgttcttctcgactccaggaaagtttactagcggttcagacaataagtcaagttccggggccacaggggggaaactaatctttttgattcttcaggctcgtctgttaatcctagattgtcttccgattcttttggttttgtgggggagagtggcggtgatgagatgtcccgcaatgatgatccagttgttacttcgaacggttccagtactgatgtcaatcgtggaagccgaatcacaagtgaactaaagaagaaagaaagcaatgcagtcagaggacagccacgtggatcctgctctccaaccaacaacgacgtttcggcgcccggatacgcctcacgttctcacccgaccaccgacccaagccattccgtaagacgaagttcgcgaattcgacgagtaccggacagatatggttcatctgtggagcacccttcaacctccaccggaactccgcgaggatcgacatccacacagctcggtcaagcctccactcgcaacggaagtcgatatacagcttctggtcgaaacccctcttcccaagggaatcgctattcgtcaataaggggggaaggtgttacggcgagacgtgaacgtgttcgcactacttggcgataa

SEQ ID NO: 28692 - DNA, 695 bp, Caenorhabditis elegans
atgagctccctcaacaagttggctatcgaccagttgaacctcgccggaaagcgagttttgatccgtgttgacttcaatgtcccactcaaggatggcaaaatcaccaacaatcaacgtattgctgccgctgttccaaccattcaggtaatcaattcaaatttatttcaaacaacattttcaataatattcaaaatttcagcatgctcttagcaacggagccaaatctgtcgttttaatgtcacatttgggacgtccagatggcagacgccaagacaagtacaccttgaaaccagttgctgaagagttgaaggctctcttgaaaaagtttgttgtataatctgattttaaaaaaattacaaatgattttcagagatgttctcttcctcgacgactgtgtcggatcagaagtggaggctgcatgcgccgatccagctcctggatcagtcattctccttgaaaatcttcgttatcatctggaagaggagggcaaaggagtcgatgcatccggtgccaaggttaaggctgattcagcagccgtaaagaaattccgcgagtctctcaccaagcttggcgatatttatgtcaatgatgctttcggaaccgctcacagagcccatagctccatggttggagtcgagcactcacaacgtgcaagtggattcttgctcaagaacgagctctcctactttagcaag

SEQ ID NO: 28693 - DNA, 660 bp, Caenorhabditis elegans
gtttggattggattggtctatcaaaactcaaaatggcaatggactgatggatcagtagtcaattatgttaactggggagatggagagccaaataatatgaataaggaatggtggaccgctgtgagttcgaataatgcttttttttgaaaaataaaaaaaatgggaaaattctgagaatgcgtattgctcaacatattttacgcgcaaaatatctcgtatcgaaaactacagtaactttttaaatgactactgtagctcttgtgtcgagttacgggctaggattttaaatgaattaaaatcatttatttatcgatagaatattaaaattaagcaaaaaaatgagaaaataatatcactgtagctattcgaaaatatactagtttcaaaaatcaagcccgcaaatcgacgcaagcgctacgctacagtagtcatttaaagaattactgtagttttcgctacgagatattttgcgcgtaaaatatgttgagcaatacgcattctcagaattttttataaatttttatttcaatgcaatggcctttaaaatttcagctagtcgccgacccacacgagggtaaaaacagcgaaggaactcgatggaacaacgtgccacaagacgatcaaagagctttcctttgtaaaattgctccacttcactaa

SEQ ID NO: 28694 - DNA, 848 bp, Caenorhabditis elegans
atacaccttcaccctcggaaaaggacaggtcatcccaggaatggagagagctatgaccggaatgtgcaagggagaaaagagaaaggtcgtcatcccaggaaacctcggattcggagacaagggacgtgagcgtgacaacatcaaggaggatcagaccctctactacaccgtccagctcgtcgatctgttccgcgctgtgccaggagagaagtggaccaccgatgagggaatcgttattgagcagacacacaagattgatgaggataagtgcaagaagtcgaagagtggagacaccattcaccaacagtacgtgcttcatcttgaggacggaactttcgtcgattcgtctttttctcgcaacgctccattcatcttcaagttgaataataatgtaagtgttgggaaagttgcgcgtaaagtttgatgcattcggataatgtttgatgaaatgcttcttcttttgatctacgtataactttggcgtgatttctggagatcaattaggatgttatagacgttctaactattcatgggccgggagaggggcgcccgctctatcacctagttaaaactagcatattctaagatacagcgctcaaatatacaatggtatataccacctttgacacccaatttttaaattatttccaaaaacccctattttacaggaagtcatcaagggaatggacattgccatgactggaatgtgcgagggagaacgtcgtcaagtggtcatcccatcagacttcggatacggagacgacggaagagctccagccattccaggaaaagctcgtctctactttgacatcaccctcgagaagctcatccaacgcgacgagttgtaa

SEQ ID NO: 28695 - DNA, 565 bp, Caenorhabditis elegans
atggctggtatgcacttcttggtgggaatttccaccgaaaactacgtgattttggccgcagacaaagccactttcgcttatggcgctattctcgctgacagcggtaaggctgagaatccgggatgcaaaaaatattcaaatttatattttagaaaacgacaaggaatatagactgggaaagaagttgacaatgatgtgcatcggagaggaaggagacgtcgcacagttcggagactggaccaagagaaatcttcagttgtactcggtcagaaatggttacgaggtttcaccatcatgtgctcatcacttcgttcggcgcagtatcgccgaaggtctccgctcgcaagatcactacactgtcgatgttctgattggaggatatgatgacaaggaggacaaggctttcctaggatctgttgattacttggctaatggactcgggcaacaggtattcagcaatttattatcttttagtcaaaataaagaattattattcagccgtacttgttccgaggattctgcggacgcttctgctatgccattatggatcgtgaatacaaaaaag

SEQ ID NO: 28696 - DNA, 309 bp, Caenorhabditis elegans
attcgcagttttccgtcaattccgtcataatccacttcaaaatcaaggtgcacctgtcgatcagttcagtaatcctgcatatttgatcgatgaaggcggcatcgaactagtcacccaaaatacgagtcttgtctcatctcacgatgtaagccttttttctttatttcagcaagttttaggacatttaaataaaaaacatttcagcgaggatcgttcaacaatccggtttttgaacaagaaatggttccgatctacaatgataccgtcgagaatcatgaacttttgccgaataatagatcttcgaattaa

SEQ ID NO: 28697 - DNA, 1751 bp, Caenorhabditis elegans
gtatatgttgtcactcgccaaaacgaggtctggaaatgtgcgacgaacggatcatttgctcatattgtctattcgaccaactcgcatcgaatcgctgctataactttagaccgtgtaactggatatcttcttgtgtcagcgagggaatcaatttcaccgaaaggttttatagttttgatcgatccggatagacattcagaagcaattcatcaagtaatcgtggaagatgaagataaaatcccatatgaaatcgcagtagatcctccaaaagggtaggtgttttgaaactcataaattggtgaaaatgggctcttggaaactgtaaaaaataattcaaataataatcaatgatttttaaattgatatgtgatttgtaagttgtgagttgtgaaatttctcaattttcgccgaccaatcagcaaattcgtacattttcgattaatctcacaaatgccaaaaatacaaggttttaaagttacaaaatattttagagcgtaaaaaaaggatacatttcaaagtttccgaaatatagctaaatatcgattgcatttagtttgaccgccaaaaaaatgcggcaaaattgttttaggcaggtgtgacgtcacattttttgtagcgtctaaataggaaagtagtattgatactataaattatattttgagctcttcttgaaatgattctttttgaaatattcaaattagcttgtctacgtaatacttcttattcaattgatttcaggaaactcttctgggccagctcgagctgtatcaaatcgtcaaattattatggaactgaagccaagtgcattgtctcaaaatcttccatttccgccattgcaatcgatgaaaaccgttctcgtctttgtttcgtggattccgaaaaggctgctgtcgattgtgtagactacaatgggaacaatgaacagcgaaatgtggcaatgtttaaagctcagccaatgggagatattgttagtttggtgttcaatggagatgaaatgtactttttcgacaagttcaactcgtctggaagtattgtgagaggattggttcaacaagatggaagtgtggttttgaaggactccctggtgaaggtccatccacggcagaagattcgagtaatcgattttgatgttatggatgtaaaaagttcagttctcttcacagcatgctcaaataacaatggaggttgtgagcatctatgcatcacaacaccatcagaaaattcaccgactgttagaaaagagtgtctttgtgttcactcaactcgtttggataatggaagctgtggttccagtgatagtttcatcgctttcaccagattcacttctatcgaatttctttctacaaaacctggagatctcacttcaccaaacaaacagataacctcaaatggatgtgtcatgtcaaaaattggagcagtcactgcagacgctacacgtggaagaatctattttgcggattacgacaaattcagaataacggcagtcaactttgacggaacaggatgtgttgtgatcgcggaagatgttggcgttgtgccaagcatggcctacgatgaagtacacacagaactatactttgtgcgagcgaatcctgcaagtatctggagaatcaacgtggctgataataatttggagagctatccgacagagccgaagattgtgttgacactgactgtaagagatcgtccaagacacattgcaattcatccatgccgaatgttgctctttttcaccaataatgcaattactg

SEQ ID NO: 28698 - DNA, 666 bp, Caenorhabditis elegans
atgggtgcaattgttagtttttttggagcaccggaatctggcaatcattttgaagttactccgaattggccccgaatatctatgtgaagaaattcaaaataatttccatgatttcatatttgagcttgaaaccgcaaatttcctttttgtacaatttgtgttcaattggcacgaggaaatcaaattgtcaattaaaacagacaagaaaagacgaaaatgtagaaacgcgagtttgaaaatagtcatgtgtacatgaagcgcggtttcaggctgaaataagagttgtgattttttggtgaatttctacacatcgatatccggaattgggcaagtttgaagtcattttgaactatttcccaaattcgtgtgcttcacccgacccagaaattagctatctgataagcaaaataacattttcagaatcttatcgaagctgttaattacgatacgaatccggtcgtcgttcactgctctgctggagttggtcgttctggaactattgtgggaatttctttgattatggataagatgattcagggagtgagtttgaaatttttcatgtctttcgtttcaatttgctatatttttcagattaattgcaaagacatgaaaaagttagtcgaggaaatccgcaatcagcgtcactatgccattcagacggaggcg

SEQ ID NO: 28699 - DNA, 489 bp, Caenorhabditis elegans
atggccaatcgcaccaccgccggaggaatcggattcgctgtccgccaaaaggtttggtgaatttcagtgattttgttaggctattcttcatttttcagcaagactccaagttcatcgacaaggaggccactcttcttctcgaatggatcaagaagctctccggtgagaacatctctacatccggagaacgcgacaacttccacaaccttctcaaggacggaacccttctttgcaagtgagtttttgttacctagtattgttcaacaaaatcttaaaattttcagagccgccaacggaatcgaggccggatcaatcaagaaggtgcaaaagccgatctcgaccttcgcatgcatggagaacatcaacgcattcgtcgagttcgccaagaagcagggagtaccaaatgaggagacattccagtctgtggagctcgtcgaaggacgcgatcttttctccgtctgcgtcactcttctctcgctcggcagagtt

SEQ ID NO: 28700 - DNA, 1191 bp, Caenorhabditis elegans
atggctagtcgacgccaaaagcagttcgatcggaagtacagctcctatcggtaggtttggagattctggagctgaaaaaaccaattttttgaatttctgatagatttaactattcagaattttctctttttctactaagcctactttccccagcgtaccgtactctaaattgcgaaattaactttctttattatcaccaccgccacgtgacgcatatgccacttgaactgaaaccaacagtttgtttgcacataagtctcaagatccggaatgttctgcggtattcctaagagaaaaaaaaacaaagaaaaattatttgagaaaatttcggaacgccaagaatgaaaaattgtctaattggttaccgcgggttactgttgttaaacaacttttttggaattttttaatgcaaaatctcgataggtttgcaaaaagtacccaaaatcaggaagaattgagagtgttaaaaattttttaaacaaaaattaaatacaaattgtgcattgaaattttgaaatatattttttaaaaacctcacgactagaaattgtaatgtttgaatatcgtttttttaaataattgttcggtttggaagatccaaaaaacctgattcaatttttgctaagaataaaaaaagcccccacgatttgaaggctacaaaaggggatataataggacgaccatgtgcacctttaacatccaagaaacaatacaaaccccaaattcaatatttcagaaaattcactgcaaccgaagatgtcaactacagtacccactcgtcaagatcatcctatcgatctgaatcattgacttcgagaaccgatggacgcgggcggtccacgtcatccgaaatcattgccggatcggaatcccgatcttatccagtgtacattgcgattcaagactacactcctgacaaagaagacgtggaagcgattcccttagaacaaggtcaaattgtcgaggtgctcgacaagaagaactcggttcgatggcttgttagaacaaaggtttgatttcctgaaaacagtttcccaacatttataatttccaggcacgtccaccacgttccggttgggttccgggatcgtactttgaaactccgaccgagttttacaagcaaagaagacgaacgagagaaattgagaacgtcagtctgtctgatgaacaggcggctcttgtcaagagaga

SEQ ID NO: 28701 - DNA, 1145 bp, Caenorhabditis elegans
atggcagagcaatacgaacagaaacaacggacactatagtgagagcttggtccaaatgattattattttttcgtaacataatggttaggtttaccattaattggtaagtacaaacatccaaaggtgctttaggaaacctaattttctacgccttggttatctcattaacttatgacctaggtaaaatacctgcctttaagaggtgttcctgctgcaaaattagattaaaataaaagctatgaaaactgcaaacatctgagatcacttcaaaatgtagaaaaataaaaatcagactgctatgaggtaggtatgaggcaggcacctttgctgtagcaagccgtgccttcctatcataacatccaagccctatcaaagtacatgtttccaaaatctaattttcatccaatttttcagtgcaaactcaactatcgacggcctctcaagccttgcgcaccctggcgtcgaaattgctgagccaaaaggagtcaaccgtgaaacatgtgttcgtgtctttgttcgtcaacttcttcttgctctcaagcacatgcatgatttgcgaattgcccatctagatctccgtcccgaaaccattcttcttcaagatgataagctgaaattagcagacttcggtcaagcaagacgccttctacgcggccttatcaccggagaaatcaagggatcgcccgagttcgtgagccctgaaatcgtgagaagttacccattgaccctggcaactgatatgtggagtactggagttttgacatatgtattgtaagttgtttctttattgttacacagaattgttattgtgaatacacgctgtacacatcatcaatcgtgctcactgaggtttaaacttcaataaaaacttaaattccagactaaccggattgtcaccattccacggagataatgacaatgagacccttgcaaacgttgatagttgccaatttgattcgtctcctcttggcaacttctcctatgacgccggagatttcgtcaagaaactgttgaccgagattccagtctcacgtttgacagttgatgaagcattagaccatccatggattaacgatgaaaagctgaaaactgaacctttgtcagctgacacgttgagggaattcaaatatcagcataagtggctg

SEQ ID NO: 28702 - DNA, 448 bp, Caenorhabditis elegans
atggctccaactaacaaagacggagatgtggcgactgtcaaagctgtagatgttctcaaacaaaaggctggagcccatcattgccttggaaatgttcatgcaaaccttcccgttaataaggttagcatacctgagcgagaaaattcgattttaaataaacacaattatttaaggtgaccgtccatccattggttcttctgagtgttgttgatcatttcaatcgtgtcagcaaaactcaaagcgtgaagcgtgttgttggagtccttttggggtccatgaaaaaggacaaaactctggatattggaaacagttttgctggtatttttaaaaatttatttgcttacttataaagtaattttcagttccgtttgatgaagatgacaaggataaaagtacatggttcctcgacatggactatttggagagcatgtatggaatgttctacaag

SEQ ID NO: 28703 - DNA, 586 bp, Caenorhabditis elegans
atggatccttctgttgtgtctcgattggagaatgttgcgaatcgaacggagaatatattgctgaaatatgactcgaacaaaaaaggcaattaaataattgttctcgaaattataaattccaaaaaaactgctttttagaaactccggtcgacgcgacgcctcaaatcattaatctttatgacgatgcgatctgtgagaatctcgtctcgttttatgatttatctgcaaaaattggaggagatttgaatcgccttggatgcatggtaaggaaatatataatatttaattcaaattttatcgaaaattatgtttcagactaggagtctatttttcacgcatcgatattttttgtggattgcgtgtgggcgcaaaaaggcggacaacgacgagttcgcgactcttgtgaacgatttgtcgaaggaaattgttgcattttccgatttcaaggagaaaaatcgaaaatccgaattctataatcatatctgcggacttgaagctgcggttggaggtgaaaatttgcccctgattccgaatatctatgtgaaaaactcttcattattttatatatttcagcttgaaatcgctt

SEQ ID NO: 28704 - DNA, 1274 bp, Caenorhabditis elegans
atggcgatggtaatcccagctcgcaatcaaatggcttcacaatttttagagttacccaaaaggacttcaagcttgatggtttgatttttagaaattttttgtttgggaagaaatttggctttttcgatttttttttgtttgaaaaaaaaagtattttggaatttttcgttttctctcgattttaaaaaaaatctagctttttcgaaaaaatagcttgaattatattttagattttccagtgaatcaaagaaaaaattcgctgagaaattgtgaaaaattatttttcaaaaattgagaaatttatgaaaacattgaaatttttgaaaaataactaaaaattttgctatttttcttttttacagaagaaatttgttttatacgaaaagatgcgcgcctttaaagagtacagtaaagagtactgtaaaactgctgtaagagtactgtgtactttaaagagtaatatagtactcatcaacatgaaaaaaattgtaacaatttttgaactcaaattttttttccgattttttaatttttcgtaatttcgacaaaattcgataagacaatataaaatttaaaaaaatttttttggaatttttcgaaatcatattttcagaaaatcgaaaaaaccgccacccttgttagaattacaaaaaattgcaatttttcgacacaaaaaaataaatttcaggctccaacaatggttcttcaaggacacggaggagagatttacacgtcccaattcagttcggatggaagttttcttgctagtgccggatatgatcaacaggttttttgaaatttgacgttttttacatcaagaatacggtacccaggtctcgacacgactggtgctttgtaaaatgcgaaatggtgtgtgcctttaaaaagtactgtagttttcaacttttgttgctgtggagttttttttaaataaaaattaaactaagagcttttattgttatatttgactttcctgataaataaatatatttcttttcgtaaaaattataaaaattcgatgagaattccgcagcaacaaaagtttgaaactacagtactcttcaaaggcgcacaccttgtcgtgtcgagacctggtaccgtacttttgacgtaaaaatcgcttccgtgtagcaatagaatagcgtttcactgaaattacacttatttttcattcagatcttcctgtggaatgtgtttggcgaatgtgagaattttgcagttctcaaagggcacaaaggagccattatggaagtgaaattcaacgcggattcgag

SEQ ID NO: 28705 - DNA, 1536 bp, Caenorhabditis elegans
atttcaagcccacgagccagaggtagaccacgaaaagctacaaacttgaagagccaattgacaactccacgtactccggaaaaacagtcgaggtcacgatctggatctcagggaacaccagagaaaaagtcgcgaaaagagagctcatcggaatctgacagcgaagaaattatttcaacatcttccgaaggggctttgaaaggaagacgtgaagaatttgattcactgaaattatggattatgaaaagtaaagaaacgaatacttcgttgtctatttatgtcagtggacaacctggaactggaaaaactgcgaccacaatgagagttcttaaatcattgggaaaatcagttcgaagttgtattgtaaattgcgcttcaacaaataccaaatcagcactattcaaaacgattttcgaatctttggatttggacggaaagccgaatgaagaaatttttgagaagcacgtgaagcaattcaaaactcctctggtactggttctcgatgagattgatcatctcgcgaatcgaaagaacgctgcactctacgcagcttttcaatggccagagacgttgtctcgaaaaattatcattcttggaattgcaaattcgattgatttgacagaacgacttcttccaaaattgatgctcgcgaagccaccgaaaagactcgtttttgaaccgtatacgaaagatgacatcgtagaaattttgaatgataaaatgaaaaacgaggaggtaagtttaaatttaaaggatgagtatcggttttcggcttgtatagactcaaaatgtaccaaaaaaaactaattttgtagtgagaattttcaaaaaaacaattatggtggctaaaaaatttcgaagaaaaaagctatttttaaataaaatcaccaatttcgcccattttctaagaacttttcagcagtctcattatgaaattctttcgtttgcgcacattttgattctttccaagcgaaaaactcagagaaccggtgctcctaagttcatttagtattttacattttataatttcagacttcaattgacgcaaaggcaatcgagttaaccgctcgtaaagtggctgcaatgagcggagatcttcgtaccgcactccacatcttcaaacaacaaaaaagtcgtatgattcctgatgattcaaaagttcctggtaccccagttaatggatgtcgtgaagttcttggaatcatcaacaatgtctattcgtctccattggctcgtgctcgtcttccacttcaacctcgaattcttctagctgtctctttaacactttctgccaacaagaaatgcacattcgatcggaattccctgctccgtgcctattataaagcttgcgaggctcttcgaatgcccgctcttgatgacgatgaacttcattcagcgttccagactctcgaatctcaatccttcgtccgtcagttaaacggcggaaagctagttcttcaagttgatgctccgacggcaaaatcggctatcagtgacaacgcgatgcttgatcaaattggactccttcaattttaa

SEQ ID NO: 28706 - DNA, 2049 bp, Caenorhabditis elegans
tttcttgatgagtcgtcttctcaacccatattgcaagtcattcatcggacaaagtggaagaggcgaacgagatggtgataagcttgcaccgacggttcagaagtgcttcactgaagctgaagccgccttgttacatcttcagcaaaatatcgatattccggagatcaacttggttgtcaatcagcatattttggatgctatcgagcaggctggaaaggaaaaccgtcgtgctaaggtaggacttattttatgtactattaaagctatagaagttactaacagatcgaagatctcggagatctcgtggaagatgcaaacttcttgaatgcccttcaatctggctgcaatcgctgggtaaaggaaattcggaaggttactcaactggaacgtgatcctagcagtggaacttccctccaggaaatgactttctggctgaacttggaacgtgctcttctaaaaatttcacaaaagcgagacggagaagaggtcactttgacacttgaggccctaaagtgcggaaagcgttttcacgcaaccgttggattcgacagtgacaatggtttgaagcagaaattggcggttgttcaggattacaatacgttgatgaaagaattcccgctgagcgagctggtctctgccacagatgtccccaaattgatgcacgctgtcgttggaattttccttcatcttcgaaaattgcgatccaccaaatatccactacaacgtgctcttcgtctggttgaagcgatttctcgtgatctcaactctcagttgcttaaagtgctctcatcatacaatttgatgcgtactccaatcgcagaattcaatgaaatcatgtcacagtgccaagctttgttcagcaaatgggacgatgagtacgataaattcattgctttgcttcgtgatataaacaagaagaagcgtgatgatccatcaaagttgtcctggaaagtcacagcagtgcacaagcgactcgaaactcgacttatgcaaattttgcagttcagaaagtgagtggtaatgcaacagtttccaagaaaaattgaatttatttcaggcaacacgagcaattccgtactgttatcgagcgagttcttcgtcccgtcggaaatggatctagggaaagagagcagttgatgattgattcctcggaaggagagaagtcaccagatgagcaggtggacattgcatacgaatttctgaagaacgttgatttccttgatgtcgacagtcctgcatgggagaatgctttcaagcgctatgaagaccagattggagtagttgagacagcaattactactagactgaagagccaactggagtcatccagaaattcaaacgaaatgttctccattttcagtcgctacaatgctctcttcatccgccctcgtattcgtggagccatctacgagtaccagactcgactgattaatcgtgtcaaagaggatatcaatgaacttcaagcaagattcacgaaggcacgtggtgagcaaggagtgaaaatcatgcaaactgttggtcttcctccgttctctgcgaaaattatgtggatccgtaattatgaaaggcaacttcaaaggtatatgaagcgcgttgaagatgttcttggaaagcaatgggaaaatcacgttgatggaagacagttaaaagcagacggagacaatttcaaagtgaagctgaatactcaaccgatgtttgacgaatgggttgagtccgttcaatcacaaaattggacgctgcccaacaagatattgacagtcgatagagtccaggtggacggcagaatgcaacttcaactcaaaatcaactatcatagtgatagttcagttctgtacaaggaagtatcccatctgaaatcaatgggattccgtgttcctctaaagatagtcaactgggctcatcaagccaatcagatgcgtccatcagctacttcccttattgaagctgcacgtacatttgcttctgtgaatgctgcgctggcatccgtacaaggagttgactcattgcttgcaagttacaaaaaggatattcaaaatcagttgattgaag

SEQ ID NO: 28707 - DNA, 1585 bp, Caenorhabditis elegans
gatccaattctaggagttactgaagcattcaagaaggatacgaatccgaataagattaatttaggagttggagcatatcgtgatgatcaggtaagggggaaatgctcagaattttttattctagaattaaaaaaaaaaaagttttgaaacgagtggccggaatttcagggctgcaattaaataattaaataaattgtaatttcggaccaaaaattaattgaaaccggtgataaaaccaaaaaagcattaaaaagaaaaatatttattaaatatgaatagtattcgaaaaaattattaaagacctaaaaaaacccacatttttctatttttcacaaaaaaaaagtggttaaagtgaaaaaagttagttttttgaattttttggtgttaaaatacgattttcgttaatattctaacaaaaaacccaaaaaaatggccgcggcaataatggctaattgtcgaaaattttaaaactcggcaattgtcgaaagtgtcggttgcggaattttggaaaattctgccaaaaatccaattttcatcatgagaattagggtctgggaccaagaaaaaaaaattaaaatttgcgaaaacccaaaaaaaaatgatgcttgaattaattttttttaaaccgttaaaaagtgaacaatttttggttttttagttctaaaacaccaaaaaatcaatttttcgtcgattaaccaaataaaccaaataaaataccaaaagtgtcacagccctgatgaaaataagttggaaaaattatatttcttcaccaaaaacacttactacagtgaaaattagttttttgcaaaattttttgagttttttttttcaaaatttttgaactcgattcatgtcgatgtccaaaaatttttgattgccgtctcaccctcgatttaatattcaaattattgtaattttctattttcagggaaaaccattcgtgctccgagcggtccgcgaagctgagcagcaaattatagatgctaaaatggacaaagagtactcaacaatcactggagttccagaatttgcgccattggctgcgaaactcgctttcggcgacaattccgaagtgattcgcgatggaagagtcttcacaactcaatcgatatccggaactggtgctttgagaattggaggacaatttgtggaaaagtttattccatccaagactttgttttatccaacaccaacttgggctaatcatttgccagtttttaggtaaattttttaaaattttatttttatttttcggaaatcatattttttaaaaatttaaatctattttttttaatcgaaaagtcgaaaaacgaaaatttttcgattttcgggaaaacaaaaaatcgaaaaaaaattgaaaattaacaagaatttgcagcttttaattttaaaaacttgtagctaaatagttttcgaaaaaaatgtttttttttgtttttagattttccaaagaagctacactcttatcgaggaaaaaaatcgggtttttttgaagagaaaatcgaagaaccatacttttcgattttttgattttccgtaaagcaaaaaatcaaaatttccatgcacttgttgtattttttcccct

SEQ ID NO: 28708 - DNA, 527 bp, Caenorhabditis elegans
atgaccctctcggtaagcttcaaattccgatgtagaaaatccaaaataatctcaaattcagaataatgacaacaacagaaagcaataattgtaaaaccgtgatttttcaatgttggcaaattcccttcaaaatagcggagggaacttagtcaaaattgaaaaagagacatttttataatttggcgatttttttctgaatttgagactactttagattttttgaagcaaaatgttgatattttcccaataaaatctcactaagtcttttcaattttcagttcgacgacgctgctgccaccgttaagaccctcaagacttccccatcgaatgatgagcttctcaagctctatgctctgttcaaacaaggaaccgtcggcgacaacaccaccgataagccaggaatgttcgatttgaagggaaaagccaagtggtctgcctgggatgagaagaagggactcgcaaaggatgatgctcagaaggcctatgttgctcttgttgaggagctcatcgccaagtacggagcctaa

SEQ ID NO: 28709 - DNA, 516 bp, Caenorhabditis elegans
gtaaagctccgcggagaagttgatccgacgagtggaatggtgtatgacctggcaaagctgaaaaaagaaatgagtttagtgctggatacggtagatcacaggaatttggataaagacgtggaattttttaaggtactgtagacagattatgcgtcattaaaaatgctattcaaagtgtgggtcttggcacgagcgaaacttttcagctacagtaccatctagtatggtttaaatgttttttgtttaaaagattcgagaattttgctattgaaaaaaatctaaattaaattttttttgttatcataaaaaatttcggaaggacccaagaccgcaatttcgcgtttcaaaaccaagataaatacttttttccaatttcagacaactgtgagcacatctgaaaacgtggcaatttatatgttcgagaagctgaaatccgtaatgtcgaatccatcggttttgtataaagtgacaattgaggagacacccaagaatattttcacttataaaggatgttaa

SEQ ID NO: 28710 - DNA, 509 bp, Caenorhabditis elegans
gacactttcaactggatgcctctctgtggactcattggttcccgcatcctttgcatgcatggtggtctgtccccacatcttcaaactcttgatcaacttcgccaactgccacgcccccaggatccaccaaatccatcgatcggaatcgacttgttgtgggctgaccctgatcaatgggtgaagggatggcaggcaaatactcgtggagtctcttatgtctttggacaggatgttgttgctgacgtttgctcgagacttgacatcgacttggttgctcgtgcacatcaagtcgttcaagacggctacgagttctttgcctccaagaagatggtcaccattttctcggcacctcactactgcggacagtttgacaattcggctgcaacaatgaaggtgagattctttattacaacttctttgtgaaaaatcgaatattttaggtcgatgagaacatggtctgcactttcgtcatgtacaagccaactccgaagtccatgcgtcgaggataa

SEQ ID NO: 28711 - DNA, 775 bp, Caenorhabditis elegans
atgtttcaaaatcacaacgaaaatgtttttcaggaggttgttgaggaaaagggcgggaagatcgcgtggctcacgattcgcgaattgggtagaggtgcatttggtaccgtgtaccatgtttcaaacaagtccacaaaacaagaagctgcactcaaggtatgtcttagaagagcacatttgaaaataagaacaattttcagattgaaaaaatgactgccggagacaatttactgaaatttgaaagagagataatggtggcaatgcaacacgagccaactgcaattcatatctacgatgatggcatttacaaggattatagatacattgtaatgacattgtgtggtccggatctgcagaaaattgccgaattggtaagattttagttgtggagcttctctaatcttcctagatctaattcctagagcttcctagacttatacttataatttgactgaagaaaagaaaaatgactttaactcatgagatgtataaattagaaagttcagagatcaacgctgaatctttaactcattaattccagatgaacaataatttcaatcaagataccatcatccgtgtatgcattcgaactcttcttgctatcaaaacaatgcacgaatacacctatattcatcgtgatctaaagccatgtaatttcgccgttgatttcaacccaaattctcttcatgtttatttgtttgattatggaatggctagaaaatatgcgacgaaggattccggtaataaatggcaattgcgacgtccgagaaatccg

SEQ ID NO: 28712 - DNA, 819 bp, Caenorhabditis elegans
atcatgtatgacgacgcgtcgtgcaattcgtcacgacacgcctccaattcagatctctcaatgattgaatcgttccgagaagaaagttggaagcggcacgatttccaagagctctcctatcacatacgcacgttttgtgatgtctgcaataagaaattgtctgacattatccgaccgacgcctgcattcgaatgcaaaaattgccatttcaagacacacaaggatcatgttgctcaaggatcgttgccaatgtgtcgatgtaagtatcgtaatttcacaaaactgtgacatgccattttaaaggcacatgggattatgcagatgggtcttggtgcgctgaaaaaaaatcagctccgtttttagcgaatttcgccttttttcattttcatgtttctgtagtccgaaaaacgagaaaaaacacatttctaatagaaaagtttatttgtactttgaaaattaaaatgaaggctaccataaactttttcccaccgagacccatctgaataaatctgtgtgcctttaagaagccatgctaaagtcttgtaaaatgaataattgcgagaacagttatttgctatcatttttcataataaacactgtatttaaacgacacaatttacactctttaaattttcagacaacacgggtctctctcgtgaactcgttcttatggctccacaaacggataactgcaataaatgggtatcacaacttcgacgcttcattgaatcatcacgatcagcggcagtttcagtgtctcgtgtctcttcacgacgacatgctccaggatcgtcaaactcttccacaatctatcaatag

SEQ ID NO: 28713 - DNA, 1962 bp, Caenorhabditis elegans
atgacaacgatcaactgctctcgatctgttccacctgatgttacagtcaatgattctgttctatcaattgtcttcacatatttggctttatttattctggcatttgttggaaatgtcacaatgttcctgattttatgtcggtgagtctttgtcttgtaaaagaagcgagtcttactaaggttctgaccggcactttatgagttttaaatttttttaaaatctatgtacaaattgaaaagtggaaattctcattagcagttttcacataaataactttggaagtcaaccaaaaattgttttatgcaaattttatagtttctttatgtttcaaatatttgtattgaatattgtagggcctcaaactcccgacaatgctctaattttccaaaaaaaaagtccaattgcttatgtggagtctaaccgtcctaatcaaatcccagagaaagcatgtagttcaggcaataacaattacagttaaaattttttagtagagttagttgcaaaaccaatgaaataggcatatggtaggtgtaggccgctttgtgtaaactcatttttgtgggtatttttaccaattttgttgatgtttaatccataataaaaatgaaatatttcaacacctagacgatgtcaatttccgccctcctcaaatttattatgtaggtcttccgaaatttcgtggcgcaaattttagacatgacgcgatgtcgtgaaataaaaatacaactagacacttatggagcttcttgagaaaaataaaaaataaatcgttcaaagtttttttttttcagaaatcaactggtaaaagttcgacgggtgcattcgttgcttctacacatgaatattgctcatttacttgtcactcttgttgtcatgccaaaggagattctgcataactacatggttgcttggtttgcaggagatgttgtaaggaacataaagaatatgggggtcaaactatgactctaaaaattttttgttagaaaactgtagtgttaatcttaaagttaataaaaacagctaatgtttccgctctgagaacattttaaacttattggaatattttgagcatagctctatgttcgaacttttataatgttataatttttaaaatttttactattttgggtatttagttattttagcaccataggagcaattttaaacaacttcctcattttttgaacctaaaaattttcatatgcaagtaataaactcattagttgctccaaaattctagcagaaaccccgtctctcaaattaattgattttgtagttcttctgcacaatttttgacattttcaacatgtgaattatcttcttgatgttaaaaagccatttgatcttttaaaatgtattttcagaattcatagctttttccaactataatctataattaggcaaagtttgttttctgctacctcatactgattcaaagaacatttgttcagaatatataatttttgcaagtttagaataatttggaaatgttgaacattgaggctagaaaaaaaaactttgttgaagtttggtaaaattgaaaaatgattgcaccggaatacggaaaacgaattccatgtacaaatgtcattccaagacacaatattttataagcgttatgtgaatctgaaactgtaaatattttactatttacacaagtagaactaacctaactcaatcttacagatgtgccgaatttgcaagtttttcgacgtcttcgcaattagtttatcaatgaatgtgctcatttgcattaccctagacagattctactcaatattttttccgttatatgcgatgagagcccgtaaaagtgtccaacgaatggtatcatttgcatggacaatctcatttgtcacttctgctccacaactgtatctctttaaaactgcaactcatccgtgcttcgattggtacacacagtgtgtttccaaaaatttcattggagaattgtcgaatgat

SEQ ID NO: 28714 - DNA, 758 bp, Caenorhabditis elegans
atgggttacgtaaaacaagagaaacatccattggaatacgaatatcttcaaccggagcatctgaaaggattcgattcatataaagtttgtgaaatgagaggaatgtgagaaggaaatgattaattttttagtacaattgcgtcgacaactctccattatcagtttatgtttcacacccattctggaattggctagtagtagtgagttttcagatattggaaataaaaaattcttaccagaaggtaaactcgaaaattgtcttaaattcagaaatattattttaaaaaagcgaaaaaatcaaagaaaaatgaaaaatttaactttcaagcaaattccctgtttgaacttcttcaaaagtggattttatcattctttttcgattttttcgtttttctttcaaaatatttctgcatttacggcaattttggattttttgaagcaaaatccccatttaatcaactccactttaaaataaaagttaataatttgaaataaataaataaaatttcagttttacccacgaacatgggttccgaatgtactcacattagtaggatggggatttgtaatggctggattctttatcgaagcatatctagattattctattgatcgaaattccgatggctcaactaatccgatacccgattggttctggtttgcagcggccgcctgtacattcttaggacatacattagatggaacagatggaaaacaatcaagaaggattggagccagtggtccaactggagaacttt

SEQ ID NO: 28715 - DNA, 729 bp, Caenorhabditis elegans
cgtgccaaacatttgtattcggagcacttctggaatacgcatttgtcagttatcaagatagtgtccggcaaaatgacaggtcaagagagaaagctgcaaggaaggcgcagagaaggagagaaaagttggaaatggtggatgcagaagtctatcagccaccgtgcacctgtcatactgtaggttaagccttgaattttaacaatcatcaaaaagttttggtcctggaattcgccaatgttattgaaaaattcaacaaaaaaactttttgtataaattcactgggtgacaaataaaaagattcaactttttgaaacgatctcaaatattgaaagaattcaaaatgcaaacagcttccaaaaagcttccagcatgataccactaaaaacacaaaacgtcgacttttttccatttaaaagttattgtatgtagctatttttttaagtgtagtaacctatgtaaaagtcgctattccggaataatcttgcaaaaaatactcataaatatgttagaaaaatatgcgaaaaaaagtcaatttttcagttcgaagcccgcgagacattccgtgacaaagtccgccgttacttcacaaaaccagattatctaccggcaaaaattgatttctatgccagatttgtcgtcccacttgcctttctcgctttcaatgttatctactgggtatcatgtcttatcatgtctgccaatgcttccactccagagtctctcgtttag

SEQ ID NO: 28716 - DNA, 562 bp, Caenorhabditis elegans
cattaaacttgcatttccgtactccaacaacccatttgatgcctaattgggtgaagaaagtattcctaaaatggcttccaaaacttcttttcatgagacgaccaatcgatgattacgaggaaaaattcgatgataaaaagaagccgaaagacgggaaaattgcattgagcgttcatgcacatcgagtttcaaatgttggaaataacattaggaatgcaacaattgatgacacaattcaaaaaatgtattattctccgccagttgtaaaagctttcgaaaatatttgctttatcgccgaactgctgaaaaagaaagatcgagacgataaaatcgatgaggattggaaatacgtggcaatggtccttgatcgacttttccttcttattttctcaattgcttgttttgtaggaacagttataattcttttgagggtaaggagtttagaatattctgaaaatttaatttgcaaaactttcaggcaccaacactgtatgacacacgacaacccatcgatttgcagtatcgtccagccaatttatctgctaatccaattagtttctga

SEQ ID NO: 28717 - DNA, 704 bp, Caenorhabditis elegans
atgagtgttacagttgagcaggtaagtcaacttttttcaaagcttagcacgttcaacgctgactctttcaggaagcttatgaaatgccagctgacaataaaaaagtcatgctgaaaatcgaagaagtacatcttcactcgtgtggcgtcttcagcaatgtctacaaaggaatactccgagagccatatgagaagaagatcgccatcaagaaaagttggccggaaaagggagaacgcaatttcgagttcatcttcttgacgggtcgcgaacgggctaaacacaagaacgtgattcatatgatttttgcgtttagccacagttatgacacaaaggtttgccacaaagcactttcgtagaattcaaggaactcctgaatttccaggtttgtgaatcctacgtcttcgactttatgccaaacaccttggccgaagtgattcgccagaagctcacggacctcgacattcgcctttacacgtggcaaatattctccggattgaaatacctggaggaacacaaggttgtccatcgagacctgaagccggtgaacattctggttgatcatgacaccgcattcctgaagatcagtgacttcgggtcagcaaagatcatcgtgaaggggaaggcaaacaacttctatcaggtcacacgcttctacagaccgcccgaattgttgatgaaagcaatggaatacaattccacagttg

SEQ ID NO: 28718 - DNA, 804 bp, Caenorhabditis elegans
gtaaaaaccgatcgctaccgacgcttccaagatttcttcgatcctgtggccaacactatcgatgacatttacaagcaactctcacgaaatacttctgctcaagccttcctcggagctgataacatggaagagccctatctggatggtatccagtacaattgtgtagctcctggaaaacgtttccgtccgatggataacttgtctggaggagaaaagacaattgccgcgttggcactgctttttgcagttcacggacgtaatcctgctccgtttttcgttctcgacgagattgatgctgctttggataatactaatattggaaaggtatttatttaaactgttcattaaaattaaattttgcttcaaaagatagaaaaatgactgtaatgaccgaatattactgttgtaaaacacaaaaattataaaataagggtaaatcctccggtttttctgcatatttttgatagttgatctaaaaaactatcaaactatcaaacttttaagcaaaatttcaaaacgattttactccgcctttagtataacctgcgagaaaagattgtaacgttttttttgtaatttcaggtcgcttcgtacatctgtgaatcagctcgtgagcatatgcaaattatcgtcatttctctcaaagaagagttctacaacaaagctgactcactcatcggaatcttcccatatccagccgcttgtacaacatctggtgttctcactttcgatttgacgcgcttcaaacaaattggtctcaatgaaatgactgaaaatccaccaacaccatcgattgcaacataa

SEQ ID NO: 28719 - DNA, 377 bp, Caenorhabditis elegans
ggaaaacaagaagccaagccggcgacaccatctgctcgatctgaaaccagtaagaaagtgaaaaggagatatattgcgagaacaccatcggcgcataaggtatagaatacgttattcgacgtattaaattttccaattttcagattgaacagattgaaaagaactggaagaagaaagaggaagaagcgaataaagagaagttgctgaagaatgcacgggcggcacgaagagccaaagaagattttattgttccggaggataatacggttcaaaaaagaaaactcgagagcacacaactgtcgtctgcagtttccacgaaatccactagaagtattggaaagaagattttgccgccgaaatcatttgagcttcattga

SEQ ID NO: 28720 - DNA, 1127 bp, Caenorhabditis elegans
atgtggttcgaggagagcagctggtcgaatcttcggcttactgatctcgttgaggaatggagggatttgtggccgtcaaaaatcgaattcattgtgtcagcaatggcatatttgttcgcaatgacaaacttccttaacttgccaaaattgatactcgaaaatggaggaggtatgatttcggatttttttttggtctctttttatgatatcctcatcagggctgtcaccaaatatcttcaacaaaaaatattgtttggattttggacaaacaaacaaccacattttcagaaagttttttacctggaaatttaccaaagcttgtactgaaaattttgaaaaatctgataaatttatatggctctatgaattttttgagttcacttcgttcaataaatttagttttttttttaattttcaaagctcgaaatattttttaaaaaattgaaaaattaatttgccattttattaaataaattcttttcagtagcatttgcggctgcatatgcaatagtcgttggggttctatgtatgccaacaatggttatggagatgtcaattggacaagtgaccggacgagcgcctgttcttgctttttatcatctgtttcccgtcttccgaggttcgtttagtctccctctgcccgtttacaacatttcacttacaaattttatgactgagaaaatggcagaaggcaaggggaaaaatattgaagtttcgaaagaacatgtgcaaatgccaaggagttgagatggggatgtaacgggttttctaggattaaagtttgaaaaaaatctgattttaaatttgaacacaaataaaccatataaatacattttagctatagctaatcgaaagaccttttcaggaatcggagtttctcaaattctgttcacaatggtcgtacttgcctgtatgacaaagttcctctcaactctatgcctcttcctctactactatttttggacattccatgctggtcgaagtggtctcccatggctcaactgcaaggctttcccagaatttgtctcccaaccgtgtcgagaagctggatcaatcacgaatattactcagatcaacaacagattgaacacgattcaagcggaaagttcgatgatgcagtttctaac

SEQ ID NO: 28721 - DNA, 859 bp, Caenorhabditis elegans
gtcgggaaacgggccgaagaatgtgcgaaggcggttaaaatcttggagcagttggattctggaaacgttaaagataaagttatcattggaaacaacgcaaatctggaatttttcaagaataagcttctcacgacgactgcgtcaattattggtcactcttttggaggtgcaactagcattgcctcttcttcctcggatttccaaaaagcaattgtattggatggatggatgtatccattggatcaaaatcaacaggagcaggcaaaacagccgataatgttcctaaatgttggagattggcagtggaatgagaatttggaagttatgaggaaaattcttccaaataacgaaggaaacattctcttgactttaagtggagctgttcatcagagttttaccgatttcccatttgtttttccaaattggctcgccaagcagttcggagttcatgtaattgatttttatttgagaagttatagactaaaatacatatcaaaaagttagaaattagagagtaaaattttttcgactcaaaactgacataaatttcatgtgaccactcaattagacgagaacccaccaatccgcgagaggattggaggtgtagccagtgtgatttaaatttgattacaaataatttttttaaagttaagagataaatctcttgatttttcgattattaaatagcgtattttattttcagggacctactgagccatatctctgtatgcaatctgcaattgaactcacattgtcatttttgaaagatgggaaagatggtgttcagaagttgaaagatgaaaagtacactacattcatcactaatgagatttacggtcgggtgaaactcattgtgtga

SEQ ID NO: 28722 - DNA, 374 bp, Caenorhabditis elegans
acccttcgtaaactgatccgcaagttcgacgctgacggttccggaaagctcgagtttgacgagttctgcgctctcgtgtacaccgttgcaaacactgtcgacaaggaaacattggagaaagaacttcgtgaagctttccgtcttttcgacaaggaggtttgtacttttagattttgctttttattctttaattattaatttttcagggtaacggatatatttctcgaccaactctgaaggctcttctcaaagaaatcgccgatgacctcaccgatcaacaactcgaggaggctgtcgacgagattgacgaggacggttccggaaagattgagttcgaggagttctgggagttgatggctggagagtctgattaa

SEQ ID NO: 28723 - DNA, 627 bp, Caenorhabditis elegans
atgctccaacaacacggaattagttttcaaatgaatgccgatagacagaacaaagcagccacaacttccaatcgaatagtctccgctccagctacaaatgaatttgacgagcggcatcgtaaagttagtatttcttctcctttaaacaatttttaaggaaaaaaaaatcatatttcagcaagggattgatgctgcaagagctcttgcttcacaatatcggagccgaattacggaaaatagagatgcaaatcaacgacaggctgctcgagaactcagcaggtagttttttttttaaataaaagtcaataaattaaatatattattttcctcagatatgttcgaagtgagctgaaagacgagccaaatacttttagtgatgctttcctgaatgcaatcgatggacgaacagatatagcctctcagagtgcaatttataattgtatgaagtcgaattcaaatatcgatcagaaacgagccggtatctatctcatcgtgtgcttagctgaaactcattctggaaatgttattcgatatgcgaattatcttctgaaaatgttaaataatggaaatggattagatgaagatacagtcaagatggcttcaaaagctctcgcttttctgattgcg

SEQ ID NO: 28724 - DNA, 1067 bp, Caenorhabditis elegans
ggctgcgaaacaattgtatatctggcagagacatcgggaaatcagctgaaaaatggttcgatgtactatgagaggaaagaagaagcatataatgagatggttgaagtggtaagagtttgttatgaaaattgatatttataacggaattttggccaaccgaaatttttttgtgcaaaggagtgtgccacttttatgaaaatataaaaatattgtacattcataaccatacgtttttttccaaaattttcgtttttttttaaataccagcgatcaaagtttattttccaattttccagtttttttttctgaaaaatgtgattctggtgtttttcaaaaacaaacaattcggttttcgtggaatcgaaaaattgcaatttttctgggctttcacaaaaaatgaaattaactgaaaaaaataaaattaacttctttgcaaattccaaaactgaacaaaaaatttgaattgaattttaattttctcgtcttaaagtaacatatctgaatcagttttttttttcgttttttaatctgaaaaaataaaaaaaagttttgccaaaatcccccaaaaacagagaaaaaggtagccatgatctgtttttatcggaaaaaaatttatgagttatgaaaaattagggtgcttggatctacagtatacccaagcataattggtgaaaaaactacatattcgggaaaacgaattaaagcctataaatgccacattcagcacgaaaaaatttgctaaatatattttttatgcaaaaaactcttaaagcgtttttttgtaaaaaaagctaaaaattgaattttttgttaaaaaaaatttaataaaatttcaatccctggtacagaaattttggaaacttctttatctcaaatttatgacgatattatatacaaatctttaaaattaaaaaaatatatatttgcagacgtcgatccgccaagtttgggcaattcttcgacacctagaagacacagtttggaaacggaatactcaaatgactgatgaacagagaaatcatggagaaatggttagagaactgctcaatgaatcattaattgtttaa

SEQ ID NO: 28725 - DNA, 1384 bp, Caenorhabditis elegans
atgacgaaccgtctcgctttcacagctaaaaattcaaaggcaatgtgagtgtatatttctcttctctccattcgtttccatctattatatttccaataaaatgcatcactgtatgaaagcattatcggaattttacatttcataaaaatctgtgtgccacgaaactttttggtgtgctttgtatattcgttttattttgggaagctggtttgcttttttttcatagcaaaatttgatttttcgggattttcacttcagatgactccgatttgcccaaacttggagagaacttgaatccgatggtcaaaaactccaaagaaatatttcaaattattttgaaaattattcctgaaccatttttctcatcaaaatccgctgcaagttttttttctcaatattttatcaactgcaaaactgaacaaattccttttattggtattttttaattctattttctactattttctattttctattttttctatttttataactattttcaaacgtaacttaattttgaaaattaaaaaattaaacttggcataatttagtaattttgagcttaaaaattgaactatttgtgataaactcggttaaaattgtcaaaaatcaaattgccaaaactgatatcaactgattacaatttgaatataaaattcttataacttaaaaaaatatatagtttgctaaaactaaaaaaagtttttaaacataaaaaacgagaacaaaaattgggcaaaaataaattcacgttcaatcccatggagatttttttgcagcagctatttctgcgttaaaaccgcccgtgagttggcattcttttactactcataaaatgttcctaaaacaaccatatcctataattttatgtgtcctcttcaatgcacacactttttcacctccttttccccatttcagctgttcaaaccaaacgctacctccttttgtatttcaatcctattaaatttcccacataatttgtggaatgctttctcttttcaaaacaactatattctttctagaactatattggtttttttttcagcatacaaaaaatgcaccgacttgcgttatcagccaaacggaaagtactactcaatccgaaaactgtttctatttatttttttgctattctcttcacatttttattggcatatcatcaaagattaggacaggtttgtgaacaatttttcaaatgagcaagaatctgtaatatattttgtttcagcataataatgagcttcacatttcacgagttgtcaacatgcgatcttttgtaaaagaagccaataatctatcaaacagtcaaaagaatccaaatattttcgaaccaaaaaatgaagtctgccaacgaccactcacagagtcttctaccaattttaat

SEQ ID NO: 28726 - DNA, 793 bp, Caenorhabditis elegans
atgttaggtattctttattggattctgaacttaacggttgtggaatctgtattctatcttgttgtggcattcttgttatttttaattggcaggcactttattgagaagctccaaattaataatttatcgaaaagggccgtttttatcactggatgtgactctggtatatttttcggagcaacttacaaataactagatttgtctgttttgcaggattcggtcgtggattagcattaaaatgtttggagcaaggaatgcctgtatttgcaggatgtctcactgagcaggtatattatttgttatttattttttccgtcgggtcgagacctcgtaccgtaatcttcagttttgaattattaccagacgcgacatttagcgatttttgtgcaaaaaatcccagtctatgaaaattccacagctacgaaagtttgaaattacagtaatctataaagacgcacacatgtttctatataaaacaaaaatgcgtgtcgagaccgggtaccgtatttttcgcgtaaaaaatggaaaattttgtatctaactaatccagttttctttcttgttcctataattttgtttcgagttcaaaagttttcctaaaaatcccccacatcacataaaacatgaccgttgaatggtgccccatttcagggaatcgaaagtcttagtgcggaggctcgaaaatccatcggaaacgggcggtctctcgacgcgtttttgatggacgtgacaagtgacgagtctgtcggtgaagtggccaaacgacttgaaaagaaatgtgaacaatatggag

SEQ ID NO: 28727 - DNA, 310 bp, Caenorhabditis elegans
gtctcgccactgctccggtactatacgcttgcgagcaatatcctgagctcaatacgatgcttcttcgaaaattcaagcatgatggagatgctgaaaaagcacgggaaattgttgtaaattcggatggaatggataaaacgcgaagattgattgattcatattcacaaaaagctgttgaaatggtaattttttaaactgaaacatagaaaaaaaaaattaaacttttcaggcttcatccctccccaaccgcaatgaatctacggaacatttaatcaaattagccatgtcacagtcggatcgaaaattctaa

SEQ ID NO: 28728 - DNA, 490 bp, Caenorhabditis elegans
gacttttggctgagaacggacgtctgaacaagctcgagtcagttgtttcttcattcgaatccatcatgcgcgctcaccgtggagaacttttcgttcaggtacttttattataactgccaagaaaaacaatgtttcttttgaaatttgttttcgtaaaattataaaatatgaatagcgaatgttttcaatacgtagaaatggaaattttcaagtctaaattttaatcctgaagatgctcgtacgtaccgttttaaaaactaaaaatcattttcaggtcacctccgccgaagaattgagctcatcaaaccagaaggcattgtctgatgcccttagcaagatcggaaagtctggacaaaagctcacggtgacttatgccgtcaagccatcgattcttggaggacttgttgtcactatcggagacaagtacgtcgatctgtcgatcgcttcccgtgtcaagaaatacaaggatgcccttgccaccgccatctaa

SEQ ID NO: 28729 - DNA, 856 bp, Caenorhabditis elegans
aaaagcgttggctctcggaatgttcttgaatagttgtgaatatgatcgtcaggaagatcgatatcgattaatgattaatcctgcgattactctgaaaattcatccatcgtcttgcctctcaagatcaaaacctgcatacattgtgttttctgaattaatgaagactaatgatctctttgcgctgtaagtttttttttctttaaaaaatcagttttctatgtttttctccgtgatccatcccaattcaaactttgagttacaaacttgaaaaaaaattaaaaggagtttcttcaaacacttcaaagtggtttaaaagttgtttttaactataaacttcaaaaaaagataaggttgaaaaatgtcgtacttaaaaactatttttgaaacggaaaatcggaaatttttggcgttttttttttaccaaatgtttgaatcgaattttaagcaaaaatcttcaaacattttcaagcatttaaagctttaaaaagtcaagtttcaagcgtttatatttcaaatattttgagaaaaacttgatttgattgatttttgaaaatatttgtaaaaaatgtgatttttttcggggaatcttgcaaaaatacaagaaaattaagaaaaaaccaagactacataattcaaaagttgattgaaaactagaagcaatttaaaactaaaaaaatacaattatattctattttccagacaagtgacccttatcgacggcgattgggttcgcccattgatcagcgatcacaagaaaatgcgtgcaaatcatttggctgaaacgacagaacgagtacaacaaatcactcgtttagaaccaaaagccaaaaaagcaaaactcaatgtcacattttaa

SEQ ID NO: 28730 - DNA, 869 bp, Caenorhabditis elegans
tcgtcactgcatgggtacaacgtcggattgattgcctatggacaaaccggaagtggcaaaactcacacgatgcgaggaggaaatggtgaagaggaaggaatcatcccgagagcagctgcatttctgttcgccgaatccagaaagctcgagtcacttggatggaaattcgacttctcgttgtctttcctagaagtctacaacaacgtggcatacgaccttctcagtgaccgcgccgttgtccaacttcgtttgaacgatcaaacggtttccatgattgggctctccgagcacacgatttccaatgtctcggatgtggctagacttcttcgtgtagcagacggtggcaggaagacggcggcgacaaagtgcaatgagagctcgtctcgttcgcacgccgtttatatgtggaagattacagctcatcagccatcaactggtaactttcgaaaataaaaataattaattcacaatattgatatacaggaatttcaacatcgtgccagctcaaacttgtggatctcgcaggatccgaacgtgccaaggagtctggtgtcagtggcgaccagttcaaggagatgactaatatcaaccagtcgttgtctatccttcagatgtgcatcagccagcaaagatcccagaagggacatgtttcatatcgcgacagcaaactgacacaagtgctgatggactgcttgggacgtggcaactcgaagactatggttgtggtcaatctcaatccatgcaacgagcaagcgacagagtccaagagaagcatcgaattcgcctcaaagatgcgcagtactaacatcggatcggccgtgcagcaacggactctcttgggtgacgtgtcccagatgtctatgaactag

SEQ ID NO: 28731 - DNA, 472 bp, Caenorhabditis elegans
caacgcgaggcagagttcaaggcatttgaacaacaatacttgggaaccaaagaagatattgagagcaagattcgtcgtgatactgaggatcaaatcagtggaatgaagcaatctgtggctggaaacaagcaagctgtgagtttgaacaaatttccacacaactttgggaaatcttttgcactttgcaaaatatttactggagaactttcaaaaaaaatttctcgaatttaaataaaatgttctaaaataattttattgaatttctatatttgtcaccaaattaaaatatagttattgtaaaacggcacatacacatttttggctcacactctcgaaagttgcataatatctcaataaaatccgttaatttcaggtcattgtccgtctccttcaactcgtttgcgacatcaagccagagctccatcataacttgactctccagaagaaacttcacggacagttcgctgcctaa

SEQ ID NO: 28732 - DNA, 1158 bp, Caenorhabditis elegans
atgttatccaatcacttcagtgaaatgcaatcggtacagttaatttctgaataaggaatgataacaacttgtcagagcaaataaaacacaattttcagacacgtattggtagctgaaggttcagctcgaagcatagtctccgattgtggaaaacatggaaaatgcgtcaacgggcagtgcattttgaatagtgggtatttttataaattagttttaaaaactagttttctcgtacatattacaggaacacgaaattctgagaatgcgtattgcgcaacatatttgacgcgcaaaatatctcgtagcgaaaactacagtaatgcttcaaatgactactgtagcgctggtgtcgatttacggaaaagggcaaaaaagaggccccacgaaaaggggagcagaacgaaaaggggatctgcaaaaaggggagatacgaaaaggggagcaacgaaaaggggagctggcactgtgccaaacgcacaaaacgcaattttctcacgcaacgcgcgttgatttttgaaattttcttctagaagatacgcttaacaacacgcgacgcgtaacatcggagcatcgttgtatcgttttcttcgagaaaaatagcgtttggcacagtgccagctccccttttcgttgctccccttttcgtatctccccttttcgcagatcccctttttgcagatcccctttttgcagatccccttttcgttctgctccccttttcgtggggcctcgcaaaaaaataaaatggaatatcactatcactatacgaaaataaatttatttcgacaaccgagcccgtaaatcaacaaaagcgctacagtagtattttaaaacgttactgtagttttcgctacaagatattttgggcgtcaaatatgttgctcagtatgcattctcagaatttcgtgttcccataatagttcaacagccgagtttgtaaatttgtcagatttcgaaaggaagaaatgcttgaatgctctatcgagatattctccaataaaattaatttttgaataattcaggatgccaaggagtttcgtgtgacgaaggatcaatgtgtcgtgatggaaagtgtgaaaaagttctcgagactttctgtattggtcacgcggattgtggtccaaatatgttgtgtcagcaaaataaatgtcaactcaa

SEQ ID NO: 28733 - DNA, 495 bp, Caenorhabditis elegans
tgcaagatctgaacgttttcccaatcgactttgaacctttgatgaatgcgatcaagaaacgtgtgcgactagcttcagagattgactctcttggattccgttgcaaaaaggtatcgaactactttctaatagctttttatattgaaatttcagatcaaaatgtcagagtcttggtttgaaaaagctgcccgtgccgcagatttagactatgatgagacgcgtcatcgagaaatggatggattgaatcttgaagttgacacaatggtccagaaaagtcgccaacttcaagcacaactacgcacggagctttcccttccacttccacgtgttgatggatcggattcgatgaagacaaagtacattactcctgaaattgttgcccgtttgagatcagttggtgataatgcaattgacgtattaaaccagaaaattgatgagacaaaggaatggaagagaaagagccgaaaagctacaagagaagatgaaatgaactcg

SEQ ID NO: 28734 - DNA, 359 bp, Caenorhabditis elegans
atttggctccgagcgattctgcaacatcacggaatgcaattgaaaggacgtgctgacgtggcaactctgactggtatccaacaaattgtggctcatcatcaacaacatatcactaaattgttggtttttgtctttaattatttactgagcaccgttttaaactcccgattttcagggcaaaccagaacaagttcgcattaaattggctcgtgaaaattcggcaatcgaagaaatctgtgaaaaaggaagaagaggaagaggaggatgttagtgatgaatcagacgatgaagatattgaagatgaaagtgctggaagcgacgatgaagattctgatgattcagtggaaattattgaataa

SEQ ID NO: 28735 - DNA, 1126 bp, Caenorhabditis elegans
atgacacttccacgtttcgatcaaatccgacccaagatcgagcaacacatccgggaggtgaaggatttcccgaagaaaggcattaattttcggtatgcacaacacgtgtattcagctcgaccaacgcctcgaaaattttcaaaaaaggcgggaaaaaatatttgaattcgccaagaggaatttcaccgcagcgcgtgcaaaaatgtctgcatttgcgcgtgacggtgtttgcacaaattacaccgaatggtcgagctgaaaacacgtgcacaacttaaatttttatttcatcgtaatttcaaaagattttgatatgcgttcatatttagcacgaatttattcagatgggtctcggcgcaaaaaaagtttgtggtaattgttttgtaatttttccttgcatttttcactttttttcgcgtcaagacccatatgaataaattgatgtccctttatgatggcgtgccaaaatcttatgaaattacgataattttaaacagttttaaattatatcattaattgaaaaacgggaagaagttaggatttttcaaaaaagaaggacaataaaagacacaaaaagagataattttcgaaaaatctaaatttctctatatttcagtgatataatgccattgttcacaaatcctcaactcgtcaacgagctctgtgttgtcattgccgatcacgttcgtcatacagttggacacgtggattcagttgctggcttagaggcacggggattcctattcggaccacaagttgccattcagctgggtgttccatttgtgccaatccgcaagaagggaaagctcccaggagcaacgattgaagcatcgtatgtgaaagaatatggagaggatcgggttgaaattcaagaaggagcaattaaaaatggggatattgtgttcttgatcgatgacttgttggctactggaggcactttaagagtatgtaacgtttttagaaaacattttaaaatttttttttgcaggctgccaccgatctagtcgtgaaagctggtggaaaagtcggtgaggcatttgttctcatagaactggcaccattgaatggtcgttccaagcttccggatgttaatctgacaactctcatctcctatgatagcgcttaa

SEQ ID NO: 28736 - DNA, 585 bp, Caenorhabditis elegans
gtcatggcccattctcttctgtagttggatacactccatcaggcggtgctattctatcaggaaaagatcgtcacaatgcacgtgggcatggatcagcggcttctggcgatacagtttccttagtcgatcaacttcaatctcttcttcactctaacccattgtatctcatacttttggctgcgtttgctctgattctgatccttacactgattcttatcataatgtgttgttggaaacgatctagtggtggagggcgaaagaatggatatcagtctggaaaaaagacgagtgccggagctggaagtggaggtggaataggtggtcttggaggtccacctaatgatttatggattaatggaactggaagtcatatgagagctggtggtaagtgttacacaatctaggtcttatccagaattttatttatttccagcttctgattatatggttgatggtctagcaaccgcccatcttactgctgctgacattgaatcacccacacctagataccatcatctacaaggtatttttaaattcgatcttatcttccttccaatatttatcaaattatccttatttctctaa

SEQ ID NO: 28737 - DNA, 394 bp, Caenorhabditis elegans
gtcattgctgcaacgaaccgtatcgatgtgctcgatcccgctcttcttcgttctggtcgtctcgatcgtaaaattgagcttccccatccgaacgaggatgcccgtgccagaatcatgcagattcattccaggaagatgaatgtcaagtatgttttcgcgacagttttatttgtaaaatttagtctaattaatttttttcagcaaggatgtaaactttgaagaactggcccgctgtaccgatgacttcaacggagcacaatgcaaagcggtttgtgttgaagctggaatgattgctcttcgacgagatgctactgagattcttcatgaagactttatggatgctattctggaggtccaggcaaagaaaaaggcgtccctcaattactacgcttaa

SEQ ID NO: 28738 - DNA, 436 bp, Caenorhabditis elegans
attcacggtgctcgcgagcaaaaagaacggtcggctgctttgaaattgttccgaagtggagctaagccagtgctcatcgccacggctgttgttgagcgtggtcttgacattaaaggtgtagatcatgttattaactacgacatgccaaataacattgatgattatatccatcgaattggccggttggttatttcctgaaatgttttattttttgtaattaccgtttttcagaactggacgagtcggaaactcgggaagagcaactagcttcatatcattggcagacgatgttcaaattctgccgcagttggtgcgaactctagctgacgccgaacaagttgtgccaagctggatgaaggaagctgcaggagggacctccaatcctaataaattcgaaaaatctattgataccgaggaaccggaggaagcttggtga

SEQ ID NO: 28739 - DNA, 282 bp, Caenorhabditis elegans
ctttgcttccgcaagcaaaaaccaacttatcctgatattgccgacaaaagaccagatgttaaacgattcttcgataattgctttgaatttcttccaaatgatcggcctacagctgcggaacttcttcaaactacgtttgcaaatgttaatataacggtaattatcaagaataaatagaaaaattagtaaatttgcaagtttcaggacgaaaatcatatcccggactatcaatcacaatcttcaaaggacaaatcgtcaccaagctcgttttttctagtctag

SEQ ID NO: 28740 - DNA, 1079 bp, Caenorhabditis elegans
atgcacctatgggaaaagtatcaaatttcaagacaaatcagtggttttgttcacgagagaatttgcctagtttcagaaggtttatgaaatatcaattagtattaagagtacacaaaattataggattttttgttgaaaatttaaaatggtgcttctccgtttaagatatatttaacaaaaaatctaacaaaattaaattggtaaacgttgatataaaaaatcagaaaattggtttggcatttcagaaaatatttcaagatggatcaatcgtacttgttaacagtatcaattttaatttaatttaattttttttcaaaatataataaatatgtttaaaaattcattgataataaaaattaaacgtttttcataaatcaaacttcgaaacattttcataaaaaggtagcacaagcaataagaaatgttcttatcacagtcaacctagatgacatgaaatattaaatgataactgttttcagaattcaatggtggagtgcaaagtggagggctgattaaaaatgaatccgaattgactcaaatgacaatcaaacaagaaacagaaggaaacataaatgaagctagacgagaagaagaagacgaagaacaagatgaagattccagaacatcaatgccacctgcattgggagaagatgatgattatgaggaggatgatgctgatagttttattgataaaactaatgtaatactatgtttcttctagttttacaacataatatttaaaattatacggaaaatgatgcggataattttaattttcatcaacacttgaaaaaggaagtctaggactaagattttctaaaaattatatcaatgtcaacctgaaaagttaatatcataatcagaaaaaagtatttttattaaacgaaaaaatgaaaaaaaaaccccctttttgcccctgattgctcaaattaaagtataaaaaagaattttaaacttttcagacaccgccaccatcacaatcatttctggaaggatgtcgagcagctaatttaccaaatgacattgttactggtgcatgggaaacgtacaaccacgcggttcaacgggtttctcttgag

SEQ ID NO: 28741 - DNA, 210 bp, Caenorhabditis elegans
gttgacaaactttcatttaccgatactccaaactacaaggaaatctacggacttctcaccaacgctattctcttcagtggaaaaaatgtatgttttacaaactctttataaaaacgtgcaaaattttcgtaattacaggaattcccgtacgattgggaggaggctgagatcaacgagttcaagaatccaccaaagccaagtggagagtag

SEQ ID NO: 28742 - DNA, 983 bp, Caenorhabditis elegans
gtagttcttgctctcggagactatatgaatgttcaatgtcatgcctgtatcggaggaacaaatctcggagaagacattcgcaaattggattacggtcaacacgtggtttctggtactccaggacgagtatttgatatgattcgccgtcgtaatcttcgtacccgagcgatcaagcttctggttcttgacgaagccgatgaaatgctgaataaaggtttcaaggagcagttgtacgatatctaccgatatcttccacctggagcacaagtcgtacttctgtcagccacactgcctcatgaaattctagagatgaccagtaaattcatgacagatcctatcagaattcttgtgaaacgtgatgaactgacacttgaaggaatcaagcaattcttcgttgcagttgacagagaagaatggaagttcgacactcttattgatctttatgatactcttaccatcacacaggctgtactattctgtaatacccgtagaaaggttgattggttgacggataaaatgaaggaagccaacttcacagtgtcatcaatgcacggagatatggaacagaaggatcgtgatgaagttatgaaagagttcagagcaggaacaacgagagtgctcatttcaactgatgtttgggcgagaggattagatgttccacaagtctcgttggtaagatttttttttagtttcttctcgatttgtaataaattaaaatgattagttttgcaaaaaaccagcaaaaaaaagttgtcatgaaatatagacaattcagtaaaaacttttttcaggttatcaactatgatcttccaaacaatcgtgaattatacattcatcgtattggtcgttctggacgtttcggacgcaagggagtcgccatcaactttgtgaagcaagatgatgtcagaattctgcgagacattgagcaatactattcgacacaaatcgacgaaatgcccatgaatattgcggatatcatttga

SEQ ID NO: 28743 - DNA, 365 bp, Caenorhabditis elegans
atgtattcaattaaaaattgggccattgaacttctaattaattcaatttataaatttatcgtgatgttttcttttagttaatttgtccttaatcgtgccgtctattttatttcttcataaaaaacttttcagttccgacatggagaataagccacctgtaatcaaccttccagagaaggaaactgtgaatactccacagaagggagggtaagaaatcaaggttttaaaagtttataaattattcttgattttacagaaaatttactattaacgatttcgagatcggaagaccactgggaaaaggaaaattcggcagtgtttacctggctcgcacaaaaactggacatttccatgtagcgatcaag

SEQ ID NO: 28744 - DNA, 1438 bp, Caenorhabditis elegans
atggtacccagccgaaatggagaaggaaccgaattgtatgcacattctgaagagcttgaagcaaaactgagagagcttgccaggtaaatcagaacactttcaaaaacaatttttttttgttttacaagccatgtagcttttgcatttgtcttgaagatttgtgtttctaaatcagaagtgaatatcccactttttgatatttcagtctggtattgtattttgagccgttaacgtacattttatgtttcagaagagggcatatggaaattgaaaaagaattagcattggaaaagaaaacgtatggatcacatatcaaaatactcattcttggaggacctttaagtggaaagagtacaatttttaaacaaatgcagtgagttgaaggttgtaagaaagaacaaaagtcatgaatgaaaaaaaaaagtttgagatgtaatttggaagattttagcagttggtaatgatattcgaagatgtgcattcaaccagcaaaataaaatgaattcctattgactttttcaatatttcccactatactcacgagctgttcaagttaaaaaaaatttgttatcatgaaaaatctgatactgcaaaaatagagaactttaccatgtcgaagcatgttggagtcgcatctcacccgcttcttcactctctcccttcttgcacctgcagccttgtgtgaaattgccgttcacatgatttttttaaagacggtcaggcaagggaatggcagatgcgggtgtaaagtaaatagtaccacgtggaagagctcgatcacagctttgacattgcggactaatggtgcacacaacgccaacgagatcgggtacagtggccacattacgacttgcagccggtcgttacgtgctcattgcgattgatggttttgtgatgtgcatatttgagctcactgaaggattgtgcacatttcaaatcaactggtgtactcaatagctgcatttttttaatttcagaaccacattaaaataaatgaaagtttgcaatgcgtgactgggttttgaaacctggggttacggctgggtttggcaaagattttaaatgttttgtaagacttttgaaaataagatgcatgtacatgcgcacaatctaaacgtatcttttttctcagaattattcacgtcgacgggttcaaaaccgaccaagaattaatacaatatagaggacttattgataacaatataagggatatatatctacaattaattgctggttcacgtgtagttggtatacctctggatccaattgaacatattacatatgaaattgatgaaatctatgctccaatgtctgatgcattttctgttcggacaatatcagaacttttggaacctttgacagagttttggaattccaaacaaattcaggagatttataagagaagatgcgagttcgagttattggattcaactaaata

SEQ ID NO: 28745 - DNA, 375 bp, Caenorhabditis elegans
ccaacttaaatttgactcaactcctgactaccaaatgatgctcaaccatttccaacaaatgtatgcccgtcttgaaattgatgaatctgaaccaatggattttgaagaaggatctgcgttctatgaagaacattttctaaacaatgatacggattcggaagaagatacggatgacactacaacagatttggatagttatgaaaatgagaaatcaaatgttgtcacaattggaactgaaagtgatgccactcaggaagataagaaattggggaggtactgttcaatttggtaaatgtcatttttaatgagaatattcagtatttcagacttgccgctggactcaatcgagcattcagtcgtttgatgccattttag

SEQ ID NO: 28746 - DNA, 185 bp, Caenorhabditis elegans
aataagtgaaattttatcgacgaatatcgatatttctcgaagggttgatttaatgtctcgactcacattcccactcacatttttctcgtttttaagtaagtttttccttagtttccaaccccatttcaattttgaaaattgcagttttctactacgttgcatatgtgaaacagagccgtgattaa

SEQ ID NO: 28747 - DNA, 2168 bp, Caenorhabditis elegans
atgattccaggtatgcgggcgacaccgacggaatcatttagttttgtatatagttgtgatctacaaaccaatgttcaagtgaaagtcgcagagtttgaaggcatttttcgtgatgttctcaaccctgtcagaaggttgaatcaattgtttgcggaaattacggtaaagatttcatttgtgcaaaactttaaaactatcgaaattaagaaaaatggttgtgtaaacgttttaaacataatcacaattaaaaaaaaaacttttttatcccacaaaattcgtgtgaaatttgaataatatgtataaattttaaaaaaattaaaaaatccaagtaaatttatttaaaatcaaaatttctgaaattcaataattttttactaattgtaaaacatatattttgtaatttcatttgaaaaaaatagttctaaaaattaaatttaaaaatatgaattttttcctgaattttgaaatatttcaaaattgtattatcaaaatgtatagaattatatataagttagaaagaaaaaagttcaaaaaatatcctgatttggcttagaatataaagttttaaaaaattcgaaaagatttccattcaattcagaataaatattaaataaactacagaaagatgattaaaactacatttttcctatcaaatttcgatttcttttcaggtatattgtaacaatcaacaaattggttatccagtatgtacatcatttcatacaccaccagattcctctcaacttgctcgtcagaaattaattcaaaaatggaatgaatggctgactcttccaattcgttattctgatttaagtagagatgctttcttgcatattacaatttgggaacacgaggatgatgagattgtgaacaattcaacattttcaagaagactcgttgcacaatccaaactctcaatgttctcgaaacgtggaattctgaaatcaggagttattgatgttcaaatgaatgtttcaacgacaccggatccatttgtaaaacaaccagaaacatggaaatattctgatgcatggggagatgaaattgatttacttttcaaacaagtaactcgtcaatctcgtggtcttgttgaagatgttccatggttggatccctttgcatcacgacgtattgaaatgatcagagctaaatacaagtactcatctcctgatagacacgtatttcttgttctagaaatggcagcgattcgattgggacctactttttataaagttgtctattatgaagatgagacaaaaaatgaaaggatttgtttttctacacagttttggtctattttgaaatctaacaattgagaaactacaatttctgtttcaaagaatcaattattttattcgaaaagccttccatattataattttcaacccaaattaattctactatgatttaaaataaccaaaccaatcaaaaaaaattttatcttgaacttcgaattttcagatgcgagtctccacgtcagtcaacggtggtgttgggattgtttcggcctgtacccgttactgtgtagctgatcctgaacttcttctagaatctctggcggaagttaaacacagtgcaatgacacgtcgaatcagagatgttgaagatgagagacatcgacaagtaaaaccgaataaacaagcaaaggatcgattggagactattgtgaatcttccatcatctcaagttcttacaagagaacaaagagatttagtatggaaattcaggcattatttaagacaatttccaaaagctttgaacaaatatctacgatcagttaattgggttcatccacaagaagtaaaaactgcattagctctgatgaatgattgggagctgattgaagctgaagatgcattagaattactttcaagtgcattcactcatccggcagttcgtgcatattctgtatcccgtcttctagaagctgcttctcctgagcaagtcctcctatatcttccacaattggttcaagctttgaaatacgaacaaggtcaacaactgcctgaagaaggaaatccagtgccggtggtttctgaagaagagggaaagatcccatcagttgcaactacgccaactgaagagctagaaggacgagatatgacagtggttacgaagaaagaggctagaaaggcggctagtggagatttggccaccttcctgattga

SEQ ID NO: 28748 - DNA, 367 bp, Caenorhabditis elegans
atgagttcttctctttacacgggtggccaggcccttttcatatgcctggcgttcattggcctcgatcttctggtcaatgtattcggacttgcttggaatggaaaagtatgaaaatatgttcaaaattcgaaccaaaatctcttttcagtacttcacgttcgacaatatcgctcactggtttgatttggccaactatagttttttgaaaaatccagtagattttttggtagatcagaaaattttgttcaaccaccataaattgagtattttaggcggttgcgttgattcgtgacagtattttgctcggcggagcagtttcagcatgggcttcaccttccggattctcacaagtcgccgaaaatgtcaa

SEQ ID NO: 28749 - DNA, 405 bp, Caenorhabditis elegans
atggacgtcgaaaccgccgttcgttctgctgttgatgccggcgcgttcattcgtccaactttcgaccagaaaatcttcaaggatcagtgcgcgtactgtttcaaagacccacacggaaaaggtatttactgaacaaaattgaaaaaacttatgtttttacattatttaaattttccagatggtctctacattagtctgaagaactatcacgctttttgccgcgagcacgcagaaatctacggaacaacctctggaaacactctttttgtacaatttgagtccacaaaggtacttctggctgtaaatattggaaatttaattaaaatttcagaaaataattgaagaaagaaccgatggggagccaacgagcaagatgaccaagctcacaatcgattcagatccaaa

SEQ ID NO: 28750 - DNA, 822 bp, Caenorhabditis elegans
cacattggttgcccacagtttgatgcgatgctccagcaaatctcatgcaggcagacgttgagagtaaatgagttgttttcacgactaaatggaatgatattattgcagataatggcaaagcttcaaggatatccgaatgtcgaggaagtagttgaacttgtattagattgtgttggaatgacagatttcggttacaagcttgtcaagaattgaaggtttaaaattatttgaatggtttatcactcttcacttgaaactttcagcggtggtcaaaaacggaagatctcggtcggaatcgcgttaatgtctcgtgcctcgtgtatcattcttgatgagccaacagctggaatcgatccgcgtgctcgccgtgaaatttgggatatcattcatgagatgcgggaacaggggaaatgctcaatcgttcttacttctcattcaatggaagaatgtgaagctttgtgtacacgtatcggaattcttcatagaggagaaatgattgcattaggaactagtcaatcattgaaatctcaatatggtaacacgtacatgatgactcttgttctcaacagtttggaaggtttgacatcggttattgcaattgtcagtgaagagaagccagatgcagtgttgaaaactccagaatcaagtttgactactagtattgtttgggaggtttgttattgtcaagtgatccattttgaattaaaatgtttcagcttcaaaaatctaaatctgataaatggtccgaaagtacaatcaagtggaaattcttgcaaagaaagtcaatgcaaaagactacatgttgacccaagcatcacttga

SEQ ID NO: 28751 - DNA, 296 bp, Caenorhabditis elegans
aaccaaggcctactgatcggaaaaggaggtatccatggaaacgttctccgtatcaaaccaccaatgtgtattactaaaaaggatgtcgattttgctgtagacatcattgccaaatcaattaaacaatacaaataatttcataggcgccgtcatttcttcatttcgatattaccaaattcttgttttttgttgttgtttcaaactataattcaaatattcaaaattctttcgggttctatgaaattattgttccaaaacgcttcaatttgtattgttcagaccactcccttttttaa

SEQ ID NO: 28752 - DNA, 388 bp, Caenorhabditis elegans
atgactgaatttttctcgcagaagcagattgatggtaagtgaaacaacactataattccaagatttgactccgaaatctttactttattgtttctcatcagaaattcgtgaatgcttcaacttttattcaaccagtggagtactaagaacagattctcaacttcgatgtgctctccgaagtcttggatattctccaactgcttccaaaactgatatttatttcaagaagcttaatagtatgagttttagaacattacacttctgaatgattgctatttatttcagaaaaaccaatcgaatttgcaacatttttggacatttgcaaagatgaacaaaatagtccgaatccactgacggagattatcaaagcgttaagtggattggatag

SEQ ID NO: 28753 - DNA, 1052 bp, Caenorhabditis elegans
aactgaaactatgtttgctgaaaatccattcttcactcccaccgagtccaagttgaaatcggagatcgcacttcttcaaatgaaattggatgacgaacgatttgatcatcagaaaacgtaagttgtttgaactctaggacaacgtgcaacctgttatatagattatattgtactaacccattcttaatatgttcaatttcagacgacgagagcttgccaattctcgacttgagatctctgatctgaaaggggaagcgaagtgccatgattcggaactcaatcgtctctacacaataatcaataatttggaaaagaaggttgaagatttgaatggagaacatcaaaagtcattggaaaaattgaaagaacgtcttcatgaaaaggatgcttttatcgaggcttgtgaagaattctatgatgagaagaagatcaatgtgaacaaaatgacattgatgaaacaagaaatggaattgaagagaatcaaaaagaactttgaagaatacaaggaaagaatgactgaagttgagaaaaatttgaacgaatttatcaaaagacaatcggccatttgtatgggagtgagatatgaattgaatatggaaaaggattcgagagagagatatttcaaagaagctcaacaattgaaacaagagaaagatgtattggtacatgaaatcaatgaaagagaagtcagaattttgtgtctgagaagtgatattcttacattgaaatctgaaaacaacgacacctctaaggaacttgatgaaatgaaaaatggaaccaaagctttgaaacatgaacttgaagagaccaagaaaatgaaatccgaagccttgtcgaaatatgaagaatctcaaaaagagttcgaacagttcaacttgaagttccaaagattgtgcacaaagttctacgaggaacgtgtctcttctcagacaacttcacctaaaatgaaagaacatctggcatctgctaagaaacgattgtctgctatcaaggaaacactccaaaatgaagaagattttgatgaaaccggagaagtaaccaattatcaataa

SEQ ID NO: 28754 - DNA, 1294 bp, Caenorhabditis elegans
aactagccatgggaaacaaaatggcccttccacagaagaaacaggagaagcccactcacgcagcaatgaagatcgcaatgaaaagcggtcgacgcggcatcgagaacgccaacaagcttccgacagttgcaccaaagcgacagtgtcttgtgcgccttctcaagatgaacaggattcatgattacttgcagttggaggtttgtgaaaactaaattatcagttcatccctagaaagcaaagagttcatccctagagagcaaagatgcggaatttatctaactcgaggtctttaacacttcataaagccatagcttgtagtaaatgtagtttgcaatctatgacgtcatcattacacgaacttcaaatcgttgtagggttggagtagtaggatagacgtagagaattttgttttgtttatgtcagttgcgtagggatcctatgactgcagttaaatggttaacagttgttttcattacagaaagagttcatcactcgtcaaacaagccgtcatggtcgccctcttgctgtccaaaaacgtcgtgaacagcaattagttcaaagtctccgaggaactccaaccacattggctcgtgtccacgagcttttcgatgatgagaagcatgccgttgtggtcgttgaaggttcgagacgtgaatggtacgtaccaattctctcgatcgtcgacaaggacttgcttcgtctgaatgccctcgtcatggtgaaggctggtggaatgttcaaaacagttccaagtgcaatcgttggagttttggatgacaagattgacagcaatgcgatgggacataaagttgagaagacaccaaaagagacattcgatgacattggaggatgtgagagtcaaattcaagagctgaaagagtctgtggaacttcctcttactcatccagagtactatgaagaaatgggaatcactgctccgaaaggagttattctttacggtgaacctggaactggaaagacgcttttggcgaaagcagttgcaaactcaacatctgcaacattcatccgtgcaactggatccgatcttgttcagaaacaaagtggggaaggtgctcgtcttgttcgtcaaatcttccaaatggcaaaggaacaggctccatcgattgtattcattgatgaaattgatgcagttggtacgaaaagatttgatacttcttcacgtggagaacaagaagttcaacgaactcttcttgagctcttaaatcaattggacgggtttgaaagccgtggagatgtcaaaattatcatggcaacgaacagaatcgactcgctg

SEQ ID NO: 28755 - DNA, 341 bp, Caenorhabditis elegans
gcttaataaactattccttttccggaaaaatgtttataataattttctatgtacattttttatttataaatttccgtgaactaattttttctgttattttcgcccatttttagcccatttttaccttgtgatcaaagaaatcaatcattttttaaattggtgcgtagtttaataaaacgatcagttacaaatatagtgagtttttcatattattacttatttttattcttattttcagcttaacatctttcgatataatggctgatgataacattactctcgatattcaccaattcatcaaaagtcatttgttcgtcaagaattggatcaattacagacag

SEQ ID NO: 28756 - DNA, 950 bp, Caenorhabditis elegans
atgactctcaccgaaaccagcctgtctcacaatgccgaagagggaaaggatgagggaggccgccttcaacagtacaagaatctcaccaagcatgaagtatgttaaattattgataacagatttcatgcaaaaatgttactatccgacttatttaaagtaattgcgagatttatttatttgttctgttcaggagctccgtcgtcgtcgtactgaatgcagtgttgaaattcgaaagcaaaaaggagcggacatgatgatgaaacgccgtaacatcgtcgacgtcgatgaaggtggcaattcggaatcggagctcgaggagccagagaagatatctcatcagcaatcatcaacccgtttgtcaaatgatgagattagagctattctctccaacaatccatcggaagatgatatggttcgatgcttcgagtcgttgagaaaatcactatcaaagacgaagaatccacctattgatgaagtcattcactgcggtttgcttcaggctttggttcaggcattgagcgttgaggtaggtcgatctttatttccattcaataatttccaattttcagaacgagcgtgttcaatatgaagcagcttgggctcttaccaatatcgtttccggttccaccgagcaaacaattgcagctgttgaagccggagtaacaattccactgatccatctttcagttcatcagagtgcgcagatctcggagcaagctttgtgggcagtcgctaacattgctggagactcatctcaacttcgtgattatgttattaaatgccatggagtggaggcgttgatgcatttgatggagaaagtcgatcaactgggagattcgcatgttcgtaccattgcatgggcattctccaacatgtgccgtcataagaatccacatgccccattagaagttcttcgtgttctgtcgaaaggtcttgtcaaacttgttcag

SEQ ID NO: 28757 - DNA, 664 bp, Caenorhabditis elegans
atgcgtatatcgataggccggatagcatggcaaattctggcagttttaatcgcagttgcattcactattgaacatgattccgtaagttattcaatcaactctaaaatacttattatacttttcagatttgcgatgaaagtataggtgcctgtggggaaccaatacataccgtaatacgtttagcaaaaagagatgatgagcttgcacggcgaatagctgctgatcatgacatgcatgtaaaaggtgatccgtttttggatactcactacttcctttatcactcggaaacaacaaggacacggcgacataaaagagcgattgttgaacgattggattcacatccagccgtcgaatgggttgaagaacagcgaccgaagaagagagtcaaaagagattatattctcctggataatgttagttttttagaaatattcaacctacatgatatttatccagaatcattaccgtttttctttttatcttagctttagagttttttctgacaattaatatttttcaggatgttcatcattctaaccccttccgccgttcggttttgaaccgtgatggtactcgtagagctcaacgacagcagccacagtctccacgagaaattccatcacttccatttcctgatccactttataaagaccagtggtatttg

SEQ ID NO: 28758 - DNA, 664 bp, Caenorhabditis elegans; identical to SEQ ID NO: 28757

SEQ ID NO: 28759 - DNA, 664 bp, Caenorhabditis elegans; identical to SEQ ID NO: 28757

SEQ ID NO: 28760 - DNA, 664 bp, Caenorhabditis elegans; identical to SEQ ID NO: 28757

SEQ ID NO: 28761 - DNA, 664 bp, Caenorhabditis elegans; identical to SEQ ID NO: 28757

SEQ ID NO: 28762 - DNA, 559 bp, Caenorhabditis elegans
tgtgattgtctcccagtggacttctgtgctgaatcttgtggaaaagcatattcaagcaggcggccacaactatacatcaatcaccggccaggttcttgtcaaagatcgccaagaacgagttgacagtttcaaccaggaaaaaggcggagctcaggtgatgctgctctcattgactgccggaggtgttggactcaatttgattggaggaaatcatctgattatggttgatttgcactggaatcccgcactggaacagcaggcttgtgacagaatttatcgaatgggacagaagaaggaagtctttattcataggtactttttttaaaaatcatgttatgtgtctaaatactatgtacatatttttagactaaatatttcaaaattttgcagattaatcgtgaaggggaccatcgagcaacgagtcatggatctccaggagaagaagctcgcattggcagcttcggtgttggaaggaacagcgacccgaaaattgaacaagctcaccaccgccgacattcgtatgctctttggactagacggatcgagcaatgcgaattaa

SEQ ID NO: 28763 - DNA, 536 bp, Caenorhabditis elegans
cttccacgagacttcagctaaattgaatgttcacgtcgatacagcgttttacgatttagcagaagcaattctggctaaggtaaagttttaaaatgtttttaaaaattaaaattaaggatgtgaaaattcgaaatatattagtacattctttgcacgggcgaatatatgttctgatagtattgaaatcgacgaaaatgtgataattagattgctaaatgcattagaatctgattttttcttgtgaaattgttcgtaattagttgaaaaatctaagagcctttttatttttgtcctcattactcttctagtacaaaatatgaagagcgaaacttcttcgtttttaatcatgcaaaaaattttaatcgcttcgtcaaaaattgcaccagaataatctaaattagtttcattaatacgattgtttttttttcataatttgtttttattttcagatgcctgattccactgacgagcaatcccgcgatacggtgaatccagtgcaaccacagaggcagagtagcagtggaggatgctgctag

SEQ ID NO: 28764 - DNA, 706 bp, Caenorhabditis elegans
atggctcgccgaccgtatgacatgctcttcaaattgctgctaataggcgactcaggagttggaaaaacttgcattctgtacagattttcggatgatgcctttaacaccacattcatctcaactattggttagtttttattcagaatctagtgatttcaaaataattttcttttttcattcaggaatcgacttcaaaattaaaactatcgaattaaaaggaaaaaagattaaattacaaatctgggacacagctggacaagaacgattccacacaatcacaacatcatattaccgcggagcaatgggaattatgctggtttacgatatcacaaatgcgaaaagttttgacaatattgcaaagtggttgcgcaatattgacgaacatgcatcggaagatgttgttaaaatgatattgggaaataaatgtgatatgagtgatagacgagttgtgagcagagaacgaggagagaagatccaactaccaccactaagctgtcaacactttgccctttgctttcgccaagctcttgtgaagcagctcatgtcttttttctttttcatccttccaacaacgcgcgctctctctctctttctccgtctctattccttttctcgttgtctcggttccatcgatctcccattcaacatacggccgaggcgccctctcttgtctgtatctctggtctctctatcatctagagaatga

SEQ ID NO: 28765 - DNA, 522 bp, Caenorhabditis elegans
gatacaaatatgcgatcgagtgcctgaatgctggacgtatcggaatcggagcacaaatgttaggattggctcaaggctgtttcgatcaaacaattccatatcttcaacaaagagaacagttcgggcagagacttatagatttccaggtattatttgtcaaaagactgaaattaaaatattgtaattatcaaaaattttcagggaatgcaacaccaaatcggacaaacacgaatggaaattgaagctgctcgtcttctggtctacaacgctgctcgcatgaagcagaatggacttccattcgttcgtgaagcagccatggccaaattgtttgcatcacaagttgccactacagccacttcgaaatgtgtggaatggcttggaggagttggattcaccaaggaattcccagttgaaaaattctaccgcgactcaaaaattggaacaatttacgaaggaacgtccaacattcagctcaataccattgccaagctcgttgacatcgaatatcaacaaaaggcttaa

SEQ ID NO: 28766 - DNA, 440 bp, Caenorhabditis elegans
atgttatcaaggtcgtctagtgctttaacctctactggaagcaagacaagcagcatggagaatattctttatggtttggatgatgagagacgacccaaatgggtttctgcgttcgatattcaaagcacggaatcggaggtaaatactgtcattaaaaatttcagtataattttttcattttgcagaatgatttagatgcagctcttatctatcagcgcaatataagttcaaatgcttcaaatgcgtcttccatagtcaacctagctgaagagcgcattgttcaacttgggctccaggtgatcacaccggatttcccagatcgcccgtcagaatcatcgtcaaccacaccagcaggagaacatctcccactcggggaagggggtcatcagattccttgtggaattcttgacttctcatcgatttctgacgacgccgaataa

SEQ ID NO: 28767 - DNA, 412 bp, Caenorhabditis elegans
gttacaagtacgcaattgaatatttgaatgctggtcgtatcggaattggagctcaaatgcttggattagctcaaggatgttttgatcagacaattccatatcttcaacaaagagaacagtttgggcagagaattattgatttccaggtgagacataaaacatgacagagaaatatatatatacaatagacttctagggaatgcaacatcaaattgctcaagtcagaactgaaatcgaagctgctcgtctgttggtttacaatgctgctcgtatgaagcaacacggattaccatttgttcgtgaggcagcaatggcgaagctctttgcatcaccaaagaattccccgtcgagaaatactatcgtgactgtaaaattggaacgatttacgaaggaacttccaacattcaattga

SEQ ID NO: 28768 - DNA, 884 bp, Caenorhabditis elegans
atgctctacactgtaatcaacctcctagcgtaagtttcctttgaaatattcttgaaaaatggttttttttctagacaaatctattgcaatggaccaattcttcaaactgtacaagattcacacatgtttccagactcgaagcacttcgtcgatatgtcactaaaatatgatccaagtaaggtttttggtttttaatgttgttgttacgtaaaaatcacataacaaaacataaaaacaatctatcaaagacgctatctttatcacctgaaccggtttttgcaacggagttgtaaatttgaaaggtcttgttgattgtaaattaaatctttgttaaaagtcaggaaagaagaatattttcaagcagctgacagacacgagcttcctcaaattcaaagagcaattagaagtcagagaatcaactactgacctttagtgttttgggaaaaaaattgaaatcaggccatatcataacttttttggtggatgatgattggtaaaaagataattgaattacatcttccaccacgtgactttcgaaaaaggaatgctaaatgttaaaattgaatgaggtaagcaattgaaaacgatgagaccggtttttgggttatattttgtgatcgagatgttcgaaaaacgaatgtttaaatttttctttttcagttacgacacttcgacatttcgacgagcttggtgatcgaacttcagatatgattattttaagggaatttgtaacttcacattttaatccgcctggaagtgagctggttgaatggtttcctccagattgggtcgattttccatcaaactttttgaatattcatgattatcaccatagacgatgggcattgcatttacataggatttggaaagatttatgtagaaaa

SEQ ID NO: 28769 - DNA, 1250 bp, Caenorhabditis elegans
atgggaatcactggattatggaaaattgtagaaccaacggcaacagagattcctttggaatgtttagaaggaaaaaaattggcaattggtaagctaaaaaacaaattcaaaactatgtaaaattgttttatttcgtatatttaagttttcatgtattggggtactgtacttttcacttttattctgacattacatgttttgtaatttttatcattttttcagatgtttcaatttggatctatcaggctcaactcgcatatccatcggatcaaccgtttccacatctgcgtctccttgtaaatcgtctctctaaacttttattctacaaaattcgtcctgttttcgtgtttgatggaccacaagtaccacctctcaaacgtcaagtcttagaagcgagacggcaaaaaagacagaatgatgatgatattcttaagaattcgaagaaaatgggaaaattaaaggtgctgaaaaaatctcaaaaaattagggtaaaattaatttatttagaacttcatgaatttttcagacagcgaaaaaataacaaaatttttccatcaaaaacatgacgaaaaacaacgaaaaagctctgttcatgaagcaagaatacggcgcacggtctcgaaacaaccgaaaattttctttgaaaaatactccgaaaatggttatgcgcctttaagtagtactgtagctcccgtttcctattttttgcaattaaatttttggttgttaaaagacaaactagattttttttgttttttaaaagagcaaaaaaatgagcacactcttcacgatcttcattaaaatatatcgattcgtttcaagacccggctctatattctcgcatcaatttttttgaagtttttaactgtttaaaaagttttaaattatttccaaattcttttgttaaaccaatcaattttcaggaaattgccagtggtggtcttgatgacgtggcacttgcgaatgcaatcaaagaagttataagtccatcgaaaaaagtaattctgaacgacatttataaggatattccctcaacaagcacatatttggataaaccttctgcacatcaaaatgatcagcttgtttatggaaatattgaagattcagattcagatgatagtgatattattattgtacctactgtaaaagaagaacgaatttcgaaacaatttacttctcggaaactggaaattcaaagtctcgtggaaaaaagagagatcatgagaaatagcagattacggcctgatatg

SEQ ID NO: 28770 - DNA, 820 bp, Caenorhabditis elegans
atgttcgtagccctgggcgctcaaatttatcggcaatatttcggacgacgcggtgagcggtttttggattcttgttgttctcttttttaatttttttctcactggttatattttaaatttctcgaaacaaaattgatcgatgatcaaacttcttatttgataacgaatcaacagttttgatttaattccatttttcataatctcgtcattttgttttgccttttttttaattgtccttttttctttctaatacctatttttatattaattgattgctaatgttttaattttaatggaggttacatttaaaagttttgctccgaatatatttgaaagaaattccttcacaagcatcatctagtatttttattctttttatattttgtgcgagaaatcacaatccccctataacagctaatagttttcgcctttaaactcaaaaatttttcaatttgcatcatattccgatatttttcaggaatggcgatggcaaataacagttcggtggccaataaggtctgtctcatcgttattgatggatggggagtttctgaagatccttacggtaacgctattctcaacgcacagacaccagttatggacaagctgtgttcgggtaagattttatttatttcaaaattgttaacccaagaacatttttccaggcaattgggctcaaattgaggcacatggtcttcatgttggtctcccagaaggattgatgggaaattcggaagtcggacatttgaacatcggagccggacgtgttatctatcaagacattgttcgtattaatctggcagtcaagaacaacaaattt

SEQ ID NO: 28771 - DNA, 524 bp, Caenorhabditis elegans
gagtattcttctcctgctgtatgctcgttgtttctgcttcggttgtcttcaccattgttgtccttaatttacacttcagaagtgctgatagtcacgagatgaatcctctagtacgtcgtgtacttctggaattccttccttggcttctctttatgtcacgtcctggatacaaatttgtgaaagctaatgtgattgatagcactgacaaaatgccgaaaaagccaaaaaatccactggagttagttttaacagttttattgaattaaaaagtgacaattttcagctgcaatcttccatctaatcatgctggatatgaagcacaaattctacttcttcattcggttcatacagaattaagaagagttgttgctttttataacaaggaagaacatgatgaaaggattcaaacggattggagattcgcggcgatggtcgtcgatagagcgtgtcttctacttttcaccgtttttattgttatttcaatattggctattatgatgtcagcgcctcatattattgcctaa

SEQ ID NO: 28772 - DNA, 630 bp, Caenorhabditis elegans
atggaaactttggagcgttctgaagaaactgtgtaagtttggtttttgaagtttatcagaactcaggtctcaatttttccaggatcttgatagatggattggcaattccaaaagtgaagccatatgtgccgatgttgaaagatcgaaacggttctgagtatttgtcaaatgatcaaatgtttcgcggaaagtttatggtgaaggtaagggattttcaaaacaataagcaatgctacaaaaatggctactgaaaaaaaccacgtctgcgcctttccctttcccatgatttcttgatgctaaaaatgaaaacgttctcataagcggttcgagctttcaaaaacttctttgatcaatgtgaaattttgcgcagaatcacttccaaatatttataatttttattaaattaaaaaatttaggggcttatcggacgtggaggtttcggccaaatctactacggctcagacgctacattcccggaagatgttgtcatcaaaattgagccagtggtcctgaaaggaaggccaagacgacgaatgatcttggagcaaaaagttctctaccgtctgcagggaagacctcatgttcccattatgtgcgcttcgggacacacggagcaattgaattttattg

SEQ ID NO: 28773 - DNA, 583 bp, Caenorhabditis elegans
atggacaattatgaaaaagtgcgtgtcgtcggacgtggtgcttttggagtttgttggctgtgtcgcggtaaaaatgatgcatcacatcaaaaggttagtcagacaattgtaatagtttcgttggactcttttacatttgaagcctggtatggtttaatttagggaaaataatcaatttttagaaatacttattttattggaaaatcagtttttttttcaaatagcagtactgtgttataatctactaactttataatttaatttttcaggtaattataaaactcatcaatactcacggaatgactgaaaaagaggaaaatagcattcagagtgaagtaaatttgttgaaaaaagttcaacatccattaataatcgggtatattgattcttttattatggataatcaacttggaattggtaagtaaatttaattttaaaattgaattaaaattcgatatgttcagttatgcagtacgcggaaggaggaacattagagagattaataaatgatcagagagcgattaaagattcaaacatgagagaatattttcccgaaaaaactgttttagattattttacacag

SEQ ID NO: 28774 - DNA, 414 bp, Caenorhabditis elegans
gaaaagatcctgatcgccaagaagaaagtgacccgaatgttgataacacttgtgattgtttttgcattttgttgggtgccatcttacctgtattggctactactcagaatggctgaactagcggtgagttttttcggaagattttccaagtttttcaatttccttttcaaacgaaaatcaaactaattctatttggaacggatctgagcggcatatagttttggagaatttacaaataccaaatatacattttaattttccaattgtataatatttttgcataacatttactgattttttcggccaaaacattcgaccaaacgaatcatatcattacaggcgactgatttgtggaatcctggactcaactcatcattgacaatcatgacatacatcagctctttggcaaatcca

SEQ ID NO: 28775 - DNA, 903 bp, Caenorhabditis elegans
atgaccacaaaggaaggatttgattatcgaaagtttcttgttgatctcgcctccggaggcactgctgcagcaatctcaaaaactgccgttgctccaattgaacgtgtaaagcttctacttcaagtcagtgatgtctctgaaacagtaactgccgataaaaaatataaaggaattatggatgttcttgctagagtgccaaaagaacaaggatatgcagcattttggagaggaaaccttgcaaatgtgcttcgatattttccaacgcaagcgctgaattttgcattcaaagacacttataagaagatgtttcaagaaggaattgacaagaataaagaattctggaaattctttgctggaaatctcgcttctggtggagcagctggtgcaacatctctatgcttcgtgtacccactggattttgtgcgtactcgtcttggagccgatgttggaaaaggagtggatagagagtttcaaggtctaacggattgttttgtgaaaattgtgaaatcagatggaccaattggtctttatagaggattttttgtttcagtacaaggaattataatttatcgtgcagcatatttcggaatgtttgatactgccaaaacattgtactcaactgacgggcaaaaactcaatttctttacgacatgggcaattgctcaagttggaacagttggttctggatatttatcatatccatgggatacagtacgtcgtcgaatgatgatgcaatcagggagaaaggatattctctataaaaacactttggattgtgttagaaagattgtgaagaatgaaggaattactgcattatacaaaggaggtctttcaaatgtattccgagcaactggaggtgctcttgtgctcacaatttatgatgagattcaacatttaatttaa

SEQ ID NO: 28776 - DNA, 2856 bp, Caenorhabditis elegans
atgagtcaaaatgccgaacaaaaatacatctactccaaacttccacctggtgcaataagcaagtcgacagtaattgtactcgcgacaggaattgccagttacacagcacttgaacttctatatggttcggaaacgttctacaaaaaggcagtaatgccaatggtacacaaatttgtcgatggagaagattcacatcgatgggcggttcgagctgcttcgtggggacttttgccacgtttcggatggaatcgaaaagaatatcctgaactgaaatgtgagctttttggacgagaattcaagaatcctatcgggttagctgctggatttgataaagatggacaagcaattacacaattggccaagaattctggatttggactcattgaaattggatctgtaacaccaataccacaaccaggaaataatagaccacgcgtgtttaggttattggaagatgaaggagttatcaatcgatatggatttaatagtgatggagttggaagagttcatcaaagagtacgaagtgccagagattcatgggttccagagagttatgcatattttggagtcaatttgggaaagaataaacttacggaagacgcaaagtcagttaaaaaggcaaaaacgtttaaatttcagttcttgtagattggattatgaaattggtgtcaactactttgctccacattgtgattatctggttctcaatgtatcatcacctaacactcctgggctcagaagtatgcaaaagaaaagtgatttggagaagctgttggcctatgtacaccaagcgcttgaaatgcacaagctggaaaagcagcctcaagtttttctgaaaattgctccggatctaattgaatcagaattaaaagacattgcacaagttgtgacgaataaaaagtttgcgatcgatggaattattgtatcgaataccacaattgcacgacccgactatctcagatcagagaataaaacggaaacaggaggattgagcggagcgccggttagagaaattagtacggaatgtgtcagaaaaatatacaagtgagttttataactactcacggcgtgtaaattgggacatgtggcctagcgaaaattgaaaagtgagaatcctaggccatggccgctgcaaagcgcgcgaaatttgaatttaaatttttaatatcattgaaattcgatgaatgagacattataatggataaaactacaaaaatatatacaaaattgtttttaaaatgaataaatcacatataacaacgattattttcctaaataaaagtggaaattcgatttattaggcaattattaggaaaatacgtcaaaagtggcacatttttgaacttttttcaaaaactagatccacaaattttctgaaatttcaccagattactcagtagactactttaatcaaattgtgtgcaaaaaattcatacccaccgtcacaagttcctattgaatttttctattttagctccgaaaaccactaaaatcgacaaaaatggcccatttttgaacttttttcaaaaactaggcccataaagtttttgaaacttcaccagttaactcggtagagtatttcaaacaaattatgtgcataaaaaccatacccaccgtcacaagttcacattgaatttttcaattttagcttggaaattcacaaaaaatcagtgaaattggcaccaatttgaaattttttcaaaaactagattcacaaaggttttgaaacttcaccaattgactaaatgaaggtttttgaacaatttaagtacataaaatgtatacccaccgtcacaagtttacactgaaaagcgctgttctttaatgcagcttcaaactgccttgtttcgttttctgcgtagttcatatttttttgtatttgaatttaatgtaattttagtgtttcttttattcttttccaaaaagataatgcattttttgcttgagttcaaggatattttcatataaaacgaaaccgggaagtattaattgctaaaatttatgtggactatggtagtcaagtccgcaaacaccaaccgcattttcataattgcgtacatttgtttttcaagcttttttctaggccagaggtaccaatttacacgccgtgtactcaaatacgatataaatatcagaacattgtttcgttcaaaaatttcgaagagaaaactgaaattagataattttccattttttccgtgtggctttagttatatttccagtacataattaaccgagtttggttcccgtttgaaaaaaaatgtataagtaatttaaatcaacaaaaaacaacttaataattagctagaacgagcaaaatcagctagtaatttgagaacaaataatctcccgaagctgtgacttggtgaagttagcaaatttgagattgtagctaaaattaaattgttcaatttttaatttgttttttgagcagtctctttatgtaattcggccattttgcgtgtgtataatcgaaaatctagaacctttatgaaattttaacataaatcaaagaacccaaacaccaaaaaatcacaacgttgaaccttcttggctagactatagacaattgtcatcatttttaccgcatgtccccttgttatttcgttttctttggccacttgtcaccccggttacactgggaaaaccaggcggcgtatttagtttgattcgttttactgcgcaaatatggtaagttaagttttcatcatttttcaaatcgataatttttcaacaaaaaaaattggtttaattttgttcgcattgatagtttaatttcagactcacaaacggacaaattccaattatcggctgtggaggagtgttcagtggagcagatgcatatgaaaagattag

SEQ ID NO: 28777 - DNA, 477 bp, Caenorhabditis elegans
atgtcggagctacgtgtcatttctctcgatgaggtctcaaagcacaactgggaagatgctgatcaatcgtgttggattgtcatctccggaaaggtaatttttttttcattttttaaatttaaatatcgaaatcattccttacaggtctacgatgtgacaaagttcttgaatgagcatccaggaggtgaagaagtcatcactcaattagccggtaaagatgctacagttggattcctcgatgttgggcactcaaaagatgctattgaaatggccaatgaatatctcattggtcaattgccagaatcagacgttccaaaagtcgagacagcggctgcgaaaccttcgaaaaacgaaaaatcatcatctctcctcaatgatttcaccgaaattatgacttcaccaacatggaccaacttcctgattccaactacaatgggacttgtcatttatgccgtgtacaagtgcatgttcaattaa

SEQ ID NO: 28778 - DNA, 1425 bp, Caenorhabditis elegans
aggtctcaagaagaaaatggaattaaatcacggagaagtagtttgtgcggccacaatttcccgtgataacagtcgtgtttatactggtggaaaaggatgtgttaagatctgggatgtcaaagaatcagatatttctggcgcaacggttgtgaatcggcctccaattgcatccttggattgtctcaaagagaactatattagatcttgtaaactctttgaagatggaaatacacttctgattggaggagaagccagtactgttgctctttgggatcttacaactgaaacaaaaactttggacttggaaactgattcacaagcatgctacgcgttggcgatgtcaccagatgagaaattattgttcgcatgtcttgctgatggaaatatcctcatttatgatatccataataaggtgaaagttggaaccctacctggacatcaagatggagcatcatgtctcgatctctcaaaagatggtacaaagctctggtcaggtggtcttgacaattctgttagatgctgggatcttgcacaacgaaaggaagttgcgaagcatgattttgcgagccaagttttctctcttggatgttgtccaaatgatgaatgggtggctgttggtatggagaataattatgtcgaggttctgtcaacaactggaaaagaaaagtatcaattgacacaacacgaatcatgcgtcctttcgctcaaatttgcgcattccggaaagttcttcatttcaactggaaaggtatgttttgattatactttgtcatttaccgtatttcttctattagtatggcctccctattagacttgcactccctattagtattgcccctcggagaccttccaaaaattagtatggcactccctattgcactctctaatagtcttgcgtttactttttttttattgcaaacccatctcgctaatttcaggatttcaacaatattttttgcctattgtgcaacaatttttcacaaaatttatacgaaattgaagtttttgaacttataggttacaattaaaatcaaaattttttgtatttttacataagattcgagctttttcagaaaaaaactagtaagctcaaagtcagaaaaatattctgaaaattagtattgcactccctaatattcttgcactccctattagtcttgcaagcgggaagaccatcgaaaaatagtattgcagccatattaatagaagaaatacggtaattggctcaatttttctaattgaaacctcataatctcaatttttcaggacaatgctctcaacgcctggcgtactccatacggagcatcactctttcaactaaaagagaacagctccgttctctcatgtgacatctcattcgacgactcactcattgtcactggatcaggggagaagaaggcaactctctatgcagttgaatattaa

SEQ ID NO: 28779 - DNA, 240 bp, Caenorhabditis elegans
atggataaatctgacatgcaacgaaccgtcgactcgcttcgcagccagctcaatattgagcgtactccgatcactgtttcggcagccgagtaagttaacgagatcagaatgcccaactttcaaaattttgtttctttcagacttcgtcgcttcaccgaaagccaagaagatccacttgtgaacccaatcgacaagaaggttaacccatgggctgagaagagcaagtgcagcatgctctaa

SEQ ID NO: 28780 - DNA, 917 bp, Caenorhabditis elegans
aagctgacgaagacaatgatggaaaattaaatctggaagaactggcaagttttcttaacccggagcatcatccacatatgcatccggttctaattgctgtaacgctgctagaaaaagaccagaatggagatggagcgatcgaagagaaggaatttttgggagaacttgatgaacaaagaggcagtgaatggtataaagttgaggtggagaggtgagttattgcttttaatgttaagattttgggattttaaaataaataaaaaagattgaaaaccaagaaacgggaaaacaataaaataacaattttatagaaaatcaatatgagagcacggtatactttaaagggacatgactaataaagcataatggtctcgcagggatcgtgaacaaattactgtagaaggcgcatatttctttatttaatattttgcggattcaaaactgaaaatatttgagaaacatgtgtttaagaaaatttagaactttagaaaatacaattatttgaaataatacggttttataaataggctaactcatttttcaatatataaatactttcgaatcaatatttatttaaaatatattttaaaataatatatttctaaactattctgcttcggagaaaagtcgttcaattttttttttcctaatttgtgtccatttttagattccgtacagtttatgacaaaaacaaagacggaaaactggccggcgacgagctgaccgattggcttctcgttgatggaacaacagctggatcttatgaagctgaaagtcttctaacaaattcagatgatgataaagatggacaattgtcttatgaagaaattgtgaagcatcatgctctttttgccaaaactgaagctgctcaagaagccgatcatctgcacccatattattctcatgacgagttgtaa

SEQ ID NO: 28781 - DNA, 1045 bp, Caenorhabditis elegans
atggctggaagaaagtcatcaaggacggctgaacgtgtccccactacacaaaagccagaaagaaaatctgctattttgtaagttgaatttagatggatattagagaactgataatttttagactttataaatatttattcatctttcgaaaaattttaattttcagatctccacatgacgaactgcgtgaacgtcttctggagactgcaattgatatgaaggaaaatattccacaacgaaatacccgaaattcgagcgttggaagtcagaaatcagattgttctgagacaagaaaacgacgaagtactaaggtttgtgtgcttatcagtgaacattttaagatggaacaagggaaatgaaatagagagtgataagaaaagtacttttttaaattataatattactacttgtacaaatgcctaaagagatttttgcttctaatttttcgaaaaccgtaagaaaaactgtcaaacgattgcggattgttactaagctgaatgggggtaaggaatacattttaatttgccaacaaaattagcaaatatttctagatttaaacacattttgctatattttcagttttgaatttaacttatttaggtaacagcattcatccagaaacacaatgtctaacaaattaattgaatttcgtgggtaactaactaacagtcaaacgctcaatattgagtagtctgggttctacaggaaacatctctcgttaaataatttgcaaacaaagtttgcactgagaaacagacactttgtatttgaccagtgtaatagtgcgccaaaatgtactcattctcccgttttcttttttcttctctcatctcatgttcacaccagcacctcagatttgcgagaaaataagacgcagacatcgatagtcatagtgaccagtctctttcgtatgcagaacacagttttgtgtccgctttgtatgtccaatacttgtttgccgtctgagtctcactgttcatctgggggtatagctcagtggcagagcattcgactgcagatcgagaggtccctggttcaactccgg

SEQ ID NO: 28782 - DNA, 977 bp, Caenorhabditis elegans
atgtttcaagctttgttaagtaagtttgagtgaatttctggttttggtggaatttattctgatatcgaaagctctatgtctattcaatcaattgatgaaaatgcgtaaatagggaactatgcacacacggcggctcagactgatgaagcttttctagttttggagaatgaggtctaattgagcaaattttcagcaaaactcaaaaataatgcggctttgggagcagctgcaaataacttgaacaagttcagaagttcgaatcttggtaatcagagacgttctgtctcagttgctgtgacatcaacatctccgaaatcggaaaagccagtagccagggaacatatgatttatgatgaaactcattttgtcatgcagaagagtttgggaaaacttatcgaagaaaaaatcaatccaaatgtggcaaaatgggaacaagacgggcggtatccagcacatttggtattcaaaatgcttggagatcatggtgtttttggtgttaataaaccagaaggtaatacgctttttttagctaacttgttttattaattagttatccatgcaatattattatttgattggacttttcaaaacgaaaaagtgttaccacaaaaaaccaaaagcgtagatttcagaacttggaagaataacttccaggttacaattagaatatcagaacaccaactttttgggttctaaaaatgtcaagagcctgtaaaactacatcattctaaaatgttaaaaagatagtactggtgggaggaaaaccttaaagatacaaaaaactgcaagaataatagaattaatacggtgtgttatttctcatttttaccaacgatttttagcatttggtggaactggaacggatattgcaatggcaacagcaattgctgagcagatgggagcaattaattgtggatcaattccaatgtcagttatggttcagactgatatgagtacacctgcacttgcacagtttg

SEQ ID NO: 28783 - DNA, 420 bp, Caenorhabditis elegans
gtggccattgtaacgggttgtttcattttctgttggcttggtttcgcactagtttatggcttggaaataaagctgaatgatgtcgtctggagcattgttttctggcttggttatctgaattctgctctcaatccggttatttacacagtattcaatcgcgaattccgaatatgtttcaagagattgttgacgtgtcatcatttgaaccatccaacgcagaaggtaatagtatttagaacaaaatagagttctcatatcttaaagtttcagtacacgaacaacaattcgtataactcaacggcaattcgatccacaaatgccgttaaccgtgtacctcaaacaagtcttggaaactacacacaaacacaaaattcggagaaaagttctgcagcagtgacatttaacactccaaccaactaa

SEQ ID NO: 28784 - DNA, 1450 bp, Caenorhabditis elegans
atggcccagtctaagccagcttacaaggtcgctgatatcaagctcgccgatttcggacgcaaggagatcatccttgctgagaatgagatgccaggacttatggctatgcgctccaagtacggaccatcccagccattgaagggagctagaatcgccggatgtctccacatgaccatccaaaccgctgttctcattgagactcttactgctctcggagctgaggtaaatcttgttttttgaaagaattagtattaaaataagttggtttgaaaaatcgaaactttttccaggtccaatggtcttcctgcaacatcttctccacccaagatcacgctgctgccgccattgcccagaccggagtcccagtctacgcctggaagggagagaccgacgaggaatacgaatggtgcattgagcaaactatcgtcttcaaggatggacaaccactcaacatgatccttgatgatggaggtgatcttaccaacttggttcacgccaagtacccacaatacctcgctggaatccgcggactttccgaggagaccaccactggagtccacaacttggctaagatgctcgccaagggagaccttaaggttccagctatcaacgtcaacgactctgtcaccaagtccaagttcgacaacttgtacggaatccgcgagtctctcccagacggaatcaagcgcgccactgatgttatgctcgccggaaaggtagccgttgtcgctggatacggagatgtcggaaagggatctgctgcttccctcaaggctttcggttcccgtgtcattgtcaccgagatcgatccaatcaatgctcttcaagccgctatggaaggatacgaagtgaccaccctcgaggaggctgcaccaaaggctaacatcattgtcaccaccactggatgcaaggacatcgttaccggaaagcacttcgagcttcttccaaatgacgctatcgtctgcaacgttggtcacttcgattgcgagattgacgtcaaatggctcaacaccaatgccaccaagaaggacaccatcaagccacaggtaagaaaatgttcagaattaggatgaattcacaatcatcgatagaagtttgaaccaacttttttcaggttgaccgttacaccctcaagaacggacgtcacgtcatcctccttgccgaaggacgtcttgtcaaccttggatgtgccaccggacatccatctttcgtcatgtccaactccttcaccaaccaagttctcgctcaagttgagctctggaccaagttcggaactccacaagaatacaagctcggactctacgttcttccaaaaacccttgacgaggaggtcgcttatcttcacttggctcaattgggagttaagcttactaagctttccgacgagcaagcttcataccttggagttccagttgccggaccatacaagccagaccactacagatattaa

SEQ ID NO: 28785 - DNA, 607 bp, Caenorhabditis elegans
atgatgttcaatttttatcagtttctctataacctgcaaaatgtttccccatttattgatttttcagtactaaaacaacttacccacacgaaaatgagggaaaatgagccggcaagatttgagactcgttcattcagtcaattaatagatcatgcaagaagttggaagacggaggttcgaaaaatgatttaaaaaatattatttcgataaactgattcaggtgcgcggcatgacaacacaaggattcacaaaaattagcctcatgcgtgcagaaaaagatcgtctcaacatgtaagtcaattacttttgaagaaacgtttgctttaaaattcataacagaagaagaaacgagttttaatctttcctgaaagtttagagaatatttttttgctgaacttgtttttgtaatgtttcttcaataatcgaataatttgattcttcattataaaaacatgttcaggtatgcaatatcttcagtacctggtacaaatacacagtcgatcttttccgtgacaattcccttggaactcgttgagaaagctcaagtggccgatcgtaaatttgagttgaagctgaaatcggggtacaatgtagattcatacatccg

SEQ ID NO: 28786 - DNA, 1176 bp, Caenorhabditis elegans
ggtatcaaaccttgcaagacattcgcggaagctaatctcacggagaccatgcagaaaaacgttgctcatgctggatactccaagaccactccaattcagcaatatgctcttccacttgttcatcagggatatgatatcatggcttgtgctcaaactggatcaggaaaaaccgctgcattccttctgcctatcatgactcgtctcattgacgataataatctgaacactgccggagaaggcggttgctatccccgttgcatcatcttgactccaactcgcgaactcgctgatcaaatttacaacgagggaagaaagtttgcttatcaaacaatgatggagatcaaaccagtttacggaggattggctgtcggttataataagggtcagatcgaaaagggagccacgatcattgtcggaactgtcggaagaatcaagcacttctgtgaagagggtaccatcaagcttgacaaatgccgcttctttgttcttgacgaggctgatcgtatgatcgatgctatgggattcggaactgacatcgaaactattgtcaattatgacagtatgccgaggaaagaaaatcgccagacactcatgttcagtgccactttccccgattctgtacaggaagcagctcgcgcttttctcagagaaaactacgtgatgattgcaatcgacaagattggagctgcaaacaagtgcgtcctacaggaattcgagagatgcgaaagaagcgagaagaaggacaaacttctagagcttctgggaatcgatatcgacagttacacgaccgagaaaagtgagtttttcgttttcttatttgatgaaataaatttcaatatttcaggtgccgaagtttacacaaagaaaaccatggtcttcgtttctcaaagagcaatggctgatacactggcttcaattttgtcatcggctcaagttccagctatcacggttggtatatttcatttttgaccgctttttaattcaaaatgtacagatccatggtgcccgtgagcagagagagcgttcagaagctttgagacaattccgaaatggatcgaaacctgttcttattgctactgcggtcgctgaacgtggacttgatatcaaaggagtggatcatgtcatcaactatgacatgccagacaacattgatgactatatccatcgtatcggaag

SEQ ID NO: 28787 - DNA, 950 bp, Caenorhabditis elegans
aagaaaaggcatacgaataatgttcctcaagagggagaaaagaagaaaaaagaaaagaaagaagagaaaaacagcagcagtttgaaagatcagctagctcttctttcgattgataaatctctttatggaggtgctctagaggatagcagtgccaagccattcctaggtaaaaactttgaaaaaatatttcagaacttacagtatatgttctaagacattcagatatgaatttgactgcaaagaaatgtggatttttagaaaaaatagtattcttaaattaaacttcatatgtctgaaattcgaaaaaaaataataataacagctctggcttctaatcatcctatattcatttatgaaagtctaagaacatctattgtaagttgagttgaaattaactccaaatctattccattaaaaaaatcaaaaacgtttatgaattttcagaatgtgtgaagctttgcatgccggtacataaatacatgaaaaaactgaaggaagcgcaggaagccaaaaatcaagctgacgaggccaaatatcttacccgactcggcgactcgttccttgaaaacctcgaaactcttataaaaaagaagccaaaaacaaatattcgaaaatggtataactatttgtggatatttctttgcaagttcactctgagagaacctggagaaatggctgaccgatatagaagtataacttctgataaacacaaaaatcaccatcaccatcaccatcataagagtaaggaggagaagccgaaagaagccaaagatcacaaggaaagggatcgagagaaggacagagaaaggaatcgtggagaaaggcggatggatcatggtgaaggaactagtaaggaccatcatcgggaacatcataaagatcatcacaaggatcatcaccatcgggagcaacataaggtattcattaagaaaacaacaacatttttttga

SEQ ID NO: 28788 - DNA, 674 bp, Caenorhabditis elegans
atggctacagagagtgcactcatcaaagttcacgtgaaatcaccgtcgaacaagtatgacgttgagattgctgcggatgcatcagtttcagaagtatgttatattttatttaaaaaataaaattttgctcttgagaattagataaaaattcaagtgattattccattttgataaattaaatgtgtaaatcacagtgtttaattaatattttacagctaaaagacaaggttcttgtgttcgttccaactgcgaacaaagaacaagtttgtataatttacaccggaaaaattctgaaggatgaagaaactctcacacagcacagtaagttgaaaaatgtgttccaaaaaataataaacaaaaatttagaaatcgctgatggtcacaccgtccacttggttattagaaatcaagcccgtccaacaccagcgccggctgctgcaacaccaacagcttcatctgcaccaagttccaatccaacaccttcttcacaaccgaatcctaccaataatccatttgcagcaatgggaggaatgggatcacctgctgatattttaaacaatccagatgctatgcgttcagttatggataatccaattacacaacaacttctaggaaatccagagtttatgagaacaattattcaatccaacccacaattccaagcattgattgag

SEQ ID NO: 28789 - DNA, 597 bp, Caenorhabditis elegans
ttgtaagtttttctgagtcaaatttctctaagtaaaaaaaaatcttacattaaaatcatataataatcaatgacgagtggcaaatgccaaatatcaatttgccgaaaaaattaaaaaattgtaaatgtgaaaaaagattttcagcaatgtatttttgaacattttccttaaaaaatttccaacaaaaatttcaaaacgacaaatttccaattcgcccaattttacgtctgccgcccaccatttattataattttaaacaaaatatttaaacgtcacgaatatcctcatagtttagtgatccgttaataatgttttaattcatattcagcattgcttgattcacctggcatcagctccctaatggagcagatgatgtccaatccaagtatgcaggccagtatgttcagcccagaagtcatcaattcaattcgtcaaaatatgtcaaacaatcctggactcattgattccgttagtttcatttttaaaaaatttaaaataattatgtaagttcagattgttggacaaattccatcggctcgtgataacccacagatttccgaaggaattcgtagaagttttccacaaatgctcaacatg

SEQ ID NO: 28790 - DNA, 406 bp, Caenorhabditis elegans
gaaattctggcaaacagagcagctgatcgcgttttcgcttatcgggagacaaaatatcgagttggaactgcagcagatatgcttggaacagcaactggaggagcaactgattggattaaaaagaatactccgacaaaatatgtctatgtactggaattgccacctgatatgaaaagtaagaattcgtttagatcttccatgaaaactagaataacattcaatttcagcttggttcgcattccaagtcaaaccacattggcttattccaattggaaaagagacatggcttggaattgaagtaatattcgatcaggtagttgaggaaaccaagaactttcaaccgactgaaccaactacaaacggaacatcagcagacagtagatctcctcgattcagacagctataa

SEQ ID NO: 28791 - DNA, 648 bp, Caenorhabditis elegans
atgagcggaattgaatttgaagctcgtatgaaacctggcactccggatgatctgaaaaaggtaagaaaatttatttgagaataaaatgtaacaggaaatcaatttcagttgcattcatggctcgagtcaataatttttcgctattttcatgtttggtctccagttaattgtcaagatatgctcaaaagatacgaaatttatgagctttgtcttcgtgctagagagcttttttggactcagccactttatagacatgtttgtttttttttcttttcaatacaaaaatatttctgttaaacaggttgaagtacccgtcactattgttggagatattcatggacaatttgaagatcttaaaatgatgatggatatgaatggatggccatttactgaagacgaagcgaaagaaatgtgcaaaaatcttcttttaaagggtggaaaagatgggaaacagacatttccagcagttcttggatctggaactgaccgtcagaaaactcaaaagaattatcttttcctcggggactatgttgatcgtggaccatactccattgaagttgttcttatgctttttgcaatgcatcttcgttggcctgatcgtgtcactttgcttcgtggaaatcatgaatcgagaccggtcaatagaca

SEQ ID NO: 28792 - DNA, 420 bp, Caenorhabditis elegans
actgcccaccacaacttgttcctgtaccaggagaaaacggagcccagtacaaatactgctctccatcagctccactcaatgacgccatccagggttgtggagccaacagacattgccaattctccactaatttggaaagatatatctgttgtggacttgagtcagatgttcgattgccgaatgtttgcccaccacaaccagctaatttggttccagtcgagttggctggaaactataggacgtgcaatccgtaagtgaaatttgatttgaaaaattgaatggttttcaattttgtataattttagatatgctcgtgctggaactccacaatcttgtccagacaactcagcatgtctttacacgggcaatgacaatggattcatctgttgcagagttcagttgggaaatggaaagagttaa

SEQ ID NO: 28793 - DNA, 565 bp, Caenorhabditis elegans
atgccgaaacgccgctacaatccgtccgccaacgaggaggaaaagattccaatagtagaaaaattatataggtgaggtttactttaagttcaaagaccgttgagcttattgcagggaaaatcaagaatcggattttcttggtggcggattctgtgatgacgacgatgaggtgcaggaacgtcgcgagcaaatttccgaaatgagacaaaaacgtaattgtttaactgttgaaagtcaatggcaatttgctagtatttctgaatttagaaattattaactaaaaaacgagtaaaactttaagtgatataattattttattctaaattcggaaaaaaagtgaaattatatgtattctttgactatatgcttacacaaattttcaggcgaagaagcagctcacaatttgattcaagctcctgaaaattgtgaaaagtgcgacaaaggtttgatggacagttggctttgggaacgatataactgtgcagtttgtgatgcttgtagagatgataaaggcgaacataaattacttgctcgtacggaagtcaaaaatacatatcttctgaaa

SEQ ID NO: 28794 - DNA, 2448 bp, Caenorhabditis elegans
atggcctgtaaggtcactggcccaaatcggcacctcacttcagttctcgaaatgtcatcgttcgtgtagtgagttgtttttctgtttacgtggcacctcggcgggtgtcctgaaatcttttgatctaactctagacatttgaagcaatccgtaatgttctagcatactgtagggatgtttcaattcaaaatggaagtttcgaagactatctaagatggctgaaagtttctgaaattttgcacatatttttaaccagatttcgggtgttcttcaccgtttttgccatcaaattcacttttcccagttttccgcggcggtaccatcacgtacttgctgtgtatacgtctccgtctctcttttgtcgtttcgcatgatcagcggaaagtacaatttacgaaattgcaacctcccgtcgtcgtcgtcgctgccgctgccgccaccaccatcatcgcaaaccacgtcgtctatatcctgcctcacacagcgcgacgacgtcgacgacgcggggtcctgtcacctcctggcgggaggcataccgtaccgttcgcgcgcaacacaccgtgcacaggtaccgaggtcacttctcgagatgaagaaatagcgcggagacgtacacacaattgtcttcttcatcttcttattcctacgtcttcttcatttcctaccttgtttctcagtattcccatatcctccatcgtcaccgtctcttcattctttcaaaacactgtaattgttatgagaggagcggtgagatggggataaagttgagaataggcaggaaatgaaggatgagcggtatgatgaggaaatatgaaatatgttgcgaatatataagacctgataattgtggtcctaggaaacgaggttgaaaatcgagccgatataataaaagagttggggacgacgagatttttatctgaatcagaaatgagtgatgctattcgaagtgagattgatatagattttatattcttgccgtatacattttctgattaaaatttatgcacaaaaacataaagaactcccgaagcatatttctcttggcgggttttcgtcaaatttttcatttaaaaataccaaaaagctgagccattttttttgcgttttaggcgagacattaaaatttccagtttcaccaaatttcttttgaagaattccatttgcaaaacaatgcaaaaacaaaatttttttgttttttttcaaatatttgaacttctgcgtttttaatatttataaatattaaaaacgcagaaggtacggtgtgctaagagtgtttgcggactttagttcattttatgtcgcctaccgtagtccgcctcgctgatattcgtttttttttaaattcatttttgacataaatattttgttttcaaccatttttctcaaatttaaatttagaattcgaaaaaaatcttactattctaatctaaaatatgcaatgattcaatttttaaggctaattccccccccaaaagcaaataacaatgaaaaaaaatgttcagcaggaatttaaatatttattttgcgtgaatttttttcctaactataagctagttattatgtttagattatatcttattgataaaacctaaataataataataagtcacgttaagatccacggctggtttttgtttcgaaatttcaattaatttcaatttatatcctccagtaactaataggtgagtttcttaagctctgcgattgcatggcatttcgtaaaaaaaaaacgtttcgcaaactgtttctagacgttcaatctttccgcgtatcctatcattactcgcttaaattgtagtccgcctttcttgattttatcttcagctggcctcgatcgcgacaacaagctcacaattttccgatgcaagctgtagagcagaagttggctgatgcaacacgaactcttcatgcaaagtcatctcttcaaccatcactctcaattgaaactccaaaaagcaaggaaaatgatgaatctggatgcgagagttcaaattgcatgtttcatccgcatacgatcaaatcggaaccaaatttttgttttgctcgggagtttaagtcagttcccgatgattttcgtataggcggcggagatcttcaaatgggaaacaattccaaaagattgacatgtgttattgatacaaatcgagtcgatatggccggaattcttcctgataatatgagcttccggggacttcccgaaaacaaatctcttctgggtatgcacgtattttttgttcattgtcctactaacctttaaaacccttgaaatttggaatttggaaccgaactctgaaaaaaaacactccaaaattgtgataaactgaactttttaaagattctaaatttactttttcagtatcagcgcagatagaagtaataccatgtaaagtgtgcggtgacaagtcgtctggcgttcactatggagttatcacatgtgaaggctgcaag

SEQ ID NO: 28795 - DNA, 504 bp, Caenorhabditis elegans
aacatcttcgaaggacttagtgtacaaacagacaatgtgaagaagatcgttgaagacgaaattgcattccttggtttggaaaaggcaatgatgatgctgacggaagaaggtgtcgatcggcaacaagctcatgctgtgatcagaaaaactgcgttggaagcaaaacaacttcaagccacacaaaaagttgatattcgacagacaatggccgatccatttttcgattcagtaagattttattattatttttttaaattaaattattatttaattaaaattcaattttttattctacttcaaacaagacgtaccaaatattcaagtcagaacaaaactatcaataattttcaggttcgcgaccgtgttgttgggcttgtcaataatccgataaacttcacggggcggtgtgtttcccagacggagagctttattgccaaggaattgaaaccaacaattgacaagtaccttgataaatcagcaggaaatgttcagctggatgtttga

SEQ ID NO: 28796 - DNA, 827 bp, Caenorhabditis elegans
tcggtgccaaagcattggccaaggtcgaggatcgtgttcgtagcctggaagccgagttgcactctgagcaacgcagacaccaagagtccatcaagggttacaccaagcaggagagacgcgctcgtgagcttcaattccaagtcgaggaagacaagaaggcgttcgatagacttcaagagaacgtcgagaagctccaacagaagattcgcgtccaaaagagacaaatcgaagaggcggtatgtatactttattaataactaaaacctcaacgaatattagcgaattatcagcgaatggaatgtttaacataattatttgaaacttattgatccgatgtaatcattcctgtttttcaacatttcaaagagtttattcaatagtacctatttagttcaaattggaatttccaattgaaatcatatttgattacgatccttaaacttttgttcgatctaatgaccattatttgacttatattgtataggtacaactatttgatcatagtagtgcactgaatataagaggtcgtggcgagaccaacttttaaaaactgcgtgtgcctttaaagttatgtttcacgttttcatgaatttgcaataccaaatatgattccacaaagttggagtcgtgaaatgttgttttttttttcaaatttatttacaaaaactaaaagtttgaattttcaggaagaggtcgccacccagaatctgtccaaattccgacagatccaactcgctctcgagaatgccgaagagcgtgccgaggttgccgagaactcattggttcgcatgcgcggtcaagttgttcgttcggctaccaacaagtaa

SEQ ID NO: 28797 - DNA, 1828 bp, Caenorhabditis elegans
atcttctcgagaaatctcgtgtcatccgtcaagctccaggagagcgttgttaccatatcttctaccaaatctactcagattttaagccacaactccgtgacgagcttcttctcaaccatccaatttccaactattggtttgttgctcaagctgagttgctcattgatggtatgttttgtatttctggagaatgagattaacttgttttattccaggaatcgatgacactgaggagttccaattgaccgacgaggcctttgatgttctcaaattctcgcccaccgagaagatggattgttatagactcatgtcggctcacatgcacatgggtaacatgaaattcaagcaacgcccacgtgaggagcaagccgagccagatggccaagatgaagctgagagagcttgtaacatgtacggaattgatgtcgatcaattccttaaggctttggtgtctccaagagtcaaggtcggaaccgaatgggtatccaagggacagaacgttgatcaagttcactgggctattggagccatggctaaggggttatacgctcgtgtcttccactggcttgtcaagaaatgtaatcttactcttgatcaaaagggaattgatcgtgattatttcatcggagtactcgatattgctggattcgaaatcttcgacttcaattccttcgaacagctctggattaacttcgtcaacgaaaaactccaacaattcttcaaccatcacatgttcgttcttgagcaggaagagtacgcccgtgaaggaatccaatggacattcattgatttcggacttgatctccaagcttgtatcgagcttattgagaagccactcggtatcatctctatgcttgatgaggagtgtattgttccaaaggctactgacatgactcttgcccagaagcttaccgatcaacatcttggaaagcatccaaacttcgaaaagccaaaaccaccaaagggaaagcaaggagaggctcacttcgccatgcggcattacgccggaactgtccgttacaacgtgttgaactggctcgagaagaacaaggatcctctcaacgacaccgttgtctccgtcatgaaggcttcgaagaagaacgaccttcttgtcgaaatctggcaagattacaccacccaagaagaagctgctgccgccgctaaggccggaggtggtcgcaagggaggaaagtctggatctttcatgactgtatccatgatgtacagagaatctctcaacaagctcatgactatgcttcacaagactcatccacatttcatccgttgtatcattcctaacgagaagaaacaatctggaatgattgatgccgcccttgtgctcaaccagcttacatgtaacggagtgttggaaggaattagaatttgcagaaagggattccccaacagaactcaacatccagatttcgtccaacgttacgctatccttgccgccaaggaagccaagtcatcggatgacatgaagacttgtgccggagctatccttcaagcacttatcaatcaaaaacaattgaatgatgaacaattcagaattggacacactaaagtcttcttcaaggctggagttgttgcccacattgaagatctgagagatgacaagcttaaccagattatcactggattccaatctgccatccgttggtacactgccactgctgatgccggagcaagacgcaagcaactcaactcatacatcatccttcaacgcaacatccgttcctggtgcgtcctccgtacttgggattggttcttgctgttcggaaagctccgtccacaacttaaatgcggaaagatggctgaagaaatgatc

SEQ ID NO: 28798 - DNA, 517 bp, Caenorhabditis elegans
gtccgacttgcaattcatatggcgaaagtgatgaaacgtcctgaaagccagatattcgtctcggtgagtagttttataattttacccgaacactactatattgttaaaaaacaactactcatttctgaataggtaactataattatttcaatttatgatatcgtattcacgacagttaaatcaactttttcagctcgacatgaattctcgaatgacgcgaggacaattgactgatcccttagctgttttagatgtcacatcatccacagttcttactccgattctcaccgaagaatacacggttgctctctgtgaattcttctcgcaggagctggctctagattctgacgcagtcctcattaattatcgatcgctaagcccggaacttatcggattcaatggacatattcttaccgaaaatcgaccattcatctctacagatcgtgctcgcttcattattggagttctaggcattgcgtttcttgcattcctccttcaattcctcaaatatatctga

SEQ ID NO: 28799 - DNA, 378 bp, Caenorhabditis elegans
tgtcgcttattcgatcttcgagcagatcgtcaagtatgtgtgtatgaaaaagaatcaatcttgttccccgtaaatggagtcgatttcagtttgagcggtacgtttaaatcttcacaaaaacgtatagtccaaatcaattcaatgcatctctgaaattcacagaactaaacttttcactctaactattaaaaaattacaggtcgtattctatttgctggttatggtgattatcgtgtcggtgtatgggattcgctgaaatgcgcccgtcattcagtactttatggacatgagaatcgtattagttgcctccgaacttctcctgatggaacagccgtctgctcggcgagctgggattgcacaattcgcatttgggcttga

SEQ ID NO: 28800 - DNA, 426 bp, Caenorhabditis elegans
gtcgtctatacacgaagaaacatgaatgggtgctcgtagagaacggtgttggaaccgttggaattacggactttgcaacggttagtatttttcaatatgttcaatttgcatatttttagtttccaggaacaactcggagatgtcgtcttcattgagctgccggatgagggaactgaaatttcaaaaggagactcaactggagctgttgagagtgtgaaagccgcttctgacatttatgcaccaatctctggaactgtaacccagaaaaatgtgaaattggaggaagaagccggtctgatcaacaagagtccattcgaaaagggatggttgtacaaattgaaagttaagtcagcagacgagctggaaaaacttcttaacgaggaacagtatgcaaagttcaagaaggacgaagaagctgcccactaa

SEQ ID NO: 28801 - DNA, 551 bp, Caenorhabditis elegans
atgggttttcggatacggataaataaactagatgtattcttagttgttattgcaattgtgtttattgtgtttggaattgttacttgggcggcattctcttcaatttacagtactctggtcataaaggtattcccgtgaaaagtgaagttaattcctaaacttgcatgatatcagaacctacaactaactgaaaattctgataccagtctaggatattctgcatttcaatatacaagtcctcaagtggataatataatgaaattctacttttttaatgttacaaatccagacgaagtgaaatactattctgctgcaccaaatttggtagaaattggtccattttctgtaatgtaagttgaattttcctcatagatatgttaattaaattccgaatttgaagggaaagtgagcagaaaaaatatctggaattcagtgatgataaatcacaaatgttttatcaaaattacaaaaagtatattttatcaaaagattattcgtgtgaagattgtgactgggacagaaatattgtttttccgaatccaccaggattg

SEQ ID NO: 28802 - DNA, 1983 bp, Caenorhabditis elegans
atgggttgtaccatgtcacaggaagagcgtgccgctcttgaaagatcacgaatgattgagaaaaatcttaaagaagacggcatgcaagcggcaaaagatatcaaactgctgctacttggtgcaggagaatcaggaaaatcgactattgtaaaacagatgaagtgagatttttttaaatttctaaataacaaattaaaacatatataaacgaaaatggtagaaataaatggtgaaaaactcagaatttatcatccgaaattgtcccatagaacgtccgaatatttcgtttgatcgatttgaattattaaaaattaaatttaattaaaaagtaaataaatcactagagactgctattaatttttttttcgtattcaaaatttgaaaagtaagttcaactctctaatagtttaaatttgaaacacgcctttacaaattttcacattttaatgtttttttttcagaattattcacgaatcgggattcacagcagaagactacaaacagtacaagccggttgtctacagtaacacggttcaatcattggtcgctattttgcgagccatgagcaacttaggcgtttcatttggttcggctgacagagaggtgagtattatgacaatttttctgcaaaaaaatcgaaattatttaaaaatgaggcacgaaattttcaagtgatcccttaatggaaaaaattaatttcggtccattagctgctaatgattagcacgacaaaaacgttacttcaaaataaaacttatttttctgaaatttacttgcgattgtgatctatagatagaacataaacattattcaattaaaaatgtttcccgtgttctgaagagtaattcgaaatatttggaaaataacgaataaaaagatacgaaaaacgaagagcatgagaataaatgacataatctgttgtattcattggctcggtatctttttctctctctctctcttacattctgcaactcttattgcctctcgttgcactcaatgcatcccgctaccacaccaccgtcccattccaattcccttgtgagtttcgatgcgcgacgcgccaccgacaaactcgtagactcgacctagtattccaaaaatatatgttcgaggcaggaattttgaattgggatttggaagggattctagaatgttggaaaatctttgggaacacattttcgattgatgtggcaaatcatcagaaaaaaatgttcccaacgttttggagaagattttacatcattcagacgtcaaatgttttgttattgcgtcacaaatgcaattcccggtttttatacgatgaatttgtgttcaatgcaagaaggtgtgcgcctttaaagagtactgtaatgtttaattttcgttgcagccaaatttttaatcgatttttcatagttattcaataaaaacgtattcatttattttaaaaattaataaataacaatcaaatatttacgaattaactttaacaaatcgtaagaataaatataaacatattttagcattcaacaaaaatttgtcgtgtcgaaaacgtaaaaaagtttttgatgtgaagatcgaacatttatcattcaattttatatatatccttaatcttaacaagacgtgactatgcatgtcaccgaatataaagtaatttgagataattgaaataaaatgaccattttgagacctttggacaaaccattggaagagagccaaggatccaatttcaattttgtgagaaaattgggaaaatgatgtacatgacatgctgtgaattattcaattttcatcagcgaataaagttatcgagaactaaaatcaaagttttttgtttcaggtagatgcaaaattagtgatggatgtggtggcacgaatggaggacacagagccattctcagaagaattgctcagttcaatgaaacggttgtggggagacgcaggtgtacaggattgtttctcaaggagtaacgagtatcaattgaatgattcagccaaata

SEQ ID NO: 28803 - DNA, 552 bp, Caenorhabditis elegans
atgtcttgggtgcggtttacaaagacgggcgtggcagtggttgccacgtcagcagccgccgttcttgcactcgacatgaccaacgaacgacgatttcagagacaagttgtgagttttcagaaatgcaaagttttctgaaatatctgtcactttttagaaagatcactttcgaactgtacatgctgatcgacttgcagaactgaataaaagagctccgagtgctctgccaacgagaaaagatattttgacgaatttgagtgtaagtatcgaaatttctggaacattttcaattaacatttaaaatattttctacagaaaggcgaagaattcgatgttctaatcattggaggaggagctactggagctggggtcgctcttgacgctcaaactagaggactaaagactgcattggttgaactagatgacttctcatctggaacatcatcccgatcaacgaaacttattcatggtggtgttcgatatcttcaagctgcaattatgaagcttgatttggagcaataccgaatggtcaaagaagctttattcgaaaga

SEQ ID NO: 28804 - DNA, 2096 bp, Caenorhabditis elegans
cacaatcttcttgaaattgctccacatctcagctctccactccctattatgcttccaatatacaaattgtggcaagtgccatattattggtctggaattaaagcatatgattttgtatctggaaagcgtgtactcaaaaactcatttttcatcaacaaatcacaagcacttgagaggttcccgatgcttcgtaatgaatcattgaaaggagcgttaatctattatgatggacaacataatgatgctagaatgaatttggctattattcttactgctatcagacatggagcagcggtgagcattgatatataaagctaatgaaactatttcaattattttcagtgcgccaatcatgttcgcgtggagaagcttaataaggatgagacaggaaaagtgatcggtgcacatgtacgggatatggtcactggaggagaatgggatattaaagcgaaggctgtaatcaatgccactggaccattcactgattcgattcgtctaatgggtgaccctgaaacggctcgtccaatttgtgctccaagttctggagttcatattacccttccaggatattacagtccatcgaatacaggattattggatccagatacttctgatggtcgtgtcattttcttccttccgtgggaacgtatgactattgctggaaccactgatgcaccatctgatgttactctttcacctcaaccaactgatcatgatattgaatttatccttcaagaaattagaggatatctttcaaaggatgtttccgttcgtcgtggagatgtaatgagtgcttggtctggacttcgtccattggttcgtgatccgaataagaaggatacaaagagtcttgcaagaaatcatattattgaagtcggaaagtctggtctgattacaatcgctggtggaaaatggacaacatacagacatatggctgaagaaactgttgatagagttgtagaagttcatggattaaagactgaaaatggatgtgtaacaccaggacttcttctcgaaggagcacatgattggaattctcttcaatatattcatttggtacaagattatggaatggaagttgatgtagctcaacatttgagtaacacttatggagatcgtgctttcgttgtcgccagaatgtgcaaaatgactggaaagcgttggccaattgttgggcaacgccttcatcccgaattcccatatttagatgctgaggttcgttacgctgttcgtgaatatgcctgcacagcaatcgatgttatcgccagaagaatgcgtcttgctttcttgaacacatatgccgctcatgaagtacttcctgatgttgttcgtgttatgggacaagaacttggatggtcatcagctgaacaacgagctcaattggaaaaggcacgtacttttattgatatggaaatgggacagaatgctaaacaaactgcagtatccaatgttgcactgaatttgacaaaagaagaaatgcaaagagccaaggaacgattccaacaattggataaagatcgcaaaggacatatcacagtcaacgatcttcgcaagcatttcagagtgagtttcagaaaataaagatcatattatttcccagacgcgcaatttcgcgatttttgcgccaaaaatgtggtacccgggctcaacacaaaaatttttgttgaatgcatttttgttgaaagttgtgctcctctaaagagtgctgtaaattcaagctttggttgctgtggaatttttttttcatagtatttcgataacatttacttattcaaaatcataaatcctaaacaaaacgaaagaaaaaactataaaaaattaatgaaaattctgcagcaacgagaattttaaattacagtactctttaaaggcgcacacctcttaacattcaataaaaatttttcgtgttaagaccaggtaccctatttttggcgaatcgaaaaatttcgaatctgggtaacatattccgacagtctcttcaaaaatgtaatttttaggaacataaccaaaagattgatgaacgtgttctccacgaacttctaaacgaagtggatctcaataagaacggagaaattgaaatcgccgaattcttccag

SEQ ID NO: 28805 - DNA, 734 bp, Caenorhabditis elegans
caactggaatcggcccagaatccttccaattcacatcgagtgtagaggcaaaaacagaacgtcgtcaggattcatattatattcttcgtcctgaagtcgttgagacatggttctacttgtggagggctacaaaagacgagaaatatcgacaatgggcttgggatcatgttcaaaatttggaggagtattgtaaggttcgtgaaagtctcaaaagtcaatagtctcaacaaaaaatttgcggcaattatcgagtttgcaaaattttaaaacaaaaagctgaaaacatttactgcaataattttgtggtgaacataaagaaacctacaacagttatatttaatttttctaaaatttttttagttaggcgaaaaatatatattttttctagttaagaaaaaatatatatatccaaaaaagtgcgagtgatcagaaattttttcgcaacaatgaaaattatcacttaaaaaattttttttgtatcattcttagaataatcttttaactttatcctccatagagatcaaccgcatctgaaaaattttcagggcactgccggatactctggaatccgaaacgtctacgaatcgagcccggaacaagatgatgtgcagcagtcattcctcttcgctgagctcttcaaatatctgtatttaattttcagtgaagataacattcttccacttgatcaatgggttttcaataccgaagctcatccattccgcattcggcattaa

SEQ ID NO: 28806 - DNA, 2197 bp, Caenorhabditis elegans
atgattctgaggttgctcattttcacagcgttggctgtaacaaccgccaattcaagtacgcggcaacagtcaacgtttcattcaattcaaggtgagaaggttttgtatttaaaatcgataaaagttctatcaagttaaaaacaattctgtttttttttctggtttcagataaatttttttattattatttcaaaaatctgtaattttcttattgccaggggtagtactccaaatatttatattctataattgtaaattgtaagtccgaattctctgcaccattttatgattgaaaataaaaaaagttgcattctctaaattcttttagattgttaaaaactttctattaaaaaggtttctgttaagtgacaatctttctgaaagatttgggcttttgtaaaattggtttaaaaaatatttaccgttttctaaaattatgaatggcagagactgagtatttgccattttttgactggaaattaatattattttgaaaagtttcaataatttcttgactggcgttcaaataatttatttcccgtagttttttttgttgaaatttgggccctgcctccagacatttcaaacttgacctctctacatatcaccaaagatagaagcacaaatgttcacaaaaaaggtgcataaaaaacaggaaaagctcaaaaggtgttcaagagtgacctatgtggagcattgcttcgtgaggttcggcgcacttttgtctgcacgagaagcatactcgcgcacctcatagcacaaataatgtctctctctctctcaattggaatagagaaaagtctcagagttagaacaacaaaccaacaaaagtgaacaaatatatgataatattcgacaaaggaatatacactattaaaaacattaattgttccaagaatttcgaggttttcatgatcttttcacatcttattttaaagatggaatagcgccactagggaaaatatttaaaagaattcacaatggtttttggcaaatcaggtctttttcaaaatttaccagcaacattaaaaattatttccaattcattcaaatattttccttttttctactttttgttttgtttcaaacaaaatttgtcatcatatttttcctcgcctccgaagttttcaagcggtgtaaattaaagtgtgattagtatttgtttgttgatgtggttactgaatgatacaagtttttttgaccatcgtttttcaaacaatcattccaaaaaaagtgacaaaaaagggaggaaaactggcttcaaccccatagatgaccactacaccgtgtcaaacatttgatttagttttagacagcttttggtctgcccttgtgatgtttaatcttaagttacaatgtcaaaaggatagaaagatcggatagtagggtttccagtcgttgttccaggagtgcgcggaaattaaaattattttgcaatttttcttcctcgttaaaataatttggaaactgtaaagcaaagattttgaaaaatgattcagaaaaatcaacaaaaagtatttattttttatgtagagatttcgttcatctctttgaatttttaaatgtcaataggcttggtatatcacagaacagttaagtaccgtaacttttggaatatttcagagctttttagaaatcaatgtgatgaacaatattttctgccaaaaatgtttaacatttaaacgaaaacatgcaaccccaaaaaaatggaacaatacaaattgacagtaggctgaaagcaatctaaaatttttgcagttgactcaccgccatcagttcgttctcgaataatatctgcatcagtaaacacagcttcatcagtatgcaacgagaatgactttagatgtaacgatggaaaatgtatacgtaccgaatggaaatgtgatggatctggtgattgttcagatggcgaggatgaaaaagattgccgtaagtttgaatataaaaatgttcccaaatcttttggtctgtttcaaaaattcatttctacgagactaattgcgacaatttttttgcgaaaataataaaagttgttaaattctcgaacccactcctcaattttcagcacatcctggctgtaaatctgatcaatggcaatgtgatacctacacatggcacagtgtctcatgtattgccgaatatcaaagatgtgataacatcactgattgtgcagatggatcagatgaaaaggattgtc

SEQ ID NO: 28807 - DNA, 1341 bp, Caenorhabditis elegans
atgagttcccgagccgtaagcctcttctcaaaatgtggatccagaatctcccaaactcgaggaaaagctcacttcacgtttcaaccatcaaccacacttccagcaggacttgaaaatcttgaaaagactaaaatgaatttgatgcagtctgttaatgaagcgatgagaattgcaatggaaacagatgattctgctgttctttttggtgaagatgttgcttttggtggtgtcttcagatgtagtttggatcttcaaaagaagttcggaaaagatcgagtcttcaatactccactttgtgagcagggaattgctggattcggaattggagtcgcagcggctggagcaactgccattgctgagattcagtttggtgattacatcttcccagcttatgatcaggtaatatccggaataaatattatggaaataaaaaaaattattccagcttgtcaacgaggcagccaagttcagataccgttcgggaaatcaatttgactgtggaaaactgactgtaagaacaacatggggagccgtaggacatggagctctataccattcacagagtcctgaagctaacttcacccataccccaggattaaagcttgttgttccacgtgggccagttcaagccaaaggacttcttctgtcgtgcattcgtgatccgaatccatgtattttcttcgaaccaaagattctttatcgattggcttctgaagatgttccaactggagattacacaattccactgggacaagctgaaactgttcgttctggaaaagatttgacacttgttgcctggggaacacaggttcatgttgctcttgaagcagctcaattggccaaggagaagctcaatgcagatgttgaagttattgatcttcagacgattcaaccttgggacgaggatcatgtagtagaggtgaattattacaaaattctgcgaatgcgtattgcgcaacatatttgacgcgcaaaatatctcgtaacgcaaagtacagtaattctttaagtgactactgaagcgtcgatttacgggctcgattcttgaaattaattttttgcgattagttcgtttctccgtttggattttaatattctatcgataaatcaatgatctagcccgtaaatcgacacaagcgctgcagaagtcatttaaagaactactgtagttttcgctgcgagatattttgcgttttttgtttgtgttcgcgtaatatttggatgttgagtgattaaatatgaattatttttcagagtgttcaaaaaactggtcgactcattgtcactcatgaagctccgatttcttctggttttggagctgaaattgcttctactgttcag

SEQ ID NO: 28808 - DNA, 903 bp, Caenorhabditis elegans
ggtcaccgtctgttcgtcatcgcaacctcatcggatcgtatgttcttaagagacatgggacttatggatgtatttggagatgttattgatattcctaaactcactacagcaggacaaatgatgaatgtgattcaggagagtaacatttattccgatgatcaacttcctatgattgaacaaaaacttgcatcaatatgtagaggagaagggtaagaatgttcgatttttattttataaaaaaatattatttcaaacagtgtgaagctcaattttattattaaaaagtaaacttctgataaagaaataatcataattctgaaaacattactaatttatgcttttaaattagataattcttgatattaaatgatcagttgtgttatatacatcttattttttaatattaaaaaaatcgttcacaaaattaattttcttcaataattttttttttcagaaaatcgtttttctcgaaaaatttttttgaattgaaacactcaaaaaattttaaaatttgaatacaaaattttggcgaatctattttttccttttttcttttggaaaaaaagttttttctcgaattgaaccctgatatcgcccaaaatgttatcaaatcatcatctgcaagacttgtttctgaattatcattccttttggttccaattccttaattccattatcctcttacaagccattaactcttttttagccggtattagttgattattttttcataaatctcattccagcaaaattctcctaaaataagaatgttccagattccatggagtcggtatcaaacatcttctcgaattaattgaatctgctcgtcagtgtgaagccgattaccgcgtcccgacacttcttaatatgatggaaggtcttgctctaaacttgtaccgttaa

SEQ ID NO: 28809 - DNA, 227 bp, Caenorhabditis elegans
atgagtccagtcccgtgtttaagcacatgttgctgttttaggaaaatcgtggtaaataattgtgtttcaatgctcattattcgtttgatcgtttctcttttaattctttatttattgaagatcaggactgtatttattctctttcaaaattgttaattttcaggaatattctacaatgtcgtggtttcggaaatcagcaaacgactcactactggagacaaatcacg

SEQ ID NO: 28810 - DNA, 1323 bp, Caenorhabditis elegans
atggatagcgagaattcgagtagtcattcgataagttctccacaaatgtttcaaaacacgcacaacaattcagcaatggaggataatttgctttctcggccaatgaacaatgaatcacttcaaatgattattggatacttacgacgaaatggtttaacagaaactgaagagcttttgactcgagaagctggaccagtacttagagttgaaggatctaatggattacctccagagtaagttttttttttcaatttaaaaatgtatctagaaattaatattttaaaaggttggagcattgctagactcaaaatgaccccacaaaattgttttaaatttctcaaaaaaaagctaaccagttgattaagatgctttttcagtagatgtgcacacagtaatttcaaaataaaattttttccaaatgttgtgcatccatcgactgaaaagatcacttttaccgaaaaaatcaattttgtaattttctgccgaatatagacttttcccctaaactcaaaaccggtatttaaataaatttgggaaatttacaagacgtattaataatacattcggttttcggtatcattttaagtctaatgaatctactcaaatttcgccacttcatcttagaaataattttttttaatagcaaaatagacaaaatttgaatttttcaaagcccaatgtcttaaaaaccaaaagtttcagagaagcgatatccgttgaattcgacacatttgtccagcacgcaaacgattgtacagatgttgttcaagcggaattcagtcaacttttatttcctatatttgcacacagctatatagctttaattgaaaagcatgccgcaactgcccgtatattcttcaatcgattcaagattttcattcctgaatgtttctcggaatttgtatatcaattatcactaatcgaagatgcaatgacgttacgagccaatgaacatgttcacattttacgagaaaataaatttcttgttcgactttcgaggccaacactgaaacatcttgaatcaattcaaacgagagtgattggtgttaagaatataattgcaaaacatatttgtattgaaagtaagtattcatttttatatacaaaaaaaatataataatatccgttaaagatgctgacgaagtatccacaaatcgaacgacaatagaaacccaaatgggtggaattcttggagtaacttcgaaaagtgataaaagacataaaatgatgttttcggtgttaaaagacgaattgatgcagaatattgaaaaacggaagacaaaaggaaaagattggaaagatatgggaaagaaaatgcagacg

SEQ ID NO: 28811 - DNA, 1126 bp, Caenorhabditis elegans
atttgtatgtacacaacagtaaatgcaccaattggagtggcttcatgtgattttacggatgattcaagtcttattgcaatgggtttatctgattcttcaattgttatgaatgcaatggatccgatgaataagatgaagaagcttcgtgatatggaatttcttgataaaatcgatattgaaactgcggataacgtgcaatcacaaatgtttgatttacaaggatcaacgacaagtgtgaggtatacaggccacggtggtcccgtgttttctgtcaatttttcaccggatcgacgacttcttatatcatctgccggagatcgaacagttcgactttggagtatggagactcagaggaatgctgttatttatagaacaccagcagtagtttggcaggtttgtatttatataattttaactagcattttaactgagatatttagtgtcgttggtaatcttatttcaaataatagatcattatccgaaattatcgaatttaactaataaaaaaactgtctcataaagtttcagcgcaacgttctacattatctaatctgaaaactattacaggctcaattctgtagtcgtggatactatttcgctacagcaagtgccgataaaacagctgcaatgtggtcgacagatcgaatgcatccacttagaatattcgctgatccatatggagacgttggatgtattgattatcatccaaattgtaattatattgctggaggatcagatgatagatatgttcgagtatgggatgtttgttctggtactcgagttcgcatttttagtggtcataaagcttcgattatcgctgtcaagttctccccatgtggtcggtatatcgtctcgttagatgctattggaaatctgatgatttgggatttggcataccagagattagttgcagctgaaattacggaacaagctggaacgaaggtagtgaaatataaaaatgataatatcatattactagttcatttcagggttcaattacattctctcgtgatggtggtgtatttgcggtatcccatggaaattcaagtattcaattatattcacttgatactcttattggaacagttctcgccgctggacaaaatgattcctacattgagccaaa

SEQ ID NO: 28812 - DNA, 4732 bp, Caenorhabditis elegans
atgtctgttgatccaaaccttcttactccttacaaggtaatattttttatttatgttcttgcctaatatatgtattgttttagaataccggagctgccaacgcatctctccgtcagatctctgaagatgctttctacgttgtcaatgaggtcgtcatgaagcgtcttggacatgttccgattctcaaggtaatttttgaaagttccgaaaagaaagcaattgaaagtgtttacacttttaaattgttataatggcaacgagtataacacttgaacaaacaaaatgataaaattgggtggaaagtacagaaaatcattaaaatttatttcgatacatgtacacaaatgtgttgattctagaaattgtgatgaattggattttgatcaaaaaccatgtgagatggtatcgaaaaagaaaattgaaataagaaatcactgaaaagattatgttctaaacttttaatatcgtttcttgattttccaaaaaactttcaataattgtttcgttctgaaaattgcttctgatttcattccaccaggcaacaatacaaaagggacgaacaaaaaccaaatatttgctaataagattttattccattgcttttcttttcttctttccaatattttcttcttcacaataaacaaactattgtgtgtagtggtagagaccgaagacggtctgcgttttagaggccaaaagagcgatcttgaaaccaattacaaagcaataagaaggaggaggaggaggaggtgatctcttatcacttatcactgattgactcgctgatatcatatcacaccacgaggacagagacggggttttccaaacggcgattctcgaacagcgcaaagtacgcacttagatcttctacgactaggaaccatagaatattccagaaaagattcaagaaacgagagcgcacaaaaatgtgagggagggattggcacgcgccttgctttttcaaatggaaagtggctttttcaagcaggaaagggtcctcttgtacagcatccgagagggttgtttgttgagagtagccaacgaaaaactaaaaatttgtctcaagggaaaaatatttatttgggaataattttatatgctgtcgtatctacataagtttactatagttttggaaaaaattcactatcaagcaatttcagcatataatatttttttttaaataatggaaacaagtagttctttccgttctttcaaaaatttcaaagatagtaaattttgtcgaaatttaaagttcaaagtctcaggctcttgtggcttatgagctcccttcttttttcgaaacttcttgatatctacacgtggttgtttgcaaccttctccatcttctcctccccgtgtctgcgtgcaattcggcacaagtgccggggagtcggctggagcagttggtgtccctgtccctgacaactcggcccgtaactgcctctggtcaatcgatctaggagtgcctgtgagagaacgagatgaaaaaaaaactaaaaataaccaagagaaatacataaacaaatttttttcccagcatgaaagattctcgtgcagaggaaccagtttcggatagcattgaaatggaaaggtcaatgttcaaatgatacgatagacggttgttggtgtagggcagaaactgcaaggaccggtacaaaattcgaactttgcttcgagcgaccttgttagtttattggggtaaaggaaataaataatttaagctacaataacactactaatagagactttattttgctgcaaaatcattacttatatataaaaaaataattccgtttgttccatagtttgtagtctatgtagtctttgtagtctgtgacgtcacacccaaagtcactgagaattgtgggcggggtctgtcatccttcgtggtgagacccatcgtggcgagacccatcgtggcgaaacccatcgtggtgagacccatcgtggtgagacccatcgtggcgatacccatcgtggccagacccatcgtggtgagacccgtcgtggcgagacccatcgtggtgagacccatcgtggtgagacccaccgtggtgagacccgtcgtggtgagacccatcgtggtaagacccatcgtggtgaaacccatcgtggcgagacccaccgtgatgagacccgtcgtggcgagacccatcgtggtgagacccaccgtggtgagacccgtcgtggtgagacccaccgtggtgagacccgtcgtggtgagacccaccgtggtaagacccaaaattttggcgggaaatttaaattttctgtgaaaaatattttggcgggaaatttaaattttctgtgaaaaatattttggcgggaaatttaaattttctgagaaaaatattttggagggaaatttaaattttctgtgaaaaatattttggcgggaaatttaaattttctgagaaaaattttttggcgggaaatttaaatattctgtgaaaaatatttttgcgggaaattgaaattttctgaaaattctaaaattctggaaatctagaatcttctggaaatttcgaaaaaattctcgaatgttccagaactttctagaaaaatcgagaaaattctggaatgttccagaactttctagtaaaatcgaagaaatctctggaatgttccagaactcctagaaaaatcgagaaaattctggaatgttccagaactttctagaaaaattgggaaagttctggaatgttccagaactttctagaaaaatcgagaaaattctggaatgttccagaactttctagaacaattgggaaagttctggaatgttccagaactttctagaaaaatcgagaaaattctggaatgttccagaactttctagaaaaattgggaaaagtctggaatgttccagaactttctagaaaaatcgagaaaattctggaatgttccagaactttctagaaaaattgggaaaattctggaatgttccagaactttctagaaaaatcgagaaaattctggaatgttccagaactttctagaaaaattgggaaaagtctggaatgttccagaactttctagaaaaatcgagaaaattctggaatgttccagaactttctagaaaaatcgagaaaattctggaatgttccgaaaaattgagcttagagctttagaagaggtagttatttgggagttgatgggggatcaagtcaaggtactgtagtggtactataggggtactgtaggtatacggtagggttactgtagttttggaaaatttgactttttgtcctttgaagagatattgggttaggagttggtggaggataatgtcaaggtactgtagtggtattgtaaggttactgtcttggccaaaaagtaacagaaagttttcatactgtctgtgaatttttgaaacatgcatgtcgtagaaaaatacatacatgtaacagtgccagtaaaccgcgttttaagtgtttcaagtttttttcatgatgagaaattttttgagtgattgaaggtatgtgtgtcaaatacttttaatggtgccagtcgttgcccgcgccgtaggcgcagtcagcggctggtatatatataatttttttcagggagacttccatcttctgccagccaaggtgcaacgtttcatcgccgagaaggccgagttgatgcgtccacgtggaatcttcatctgcgacggatctcaacatgaagctgatgaacttatcgacaagctcatcgagcgtggaatgctctccaaactcgaagcatatgagaataactacatctgcagaaccgatccaaaggatgttgctcgtgtcgaatcgaagacctggatggtcaccaagaacaagtatgacactgtcacacacaccaaggaaggagttgaaccaatcatgggacattggcttgctccagaggatcttgccaccgagcttgatagccgtttcccaggatgtatggctggacgtattatgtatgtcattccattctctatgggaccagttggaggaccactttccaagatcggaattcaattgactgattccaactacgtcgtgctttcaatgagaatcatgactcgtgtcaacaatgatgtttgggatgctcttggaaatcaagattttgttcgttgtatccactctgttggacttccacgtccagtcaagcaacgtgttatcaaccattggccatgcaatccagaacgtgttctcattgctcatagaccaccagagcgtgaaatctggtcttttggatccggttatggaggaaattcccttcttggtaagaagtgctttgctcttcgtatcgcttccaacattgccaaggatgaaggatggatggccgagcacatgcttattatgggagtaacacgtccatgtggtcgcgaacacttcatcgctgctgctttcccatctgcttgcggaaagaccaacttggctatgcttgagccaactcttccaggatggaaagtccgttgtgtcggagatgatattgcatggatgaagttcggagaggacggaagactctacgctatcaacccagaagcaggtttctttggagttgctccaggaacctcaaacaaaactaacccaatggctgttgctacattccaaaagaactcgatcttcaccaacgtcgccgagactgctaacggagagtacttctgggagggacttgaggatgagatcgccgacaagaacgtcgatatcaccacatggcttggagagaagtggcacattggagagccaggagttgctgctcatccaaactc

SEQ ID NO: 28813 - DNA, 496 bp, Caenorhabditis elegans
aggctcattgtacttttgccaatgtattgtttcagctacatcaccatccaagacaagtcgtcactttgatcgtttcacagctgacctgaattcatcgactcgtgctcgtccaactcctccaatggctccgccaataatgtcaccatcgacggaattttcaactacaacaactgaagaagaagatgtgacaggggtaattcgatcatcttcaatagcttcgagagcaactacatatggattcttcactgctacaaaaccatcagcatttctggatcccgaatgcagagatatgaggttagagctgttaacgaaaaaatagacaaataactttgccaactttaacaattatttgaaatgttattatttaatttccagatattcgtgtggattttggctgaaaaacaacaaacaagtgtgtgaggagcaacaatcatttatgcgtgctcaatgtgcatatacctgtaaattctgcacgtcgttcatcaaacgtcactga

SEQ ID NO: 28814 - DNA, 725 bp, Caenorhabditis elegans
gataccgaaatatacattactttgaagtagcttctgtcattttgataatcggtttaatttcagatgaagaagcattggaggagaagggaaaaattgaagaaattgttgagaaattgaaaagtgcagtggatgaatattgcaaaatgaataaacgtagtgaggtaacgtccagtcggttttcaaaaaaaaaaacttagaaaattggaaaaattatagtgaaaatgcaattttctgaaacttttatttcaagacacacggatttattcagatgggtctcgctgagaaaaagtgttctatagtacttacagttagattttgtgtttctttttcaaaaaacatataaaacctgaaaaattcaatttttcaaaatcaacattttgaatcgaatttttatgaacctggtattgaaaaaagaagaaaaataatttgagttttccaaggtcatcttttcataaatcggaaaacaacaaccccattttcatagattgcaatgaaatttttcaaaaaaatatgtatgtaactaaatatcaatatattttcagagatatcatcaaatctgtgaatgtcttcaacttctcaaatcaactcgaaatcttccaatttctcgtcttttcttttctcgacttcttggtacaactcctcttgaaacaattttatcagatcttttaattactccacctccaccaacattaccattctttccccaactaccttccagaaattag

SEQ ID NO: 28815 - DNA, 622 bp, Caenorhabditis elegans
ataccgctgtggctcgtcttcgtacacaaatcaacgttgcggaagccaaagtttccagtcttgagcaacagctttcattggaagagcaggataagatgcgtcaaggcagaaccctgcgacgaatggaaacgaaaatggcagagatgcagcaaatgctcgaggaagagaagagacaaggtgaaagtaatcgtcaggctgttgatcgtcagaatgctagaatccgtcaacttcgtacacagttggaagatactgaggcagagcgagaccgtttgacaaacaagttgaaggacgagcggagaagagctgaagagatgactgatctcaatgagacactctccagagatgtttctttattgaaacagcgtgaaacgacagctcgtagaacacctggattgattggacatcgtgaatcgagaagatttggaagcaacaccagccttgcacgaggtattttgttaaaatttgttatgaaatttaaacatttataatttcagatgaattccgtggatcagctctcacaaacgaaatgtcaccatctgaccgtccagcttctcgtctcacatctggaaccggatcccaacttggcaacaccgatgaagaccgcgactcagttcgcaactaa

SEQ ID NO: 28816 - DNA, 910 bp, Caenorhabditis elegans
atgacatcatctcgacaaaaagatgatgagattgaccaattgagagtatgtttcttcaaatatttttatagttatagctttatttctaattttcaggccaagacagacttcctcaatccatcgatttcggcagattgggcgaaaaaaaagttgatgtgggtacccagtgagaaggatggattcgcacttggagctgtcatcggggaaccacatgcagacggaactatcgacattgagcttatggagactggcgaacggcagcgtgtttcgtctgatgattgccagaagccaaatcctccgaaatatgacaaatgcgaggatatgtcaatgctgacgtgtctgaatgaagcgtcggttcttcataatctaaagcaacgatatttctcgaatctctactacgtaagtttgtcgatagctaacaattcttcattgaatataaatattctcgtcaagctggttgtcgtcttttggcgtttacataagcctaagatgcggtttctttcgtagcaattctttgtggcgatttaaccccctaactcagaggaaccagctcaaattatagaataagtttcaaagtagaaattttgtaaatggaccggcttctgccattcccggagattttcctatattgaaccttgctgtgacctttatctctaagaaggaatacagttatttctgtagtttgataatctttttatcaggtgagatataaaatatgcagaacgtctcaaccggtcgttggtttttaataatcaagagatcctgatgacctttgcaacatttcaaatatttatttaaggcaaaaacttatacatttatataaatatcaatcgaattattttcagacatactctggcttgttctgcgttgtaataaatccatacaaacgaattccaatctacacggatac

SEQ ID NO: 28817 - DNA, 819 bp, Caenorhabditis elegans
atgggcaagaatttcggtaagttgatttcgtttatttttaatgagggaggttaattttaaaaaatacgaataaaaacgaaaatcaagctttctttcagtgttatgacagattgtctaaaaaaataattcaaacatatttgtattcttgtttttgccagacgcgaagttttgcggttttgcgccaaatatacggttcccggtctcgacacgacaatttttgctaaatacaaaaggctgattttttatcaatttttcattgtttttcgatagatattatttatttgtttgaaaaaactcaaatacgatattttaaaaaaattctaaatttaacataaaaacattatgaaaaattgaagaaaactctgcaacatcgaaagcttgaagttacagtactcttcaaaggcgcacgcctggttttatttaacaaaaaattgtcgtgtcgagacctggtactttgacactaaaatcgcgaaatttcgtttgaattatatttaagtatcaaagtaagtatcgaaataaaaatttaacttcaaaacattcttgtactaaatttagtactaaataataatttatattatttttcagacgaggccgctttgctcaaatctcttgaaggtgttcctgatgcggaaaaagttcagaaactaattaaaaaacttgccgaatctgaaaaacaaaatgctgaattgaaaataaaagttttggatgtaagttcaatcgaaatttgagtaactttttaaaaaacaaaatttgtttcagtacgacaaggttgtgaaggtcaaggacttgacagagaagaaactggaaagaaataatcag

SEQ ID NO: 28818 - DNA, 502 bp, Caenorhabditis elegans
gatcaaggacgcaaagatgacttggaatgctggatttatatggtgtttgatatttttgatccgaaaaatggcgtctcgtggaaaaagcagagagatcgagtcaaaattcgagaggctaagcaattatttttcgatggtaaaggttagttactgaataaacgggggaaagtgatttttgactactcatagtcattaattgtctttaaaattcccaagacacaaataatttacagctcaatacgactatgctccaatcagtttgagaccaattatcatttacatcaacagtcttcaattccaaacaactcccgaatacgcaaatcttgtcaagactttatatacatcgtcatctgcttctggttatccaattcatagtcttgatgacggtggatgggttggaaaactaaagaaagaggcaaagtcgaaaatggagaaaaagactgcacgctttggtgatagctcttcagaatctggaaaacagtctggaactgatgaagattga

SEQ ID NO: 28819 - DNA, 270 bp, Caenorhabditis elegans
tccatccgtgatcttcacaatcttggatatcttcatcgtgacataaagccagccaactttgccgttggtgttggagctaaagagtcaaccgtcttcatgcttgatttcggaattggaagaagttatttggatccgaaaaccaaacagcacagggtaaaaacatggtgcaacttgaattttagtgaatgaatcaattttcaggctccacgtaaaaaagttaagttcttgggaacacttcgatatgcatcacgagcctgtatgctagaagta

SEQ ID NO: 28820 - DNA, 1360 bp, Caenorhabditis elegans
atggaagatatattgatgcctgaaggagagaaagtttccatggagaactttgctctcctcagagttcttggaaaaggagcatatggaaaagtattccttgtgcgaaaagttggtggaaaggatcataatactatatatgctatgaaagtgttgagaaagaccagagtgagttatttttggaaaagaaatgaatttaaaaataataatttctcatttatacggtgctgaacctttgtattattatttgttttttcatctctcgccaagagcgaaaaaaccgacaattgccggaattcatattcttgaaatggttttgaacttttcgaaacaaataactggattgaaaaatttttgagagatgggaaagtgaggtgaaataaagtttatagattagtattttaatatgaaacgaaaaaaaaacaaatttgattgcaggtgctcacaaaacaaaaaaccctggagcacacaatggcagagcgtcaagtacttgaacgtctacgtggaacaccatttcttgtcaatttgttctatgctttccaaactgataccaaattgcacattgtaatggaatatgtgagaggaggagaattattcacacatctttgctcgagaggtcattttgatttagaagctgctagatttgtaattgctgaacttgtggttgcaattgatagtcttcatcaaagaaaagttatttatcgagatttgaagcttgagaatattttattggacgaagaaggacacgttaagttgacagattttggattaagtaaattgtttctacccggagagttggatagagccaattcatattgtggaactattgaatatatgtgagttttgaaatttccagccaaagtttaggcacactgccaaacgtatttggaattaaaaaaaaaaagaacttatcaaacctcagaattatttgcatgtcaataatttaaacatgattagaatatacaattcgtagtttttgatgtagttccaaaattaggattaacaaaaactgggtaattgctactttttggttgtatattaaaaggtatcattttttgttgaaaattattgatcattgatatttgattattgagctattgaattttttcattgagattttcatataattctttacaaacgaaaattggcacagacggctgtgtaaaagtaatttctgaatagataagaaataaattctcaagtttaatgattccaggtcgccagaagtaatcaatcgccctgaaggaggatacagtgatgttgtcgattggtggtctttgggtgtaatttcatttgaattgctcactggatgctcaccatttactgtagatggagcacaaaactctagtaaagatattgccaa

SEQ ID NO: 28821 - DNA, 369 bp, Caenorhabditis elegans
gtcgcctggatcgtgctatttatgtcggattaccatgtgaagtgacacgaagagccattctcgaaatgcgaactaaaaaaatgaaattcgatgatacagttagaacaattgataaactagtggaaaaaacatcaggatattccggtgcagaacttgttgctgtctgtagaactgctgcaatgtttgcaatgcgtgaaagcattgatgctacaatcgtgcaatggacgcattttgaacaaggtaattaatattattaaattattcattaactaaatattttcagctcttgccgcagttgtttcccgaactgaagcgtatcttcttgaaatttatgacgattttaaagcaggtcgagcttcgaacgcatga

SEQ ID NO: 28822 - DNA, 869 bp, Caenorhabditis elegans
agcttcactgcgaacaatgctacaccaatcttcctcggacatggaacagacgactttttggttcctcttcaattcggacaaatgtccgagcagtatattaaaaaattcaatccgaaagttgagcttcacacctacaggggaatgcagcattcgagctgtggagaggtattttatttttaaaaaacgattttcggaacatgagtgtcggttttccttttttaaaaatcgaaaacgatattttttttttaatataaaaaaaaggaaaaaaattgtcgactttagattcctcgaattctggaaaaaaaacgttttaaaataatttccagatttcgaattttcgaaaaagttataaaaatgaaaatgccctgaaatttaaataaaaaacttttttttttcaaaaatcgagaaatctaatttttcactgttttttaatcaaaaaatcataaattgagaaactgggaaacatgttagaaaaattgtacggaaaaaacgaggaagccattgatttttcaaaattatgtaaaattttttgtgaaaaagaaaaatattaaaaaggattaaaacaaaaaaataaaatataacatttcttctattcccaaaaaatctacatatttttgatatatctataaatagtttcctcgtctttttccgtatttttctaaaatttttccaagttttaaattttcgaattttcgacgtcctcgtttcgggtaaagaattacaaagaattaaacaaaatgaaaacttcaaactattagatcaaactacacatcatattatgcataatcaaaattatattaatcatattaatgtattttcaggagatgcgtgatgtgaagaccttcttgagcgcccacattgcccactaa

SEQ ID NO: 28823 - DNA, 1105 bp, Caenorhabditis elegans
caaaaggacatctacgtaccattgagtttattcacttcgagtttattcttctcgttttccaatcttcaattccacaatccaatgtacaattatagtgtgaacactataatgcacttgttcggaaagacaattaaatcttgtgaggtatgagcaatgttttgctgtcttaaaaaatgcaaatttaaaaaataaccatttttcaaaacccctattttcctattctgggttatgtttgagtttcctccgaaaggagaactgcaaaactaattagcgattcgttccgcccactttggagccaatcgacagtttcaaacaaattcacacactccatttgattaactcatctaaactgggcgaaaaataattggaattgcagttgtctgcctcttcctatattaaatcctgaaattgcattcttgacagaaataaaaaataagggcacgttttcgacatggggtgtcatttagaagttaattcaaacagagaggatatccaaaatgaaagaaataacgatcttaaaagtggaatttttagatttttcaaaattgtttttctttattgttatctctattttaatatgtggaagcaaaccccacctttatttcaatccaatgtcaaaaaatgaagcaaaacaatttccaggacaaaagttcaactcgtgtggaaaccctagcccgtcaaatgcaattaactgttttctatcacatttcccgtggaatattccgtcaagatcgtctcatgtttgccgttgcattcattaatgctacaatgccaaaaatgtttcaaccaaaagaatgggaactattcacaggtgttcttgtggatgaatcaactgatttgagcgcacttcgtgtccaatggatctctccagatcgtcttcaatctcttgccagaatacgaactcatttacccagtttattcaataattttcaaattcaagatgatgccacgtggaatgaattctcgaaaactttacaatgcgagaatgcatttcccaagaatgttgaactcaaaatgactcattttcaaaaagttttgttcattcaggcggtgaagcccgaaagattatataactgcttgatggattttgttcttaaaacactta

SEQ ID NO: 28824 - DNA, 873 bp, Caenorhabditis elegans
gattgtctgatgttcctggcgaggctatggtgaaattgtactgtccacgttgcaatgatgttttcgttccacgatcatcacgtcatcaacatactgatggaagctattttggcaccggattcccacatatgctcttctttgttcatcctgatctgcgtccacgcagaccagtcactcaattcgttccaaagtatgtcagaggatatatattaagctaaatatttgaaaatccgaaattctaatttaaaaaatctttaaaatctcggcaatcgagtaaatcttttcatttcagtataccaattaaactttttgaataaaaaatgaagtaaaatatttgcttgattcgaaaacacaacttaataatgttggaaaattcaaaacgactagtgtctgaaggttattttttcggcattcggcaactttcaggctctatttgagatcttttttcaaatatttcaacaagaataagttgcaatttcgaatcaataaaatattttgacacatttctaaaatcatttttaattcaaaaagttgacttggtagactgaaattagaagatttactctattgccgaaataagttggctgtactaaattagattcgaaataattttagaaattagaagatcaaacaataatattttatccactttaaaaatttagcagaacttagtacaataataattatgttatgtgtaaatttttaaatatcaaaattttcagactctacggtttcaaaattcatcctgttgcttatggaggacaggagggaaacagcggcggaaatacggcgaataacgttgccgcagcacaaaacaacacgactccagccgggcaacaatctggaggacaattcaataattatggtctctga

SEQ ID NO: 28825 - DNA, 873 bp, Caenorhabditis elegans; identical to SEQ ID NO: 28824

SEQ ID NO: 28826 - DNA, 1340 bp, Caenorhabditis elegans
atgaatggggatgtgcagtcagtcattcgcggatatctggagcgagcccaagtcgcgaaaacaatgtccgatgccggacgatggaatgaggctggtgatcttcttcgtcagctcatgacagatgtcaaaagctgtaaaatttcggcaagcaacagagacgagcatgacgcaagaaatgtacgtaatataaatcttttaaaagcttgttgaattatttgaaatttcagacattcctacgagccctagaggctaatttgaagcttgtccaacaaaatgtgcgcgatgaagatgacctacacgaggcgatgacgcgacaaagtggaagtccagagccacctgcagacccagatgtttggtccaaaccatcgccaccgttaccatcctcatcgaaatttggagcaacaaagaaaggagttggagcagcaggtccacgtcccagagaaatatcaaagtcaacgtcgtcgatgagcacgaatccggctgatgtgaagcctgcgaatccaacacaaggaatactgcctcaaaatagtgctggagattcattcgatgcatcggcttatgatgcggtaagttattatgttttccagaaacaaaaatcagaaatcttttcagtacattgttcaagcggtgcgtggtacaatggctacaaatacggaaaatacaatgtctttagatgatataatcggaatgcacgacgtgaagcaagttctgcacgaagccgtcactcttccactcttggtgccagaattcttccagggtctccgttcaccatggaaagcaatggttctcgctggaccacctggaactggaaagactcttatcgcacgtgcgattgcttcagagtctagttcaactttttttaccgtttcctcgactgatctgtccagcaagtggcgtggtgattccgagaagattgttcgtctgttattcgaacttgcacggttctatgctccatccataatcttcatcgatgagattgacacacttggtggacaacgtggaaattctggagaacacgaagcgagtcggcgtgttaaatccgagtttctggtacaaatggacgggtcacagaataaattcgattcgcgacgtgtattcgtgctggccgccacaaatattccatgggagctcgatgaggcactccgaagacgtttcgaaaagcgaatcttcattccactgccagatatagatgcaagaaagaagcttatcgaaaaatcaatggaaggaactccgaaatccgatgaaattaactatgatgacttggcggcaaggactgaaggattctcaggagctgatgttgtgtctctatgcagaactgctgctatcaatgtgttgagaag

SEQ ID NO: 28827 - DNA, 804 bp, Caenorhabditis elegans
agggtaataatttatctaattacatttattttgcaatttcagggagaagccgtcgaaatcgagtttgacaatgagaatcaggccacgatccacgccgtgaaaaccgaagctcatttgcatattccaatggcatcaggaaatgtgattaagattccattggcagcaattcaagaaccatcacattcgattaatttgacaaaggaagtgaataatagtggaatgtggaaacatattacatcagttgattcaaagaattctcttgttcgtgatgttccagcttcatcggatccaacttcaagtagagatgctccaattgagcaaccagaggatgatgatgatccgattatgattaaggtaaaaattactatccaaagagaacgataaacctctaaaagtcgcagtttcggataaaaatagaaggttttgcaaagctgcggcacatttgatgcatatcgatttacgaaggattttgtattacacacggacaagtgtgaattaattttaccggcatagttttacagtttggacgaaaattctcgttttgaattattcatttagtgttttacatttgaaaaaagcaattttatcgtgcataaaaccgtgcggcagacttgcaaaaccttcactccgcctctttgtcattccaaaactgccattaaacttagtaaaatatctgaacgatctgtttttcaggtaattcgtccgtctccacacacttcgacatcgaatttaacaactgaaaatactccacttttgaaggatgaggaaccaccaaaaactaatccagatgaaccaaaagtctaa

SEQ ID NO: 28828 - DNA, 782 bp, Caenorhabditis elegans
ccggaaaatttgctgatcgacggtgaaaccatctgcattgctgatttcggggagacagttctcagcacctcagacaaagttgttaaacctggcaccctaccgtatctcacaatcgaacatatattggggtataaggagaacactaaatctatggatatttgggctgctgcttgcgtcttgggtgcaatgtttcaaggaagtcatcttttctctcagaattccaatttgcaaacagtaagtcgtttgttctaactttttgagttcatgaaaactggtagatttaattttaaaaaacttttgcggaaaatatgtctcaaaaattgacaaagtatgtttagatatataaaacaaaagaaaaaccgaactgtattgccggaaaacgcaacatcttttctctaatttttttcaaaattggaaaaatcataacaaatttagaaagttttttataaattctataaaagtcatcacttttcaaaattattttactccacttttaatatatgaaatgataattttctgttttgaagatccatgcaattcgtcttcttcttggaaatcatacgaaggagacgtggccggaaatggacaaacttcccttaatgcaatccatcgagctgccacccgttggtgagaaaacattttcgaaaatcgagaatattacaaaagaagcagctgatttgatggaacaaatgatgaagtatgatccgacgaagcgattgatggcatcacaagttctcaatcatgaatatttcaaaaaggaggcaagtgcacaggctaactaa

SEQ ID NO: 28829 - DNA, 810 bp, Caenorhabditis elegans
gaaatgttggaattgattcgttacgtattggaatctgaaaataaacgctacaactttgcacctgtggtcatgccccatttaaatctgaaattctactcaaactccgagaatccgtatgcgagcattgtgaggaatgataataatcgtagaaatcactcggatcccaatcaaaagtcaacagaacgagaatcaagaaaacctaaagaggctgtctcacatggaaattcaagaaaacagtctaaaccaccaaaaaatcatcaaacgaagacaacatccaactttccgtctcacaattttccacctccggatttaatgcgaaatagtcattacaatcaaaatatgagcacatcgcatcaatcgtcaagtagtaacaatcatcattatagccataattatagttatccacattataacatccaactgccacagaatcagtaccaatcgtggactccgcaatttgattttcattcgatgaatacaagttatggagaacatggtcacaatggtaatcatcaatatatggagtcgtctggaattcatggtcacatcccatatcaagggggaaatttcaacacaagaggtgttagcagaggaggattttcctatacaagtgtgagtaagaggcagggctttttttttggtttaaagggaaaagtgttcacactgtagatttcggttcctaatttgaaaaaaaaaattatgtctaaataatatacaagtttatctttcattgttccaatttagggtaatcaatttcgtggacgtggcctatcgcgcaaattgtatgagcacaatcctcgcaacgagtaa

SEQ ID NO: 28830 - DNA, 2717 bp, Caenorhabditis elegans
atgcgtgaaatagtttcgattcatatcggccaagccggtgttcaaatcggaaatgcctgttgggaactgtattgcttggaacacggaatcactccagacggtcttatgcctgatgatacaagctatggagttgaggatcaatcgtataataccttcttttcggagactccatctggaaaacacgtaccacgtgccatttttgttgacctcgaaccgactgtcatcgatgaggtttgtagtctattgttgagttttgatacactttattataagtggatctgattatgaggggatgtacactttttttttgtttctttctgttatcaaaaattaaaaaaaaaagagtacacggagtgccaagtttcttatgttgcaatatttcgctctatactcattaaagatggagtacgactttccaaccaactttcggcaacattcgtccacttttgtcatctttcacccactttcgccaaatttcgccaagtttgccaaattagctagaaagtgactacagttggttgaaagtggcgcggatttgccgagagaaaaactttcagagtctttcaaaagtgagccagagtcggggagaggggtgactttgaatcaaacgttaaagctataaccatgtcgcatcctaaacgctatctggaagagattatagcttttttcgttcaaattgtgcgttcgatataacaaagcggaatttcaaatttcataacttattgtttgatttatcaaagaccatctgtcaaatgatttgaaacaaaaaaagcgaaatatttatttgcgtgggttgcggaggggatcaactttttgcgcagattggttgactcgtcataggcatcattttgacagatttcaatggtcaaagtgttatgtataattttcgaaggatgagtagcccgtattttgtgtagacaaatatatgaatgaacacaacaagagagactgagtggtgacaaaccgttaaactcagatttagatgtttttagcaccgagggggagaaccattcgtcgttaatttggagtatagtttgtgttgactgtagagaaaacagatgtcacgtaacatatgaaaatttgggaagaggagaatcattagaataacatttccatctattacattcagctacttcattttgaaaggtcatgtctaggtttattttgaagatatcaatatataattagctacatatagctaaaaaagaaataaaacctatttttcagttgataatttttaaatcaaaggagatataaactatcaaatttgaacagtaaggttcaaaactaatagaggaaatacgataattgagatatgccatagaactttgcaacgaacttccaaaatgttgctaaatatagttgcaatttacaaagatctttaggcgaagaaaatgctttttaatgctctaaaagacagaaaaagaacccatgagatcgaatttcaaaaggagacctctcgaaaatgcctctagacttttgtgttcaaaatttcagaaaaagctgggttaattagctaattcgctaattagaaaaaactcaagctctggtttgaggcaccattaaaaatttttgacgaaagtttcgagcgcgacaaattttgagattggccgcatacctctggtttctttgtttatgaaaattgagatgcattatccttttaaacggacaactcgaatgtttggacatcattttagaataaagttttttcagaaattatcgacaggctttagaattcttggtaatttccgtttacactacaaataaatttgcaggtacgcacaggaacttacgcaaagctcttccatccagagcaattaatcagtggaaaagaagatgcagcaaataattatgcacgtggacattatacaattggaaaagaactcattgatgttgtaatggatcgtgttcgtcgtttgacagaaagatgtcagtcacttcaaggatttctcatttttcattcattcggtggtggaactggaagtggatttacttctcttgttatggagagattatcgattgattatggaaagaaggcaaagttggaatttagtatttatccagctcctcagatcagtacatgttagttttttcttaatccaaaaaagtttttctgaccggatacgatctaactgtttttacaccttacagaaacacttatctagagaaagacctcgcatgcaaatttatttttcatttcgatttattttcatttcgatttttttttataactttggaaaccatcaaaagaaatggaaatatttcatttgaaaataactatttcaaatgactttttgaaactacaaaagtatattttaaaacttttattgtgagctttctcttatttatttctcttatttctatttaatttgatagattctgcctattgttgtaaaaacagttaatggaaaacagaagattttcaaattaaaaaaaactaaaaaaaaaaaatctataaactgaaaataaactcgagtaatattacagcaatggtagagccatacaattcacttttgacaactcatacaacattggaacattcggattgttcatttataatggataatgaggcaatttatgagataacaaaagtgaatctaggtgtcagaagtccaacatatactcatttaaatcgtcttttggcacaagttgtatcatcaattactgcttcacttcgtttcgatggagcgttgaatgttgatttgacagagtttcag

SEQ ID NO: 28831 - DNA, 126 bp, Caenorhabditis elegans
atgtttcaagtctccgatggagatggcggtgtcgtcgaagaagtcgactactcgaaaattgcaaaactggctgggataagtacgggcaacgaatcagatgttgtatcggaaatgtgtaaagaacag

SEQ ID NO: 28832 - DNA, 1522 bp, Caenorhabditis elegans
cttcgaataattctccgtgaaaagttacgaactggagaacaattaccccctgctgtacttgtgctattgtgcattccagcagttattataattctgctaaccattttcggaaaccttcttgtcctattcttcaaagctcgtgtcggtcgtacaaatacaacacttttagtttggaatttgggtttaacagactttttagtcggtgtcattgtactcccaatgggagccgtgtacttaatatatcgaaaatggatatttggacggtttctttgtcgattatgggtagcagctgatgtaacattttgcacttgctcagtggtaagtatttgattttgatttccaatctgatatccacttcatcaggtgacaatatgtgtgatatctgtggatcgatatctcgcagttacaaggccacttcgatacaagagcattgtcacgaaaacaaaagtaatatcagtgatgacaatcatctggatattctcttcgtcgattttgctcacaacagttcggtgggagcagccagaatgttacgatgatgtaagtttttcgtcatttttgaaatatcaaactagatcaagtccattttcagtccttgtgttttgttggaaatgagattcgccacttggctcatagcgttgtgtttgcattctttctaccagcatcagtcacattaacactttactggcgcatttataaacttgcaaggaaccgtcaaaaagctttagatcgtgggtttctcatgattctcggatcaaacatgaactttctcacgaacacgctcagtcagcaggtattgaatttttgcaaaagattcgtgtttaataattcacaaagtttccgctttcagacaacactacgcgtacactttggaaagacaaacgggatggtggagcatcagcgacgggtactcagaacacatgagagaattgcaaagacattgggtgtcgtctcttgctcatttctcttttgttggttgccatttttcgggttatatttgacaagtgagtatagtataataatttgtttcaagatcttttacccggtaactaatcctatttcagattataaatgttctggttgtgttcctccgattgccatcgatgtagcaagttggttgggttactgtaattcaatgctcaatcccatcatctactcattcacagttaaagagttcaaacgttccgcattccggctcgtagtgccaatttggcaatttgtcaatcgatgtttaccatttgttccagccccgcccgataatattttgcaaaggattgcaagacatgtacataggcataaggaaaaagtaagtcacacttttcttctgttttttcttcaaaatgtaatgtttcaggaaatgcaaacaaggcaccgatcgtttgaaatgtcatcgaacaaaaatggaatgctgacaacgaaagttcgatccaaaaggaggcaaactgaaccaaatgttgttgggctcattactcctgatcataaggtgagtagtacttttgaatccatttttacacccaacaaataa

SEQ ID NO: 28833 - DNA, 317 bp, Caenorhabditis elegans
aattgaaaccaacggaaccggtagagacaaaaaagaaaaaggagagaagtgtcaagccagtgcaaagcaaagaaaaaggtatagttcatttcaaaaaggaattttaataatattgttgattgtcgaaattttcagtaaccgcagaaaatgtagaggatgatgattcttcttcaacaattactcaattcgagtcttcattcaacaaaccaaagacaacagctccacgtttggctccagtagccgccgcacctccaaaaaagaaagaagaaaaagcaaaaggatgggatgatgatgcatgggatcttctcaatcaatag

SEQ ID NO: 28834 - DNA, 387 bp, Caenorhabditis elegans
aatcgaatgaaagaatcgataaagttattcgaaacaatatgcaattcccgttggtttgtgcaagctgcgatgattttatttttaaacaaacgggatttgtttgaacaaaaattaaagacaacaagtattaatgtgctcttttcaacatatcaaggtaggagattccattgatttctccttctagaatgttttttaggatcaaatgattatgccgagtgtgttgcctatattcagatgcgttttgaacgacttaataaatattccgacattaagaaaatttatacgcatgtaacgtgtgcaacagacacaaatcaaattcaattggtaattgatagtgttgttgatatggttattggacgaaatttacgaggaacaggcatggaataa

SEQ ID NO: 28835 - DNA, 780 bp, Caenorhabditis elegans
gtggctccggaagttcttcgcaaacaaggatacgatcgttcttgtgatgtctggtcccttggagttctacttcacacaatgctcaccggctgcactccgttcgcgatgggtccaaatgatacacctgatcagatattacaacgtgttggagatggaaagatttcaatgacacatccagtttgggacacaatttccgatgaagcaaaggatcttgtaagaaagatgttagatgtcgatccaaatagaagagtcacagcaaaacaagcattgcaacataagtggatcggacaaaaggaagcacttccggatcggccaattcaatcagaacaagttggagagcttgatatgcaaaatgtcaaggtaattggatggtttttttgtatcacatgaaaaacgattataatttaaaaattcaaacataacgagattttttacttaaaaaaaaacaaaaaaggtattctgcccaaaatccgaaaaaattttcctcaaaaattcaaccgttttgaatatcgatacataatagttacaatacggtttcgttttctaataagaggattcggagcgccatgttttaattaattgtgaaatcagtttcaggttgcacttgagcagacatataaagcaatcgcatcggctccaagtgttcaacttcgtccagttggatcgtctgcacttgcgaaacgacgaatgaaggagattctttacgccaactacacgaagaatgtgtcagcaaatgcatggtgcgttttttttcttcaatgtcgctggctcttatcgtga

SEQ ID NO: 28836 - DNA, 780 bp, Caenorhabditis elegans; identical to SEQ ID NO: 28835

SEQ ID NO: 28837 - DNA, 117 bp, Caenorhabditis elegans
atgggtttgcagagaggaatgccgttggctcaacttggagagccgttcggaatcacaccatcctccatcgagaatgtatcaccaggcattgatcagtgcaaggatcacaggatggat

SEQ ID NO: 28838 - DNA, 616 bp, Caenorhabditis elegans
atgtccttggcatttagaaccctttcgttcggtattaaaagatcacaaccgaaaaagaaagatgccgatgatcttaacaaaaagaaagaactatcaacgatcacagaagaatcgcttcggagatatgacgaacttcgtgaaaaaatgatcggaaaagtcgagtcaaaaattgagaaaaaagtgaagaaaaataaaaagaaaggttaatattgtctatttagtataatacttataaaccatttgtaatattcagcgtcgattgaaattcttgcatcacgaaagagagtacatgattctgacggagattctgaaaatgaagtggaggagaccgttggcgacgtggaaaagagaatgcagaaattggtgagatttctacagaaatttaatttttatttgaaaaaaaatcttcagctcgacgacattcgccgtaccaatcgaattttcacttggggtgatcatcttcctaatattattctacgattctccgattccagcatgtcaccatcattgctcaatcgtctatctgagaattcaatccgtcaaccatcaccaattcaaatgcaatcaattccatttatgactgagagaagaaatgttcttgctagtgctcccacag

SEQ ID NO: 28839 - DNA, 336 bp, Caenorhabditis elegans
cgaaatacaattttttattcaaacaaaacttaccaaatttctttacagatccgttcacggaaccgccccagatattgctggacaagacaaagcaaacccaactgctcttcttctatctgccgtcatgatgctccgttacatggtttttatatcgtagtcggtctaaaaattttacaagctcattttcagaaccttccacaacacgctgctcgtatcgaaaaggctgtatttgatgcaattgctgatggacgtgccaaaactggagatctcggaggtactggaacttgctcttcattcaccgctgatgtttgtgcccgtgttaaagacctcgaataa

SEQ ID NO: 28840 - DNA, 800 bp, Caenorhabditis elegans
gaaaattcctactaccgaatgttatttggaatgttagctggtttgatcggtcaatcatcgtcatatccactcgatattgtgagaaggcggatgcaaacagggcgaattccgagtggatggagtcctcttagagctctaattcatatttatcatacgggtatgactattttttgaattatagttttttttaaaccttactataatgacaatatagttctatcagaaatgggcggttgcaattaaacaaaataacctgcttgttccaacatttttttaattgaaattcaatgtcaaagtatagaaaatcacttgatgtgtccgaaaatcaaattaattccagttgaaaaatttgagaaagtgcttaaaaatgatctgaaagttgtcaattactgattatcgagttatctaactttgtttttgggcaaatatcaactttttggataatttaagtgattttctatactacgattttctaaaaaaaatatatggggtgaacatggcgcaatatttatgatttttcaataattgccgccgtccacctctaaaacaagattttggaatttctaaagtaattttttatagctacacataaaactccgaacaattcacaatatttgagtgggctttactagaataaactatacagcaaacaatacaaaaacatcaaattttcagagggtttgaaacgaggattgtacaaaggattgagcatgaattggctgaaaggaccaattgcagtcggagtctcgttcaccacttatgaaaaagttctggaacttgtgggtcatctaaaacgataa

SEQ ID NO: 28841 - DNA, 503 bp, Caenorhabditis elegans
aacgtcactggccaatctttcgacacccaaggagacgctgacaacttggtcaaggtttttcaagatggaagtcttctctgcactcttgccaattctttgaaaccaggaagcgtcaagaaggtcaacacatctgccatggcattcaagaaaatggagaacatctctttcttcctgaagtttgctgaggagtatgtgcaaaagtcggaactcttccaggtttgtcctttcactaaacacattatgacatcaattgttttcagactgttgatctctacgaaggacaggacccaaatgctgtcctcatctgtctcgcttctttggcacgaaagtctgagaagaacttcggtcgatctggtctcggaccgaaggaagctcaaggagatcgtcgtgaatggaccgatgagcaattgaaagctggacataacgtgattggtcttcaaatgggcagcaacaaaggggcaactgcttcaggacttaacatgggaaacacccgccacatgtaa

SEQ ID NO: 28842 - DNA, 471 bp, Caenorhabditis elegans
acgttgcaagatgaacccagtgtggaacacacttgttgtcgccggagtcgaagaggaggagaagaacaacaaggagactagcacacctttcatcggtgtcattactcagaaggtaaacttgaaagcgttaacttgccggatcagaatctcatgattaaataatcacataataattattctaaatttcagggatgcgcatatcaagtgaagcacattgcaactggacttggagcgttcctcctcaaccaagctgttgaagatgagtggagaaagaagggagaagacctctcccgtgaagaggcagaagccgtgcttcgcaaatcgcttgaacttactctctaccacgactgcgtcgctgacaatgagttcgaaatcggacgtgttgatgcgacagaaggtgtcgttttgggtaaagaagagaagattattggtgactggtcgattgccgagactaactgtcaatatgaataa

SEQ ID NO: 28843 - DNA, 606 bp, Caenorhabditis elegans
atgacgtaagttggaaatttgcactataaataaatcagaaaatccctattgcagattaatgattgatgaaaacttcaaaaaacaattggcacagcgtcgagagagagtagaagaccttttctactttgaaaattcaaaagaaatcggcagaggaacatatggattagtttataaagcagttccgaaaaagcaaaatggacaatttcctaacaaagaatacgcattaaaaatgattgagggacaaggattttcaatgtctgcatgcagagaaattgctctattcagagaattaaggtaatttcaccgattaaataatattaatttaaaatgaagattgaattcgagattttcccctttttataatctaaaattcgaaaaaaaaactgaagtagatattcaaaaaaaaaaaatgtttcaggcatccgaatttaatctgtcttcaacgtgtatttcttaccaacgaaaaaaaagtctggcttttattggattatgctgaacacgatctctggcacgttatcaaacatcatcgaacagctaaaagcaagaaagtcccaattatggtgccacggaatatggtcaaaaatatattgtttcaaattttatcag

SEQ ID NO: 28844 - DNA, 491 bp, Caenorhabditis elegans
cgcttcacacaatctccaggacgtcgcccattcggaatttcaatgctcattggaggattcgatcatgacggaactccacgtcttttcaaaaccgagccatctggagcttactacgagtacgttgccaacgcgactggaagaggagagaaaccagtgcgtgaataccttgaggagcaatacagcgaggaaaatactgtcgacgaagctaccactcttaaattggttgtaaagtcgctggctcaggtcgtaccaccaggatcacaaaatatcgagattgcagtcatgaaaaaagttaatgtaagtgatttccacctgagattattttcagtaataacatttttttaaattgaagatggtccttaattttaattttttaggatgagctgcagcaacgtgtattgtcaactgaagaaatcgaggctctcctgaaggttgttgagacagaacgtgtggctgctgaggctgaagaggctgcatccaagaagaagtag

SEQ ID NO: 28845 - DNA, 509 bp, Caenorhabditis elegans
atgagaaaaatgaacttaatagtggctatggatgccgaaggaggaattggcaaaaatggcgtgttgccatggcgaatcaagaaagacatgcagtatttcgcgtctgttaccaaaaatgtttctgatcagtcgaaggttgttcgagatttctaactaaacttgtaacataacttttgtagagaaatgcagttctcatgggacgaaaatgctgggaaagcattccagtaactcgccgcccgttggcaggacggctaaacattgttttgagccgacaacttcctgcgcaaaagtccgatgactacattgttgtgtaagctgtcatgaaataatatttaacctgttgttgttacattcagaaactcgctcgaagcggctatgaaactactttcggagccaccatttgtggattcgatcgaaacaatctggaatatcggtggagctgaaatctatgatcttgcgttgcgagaaaacttggttgatgaaattcacttgacacgtattttcaaaaa

SEQ ID NO: 28846 - DNA, 286 bp, Caenorhabditis elegans
aagattgattactctgatatgaaagattccgttgagctacttcgtcaggtgcttgtctacaatccgagcagacgactctgtggaatagaatttctcacgaatccattcttcaccgtggttagtctatttccatcttctgttctgattattctattttcagttgttcaacgagaagactgtgcgtttcaataaaaagaagatccaatgcgtgtcagctgtcgatctacaagctgtgaaatcgggagacgtcacactgacaaatgagtctgtagagcactcgacctaa

SEQ ID NO: 28847 - DNA, 434 bp, Caenorhabditis elegans
atgtcatctcgtaaaggtactcgtagttctcgtattgttacgctagagcgctcagcgaattcgtcgctaagcaacaatggaggaggcgacgattcattgtgagtttttattttgcttctctagttcctgcactcataaacgcatttcttgtgttatctaaaaaaaaactcgatgaaatgcttttcagtggctcaacgcttctagaaacttcacgtcttcaagagaaagatcatttgacttcactcaacagtcgtcttgccacttacatcgacgtgagttttaatttggaaagtattcatatttgaaagtacacttttcagaaagttcgtcaattggagcaagagaacaacagactccaggttcaaattcgcgacatcgaagttgttgaaaagaaagagaagtcaaacttggccgatcgcttcgaggcggaaaag

SEQ ID NO: 28848 - DNA, 988 bp, Caenorhabditis elegans
atgcgattaaacctacttctactacttctattttattttgcacatggatctgtggttcccaatgtagaccagaaaattctacgcggggagttccatgacgagggaaagtttatggtggattatgaggataattcgcaaaatttgaccgattatgcgagccgaagaagcagtgatgacgataaaataactccagaagaacaaaaaaggcgtggaaatgacagtacagaagtttcagaagatgatgattcaagtgatataagtgaagaaaggtgtgaccatttaatttaaaatcattttttctcaccggcttcttgcgatttacaaaatttggacagttcagacttataaaaatgtggggaaaatcagccgattatgacaaatttttcgacactgctacgtcatcacacgaagatgaagaagggttttcaatttttgaaattagaatgctaaaaccgcatggtctgcttctcccaatttcaaactatcctatttatttttgttgagttacttaattttttaatcttcttttccatattagtttcttccaattaaacgctttttgaatgaggtcgagtgatggtcttcctggaactctatgaaaaatgacaaaaacaattattatttcagagaaagagacagtgtggatcatcaacatctcaaatctctgaccgccatcaaacctgaaaaacatcaaccagtggctggtgtaatcaactctgcattcaatgacaggtttatttttactaatatattgataaaaatgaagcttttttcagaaagacattctcctgtcctcgtatcaaaactgaacttttgactggaacgaatgttggaaacatatctcctgaagatataacaatcattgctgcaatgggagatgctctcgcaactggaattggattatggccaaatgcggatatcgagtttcgaggtgccagtttcccgattggtggagattctactatagatggattgatcaccattccaa

SEQ ID NO: 28849 - DNA, 398 bp, Caenorhabditis elegans
gtttcaattagtgttttgcaagagaataccggattccttgacgagagccgagcttctcaagaaacactaaatcgattcaagcagtggttctggcaagtgattgagtcattcactcaacaagagaaacaggttaataaaaaattcttcaaaaatcacgtattcttatcttctcatgttttcaggaacttgtgttcttctggaccggatctcctgctctcccggcagctggaaaatggccaacctcagcaagcgtcatgctccgcccacaagaagatgtattccttccaacagccaacacgtgtatttcccgcctctatgtacctgtttactcgtcgaaacgtgtccttcggacgaagttgcttttggcaatcaaggcgaaaaattttggtttcgtataa

SEQ ID NO: 28850 - DNA, 834 bp, Caenorhabditis elegans
tgagctgtaccatcagtcatcatgagttccggcagattatgagcgaacaattgttcactatcacctcggatctttgctcaaacgtcttacatgcggcgatccggctaacaagtgctaccaaaaactcggaagattctgataaagctgttcctgatacaactatgccaacattgttcccaacccgaaatattacactaccaccacaagatgtatccatggaagatgcagccccagcagaagaatcgagctcttccaatatgcaaggcgatgaaattgatgatgaggaagagccacgatggtcacgagtactcagaagcagaccgaaaagagagcaagtgacaccttcaaagaaatcgaaaaaagaaaaacgagctgattctgaagaaaacgacgagtacggaggtgaaaatcattcgttctctgcagtacgatcagatgaaagtgggatgccgttcggatctccaaggccaccgatggtccgtcaaaaatcagcacttcagattattgacacttttctgaaacatccagcaatgttttatgacaaggacgctgaagaacatattggtatatttttgaaatacgaaactttcaaaacaaaattttttcagaatatgtggatgaaccggaccgtctgtctgctgtgaaggcgcttctacttacgcgtgatcttaatggaatgactcctttccaatcagccataaatcagcgagcttacggtgctgcgactagtatttggagagcattattgcaattaggattccagacgatgtcggaggagcagaaattgaagtacattttcccgagttttaacgtcgatgaaagtcacaatgctga

SEQ ID NO: 28851 - DNA, 437 bp, Caenorhabditis elegans
gttcccgctcatggaatgaataacaattacaatcagacaccagctccagtatcgactaatcatcaatatagccaagaacctgcgcgaattccagtgatgggaaacgtcataaatcagttgaataacatgaatctatctggaaacggaaactctccagctggacgaggacctccgccagcgcgtggaccaaaacctcctccaccagcaaagccaaagcttaatcctgtcgttattgctgtctatccatatgaagctcaagatgttgatgagctcagctttgaagctggagctgaaattgaactcatgaacaaaggtttgtcataactataagaatactatttttttaaatatttgtgatttcagatgcttctggatggtggcaaggaaaagtgaacaatcgagttggtcttttccccggaaattatgtcaaagaataa

SEQ ID NO: 28852 - DNA, 1257 bp, Caenorhabditis elegans
atgccgacccctgtatcaacgaagaagactatagcaccttcaacgatgaagactacagtggctccgccgacgatgagaacgacaatggctccgacgacgatgaaaacgacagtagcgccgccgacgatgaagaccacaagatcaccatcaacaatgaagacgacaaaggaaccatcaatgacgcagacaacgaaaactgttcaatcgacaattacaaatcctgtttcgtttcttgattcggaggtgacggccaaggaatatgtgaaagatggtggagcagcgagaaaagcatatcgagatgcaatacaagtggagaacactgatcgacaagcgttcagaggggtgagtatgaagttaaattgcgatgtgcgcacaatgcttcgttgggcgcatcgcaatcagagatgggcgcgatgggaacatcacgaaagtgttcaccactcgaaatgtgcgcattgtatctaattttgttggcgatgtgtgcattgttcgttcacaatacgaactgtgttcaccacgattttcgaagataataaaggaaggagacactctgattacacgtgataaagatttcaattctggaacttaaaaaatataactttaaattctaatcgtattgctttgtttttgaaatgtgtctcaaattccagatagaatcgcttctgagttcacttggccaagctatcggtctgggtaatatctggagattcccaacggttgcctatcaaaacggtggtacatccttcttgatcgtttacatcatttgtgcattcgtgtttgctgttcctgcgattcatatggaatttgctttgggacagtacgcagcaaagtcgcctcctgctgtctttagaagaattatgccagcattggaaggttggttcgatgatctcgaaaagtataattttgattttcctttttaggtgttggttggatgacctgtattgtgggagcggtgattggtgtctattacatgattctaatctcatggattgtgttgtatattatcaacattttctatgttaataatatgggtagatgtgacaatccgtggaatcaaaataattgttatgatgggtcggaacaaagccgatgcaacaaggggctctattccaatatgactgctaatgcatcttcatttctgaatacaacaatggcacctctgatgagcagtgggtcaaagagaattttgtacatcaatggaaagtgtcaagatgccaccaatatgagcgttgaagttggcactgagcagttcttctc

SEQ ID NO: 28853 - DNA, 1049 bp, Caenorhabditis elegans
atgaaatgccacacccaaaaaattgtccactattcaaaaattagtatgtgtgtccttcttcatcaattgagtcatgtccatttcgagtgctctttccgtctagctccgcgagcttccaaagagaagagtactgttagtggaaacgcagaaaatgagagaaacatgataagtgatgataagcactcgttttctctgttcatttactcatttatctcttgttttctctcaatttccaattatatttcctttcttatagatagttggaaattgtttcaaatgacaatattatgacgaatttgagatggcttttactaattttatatggatttactttcgtggaatcctctactcttcctcgatattatgacacggacatgtacagcgattgctttcaaaatgcaccaggtagaaaagattttaattttgaaattttttaaaaaaatttcaggttgtaaaacttcattcaacaataaaaatcatcaataatttggatataattaataatgagcattacctcttacagaatactgaaaatattagagttgattgaaataataaattagctagttacttggccaaattaggatgaggatacaaaagaaaatataagctatttaaatttttaatgaattcgaagatgcaaacaaggggatttaattttaaaatactctgaaaaataaaatataatttcacagaagaacaatttaaaaaaccgcgaatttcaaactctcgcttattttaggggcaatcatcgactttccgctcactctgatcggtgatttttttcgtttttcgtatttcagaatattggaatattacagttaataattcatttttgtcatttattgacacatcaataaatgaaaatttagaatagaatcgctaggaaaataattaaaatatgattatatgaagttttatctaaacgttttaaaattttgcgtaattacaattcaattttcaggatggtatcatctcacagccacgtgtatttttccattgactcaattcgaacgaaactattcgacagctactcaaatgtgtggagc

SEQ ID NO: 28854 - DNA, 239 bp, Caenorhabditis elegans
ttccgagacgattggaaatatgtggcaatgataatcgatcgattgctgctttatgtattttttggaataactgttggaggaacatgtggtattctgttttccgcgcctcacgtattccagagtgagttctaatatatttctcaaccaaactacaactatgtattgtttcaggaattgatcaacaagaaatgttggatcgtctcaaagagaaatacgatacagcatccaatattccctga

SEQ ID NO: 28855 - DNA, 458 bp, Caenorhabditis elegans
atgtggattgtaatgggaaatttaagattttgatgtataattaggttttctatccatttcgaatttacagcgcgaagtaatatcaatccacgtgggtcaagcaggagttcagattggaaatgcgtgttgggaactgttttgtctggaacacggaatacagcccgatggttaccatgttgaagatgacacttatgatgaagaaactgagacaattaacactttcttcgcagagaccgctggtgggaaacacgttccacgttgcctttttgtcgatttggaaccaactgtcgttggtatgttttcagaaaaaggttagaaaaagggttcactattcagacgaagttcgcactggaacataccgaagtcttttccatccggaacagcttttgtctggaaaagaagatgcagctaattgttatgcaagaggaagatatacaattggaagagaaatgattgat

SEQ ID NO: 28856 - DNA, 625 bp, Caenorhabditis elegans
aaaacaacgtcaatacctaatagaagtggagagacatattctaacccgtccaaatggaaatggacattcagcagttgataaagcagtgcatcttgacttatcaactggtaatccacactctgatgctaaaaaatcatcaccttctccaaaacgaacaagtgcttcaataatgggtatgactggattgccaacaactcaaatgaatggagcattggattcttcaattaataaatatacttgtacaaaagttacggttagtttccattgtttctcgagttgaataatactataaaaaactgtattcttacagcgtccactggaaaacggttcagcaacaataaatcacaaatcatcacctcaaataaatccaatcaataacaataatatctataaatgtgcaaacaaccaaaagactcaattcgaagatcgtcattttcatcatattctgaatgagcttcgtgttatatcagctcgtgtgagaaaagaagaagcaatgcatgcacttcaagctgattggatgtttgcaagtcgagttgtagatcgggtttgttttcttgctttttcagcatttctcttcatgtgcactgctattatttcttataatgccccgcatttatttgtataa

SEQ ID NO: 28857 - DNA, 365 bp, Caenorhabditis elegans
gaaactgtatgtctgagtatatgggattaatcactggatgctatgaagcaaaagaaggaggattcaagccaggtggtggttcccttcattcaatgatgactccacatggacctgattttaattgttttgaaatggcatcaaatgctgaccttaaaccacaaagagttgctgaaggaactatggtaagatttgtatttaaaaaaggaataacccgcttcaagttctacaatatctttttgcagtctttcatgtttgaaagttctttgaacatggccataaccaactgggcagtttaccaaaatgtggataaagactactacaaggattggcaaccactcaagaaacatttcacaatgcctaaataa

SEQ ID NO: 28858 - DNA, 399 bp, Caenorhabditis elegans
gtattcgcttctccgtggctgttcgtggaccatctcgtggatacattttagaagtatacggaactcacttccaacttcctgatcttggaccaattggagcaaatggtcttgccaatccaagagactttgaggctccagtcgcatggtttgaagatctcgatgttgaatttaccattatcaacaagtatcaaggatcctggttccaggccaaacaagttagttgtcaatgaaaatatttcaataattcgctgttctcagggtcattctccatttgatgttgttggttggcatggaaactatgttccatacaagtatgacttgaaaaagtttatggttatcaatacagtttcattcgatcattgtgtaagtttattaattaaaatgctgattttgaaaaag

SEQ ID NO: 28859 - DNA, 6740 bp, Caenorhabditis elegans
atggcatcatctcaggtacaagacgtcgtaagtttcaccagacacttaaaaaactattaaaaaagcggtggtggttgattgataagactttttattttcgataattaaaatatcaaaatcgacaagtttttatttactgattgacggaacgggacgatgcagtcaacattgaatgacctcggcagttgtcgtctctgtgggcatagaaatttgataggagtcatcgattgatgcggagaaagttaagactcgtagagatcataagaaatggagaggagcagacgttcgaggtacttggtgttcggaatatcaatgcaactagatagtatgtaatagttggaaactttcgaatgatgaaaggtaccgagtagggtggagcaggctggagaataaatattgactgaacagtatgttaggggtgccaattgtgttgacgatggctatgaacaattgtgaggggatgtcgaaatggttacgagctattttaaaagtaaatatactttttgaggctaaaatacgaagcaaagtattagtttaggtaggtttacgaaaaacggtatgcactttaatttcaaggatgtggaaatattttctaatgcagaattatgtcgaaattttgtctaatgttggaaaatttctaacaagtttccgaaagtgatattactggttcgatgatgcaaaactggaaaatttcaatttcaattagagggacttgatttcgggaagatattttacagacttgggacataagtttcattaataagtggtagattgataatcaacttggacgtttttgaactcaatttggtatgttgctgctacttaaaattgatgtatggagattatcctcttcccttcctcattcacacgtttcaattgcaaaaaaaaacatgcattcgaacttattggaaactgaaatggcaatcaattcaacgaaaggattagagctccagcatcaagtaattcaagacggaagagttgcattttaatctttccttctttttctttccaataatttcttgtcatcgccatgtcagtcactgagtatcttctttctaaccaccatcttgataattttgattgatacatctaggtaacaatagagcactgattaactccctcatgtttaaaaatggggaccgaaaactaagaaacccagtgaagcgggatgaattggaaggcagaagagagatttctcttcatcttctcaaagcattgcatgattctaggtgaaccgtgagaaaatgagaaaaaaggacaaaactcatgagttggttattcggatattccatccgtttctcctatttttcgcgtgattcttaatatctaccctgaacaacgtttcaccgtttattattcctaatagggctgtgcggctgatgactcggctgatggagcaaatcaacgtttttcaacgtattagcaatgatcaattagggaatacttgtatttgccatatcggctgagtcttgagcttctaattctagaaaaaagtgcacaccccttccagaaaaactcgtttttccaatcagccgacagccgacagccgagttactcggctgattcaaaaagccgactgttttgtcaaggtgtgtgcacttaaaaaaaacttttttctagaataagaagctcatgactcagccaatactgcaaatacaaatattctttaattgatcagtgctaacacgttgaaaaacttgattgtctccatcagccgagttatcagccgcacagccctaattcctaactaatatcctaatagtaaattacaattttgaaggtgttatctaaatgcggacgctccatggtccttcagttgctccgatcgaggctacaaacggcagcttcagaagacttgaagtttgtcagagctgtgggaagcaagatgagcctatgatacgagctagctctgcagaagagctaactgaaactgcaatcgaatctgctctcacatctctacacgccgagcaaccgaatacatctactgttcatcgtttggatcggtccagaacttttgataaggactgggatcttcatccagatgcagtaatctgtaaagcttgcatttttgagtcattgtaccccgaaaactgtgacaacgattctgaaaagtttcgagaaactgacataagtaacatgagaatgtcatcagaagaatttgagtttatagatggaggtagtggaatcataatcgaggagattgaagatgatgacgaaggaacatctcagaatcctcaaaaccatagctgggaagacatcccggtaaaaggattgatggaaaataatgagagctttgagacagtgattcttcaaaaaatggaagtcacaaatgatgtagttttaactggtacacctgccatttatatagaaacttctgaagttgctaaggaaccagaatcaatttggagtgtgagaaggcccttatcaattgactcgataaatactccgattgtgccaaaaatcttgacacccgaagattatttgaaagaaaaacaagaagatcgtaggcaatcatttgtgactccactcgaagaactttataagaaatataatcatcaaccaataagtcaaaatgggctgatccgtgtaatacagacacccccgccgccttgtcggttttccactttcggtcatcttcggcgtacttcttcatgtggaacaattgaaacttatggagatgctttgaaacgtagatcattttggtatattgatgaaaattcggagacatctgaatcaagacaaggatctcaagctgaagatgagaatgataactctatagttatcgaagttgaagagtctatttcgggcgttgattgtacattttgtagttctttttggaattttatgaaatgcaagtgggtactcggaagtgtaagtataagtaatcaacgagataaatctgacagtattttaatcacaaatttaattaaaaacgattatgctgtcaaaaataaatagtttagctctgaccaaaaatatatttaactttcgcaaaagattattctaatttccaggagctcgccgaagccggagacaccatcaatgaggtaaaggccagcagtgccagcggaagaggtcgtcttgctcgccgaatgaccatcgaagaggagcatgctggtgattatttcaagtgagttgaaattaattattaaaattagaatgacgaatgaacaaaaaagaaatgtcatcatacgcttctgaatcctctcctcaaaatagcattgcattattcttggtgctctcatgctcacgactgcgcgacttttactcatttacatccttttcgccgtctcagaaaataatttaaaaagtaagtattaagtgccgaaaaatgcaaaataccgtactcctaaaaaggcgcaaactttttaatttaaaattaattgattgtgtcgagaccgaataccgtatttttgcattaaaaactaatatttcaccgctagcttaccattcaaaacttattgagaaatattcaaaatgtctgcttgtgatatttccaagacttattgaatttccgtagtgttcttttgtacttttaccgtattcaaaacgtctattgtgttttttcgaaaacgttcgaaagtctattaacctcgatttctttggataatgttcctttttgtccctctctccgttctcatggtagttttcgcggtaagaccccggaaagtggctggcttcatggtcactgcgcatgggcctaaatttgcatcatgtcctggcagtacttcgcgcttttttgctctttttctattaatttttgtgtgatgcgtctctgaaattcgcgctccgtcggctgcaagatttccaattattcagaaaacagtctaaatctagaaagttcaaatgaatcataacgtggcaccgagaaagttctttttgtttacgaaagtcactgtcttcgacgttttttgaaaatttttctgctaagtgtttgtgtgaccggcgggcaaaaaatgcaattctcgcccgcccacctacacaaattcttgctgcaaatagtttattaaagaaaactgtattttctacaaatgatttttgatttattttcatctatctttttctctgacaaacgttgattttctcgtgccttttcttccattacagaaaacaatgcggaaacatgtgttttctatctccagatgttcattttccaatgggcgtgtcctgggaaacccctgcgtaattgtctccattctttcagtattctgtcgccgatgagaggcgccgtgctccttttctctgctagtctcggacttctcttcctttatatactatttcctttctgaacaagtcggggatgctctgtgcccctgaggcgggctcgcgcagccacatcacaagaaagaggagaaggcatgtgaaatccgtccgcctttctcctttcagtgaatgttctaagaattttcattttttgaatgtagttttgaatctttcgtcggaattcttgaaattttgttgtttctatccgttgtaagtcctataaagacattaaatattcctattttaagcttatatttagtcttttgaaattccgtaatttttaagtttttttaaattcaagttttccataactttcaataaatataaactaaactaaatattttctaaattttggaaaaacttctgtcatcttagcttaaagcttaagttttcgatacaaaaatcacatgaatttcgaaaaaaaacctcttccttctctcctcgccgcgccttcttgctctttaaaaatcggtcagtggccctctgctgtctcgttttctctgctcatcacatgctttttcaatgtctgctaggtcctgtgtttttgcgtgttggtctctacaaacatgggatctcatttcatcataaatcgaacaccaaaagatgaagaatacgtataaactgtaaacaattttggaattattcattatttgtagattttcctaaagctttttgtcatctgtagtctagagaaaacgtttgttctcgatcgatttgaaattgttgtatcggatattaggttatctaaaattgaacatttttgcactcattcttcaagtccttcaaattaatcaaattaaattacaaaattgacttctacggatttaaattttgatttcgagaagaaaaacttgtttgatttattttttgtttacctaacgttctcccacatttcttcatctactaattgaagtataattgttttttagtttcttggcttttttaggctttcagtgcattttttaaacattttcaagtttctggcttctgcatttcatcactatggtgataaatccaatttgttggttgcttgaatatgtgcacaaaaacatctggatttatttgctcttttcaattcgttattactccgcccatttcttttccagttgttctctcattttctcctttctcagatcatacaacatctcactttcctttcgacgtaaaatctcgagcttactctgcacattttgtctgagttgctcgttgtcaccaacaaattgtcaaaacgggagcactaacaaccaaagcttgtgagcattcggagcacgaagcggctcactcgccgccgtctcagccacaggagaagcctctgacgatcaaagagcctccgaagctcgaatcacctaaacgttcgacaccgcctccatctgcggttcctcatccaaaagtcgtaaatcttttggctccatctgttcttgcttccgagcgcctgaaatccgcatccacttcttcttttcgtgaactttttgcctacgccgcaccaacttcagacggtccacccggcgattgggattctgaagacgacgacgattcggatattctttgtagtcgacacagcgtgatgagtgacgattcgttccagaaagagcttgaagcttctggatatgataagtaagtttataacatgattcatgattatttaacaaaaattattccgtcattaaaatttcaaaaagtaccaaaaaattgccgtgaccagcgttattttttgattaaatagaactgataattataatagagtgaaaaaagtttattattcgaaatagaaaactcgtattgttgatgtatcgcttttggtccttaatctccggtgataaggttatctcgaagacttcgatgaaaagtattgaaaacgctaagcatattgcacacgttgagcaggtatttttatttggaagtggattttaatttttttactgttgtggaaatgtttacctctctgagaccttttccacaatagttctatccacttacaaattttaatttctaaaggttccattgtctccaatgctgtcaaaattaattggtgaaccacctgctcttgatgaaaacaacaatgaaaaaattggaggatcttgtagcgatgaaaatagaccaaaaactcacgtttgctcggttccgggtttcatgcaaaaaccttataaaactaggtatagtggatgttcagagagttcagaagcgtaaaatgaaccatttaaacgttttcggttgatttcaactgattatttgatttttttgagtgaattaatgaaaataaatatttcaggcaagagcagaagctcgctgctgttccagccactacccatatggagcatttgtgtcgtttggacattcgtgaggctccacatctcgttcgtcagaccggaattatttgcacaattggaccagcttgtgccagtgttgaaatgcttcaaaaattgattctcaatggaatgaacattgctcgtctcaacttttcccatggatctcatgag

SEQ ID NO: 28860 - DNA, 692 bp, Caenorhabditis elegans
atgtatcgcttttggtccttaatctccggtgataaggttatctcgaagacttcgatgaaaagtattgaaaacgctaagcatattgcacacgttgagcaggtatttttatttggaagtggattttaatttttttactgttgtggaaatgtttacctctctgagaccttttccacaatagttctatccacttacaaattttaatttctaaaggttccattgtctccaatgctgtcaaaattaattggtgaaccacctgctcttgatgaaaacaacaatgaaaaaattggaggatcttgtagcgatgaaaatagaccaaaaactcacgtttgctcggttccgggtttcatgcaaaaaccttataaaactaggtatagtggatgttcagagagttcagaagcgtaaaatgaaccatttaaacgttttcggttgatttcaactgattatttgatttttttgagtgaattaatgaaaataaatatttcaggcaagagcagaagctcgctgctgttccagccactacccatatggagcatttgtgtcgtttggacattcgtgaggctccacatctcgttcgtcagaccggaattatttgcacaattggaccagcttgtgccagtgttgaaatgcttcaaaaattgattctcaatggaatgaacattgctcgtctcaacttttcccatggatctcatgag

SEQ ID NO: 28861 - DNA, 189 bp, Caenorhabditis elegans
gctctatcgctcggactctacatgatctctcttatcttattcgatcaatatttcgaccgtcaattcgtcctctcatgggtttttatatcgaagactacggccatcacagcagtctcatgtcttccattatacattgtaaaggccctacgacggaaattctccccaccaagctacgcgaaagtcaactga

SEQ ID NO: 28862 - DNA, 452 bp, Caenorhabditis elegans
cggtctgataatttccacaatgcaagcaatcttctcatgcgtcttctattttgcatctgtctccctgtatcagggtgttctcatggtggcctattcaacgtgttacacaatgctcccggttttctcgttagtcgtcgatcgtgatgtcaccgccacaaatgctcttacctatcccgaattgtacaaagaactgggaaaaggacggagtttatcgtataaaacattctgtatttgggtccttatttcgctttatcaaggtaaatttagaattgttatatataaaacgtattttttcgttttcaggtgctgttatcatgtacggtgcccttctggtcttcgatgccgactttatacacgtcgtctcgatctctttctctgctctaatcgtcactgagcttattatggtagcaatgacggtgcacacgtggcattgggcgatgcttcttgctcag

SEQ ID NO: 28863 - DNA, 944 bp, Caenorhabditis elegans
ggtcaactattgggaccgtatccagcagctacggtagttacagcaacatgtcaagctggatatataccaactggaataatgacatcaacctgcacaaatggactttggactccgccatctcttggattatgtgaacttattggaaatgaaatcggtggaacatcttgtggaagactcggtgaacctttgggcggaacactggtctacagtgcaattggtttgggaccatatccaactggtacctctgcgacagtgctttgtaatattggaacaactctgtcaggatctgcatcatcactatgtacaaatggagtatggaatccattaccaggaacttgtattgcaactctcttgagaaaacctccagcaaaaggtgttcccgagaacggaaccgctgctgattcaccaaaagttggaaatggaacaaatgatgatacaccgacacaaattcaattatctggagaaaaatgtccaccaccaatagctcctgcattcggagaggttagttataatgaaaacacaaatatagcttaattctaattgcatttcaaatgtctaatttaatgtttcagataacattctctggtttctcaactaagggaacatttgaagatggaacaaccgcagcgctgaagtgtaatcttggctataaaccaactgggccctcattctccacgtgtagaaaaggctcattccgtccaattattggcaaatgctcgaatggctcagaacaccagcttcccggagtctgcgttccactgactccacccaaaaatgctcgagtcgtctatattcaaagtggtacatcactcgattttgaggacggtacaactgcacttttgtactgtgaagagggatttgcagtgactggtgttgccacattaaggtgtgaaacaggacaatgggaaccatctagtggctttggaatgtgtgattctatttaa

SEQ ID NO: 28864 - DNA, 944 bp, Caenorhabditis elegans; identical to SEQ ID NO: 28863

SEQ ID NO: 28865 - DNA, 194 bp, Caenorhabditis elegans
cacctagaatctgtcttcctggtcaattccaatgccacgacaatcataaatgccttccaccaggtggtctctgtgataaagtcaccgattgttctgattcttctgatgaaatatattgtgaataccaaaaaacaacagaaaagggacaatttgttctgaatacgacaaaaggaaaacattcaataaggaattga

SEQ ID NO: 28866 - DNA, 413 bp, Caenorhabditis elegans
agacgtcgacatgtgagacacgagggtgtgaccagttgtgtttgttaggggagaacggcgcggcaacatgtgcttgtggagaagggtttgaccttctcaacgatggaaagaaatgtagctcgaactgtagtgaatcacaaatcgaatgcggtggagctgatccaaagtaggttaatttcatattcaaaatcagtttaaattaaaaaaaaataataatgtcaaaattgaatttaaagtattcacatttttcagatgcatatcaaagatatatctttgcgatggtcttgctcaatgttccaatcaagcagatgaagaaaaatgccgtaggtttaaaaaaaaaatcaaatacataaaaaaccaaatacaaaaaatcaaaagtattgaaaatttcatacgtattttctggttcaact

SEQ ID NO: 28867 - DNA, 1039 bp, Caenorhabditis elegans
aggaaaattggtcacctggacgaaaggattcaaagcatccggagtagagggtgttgatgttgtcactttgcttcacgaagcgtgccatagaagaaaggatattgatattgacgtagtggcactgctcaacgacacagtgggaacactgatggcttgtgcattccaagaaaactcttgtcaaatcggagtcattgtgggaacaggtaccaatgcatgctacatggaacgtttggatcgtatcccgaagttggctggatacgttgatgaacacggtgtgacaccggaggagatgatcatcaacactgaatggggagcatttggggacgatggagcactcgatttccttcgcaccgaatgggatgaagttgtggatcgtgagagcatcaacccaggacaacatctctatgagaagatgatctccggaatgtatatgggagagtgtgcccgagttgttctcgaagatttggcaaagcaaggattgctgttcggtggaaactcggatgctatttcggttcctcattgctttccaacaaagtttgtatcggaaattgatagtgatcttcttgaggatgatgatcgaacattccaaaagacttatcaaattctcgaggatattggtgttgagatgatcactgcgaatgattgtgccaatgtggcgtacgtgtgtagtttgatttcaactcgtgctgcccatctgacagccgctggaatcgctatgttgctcaatcgaatgaacaagaaacatgtgactgtcggagttgatggatctgtatatcgtttccatccaacttatccaacacttcttgatgccaaaattggagaattgattgttggagacattgaggtaaaaattgaagactcatgaattttatcacaaatcattcacattttgaattctaaaatgattaatttacagtataaattgatgctctctgaagatggatctggacgtggagctgctctcgttgctgctgttgccactcgactgaaagaggaaaagcttgccgcttctctttcatcgtcatcgtccaatcagtag

SEQ ID NO: 28868 - DNA, 776 bp, Caenorhabditis elegans
atgcaaatcttctttggaattgtttattatcaaagacttcgtcatatgattgctgataaattccaagtgagagccactggaccaattgatccaattactcatcaaccagtaaaaggaagaaaaaagggaggaggtattcgatttggagaaatggaaagagatgctattattgcacatggaacatctttcgtgttgcaggtacttttatttctatgtttaaaaataacaccgaaaattttttagatttttctgtttttttcagggaaaaaaactgaaaaatcggaaaaaaatgttcagaaaactaaaaaaaaagttaatcttaaaagaagaaaattggtcaaagtttacatctgttttttttttgaaaaatcgaagttttgaacaaaattggaaaactagtagttttcgatttttcaatactcaaaaaaatcgaaaaagcgacaacactaacttcattgtactgatattttaatttccaggaccgtcttctcaactgttcggatcgtgacgtagcatacgcttgtcgtcgttgtggatccctattgtccgtgttgatgtccagtcgtgcaggatcacatttattgaaaaagaaaaggaaagacgacgaaccattggactacacggaaactcaacgatgtcgtacgtgtgataaagatgatcaagttttcctgcttcaagttcctcgtgtcttccgttatttgactgccgagttagctgcaatgaatgtgaaaatcaagttgggcatcgaacatccatccaaagtaactggaagttaa

SEQ ID NO: 28869 - DNA, 991 bp, Caenorhabditis elegans
atggccgcccgaaacgcaggaaccgcccggcctggaggtccaaacagaacgtgccagttcaaactcgttcttctcggagaaagtgctgtaggtgagttgatactgaaaatggaaaaaaccgctaaaggttggagtagaaaataaaagcaaacaagaacagttttccaaaaaataaagatttttttattctactccgttctgtctgtagcatatttcgcagttgctgaaaaccgtcacaaaatttcgaaattgcgttgatttcgaagtttaattcttcgtcttttgattgtttatatgtttagaattatgggtcatctgatagttgctagcatatgacgtatatgctctcttatttcacctaaacatcacagaaaactatcatttcaggcaaatcatctctcgtattgcgattcgtcaagggacaatttcacgagtatcaggagtcgactataggtgctgcgttcctcactcaaactgtgagtttttgaattttttgtgaaaatataacaattttccctaatttgaacaaaaattttgactaaaatgaaaaatctcgaattttaataatatattgttttttaataatataattgcggagatttttgctcgaaaaacacggattttatattgaaagacgtaaaaacgttaataattaagaattgaattttcgaaatttcaggtgtgccttgacgatgcaacaattaaattcgaaatctgggatactgcaggacaagaaagatatcattcattggcaccaatgtactatcgaggagctcaagcggctattgttgtctacgatattaccaatcaagaatctttccaaaaagcgaaaaattgggtaaaagaactgcagcgacaggcatctccaaatattgtgatggcattggctggaaacaaggctgatgttgccaataagcgaactgttgagtatgaagaagctaatgcttatgctgaggacaatgctctcttgttcatggagacatctgcgaag

SEQ ID NO: 28870 - DNA, 992 bp, Caenorhabditis elegans
ggtgatcatgaacacgcggactacattgtgacaggcgcgtggtcttcaaaagcagcagatgaggctggaaaatatatcaatgtgaagaaggtttttcaaccatcaaaaccgtatgtcactgtaccagatcaagagaattgggttcacgatgaaaaagccgcatatctgtattattgtgccaatgagactgtacatggaattgaatttactccaactgctccagaatcacataatgttccattggtggctgatgtttcttcgaatttcatggctagaccatttgattttaaagatgtaagcacaactatgtatataaaaatcttttagaaaattagccagatgttttatcctaattttacaagattttggcaagagaaaatcttgtgaaattaccaaataagttttatgaaaaaatcattaacctttttttaaaagtttcatttcagcacggagtggttttcggtggagctcagaaaaaccttggcgccgctggtcttacaatcgttattgttcggaaagatcttatcggaaagcaacaagcaatcactccatctgtcttcagttataaagaaatgattgcaaataatagtttgtataatacaccaccaactggaggtatctacacaacaaatctcgttctcaaatggataaaatcaaaaggtggacttcaagcaatctatgagctaaaccttcaaaaatctggaatgatttatgatataattgataattcaaatggtttttatcactgcgccgttgacaaacgctaccgtagtattatgaatgtttgcttccgaattggcggtccatctggaaacgatgaacttgaggagaagttcttgaaaggatctattgaacgaaatatgattagtttaaagggacatagatcagttggtggaatccgtgcatcgctctataatgccatctcagtcgaggagacacaagtacttgccacgtggatgaatgagttccagaaactccataatactaactag

SEQ ID NO: 28871 - DNA, 1918 bp, Caenorhabditis elegans
gttgaaatcctcgcgaactccgaagggaacaagactacgccttcctacgtggcttttacagatacagagagactcgttggtgatgcagcaaaagatcaagccgctcgtaatccggagaatacagttttcgatgcaaaacgtctaattggaagacgattcgatgaagaaactgttcaatctgatattaaacattggccattcacagttaaaggaaaacaaggaaagcccgttgttgaggttgaagtgaaaggagaaaaacgagaattcaatgctgaagaaatatctgcaatggtacttcagaagatgaaagaaacggctgaagctgtacttgggcattctgtacgggatgctgtcattactgtgcctgcatattttaatgatagccagaggcaggcgaccaaagatgcagctactattgctggactcaatgcaattcgtattatcaatgaaccaacggcggcagctttggcctatggactcgataaaggaattactgatgagaagaatattttgattttcgatttgggaggaggtacatttgatgtctcgatcctttcgattgcggaaggatctattttcgaagtcaagtcaactgcaggagatactcatcttggaggagaagactttgattctcgagttctacaacattttatgaccgaattcaaaagaaaaactggaaaagatatttcatcaaatccccgcgcaattcgtcgtctccgaacggcatgtgaacgtgctaagcgtactctttccagttccactgaagcaactgtagaggtcgattcgttatttgatggaactgatttctattcgaaaatcacacgtgcaagattcgaagagctctgtgctgatcttttccgcaagactttggagccggttgaaaaggcacttcgtgatgcaaaaactgataaaggcagaatcgatgaagttgtcttggttgggggatcaactcgtataccgaagattcagaaactactgaaggagtttttcaatgggaaggtaagaataattactctagataatgatgaaaatagtaacttttaatgatctcaattttcaggacctcaactgctccattaatccagacgaagcagtagcctttggtgcagccgttcaagcagctgtactttctggagtaaaagatgatactatcaaggatgttttactcgttgatgttgtcccactaagtcatggaattgaaacagctggaggagtaatgaccaatttgattgatagaaacactagaattcctgccaaagcttccaaaacatttacaacgtatgcagacaatcagcctggtgtctctattcaagtatacgaaggagaacgtgctatgactcgagataatcatcgtcttggaacatttgaattaactggaatcccaccagctccacgaggagttccacaagtcgatgtaacgtttgatattgatgcaaatggaattctcaatgtatcagctgccgataaatcaactggtagatcaaacagaattacaattcgcaatgagaagggacgactctctcaagctgatattgatagaatggtcaatgaagcaaaacagtttgaaagagaagacgcagcacaacgagatcgaattagctcgcgtaatcaattagaagcgtatgcattccaagttaagcaggctctcgaagaacatggatcactgttatcagcagaagatgcaaaacgtgcaaaagatgcagttgaagatacccttcgttggatggaacgtaatacattagcggataaagatgaaattgaagcaaaggacaaagagttaaagtctatttgtcaagatattttaacaaaaatgcatcaacaagaagcccaatcaggttccggatgcggcaacccaggatctggtggattccattccagcaattatccacaaggacctactgtagaggaagttgattaa

SEQ ID NO: 28872 - DNA, 1453 bp, Caenorhabditis elegans
atgataagaactgataatctatctgatcttgcatcagcgagagattattggagaactgataaatacatttcatttgtaatcacatttcagttctatttgctgttggacacaatgaggtaagtgtccacactgatattctcgtatagttgaaattcttttagtgacagtttcaactggccagctggaaataacgaggcaagagaacgtttgggagaaaagtgagtttactgaatttcaaggagttccccggtcattttctaaagtaaaaactaggttttttaggcatcgtaattttcagtttcgttgcattttttatttttcaatgtttaattgactactgtagcgcatccatcagaggtaggcacggtttcaaggcctgtgacagcctgaaacctaccggcctcctcgtctaaataatgcattctggcgtgaaattaaaaaacctggagattgaaccacaagttgcgataggtatatgtgtttctcctatgcagagtttgccagcaaatgtgttctagggcaagggtgttctggtaaaactttaaaaaataaaacaatctgcgttcggggggaatcgaacccccgtcgaatgcttggaaggcatccatgctgaccattacaccacgaacgcggtggttttataaagaaatgatggaaagggtatttaaaagacgggaacttgattttccgactatgtatccctataaatcccgataaaatcgtacatatatttatgttttcttcttttttatatctattttcatcaaatcaccgcgttcgtggtgtaatggtcagcatggatgccttccaagcattcgacgggggttcgattccccccgaacgcagatcaaacttttttgaatgtataaaaaaagttttgttagtaacggaattgttttcacatatccttttaatcagatttgaaagtctccacttggacagtcgaatttcaacatctcatgcaaaaccactttcaaatgctgatccagtagttgttccaatttatcattcaagtacttatcgtttcaaaacagttgatcaattcaatgaagacaatcacggtgccaactttgtatatcgtcgatgcggaaatccaacaactgaaaatgtggaagttgtgattaatgagatagaaggcggtgcaggatccctcctatacaactcgggtcttgcagcgattagtgcagtttttctggaatttctgagttccggtgctcatatgattgttatgaacccaatttatagtggtacatcatcatttattaatgagacattggctcgttttggagttgaaataacttctgttgacgttgaaaaagaaaaggattttgctggagctgttgaaaaagcaattcggccaaatactaagatgatttactttgaatcaattgccaatccaacgatggcagttccagatattttgggaacaattgaagtggcaaagaaatataag

SEQ ID NO: 28873 - DNA, 1519 bp, Caenorhabditis elegans
atgacgccacggattcgcagaaaaacgaatattgccagtttccgtatttttcacattagtggggattatatcctctgtattgttatgtctatttattttttattatcgtcaaaaacagacaatatttttagatatctgatgacaaaaaggcttggagatggaacattcggtgaagttatgcttgcaaagaaaatagacactggtgatcgagttgcaattaaaaggtgtgtagttgaatggatccagataataatgcccagactatttaaagttttcaatcattttagttcgttttgcacgaaattcatgttgtttgataaaacttaatgagaattagttttttgcagaatgaagaaaaagttctacagttgggaagaagcaatgagcttacgagaagtgaaatccctcaaaaaactcaatcatccgaatattattaaattgagagaggtaagagaaaactcagaaagattagatttcgttgcgaaatattcatgcataagtcacaaaaatacgaaaatctgaactcaaaaagtaatatgactctctctgattaatttttagccaatttttttttcaaaatgcacataatcattctcaaaactatatagtcaaacatacaacttttaaactacggaaagagtcgaacattcggaaatatgaaaattttgaaaaactaaagtgacttattttttccattttcatagtcctagtgatggtttagaatggcgactactgtagtgttactgtaatggtttggtgaaggtactgaaaatagtactgtaggattactggaactattctgaaaatccgttcaaagcttttgagggaagactgagttgagtgtcataacactgcagagcctctgaggaatcactgtcctgtagagttactgtagctacactgtaaaattttagaaacttcttgaattctctagatgcttttgaaaaacttgtaaaaactccttcaatatttatgaaaaaattttaaaatggacaattggatgcattttctgtagttgtacaacaaataaataaataattgaaatcccattttgcaggtaattcgtgaaaatgacattctctactttgtgttcgagtttatgcaagaaaatctgtacgagctaatgaaagatcgtgatcgttattttccggaaagtgttattcgaaatataatatatcaagtactacaaggacttgcattcatgcataaaaatggattctttcatcgagatatgaaacccgaaaatataatgtgtaatggaacagaacttgtgaaaattgctgattttggattggcacgagaaatcagatcaaaaccaccatatacagattatgtatcaacaagatggtatagagcacctgaaattcttctgagatctacttcatacaactcaccaattgatatgtgggcattgggatgcattatggcagaactttatattctaagaccacttttccctggaacttctgaaatggatcaattattcaaaataatatcaattcttggaactccaaataag

SEQ ID NO: 28874 - DNA, 374 bp, Caenorhabditis elegans
gctcatgcggcagattcggtgaatattcaaacacctccggaagtagttgctactgttcaacgagtctcaattacaaatgaacaatttgaggataacactgaagcggttgatatggaaattgaagaggatgaagatgaaaactctacagagaagaaggaaaacactgaaaaaaccgcagaggaagaatctgagaatgttaagaatactgaggatgaactggatatacctatggatcctgcacctactcttccaccaccagtggtgaggtcaatttttaaacaaaaaatgttcaaatcctttttcagacatcaaaaaatcaatcttcatcacctattaccgcctcaagttcagataacaacgagacaagtgcttga

SEQ ID NO: 28875 - DNA, 374 bp, Caenorhabditis elegans; identical to SEQ ID NO: 28874

SEQ ID NO: 28876 - DNA, 919 bp, Caenorhabditis elegans
atggagaaaaaggtcgacgagaatgccacccttatgaacggggtggaaaccactggaccggcccgtgatgatgtgccggaaacgttcagagaatttctctacaacaagaaaaatggaaccgttatgggtagaaccggaaagtcttggttccaggtaatattttcaaactctaaatttaatttactcaaaaaatattttttaaactatttttgaaatttcagatcatcgtcttctacatcatcttctacgcattcttggccgccttctggttgacatgcttgaccatcttcatgaagacacttgatccaaaagtaccaagattctatggaaaaggaaccatcattggagtgaatccaggagtcggatatcagccatggttgaaggaacggccagattcgacactgataaaatacaatctccgtgatcaaaaatcatacaaagcatatttggaacagatgaagacgtatttgacgaaatacgattcaaatgccactgagactcgtgagtgtggagccggagatagcaatgatgatcttgagaaaaatccagtaagtttcaaattttttgactttcgtttcactctgagtattattcaattctatgattgatttttcaggatgctcttccttgccgtttcgatctctcagttttcgataaaggttgtagtgagaaatccgatttcggatacaagtctggaaagccatgcgtcattatttctttgaatcgtctcatcggatggcgtccaactgattatcaagagaattccgtgccagaagaagtaaaagaccgttacaaggctggatcgattgctataaattgccgaggagctacaaatgtcgatcaggaacacattggaaaagttacctacatgccatcaaatggaattgacggacgctattatccatacgttttcaccaag

SEQ ID NO: 28877 - DNA, 751 bp, Caenorhabditis elegans
atggctgaccaaaaggaagcatccgaagcagcaaagaaccgcgaaatcaagatctcgtcttcggatgatgaaatcttcttggtaagctgaaattcgtttgttattgtcatttttatctgaaaaactaggcttcgggtcgataagacgctttcgcagttcttatagaaaatgtttagtagcctagttgatttttaataaatcaacaaaaaaagcggcactgtacgctagatggcatgggaaaaattgcaatctgaacttccaggtcccacgcaatgtgatccgtctctcaaacactctcaacactcttcttgtggacctcgggctcgacgacgatgaaggaaccaacgctgagccaattccagtgcaaaacgtcactgcctcgattttgaagaaggttatcaactggtgcaccaaacaccagtccgacccaattccaactgaagacagtgagaagaaaacggatggttccatccaagactgggacaaaaaatttctcgatattgaccaaggaacccttttcgagctcattttggtaacttgttattttagttgcaatattttaaattcctattttcaggctgccaactatttggacatcaaaggacttcttgatgtcgcctgccagtctgtcgccaacatgatcaagggaaaatctccagatgaaattcgtcgtgctttcaacatcaaggacgacttcactgcagaggagagagagcaaatccgtaaggaaaacgcctggtgcgatgattaa

SEQ ID NO: 28878 - DNA, 421 bp, Caenorhabditis elegans
atggctgatcaaaagaaagtatccgaggcggcaaaggaacgcgaaatcaagatatcgtcttcggataacgaaatcttcttggtaagattcaaattattccttcgttttcgttatttttgtctaaaaaaactaaatcgataagccgtgctgcatgcatgcgcgcgtagagttttgcttcttggtatcctaggtgatctgacttatagaaaaatagacaatgttaaatgttccactatatttgaaaattcacaaactaaacttccaggtcccacgcaatgtgatccgtctctcaaacactatcaacactctcctgatggatcttggactcgacgacgaagaaggaaccaacgctgagccaattccagttcaaaacgtcactgcctcgattctgaagaaggtcattagttggtgcaaccatcat

SEQ ID NO: 28879 - DNA, 339 bp, Caenorhabditis elegans
cactccgatcctatctcgactgaagattccgataaccgcgagaaaagaactgacgacataggcagctgggacgtcgagtttcttaaggttgaccaaggaacccttttcgagctcatcttggtaacttgttattttagttccaatatttgaaattcatatttttaggctgccaactatttggacatcaagggacttcttgatgttacctgcaagactgttgctaacatgatcaagggaaaatctccagaagagattcgtcgcactttcaacatcaagaacgacttcaccccggaagaggaagagcaaatccgcaaagagaatgcctggtgcgaggattaa

SEQ ID NO: 28880 - DNA, 1556 bp, Caenorhabditis elegans
atgaatgtcgctcgtagaagaagtggcctgtttcggtctactatcggagcaccgccgaaggccacaagaggacgtgctgccgcaccacccatcaaagaagccgatccagcaacaatcccaagacagtcggctcctggaggaataacgattggaggtaaatttgttatttttgtttttaaataacttcctcgtgatttcaaatgttcgcacttctaaaatagcgttgtaattgctttcaaagtttaaaacaacaaccaacaacgagtttaattatgaattttcagccgctgcttgtcgtcctccgtctcgtttgcctggcgccacaatttctgctactggtagagcatcgttgccagaacgatcagcgatggccaaaacatcgacgagttcccattccagaccggcgttgcaatcgaccgcgagccgtaatacaacactgacggcagcttctacgtctcgacaacttcgcactggtcgtccaccaccaccatcaactcaacgttcaactgcgactttttccctgaagccgtcggtagcaagagcccgaccagtggcacagaagcctattctcccttccaaagtgacgcttcttgaggagagaaatgcgcaattggagcgtgagatggctgaggctaccgactttgccgaacatcaaaagagcaagatccaattcctggatggcaaacttgaaggcgcggatcgcaagctgatttcactgcaagaccaattgagcacgctgaaagaagtccacaagtcaaaaatggaggagtgtgaggagtatcgtgttcacaacaacgatctccgggatctgctcaacgaaaaggaagctgagttgagaaagttgcacaacgatgtcgtcgatttacgcggtcaaattcgtgtagctgttcgcgttcgaccgttgatcaaatctgaagtcgacacctcgagttctgcgattgagtatccagctgtcgatgccatcaaaatcaatgaaggctcgaagcctggaaatgttgtcaaattcgagaatgttttcacaccagtcttctcgcagaaggaagtattcgcgaacgtcgaggagttcattcgggttagtttcaaaatataatattaataataaaaatgttgataatttcagtcgtcactgcatgggtacaacgtcggattgattgcctatgggcaaaccggaagtggcaaaactcacacgatgcgaggaggaaatggtgaagaggaaggaatcatcccgagagcagctgcatttctcttcgctgaatccaaaaagctcgagtcacttggatggaaattcgacttctcattgtctttcctagaagtctacaacaacgtggcatacgaccttctcagtggccgagacgttgtccaacttcgtttgaacgatcaaacggtttccatgattgggctatccgaacacacgatttccaatgtttcggatgtggctaggctgcttcgtgtagcagacggaggcaggaagacggcggcgacgaagtgcaatgggagctcgtctcgttcgcacgccgtttatatgtggaagatcaaagcacatcagccatcaactg

SEQ ID NO: 28881 - DNA, 1247 bp, Caenorhabditis elegans
agatctctcacaatcatttcacaaactcgaatttaattccagaaggtgagcttttaaattttattttcaatgctttgtgaaagtactttctatcggtttttattctttcggcttatagaaaatagaattcttgaaaaaccatctatttagatattctatagtggtgttttcgattattttcagcttctaggcactttaagctttacttctatttgctcccatttctctcaatttccacattttttcggaatgttttttgtttgctgtcgcactttcaccttttcaggttctggaatgccacgtggatattctgaagatgatgaagcagacgaggaagaagacaatttggagaatcaaaagaatggtcgctttttcgtttttttggttttttttgcacctctcactttttcacacttcactgtttgttttgagtgttgaaactacttttcacatttaaaaaaaaacgttgttgctccttgaagtatgctctttcaatgtaaaaatcatttcaaaatagtgtaaattacaatttttgtattgttagagcacattttgagcactcaaatatcgcatgtatgtttatgtataatttcagattcagaagaagaagattcacaatcacctcctcaattggaattttattcacaagctcgtcggcatgaatctcggaatgctccaactacacgttcaggcatgctattttaaaacaaaaaaaacgtcattcattctgtgatcaaatgatggaaaatctgagtttatgagaaaaaatatttgaggggtcgaaacagacaaacagagagaataaattaagaaatcataattcatagaatcaattaatgtcttaacttcccaaccaacattcttccattcttgaccgtgagaaagctcaagaaacttggatttttgacataaaattgacacttaagacaattttttgaaaactgggattctagaaagattcaatttcaaaattaaaaattgaagcctagtgcattaattgggaaatttctgcttatcaaccaattttaacaattttttgggaaatgttgccaaatatatatcgaacataatttcgggttggtgatttgaaagttattagaattggtttaaaaattgcggcaaaaagccaaaaattaaactttaaaactataatttttccagagctccgagcaattcaagtggattcagccagtttcccatcacttctgctcatcacaataatctactttgtctaccacgggttctaa

SEQ ID NO: 28882 - DNA, 297 bp, Caenorhabditis elegans
tcgggttatcgtttgggatatttctaaaattcaagacccatcgtcttcatcagctgcatcatctgattctgttccaccagaagttatttttattcacgctgggcatactggaaaagttgcagatttctcttggaatcccaaccgcccatggactatttgcagcagcgacgaatttaatgcattacaggcaagaattattttcaaaaaattaatcataactatttaatggtttttcaggtgtgggaagtttcaaacagtttagtttcgtcggaaaaatgggagaccgaaatgatttaa

SEQ ID NO: 28883 - DNA, 1145 bp, Caenorhabditis elegans
gataacagcgaccatactattcatcggctcattcttggaactcatacttcagatgagcagaatcacttgcttatttctaagatctgtatgccaacggatgatgcccaatttgatgcatctcgctacgataccgagcgcagtgaatacggtggtttcggagctgttaacggaaaagtggaacccgatattcgcattaaccacgaaggggaggttaacagagctcgttacatgcctcaaaagtcgaatatcattgctacaaagtctccacatgctgatgtttacattttcgactatttaaagcactctgctgttcctcgtgataacacgttcaatccgcttatcagactgaaaggacacacgaaggaaggctatggattatcatggaatccaaacaaagaaggtttgattctatcagcgtcagatgatcagacagtttgtcattgggatatcaacgcaaatcagaatgttgccggggaattgcaagcgaaggatgttttcaaaggtcacgagtcagtcgttgaagatgttgcttggcacgttttgcatgatggtgtcttcggatcggttggtgacgataagaaattgtaagcttttgttttttttctatttattaactaattaaaaattataggctcatttgggatgtgcgcacaagcactcctggacactgtatcgatgctcattctgccgaagttaactgtctcgcattcaatccatattccgaattcattctggccaccggatcagctgataaaactgtcgctctttgggatctacgtaatctacgaatgaaacttcactcatttgaatcacatcgtgatgaaatcttccaagttcagtggagtccacacaacgagactattcttgcatccagcggtactgataaacgtcttcatgtgtgggacctatctaagattggagaagaccaatctgccgaagacgcggaagatggtccaccagagctgttgtttattcacggtgggcacaccgccaagatcagcgatttctcgtggaacccgaacgagccttgggttgtgtgcagtgtgtcagaagacaatattctccaagtgtggcaaatggctgataacatatacaacgaagttgacgaagaaactccagccgatgtggtagagagacaacagtaa

SEQ ID NO: 28884 - DNA, 87 bp, Caenorhabditis elegans
atggccactcttgaagatggaacctccgaagatcgcgtcgcaaatgatgaatacaaaatttggaaaaagaacaccccgttcttgtac

SEQ ID NO: 28885 - DNA, 1274 bp, Caenorhabditis elegans
atggtactgtttcacgatgtcttcgacgcggctcaaaagaacggattagtgattccatcggcttcatcggttgttcgtaccgcaaaatgttcatcagctgccacttctgttgctgctccgattgaatttggctccagtcaattctatgcaatgtgtgctcttggaggatctctttcctgtggattgactcattttgcaatcactccgttggatattgtcaaatgccgtattcaggtatcatccaaggtctattttttattgttaccaatattccaatttcaggtcaacaaagaaaagtatggaagcatggtgcaaggttttaaagtgaccatagctgaggatggagttcgtggtcttgctcgtggatgggctccaacattcattggttattcggctcaaggacttggaaaattcggattctatgaagtttttaaaaacatctacagcttgtctttaggagaggagaatgcctatatttggagaacttcgatctatcttgccgcatctgcttctgctgaattctttgccgacatcttcttggctccaatggaagcagtgaaagttcgtatgcaaacatctccaactgctccaacaactcttcgtgcatgtgctccaatgatttacaagcaggaagggctcactggattcttcaagggactgccacctctttggactcgccagattccatacaccatgatgaagttcacttgtttcgagaaaactgtggagcttctctatcagtacgttgttccaaaaccacgtgctcaatgctcaaagtctgaacaattggcggttactttcacagctggatacattgctggtgttttctgtgctgtcgtgtctcatcctccagatgttcttgtttcaaaactgaatcaagattcaaatgccagtgttggaagtcttgtcaaacaacttggattcaagggactttggggaggacttggtccaagaatcattatggttggaactttgactgctcttcaatggttcatctatgattcgttcaaggtaaggttctctctttatctttaaacttatctcacttgtttcaggttgcaatgaatcttcctcgtccaccaccaccacaaatgccagaatctttgaagaagaagcttggaattccgggaaccactgaagttgctccagtcgctgaaaaagttgctgctccagagaaaaacgcaaaatgtgagaaaccaggaaaggtcgacaagaagcaggaaaagaaggagaagaaagaaaagaaggccaagaagtcggaagaagctgtttaa

SEQ ID NO: 28886 - DNA, 564 bp, Caenorhabditis elegans
atggctacacgaggaccaacacctgacaaagcgagaatgggactgcctgatagatggctgcactgtccaaaaaccggaacggtctgtgcaaaatctgagatttcggttgttcattgttctcattttcagcttatcaataatttgtttttcccattcaaaacaccactgtgtaaaatgtatgacaatcaaattgccgaaagacggtatcaattccacccggcagaagttttttcacatcctcatcttcacggaaaaaagattgggttgtggatcgacctcacaaacactgatcgttattatttccgcgaagaagtatgaaattcaattaaaaaaataaatttgtaacaaaacgattatgttcaggttaccgaacacgaatgtatctatcataaaatgaaaatggctggacgtggagtgtcgccgactcaggaggacacggacaacttcattaaactcgttcaagaatttcataagaaatatccagatcgtgttgtcggagtgcattgcactcacggattcaatcgaacaggatttttaatcgctgcatacctatttcaagtagag

SEQ ID NO: 28887 - DNA, 723 bp, Caenorhabditis elegans
atggtgatggaagtggacgaacctgcagttgcggcgactacatcgcaaaatcaaccgcaggagcatgcgaatgactttgatatggatacctccgagggaccaattgagaacgatgaaacatttgaaccggtagatcaaataaattggaaattcaaccaggtgaaaggaaatatagatgccgatgtgcacacggaaggtaaaaaattgttacttgaaatttccctacgtttttgatactatttcttaaagacgcacgatttattcagaaaaaagttggtggtttaattgccttgtttttttttaaaattaaaatactacttagttcattttttgcgaaatttgtcatattcttttcatttttctgtgaaaattgttttaaatcagtttttaaagtaaaacattcgaaaaaaattaccataaacattattgcgcgccgagacccatctgaattaatgcgtgcgactttaagatgatatgtcaaaaattagtaaaaattatgatgcctagaatactgaaaaatcgaataattttcagccgatgtgatctcttgtgtggaattttcacacgatggtgaatatttggcaacgggagacaaaggaggacgtgttgtaattttccaacgagatcagagtgtaggttttagtttttagaaagacgagaactgttttaaatatttaatttttcagggaaagtatgtgaaaggcgttcgatcgagggaatata

SEQ ID NO: 28888 - DNA, 722 bp, Caenorhabditis elegans
atgtttactcgacatttcaatctcatgaacctgaatttgattatttgaaatcactagaaattgacgagaaaattaatcaaattcggtggcttaaaaagaagaatgcagccaatttcattctctcgaccaacgacaaaacaatcaagctgtggaaaattagtgaaagagagcgtaaaattggagacgatgcatggaatctgcctagaacaaacagaatcaagtataacattaatgattaaatattttaaatatataaatataattttcagcacttcctccttccgaggtcgcttacaaataccctcgatcgtgccaatggagttgatagttgaagcaagtccgagacgagtttacggaaatgctcacacttatcacgtcaacagtatttcagtgaattctgatcaggtattttaataatttttttttgtgttcagcttttttcaatccaaagtatacgatgaatcaaaatctcaacagtataaccttcttcacatgttcggcgtatttttttaactattcaatttattagaaaaatagtaccaggttggctgaattcttttttgtgaaaatttaaaatgtttggtactgcaaggaccaaaatatcaattatgtataagtgaaccgaaattaaaaattatattccgattttcaggaaacattcctatctgccgacgatttgcgagttaacctttggaatctggagattaccaatgagtctttca

SEQ ID NO: 28889 - DNA, 486 bp, Caenorhabditis elegans
atggggagttgatcactcaacaggaaaaccaatcaaatactggttgtgtgccaattcatggggaactcagtggggagaagatggatatttcaaagttttaagaggagagaatcattgtgaaattgaaagctttgttattggtgagtttagaaactattgaagttcacgaggctctacgaactttggcaactttctatcaaattttggaaatcttctgaaaaattttctctcaagctttggtaacctccggtacaattttggtaattttctgacgactattagaaacttataactttttgcaaaattttggaaattttcttcaatcctggtaacgtatgaatatttgctcaaatgaattgttacattttgtaaaggaatttatcttcgaacaaatatcaaattacaggagcctggggcaaaggatcaaaacgacgaaggcgattcaagatgagaaaacttcgacgattcaggaagatgttcaaataa

SEQ ID NO: 28890 - DNA, 1175 bp, Caenorhabditis elegans
atgagatccgcactggaacctacaagaagctgttccatccagaacagatgatcaccggaaaggaagatgccgccaacaactacgctcgtggtcactacaccgtcggaaaggaactgatcgacactgttctcgacagaatccgtcgcctcgctgacaactgcagtggtcttcaaggattcttcgtctttcattcattcggaggaggaactggatctggattcacctcattgcttatggagcgcctctcggttgactatggaaagaagtcgaagctggaattctccatctacccagccccacaagtctcgactgccgtcgttgagccatacaactctatactgacgactcacaccaccctcgagcactccgactgtgcgttcatggtcgacaacgaggctatctatgatatctgccgcagaaacctcagcgttgaccgtccaagttacaccaacctgaaccgcatcatctcgcaggttgtgtcttccatcaccgcttccctccgtttcgatggagctctcaatgttgatctcaatgagttccaaaccaacttggtcccatatccaagaattcatttcccattggctgcgtacactccactgatctctgctgacaaggtatacatttttaatgtcaaattgttaaaaaagtaatgatttcaggcttaccatgaggctctctctgtcaatgacatcaccaacagttgcttcgagccagccaaccaaatggtgaagtgcgatccacgccacggaaagtacatggctgtttgcctcttgtacagaggagatgtcgttccaaaggacgtcaacactgccatcgccgccatcaagaccaagagaaccattcaattcgttgactggtgcccaactggattcaaggtcggaatcaactaccagccaccaactgttgttccaggaggagatctcgccaaggtaccacgtgccgtatgtatgctctccaacaccaccgccatcgctgaagcctggtctcgcttggactacaagttcgatcttatgtacgccaagcgcgccttcgttcactggtacgtcggagaaggaatggaggagggagagttcaccgaggctcgtgaagacttggctgctctcgaaaaggactacgaagaggtcggagctgactcgaacgagggaggaaacgaggaggaaggagaagagtattaa

SEQ ID NO: 28891 - DNA, 894 bp, Caenorhabditis elegans
atgcgcgtcggatcaacggttcgaagtcgggcgaaggcgcgtgtcgtccgtcgtctaattctccttccagttgcacttgttgccattattggagcagctcatttgatgagagaacgacgtagtaatcaaacaggtcctggaattataacgcctgaaaatacacctgttaatgcttcaaaaccattttggaaaacattgcttcccacttgcaatcggtgagttttcaaacaaatatttaatgcaaatttaatgatttaatgttacgagtaacttttacatgaaaatttacattcgaaacgatctgatttgaataagatatttcagcaatcctttaaaaaatagttttcaactctatgaatttttctccagatctctagctccaccggctccggatgtcaatgacgatggtcaatttccacctgatccatttagtcttgaacaacgccaaaatggatttgtagttttgcatatgtgtggtctcatctacatgtttgtatcacttgcaattgtttgtgacgagttttttgttccatcacttgatgttctcactgaaaagttatcattatctgatgacgtggcaggtgccacttttatggctgctggtggatcggcacccgaattctttacttcagtaattggagtgttcattgcacagaataatgttggaatcggaactatcgttggtgagtcgatactaacttcgaatcttcaagttttgaaaccaactccattaatgttgcaggttccgcaacattcaatattctctgtgttttggctttttgcactcttttctcaaaatcaatattggatttgacatggtggcctcttttccgagatgtatccatttatatgttggctcttgcaatgctcgttttcttttttatggatgaaatg

SEQ ID NO: 28892 - DNA, 1540 bp, Caenorhabditis elegans
atgcatcgacatattctgatattatttttattcggatgcttatcagctgatcaacgactctcatcaacttcaatttcatcgatgaatggattctcaacaactcgaaaatgtgaacatattacaattccaatgtgcaaaaatctggattacaatcaaacagtatttccaaatcttctcggacatacaacacaatctgaagctggtccagcaattgcgcaattcaatccattaattaaagttaaatgctcagaagatattcgtctctttctttgtactgtctatgcacctgtctgtacagtactcgaaaaaccaattcaaccatgtcgagaattgtgtttatctgcaaaaaatggatgcgagtcattaatgaaaaagtttggatttcaatggccagatcaattggattgtaacaaattcccagtaactgatttgtgtgttggcaagaattccagcgagtcgagcaactctaaaaagtgggttttctgcataattttatgaataagaatttataattgatatatatttacaacaaaaatttcaaaagtacccaaaacatgaattaaagtttaaatttacgggaaccgttctagaatcctttttttaaatacagcgagaaattaaattgtaaattcagttaaaatcatcggttttgcatttaaagaaaaataataataaattcagaatggcctgcaaagaccgaacctcgtaagagttttcaaaaaaaaaaagctctctgaaaattaaatttacggccgctgtgatactgacaagtttggctgaatttaagtattattccgaatttttgagccccataaaaactcctactccaaagcgtcaaatagttttttatcaaagtttttgaatttagaaattttccgaaaaaaatgtacatcgagatttctaaattctttgttttatcgaacaataaaacaagtttccgtagatcgaaatataaaatatttcaagttacagaagtagtaatgacgtcacattcggtgtttcaacaattgccaacgaagttgtcctttctccaaaaaaatgccctcatcatatgcatacaacaagcggatctcatttttcattgcctcttctcagtggacgccttcctgaatgttcattaacatgtgaagctgacaatcaagtaccaatgatgtttgatggacgtgttcgacgaattcttcgaatctggacagcagcatggtctgtggcatgtttcgtgtgctctttattcactcttgtcacatttcttgttgatttatcacgattcgcgtatccagttcgaccgattttgtatctcgcgttctgttatctagcaatttctacggtttatatgataggtgagttgaattttctgttttttttaaatcagattttttagaaactaaaaatgtatttctacaggcgtagtcggtgaagatggattcgcttgtggaacgtatggatctactccaacaacacttgttacgcaaggaggagaaaatgttggatgtagtgctcttgctgttgttcattactttttcttcatgtcaagttgtgcgtg

SEQ ID NO: 28893 - DNA, 718 bp, Caenorhabditis elegans
atgtcgaagatgagtaagttactatgaaagttcgagtatgccaatcatgtaaattgtttcagaacggcgtacaaataagcctcgcgctacagagagtgcaaacagcagcaccaaatcgtcggtgctcgatgaaccaacactggttgagcggaaacaacaaaagaaacaggtaaactattttgatttttttaaatataaggagcctcgcagtacatcaaaaaaactaccataccatctcccattaaatataaatctgtttcagatcttgaagttcgttcagcgtacactggaaaagatgccacaagggcttcgcgccgagttcgttgggatgagacgcttcaacgattttgagaaaatgaaagcgttcaaagaagctcaagaagctggaaagaaccgctacaaagacgttggatgccttgacaacaatcgtgtcaaactggaaggaccatggccgcatgaatacattcatgcgaactacgtggcaactccaacgaacccgaaaagattcatctgcacccaggccccattggagaagacttgtgccgacttttggtacatgtgctatcaagacaaggtcgagtacatttttatgctgtgcaactttctggagaaaggagcaaaaaagtgtttcgaatacttcccgagcaagaagggtgatgtgatggactttgacgaaggtggtcagaagatctcagttaaatgcgaatcttcggtgacg

SEQ ID NO: 28894 - DNA, 1942 bp, Caenorhabditis elegans
atgttcggatcgtcgggatttggcaataaatcgatgttcggaggatcgaatatttcaacctcgacaactactcccgctgccaacactacacagaatgatgactttctggtaaattttacattcaatttttaccttcatatcgtttttttcaggttgatggagctccagaggacacaattcaggtcatcaagttcagccccacaccgcaagataaaccaatgctggcatgcggatcttgggacggtgtatgttatatattgtacatgctatttggaaatactgatcagaaccattgctgcacggcaaacattcaaaactgcttattttattgattccgtctcaaaatataattaatttttttgtgaaaatttttgaaaaagaccttaaatagtgcccgaaagttgcaattcgccaaaaactttaagcggcacttttaacgtcaattttcaggcattaggccttttcggcaatgttaatttttttttcaaatagaacgacgctttttcttcatttccacaccaattttaattcaaaaaagttagactatcatagtaaaataagaagttttgtgcgtttgccgaaaaaatttcccgtacagccctgaagcaggggtgccgccgaaatttttttttttcgattttttggttttttttgagcaaaaccgaaaaacgaacaattttcgtttttagcaaaaccgaaaaaaaagaaaactctaaaatcggtagttctcattcagaattcagttgtttttcatttatataattaccagccgtggaccgcacctccggcgcggcccccgacttctggggctgaaaactaatttttctgaaactaccgtaaccctacagtattcctaccgtaccactattgtaccactacagtaccccgactatatcccaccactaaccccaactcactgtccctccagaagccaaaacttcacagactacaaagactacatagactccaaactatggacacacagaataagcgctttatatatagtaaatgatttatagttcaaatataaaattatttacatatcggatcaaatttcgtctcacagtcatagattttcaatactgttgaataatgagtatattttcagacaattcgagtgtggatgttcaatgatgccaacacattcgaaggaaaagcacagcaaaacattccagctccaattctagatatcgcctggattgaagacagttctaaaattttcatcgcatgtgctgacaaagaagctcgtctgtgggacctcgcttctaatcaggttgcagttgtcggaacacatgatggaccagtgaagacttgtcactggattaatggaaacaactatcagtgtctgatgaccggatcattcgataaaactcttcgattttgggacatgaagaatctaccaaatcagacacaaatggcacagattcaattaccggaaagagtttatgcagccgatgtgctatatccgatggcagttgttgcactagctaacaagcatatcaaagtttataatctggaaaatggaccaacagaagtgaaagatattgaaagtcaattaaagttccagatcagatgtatctcaattttcaaggataaatcgaatcaaaatcccgctggattcgctctaggatctattgaaggtcgagtagctgtacaatacgtggatgttgcaaatccaaaagacaacttcacattcaaatgtcatcgatcagctgaacttgtgaacggatttcaagaaatttacgctgtcaatgatatttgcttccatccacaacacggaactctggtcacaattggttcagatggccgttattcaatgtgggacaaggatgcacggacaaagctgaagacatcagaaccacatccaatgccgttgacatgctgtgatgttcatagttcgggtgctttccttgtctatgcattgggctatgattggagtcga

SEQ ID NO: 28895 - DNA, 566 bp, Caenorhabditis elegans
caagattgtccgaaaggccacttaaccaaggagcagttcataaaggtgtataaggatttcttcccgtcaggttctgcagaaggattctgtgaacatgtattccgaacattcgacacggataactcgggttttatcgacttcaaagaatttttattggcaattaatgtgacgagttccggaacgcccgagcagaaacttgaatgggctttccgtatgtacgatattgatggaaatggtacgatagacgagaaggaaatgatcaagattattgaggtgagcttttttcaatcagaaacaaaagaaaacggaattatttcccttctttgaaaagtgtcaagtgtcacttttaatcgtcatcctaaaaataaattcttcaggccatctatgaaatgctcggcccagaagtgacaaaatctgctgacgactctccaagaaagagagccaagatgatcttcgagaagatggatgttaacaatgataaagagctgacattgaaggaattcgttgacggctgccttgctgataaggagctcttccaaattttgaccaatgaagtcaagaagtaa

SEQ ID NO: 28896 - DNA, 2126 bp, Caenorhabditis elegans
atgcaccgtgttgttataacagggatgggtgcaatttcaccattcggtgttaccgttaatgcactacgaaacggtttgaacgagggaagaagtggcttgaaatacgatgaaattctcaaatttgtcgtcggtgcagttcctggagaacgggtggaagatcggtggagcactggacaacaaagagaaatgagtaaagcgagcatgttcgtgttagctgcatcagaagaagcattgaaacaggcaaaagctgaagatgtcgatcacaatgaaacattagttaatattggaacatgtatgtcagatctagaacatattggagaaactgcacaaaaagtgtcggaaggacaatcgagaagggtgtcaccatactttgttccgcgaattttgaataatcttccagctggatatgttgcaatgaagttcgtttttaataacgcgatattttgcgattttcgctccaaggcctcgacacgacaaatttatgttcactgcgaaaagacacgcgcgccttaaaggggtactgtagttaaagtctctagttgctgcaaaattttaattgaatttcatagtttttcaattcaactagaatatttatttttaaattaactatattttaaaaaaatatgaaaaataaataaaaattctgtaatcttaaatttttttaaaaatttcggaaatttggtaaattctcaacttccggaatactaaaaaaaattttttttttttattaagtttttataattttgttgttttttttagttttcatgaaaaaaattgaagtttacagtaatcttcagtaaaatgctcacacatttttgtatttaactaaaatttggtcgtgttgagaccgggtatcgcatttttggcttgaaaagctcaaaattttgcgaccgggcgctactaaatttttaattgttttcttttccaaaaaccaatgtaaagttcaatcctaaactctaacatttcagatataaaatgcgtggaggagtagaatcaacatcaactgcatgtgccactggacttcattgcattggaaactcatttcgatctattcgatacggagattctcgacgagctctggcaggagctgtagaatgtgctctcaatccaattgctctagctggttttgatagaatgagagcattggcaagaggtgatcaaccaaatattagtagacctttcgataagaaaagagctggatttgtaatgagtgaaggtgttggattagtatttatggaacgactagaagatgcacaggcacgtggagcacagattttagctgaagttgttggatatggaatatcatctgattgttatcatatttctacacctgatccatctgcaattggtgcagttctttcaatgaacagagcgataggaaatgcacatttggagccgaaagatattgggtttgtttttttattttccaaaataacagcgttactgaagttactgagtttttaaaaattggaaaaaaactaaatttttaaattttagatagttttgaaatcgaaaaaaattttaaaaaatgttattgcaaaactatttttcttttgaaaatcatgaaaactgaaatatttcaattaaaaaatcaaaaaatattacaatttcaaattttggatagttttaaaattaaaaaaaaagttttgaaaaacatatcattgcaaaacgatattgttttttttttgaaaatcgtatttactgaaatattccaattaaaacaaaatcgaaaaaaattaattacacgaataaaatcatgtaaataaaaataaaagaaaagatcgaaaaactgaaattgataacttcgatatattaaaaaaatgtcttgattgattttgaaaaccaaaacatatcgaaaattaaatttttcaacaaaaaaaatcgaaatatattgcctctcatattccagatatgtaaatgctcatgcaacatcaacaccaaatggggatagtgtagaagcagaagctgtacgacaagtatttccagaacaaaatattgcagtgagcagtgtcaaaggacatattggacatcttcttggtgcagctggatcagttgaagcaattgcaacgatttttgcaatgaatgatgatgttttaccagcgaatcgaaatttagaagaaactgat

SEQ ID NO: 28897 - DNA, 1144 bp, Caenorhabditis elegans
atgtcaattgcagtaattcttgaatcaattcaaggttcaagttcatttgaatggattcgaactaatttgaggcatttattgcctatattttgttttattggaattcttggaaattctatggcattgattctgatcaggtgggttttggcttttgaaatgtggtaagattcttaaggccaaggggaaaaatggaacaaaatttgggtttagaattataaaattaaaatggttttgaaatttactgtaaatattttctgaaaattttagtttttcgaatttcaacttttgcattcttgaaaacaaacataaaagtctagtggatttctcaccttttttgtagagaattttttcccataaattttctctatatttttcatagagttatatttttggaaattatttgctctagaaattcagtatttttttctagccaagatttagaaacagtacacttatttgcacgagctttcaaactcttttacattcgaaaaaatcgaatggccgttgaagcatgaactttacccatgtgccaatttattgtttgaattatcaacacacacattgaagtgaaattttatgcggaaaatttcagttttgcttttgaaatatttttcagtttttaatttgaaaattgagcacgaaacatgtatattttgtaacaagtgattaatttttcaggacaaatttctggttgagaaggctaacatcaaacatctacctctgcactttatcagtatcatcatgtttttttctacttacggttatcatttcatgggcagatacatatatgggattaccactttattcagaatctgaacttggttgcaagttcttctcatttcttgctcattttagtgattttatctgtgtttggatgatttcattgatctcttgtgatcgaatgatcgtactttatagacctagtaagtatttattactcttcaaatcaaatgtttctatttccaggaatcagaaaatgggtttgcacgaagaaattctctcgaaacatgacaattggctttgtgttatcatcagttgtcctctacagctggctatttctacttgctggtcttcaaatttatagattaaaagatggaactgaaaacacgttttgtggattgagtcaggatgtcaatttatttgg

SEQ ID NO: 28898 - DNA, 2227 bp, Caenorhabditis elegans
atgatgatcaccagagagttggtgctgaaagcgaaccgagagcaaccgccgtatgcgtcgattttggctcttgccgcgtctggattttccctcgagaagtctgttcaattctctgaaaagcagcagcttgctcttaacttgtaagtgttttaggaattataattttaaaaatataatttaaatgctttaattatttttcagagacggagaactcctgtccaatgacgttgaaattgctagaatcatcgctcaaagcactgatgctgctgatagtcttctaggatcttctatcatcgatttcgctgtcgttgacgatcttacaaacttcattgctgatgctgtcacgaagaatgactattccctccttttgggaaaggattttccgaccaaaattctcgataattccttgactgttgctgattttgccatcttctctgtggcgcacaacaatcctcaattgaaggccaagttctctggaattatcgacaaagttctcaaagaaccaaccctggctgctgctcacaactttgtcggattatacaaaagtgcagctgctccaactgcaacggcatctactggaaaagaaaagaagaaggacgaaggaaagttcgttgagcttccaggagccgagaaaggaaaggttgttgtccgattcccaccagaggcaagtggatatttgcatattggacacgctaaggcagcacttctcaatcaatactatcaacaagctttcgaagggcaactcatcatgcgattcgatgacacaaatccagccaaagagaatgctcatttcgaacatgttatcaaagaggacctctcaatgctcaacatcgttcctgatcgttggactcactcttctgatcattttgaaatgcttcttaccatgtgtgagaaattgttgaaggaaggaaaggcattcgtcgatgatactgacactgaaactatgcgtaatgaacgagaacagagacaagacagtcgtaatcgttcaaacactccagaaaagaatctccaattgtgggaagaaatgaaaaaaggttctccaaaaggattaacttgctgtgttcgtatgaagatcgacatgaaatcaaataatggagccatgagagatccaactatctaccgatgcaagccagaggagcatgtgagaacaggattaaagtacaaggtctatccaacttatgacttcacttgtccaattgtcgatagtgtagaaggtgtaactcatgctctcagaaccactgaataccatgatcgtgatgatcagtactacttcatctgcgatgctctcggtcttcgtcgtccacacatttgggaatatgcacgtctaaacatgacgaacacagttatgagcaagcgtaagctcacctggtttgtcgatgaaggacatgtcgagggatgggatgatccaagacttccaactgttcgaggagttatgagaagaggattgactgtcgaaggattgaaacaatttattgttgcacaaggaggatcgagatcagttgtcatgatggaatgggataagatttgggcgttcaataagaaggttattgatccagttgcgccaaggtaaattttagattcaagagaaaattaatatttcaactgcaagactaattcagataggtttagggccggtcacagaaaattttgaaccgacaaaaaacagaacatcgaatttctctggagaaaaaaaaacaacaaaaaaaacaaattattttttctcccgatcatatattttttcggtccaaaaaaccacagatatgtgtgtgtagactgcgattttttcgattacaaaaaaagcgaaaaacgaaaaacttctgaagtttacaacgtcattttgtaaaattttatatgttacccttacttgcactatagttatacttttgagtgcaatttttttaatattttggaaacaagtgcaaaatttgaaaattaaaaaaaatttttcgttttttttttcaacgaaaacgaaaaatcttcaacgctgtggagactttataaactcctagagaacatatggtatttatatggctagtttatggttttttatcgtaaaactacaaattactagtgaaacaaaaattatttacttttaaaaatcagatttaaaatgaatctctaaaaaattttcagatacacagctctcgactccacatctccgcttgtttccatcgaattaacagattcaatctctgacgacacctccaatgtgtctcttcatccaaag

SEQ ID NO: 28899 - DNA, 800 bp, Caenorhabditis elegans
gttggagaacttgccgatctcgacccagagggcaaattcattgtgtcgacacgtatccgctgcggacgttctctgcaaggatacccattcaatccatgtctctctgagaccaactacaagatgatggaaacccgtatgaaggagatcttcaacagcatcaccgatcccgagctcaagggaacgtactaccctctgactggaatggatgaggagacgaagaagaagctcattgctgatcacttcctcttcaaagaaggtgatcgcttcttgaaggctgccaatgccaaccgttattggccaaacggacgtggaatcttccacaatgagaagaagactttcttggtttgggtcaacgaggaggatcacttgcgtatcatctctatgcaaaatggaggaaatgttggtgaagttctcgccagactcatcaaaggactgaacctcgtcgctgccaaggctccattcgctcgtcatccacgtctcggatggctcaccttctgtccaaccaacttgggaacaactgttcgtgcatcggttcacattaagctgccaaagatctcggcaaaggacgatttcaagaagatttgcagtgacatgaagcttcaggtatttttaaagttttatttcagttttcaaattataattttcagattcgtggaattcatggagaacattcggaatcgaaggaaggaatctatgacatctcgaacaagcagcgtcttgggcttaccgagtatcaagcagttcgtcagatgtacgatggattgaagaagttgattgaattggagaaggccgccgcctaa

SEQ ID NO: 28900 - DNA, 635 bp, Caenorhabditis elegans
atgacgacgaaacggacacggaacacgttgtggcttctgattttaatttcagcttttgcaataaatgctgaaattgcagatgataaacctccgttagtttttttttgttgaaaaaaaatgctaagaaaaatgattgattgagaaaggcaaacgttttaaaagctaataaaacagttgcaactttcaaaaaatttcaaaaaatttcagaaaatttcaagtccttcgtgcccatgcaaccgatgttccacagctgaaagctcttcgtgatatacatgagaggactcagcatgatgtgagattttgttttttaaagtcgattggtagaagttataaaatgttgagtccttatttttagtcgaaaaattgccaaagatgcacttagatattttatttcatttttcttacagcttgatttctggcaaacgccgtcaaaagttggccaccgtgctgacataatggtcgacgaagatcgaatggaatggcttgattccgttctgaaaaactcaaatatcagctatgacgtcattattgaagacgttggaaagttgattctagaaaaggaacatggcccaccgagattttcaaatttattattttccaaaagaatgcacaatgaaggaggaaatcgagcaagg

SEQ ID NO: 28901 - DNA, 842 bp, Caenorhabditis elegans
ggtcaagatagaaacgtggtgatgcaatggaaacaaaaacgaagaactctgaagaatcgaggatatgcgttgaattgccgtgcgagacgagtcaataatcaggtacaactggaggctgataatatgatgcttcgaaatcaggtaacttttttccgtgactttacaatactggcagattgtcgcactaggtgccaaatttgttttgaaaaatcttgactttctctgatcactttagaattacaaagttcacaagcttttattttctatgtaaaattaacagatctaaaagatttgatacctgtaccagacaacattattgagatcgtgacgagacccatttagaaaagcagtgtgtgccttaaaactggcattcaaaatgtcgcaaaactatatcatatatgaaaccaatacctgcagaccttgaaaagtggagaaattgtggttcggaacgcgcactgtcgctagagtgggcttgatcaatttttcagaaggaaatatttgaacgaaaattctttttttttttaagtcaaaataaaccgtgcgcgaaaaatgcgcctaaatcggtagcaccgctggaaaagtttcctctaaaattgtcttaatattttgctcactaaccccctattttccagataaaaactcttcgagaagctctcagtgaagcccaaatgagactacattactacgagccagtgttctatcaggcatatccaagtattgtaccaagtacgacgtctccagtaactgtatctctaccaacaattgctcgaccaataccagttccacctgattcgacagctactgtcaccaaattcgcaacggatttcaagcaaatcttttga

SEQ ID NO: 28902 - DNA, 114 bp, Caenorhabditis elegans
atgctctacagtcatgtcacacttctcatgcttcgcgttgtcgatgtcgttgcaaagacgacggtccaacagtcggcacgaatgcttgtggcagagattcatggagagatacag

SEQ ID NO: 28903 - DNA, 467 bp, Caenorhabditis elegans
tggtctcgtcggaaagatcatcgctcgttttgaagagcgcggatacaagcttgttgctctcaagcagatgaccgcctccaaggcccatcttgaggtacgttttcacgaaattacaaaattttaggcccaaccagttaaattattatttttaggttcactaccaagacctcaaggacaaaccattcttcccatccctcatcgagtacatgagctctggaccagtcgtcgccatggtctggcaaggacttgacgtcgtcaagcaaggacgttccatgctcggagctaccaacccactcgcttccgccccaggaaccatccgcggagacttctgcatccaaaccggacgcaatatctgccacggatccgatgccgttgactctgccaaccgcgagattgctcactggttcaagcaggaggagatcaacgactacgccagcccattcatcaactcatgggtctacgaataa

SEQ ID NO: 28904 - DNA, 843 bp, Caenorhabditis elegans
atgttcctcactcgcagcgagtacgatcgtggagtcaacactttttctccagaagggcgtttgttccaagtggaatacgctattgaggccgtcaaactcggatctacaagcattggaatcaagacgagcgaaggtgttcttctcgctgctgagaaaagatcgacatcgaagctgatggtcaatgacgcgatcgagaaaatcagcaaggtcgaccaacatattggttagttctgtgaactgtttatcatcttaatttataagaattgtttcaggcgtcacattcgcaggtttgattgccgactcgcgcactctggtcgaacgggcacagatcgaggctcaaaatttctggttcacttataaccgcaaaattcgcgtggaagacgtcactcagtcggtcgccaatctagctcttcagtttggagacgacgacgtcaaagcatcaatgtctcgtccatttggtgtagcaatgctgttcgctggtgtagaccaagaaggagccaaactgttccatctcgatccatctggaactttcatcgattgtaaggctaaatcgatcggtgcagctagcgatggagctgagcagaatctcaaggagcaatatcatgatgtaatttcgtcaaatatggttatacaggaaaatgtattttatttcaggctctgactatcaaggaaggactcaagatggcattggccattctcaagcaggtgatggaagagaaactgaactccgccaatgtcgaagtcgttgttatcaaaccaacagttgacgcgaaggggcgtccaatcggagaattcacaagagtgtcgaacgaagagctcgatcaagttatcacatcgctttga

SEQ ID NO: 28905 - DNA, 940 bp, Caenorhabditis elegans
atgccgccgaaagcttcaaattcaacggaagtttggattaacccgaagttaagtgtaaaattcccatttgaaccatacgaatgtcagaggatcttcatgaagaacgttgtcgatgtactggatagaaaactagacgcagcacttgaaagtcccacgggtaccggaaaaacgctgtctcttctctgttcgacgctcgcatgggttcaacgtcaaaaagagacgaagccgctggattttgccacgtggcagacgtcaggagccggtggagcagaaaaaactgatgagaaattgaagagtgcatacgttccgacgatattttatgcatcaagaacacattcacagttggaacaagttgttcatgaattgaatagaactgaatataaatggtatgggtttgtgagaaattgcgattatgtcacggaaaaataaattaaaattttcgaaattttctccaatttaatcatattccacagaaaaataagagaaagttattttttttctatccaactagttaactgcaggttcttaacgctttattttggctaatttaacattactttatggaaaaccttggctttttctgaaaagttttgcgattttctgtaataaattcccaatattttttttaaatatttcgcttttatttctctattttaatttccagggtcaaaaccacaattctaggatcccgtgaacacttctgcatcaatcaaaaagtcaagaaaatcaaagaatccaatcgacaggctcatgtttgtcgtggattggtctcgaagcgagcatgtcattattataataaatttgacggtacggctgagtcctgaaattgccagcaaaaaaaattatttccagcgtgcaccacagacaaaatgacagaatttttggataaaggcgaagcaatggatattgaagatttcgtgaaacttggaactcaaaattc

SEQ ID NO: 28906 - DNA, 471 bp, Caenorhabditis elegans
aacgaagatgagctgaaaatcaaaaaatgggagcaagaaaacgatattcaatgcttatcttcaataccccttgaatctaataaacgaaagtttaaaattgaaacaccagggccatcgacatctacgctgacacagaaaagtgaaccaccaaaaaagaagaaaattctgcttttggtaattattttcagcataaatttccactaacatacagtgaaatttcagacacgaaatactctacctgatgaatatcaaaaagcaattgaaattccaacttctgaacttttgaaagatgtatgtcagctgcctaccttataaaagtgaaataatccaattatttccagatgtctgacgacaataaaaagcaatttgccaccacactcagaagctacaaagctgaaagtatcagatgggatgaagtttttcaaagatttcggccaatttttgttccgcacaaggctgatttgtttattg

SEQ ID NO: 28907 - DNA, 1676 bp, Caenorhabditis elegans
atgcggctctggctaggtctcctagctgtgagcaacattgctcttggtggttggaatacttcagaagatgcatcaatatgggaaaattatgtggaagattctaattatcacgagtttattagctcggaaagcggtaagctaattttgaagaattttggaatttttaaggaaaatcgaaagctctaaatttaaatcatctcatcacataagattattacttgattataaaccatcatgcctacgggttttgaagttagggtcccgccgcgaatagtgatattactgtactagttaattaacactttgtcaaaaattgaataagcccttggcaggcactcactttccttcagtttttgcgcatattttgcattttcagcgccaattataccgtacccggtctcgatgcgacactttttaatgcataaggctgtgcgcctttaaagattactgtagcttcaatcataggttttctctcaattggtggaaaagtatgtatttttattctgttttaattttaaaatcaagtaagaattctttttatcgaaaaacgatgaaaattccgcagcaccgagagtttgaaactacagtactctttaaagactcacatattttctaactctgcaacaatgtttcttatcgagacctggtaccgtatttttggctgaaaatttgcaaaattttgcgtctccacaatattaaaatattcaagaattgacagtacatatctcgcttattctcgtatttctcgaaagttttaggttttacaagaatctctgggaaattttaaaaaaacatattacagactattattttgaaaatgtatttttccagaacgaggactcttcccgaacattttcaatttggctaccaactccttaatcactgcgacagatacctgtggtcaatacactgctgaagaatattgtaaactagtagaacatgtccttctacgaaaaacaacaaatactcaatcacctcaatgtgatatttgtgatgcaaataatgttcataagcgacatccaattgagtatgcaattgatggaacacgtagatggtggcagtcaccatcactggcaaatggattgagattcgaaaaagtaaatattacaattgatttgagacaagaatatcaagttgcatatattattcttaaaatgggaaactctccacgccctggaacatgggttttagagaaatcattggatggagaatattatgagccatggcaatattatgcaatgcaagatgctgaatgtatgagacaatttggaattcctgcaacaacgggagtacctagatttcaaaaagaagacgaagtacattgtacatctgaatattcaaagatcacaccacttgagaatggagaaattcatacatctttggtaaatggaagacctggagctgagaatacaagccttgaactacaaaagtttacgagagctcgatttgtgaggctacgacttatctcgccaagaactttgaatgctgatctaatgattatcaataaaaagtcggattcattggataaatctgtaactatgaggtttgttagagtgatcaaattaaaattatttctatttttcagatatttctattcaatttcggatatttcaatcggaggtcaatgtatttgttatggtcacgctgagagttgtccaagtgatcctgttaccggg

SEQ ID NO: 28908 - DNA, 3764 bp, Caenorhabditis elegans
caataaatcagctgtttcaatcaaacaattcactggaatcgctgaacaattgatcctagatgctcaaatccattatgccaatgcattcaacactacaaacttcctcaagatgttcgcagagcatggagcaactactgtaggtggagcagcacttgatggaatgcttatggaggcagaagctcatttaaatgcgacagttgaacggggagaatatgttgagaagcgcctgaatcgggcacagcaggagcacaaaaaggcggaggagcttttgaaaatggtcactgctcagaagttgaatgaaactattttcgaggatttgaagaatcggattgacgttttggaacaatggatgaatgattatagagagacaatttatgatgtttcaaagaaagatacagctgatgcagagagaatgagtcttgttgttggaaaaagaattaatagatataaggaagtatcgaatgaaattgaaaaattacgagttgaagcagaagatcagattgcttattcaaggaattcgattgaaaaagcaagatctgaagagttgatgaatatgtttgaggataaggaaaagatcaatatgacactagctgaactgccagatttagtggagcagtgtcagaatattacacttttgtgagtttttcatttaaatgataacagaaatatgaattgatagaagagtgtagaaaactgccaattttggtatgttaatccaattttaaaaggaacaacttttttttggctggaaagtttgaaaagatcttcaaacactacctaaaaaattagtttttatttaaaaaatgtttgaatgaaacaatctaaagtcattcaaactcttttgcaattttctaattttcaggtattcccaacttattgatgagtacgacgaggaatatgtacagactgcaggccgtcatgcggaaaaactcgaagttcaggctcaaaagattgttgatcgatttgtggacactcgaactgagactgagaatccactgaaagcatcgcatgcttatgagaatattgttgaggctttgaagaatgcgacggaagctgttgattcagctgcggaagcatcggaagccgtgtccaagatgttagggtcggaaggatcagaatctggagatgcgaatgaagaaagtttgagaagccagttggagaaattgaaaaatgaaagttcattaagcaatgtggacaattcgaatgctgtgaagatagttgaggagttgaaaaaagaaaagaaagatttgacggatcgactgggacacttgaatgagttgaagacgagtattgtaaaaagattgggagttatcaagaatgaagcatcatcttgggatgataagcatgatagaatgcattccattttgaagaatggagcaaaaacagctcatgaaagatctgcaaatgttaagaaagaatctgaaggcatcaaaacagaagtgtcagcaatcaaagcagaggttgagaagctgatgaacagtacttcgagtggagttcaagaggatatggagaagattcgagcatcaagaactggaatggagtatggagcacagaaactgacaaaggtcaataaattgagtacagctaatcaaggaagaactgataagatggctagaaatattgcaattctcaaggcaaagattgagcaagcaagagaaaaggcttatcagattagactttccttgaactcaggagagcgtggtctttgcaagagatcttatatttctccagcatctccatccccagtcaacactttccatgtatcataccgcccattgcaacaagtatcagatgcagttatattggttagtaagacaaaaggtagaagaactcaaccatcagaacatctagctgtcgagattagagataaaagagttgttgtacattgggatattggatctggaaagaagatgataacaaatagtcatccgattaattatgtaccatcaaatgatagagttacctggtatcatattgatgtgctcagaattggaaacgccgttaacttgacagtggctctcaaggaaagctatgatggaggattcaaacctcgaggtgctccagtttcagttttcgttggaaactcgaaggatgataactcaatctttaacacaattcctggagaaactacaattgatgttggaacagatgaaacagttgcatcagatattggattaacgactcataaattcagtggaatagttggaggattgagaattgatgaagttccattgccactgtggtcatttgaatcaacaacgggagagtgtgaaggcgcaacatctccaccgaagacttcacagagaggccacctcttcagagatggatttgcaaatgtttcaatgtcagtatcagaaagaacaatgtctgctatcactgttatcttcaatgcattctctccaaatggattactgtacttccgtggaagtgaggcaagtggagactttgttgcgatctatttgaacgatggaaaggttatgttcaaaatcaatctgggaggaggatccgtagctgagttgacatctcagaatgtatataatgatggaaaagagcacacagtgaaggcaattcgtactggaagtgaaatgtatcttcaagtcgattcagatgctgatcgttttaatacagtaatcactggagagaatactgcattgaatattgaaaatgagaaccattatgttgccggagtccctatgacattgaataaagaagtgtttggtgatatcaattggaatggatttattggatgtattcttacagtgaaaccatcccaagttggagaacttgaccttgatcatccagaacactctcaaggaaagactgatggatgttcccaagtctctggagtaacagacaaaattattggattcccgaaaccaggatatctgataacaaagggaatttccatcgataacagttcaacatttgccttctcattccgaactcgcgaggaaaatggaacacttgtgtatcaatcatcgaaacttcaaaaagtatcaaaaagagattcagaggatgatggaaaagggtacatcgccttctatttattccgtggttatcttgttcttcactttggaaaagatgcttcatcgagaaaggaagttgtgacattccgatcatctcatccatataatgatggacaggttcatgcagtgtttatggaaagaaacgggaaaatgtgagttttgagttctaatctttttgatgttctgcctttgacccctatccggtgttttcgtttaaattttcactattaaggattttcaaaaagtccatggaaaaggatcagtttgaaaagtttttcaaaatctattctaatcctaatctaattatcccaaagttcatggcccgaagtaggtgtaatttgagcagatcgacaattacagaaatgttcacgggcttaaaactcccattgacacccctattttaaggaataggaaaaaaaacatcaagtcaggggtttggaaagcctggaaaattaagatcccaagactaggaaaaccaaagaggatcagtgttaagaaaccctaaaaatagttgttcaacaaccttgatgtgtgatacaattttcagaatctccgtgaaagtagacgacaaggaaattggagacagtcaatcactatctgatgaaacatcagttggcactacatctggacgtctgatccttggaggattcagtgatgatttgaaaccaccaaacaatgaaattccaatcacttcattctttatcggatgtatttctgatgtattcctgaacatgaaac

SEQ ID NO: 28909 - DNA, 69 bp, Caenorhabditis elegans
cgttcaaaactatccggagctggctaccgcaagaagaagcagtcattcacattcaaggcgaagaagtga

SEQ ID NO: 28910 - DNA, 641 bp, Caenorhabditis elegans
atgaatcgagaagaaaaatctattaatcaatattcatcgaaccaaaatcgaccaatttcgcagtattttgaattcatatttctctggcaaattgttgaaatggcaacggaaaacaatacaggtaagaattttatgcagattttcagagaaaataactaattttcagatgtttctgagaaccaagaagaacctgatgaactgagtccaaaaacgaaagcttttgctccaacactcgagaaggtctggaagctcaaatttgagaaagttctcggtaatcatttggaaattaattccaatttataattcattaatttacaggtagtggctcctattcccgtgtggcacgcgcaactttcggagagaaaaagctcgaagttgcagcgaaaatcatcaacattacgccaactcgtgaaaaagaggactacatcaaaaagtttttgccacgtgaaaaagagattgtcaagctcttgaaacacgataatatttgtcgtttgtacgagatgatttcatttcaagatcacatcatcttcgtcaatgagtactgtgctggaggagatttgctccgtaaaatgaaggatatcgtggcaatgaaagaggaagatgcaaagttcacatttcgtcaacttattgcagcacttact

SEQ ID NO: 28911 - DNA, 585 bp, Caenorhabditis elegans
atggaagatcgtaacattacggaggaagatcgcgtttgcccacaactccctgagtttgatgaacaagcgaatgttcaaacggatttgaagaaaatgaaaccggttcgttcagatgttcaggttttctttattatggtttgagaaatcgacgctttttctagggagatgcaattggaaagaattggaaagtggtgaaagcaattcaatcggataaaggattcaatacaatctacgtggcggagcatgtgcaaaagaagaagaagatggcagccgttaaggtacgatgtttcaggtgtgcctatcggcgtgtcaatgtatggtttttggtggtatgcctgccacatttgatacggtctaggtcctcgtaggacctagtctaagtgaaaataaggcggtaggcaggcaaaggagtacgcaatttcccaacattctataagtttcaatatttctgtaacacgaaaaaactgccaaccgagtttacaattttcaggttgaaagaaagacggaggccatcaagatgctccaattcgagcttttcgtcttgttgacagttgagaagaaaaaccaatgcaaacaattttgcaa

SEQ ID NO: 28912 - DNA, 356 bp, Caenorhabditis elegans
ggagcaacaccaaaagacggaccatctgcaggagtaactcttgtctcaagtcttctttcactcgctttagaccgacctgttgtgcaggacatggcgatgactggtgaaatttcattaaccggaaaagtgctgccagttggtggaattcgggaaaaagtgatcgcggtgggtcctctgttcttttttcgttcaaaaatttcattttttttcaggctcgccgtgtcggagcaaaacgagtcttccttccaaatgagaatcgtcgagactttgatgatttaccagaattcatgaaatcagagttggatattcgattcgtttcgcattatgatgagctctacgagcatctcttccaataa

SEQ ID NO: 28913 - DNA, 640 bp, Caenorhabditis elegans
tatccttaatgagaacaaaccaggagattcaatcccggagcttccggtaaattgtgaagagaaatcgtgtgacaatttgaacggacttttgcactcaaaaggagatatttcatctatcgaattaagacaaaagatgcaaatgacaatgcagaaacatgctgctgttttcagacggggcgatcttttgaaggtaagtaaatacagatttattctattttcaaaaaatattggatattttcaggaaggagtcgataaaatgtcctccatctacaaagagcaacaaaatttgaaggcgtgtgccgactctggaaaagtatggaattcggagcttgtcgaaactctcgagcttcagaatttgcttatcaacgccaatcaaaccatcgtcgccgccgaaaatcgcactgaatctcgtggagcccacgctcgtgatgatttccaagaaagaattgacgaatatgactacagcaatccacttgagggacagcagaaaaaaccgtttgatcagcactggcgcaagcattccatcatcggtatcgatacgaaaactggagctgttgatttgacataccgcccagttatcgacaaaactctcgataaatctgaaaccgactgggttccaccaaaggtccgatcgtattaa

SEQ ID NO: 28914 - DNA, 435 bp, Caenorhabditis elegans
atttatccacgctgaaaatcaacatcttgtcaccccagaggctcttgatttccttgataaacttcttcgctacgatcacgcggtaagaatcggaaaaaagagaaattacaccaaattagttactgaaaaccagttttaacaagaacacagagaaataaaaacaattttcacttgttttattgaaaaaaaagacatttgatactcgaaactaactataaatacttttatttgttaaattaatttatttccagaacttttaataaatttcaccatattcaggaacgcctaactgctcaagaggccatgggtcacgaatacttccgcccagttgttgaagcacatgctcgtgccaatggaactgaacaagctgacggacagggtgcatcgaattccgcttcttctcaatcctccgatgccaaaattgacggcgcttaa

SEQ ID NO: 28915 - DNA, 498 bp, Caenorhabditis elegans
atgccagaacatgaaaagagtacgcaaatgcgagagagcgcagagaaaaaaccaaatgtgaactcgtgcgtggtgagatattcccgctgcgaaagtcggtgtgcctttaaatttgtcatcatcgacaacggcgcgcattttcttttctcatctatttctgtattttagaatgaaatcactttattttcagcgaaacacttaattaaaattgatattttcaggtaattatgctttcagcttcacagcttcatcgatttgtgcaacatattaatcgccaggcaagccgagtaagttctgaagcaattaataagttattttatgtttttcttcagaacacatgggtattgcgccgagtattccaaccagaagtcacaccgcccggcggagtacagaaaaatcccaatgatttccacgattaccagaaatacgaagttgttgagttcgaaacacaaaaatccgctggtccgattaatgtgattttacttcaagatgttgaag

SEQ ID NO: 28916 - DNA, 272 bp, Caenorhabditis elegans
acgaaatgctggccggaaaagtatgaggatcgtctcccaatgaaggacatttgcaagtggatgaagtcgtttgtcaaggctcaaggaggagatactggtccaggcggagtgagtttttgtcaaaatgttttaaatttcatgatttcttacagatgatgtcgaagattggcaagaaaatgaaacggtcaaactcgcgtgagaagagcaaaagctcgactatgactgctgcacatgggcaagatcaaggtgcaatgacagccattgagaaatag

SEQ ID NO: 28917 - DNA, 193 bp, Caenorhabditis elegans
acattccaatctgtcgacttgttcgatggccgtgaccttttctccgttacagtaacccttcagagcttggctagaaaggtaataatttggttttcatttgcaaattgatttgaaaaactccaaatttcaggtcgaaaagctcggaatcacgccaccaaagcaagtttccaaggaccaaatcgtcaatcaataa

SEQ ID NO: 28918 - DNA, 1914 bp, Caenorhabditis elegans
atgctcaaaagtttttctggaagtacatcaactcttctaataattaatttttcagtgaaagaagccgaggattaccaaggtcgctcatttcttgttccaccatcattcaccggtgtcaatctccgagaggactacgttcccgagcgatgtttcgtaccgaaaaagcttgttcacacgtatcgaggacataacaaaggtgtcaatttccttcaatggttcccgaaaagtgctcatttattcttgtcatgctcaatggacacaaaaatcaaattatgggaagtatatgatcgtcagcgagttgtcagaacatacgcaggccataagcttcctgttcgtgaagttgcatttaataatgagggtacagaattcttgtcagcatcttttgatcgatacgtgaagctttgggatactgaaactggacaagttaagcagagatttcatactggacacgtaccgtattgcttgaaatatcatccagatgatgataagaatcatatgtttttggttggaatgcagaataagaagattattcaatgggattcaagatctggagaaattgttcaagaatacgatcgtcacttgcaggcagtcaattctatcacatttttcgacaagaatcgtcgtttcgcatccacttctgatgataaaagtgtcagaatttgggaatgggagatcccagtagacacgaaacttattcaaaatgttggacttcatgcgattccgactatgacaaagagtcctaatggtaattattgaggaacattaaattcagggaacgcgtattgtgcaatgtatatgacgcgcaaaatatctcgtagcgaaaactacagtaatccttaaaatgattactgtagcgctgttgtgtcgatttacgggctcaattttcggaacgaatttcatttcgaatagtgagcgatttttcattttttctccaatttttcgcaaaattgaaggaagctgaaataccgttgccactatttaaaaaaaaatatttcaaaaatcgagcccgtaaatcaacacaagcgctacagtagtcattttaagggttactgtagttttcgctacgagatattttgcgcgtcgaatatgttgctcaatacacattcacaatgctttgtgctcctgtaataaaaatacttaaagctcaaatttctctcatttcttttccagataaatgggttgtgggacaatgcatggacaatcggatagtccttttccagcttgtcgatgataagcttcgattctcaaaaaagaaggctttcagaggacacaatgcggctggatatgcgtgcaatatcgatttttcgccggatcaaagtttcctaatctctggtgatgctgatggaaaattgtttatttgggattggagaacacacaaaattgttggaaagtaaggttttctatgtggaaattattgattttttgtttaaaaaaaagatggaaactggtaaaaaatttaaaaatcacgatttttccgattattttgcgctttaatataaaaaaatgctgagaaagccctgaatttaatataaaattttctctcatttaattaaattttttctaatttaaaacattctaattgaataaaaaagtgaaaagtacccaactttaacgatttttaccttaaaaattgagttttaaacccgaaaaatccaaaaaataaacttttttttcgattttaatgcgtcaaaatttctgaaaaaatcgtaatttttcaatttttcaatcgttattttcagtaaatacgccacattttccattattaaaataaaaaaccccaaaacctccaaaaaatgtatgattttcagatggaaagctcatgatagcacttgtatcgcagcactatggcatccacatgaaaaaagccgaatgattactgctggatgggatggtctcattaaaatgtggaattaa

SEQ ID NO: 28919 - DNA, 1589 bp, Caenorhabditis elegans
ggatgcatcggaacgtatcgttggtcgaaacagaatctcccactgaaacgcggcggagcaatggacgagaacgaagaatcgattgtctcaatttccaacatggccggagtccaagacggttgtgatcttcgaatcacttgtgccgaccttccagccggttactgtggtggatcgttcgtctgtgtcgatttctggaagggtccattctgtacgtgcaatgatggagccaacgcgattctcggtgatgatggacaagttgtcggttgtggagagacgttggccgtgtcgaaactcggaattagctcaccggcgattattctgattcttgtctcgttggcgttgcttatactgttggttatgatgatggttgtgtatacgagacgatcgcctggtgcatttgaaaatgttcggccggaggagatgaatcgtgataatttgcggcagtatggtgtggaaggaggtggcgaggcggataacgatcaggtagagtagtagatgctacaaactacaaaagttcctgtcaaaaattggctgaaatcgcctgaaaatgctttaaattgcctgttcagagccgtttttctcgcttaaatttttttaaaaagtgattttcagaattttaactaaatttgaatttttgggatttttttttttggaaatggaaattacaataaattctaaattctgaagaaaaaaaaatcaaattcaaaaagtgggcgtggcctatataatttacgaaaaaaatgaatttttaggatttttcttcttttttttttaattcaaaaaaaaattaaaagtgggcgtggcctacattacatgcaagaaatttgaatttttttgatgttttctgatctgtttttcgaaaattccaaaaaaattctgaaattaaaaatttcaaaaattaaaaattaaaaattcgaaaaaagttttttgatgtaaaaaacgcgaaattctacggaaatcacccaaaatttcggttttgaaacgtttttttttttcagactataaactacaaaaaaaaacacacttttttatagtttctagcaatttttggcaaaaaacatttgtcaaaaaaagcccaaaaaattgcatgtttgccaaaaaacaaaaaccaacgattttttgccaaaaaatacctaaaaagccattttttttgtcaaaaaaccatttttccgaaaataaaaaccgaaaaatttttttacaacaaaaaaaaattaaaaaccaaaaaaaaatcatttttgccgaaaaaaagtccaaaacccccatttttcgaaataacagccctgatggcgactacaaactacaaactacaaactataataacccccaatttttttcagtactcaatggccggcctacgtaaaccagtaatgccactcgacacaggaatgggaccagcaatcggaggacacccaccacactacccaccacgtggaatggcgccaccaaaagatgatcatgagctgaactcgaagatcaaggatcttgagactgatcagaatgcggcaccgtacgatgaacttcggatctacgacgatgagcgggacaatatttctgtcgtcacgttggagagtatcgaaagtgcccaataa

SEQ ID NO: 28920 - DNA, 320 bp, Caenorhabditis elegans
ttcaaaatcgtccaaaccggtgatggctcaggccgtggagccgcactcatcgccgcaatcgtttcgagagtcaagcgagaagaggagaagcggctgaaggatctgggtaagcatatatgctcttgaaagctttcagaatctgaaatttcccgctttttccagaagcccaacggctccgcgacgcagaagccgaggagcggcgcctgctggaaattgagaaagagaaggaagaagccgaagagcgagcacaaaagatctcggaaatgatgagatatcagatcgagcgaggcgccgaagagtcattccaacgtcatgattaa

SEQ ID NO: 28921 - DNA, 1388 bp, Caenorhabditis elegans
atgagtgctcaaaactatcacgccggcctccaccagtcgagtacacagaggttcgttggattttaagcgagaaaacccccggtttttcgttgattttcactagaaattcgtgattttaacgtgaaaaacaccccagataactaaaaaatccacgattttgatttgcaaaacaaaaaaatcaaaaaaaaattcgcagaaaattgatttttcggcagtttttgagtgaattttcacaccgaaatttattaaattagcgattttaacagcattttccactgaaatatcaccaaaaatccaaatttaaacctaaattttcactaaaaaccgagttttccacctttctgagcagatatttatcgattttaagcaattttagagagttttccgctgaaattttcgaaattttccccgaaaaatcgatattttcatatgaaaaactattaaaaaactatagtgaaaatcgctgttttttccaactttcagttttttaggctgtttttttcactaaaaagtcgattttcacccgaaaaaaccggggttttcaactatttttactcattttaaagcaattttagggtgattttcactgaaatttctcatttttcccaataaaaatcgatattctcgttgaaaaactacggaaaatccctgtttttccaactttttcagtaggtttagggtgttttttcactaaaaaatccaaattttttcgattttcccctaagaaacccggtttttcacctatttttgggtaattttcactgaaatttccaatttttcccctcgaaaaatcgatatttttacgtaaaagacaccttttgaacactaatttccactggaaatccctgtttttttcaccaaaaacccaaatttaaacctaaattttcactaaaaaccgggttttccatctttctgagcagatatttatcgattttaagcaattttagagggtttttcgctgaaaattacctcaaaatcactccgaaaaatcgatattttcatgtgaaaactactgaaaatcgctgttttttccaacatgttcatttttttgtactaaaaagttttcgtccgaaaaaaaccgatttttcacctatttttactcattttaaagcaattttagagtgatttttccccgaaaaatcaatatttttacgtaaaaaacacctttttaacactaatttccactggatttttttcggcaaaaataatgaaaattcactcaaaattcgtgattttaacgtgaaaaacaccccaaaaaaccgaaaaatccacgattttgatgacaaatcccctaaaaagtactcatttccacccaaaaaaccgcattttttcatgtccagacctccgaagcggccgaacaccgagcatgctcaggagccgccgaaaag

SEQ ID NO: 28922 - DNA, 1388 bp, Caenorhabditis elegans; identical to SEQ ID NO: 28921

SEQ ID NO: 28923 - DNA, 1422 bp, Caenorhabditis elegans
gtactggaacgacgggatccaaggatcgtgcaactttctacttggtaatggctctttgtgcacacgatttggctggtctcttatcaaatccgaaaattcgaatgtctcttgttcatattaaaacaatgatgaaacatttgatgtctggattgaataagcttcatcgtagtaaaattcttcatcgtgatatgaaagctgcaaatgttctcatttcgaaggatggaatactcaaacttgccgattttggactagctcggccttttgtgcagagagaaagtgtgtggttttcggcgaaaaattgaaaaaatcgacctgaaaatcgtgaaaaaattgaatatttttacctaaaaaccatgaaaaattccattttttcaactaaaattctttaaattatagctcaagctgacttttcctcgtcggaaaattgtgcgaaaaatggttttcctagcgttttcggcacaattttcaaataaaaacggctcctagaacacggaaatttcgtggttttagagagaaaatcggcggcaaatttgtaccgaaaattgatgaattttcgtgaaaagtcaaattttgacgtaaaaaaaacgacattttttcccgattcaaacccagatttccgcccgaaattttttgaaacttgcagaaaaattgtgaaaaatcatgaatttcgccgctttttttcgttaaaaatgcagaaaatggcaaattttggtggccaaagttcatgaaaaatgacatttttccactcgaaaaccgtggaaaaatcgccgaaaatcggaaaattattgattttttttaatcgaaagttatgcaattttggtcaaaaaacgctcaaatttgtggaatttgtgcaaccaaaaaattgcgttttttgaattaaaaattgagaattttccccaaaaatcacgaaaaaatcaaatttgcgaaaaattgagaccctttttaaccgcaaaaaaaatccaaaagttgataaaaatgtgaaaatttcaattttctagcaaaaattagcccatttttgcccaaaaaagaattttttttttcgcggaaaaatactcaaaagtgccaaaaaatgaaatttctgttgaaacccaaaaaaatggctcaaaaatgctcaaaaacctcggatttcagtcgaaaaattacgtttttagatgaaaaattgaccaattttgagccccaaaaactcaacaattttcagacggtgcaggcccccgtccactgtacacaaaccgtgtcgtcactctatggtatcgtccaccggagcttctgctcggtgatcgtcaatatggcacaaaaatcgatgtatggggtgctggatgtattatggctgaaatgtggactcgccaaccgattatgcaaggagatacggaacaaaaacagttacagctcatttctggactctgtggatcgattaataaagat

SEQ ID NO: 28924 - DNA, 1422 bp, Caenorhabditis elegans; identical to SEQ ID NO: 28923

SEQ ID NO: 28925 - DNA, 1206 bp, Caenorhabditis elegans
gtaatggacgaggcgaaagccctacgcctccacaagcaacgtttggagcatcgctctcgaattctagagcagcaaaatgagcagctcgagatgcagctgcaaaggttgaagaaagttatagatgcggtgagttttgatgtttttgtcattgagtttacctatcgaatgacctttataatgcctatgttctgtcaatatcgaacaatattgaaaaaaaaacgataaattatcgatttttggtcccgccgctaacagagcacactttttctaaaaatttctttcggaaaataacaaaaactattgatattgaaagggaaaacatcaattctccagaaaatctaaagaaaaaatcgatgagttattgatgtttactccgaaaggggcggagcataacatgcttaatattttcaaacaattgaaattgttgtgaagataaaatcaataaatcagaagcattttttcatacatgccttttaaaaatcgataaattatcgatttattcaattttctaccggtataatcgaaaatttattgattttttcgattttcaacattttttcgcagcggaaagatggaaattttaagaaaaaatcattttatattagaaaaatcgatactttatcaatttttcgcttttttgaacgtgtgaaaactttctgccggcgcaaattgtatacgcttgcgccggcgcatttttccacatagtccgccggtcaataaaaaatcgaaaaaccgatctcatcgattttttcgatttttgcgccaaaaacgagttcttcattaaatcttcttaatataactgaaaattcccgtaaaaaatcgataaaaaatcgattttccgctataattatcttttttttttgatttttcctgtttcagcaaaagcaacaagctcccctctcaaccaactcgttgctccgcggaagtcatcatcaaccatggagccccgaacgtgctcgttcgggctccgcgagcacactggatcgtggtcttattgtgagtagtcgtcatcaggagcaggcagaagcggccggcggcggagctgaagactcatcggatgaagctggcggagccggtggtgggccacgtggcagcagtgtcggacaaatgcaaaatctaatgacagcttgtgatgatttaggaaaagcaatggaatccctggtggtgtctgttgtatatgattccgatgatgaggagaatgattga

SEQ ID NO: 28926 - DNA, 1206 bp, Caenorhabditis elegans; identical to SEQ ID NO: 28925

SEQ ID NO: 28927 - DNA, 983 bp, Caenorhabditis elegans
atgctgcgtcaaatggcacttcaacggaaggacaagctgccaaagtttaacgaggaatggaatgcaatgcaagaggttagaagagttgtaatacttagacggcggcggccacttgggaccccctcccaagattattatatactgcttacacttttgtctgtgtgtgtgtgtcacttgagcccgcacaccgctgctcttttgacatgttttgagcgattttgattggcatatcttggttttatataaggttctcaatattttaattttccaggaaaaaattttttagcaaaaaaaaacaatttttagatggattaggcttaggtttagaggctgaggcttaaaccttcgggctctgataaatttaaagtccaccaaattaaattttccagttaatccaactcgccgacgcccttgtcgacgaggccgaacgatacgaatccgaccagatcccccaaatggatcggaaatctgctccaaatgtgctcggcgagctgcgaaaacgtgtcgccaacgcagaaggaccggtgatagatctcgtgaagaagctctcccagttggtaccccgaatgcaagaagattccccaaaatctcaggacattcggcagaaagtctacgggattgaggatagattcagaagagtcggtcaagccgagggagcagcgatctctaaggctttatccagtgctctcacggagccggagctcaagttggagctggatgaagttgtgagatggtgtgagatggcagagaaggaggcagctcagaatgtgaattcgctggatggagatggattggagaagcttgacggacggcttgcacagtttacaaaagaattgcaggagaggtatggcggctctcaaacctccaataacgtgggcttaagcttatgcgtgggcttaagtttaggcttaaaattaggcttaggcgtagtcttaggcttaggcttaggattaaccttatgcttaggcttaggctcaccctga

SEQ ID NO: 28928 - DNA, 983 bp, Caenorhabditis elegans; identical to SEQ ID NO: 28927

SEQ ID NO: 28929 - DNA, 469 bp, Caenorhabditis elegans
cgatgccgatgacctgatgcctctctgtaacgacaatgacaatcgccagggattccgatgcctctgcgaagccgggtaccttccaccgttttgcaaagtccatacaaacccctgctaccaaaacctgtgccagaacagtgccacatgccatatcgacccaaagcagcggagttatgagtagggctacaaactacagatactgcaaactacagtcgttcttttcagctgtcaatgcgtcaatgggacacgtggctcgttgtgtgagaatgtggatgactcgtgtgatgcgtttggtaagttagaagcttcatgtttacctgcctgcctaccgctaagcctacaggaaacaaaatctgcgtccatggaacctgtatcaatgatgagtactttcaccggggcttctcgtgtgagtgtgacgacggatttgagggtctcgactgcaacgtggaaatcgcctggtccagtgtga

SEQ ID NO: 28930 - DNA, 494 bp, Caenorhabditis elegans
gtagaaggcaaggcagtgaaggtgcaaatttgggatacggctggaatggaacgttttcgttgtggtgcttcttcttactatcgtggagctctcggagctctcctagtctatgacatctctaagcataagacatatgaaagtgttgagcaatggttgaaggtgcttcgtgatcacgctaacgaggatattgtgattacgctggttggtaataagagcgacttgagtcatgcagttccaacagacgaggccaaaatctacgctgaaaggaatcacatatcgtttattggtgagttaaaggagtgtacatattttgtgagccaatgagccactttccagaaacatctgccctcgacaacaccaacgttgaagcagctttcacaaatatcgtaacggagatctacaaactagtatcggaaaaatataaagatcacagtggtacgatcattccttcgacagcgtccaatacaccaaagaaccagtgttgctttccataa

SEQ ID NO: 28931 - DNA, 1041 bp, Caenorhabditis elegans
atgtcaaatatcagttggtaccgtcattgttcggttcggcttcaactcgtcacacttgcacttttccttttattaggctccgcctctttaggctccgcccacattgatgaagagttcgaagatgacgtcacgacgacaatatcatcgattgcgtcaccgatgaggcggacgtacacaaatgagtgggcggtgcggatagcgggtgggaaggttgaagaagcgaaccgactggcgaacaaatacgggtacacgaatttgggtccggttagttttatttttgaatatttcaaaaaaatttccataattttgattttaaatcgtggaaaaatattaattttgagcaaaattgggtctcgcctgcaaagctacagtaaccgacccacggattttcaaaacagttattgttataaatttttaacaaattaaaagaaacataaaaacattttagatcgtcaaaaaataattattttaagcaaagttagaaaattttcaaaaaaaaatcaaggtcccgccacgaaaactagagtactcaaaaacttttgctgttttagaaaagtttatgttaacagtattgaatattattaaatttcaaaaatttcgcttttcagattgtcaaaaaatattgattttgagggaagttagaagattttgaaaattttgaaataaatccaaacaaaattttttttcgaaattttatatttttacggaaaatctatatatttttaaaattcaagaaaaattattttccagataattccgggtgacgagtactatttattccgtgacgatcgaaaaaagagtcgatcgtcgcgaaaaacgcgaagcttatcagcaaatcagcttcaacacgaggaagatgtcatgtggatggaacagcaagtggcgaagcggagagtgaaaagaggatatcgaaggattcgacgacatactgatgataatgatatttttgaagaggatgatgatggtactcaaattagcaagtcgagaaatagaaaacatccggatccgaacgatccgttgtggactgatatgtggtatttg

SEQ ID NO: 28932 - DNA, 1041 bp, Caenorhabditis elegans; identical to SEQ ID NO: 28931

SEQ ID NO: 28933 - DNA, 943 bp, Caenorhabditis elegans
atgttgccaagccaaattaaccaaaactcaaagcatatcacaaaaaaaaacgatgtcagaatttttttctgtattttgtatttcaacattaaatacttttcgttccacacatttattgctgagttagaccagaccattattattatcgatcgtcaagtcgttagtgataagattggcgtgttatcagtgtgcccccttcattcttcattctcgttcatcttttccatcaaaatcatgcggctaattttactatttctagcagtgtttctttgtcgtgtggtaaggggttttcaatttcataattttagaaatttttagaaattaaattttaaaacttttttgaaaatttgtgccttatagggcgttaagagcacaagtaattattgaaaactaatacatttttcatttccgattgtcgtaaacattatcaaatgttgatggctaatccaagtcaaatccagttgctcaccaagctgggagccctactccatacgatgccaacttcaaatctaacctgaaattccagactgctcaccaatgcgacgcagaaactgagtgctcggacgatgaaacttgctgtaagctcggagacaacacgtggggatgctgcccgatgccgaatgccgtgtgctgtgacgataggtcccattgctgtccaacagggaccacttgtgatccacaaggagctagatgcattggagctgacgagaagcatgttccaatgaaaaagaagaagcccgccagaaaaactgtggagaggaatcagttcaatgaagtcgtctgcccggacaaggctagcaagtgcccagatggttcgacgtgctgtctgttggagcagggaagctacggatgttgcccggtgccgaatgcggtgtgctgcgcagatatgttgcactgctgtccgaatggatttacgtgtcacgggcagttttgctcgcagaat

SEQ ID NO: 28934 - DNA, 339 bp, Caenorhabditis elegans
acacactgacgctcgcccatccagaattccacgtgctccatcggacatgagcgctgggcgcctgagccgtgtcggaagtgtctccaactcgaaaaactcgatcgtcgactcgtcgacaccttcccgaccagaatcccgagcctcttcggatgctggagaccgacaaacgaggattccctcgttgagagcacgtaaaggacaaaggttagttgtggttagagctgggaaatgagcttctggctgggttcttgagctcaaagcctgaaattttcgattttaaaataaaaattcaattccagatatatcccacaaggaccatcatcatcgtcttcaaagtga

SEQ ID NO: 28935 - DNA, 339 bp, Caenorhabditis elegans; identical to SEQ ID NO: 28934

SEQ ID NO: 28936 - DNA, 1595 bp, Caenorhabditis elegans
attcaaagacgaggtgcacgaaagaggagtagccaaggagcaagtcgtcgctacagctctccagctcgctgcagatgctccaccgcacctggcggctaccgtaagacaaccagtcgccgacctgaatactagatggagccgattgaatgcagcacttgccgaacgagagcataagctcgagaatttgatgctccaaatgggaaaactggcgagcacaattgctcagttgacggcttggatggataagacgagagccactttgaaggatattgctccgccgaagaatgcggtgaacttgagagatattgaaattgctcaatgtaaactcgttgtgctcagtaatgatattcatgctcatcaggatagtgtgaatgctgtgaatcgtgctgctcaaaagtacatccaaacttctggagctctggacgctgaaacttctgattctctgaaatctatgaacttgaaatgggaggatattcagaaagtcttggaatcactggcttttgatatggaagtcgctaaaaaagaggctgaaaatgttggaggagaagtcgagaaatggcagagatggctggaagaaactgaatctgctctgctttccactaaaccaacgggaggattaccggagactgctgaattccagctcgacgaattcaaggccctgaagctcgacgttgagcacaatgcttcgccacttgaagcacatcttcatgccactgagcaacacttgaaggaagaaccccaggacgctgacacatggctttccaagactcacggagcaatgaagacgaagtggaataaggtgaaggagctgctcgttgatagagagaagaagctgcaggtggcttatgagcaagcggttgctcttgagagtgcgttgaatgatatggaagattggattattggtaagagagaatttataggttttagtttgaaaaacaataaaagaaccatttttcagccgctgaacgcaagctcaccgatcagccatcgatctcacgtctcccggatgtaattgaaaagcagctcgccgagcacgaatcatggatggaagaggttgctggacgaaagatggcaatgacgaaacatcaagcatcaggagtccatatgcagtattattgtgagaagaaggatgccatcccgatcaagaatcgtcttgtttccctgaaacatcgcgttgaaaagatctctggaagaactgcagaacgtgcgaagcagctggctgtcactcgagatgaggttgccacgtggcaagacgggcttcatgatttggagcatttcatctcggatgtccttgtgaaaattgctcctgaaccaaataccactagctcactggaaaagctcaaggcgaagctggaggaggtgaaggaagctcagcgagatgtgaccgccaagcagacactgttcgatgtgactagaaaacgtggaatcggacttgcagagcgagcaactcggtcggagtacaaacaaatttcgatgacaaacgagaagatgagcaagaagtgggctgagatgttgaagaagttgagagatcgactgagagaagccgagcaggcagttctggaaggtggagcatttgaggagtcgatgaatgatct

SEQ ID NO: 28937 - DNA, 1595 bp, Caenorhabditis elegans; identical to SEQ ID NO: 28936

SEQ ID NO: 28938 - DNA, 660 bp, Caenorhabditis elegans
caacaacaaaccgtcattgaccaactcaacaggaatgttgcacttctccgtcaacacgtctcgagaacccgtattaacgagggacagtgagttttttttaaagtttttttttggtttttcgtgtcggaaattcatgacaattttaaaaaagagactcggcttcaagttcttatttccagccatcctgacgttgacgccatcgaagacgaggtgcaaaagctgaatgtccgctgggaaaatgtgaactcccaaatagcttctcgcttgctcgccgtcgaaagtgccctccaaatccaaatggtctaccgatccgagtacgagactgaaatgtcgtggttggacactgtcgaggagacgatcaatcgtctgagaaagccagaagagctccgccctgagcaataccaacagcaactcgacatgctcatcgccgaatacacaaaccttcaagagcacactcaagcgattgagcacgtgaacaaggagggtggtcggttcattcatgaagccaagattttcgacgcgaaactcggacagtactctgatggaattgttggaatccacggacccggtatcaagtcggaattccgtcgtactaagccacagccgaagaatggatcacagattgttactgaggagcttgaggtaggaatttctagctga

SEQ ID NO: 28939 - DNA, 1457 bp, Caenorhabditis elegans
ctgcaaaaagtgcaagaagagtacattgaagaggcctatgaatggcgtgagtgggtggttcgagctatccagctcgtcgacgatcgtcacctccagggaactgcttcggagctcatctacgagcttcaacgattccgagaggatgatctaccgccgagagaagagcagaagcgacggttgacacttgtctatgaacacttggagaaggtgatgaggtcgacggagctctttgcgatcccacacgagctgagtgctccggagcttcaacgggtgtggaatgagcttcagaactcgatagatcggaggtttgatgttctcgagagacatcgtattcaggaggtgatttgtgtagtactaacaaatattgtctttgtattataaaaactaatatttaaatatttaaacgcatgtaaaaataccgaatgtggcatgtttcttccgaaatttctgatcttccgaatcgggagttccgatcccccaattaacttatactatgctcctaaaaaaatcaaaatcatcttatttcagggcaactcgaacgaccttctcagccgccttgcccgcggcattggcatcaccaacgaaaagctcgacctgattctgaagagaatcgaggatgtggaggctcgcgtcgacacatcaccaccggcagccgttgagcgtaccgtctcggagattgtcgacgatttgaatgctctcgagagcccgatcgccagattctttgaagacgttgaagagctgaaatcgatgcaacatccggaagccaacgatttctacaaacaagtgtacggacttcatcagcgaagaacaacctacctggatcgtctgacgaatcagattctggttcgccttggcgtccgaactgacagtcttcacaaggaaaatcagcagagactcgaaaatatgagaaagacatcgttcagtcgtgttgaggagtgcatcgagtgggttcgtgttcgtatggagaagctcacgaccatggagttcctggaggacttggaaacattggagcacgtctttgagcaacacaagtttgacaatcgagacatccaggacttccgtcaaaatgttgatgaatgcattgcgagacaagctgaagtctcggcggaggacacttatgagtattgcgagcttcttcgcgtgctcgagagtgaataccaacaactccgtgacctgtctgccggaagaatgctcgatttggactccctcatcgcttttgtccgtgctgctcaactcgagctcatttgggtttccgagagagaatccattgaggtcaccagaaactggagtgatatcaagcagttggatcttccgatgctcaccaactactacaagcagctgctccacgagatggaactccgtgagaagcagtacaatgatgtgcacaatcaaggagcggctcttctcaatcagggacatccagcgattcgtgtcatcgaagtctatctccgacaaat

SEQ ID NO: 28940 - DNA, 598 bp, Caenorhabditis elegans
aatccagaatcaaatcgaaataaaaccgcgggattcacagatcaagaacgtggatggttcagtgagatgctcgagttgggattcaccgacaccttcagagccatgcatcccgacgagaagaagtactcattttggagttatctggcgaattctcggcagaaagatgttggatggagattggattattatgttgtcagcaatcgaattatgaataaggtctcgtctggaagctgtggaaaattgaaaaaatgggcaaaaaatgcaatatgtctgggattttttcccgtaaaatcccggtggataccgaaattttgatggaatttgccataaaaatttgattttccaaaaaaatttagacaaaatccaccggggaattgaaatttttcagaagatttccatgaaatccacttaaaaatttagaattttactgaaatttcgacgtaatccaagtggaaattcaatttttccactggaattttgataaaatccaaattaaaattcaattttaatgttcttttttcaggtcaaacgcagtgatatcatgagctcggtgatgggaagcgaccatgctccggtcgtcatgcaaatcgacttctaa

SEQ ID NO: 28941 - DNA, 422 bp, Caenorhabditis elegans
atctgcccctccacgactactttgactacttcatcccggactacaaactacacataaagccgctcgccgctctttcgaacttcaacactcctgaattcattgatcaaacgattgtcgcgcttttggagaatttaaagcaacttccacacgttccatcggtccaaatgcaatcgatttcgacgagttgtgactcaattgtgaagacttttgacgagaaactgatccgagatcatcagaatgatgacgtcagagttactcagttcgaggaagacgttcaggtggaagattcggcggaattctacgatggtcaagagccggagacgaagaatattcaatcgatgaaacggcacgcgagtccgatttgtgcggcgcaagaggagatgaagaaaaatcggattgatggcggcgaaaatgtggcataa

SEQ ID NO: 28942 - DNA, 1202 bp, Caenorhabditis elegans
acgttggcgctggaagtggcaagtactatgctctgaatgttccacttcgtgatggagtcgatgacgtcacttatgaacggattttcagaacaattatgggagaagttatggcaagatttcaaccagaagcagttgtgctccaatgtggtgccgattcactggcaggagatcggctaggagtattcaatttgactacttatggtttgtgtgtgtcgatttacgaagaagctctcgtgtactcctcgtggagaagattttctcagttttcggcaaaaattctcgattttggatcattttcgctagtttaaactaaaattttcacaaaaaatcaagaaaattcgttaaaatggtgattttcgcggcgagacccatccgaactcgtctgtgcgcctttaagtaggaattgtggagaaattcggaataataatagcaaaatcacgaattttaagtaaaaattgagaggaaacctacctaaaaatgggatttttatcggaaaaagtgctaaaaaatgcttttctcactgaatatatcggaatttcttagtttttggcgaaattttgtgattttgggccattttcactagatttaacactcaaaaaatcaagaaaagtcgttaaaataatgcttttcgcggcgagacccatccgaacccggctgtgcgcctttaaataggaatggtgaagtaattcggaataacaatagcaaaatcacgaattttaaataaaaattgagaggaaacctaccgaaaaatgggattttttcgatgaaaattactgaaaaatcggattttttcacgaaaaacatcagaaaaaacggaaaaaattcagtttttctcggaaaatatgctaaaaattgcctttttcacaaaaaaaaaaacagataatgagttttctatgacaaaaacaattttttaaaacgtatttttaacgaaaaacatctgaaaaatcacggaaaaaaactccaatttttcccggaaaatgaccaaaaattagattttttcatagaaaataaccaaaaaattggcctttttctcagaaataagcaaaaattttttttttcaggacacggaaaatgcgtggaatacatgaaaagcttcaacgtgccgcttctgttagttggcggtggtggatatacgattcgaaatgtctccagatgttggctgtacgagacggcgatcgctttgaatcaagaagtttcagatg

SEQ ID NO: 28943 - DNA, 256 bp, Caenorhabditis elegans
aagaaaaaaaaagtggattttgccgatttttccagagaaaaatcgctgaaaatcgaagaaaattgtttttttttccaaaaattcacaacaaaaaaattaaaaaaaaaatcaccagaagccgaaaatttgacaaaaaacagctctgtgagtttttagaagaaaaaatctagaatttttgtttatttttcagctctttcaggtttttcaagtgaaaaaatgcagatttttgccgatttttccagtgaaaaattgctga

SEQ ID NO: 28944 - DNA, 520 bp, Caenorhabditis elegans
gtgaaacctttgtcacacgcaaaatcacccgatctgttgcaaaaatcagtcttcgccagcaagagcacatcgagctcggcaacctgagtgctctccgagactggggccacgcgaaagaatacgtcgaggcaatgtggagaatccttcaacaagacaccccagacgactttgtgattgccaccgggaagcagttcagtgtccgcgagttctgcaatcttgcattcgcggaaatcggagagcagttggtttgggaaggcgaaggtgtcgatgaagttgggaagaatcaggatggagtggtgagggtgaaggtcagcccgaagtactacagaccgactgaggtggagactttgttggggaatccggcgaaggctaggaagacacttggttgggagcccaagattactgttccggtaggtaacttgtagttgggctcaaatataagttgttttaattccaggagctcgtcaaagaaatggtggctagcgatatcgcgttgatggaggcagatccaatggcttag

SEQ ID NO: 28945 - DNA, 962 bp, Caenorhabditis elegans
attttcctctcgtcgatgctggtcattgtgtgtacttatctacactgggagcgttagctgggaaatggatcagcgaggattgtgagagcaagctcatgtcctatatttgtgaactgccgacaactcatgcaggtattagagaaattataagttttgtggaagaattctaagggagacatgtttcagacgactgtacctacaattacaatgggtactgctacacattcagctcaactgccgaaccatttatcattgcacaaaccaaatgcgcagaaacctatggagaccttgtgtcgatacattcatcaaatgaaaatcgatacattgaaacgtttgccgcacaagattattacctcattggagcagtgtggaaattggataatagtctctactggttagataaatccaagtgggactacaataacaccgatccagagaactcatatcgaggggattactgcgtggcaatgtcaacggtcatttcgtcccctattccgtctggtttctggttcagtacaaattgtactcgtcctgccaaatatatttgcaagcgcccagctggcgtgcagtctacaactgcatcaccagtaactgtggccccaagccctgcaaacccatcaaactgcaacgcaggcctactaatgtctccaggagtcatcacctctccaaactatcccgagaactatttcaacaacgaaaactgcacttatcagctgtccacattgggagcgtataagattgctctacgatttgcgtcattctccacggaagcaaatgatgttgtaacagtgtatgatggcctgacaacggatagtccctgtctgcgccgatgcagtggaactcagagaccctttgcactgacttcgagtggaaataccatgctggtaacgttcacgtcagactcgaagggcatttccagtggattctatgcgagattctcgtcgattgtttatagacgctaa

SEQ ID NO: 28946 - DNA, 952 bp, Caenorhabditis elegans
gttttcctctggtcgctctcggacagtgtgtttactactctacgcaaggagcattgactggcaaatggctcagcgcggagtgtgagagccagcgcatggcttttgtttgtgagctcccgacaacatttgcaggtaatatgaggtttgaatatcgtttgaattttcaaattttccagataattgccttcacaactacaacggttactgttacacattcagctcgtcaccacaaacatttattggtgcacaaagtacgtgcgcacaaacctgtggaaaccttgcctcagtacattccccaaacgaaaaccgttatattaccacttttgccccacaagattattattatatcggagcaatatggaaaactgactacagcctccgttggatggacggctctgcgtgggattacaataacattgatccaatatatcctaatcgatataactattgtctgcatatgtctacgatcactacttctggatctggtttctggtacggggacgattgtagtcttagtagaaagtatgtgtgcaagcgagaagctggtgtgccatgcacaactgtgccgccgccagtcactgtaagaccaagctccacaaacccttcaaattgcaacgccggtctactgatgtctccaggagtattcacttctcccaactatccacaaaattatttcaataacgagaactgcacttatcaactttcaacactgggatcgtacaggattactttaaaatttagcaatttccgcacggaaagcaattatgactttgtttcggtatacgatggccctacaacgagctctccaagtttgggtcgttacagtggaaacattggttctttttacgtgtcgtcgagtgaaaataatatgcttgtaacgttcacatcagatgcaggagtcgttttccaaggattcactgcaagattttactcggttgtccacagatcttga

SEQ ID NO: 28947 - DNA, 1465 bp, Caenorhabditis elegans
ggttcccgcttgtcgttcttggacaatgtgtctactattctacgcaaggcgccttggctggaaaatggctcagcgaggagtgtgagagccagcacgtagcctatatttgtgaactaccaataacctatacaggtacgggaagagttatacaagagttaaagtagttatcgacttctagacctgctcaacataccttgtctggctacatccgttgattaggtcgaaggggttgattcacttttaaaagaagctattcattcttaaaattttctgaaaatatttaatttcatcaagaaacttttagaaaacttctcaaaaaaaagttatgatggcccaaaaaatggccgaaaataagttaaaatttgaaattcgacctacttgtcaatgtcgcagcggctgggaacaattttttttgaaatcatcgtcaaattttggttgtacatacatgccacttgtctcgcgttttcaacttgattatttaggtattttaaaggtgatggaagaagaaattttggtaaaaaattttaaaaaatctctttgtccatcgactttttttgagccgtcataactttttttttgaagtttcattctgaatttcggtgttttcaggcaattttgagtcttataaaacaataaagaaaatttcgactacaccgcctttaatctgaacatttcagacaactgcgatttcaactacaatgggtactgctacacattcagctcgactaccaattccattaacacattcatctctgcacagggcacatgcgctcaagactgtggataccttgcatccatacattctccattagaaatacgatacatcaacacgtttgccccacacgcatatttctatatcggagctatttggaaaaatgatggcagtctctactggttggataactcaccgtgggactacaataatatcgacccagttcaaactaatcgagtggattattgcttgacaatgtcgacgacaaactttggaagttctccagctggtttttggtttagcaccaattgcaataaccccggatattatatttgcaagcgtcaagccggtgttcaatgctcagctgcaccaccagcaactgtcactccaagccctgcaaatccatcgaattgcaatgcaggccgactgatgtctgatggaatcataacttccccaaactttccacaaaattacttcaacaacgcaaactgtgcataccagatttctacattgggatctatgaggatcgctttgacgtttacttttttcaacacacaaccttacgacttagtgaccatctacgacggagaaacatcgagtagcccagtgttggggaaatatggtgggaaccaaagcagtcttacctttacgtcgagtagaaataacatgcttgtaacgtttataacagatgggaaagatacatcgaatggattcagcgcaagattctcttcgattgtttatggaaatatttga

SEQ ID NO: 28948 - DNA, 1362 bp, Caenorhabditis elegans
cgatcgttcaaacatttggcaattctggaagaggaaggccgtcttctgccacgtttatcacttctctcgaataacgcatacagtggaaaagactacaacggcgagcagccggacggatcaataattgtcacacgtcacatgattgataagctctcgcgacgatcttttgctccatgcatgaaacaaatgcacaatcatcttcgtgttaatcatcacttgaagtacggagcacgtcgccagtacgggctcttccttaaaggtgaaaatatggcctaaatttccgcgaatctaggccatcaagtccgaagtttctgggccgcctgtatgacgagatatgacggtttgaagttggtggcctagaaatttcagtggtggcctaactttttcccatatggaagaactagtccatgcctatacggtggttaagtatcaagtttctgaaggctctgatagccgagatataacggttttaagttggtggccgaacttggaaatattaggccacctactttaaaattctataactcggctcccggaatacctagagacttgaaacttgaccacaatatagggatgggccatttctttctcgtggaaaaagttaggtcatcaactgcaatttctaggccacagtgccagccgaaatttaacgatttggatttggtggcctaataatttttaatgacctaatttttttcgacagaaaaaaaaaactagttcacttctatatcgtggtcaaatatgagggtgctctgggatcctaagtaggtggcctaacaggaaattctaggccaccaactcaaaatcactataacttggctctcagagcacctagaaacctgatacttaaccaccaaataggaatggactagcttttccctgtagaaaaaagttaggccacctggatttctaggccatcaacttaaaatttttgtaactcggctctcagaccacttagaggcttgaaacttggccacaatacattcgtagtctagaacttctttgtgaacaaaaattaggccaccatctggaatttctaggccaccaacctcaataattcttcttccaggcatcggactctcgctggacgaggcgatcgcaatgatgcgcgacgagttcacgaaaaagatcacgtcggacaagtttgacaaagaatacggctacaatattcgctacatgtacggaaaagagggccgccgagtcgcacagacggccatgagctgcgccacaattattctccgtaacccaccgtcggctgtcgattgtcacggatgcccgttccgtcattcggagaagcaggttctcaagcagaagctcggcagtgatgccatattgaaaaaggagcaaatcgagagggtatga

SEQ ID NO: 28949 - DNA, 299 bp, Caenorhabditis elegans
atgggagccttctttcctgtcattctgctcaccccaacaccaatttcctcagcacataacctgtatctttttcagatgctcgagctacaggaaaacatcaccgattctcaggtaattcatactttaataatagaagttaattctccaaatttcagccgatggatccgccatcgctagagatcatgatgctccatcacctcatgatcattctggtcacccttttcggtaacacacttctgatctatgtgatctacaagaacaatgcggtgctgaggcggaaacgggtcactcccgtgcag

SEQ ID NO: 28950 - DNA, 751 bp, Caenorhabditis elegans
gttttccaattgtcgaacttgggcaatgtgtttattattctacgcagggagcactaactggcaaatggctcagcgaggattgtgaaagccagcgtgtagcttatatttgtgaactaccaacaacgattgcaggtatcatgataacgtgtcttgtgaatgtccagaacttccagatagctgcacttacaactacaacgggtactgctacacattcagcacggctgatgcaccatttactactgcacagggaatttgcgcaaaaagctgtggaagccttgtgtcaatacattcttcaaatgaagctcaatatatcaccacctttgcgccagaaggttttcactatattggagcgatatggaatcataactcaagtctcaactgggtagatggttctgcgtgggactacagtaaaattgatccaacatctcctcgaatagattattgtttgaaaatgtcggtgtttaacggttctccgaccggcttatggtacagtgacaactgtatcgacaataggaagtacgtgtgcaagcgtgaggctggtgtgcagtgcccaactgtaccaccaacatctgtgacaccaatttcttcaaactcatcaaactgcaacgcagggcgactaatggataatgcagttatcaccactccgaattatccagaaaactacttcaacaatgagagatgtacttatcagctttccacattggggccaaacagggtttttctacaatttaatttttcatcgttgaattga

SEQ ID NO: 28951 - DNA, 939 bp, Caenorhabditis elegans
gttttccgatcgtcgaacttggtcaatgtgtgtattattctacacaaggagtattaactggcaaatggctcagcgagaattgtgaaagccagcgcatttcttatatttgtgaactaccaacaacgatcgcaggtatcatgatagcgtatcttgtgaactttcaaaaattcagatagctgcaaatacaactacaacgggtactgctacacattcagtactgctgatgcaccattctcaactgcacagggaatttgcgcacaaagttgtggaaaccttgcatctattcattcttcaaatgaagctcgatatcttactacctttgcgccagaagggtattactatattggagcggtatggcatcatgactccagtctcatctggttagatcgttctgcgtgggactacagtgacatcgatccaatatttcctcgagttgattactgtttgaaaatgtcggcgttcaacggttatccgactggaatgtggtacagtaacaactgcgtcgacaataataaatacgtgtgcaaacgtccagccggtgtgcaatgcccagctgtaccgccaacaactgtggcaccaagttcatcatactgcaacgcagggcgactgatgaataatgcagttatcacctctccaaactacccagaaaactacttcaacaatgcaaactgcacttatacactgtccacattgggatcatataagataattctagtattttatgatttcagacttgaggctggacgtgattttgtgaccgtttacgatggcgaaacgacaagtagtccagttttggcagcacgtctcagtggtactatcaaaggtggattttcatatacatcgactggaaataacatgcttgtaactttcacatcagatgccagtattgttggcccaggttttacggcaaggtttacttctgtgatttacagaccgtag

SEQ ID NO: 28952 - DNA, 390 bp, Caenorhabditis elegans
atgcacacaatttccgctctgctaatattcactgtttgtcttgcaagttgtgttacctcatccccaatttgcacaaatggtttcacactgatcaacaacaaatgcttgaaactattcagtaccccagtgaatcatacaactgctgaaaaatcatgtggtagttttggagcaactcttgttcaggccaaaaataatattgtaagtggattacataattttagaataagcacatgtcaaggttttaggataaccaagccatcgcgactattgctggatctggaagttctacattaatatggctcggattgtattgcttcgaaagtgatccttcccaatgtttttgggatgatgaaactggctcggcacacacatacaacaacttttccagtg

SEQ ID NO: 28953 - DNA, 694 bp, Caenorhabditis elegans
atggttcaccagttgaaaattcttatcatgattcaatatgcaccgagtggcttccaaagaccgcctcgaaactactttatgacttttgataagaatcataccccttttcccaccatgcaaacaatttccgctctgctaattttgactctttatcttgcaaattgtgttacttcatccccaatttgcacaaatgggttcacactaattaacaacaagtgcttgaaacttttcaatactccagtcaatcatagaactgctgaaagatcttgtagtagctttggagcaacacttgttcaggtcaaagattatcgcgtaagtacaatttgcccacaattttatgattttccaaagtcgaggttacaggataatcaagcaattgcgactattgcgggatctggaagttctacattaatatggattggattatcttgttttgaaagtgatccttcgcagtgtttatgggatgatggatctgaatcggcacaaagatacaacaacttttccagtggtttggttttatttatttgatttgagaaaaaaaaacaactattcagtgttttaggttttccaattgtcgaacttgggcaatgtgtttattattctacgcagggagcactaactggcaaatggctcagcgaggattgtgaaagccagcgtgtagcttatatttgtgaactaccaacaacgattgcag

SEQ ID NO: 28954 - DNA, 357 bp, Caenorhabditis elegans
atgttgtccaaacgcattgttaccgctcttaacaccgccgtcaaggttagttttatcgaattctccgcagaatttgacccgaaaatgttgtttttaggcttgaaaatttaatttgccactttaaatttttttgctgtgagcttttttcggatattatgcccttaaatcaacatttacggctcaattattgatttttgattattaattctaattaattgcatttttcaggtccaaaatgccggaatcgccaccaccgcccgcggaatggccggagcttccggatccgaagtctccaagattctcgaggagagaattctcggaaccgagactggaatcaaccttgaggagaccggaaag

SEQ ID NO: 28955 - DNA, 1185 bp, Caenorhabditis elegans
atgactcttggatgtgcaaagcttgacaagcaagttgccgattggctcgcttgggataagaatgataagaatcgtaatgaaattcaaaagctggttgatgagaagaacgttgatgcattgaaagctcgtatggatactcgattggtttttggaactgctggtgagaagaaaataatattacacagctgcagtgtgtaaacggtggaagaaacgcagctatattgggacaaagggaggaagacccgaaattgtgtagatttacagagtgtgaatcttcattattacgggaatgcatattgcgcaacttatttgacgcgcaaaatatctcatagcgaaagctacaataattcttttaatggctactgtagtcaattttcgaaacaatctgtatctgtcgctattcgaaaaacatttattctcgaaaaccgagcccacacgtggagtcagaaagtcccatttcgctttgatctacaaaaaatgcgggagaagagacgcagagttcttagccgaattcgcatggttaagagcgtgctggcgccacatttttctggtaaaaaattcccgcattttttgtagatcaagctatattgggacagccagacaccaagtgagcccataaatctacacaagcgctacactagtttaaagaattactgtagttttcgctacgagatattttgcgcaatgcgcattctcaaagatttgtgttcccgtatcacacggtccccacatctctgcgtctctccactgtctacactctgaagaagctgggtgatattaacaggagaacagtagagattcaaaagtacagctcaaaatataaacgtattttttccaggtgtccgttctccaatgcaagctggatttggacgcctcaacgatcttacaatcatccaaatcacgcacggattcgctcgacacatgctgaacgtctatggacaaccgaagaacggagtcgccatcggatttgatggacgttacaacagtcgacgtttcgcagagctctcggcgaacgtctttgttcgtaacaatattccagtttatcttttctctgaagtctctccaactcctgttgtctcgtgggcaacgattaagctgggatgtgatgctggacttattattactgcatcacataatccaaaggaagacaatggatataaggcgtactggagcaatggagctcag

SEQ ID NO: 28956 - DNA, 638 bp, Caenorhabditis elegans
gctttcccaacgagaccaatacaagctgtgtgtactttatcaccagtgggccagatgctggacagtggaaaagtggctcatgcaatcagacaatgggttttatgtgtgaactacctccaactattcatggtaaggctacaagacaggagcggacaatggttggagaaagcgctagagaggtgcaaatcgctaaaaaaattttaattgccgccctgcctcaaagctgttaattgattcttaaattatatatttcagacggtagttgtgattacaattacaacaatcaatgttacctacgctacaatactccgcacaacattcctgatgctcaagaaatctgtaaaacaagatgtgccaaccttgtttcaatcagctcggccaatgaaaatcgcttcatacgatcactatttactacacaaggatatgttttacttggcgctgcggttatatactacgacgatatttattggctggatggatcaccagcggtgtataattatattgaacggtatcaacacggagcttgtctgctgctgaatgtgaattgggtttacatcactgacggtgcctggtacaccgaaagatgcaccactccaggaaaatttctgtgtaaacggcctgcaggaactgtttgttga

SEQ ID NO: 28957 - DNA, 193 bp, Caenorhabditis elegans
atgtcaaaatcttatgagtttgaagagctagaatgtgatgagcccactcaacaaactcgttttgaaaaaattcaaaatgttgcttctgatcactggaaggatatattgatcggagtattatctcaaattatgtacttgagctttgttgttttgttaacctactttttggcaagacagcatctgtgcgaaacag

SEQ ID NO: 28958 - DNA, 178 bp, Caenorhabditis elegans
atgaacgaggatgaaaataaaggaattgtatttcaagtgagtttattctaccataaaaaagtttcagctttcactgaaattttcagattgcatatgaacttccctctcaacagcgtgtaggcatgcaaatggcgaatctaagacttcatgcgaggggagttttcagtaatgtgtacag

SEQ ID NO: 28959 - DNA, 273 bp, Caenorhabditis elegans
gccaaattggattcttgaatgaaactcgccgattgaatgttgcagttactcgagcaagaagacaatttgttttgattggaaatggacgaatgatgaaaggaaataaacatcttttaaaactctacaagtatgggttttcttgaatatttctggaactaatgaatacatattttcagacaccttcaatcggaaaaagtcatcttcggaccgtcaattctcgaaaccttcaacgatcttgaggaagctgctctaccaagatcggataaattttga

SEQ ID NO: 28960 - DNA, 187 bp, Caenorhabditis elegans
atgtcttatcctgacgatttcccgatccctcatgttattcagccagttaaagtggtccggcacgtggtgaaggtgagttttcagtttttgagccctagaggggcttttcccaaacaaaaaaaattaattttttttccaggaaacacctataaaaactccgtacttagatgtttgcccaaaatgtcag

SEQ ID NO: 28961 - DNA, 1256 bp, Caenorhabditis elegans
cgcgccttcctgccggcaaatatggcaactcttggagccgcagaatggcaatcatgctttggagaagtgctcttcccattgctcactaagcttctggagccattctctcaaatggatccgattggaatggaggatacacgtgttcggacacttcaaatcgtcgcgaaaactcttttaaatcatctctcagccctgtcggctcttgattcattcccggatctttggatgcttctgctcgactatatggagcaatatcttcgagttgatagctgtggaaatttgaatgaagcagtgccggaatcgctgaaaaatatgcttctcgttatggatagtacgggaattttcgctgcaacacctcggctttatgatgtgactgtggagaggctcaacaaatttatgcccgaattgattaaggatacgattccgaatccaccacggccagggcagcagcagtcggaagcgtcggagccgaagaaggagcatgcttctgggcttgaggtgctcgagaatttttttttactgaaaaatcagaaaaaaaaaagatgattttcggtcaattttcgatttctttttctctcggtcaaaattcccggtcaaaatctccggaaatatatgtattcttcgaaatttcgaatatttcaacgaaaaaaattaaaaataaacatagaaatagagaaattccctgaaattttgagcattaaatttttttaaaaatattttaaaaaactggaattacttatttttcgaaaaataaaaaattttccgatccagaataccgaaaaatcgaaatttttcgatttttgattggtgtttaaagcagagaaaaaattgagctctttaaaaaaaaaaggacgtacattcgaaaaaaaacatgattaatccaaatcgagattttttcaaaaattgagaaattaacactgatgttttcgcctttttttatacccaagacatcacaaaattaaacaaaaaattaccggaacgaaaattttaaaataaaattataaattaagctggaaacggccaatttttaactaggaaaagttttttttcaactagaaaaattgcagccaccaccaccatcatccaactcaacagccgccacttcaacatctgatccttcgatcgctactgcacaatcttcaatttcgacagcttcatctgttgttggaccacttgttacatgtccagaagatgctggaattagtgctccgattccaatacaacatccattggtcagtagtttgggggcccagtag

SEQ ID NO: 28962 - DNA, 423 bp, Caenorhabditis elegans
acccgctacgaaggctccgtggaagaaactgctccaatcggagcagctgtaatgagcttctcagcttttgatgcggacgaggaggcgaaggataatgtgttcacttatcaattatccgaagaatctgattatttctatgtgaccactgataaggactcaaagcagtcgtctgttggagttttgagggttaagcaggtatgtttttttttttaatgtttttttttgtaaaaagaaaaatattagattttttgtcatatttattgcctggttgcaattttaaaaaattcaatttttacaccaaaattgcaccaatttgagaaaaaaaatagtttaaaaaaattttttttttggcaactgggtaataagtataaagttctaaagttggaattgactaatatggcgtttgtttttttactctggtaa

SEQ ID NO: 28963 - DNA, 87 bp, Caenorhabditis elegans
atgaccgacgaggagttgttcgagatcgctcttcccggcttcttatatctcactgtttttctagttggaactattggaaactctatg

SEQ ID NO: 28964 - DNA, 3272 bp, Caenorhabditis elegans
gtctcggaacttcgcgagtgcggcaacggtgtcgtcgacggttccgaagaatgtgattgtggaagtcgtgagaattgccaagatccttgctgtgacccgctaacatgcacactccgtccacatgctcaatgtgccgcccatcacaaatgctgtcatcgttgcgaacttcgaaaagctggcgacacgtgtcgatcttcaaaatctccgtgtgacgtagccgagcaatgtgacggaaaatcgggagactgcccgcctgatggtcatctaatcgacggtaccgtctgtggaactgatggacaatgctggagaggaaactgttcggatagtcaccaacaatgtcagaagctttggggacgagaagctcgagttgcggagccagtgtgctttgagcagaataccaaaggagccgagtacgcgaattgtggacagcggcaagccgacggaacttatcacccatgtcaaattgaggatacccgatgtggaaccctacattgccacagtggaagtataactccgatcgactcgtcactcaaagcttttacctttcatttcacggaaaactcacaccaaatccagtgcaaatcgattgcgtcagccgcggttggtctgacatccgacggcacaaattgtgcatccggaagagtttgtgtggctggaagttgcgtggagatgagctcggtgagctctgcgaccgcttgtcctaccaataatcttgctcttttgtgctccggccacggccattgtacgactacagcgagatgtgtgtgttttaatgggtggtctggggtggcttgtgatattcgatcgaattcgtcgacttatcaaggaagtatgggatttggggaagaaggttcggggggatcttcacaaaaatcatccgagagaaaaaccatcatgatacctcacctgaacattggaaccaccctggagactgctacccttttcgcgattcttctcggattcggagtcttcctactcctatgcctggtctgtctgatgctttgctatcggcgacgttcggtggtggagatcccgaagcccagcgatgagaaggacgaggaatccccagatcggcagatcaaattcggcaatatgccatcgtatcgggaagagaagcggaaacggaagagcaataagaagatctacggagcgctgaatcggatcacggaggctgacgagcgggattcgacgagtttgcggtcgagggatagtgctggaggaagtcagcagttggtggataggaggaatggggcgcccgtggttgttggggggatacggtaggtgtcgaggcaactgcatggaaagaggagatttgcgagaaggagatctggcgagaaatggagatcacgcccatttttttgattttttttcgattttccgaaaaatcaaaaattgaaaaaattaatttttagagatattgggggaaaagggaattttttgacattgaaaaacgcaaattttgaatttttttgacatcgaaaaacggaaattttgaatttttttgacatcgaaaaacggaaattttgaatttttttgacatcgaaaaacggaaattttcgatattttgacattgaaaaacgaaaattttcgaattttttggcattgaaaaacggaaattttcgatattttgacattgaaaaacgcaaattttgaattttttggcatcgaaaaacggaaattttcgatattttggcatcgaaaaacggaaattttcgatattttgacattgaaaaacgcaaattttcgaattttttacatcgtaaaacgaaaattttcgaattttttgacattgaaaaacggaaattttcgatattttgacattgaaaaacggaaattttcgatattttgacattgaaaaacgaaaattttgaattttttgacttctaaaaccgcaaattttatattttttgacttttaaagccgcaaattttcgatattttggcatcgaaaaacgcaaatttccacagtttttgacatggaaaaacgaaaatttgaattttttaacaccggaaaacgaattttttacattttttaacaccgaaaaacgaattttttacattttttgacattgaaaaacgaaaatttggaatttttgacttcaaaaaacgaaaattttgaattttttgacttgtaaaaacgaaaattttcgatattttgacattgaaaaaataaaaatttttgatttgtgaatttttttcaaaaaaaaaaatcgaaaaacatgcccaagcagtgttgttaacaaaaaaatttttttgagcaaaaaccaaaaaaaacttttaaaattcgaattctacacggatttctggcttccctcataaattgaaatgaaagagtttttgccgaactaggccattttggctcggccatatctggggtagatttacagcgcgttgcgtgtcgcgtcgcggctcgattttaattgtaaaaataaaaaaattttgtcaaaaaaaagcagtttttttgctgaaaaatcgaagaaaaaatcaatttctatcaaattttttgaaaagagggacacaattaccaaaattttcagcaaaaaaaattggaaatttttttttccaagttttttttcccgattttctcttaaaaaacccaaaaagtctagcattccttctctttgaccagatcttcgcctagatctccttcccacatatttcctttttgtggtgcctccaaaaaaacacaaattccttttaaaaaattcaaatttttgcagcgatccctacgccggagagcacatctacgcagagtcctcctcaaatcatctgactcgtcaattccgtggaatcaactccgatggctcatatcctctccgatctttcggttcatggcgatcttcggctccaatcagtccggcttcttcctcaggccaactgactgatgtgagcactgcgacaactccgctgaggcttaacaagattggaaaattcctgaaaacactgcaatccgacgatgaatcgccatctccgttctctgatcatcaaagtttcaccactggaattggaatcggagcccgcctggagcagatgcagtttggaggcggaggagacgaagagctatccgcagttgaagcggatcatgatgtaggatccaatacggaatcatcaagaggatgtgaagaaccaatggatcctggaagttgggattccccgacgctggttaatggagcttcttcttcttcaacatcgaataattataatttccgacaaagtccctcacttttcagtgatccttttaagctagaaatgaccaatagtatgcacaattaa

SEQ ID NO: 28965 - DNA, 330 bp, Caenorhabditis elegans
atggcctcgttgacccgagctgtaacccgactggccatcgccggccgccaagccgtccggaccatcgccaccaccaccccagtctccggacacggtgacgacatcatggagaagtggcccgctgatagtgagtttttttttttgagtaggagtatttgatattttcccaaaaaccggcagtatgagaaaatagctaaacaaatactacgtgctaaacaccacattttaaaaaatgctttcaaaagttcaattttttgattttagagttcgacaatcacttcatcaactacctcaatcgcccagaaatcgacggatgggaggtcagaaagg

SEQ ID NO: 28966 - DNA, 1121 bp, Caenorhabditis elegans
atgtcctctgctgctgctgacgaaagtgatgctgtgctcgagaatcttattgcgaaaggtgggttactgtaggttgaatgggtctcgccacgacaatttttttcgatgaaaggtgtgcgcctttaaggagtactgtagtttggaatttttatcgattttttaaaaatagtttttcgattgcattgattcttgacaaaaactatgaaaaatcgataaatattccgaactacagtactctttttaaggcacatacatttgtttgcattccacaaaaaatgtcgtgtcgagaccgcaaaatttcgcgattgagtaataaaataaaagtgccaaatttcacagattcgatgtagaaaatgaaggtcttttgaaatttctcaatactaatttacacatatttttattaggattttttttaatataaaaaatcttctcttgtcgatttacgcagttcgtgtactcctcgtggagaagtttgtgtgcagttttgcccattttcgctaatttttgattagtttttaaaaaaattaaagtcagattcaggcaaaaatatatgaatttgctgttcaaatccccgttcggcaaattcattttccggcaaattcggtaatttgccgatttgccggaaatttccatcttcggcaatttgccgatttgccaactagccggaaagtttcaattccggcaatttgccggtttgccaaatttttcaattccggcaatttgccgatttgctggaatttttcaattctggcaagttgccgttttgccaatttgcctgaaatttccattttcggcaatttgccggtttgccggaaattgtcaattttgccaatttgctgattcgccggaagtgtttattttcggcaatctaccggtttgccgatttgccgatttgccggaaattgcagttccggtaatttgccgctttgtcggaaattttcaattctggcaatttgccgatttgctggaaacttttaattttcacttttaatagattcccggccaaatagcataaattcttaaaaatataataatccctaaaaactgaaaactttccagaaatccttccccaaaccggcaactgggaaggaaccgaggaatttcttaatcgaattgttcag

SEQ ID NO: 28967 - DNA, 2524 bp, Caenorhabditis elegans
acgactacgcctccctggacgaagtagctggagaaggatcatcatcatcagcttcagcttcagcttctcgtagaggtttaaattcatctgaacaatcacgtcgacctctattagaagagcatgacgaagaagaattcgatgaaccacacgagaactcgatatctccagcacatgcagtaacgacatcgaatcacaatggttcatagcatttttgaaattttttggaaaaagttggacaaaaattgtgttctccccccgtcccattttattgcatgtaattaccccccaattccgcccaccaaatttgcacgtttcttgtgccatttttagctgaaatttctgaactcctggtcttaaaattttaagaaaattttagggacatttgggtctcgaagcgaacggttttactgtaaaaaactgaaaaattctataatttaaaaaaaatcagcaaaaagttacgagaaaaagcctgaaaaactgtagggtttttttaaatgtaaaagtttttctgggaaaaagataattttttgaaaaaaaaacagtattttcgcgagaaaaagaaattgaattttttaaagcgaaaaatctgaaaaaataattttaaaaatccgaaaaatctgaaggaatcaatttttttacaaaattctaagaaaaaaatcaattttttcccgagaaatttgaaaaaaatgtttttttttagacaattcagaaaacattttttttgaatttttaaccgaaaaatattaaaaaaaaacttttttttcacagaaattatcccgaaaaaattgaaaaaatattttttttttaaatttttttcccgaaaaatctagaaaaattcaatttttttactgaaaaattcaaaaattaatttaaaaaaatgatccttagaaatgtaatttttcccgaaaaatcttttttttttctagaattatcaacaaaaacacatttttcggaaaaaattcgataaatcgttttttacattatttttcaaatttttttgacaaaaattcagaaaaaatcgtgttccggacccaaaattttccagaaatttctttttttttttctaacaaaaaatcttctcccccgtcccatttcttggcgggaaatttgaattttcctaaaaaaaaatttccaaatttctcgccgaatcccggtgtctctggtgtttgttctgtgattttgtttttgatctactcgatttggcgggaaatttgaaattttttaaaatttcgatttcccgctcattttctcactatatttctatctaccaattgttgtacactgttgttgttgttgtgtatgtgtgtgccgagagacatcggttcacgtgtggtaagtctcctggcctcggtcctcgaaagcctttttcttgcctatttttacctttgaaaaaatagaaattatacgagaaatccaaaaaatttcatacattttggcccaaaaaccaaaaaaaactgaaaaaaaaactaaatatcactctaattttgccccgaaaaactcaaaaattaattttggacttttttttcggaatttttccacaaaaagcttcaaatttccccatttttacttgcaaatcaggaaaaaaaaatcaatttccccaaattccgaccgttccatttcttaccagtttcgtgattcacctaccgtaacctctctacagtaaccccctgtcgtgctgatctgtaccatttggtacttaatattgtgtgtggttactgtagactttcctaagcctacctacgcctgtattcagaaaataagcggcaataggtaggcaggcaggcatgagaaaggcatgtgaaaacttgaaatttgaatttcgcgccgtaatttttttttgttgaaaatttcaaattcgcgccaaaatttttctccgaaaatttgaattttccggcaaatttttttttgaaaatttaatgttcgcgccaaaatgtttcttaaaaattgaaattttttgaatttcgcgccaaaattagcgaaaaaagtgaatttgaatttcgcgccgtaatttttttttggaaaatttaaatttcgcgccaaaattttttctcagaaaatttgattttttttgaatttcgcactatgtttttcggaaaaaatgttgcggaaaattttctaaaaattattaaatttcaaatttagagtcaaattaaaaaaaaaaaattcaaaattcaaacttcgcgccaaatattttctgaaatattggaattttttgaatttcgcaccaaatttttttgttgaaaatttgaatttcgcgccgaatattttctgaaaaaattgaatttcgcgccaaaattttgaagaaaattgaattttttttaaaaatttcacacaatttttctcgaaattattgaatttcgaatttatgagtcaaatttaaaaaaatcaaaaattcaaatttcgcgccaatttttttacacctgatttttttccagaaaacccatacgccgacatctcatcaccggaccccgtcacccagaactctgcgaacaaaaaacgtgctcaggacaatttgtacacctaa

SEQ ID NO: 28968 - DNA, 362 bp, Caenorhabditis elegans
atggtgcatctcaacaaaacaattcaggagggtgataacccggatctcactgccgaacgcttgacggcaacatttgatactcatgcgatggctgcacagatttatgggggagaaatggtaagctatctagtcaaaatggaatatttgaataactgtctctaatgtttccagcgcgcccgtcgtcgtcgtgagatcaccgcgaagcttgcagaaatcccagagctccatgactcgatgccacttccgtatatgacaagagaggagaaaattatggaaagtgctaggaaactgacggttttgacacaaagaatgtcagagatcattgatccaactgatgcaggcgagttgtatcatttgaacaa

SEQ ID NO: 28969 - DNA, 968 bp, Caenorhabditis elegans
atggcgaaccgatcaattcgtgatggagataaccccgaattgctggaagaacggaggatggcaacttttgatacggataagatggcagcggtgatctatggaagtgaagaggtaaggactgcaaactacaaactattgattacaagctttattaggctaatagaaaatcagattatacataattttagtatgaatcaagagttatcaaagctgaaattttataatgttttaaagcacaatggaatgtatacatacatgttcttgaaaaatattgtataccttaagtggagaccatgtatgtttcgcaccgtataacttaatcagttagaacgacatgttccaccacgtggcattgaacaataaaatccctgtaattccacaaaaatcaattttcgtcgttttccctttgtcggaaaaattttttttattaggtaagattagatagccactattttttctgagagatagagaccataaaacgaaatacatattctgtcaatcagcaggaaagtgcaaaagtcaatgtttctagtagtgtgtaaaggtttcagcaaaccatgaacatacatatgtatcaagattttggacagtaaagaaacagggaaatgaactatcatagtttatgagggaaattatccccgtcgatgcaccatgtttcgaatgattcaaactttggtgcctcactttggttgattgcatttttttttgaaataattaattgtcaacttattaaatgaaaaaaaaactgtcttaatacatagaaaattatttgttcagttcgctcgtcgccgtcgtgagatcaccgacgccgtgtccaagatccctgagctcgccgacatcaagccctatccatttttgactcgagaggagaaggtgaccgagggcaccagaaaaatatcgattttgacaaaatatctgaatcagctgattgatagagataatgaagaagaaagtttgcacctgcatcg

SEQ ID NO: 28970 - DNA, 561 bp, Caenorhabditis elegans
atgagctcaatttgcaaaggagataactcagatctcacagaagaacgaaagaatgcgacttttgatacggataagatggctgccgtgatatatggacgtgaagaggtaaggggggcaaatagactacaaattacaggcagcaaaaggccaaatggcgtatgaaaatgccgtagacggttcgatggtgaacaactgaggcccgcggttagtccgtccccggcagaaagtgcatccattcaactgcctgatttttggtcgtccaggctttaaaattttagtttttgggaaaatttactttttttttgtcactctaccggcctgaaatatgctttaaaattcagcttagaatctccgttggcttttccagattgctagtcgccgtcgacaactcactgaatccatctcccggatccatgagcttgcagaatccaaacccctagttttcatgacacgagaggaaaaaatcgctgagtcctgtagaaagctggaggttttgagtcgacactggaatcagaccccgttcaacagagacaacgaagaagatgcactgcacatctacag

SEQ ID NO: 28971 - DNA, 359 bp, Caenorhabditis elegans
atgcatttaaacacatcaatttgcgaagttgataacccggatctcaccgaggaacgggagaagggaacttttgatacggataagatggcggctgtgatctatggaagtgagaaggtaaggcttttaaagttattttagagaaacattatatcaaaaatattgttccagctcgcccgccggcgtcgagaaatctcagaagctgtctcaaaaattccggagctagcggatacccaaccctttccgttcatggaccgacttgaaaaaattacagaaggatcccgtaaactagaggtgctcaataacaacatccgtgatataattgactacgatgataacggcgagagacttcatatctatca

SEQ ID NO: 28972 - DNA, 707 bp, Caenorhabditis elegans
gttgtctcctcaatcactgcttccttgagattcgatggagccctcaacgttgatctcaacgagttccagaccaacttggtgccatacccaagaattcacttcccattggccgcctacactccactcatctctgctgagaaggcctaccacgaggctctgtccgtcagcgacatcaccaatagctgcttcgagccggctaaccagatggtcaagtgtgatccacgtcacggaaagtacatggctgtgtgcctcttgtacagaggagacgtcgttccaaaggacgttaacaccgccatcgctgcaatcaagaccaagagaaccatccaattcgtcgattggtgcccaaccggattcaaggtcggaatcaactaccagccaccaactgttgtgccaggaggtgatcttgccaaggtgccacgcgccgtctgcatgctctccaacactaccgccatcgctgaggcctggtctcgtctcgactacaagttcgacttgatgtacgccaagcgtgccttcgtccactggtatgttgcccgttaaactatacttttcaaatattcaatgtgtttcttttcaggtacgtcggagaaggtatggaggaaggagagttcaccgaggctcgtgaggacttggctgctctcgagaaggactacgaagaggtcggagctgactccaacgagggaggagaagaggagggagaggagtactag

SEQ ID NO: 28973 - DNA, 892 bp, Caenorhabditis elegans
atggccaccgctgacgtcaaatccaccgtcccacacatggacatggaccgtggaggcgcgttcgacttctccaactgcattcgtaatcaggcaatgtgcaagatgggcggaaaggctccaaagctcaccagtaccggaaccaccatcgtcgccgttgccttcaagggcggacttgtgatgggagctgattcccgtgccaccgccggaaatatcatcgccgataagcattgcgagaaggttcacaagctcactgagtcgatctatgcctgcggagccggaaccgccgccgatctcgatcaagtcacaaagatgctctctggaaatctccgtcttctggaattaaacaccgggcgcaaggctcgtgtgatcaccgctcttcgtcaagctaagcagcatcttttcaactatcaaggatacatcggagcctacttgctcattggaggagtcgatccaactggcccacatctttatatgtgctccgccaacggaactacaatggccttcccattcacagctcaaggatctggatcatatgcagctatcactattttggagcgtgattttaaggttgatatgacggtaagtagtctatttttgaattccaatgcgctaaaaatactataattatatttttcagaaagatgaagccgagaagcttgtccaacgcgccctggaagccggtatgcacggtgacaacgcctcaggaaacagtttgaatcttgtgatcatcgagccaagcgagaccgtcttcaaggggccaattgtgccagaattctgcaagcgaccagagcccaacgacctcgtctacaaattccaggccggagccaccaaggtgctgaaacacaagacctacaagtacgacgtcgtcgagtccatggatatcactcactaa

SEQ ID NO: 28974 - DNA, 1388 bp, Caenorhabditis elegans
atgattgaaacactgacatcagaacaagcagcatcacatgaagttgttccatgtacacatcaacttcgaacaaatcttgaagagggtctcacaacggcagaagccacaagaaggagacaatatcatggatataatgaatttgatgttggagaagaggaacctatttataaaaaatatttggaacaattccaaaatccattgattcttctcttattggcttctgcatttgtgtcgattgttatgaaacaatatgatgatgcgatatcgattacggtagctgttgtcatagttgttactgttggatttgtgcaggtaactacaaactacaaactacaaactacaaactacaaataggtgttgaaaagtttaaattttttcgatgtttttcggagaaaatcgaaaaaaaaatttcgatttttttgaaaatcggaaaacttgttcaaaaagttataattattttgaatatgttgaattttagctaaaatcaaggatttttttctgaatttttccaattttttttccaaaaatcgaaaagaaacacaaaaattcggaaaaacggaaaattttagacttttttaaaatgaaaatccagaaaaaaattgtaaagaactatatatttattaaaaaaaaaaaaaaaaaacggaaaaaaacagtaaaattcaaaaaaaaaatttttttttgatttttttgaaaattgaagaaaaattatttaaaaaatatttttttaatcaaaaaataaaattttttggaattttggaatttttcccaacaaaaaacacacaaaatacgaaaaaacgaaaaatgttcgattttgtttttcaaaagtttagacttttttgacgattttttagaaaaattcgatgtgttcaaatcttgtagtttgtagtctcaaattgactacaaactataaagtataacttttctttatcatttgaaaaagttcaacttttgtagaacagataagaaactacaaactattgggaatatattatttcgataaaaatttggaagtttgtttacaatgttatgaatgatgatgtcatgtgtaaaaattgtgggagcatagactacaaactacaaactacaaactacaaactacagtacaacgtcaaaatttttaaaaacgattcaagatgctaatccctccatttttccaggaataccgttccgaaaagacgctggaacaactcaccaaactcgttccaccaacgtgtcacgtgctccgtgatggaaaagaggcaatgatgttggctcgggagcttgtacccggtgatattgtacttctgaacacgggagatcggatcccgtccgatttacgaatcgccgagagcttctcacttcaaatcgacgagagctcactgaccggagaaactgagccgaagcataag

SEQ ID NO: 28975 - DNA, 1388 bp, Caenorhabditis elegans; identical to SEQ ID NO: 28974

SEQ ID NO: 28976 - DNA, 388 bp, Caenorhabditis elegans
ctttgtgatgatgatttttcaacgatgaccgcggcgattgaggagggaaaagccatttatcacaatatcacgaattttgtgaggttccaattgtcgacgtgagtttttggaagaaaactcaaattttcctccaaaaaagttctatcaaaaatttgaatttcccagtgaaaaatgttccctaaaaaatttaaatttcctacaaaaaactttttctcaaaaaattgaatttcccgccaaaaaaaattttccagaaaattcgaatttcccgccaaaatttatttctcaaaaaaatttgaatttcccattgaattcaaaaccactagactacaaactacaatacaatacgtttaggaaattaaacagtacacaaacaaactacaaactataa

SEQ ID NO: 28977 - DNA, 1207 bp, Caenorhabditis elegans
ctttgtgatgatgatttttcaacgatgaccgcggcgattgaggagggaaaagccatttatcacaatatcacgaattttgtgaggttccaattgtcgacgtgagtttttggaagaaaactcaaattttcctccaaaaaagttctatcaaaaatttgaatttcccagtgaaaaatgttccctaaaaaatttaaatttcctacaaaaaactttttctcaaaaaattgaatttcccgccaaaaaaaattttccagaaaattcgaatttcccgccaaaatttatttctcaaaaaaatttgaatttcccattgaattcaaaaccactagactacaaactacaatacaatacgtttaggaaattaaacagtacacaaacaaactacaaactataactgagccatatatcaaaaccgataacagactacaaactataatttttggtacttatgtattatttcccctcattttgaaaaaatacatttttaaataaaaacgtgtggagtttttgtatttttcggcttaggaaataactatttctaagcctaaagagggaaaatgggcatcacgttttcacgtggtcgctggctgtctcaaaattgctattttctcgcggacgagaaaacgtgaaaaaaatgagcgaaatggccttaaaaacggtggaagaggaggattcctcgtccccccggtcgcgtagtcctctcggagaagaaaatagcgtgtaaaagatgagacacagacaacgagacggtctcattcctttccttcgcttgtccgagtgaatttcaccgacaatattctgaatggggcgcattttcatcgaaattatgcaaagagacagccagcgagcatgtgcgttttactgaaatgaataatattaatatgaggggaaataatacacaagtacctaatttttagctccaagcataatattttttcgaatttccagaagcgtcgccgccctgtcactaatcgccgcgtcaacaatgttcaaattcgataatccattaaatgcaatgcaaatcttatggattaatattataatggacggaccaccggcacaatcacttggagttgaaccagttgatgatgatattattaggcaacgaccacgaaatacgaaacaaccaatgttaaccggaaaattgattgccgatattctcgcgtctgccgcgattattgttgtcggcacgttgagtgtgttttataaagag

SEQ ID NO: 28978 - DNA, 962 bp, Caenorhabditis elegans
atgttggactacaataacgttacgtcaggttcatcagaagaggactatgatacaagtgaaataattgggttgcaagttaatacgcacgaagaatatgaggatattattgcagaagctttatggccaaatgctgttgaacagtggttagttattctaaaaattttggaaaattctagaaaaaaaccaggaagaatggctctaaattaaaaaaaaaactctcatatctcaaaaactatcagttttatcaaaaaattgccaattaacaaaatactgtacagatatttttacacattttgttcgttgacacctttttgttaattccaaccattacggagatacacaaacttttaaaagtgaaaaaattgtgttaaaaaaaaataaattttttgaagacttttgaagccttcgcccgttgcagtgatattaaaaatattaaaattggatattaaaaagtgcttgctaacaaaagtttgcaaaaatatttggaaaatattgttagttgacaattttttgatagctttattggtttttgaaatatgctacttcgaatttttttttccgatttgtttcatattttttcaaatcaaaaaattccaaattttcaataactctcagtccatatcactttcttgttttccctctccaaaaaatgccacgtcattccccccgatgtgtcagatgtcaacttgacacctcctacacttgggggcaatttaaatttccaacgggctgaaatattccaccgctaatgacgtggaaacttgacacgtggcaatttgggttactgtagttttgtatttaaaacttttttcaggttcgtatacatattggcaagtatgatggtgatcggagtgattggaaatacgttggtcgttgttgtagtggcaactaataagtctatggtaggtcggatgggaacagggaacagggggaacagggtagtttgtagcatgtttcacaaa

SEQ ID NO: 28979 - DNA, 1119 bp, Caenorhabditis elegans
atgagtgtagtgtcgaatcatcactcgaacggaaacggcaactcaacagtctacgatacgaacggaaacgatgaaatcaaaaaagaggtgaaagatgagccaatggcatcagacagtgaagttccattcggtgaactgatgaaaagagataaaaaagaaaagaaacaaaagaagaggaaagctgaaagtggatcagatgaggatgattataagcccgagaagagaaagtcttcggcgaaaaatgggaaaaagaaggatgttggaagtgattctgaggatgattataagcctgaaaagaagaaaagcaagaaaaataataagaaaaaagctcaggagagtagtgaggatgatgatgaagaatcagaaggagatgttagtgaagaggatgttaagccacaggtttgtagcaattaataacattttttcctccaaaataacctatttgcacgggtttttggcgatgaaaattcactttttttttgctaaatttcatccaaattatgtttttcaacacaaaatttggttttaaagttgctccacgaaaaaaaattagctagttcccattttctttgttgcagagagaattattcgctttataagattatgtgaactcaaaacagttgaaaaatgcaagaaatacgtaaaattctgctatttttacattaaaattgctgaaatttaggtattttctcgcaattttgaattgtttggatgtacatattccttgtgaaaccgatgtgagcaagaaccagcatttctacaagattttcaattagatagtaataatatgtgttaataagcatattttagatggaatttagcgaaaaataacccttctaaccctacttttctgcacgtccttaacatttcctttgtttcgttagtttttttctgcttttttagatccattccgacgatgaactagaagaagaagacgaagctccgacgacagatgatgaagaggaacagaagagaaaggagaaagagcgtagaaaaaaggaaaaaagggagaaaaaagagcgaaaagagaagaaacgactggagaaggagaatcggaagattaaggaagaggacgacgaggattcggatgatgaagatgatgaaaaggcgaagaaaaag

SEQ ID NO: 28980 - DNA, 3091 bp, Caenorhabditis elegans
atgagtgtagtgtcgaatcatcactcgaacggaaacggcaactcaacagtctacgatacgaacggaaacgatgaaatcaaaaaagaggtgaaagatgagccaatggcatcagacagtgaagttccattcggtgaactgatgaaaagagataaaaaagaaaagaaacaaaagaagaggaaagctgaaagtggatcagatgaggatgattataagcccgagaagagaaagtcttcggcgaaaaatgggaaaaagaaggatgttggaagtgattctgaggatgattataagcctgaaaagaagaaaagcaagaaaaataataagaaaaaagctcaggagagtagtgaggatgatgatgaagaatcagaaggagatgttagtgaagaggatgttaagccacaggtttgtagcaattaataacattttttcctccaaaataacctatttgcacgggtttttggcgatgaaaattcactttttttttgctaaatttcatccaaattatgtttttcaacacaaaatttggttttaaagttgctccacgaaaaaaaattagctagttcccattttctttgttgcagagagaattattcgctttataagattatgtgaactcaaaacagttgaaaaatgcaagaaatacgtaaaattctgctatttttacattaaaattgctgaaatttaggtattttctcgcaattttgaattgtttggatgtacatattccttgtgaaaccgatgtgagcaagaaccagcatttctacaagattttcaattagatagtaataatatgtgttaataagcatattttagatggaatttagcgaaaaataacccttctaaccctacttttctgcacgtccttaacatttcctttgtttcgttagtttttttctgcttttttagatccattccgacgatgaactagaagaagaagacgaagctccgacgacagatgatgaagaggaacagaagagaaaggagaaagagcgtagaaaaaaggaaaaaagggagaaaaaagagcgaaaagagaagaaacgactggagaaggagaatcggaagattaaggaagaggacgacgaggattcggatgatgaagatgatgaaaaggcgaagaaaaaggtgttgttgatgtggattttcctgattttgcatgctttttcccgcttttttttgcacaaaaaactaatttgcaagctaaaaatggtgtcggtttacgcagaaattgtgtactacacgaggaaaagtgtgaatttaaatttatttagttttttagctgaagttctcggatatttagactttatgccaaattcttctgaaaaattgggtgtttaatcatttttaggctaaaaatcggaaattttacgattttttgctcaaaaaattgaacacgatgcctgcgtaaatcgacattacatgctgctccggaaattttaatgtaatcgaaaaaattaaaagttaatccaaaaaaaaccacttccgtctaacctgaattacccaccagtaatatattttctcaaaaaaaaaatcaaaaactgttttctaaccttctacgagatactttaaataattaaatttgcacgaatcataattttatcatttatttttgcagaaacgaaagtcaaaaggagctgaaaagagcaagccaagtacatcaaagaaagacgccggcggcaaaaaagagccaccaaagaagaaagtgaagaaagaggaggatatagaagatatatgggaatggtggaaagaggaaaagaagcctgcaggtgttaaatggaattcccttcaacactgtggaccactattcgctccaccatacattccacttccatctcatgttcatttcaaatatggtggagagaagatgaagctgactcttgaaacggaagaaattgctcaattttatgctggtgtactggatcacgagtattcgacaaaagaggctttcaacaagaattttatgaaagattggagaaaagtgatgactgtcgaggaacgtgaacgtatacatgatctgaaaaagtgcgattttcgagctatcgatgcttatcaaaaagagcaacgggaaattcgcaaagcgatgactaaagaggaaaagttgaagattaaagaggagaaggaagcggaagtgaagatttatggaattgcaataattgatggtcatcggcaaaaggttgcaaatttccgaattgaacctccaggagtgttccgtggaagaggtggacatccgaagatgggtcttatcaagaagcgtatcatgccagaggatgtcatcataaattgcggaaaagacactgaaattccaaaaccaccacctgggcacaaatggaaagaagtgagacatgacaatactgttacgtggctgtgctcttggactgaaagtgtgctcggacagaataagtacattatgcttaatccatcttcaaagattaaaggagaaaaggactttgaaaagtacgaaacagcgcggcgacttaaaaagaagattggtggaattcgtgagcggtatactgacgattttaagtcgaaggagatgagagttcgacaacgtgctacggctttgtattttattgataagttggctcttcgtgctggaaatgagaaggatgtagatgaagctgctgatactgttggttgttgctcacttcgtgttgagcacattaagctcttcgattcggcgaaactgaatgaagatgataagaaggaaaaggagtttgttgtggaattcgattttcttggaaaggattcgattcgttatttcaatcgagtttctgttgagaagcgagtctacaagaatttgaagatattcatggagggaaaagctccgagtgatgatcttttcgatcgtctcgacactgcaacactcaatgatcatttgagaagtttgatggatggtttgacggtaaaagtgttccgtacctataatgcttcgatcacacttcaagagcaactgataaagctgacgaatcccaaggacaatgtggcggcaaaaattctgtcatacaatcgtgctaatcggcaggttgcgatcctttgtaaccatcaacgtgccgtttcgaagggattcgatgagtcgatgcaaaagttggagcaaaag

SEQ ID NO: 28981 - DNA, 213 bp, Caenorhabditis elegans
atcgaagctcgaatgtcaatcgaacagtgtctggatcatggatggttgaaaggagaacaactgtatcgagatttgagggatttggaggttcgactaaacacgccgaggtaagtgcgctctattaagaattctttttgaaaaaagttcaaaatttacagatacctgacaagtccccaggatgatatactatatgggacacttgtgaatccgtga

SEQ ID NO: 28982 - DNA, 1638 bp, Caenorhabditis elegans
aaattcatgctaaccggaatgtggattgccacctgtaagcctaatggcgtagaagcgcagactcagctgtcctcggtggccaactgtatccagggacttgtcaaggcagagttggcgttgagatggtcagacaccccacatggacagatctacaacataatggacaagacccccgttggcactttctctttctggacccctctaaacattgctctggggttctccagctcgatgatcacagttccagcgacccctattcgattgttcgcctatttatctcaaatcatcgcggatcgaatgcgtattgacccgattgttagtgtgttggaagttgatttgcttcttgttaacaatacatttaacattgagaaggccgagcgggacctgggatatgaaccctcggtttcagcaattccagaggtaggcaaaattaatacctacactatcaacgaatgttagcaacattatagaagtcgaaaaagtattaagtctgaatcaaggctgttcgttttggaaatcgaaaaaaatcgaaaaattggctgccacgaccgatttatttttttttggtaatttaaaaattttctttgctgtacgtctggttgactaattgttgcattacaaattgttttggctaaaaataatggtcaaggttttcgaaaattgagctggaagtttgaaaatcgaaaaatcgaaaaagaaatcgcctttaatcctttaaaaaaaatgaattaaaacaccttgaaaaggaaaaaagtcacccaggtgtacaataaaaaatcaatttagattatcagctgaatagttcagttttgacaaactctcttggtctgaatgtatttttcatagtgtcaatttaatagctacatacatatgtaaatcaatcgttacatctattaaatatttgtgaaattttgaatatttattttcataagatttagtaatcgtgtataaggaaaaaaaaactacaaaacaatattacacatagctaagcataacgaacacagggaatacaggtaataccaatcatgaattgtatgaatgtgaaggcattattattatattatgtatccactgattatgattaatgatcattttgtttcaatacacaatagaattaaattcacatttatcataaccagtggatacgattataaagccttatacattgatacaattcaagattagtattaactgtgttcactgtgttcggtatacttagtattgagtgtttcgagttggacggttgtactgggccccttttttagtaactataacaatcctgaaattcctttccagaaaattgagttgactgtcattagaaaatatataattgattcttgatgttgcaattctttttttttttgaaacttttagttgagccagtaggctctaggacgctctaggtaagcgtataggatgcatcgacattatcagaaacactttgtttaatttcagatcatcgagcactacctccaccgtcttcctccagacgtcgtccgtcccaaaggccgctctgacttctatgtcaaagtcgccgtacttgtattggggaccattttgatcttcgtcgcggtgttcagttttactttttggatgtacttgatcttccagaggctgagcagatggaacccattctaa

SEQ ID NO: 28983 - DNA, 96 bp, Caenorhabditis elegans
acggaaaccctagtctacgctcatttcgtgcgcaaggcctccaccggtcaagattcatcatcgagcgacgaggacgacggcgaacgctccgattga

SEQ ID NO: 28984 - DNA, 395 bp, Caenorhabditis elegans
cgagccggtattgacaagatcatcccggcaggtgcagatgttcacgacgagctgttcgacccgtgcggctacagtatgaacgcttatatgaatgacactgaccaatacgcaaccatccacgtgactcccgagaaggcattcagcttcgcttccttcgagaccaaccaggacttggtctgcctgtactcgcagactcggaaggttcttcagtgtttcaggtgagtatttagaaaaacttaatgtagttcaacaaagttccttacagaccaaataagatcttgatgacagtctttgccaatgacatttcggagaaggggaaggatgcccagcagcagttgtgggaccgcgagctgccggggtatagaaggaccaatgtgcagtttgtgagacttgag

SEQ ID NO: 28985 - DNA, 748 bp, Caenorhabditis elegans
atgccgtgccagaactttgactattcctataactttaacaataactccggagaggactatcgcaagaagatcgcaattgttggcggtggaaactggggatcagccatcgcttgtgtagttggaaaaaccgtaaaagctcaggatgaggtgttccagccgattgtgagcatatggtgcagagattccagggtaagtagaatctaatcatggctaggatgaaagctattattcattgaatgttgttcagaaaccaggagacctctcgccatccatcgcagagaccatcaactccacccacgagaaccccaagtacctcccgggtcggcggatccctgacaacgtcgtcgccacgtcatctctcctggaagcctgccagtcagcccacattctgatcctagtcgtcccacaccaagggatccctcagatttgcgacgagctccgtggcaagctacaaaagggagcccacgcgatctctctcaccaaaggaatctcatcaagctgtgagaacggggagatcaagatgcaactgatctctgaggatatcgagagggcgttgggagttcagtgtagtgttctgatgggagccaacttggctggagaggtggcggatgggaagttctgcgaggcgacaatcgggtgtaagagtttgaagaatggagaggagctgaagaaggtgttcgataccccgaacttcagaattagggtgacaacggattatgaggccgtggagctttgcggagcactaaag

SEQ ID NO: 28986 - DNA, 416 bp, Caenorhabditis elegans
atgggatcctgtattggaaaagaggatccaccgcctggtgcaacgtcaccagtccacacgtcatccacgttgggaagggagtcactgccaagtcatccacgaattccgtccatcggtccgattgcggcgtcttccagtggaaatacgattgataaaaatcagaatatctcgcaatctgcgaattttgtcgctttattccaatatgatgcacggacagatgatgatttgagttttaagaaggatgatgttagttttttattttattttttgaaactccatatctcattctttcagatccttgaaattctaaatgatacccaaggagactggtggttcgccaggcacaaggcaactggacggactgggtatatcccgtcgaattatgttgccagggagaaaagtatcgagtcacagcc

SEQ ID NO: 28987 - DNA, 652 bp, Caenorhabditis elegans
tttgtacgagctccgcgagaagacctcaatcaccgtgagcgccgcgagcaagtactttgcaaatacgctctatggatacagaggacaaggattgtcagttggatcgatggtggccggatacgataagaagggaccacaaatcttcaaagtcgactcggaaggagatcgttgccagcttaaagtgtgctcagttggctcaggatctctgaatgcctacggtatcctcgataatcactacaagccaaagatgacggacgacgaggccagaaagctcggcctgcgtgcgatcatgcacgccacttatcgggattctggatccggaggcgtctgcaattgtacgtgaagctttttgctcggctattccacaaaatggaccatttttcactaaaaatggcttttattttgtctaaaatttaaattttagacgatttttattcgaaaaaattcttcggataaatgaaaaaattggttcattttgtgaaatctccggccacctttaatctaatcgcttctatttttcatcctccaaatttcagtgtgccacatcacgccaaccgaaaagattcgtcttccaccaatggacgtgagcaagctgtggtacgagtttgccgatgagctcggcagagatatcacctacaacccagtcgagtga

SEQ ID NO: 28988 - DNA, 760 bp, Caenorhabditis elegans
atgcttcttcactctaccaactcttattcgatattcactggtaaaacacaaaaaaatacaattttttcgaaatttcttcatttaaattaatttccagaccatgaagtcgaaactcgaacctctagaatccgctcagcgatgttccccgactggattccaccaacttctgctgcagaagccacaaattcaactacaagcatcgtcgaaatgatgcaaatgccaactcaacagctgaagcaatcagttatggatcttctaacctacgaaggatcaaacgatatgtcaggactctcgcttccggatctagtgaagcttatgtgcgatcatgatgagtcagtggttgctagagctgttcatcgagcttatatgctctcaagggaagatccgaacttcttcaatgcgccgggattcgatcatcgatcttttgtggaagctctgatggctgcgtcgaagagttccaacgtgaatgtccgtcggaatgcgattggagcattgtctcacatgtctgagcaacgtggaggacctcttctgatcttcagaagcggagggcttgctgaaatcattcgaatgctctatgattcactggaatcagttgttcactatgctgtgacaacacttcggaaccttctgatgcatgtttctgattccagagctcaagcgagagctctcaacgccgttgaggcgctaactccgcaccttcataagacgaatccgaagctgctggctcaagtggcggatgggttgtatttcctgttgatcg

SEQ ID NO: 28989 - DNA, 830 bp, Caenorhabditis elegans
gagtttcgtttgaggaaggagcttctctcggagtgccttatcttaccgcttatcgtgcattgtttcatcttgctggtgcaaaggtttgacttttatttattattaaatggttcatagagaatattaaaattttggcaaaaacgtatcaaaattaggaggcaaaatcaatacaaatcaatctttacaaagccaacttgaccatctgttccatctcaaacaaggggcggtctaaaatacgaccatctgctgttccctcccaaaactaattctcttctcagactggcgacgttatacttgtacacggagcatctggtggagtgggaagtgcactgatgcagctggctgcctggaggaacattgaagctgttggcactgctggatctgctgatgggatccggttcgtgaagagtcttggtgcacggaatgtctataatcattcggataagcaatatgtgtcgaaaatgaaaaatgattatccaggaggcttcaaccacattttcgaaatggctgctcacacaaatctgaacacggacctcggattgctggctccacgtggtagagttgcagtaattggaaatcgcgccgagaccacgatcaacgcaagacaacttatggttacagaaggagctgtttacggtgtagcattgggaatgtcttccgaggctgagctcttggactttggcatcaacattgtctcattcttgaaggaaaccgagtttcgtccacttataaacaaattgtatcgtctcgagcaattaggactggctcatgaggaaattatgaacaacaagggagcgaaaggaaatcttgtagtgcaaatcgaacattaa

SEQ ID NO: 28990 - DNA, 208 bp, Caenorhabditis elegans
atgggtaagttcgctttctaaattcaaaaatgattattttcgcatatttttctcttttccagtcgatgtaccacgcaatttccgtctgctggaagaacttgaagaaggacaaaaaggcaagggagatggaaacatttcgtggggtttggaggatgacagcgatatgactctcaccagatggactgcttccatcattggtccaccgaga

SEQ ID NO: 28991 - DNA, 3066 bp, Caenorhabditis elegans
atgcgacgaatactaactcttttgcttcttttcaatgtcgtcaggagctccgaggcaattacgggcggcgttgtcaatttgagaccaaagcagattattaattcaggcaaggttttatgtaccttaagttaaatgcgacgaaagaaaaaccggacgcttctttatctaaaaaaaattcccttgctcaaactaaattcaattgaattcaatgttctatccgctatgattccgactcctgacctcccttacaatagcaagaaagggatgaaaaacgatccgagcatcgctggcgcacgcgcaggagcgcggtgcatcttttcaactatctcacactatccatactctgacgaaacagagtgaaaagttgagaagggaacgatgcatttacacgaaaatggctcattttcagcagaaatactttgggtaaaatgtataggatggcaaaattcggcaaaatttcaaaagttgacctatagctggaaatgatatctttttcctgaaacttttcctaggacctccagctttcctctcacttttttccactgacctcatcttatgccaataatctaccgtagagatctaccgcgcagtcggaccttgtatccccttctcaccaatgtgtgtgtgtcccgaacagcttatctcacttttgggagaacatatttacaatctttttactccctagatgtcacaacctgcctttataaacaatggcgttacgctcgagacctaatcgagtaaatatgagaaagagaagagtattgtttctttttcgagagttgagatagtgacactgtttggttagtatattgctgttacttctcggtttaactaggcactcgagacttcgaatgccgacgcacataaaatgtagaatatgagcgttggttcattagcatgctcttccgaacccgaaacacttgacgtcgttccgctttcaatgcccattaacggccatttgttgcgcaatcaagcctagtttctcgtgctccgggagcccccccttgccttctcaatttcctctctggcatatggtattgttgtcctgcaaccaacatggatcatccggttacgttctctttgcaaatatacatgtgtataccgccaggcgtattgttgttctcaccccctttttgctgtctctctcgacttggcggtaaggaccgaaaaagagctcaaaagaaatctgagcatggtgaagaggtggggagggagacaaaaggagatggaaattatggttgttgcgtcataaaaatctttgagagcaggcacctgtcacgaatgaccctagcaatgtagatgatatttatttatgcaaaacaatcaatcattaagagaatccaagaagatgactatttgaattggcatcagtttgacacctttcaatagggttcgctcttcctagcagcaggatgcaatgggttccaggctaggctggcttgcaatatcaaaaaatgaattgtcaaacagcccgctcaacgtggcaggaaatacataccgtataccagggatgggcgacaattgccattcggcaaattttttgtcggcaagttcggcaaattgccggttagtcgatttgccggaaatttttaattccggcactttgccggaaaaatcgtttgtcgcccacccgtgctgtataccgtacaccttcacgagtgcaaaaatatccgatatgccatgtcaataaaaactgaagccattctgaatatcagtggatttttattgcctgttgcaatagaatactgtaataatttttgatgaatacaaaatcagtatgcatctgaaatttacaatacgacatgacacctcactctcaatcaaaatcaaaagacaagcacctgtcttgtgtcaaatatatatatatgtcccgtttaaatcaatcatggtcttgtcatcacacaccatccttacgcagcagcacaccagatttctaataaagtgtgataaatcgtgttgggttctgctgaatttgcataacttttgaagacttatgcacacacacagacagacatctgtcgaatgaacaacatctcattgatgatgtccttcaggccgacatacgatcctcttcaaaagatgtgtcaagatctaaaccggggagggaatgaagaacctaacggaatagatattcaatcttcgagattccatctatatcggaacatttttgggagaaaaaaactgggtcggcgggacagcaaaagaaaacaaaacatgaaattggtggaaagttaagtaggaggacaagtgaagtacctgggaatatgctggggaagtgtgttgaacgacgaagattagcctactttcttgcatacaaattagttaacctgggggttcataaattctaccatgcttacttgaacgctgagattcggcacaaagaatcataattctcctactccacatcctttttctttataatgatagtcatgatgctccctcagggaataggcgattagtgtagaacacatagtatatgattgcgcgatttcttgccagtcttgaatcctcgggggacatcgtctcccgctttttcttcccctttctcaaacttgtcatcttttaagaaggacatcatggaaaggaccggggaaaagtagaggggttaaatctactaaagatgacctttatacaaatgaattgttgttgggtaataagtaataagcatgacatcccacgtataacgtatgtttctcctctcggcgtccttcaaaaatgaattcgttttaggtaaatgtgtgttcctccccttttttgcatgatatgtccctcaaaaagaggttaccgccgactccctgtgtccaaaatgagatcgttttcggaaattagataaattggaaaccaatgagaaagaggagaggaagaagggtgttcggttaccttctttgatgagtcgaacagatttatgaacaaaaaaaaagaaactacaattaattttcctattaaatacacactttttacagttggaatcggagatcgcttcggtggaattggcacatcgtctgatgaatcggaccacttcaagcttcttgccgccgatggagattcacttcttgttggagcgag

SEQ ID NO: 28992 - DNA, 266 bp, Caenorhabditis elegans
atgtcagatgctgcgacaagacgactgatgaaagagctggctcaactgaaaagtgaggctccagaagggcttttagtggataatacatcaacaagtaacgatttgaagtacgatcgattttttcagttttaatttgaaattaatacgaattttaatttagacaatggaaaataggagtcgtcggcgccgagggaacattgtatgcgggtgaagtttttatgctgcaattcacgtttggtcctcagtacccgttcaattctccggag

SEQ ID NO: 28993 - DNA, 660 bp, Caenorhabditis elegans
caaacggcaaatcagcaaaccgacaatttttcgaatttgtcgacaaaaaaatttgccgaacggcaattgccgcccacccatgattcatacgagtattttctttaactttaatttatagttcaaaataatttcagtcccacactatcccaacgtgacattcaacacctcattgctcgcacctccaatgcaagtgcaatccgtgacgtggaattgtatgaaaattctgctggcctaaatttccacccaaaagttggattcggtctactgaatgcacagaaactcgtggtaatggctgccacgtgggagaatgtggcacctcaagtgacttgcgagaaaatgaatctagcgaatggaataatcgataattcggattgtgacgtcacaaaagtagaacgtgtaattgtctccggatctatcatccatccacatcgaggacaagttcaaatcagattggaatcgccacggggcacaatctccgaactgcttccacttcgtcccaaagacacatcgcgagatcttctcgactggaactttgtatccgtcaacttttttggagagaattcacgtggtatctggaagttgcatgtgacaagtgaagaggatgacgtggatttcagagttgagatgaaaatgttcaaagtggtgggaacaatgtcataa

SEQ ID NO: 28994 - DNA, 487 bp, Caenorhabditis elegans
gttatcgccaagctcgaacaacgcgtgcgtgagctcgaatctgaattggacggagaacaacgccgcttccaggatgccaacaagaacctcggacgcgccgatagacgtgttcgtgagcttcaattccaggttgatgaggacaagaagaacttcgaacgtctccaagatctcattgacaagctccaacagaagttgaagacccagaagaagcaggttgaggaagctgtaagtttattatatcttgtaacctgacattccatcatcttattaatttcaggaggaactcgccaacttgaacctccagaagtacaagcaactcacccaccaacttgaagatgctgaggagcgcgccgatcaagccgaaaactccctctcaaagatgcgatcaaaatcccgtgcatccgcctctgttgccccaggactccagagctccgcatcggccgctgtcatcagatcgccatctcgcgcccgtgcctctgacttctaa

SEQ ID NO: 28995 - DNA, 2114 bp, Caenorhabditis elegans
acttgctcgagaaatctcgtgtcatccgtcaagctccaggagagcgttgctaccacatcttctaccaaatctactctgacttccgtccagagctcaagaaggaacttcttcttgacttgccaatcaaggattactggttcgtcgcccaggccgagttgatcattgacggaatcgatgacgtcgaagagttccaacttactgatgaagctttcgacatcctcaacttctctgccgtcgagaagcaggattgctaccgcctcatgtccgctcacatgcacatgggtaacatgaagttcaagcaacgcccacgtgaagagcaagctgagccagatggtaccgatgaggccgagaaggcatccaacatgtacggaatcggatgcgaggagttcctcaaggctttgaccaagccacgtgtcaaggtcggaaccgaatgggtatccaagggacagaactgcgaacaagtcaattgggctgtcggagccatggccaagggtctctactcccgtgtgttcaactggcttgtcaagaagtgtaacctcactctggatcaaaagggtattgatcgtgattatttcatcggtgtgctcgatatcgccggtttcgaaatcttcgacttcaactccttcgagcagttgtggattaacttcgtaaacgagaagctccaacaattcttcaaccatcacatgttcgtccttgaacaggaagaatacgcccgtgagggtattcaatgggtcttcatcgatttcggacttgatttgcaagcgtgtatcgaacttattgagaaggtaagattgaattgaaattttaaatgtattttgatcaattcttatttttcagccactcggtattatctccatgcttgatgaagagtgtatcgtaccaaaggctactgatttgaccctcgcttccaagcttgtcgatcaacatcttggcaagcatccaaacttcgagaagccaaagccaccaaagggaaagcaaggagaagctcacttcgccatgcggcactacgccggaactgtgcgttacaactgcttgaactggctcgagaagaacaaggaccccctcaacgacaccgttgtctcggcaatgaaacaatccaagggaaacgatcttctcgtcgagatctggcaagactacaccacccaggaagaggccgccgctaaggccaaggagggaggtggcggtggaaagaagaagggaaagtccggatctttcatgaccgtctctatgctctacagagagtctctcaacaacttgatgactatgctcaacaagactcacccacatttcatccgttgtatcatccccaacgagaagaagcaatctggtatgatcgatgccgctttggttctcaaccagcttacctgcaacggagtgttggaaggaatcagaatttgcagaaagggattccccaacagaacccttcatccagacttcgtccaacgttacgccatccttgccgccaaggaggccaagtccgatgacgacaagaagaagtgcgccgaggctatcatgtccaagctcgtcaacgacggatccctcagcgaggagatgttccgtatcggtctcaccaaggtcttcttcaaggctggagttcttgctcatcttgaagacatccgtgacgagaagctcgccaccatcctcaccggattccaatcccaaatcagatggcatttgggtctcaaggaccgcaagcgccgtatggaacaacgtgccggacttctcattgttcagcgcaacgtccgttcctggtgcactctccgtacctgggaatggttcaagctttacggaaaggtcaagccaatgctcaaggccggaaaggaagccgaggagctcgagaagatcaacgacaaggttaaggccctcgaagacagtctcgccaaggaggagaagcttcgcaaggagctcgaggagtcctctgccaagctcgtcgaagagaaaacttctctcttcaccaacttggaatccaccaagactcaactctccgatgctgaggaaagacttgccaagcttgaggctcaacaaaaggatgcctccaagcaactctccgagctcaacgatcaactcgctgacaacgaagaccgtaccgctgatgttcagcgcgctaagaagaa

SEQ ID NO: 28996 - DNA, 70 bp, Caenorhabditis elegans
atgctcaagtttctgaaaccaaaatcgtcggacgagggaagctcgaaggacaacaagaactcggcgtcgc

SEQ ID NO: 28997 - DNA, 70 bp, Caenorhabditis elegans; identical to SEQ ID NO: 28996

SEQ ID NO: 28998 - DNA, 8224 bp, Caenorhabditis elegans
tcaaagaattcctggacaaggcacgcgaagacttcaaacaacgatgggagaatccggctcaggtacgctcgttttttttctttcgagcgatgctgtaaattgttcctgtgaatgtcagttacacacaaacaaaatcgattggctgtggagaagatagagctcaagaaaagctcgttgaatatttaagaatgtaatttgcatatatcactatcgcctagtgagactcattgaaagtcgaaaaagttgtaaaatttcctatcaccctcccttctcgagattttgatgaagtgagtccggaaaagtcggcgaaattcgggtccgtcgggccgggaaaataaaaatgcgctatttttagactgagcccatgcatttcgcacacatacaaacacgcagatatataccaaaaaatttttgagagagagagagagagagaaaacgaggaaaaagcaataacaaaatgagagagagagatgatggagatgaaggtcccaattttatatattttttggtgccttcaactctgaaacatgttattaaattcttttaatgatttcaccgaattttaaattagttttttttgtgtgaaaggcatacgacgaatgatatacaattttctgaactgggtgatcaattgcctcaactcaaaattgagctcaagtttcgtatagaagaaatttcttcatcgcattcagttcctccagaaaccacgttcgaagggttcatactcttgaaggaaatgtatgtttatttactgaaaatggtcagaagcgagcacgccaaatgttaggagtaagagcagaaaaaagatatattcctccacacaaacccaatttaaatttgagaagatttctcggcaactacttctgcttctccgtcatcatcagaaggagcttttccttgtcttctggagaaaaagaaatggcacctcttctatctctctgcacaacagccgcccactctttttgctttctgtcttcatttttcacgtttcgaaaatccaattctgaagtttctgctagagagtgggaccttgaaagtgtttaaaaattgcaacaaaaaagacaaattgcagaccatttctaaaaaaacgcaagttgacctgaactctagcaaaacgccacagattacattcctcatcagatttttaattttctgctacagtatcctctgagacctgatgtatgctcggactttttccgaggccatcgttagtttttccaaccaaatgcctataagcacgctgacatttttttgggtgttcgttaattttgggcagtttctaaaaatagttcatgtacggagaagtagaacatttggaaatcaaatatattttataaatagctctccgtcctcctcgttgtgataggataattttaaatttttgcagcctatggctttataaggaaagtattttggcatatttttagactttgaaaataagttatgtcattcggaggaaaccctcaaaatcgatcacacacaagaacgttcatcagcgtacgggtgcgtaaaaaaatatcttgaattatttttgaaacccataaaattgctccgaaatttaatttaaggatgtgttcctaggtttgcgaaacataaaaattaagattaaacgtgaataatactttcctaatgcaagactattttcaatactttatttttatttaaagatggagtagcgccagtgggaaaaatgttaaaaactactcttatagtgccaaaatggccgaatatcataattaatctttaaaaaaaaatttaccgccaaaaatgccaattgctcagttttgccactcataattttggaagacaacgaaaaaaacaatttttctacatttttatactttaattttgttgtaattatttgtattaatgaattgtaagggtcgaaacatgcgacattgctttggatttcctcaaaagctcatatttttcaaaattttggcaatttgccaatactttgaccgtaaattatgaaaaatctaaaatgttttattatgatatttgcttgttttggattgttataagtgtatttaaacaaaattccgactggggctactccacctttagagaaatgaccagaaaaagtttcatatcgactttttaaagtgaaagtgctcgtatgcagctaaatgttttgtggttgccttaaaatgcgttttccaggaagacgtttttattgcgtaattcaaaaataagttcgacgattttcattgttatgggtaagatttccagcatagcataaatagacttctttaatagtctatcaaatgtgtgccaagttagtttctttgtggtcaatgccgacatccttatagctccaccaagttccttgaaaatccagttcttgccagcggaaatggtaattggaatgattggaatgtgtatgtgttcatctgttttttgtcatctaatccaatcaactcacccactatcacccaattcttgtcaatttcactcccccccccccccacccccccattaatttgtgttcaataggttttttgagatttattgacgagacactcccctgtcaatcctttcgaagaaattatttttagattctcattctgctgatacgtgccgatttgcatttacatattgcttatggacatggtagtattactaaaatcagaagaagaagttcattcatggcaagaacataataaagctagagaaaaactagaagaacaagagcaaaacaaaatcttcggctcagtgatcaaattcagttatcgaaaacacctgccaatattttttatacgcacttccgtgatctttggggctgaatttcagaaatgttgccaagcagccaaaggttggtgttgaaattgagtttctttttattttatttttagagttatcagagctcagatttgagaagccaacctcttgcctagattagaaccaaaaggtcgtggtttctgctcaaataaaggtgcctttatttaagaatgagtacaacaatagcttttggaatttcagatcttcaagcttttaaaagctgtctgctcccctaattttttttcaaagttctggcatgttgtttttttacctatatgttacatacttatatagaaattttcacatatttcaattgataatggcgaaatagtaatgttgttatgaaaagttgtaaatttttgtaaggttacttttttttaatttcagctaaaaaaaaagtcagtaaaagctgttctaaatgtgttttggatacctgtgtcatcgaagtaatagtgatttgcatagattttttgattcatagccaatggatttcatcttaaatcaggccgatgttagacttcaatctattttaagaaatcttctgaaaaataactttttttacttttaataccatcataagtttttgtactacgctctctattgcgaatgcaaacttcatttttaaaatagttccaaaaactaagtggaaaacattattagctgattctgtgcattcgtgacttgagtaaacaaaaattggggccatttctattttcgtccttcctcgctcaaatttttttccattcttctttttcttcacatcgatatcttccactgctcatcgcgtaattaaagtttggggccctcttgccctctagctggctccatgtgccgagagtctcctcattatatagatcatcgattctccagtttttcagcagcatgatattttttacttcagtattagtaaaatacatttttatattataggtggagcagcgccagtggggattttgcctaaatacacttttaatgatccaaaacgaacaaatatcataataaaacactccaaaaaattagattttttataatttcaggttaaagttttgccaacttgccaatattttgaaaaatacgagcttttcaggaaatccaaagcaatgtcgcatgttccgacccctacaaagttttaataaaattaataaaattaactaaagcaaaattaaagtacaaagaatgtcggaaaaaaaattatttttggccgacttccaaaattatgagtggcaaaaactgagtagttgtcattttttgacagtaaataaaaacatttcaaaaaattcttttaaaattttactatgatattcggttattttggcaccattggagtagttttaacagtttccccactggcactactccacctttaataaaaaagtaaaggaaatcaaaaaataaccaattgttcttagcgtgatgttcaactaaatcctacaacaagaacacacctacggctcatttcattatagttgtataactttttcttagaaaaaaaagaacattaaatgctggtgtaattgtaggtgttgcgcttttctcttctccaagtatttttggcaaagaatttcgcccatatatgactggcacgattacaaactgggctagaacatttctattttgtctaggcagcatgaatataacgcaaacatatttaaaataaagcctaaaagcctccttagctgagaccatcgcatcaggcccaaaacgggtatttttataaaaccattgttattgtgatcttagtgtttactttttctttagatgctacatttatgatcttctctttttactcatctcaagtttgaacttgtccagaaaacccatatgatttagcctccaagcccttcccactatttctcccccccccccccctgacgggaccgccccttcgaagtgcacctctgtgtccgctgagaaaaagaagaaccaaatcattttcgctgtctctctctctctctctctctctctctctctctctctctctctctctctctctctctctctctctctttctattcctactctcaactattttgtttgactgactgagtgtctatttttagaattttccgccgccgaagccgcccgccgctcgcagccccagcatcagcagcagtcctctacttcccgtctctccacaccggtggtctctttaggcgctcgcgcacgcgacagtaccctccttggcgttttcctcctaatctagaacactctatcatttccgatctcaatccgcttttttttgctgtgggaccgcccaccttgtgtctcgcgctcaccacgttctatctttccgtgcgtgtgtctctcgttatattcatcatctaatatttttttatttttcaccctctcgcattgtctccaaaaatccctaccgtatcattaataatagttctagtgtgacgtcatcaattaaattcttatgacgacgtctcgttccccaacgccttcctcggaaaagactgacgatgagcgaatggaagaagaagaatggaggcggagactgtcggcagcaatcagacgagaggatgaagggtcccttgaagaagatgaggaagatgaagggtttatcttacatcccctatgccgtactggaccacttcagatgactgtcaaggcatcaaactcaacgacaaccctcactccatcctcaacaacaacaacatcaccgtcgatgccatcgtctccatcagacagcccttcagatgacttttcagatgacaccaacacctcaggcgtttttccattaactacagccttgtcgttccctgttgcgccactctcgccacgtaacacaacatcttccatcacaacaggattagtcaagaaacgtcgtagctcctcgtctccagaagacatttgccgcgaaaaaattccacatattcttctgaaaacctcttctggagtggtggtgcctttagcatcacgtggccagcgtgctcctgccataaccctccagaatccaccaccatcggcagctatccgaacagtgccgccgccaagtttctcaacgttttcagtaagatccttaccattcaaaactccaaactgtggatcgaaagatgatacggatgctgaaaatatggaagggctagacgacgactatttgcgccagccaacaacatcaacaagtgcaccagtgagtcctattgatcatcgacaagtgagacgtggtggccgaggagtggttgtagagagccaggttcccaatttcactgcggagattttttggctcaagacgcagctgtccgatcattggtccatgaagtggctgtttcaggtattttgtttcgttattttttaatggatttttaatgggtaaaagtaaattagccaaaaaaaaagttgattgattccacatgattcattaataatcttatcgaagtagaccaaatatacaatttaacacaataatttcccaatataaatgcgcttttatcgcattaacgcatcccaaatacatatatagaagacgatgaccaaacacctaagaagctaaagagctgagttgtagctcagttcgtgctaagcagaagatatccaaaaatagccattttctgaaggaaaagaggaaaacaacaatttccatctgtcccccatcttgttgcttctcttcatctggcacaaattttgttttaagaaaatagatggtgaaatggggaatgaagaacatttcccaaaagtctatttctcaaatcaaaacacctctatttccgctttatgcattttcaatgtgaggggtctagggaagtgaaaaatccaaaaatagaaggattacgcaataaatcagatatttcgttacgtataagaaggatttagggcaatgtcaaagctttcggtgattctttaagatatcctaagtttcaagagaccctgcactatgttttgaaagtaaatcagtctttgctaaccattagacaaaccatatttttttcaggagttgaaagattttgaagctgttgaactagaactgttatgttttttttcattgtgcggctatgaaagttttgctgaaattgtgatctgttatttatatatctaattaaaaaccaatcgactgacccaccttccatgacaaaatttctatcattgtcaatgatcaaatgggttgatttcttctatttcaacgccatcaccttatgacctaatcaactctttattgactaacttgacaaatggagatgatgacgatctctgtatgtgtaattatcccctatcggctggccccgagaatagaaatggaaacacgcaacaatagtagttgtttttaggtgaacatacacacacattgtttacatagaaactcgcaaatttatccctccgactgttttttttttcgttcaattccaacatgacagtatactataataatttcaactttgtgagtttataacattttgatatatttatcgattttcctctcctacgagcctacacacaaggagaggaagagggggccccaatacgtttccggggaattgcaatacaaacaattgcgctctctccatttctctatctcttgcaatctctttcctcatatgtgtgagtgtgtgtgagtgtgtgtttgtatgttgacacaacatttttcgatttttattcgctgccgctcaccgcgcaggtaaagggacgatggaagaaactgtgctcgctgttcgccaatcttatacaatttacaaacagcaggcttccatcatacaccggtaggcaacaaacaaaaacctgaatagtccaaaaaattaagtacgcaaatgaaggtgaaaaccaaagtgacgagagcttcctataaatacatcggaagtcaagatgcatgtgaaaaaggaaggaagtgttaaggtggtattgcagaatcaattgaaacgttttattctgcttggcgtatgcataaagctctctgaaaatgctattctatctccggcatcgatttagtaatatgccacgcctatcagacgtcctctcactaacacactaatccctgcaaggcccatagttgacgggcaggcacagatggcaatcttatctgcgccagcatcacgtcgctcttctttctcgcgttgctcatctgaaaactcaacagatgacactgctacaacgtcatcttgtacctcttgttcgtcggacgacgatgaggaggaggaggaggaggaggacggttccgaggagatcacctcttcctcttcggaaaatagttgtgagagttatgatgacgaagaggaccgagaagaccaatctttgactccacagccaaatgtttgtgtgtttagggtgtagaatttaagatcatgcatttttttgttgtgaaaaatttttaaattttcagaacacggcgtgtcttgacgactttgataggataaaaacccttggaaccggatcattcgggcgcgtgatgcttgtgaagcataagcagtcgggcaactattatgccatgaaaattctagacaaacaaaag

SEQ ID NO: 28999 - DNA, 8224 bp, Caenorhabditis elegans; identical to SEQ ID NO: 28998

SEQ ID NO: 29000 - DNA, 457 bp, Caenorhabditis elegans
atgcggctgctaattctcaatatattatttgtggtttggcaaatacatggcgtcatcggacagagtacaaatgcagctgtggtgtcaacaaccgcggcgccagttaagtaagttctgtaaaatattgatgatcaagaacctaggttgaaacttattgttagcttatggttcagcggggtcatcatacacaaatttaaatactatttataattttagaccagccacttatatgcttgtcgccccagcagtagtgcgacccgatcaaccgttctccgtttgcatgaaccttctgaaacaagctacggatgaagacatgattgttcggattgaagtgagaactgaacggaacgagacgattgctgctcgagttataagcaatttgaagccgggaatcgcacagactgtcagcttgagtgagatgcctgctcaatcactaactcctaggcaaagctataag

SEQ ID NO: 29001 - DNA, 457 bp, Caenorhabditis elegans; identical to SEQ ID NO: 29000

SEQ ID NO: 29002 - DNA, 1500 bp, Caenorhabditis elegans
gtatgtatgcagtaacgtgccagcaggaattctatgttttctccccagctatcgagttctagatcaattaaaacaatgtatgatccgtaattcaacaatgcgacaaatcgaaatgaaaaaagttgtgctctacgagccgcgaagatcctcagaattaacatcagtaatggatcaattcgatgcggcgatcttcgatccgtctagattcggtgcaaacatcaacggatctcttatgtttgccgtttttcgtggaaaagtttccgagggcattgattttgccgatgatcgtgcgcgtgtggtgatttctgtcggaattccgtatccaaatgcgatggatgatcaagtgaatgcgaaaaagttgtataatgatcagaattccaaggaaaaggggattttgactggcgatgagtggtataccacgcaggcctatcgagcattgaatcaggctttgggaaggtgaatatatatacaaagccgcgtggaataaaaactacgttttttttatttaaaaaatgttatgctatgctacaaatgttcaaaacacagcaattttctactgtaacacataattctgaaatttgcgcaacatttttgacgcacaaaatatctcgtagcgaagactacagtaatcctttaaatgactaccgtagtgcttgtgtcgatttacgggctcgattttcgaatttcctaatcgaattttgacagcagtatttaatttgtctttttttttctgtattgttttgtcatttttgtgttaaaaaaaaatatttaaatgaaaaacgtccaatattgccttataggaaactcatacaatcgtatttttacattattttccgtctattgccgggtttcacctggaaaacctgcaatagacgggaaataatgtaaaaatacgtttgtaaataggagtttcctcatcaaaatgaaggcaatattacacgtttttttctattaaaacagttggttaatgaataaaatttttttaagtacaaaaatgactaaacaatacgaacaacgaaggaaaattgaatatcactgtccaaattcgaaaataaaatcgagcccgtaaatcggcataagcgctacttttaaagaaatactgtaattttcgctgcgagatattttgcgagtcaaatatgttgtaaaatacgcattctcaggatttagtgttcccgtaatatcaaatctataatatcacgtgaaataagggaatcagtagaaaaaccatctggccaaatttcactacaatctaaaattcattaaatcttcagatgtctccggcacaaaaacgactggggagcaatgctaatgatcgatgaacgcctagaacgtcaaactggaaatcttgtgggcggagcctcgtctgctcgtgtctcaaaatggattcgtgctcaactgaaaagctatccgagttttaaagaatttaatgcgaattttcgcgaattcatccagcgtcgacacgctgttgagaaagcaaaaaaagagaatttttgtgaatga

SEQ ID NO: 29003 - DNA, 1262 bp, Caenorhabditis elegans
gttttggcgtttgtgattatttgtggactaacctatgcagacttttcactctggtcaggaacataccaggatggtcgttcaaaatttttcccgtatggaatacaaggagctatttctggcgcttccacatgctttttcgcatttatcggatttgaagctttagccactgctggagaagaagctaaaaacccacatagaacaatcccactggctactttcacttctttggcaattataagtgtcatatatgtacttatgggcgcctcattgacgctgatgataccatacgacttagttgatcctgatgccgcgtttgctgctgcattcgaaatgaaaggagcaactgttgccaagattataatgagtgttggtgcactagcgggtatgttgaacaatctagttactggatcattcgctcttccacgagctgtatatgcaatggctgatgatggtcttatcttcgggtggtttggggtgataaactcaaaaacaaaaacccctctcaatgcaactattgtgtttactataataaacgcaattttggcactggtcttcgatctgcaggcgcttgtcgactttttgtcaattggaactctgttggcttattcaatggtctcaatctgtgttattattttgcggcatcaatcccatcttgtagatggtagtgcaactgattatgataatggtaagattttataaagcaacacacacgtgtttagcaaaattaacaaaataaaaattttaaggcggatgcctgaagtcgtgggtaccatttcaaggtgtttgggaaaatttctcagaggggatttcaattcgcgtagctgtcgcaggattaatttttggttatatttgcctggcaattccattcagaacaggaatatttagcaatgctggtggtattattttattgacagtcggtgctgccttttcactgttatcattcgtttttattttgggccatgaacagaataagtcaacatctacgtataaggtgaacagaaacattttacaaaaaataataagttcaaaagtttaaggtgccacttgttccattcattccatgccttggtctactcatcaatgtcttcatgatggtgtatctaaactcaatgacttggattcgtctttttgtatggttggcgattggcattgtaatctacatttgttatggtatccgtcacagcaaagaaggtcaaaaattgagtaagattgatgtacataatgagattatgtcgagaacctctgatactaaagttcactga

SEQ ID NO: 29004 - DNA, 1297 bp, Caenorhabditis elegans
atggttgaaccaactggtcccgccatcgtagaggatgaacgcactaaggcgctcaacagctatagaagaaaattggcagagtgccgtgacattgaacagaagttgaaggacttgcgaaaaaaagaaagcgagatgaccaaacaatttgacaaatccgagaacgatatcaagtcgttgcaatctgttggacaaattgtaggagaagtgctcaagcagctcagtgaagagaaattcatcgtcaaggcaaccaatggtcctcgttatgttgtcggatgccgtcgcagtattaacaaggaagagttgaagcaagggacaagagtttcgttggatatgacaactcttactatcatgtaagcttttagttttttaaacaaaaagtcttaaaccgaaatgtttcaggcgtcagctgccacgtgaagttgatccgctagtctacaaaatgtctcacgaagatcctggtaacattagctattcagatgtcggaggactcgctgagcagattcgcgagcttcgtgaagttgtggagctcccactcatcaatcccgaactctttaaacgtgttggtatcactcccccgaaaggatgtctgctttttggtccaccgggaacaggaaaaactctccttgctcgtgctgtagcatcgcaactggattgcaatttcctgaaagttgtctcgtctgctattgttgataaatatatcggagagtctgcaagaatgattcgagaaatgttcaattatgctcgtgaccatcagccatgcattgtcttcatggatgaaattgatgcgatcggtggaagacgtttctcagaaggaacatcagcagatcgtgaaattcagagaactcttatggaacttctcaatcagctcgatggattcgattcgcttggaaaagtcaaggttattatggccacgaatcgtcctgatacattggatcctgctcttcttcgtcctggaagacttgatagaaagattgaaatcggactgccaaacgaacaatctcgcttggaaattctcaagattcactcgaacaagatcaccaaacacggcgaaatagattttgaagctgttgtcaagttgtccgacggattctcggctgctgatttaagaaatgtgtgcacagaagctggtgaggagttgaatcataaaaattgcattcaaattatcatttttgtttcaggaatgtttgccatccgtgctgagcgtgaattcgttatcgacgaggactttatgaaagctgttcgcaaggttggagacgcgaagagacttgagacgaagctcgactataaacctgtctaa

SEQ ID NO: 29005 - DNA, 890 bp, Caenorhabditis elegans
atgtgcttctcggcgcttcgagaacgtgtatttcgtctgaaaaacttgccggctggtgagatagcaaccccacttcgaagatgtctgagtacttttgacattactcttcttggagttggccatatgattggcgctggaatttatgtattgactgggtcggttgtcagaaacactgcgggaccatcaattattctgtcttttttgctagcaggtaagtaaacggcggcttcagtaaattatttccatttttcaatattttttaaggttttgcatctcttctctctgctttgtgttatgccgagtttggagctaggttcccaaaagctggaagtgcatacacatacacttatgttggagttggagagctatgggcttttgttattggatggaacattatactagagcacatgcttggagctgctgctgtcgctagatcatggtctggatacttggattcattactgggaaatgttatttcaaattcaacaattgctcgcactgggcacttgcatgaagtaagccagtaaatgtttttataaaattttgaattcgaaattccaggcttcatcatttttcggcgattaccctgatcttctcgcttttctactcatcgttcttgtggcattttttgttgctcttggttcaaaagtgtccactaacttcaactctttcctaacaattctcaatattggaattgttgtcatagtcgtgttctatggtataacgtttgctgatttctctctatggagtggagtagatgagaaagggaattcgagattctttccgtatggagtatctggaatgtttgctggagctgcatcttgcttttttgcatacattggatttgacggacttgcaactgctggagaagaagctaaagatcctgcacg

SEQ ID NO: 29006 - DNA, 442 bp, Caenorhabditis elegans
tatcggttgtcatcacatttttcatttgctggcttccattccatattcagcgacttttatctgtctatacgacgtggtccgaaaccacgacaatatcacctccggtgcaattcctatctatgattgtcttctacatctcaggattttgctattattcaaactctgctgcgaacccaattctgtacaacattctgtctcaaaagtatcgaagtgcattttgtcggaccattctaggggaccatattgctaattttgtgtttaaaggtcatcagagaccagggcagtcaaagtaagttcgaagcgtgtttgacataaaatacacccagcaacaaatttcagaagatgctcttcctcaacagaagccgaacaaagaactctcatgacacgtggaagtgtacgtgtagataagccccatcgtaaattggaagtacacaactactga

SEQ ID NO: 29007 - DNA, 949 bp, Caenorhabditis elegans
atgtccagcgcaaaggttcaaatttgccacgtggaaactcggggcaatgaggcttcacacgacgtgctcctagcgtgcaaggctactaaaaaccagttaattcactcggcagagctgctcacgcaaaaccacgtggcgctcacgaaattctcgattttcgccaagaaactgtccgatgagaagaatcaatcacaaatctggtttccccgtcacatcagtgagctcgatcaatgctcgaagtgcattacaaagtacgagccaacaacggatccacgacatccgggccacggcgacgtggcgtatatcgcgcgtcggaaattcttgaatgatcaggcgttagagttcaagttgtaagcaagttcacattacaataagtccaatattctaatttttacagtggtgacgagataggctacgtggactacacggaggaagagcacgccacgtggaaggctgtctacgagaaattgggtgatctccacttatcccacacatgtgcggtatatcggcaaaatttgaaaattctccaagaggagaaggttttgacagcggataggattcctcagattcgagatgtgaataagttcttgcaaagtaggttttgtaggaatactgtcatgaatcggtagatcattttgaaattccaataaaagtagattcaatacaacttttttgcagaaaaaacaggattcgagcttcgcccgtgctctggactactgtcggctcgcgacttcctggcctcacttgcttttcgggtcttccagacaactacgtatttgagacatcataagtcaccgcatcattctccggaaccggatcttattcacgaactacttggccatgtgccaatgttctcggatccactgctagctcagatgtctcaagacattgggctgatgagtttgggagctagtgatgagcacattgagaagctgtcgacggtttattg

SEQ ID NO: 29008 - DNA, 634 bp, Caenorhabditis elegans
atgtccaacgaaggaggagtgccaaatgtcgtgaaattcgcgttcggaggaaccgctgggtgggttttcggaatattttcagtttaaaatctttaaattgtcttgaaatcgtcaaaaaatattcaatttttgcagaatgggagcgactttagtggtacaaccactagatttagtgaaaaatcgaatgcaattgtctggaacaacaggaaaaaaggaatatcgttcatcaatgcacgcgttgacatcaattatgaagaacgaaggagtttttgccgtttataatggactttctgccggacttttgcgtcaagcaacgtatacaaccacgagattgggaacttatgcatttttattggagagattcactgaaaagtacgggaaaacacactttacagctaaaaaatagcagaaaattgactaaaaagcgcgaaaaatgttcctttttctttgaaaaattcaatttttctttaaaaaattttttttagagacaagcccctatcatttggaatgaaagctgttcttggaatgacagctggtggtattggatcatttgttggaacacctgctgaaattgcacttattcgaatgactggagatggacggcttcctgttgaacagcgtcgtaattatacag

SEQ ID NO: 29009 - DNA, 586 bp, Caenorhabditis elegans
atgttcctttttccacttgttttggggtttttgctgccagaaactctgaatacttttgtactcgaaatccaatttatgacacgttgtatgacgcaccatgatgcttgggtgagaaatttttaaagttctaaaatttgtttacaattttgaattcccagatttacaacggctacgggtgttattgtggaattggaggtagtggagacattttagatgatattgacgagtaataatttaggttcttcatgttttcattttcatatatacctaattttatagatgctgtgctaaccatgacaaatgctatgaagaccttgatctcaaaaaaacatgctggacaactccatttgaatactttccaatttactcctggaaatgtcaaaatcaaactattcactgtgatacactaagtgaggcatctgatcatccagtcttagctcacgagtgcagtaatcaattatgtgaatgtgatcgaaaactcgtggagtgttgggcaaagtacccggagccaacaggacagctaaagtgcccacatcccaggctttcccggtttttgctgaaattgcagaagaagatgttgagctaa

SEQ ID NO: 29010 - DNA, 1877 bp, Caenorhabditis elegans
atgcaagacgccgtcgtcttctccaaaaaaagcagcatcacaagcggcggaaaaaaagaagaaagtatgcgcggggagaagccgagagatttgcctctttctccatctccctctcagtctccaatacttgtacgtcttcatgtgctcggagttgtcttgctccgcgagcacccgccacttctttttcttcttcttcttttactccgtaacaacacaagaatttggaatttgcgtgtagtatgtagagaaggaaggaggaggaggcgagaagcccttgggaattctttttttttttcgttatttagttgggcggcgcaaacacactgagattggcttaaattgatgtcaaatgtttattagggaatttttttttgagaaattggagaagaaaaaattttggccaaaaaaaatttttgtttttaaaaaaatttgacgctgatgtgaatggttacctcttttgaaatctggaatcaatctgaaaatgagaagtttctgaaaatcagggaagcaaaataatgacgaaaaaaattcagttggcttttttttgttgcaaattttccaaacccctgttttaaaacttcccaaattatttttcaactacatttatgtacaacagatcaaaagtaaaagttatgtctagaaacagtaagttatttttaagttattttttgtgagttgtgagttagtgtgagtcaaccattgtacacacacagcggtgagaggcgtcggcttgaggcatgagggttgaggtccgcatttcgcgccttactcagctgggaggcctactttgcatcatggaaagaagccatgattcttatcagtaatttttaaatgagtttaaaatgggagaaggacatcatttgaatttaaagaaacacgatatgagttttcgattgtaatgatcgaatgatcaataacttctataaacacaagatattaaacgttttttaaaggctttgcactgggatccaggagtcaggtaggtagcaatactgctcccactggatttcagttcaaaaactggaggtaaactttgaaaataagtaaactctgttattaataaaaccagtaaaactgaaataaagctggaaaattttcagaaacagaacggagaaattgctatgattcaaaatgaattgaatcttggaacatttttcaaaattacgtctgaaaatccacaatgtgtaaagtaggggaaatgtcacggatctatgagactccctacagtaacacaattcacttcactttgatgtttcctttttccattcctcattcatgtaacttcattgaccaatcatgcttaatatctacaactctggtgattgtagatgtttcatttcattcggaaactcttatcgtagctcgttaaatttgaattattccgccagcttaaaaccattcaaaactgtctgataagaatcacaacttcctttccatcatgcaggcaatcgctgctctgcttcttatttggcttgcaaatgttgcaatttcatccaacaccccagtttgtaaaaatggattcacactaattaacaacaagtgtttgcgtcttttctacgaagaagtaatccacagagatgctgaattatcatgcagaaactatggtgcaacacttgttacggtcaagaatgctcaagtaagtagatactttattcgtattataattcgacttctaaatggagcgaatataatacacaagtacatattatcattttcctgactgagccaaaggtttcaggataatcaagatgttgctactattgctgggagtgctaaacttatttggctcggcctgtcttgttttgaagatagttttggaaaatgtttctgggatgatgcatccggctcggcaaacagctacaacagtttttctgggg

SEQ ID NO: 29011 - DNA, 687 bp, Caenorhabditis elegans
atggcacccgacgaagtcaccaaaaagaagcgaaaatcggtgaaattcgccgaagaagagccaccaaaagtgaaagaagcacctaaaaaacagaaagccggcaagaaaatcgaggtttccgtggagttgcgcgacaaaaatgaggagaaaatgggcagaaagagaaaacaccgaatgaagaagagtcaggcagagtaagtcgatattttgggttgcagaaaaagaaaaaaatgtgttataataatttttcagaaaacgccagaagcttatggaaagcctagttggtcctcaagtcgatgagatggatttcgagccggagcacaagacattcgcggattttggtctggatgagcgtattctgaaggtttttttttgcaaatttagacttaaaatattagaattttcttgcagagcatcggagaactcggctgggaaaaggcaaatcaagtccaagagtctgtgatctctctggcactggaaaacaagaatattatgggaagagctcgtactggatccggaaaaaccggcgcttttctgattcctcttgtgcagaagctgatcgccgaatccaagacgaatgatggatcagttggaccatctgctgtgatcattgcacccacaaaagagctcatcacacagatttataagcttttcgtgaagctttcgcaggccttgccgtttttgcag

SEQ ID NO: 29012 - DNA, 842 bp, Caenorhabditis elegans
tgtcaaaaagtggctcaaactcggtatgaagcagctctggaaattgccggcggcgaacgtcttgtttccggatccgacgattttacactatttatgtggaacccgaaagagacgaaacaatcgattaatcgaatgaccggacacatgcaattggtgaatcaagtcgttttctcaccggatacacgttatatcgcctccgcctcattcgacaaatcagtgaagctctggtgtggaagaactggaaaatatttggcttctttgaggtagaaatgcagaaattaccgagaaatccctgaaaagttccttaaaatgatctaaaatagcagtttttctttcaaaaatgacatttttagtattggaaaacacgaaacacacaattttcagtcagaattacctactttgagcctaaaacaggaaaacaaatttcgtacagcaaaattcctcctttatgcactaaaaatgaactacaaactacaaatttcgatttagcagacccgagtggttgggtctgctagactacaatctacaaatttcgaacgattttcgagaattctcacttgaaaatgggtcaaataatttttcagccgaaaacttccttaaatttacaatttttcagaggacacgttggcccagtctatcaagttgcatggtctgccgacagtcgtcttctcgtctccggatccgccgattccacgttaaaagtgttcgaattgaagacgaaaagtctgtactacgaccttccaggccacggagacgaagtttttactgttgattggagccccgagggaacgaaagttgtgtcaggtggaaaggacaaagttttgaagctctggagacaataa

SEQ ID NO: 29013 - DNA, 642 bp, Caenorhabditis elegans
gtggtagaagccaagcaggagccaatgatctacgctattcgatttggaggagttttactgacatgtaagtgattaagtaggaaaatttttagcttatagttaaagcatgaaaatttaaaaaattcaaaaaattgtttttcaaaaaaataaataactccaaaaatgttttctccaaaaatcaaaaactctcacaactttctttaatatcaacattttttctaacaaaaaaaaatttaattgattaataataattataaaaagtaattttaaaaatttttctaaatttttattccaaaaatcaaaaacccctgtaactttcttcaaacccaacttttttattcaatttttttttggtaaatatttcaaaattatcaaattttattatttttaggcgcaatggctcaattaatcccccaccttgccctattcatctccttagtcggaagtgtcgctggaacatccctaaccctcgtctttccaccactcattgagcttctatgctcttattcgaaacaagaactcacaaaatgggtttggataaggaatattggattgatggcatttgcaatggttggattcacaactggaacttatgccagtatggttcagattattgaggcttttggaaaagaagatatctag

SEQ ID NO: 29014 - DNA, 457 bp, Caenorhabditis elegans
accgtcagtagaccttccaccagcctacgtcagtgcattcaatgatatggtgaagagatactccgaagatgcggcgattactctgctgaaccttccggtacctccagataatgcagatatagatgctgataggtaggtgtagacgcaaataagcctacctgcctgcctacttcgtgccttcctacctataacctgaacttgaacgattaagcttgaaattgaaagtaaaccaaacgtacaacagtcatgagagtttgcacgagaaaattgtaaatagacaggcacgtagacagttaggcacgaggacttgtaggcaggcaaggcaggcacccaggcctagtctcaaataaatctttcaaatttcaggtacctggaaatggtgcgcaacctgactgacgcccttccaccaactcttctagtccacggagtctcttcggttatttctacggccttataa

SEQ ID NO: 29015 - DNA, 849 bp, Caenorhabditis elegans
attcataatgtggtgattaaacgtgtatccaacaagttcttatgtgaagctgcacgtccttttgcatctgtaaccgatctcatcacctactactcaaaacacactggtcattgctcttctggaaattttcaactcaagcacccgattcttcagcaatcatgggaatttatgcattcggatgtgacagttggagatgtcctaggtgaaggagcattcgaaaaagtgtgcgctggtgaattgaggctcaaagatggaagttcagtagaagtagcaatcaagatgaccaacgcatctgcatttttgagcaaaatgaagataaaagagatgatgaatgaggcaaggttcatcagaaacttttctcataaaaacgttgtacgcctgtatggagttgctcatgacgagcagccactgtacattctgcttgagttggtcaaaggtggatccttgcaagattacatgaagaagacgaaatcggttcctttggcggatagaatcaatttttgtcttggagctgcaaaaggtcttgcgtacttgcatcaaaactattgtatccaccggtgagcaaatttttgttagaaaatcgaatgaagatttttcagggacatcgctgcgagaaattgtcttcttcacgagaacgaagtcaagatcaccgatttcggattatctcgtgctggaccatcttatacaacaaagacatcttgtaagcttccggtaaagtggctcgcgcctgaaaccttggctactctgagcttctcatatgcaactgatgtttataggttagttttatcaactatttcaatgataaataaatattcttcggtgagtcacttgctacgaagtcttcgttga

SEQ ID NO: 29016 - DNA, 663 bp, Caenorhabditis elegans
gcaaccccgatgtgagcgtcagacaacatgtatctctgttgcaatcgggaagtttcgctggaaaatgggtgtctaatcaaaacgcgctgttgggatatatatgtcaagttcccttaccgagtagtaccgtaactattgaaactatcaccaccacctacataagaagtacaactacaactccacgtagtccagcacgttgtcgcgatgggttcacgagtatcaataataatgcaacttgtgttaaggtgagttgtttgaatgatttctaaaatttaaatttgaattttcagttgctcaatacaccgatgctcttccaagatgcaaatttggcgtgtcgaaatattagtaaactaggaaatttggtttcagttcatagcgcacaaacactatggaactcctattccttgcacctacataattgttgcaccacaaaactccattcctgaaattcgattcacggatctgatcatggactcttctaatttgaaaatgatgctctacggagcaattgatgacgtcggcccattcgcaatacttactaacgatgacgtttataagtactacagttcgtatactaacgtgctgaaagtgtccttccagtgcaatccgtgtaattctgatggttacagatatgcagcggattatagaagtgatctggattaa

SEQ ID NO: 29017 - DNA, 547 bp, Caenorhabditis elegans
atgctcaatcaaagtgtgcggtttttggctcgccgagcaaattctcagatccggcgttccaatcttctgaagactgtgagttactagaattttgaggtttcagtgcaaaaaaaattgttcagggctcacttgcagctcaagatcgtggctttttcttcgggaaacgtcgtgaaccaagatgcgatttgaaaaatcaatcaattgttcaagcagatggaagtagaaagtctgcatggctcggagacaaaccacttcgacacgaatcgttcattggaatactgactacttatgcgggggtagatttcagatttaaaaaaatttttaaaataaaacaaataaattttttcagattcgccgcggaccaactgtcggtggaaaagaaatgttagggaagagagtgatgaaaaatggaaaattggaatgggaatggataacgtatgagcaagcattcgaaatatctgataatgtatcacaagctatcagaaagttgggaattgagattggcgataagtctaatattgggatttactcaaaaaatcgaccagag

SEQ ID NO: 29018 - DNA, 470 bp, Caenorhabditis elegans
atgaaaattttcataatatgtctactgcatatatatgctacattttctgtctcccaaattacctcaagagctccttacaacactcaaactcccagctattctggttgccctgatgggtttattgtacttaatgggtacacatgtatccaggttagtagccctacttttttatgtattgtaactgaaattttaggtgagcaccactaagaagctttttatggatgcactctccgattgtcaaagttttcccggtggaaatttagtctcaattcataattctattgtaagttgggctgttttttcggcatctcaatataatttaaataattttcaggacaacaaagcactagccttttcggtaacctcatcggatcccaaatggatcggcctgatctgcactgagactagcagcccctgcaactggacggattatagttccgacacctccagctatagcaattttgtcgctg

SEQ ID NO: 29019 - DNA, 819 bp, Caenorhabditis elegans
atgaagtccaaaccttcaagctatcaaagtttgaaaacagttctcaaacatgtggatttcaatttgaggttgatcttaaacacttggcctgcgtggcttgactgtggcctgatagtgagtggtaggccggctcctggatagtttgagcacatgcttttggtctaaatagtgacttcgattttaattaaattttatgagatgttacgagtctaaaaccgaattgcattattcagagaaaagtttcccgaaaagccagcaaacttgagaaacactcgcaattatattggcctattcctcctcactgcgttaacgttctacatcattggtgcattagttcaacaaagaactcaaaactacaagaatgccaaaaaaccgtttttggattggagggatgaaggagtcgttggacctgtgaaagatcaggggaattgcaatgcatcctatgcttttgctgcaatttcagccattgagtccatgtacgccatcgccaacggacaacttttgtcgttttcggagcagcagattattgattgcttgggcggttgtgcaatcgaatcagatccaatgatggcgatgacgtaagacataccttatgcagtagtcataatgataaacagctacaacctgcaaatataaatttcagttacttggaacgtaaaggaatagaaacatatacggactacccatttgttggcaagaaaaatgaaaaatgtgaatatgactcaaaaaaagcgtatcttatactagatgacacttatgatatgagcgatgaatctttggcattggtgtttatcgacgaaaggggacctgggctattca

SEQ ID NO: 29020 - DNA, 843 bp, Caenorhabditis elegans
attccttaaggaaaacggagttggaaccgaagctgactacccatatgttggaaaggaaaatgtaggaaaatgtgaatatgactcaagcaaaatgaaacttcgaccaacttacatagatgtgtatcctaatgaagagtgggcaagagctcacatcaccacgttcggaactgggtatttcagtgagttaatgcatttaatgcatttttccaaaacggccgaatatcataataaaaaaaactaaaaatttttagatttttcataatttccggccaaagttttggcaattttccaaaattttgaaaaatattccaaccccttcaatcttttaatataattaattaaaacaaaattacaggttaaaaagtgtaggaaaaaacaataaaattttttttttggtcgattgcaaaattatgagtggcaaaaactgaataattgccactttttgacagtaaataaaatttttttaaaaaaattacaaaatttttgaacctttttattttgatattcggttattttggcaccataggattagttttaccaatttcccccctggccctactttacctttaattttacattccaggaatgaggagccctccatccttcttccactacaaaactggaatctataaccccaccaaggaagaatgcgggaatgccaatgaagctcgatcgttggcaattgttggttacggcaaagacggagcagaaaagtattggattgtgaagggctcatttggtacttcatggggagagcacggatatatgaagttggctagaaatgtgaatgcgtgtggaatggcagaatctatttcaattcccataaaatataaattattatga

SEQ ID NO: 29021 - DNA, 1123 bp, Caenorhabditis elegans
atggttgtaaacgggcaaaaaccagatatcagaacgatcgtcgtcagtggaaatgtatgtgattttgatagtttagcactaaaaatacagtaaaatgaatgaaaattttgaaaaaatcggagaaaattgagcctgatcgatgcaccgtgagcattttttcggaaaatcggagaaaatcgatgaaaatgaggatttttaacgtgaaaatctagaaaatccgattaaaaattccgattttcaataaaaactaacttataggcttcataagttcagatcgatgagcacttttctcgagaaaattaacaaaatcgaagaattttcagatttttaacctaaaaaaagcgttttttcgatgaaaattaagaatttttcatgtaaaaattggcttttatccagaaaatattgagaaaaaccggccaaaaactgccttttcctacaaaaattgagttatggcttctaaagttgagatcgatgcaccatgatcacttttttaggaaaagttttaaaaaatcagtatttttaacgcgtaaaactagtgttttttcatgataaaatgtagaaaatcagtatttttaacataaaaatggtatttttgatcaaaaaaatttttcagtcgctgaccaacgatgccgccgatcagtacgagagcatggagcagttcattcactctcacgtggccgatattgagaagagaaggcccatcaagagggtaagttgttgggcttaaaatgatgaaatttgactgaaaatccagaaaaaacgaaaaaatttgatccaaaatgagctttttttggcatttttagtgcaaaaatcgcaaaaaagtgctcactttttgtctatttttcgcattttttggactaaaaatcacaaatttctcgcattttttgccaaaattggtcgattttttgcaattgctatgcaaaaaattccggattttcagagtttttcagcttaaaaccgcaaattttccccaatttttttcagctcctcgtcgccacaaatggaatcgccgctatgcgatgcctgatgactgccaaaaaatttctccatcacacattccgcaacgataatctcatccattttgtctgtatgaccacggaagacgagattcagtcaatgtcag

SEQ ID NO: 29022 - DNA, 584 bp, Caenorhabditis elegans
gcatcccaaggaaaatccatagagatccaaatcaagaacatcatctcaccatgctccatgtcatgctcctttaatgctctggagctcaagctgtcaaatttcacaatgacaggtcccaggtaagagattactgtagtttgacctacttcagggttactgtagtttgatctacttaagggttactttagtttgacctacttaagggttactttagtttgacctacttctttctaagctttctatagtttgacctactttgttggcaaaatcactgtagtttgacctacttgttatcaaaattactttaggtcgacctacttaagggttactgtagtttgatctacttcacatcacaattactgtacttcgacctacttttctctaaaattactgtagtttgaccttcttttccttaactgtatcaaaactttacctacatttgttccagattctgctgcgacgagcacatctacaataggtactcccagccaaaagtcttccagtcagaaggtcccttagctgtaattggagcatatgctagatacgattatttggattttaatattgaatatcgtgctgtttag

SEQ ID NO: 29023 - DNA, 1172 bp, Caenorhabditis elegans
atgactgaaagctcgtctgaaatcccccagaagcacacaattggcctaattactgcaatttcttatactgtcggagatattgttggctcaggtaaatctttttttttgaaattttaataggcttaggcttaggcttaggcttaggctagtctggaagacccattttttgaaaatgttgtgaaaaaaatttgaaaaaaaaatcttttaaactacaattaatagaaaaaataaaaatttttcaaaaattccaaaaaattaaaaaaaacggtctgctattactttcttgtagtttgtaaaaatttggagctgctgtgttggagctgctgaaaaaataattttaaaatcaaaaaaaaaaaatttccgaaaattgaaaaatttcaaactttcaagttgggtctgccaaattttttctgtagtttgtagtctagcaaacatatctgctagactacaaactacaaaaaacattaggtctgctatatcaagtatgtagtttgtagtctaaccttccattttccaggcatcttcatctccccgacatccattttaaatcacgcggggtcagttggtttatcactttgcctatgggctctttgtgcatgtatatcactttttggagcactttcatatgtggaattgggtacctcaatacgaaaatcgggttgtgatttcgcatatttatcgcatttcgggtggtgagtttttttggatattaaattgaaaattattttgaaaaattaagtttaaaagatttttaactaatttttgaatacctaattataataattaaaaaaaaactcaagatcaaatttccagtattttgacactattcccaagctcctagctcaattttctaaattttttcagaagtacgcaaacattaaacaccctacgacaaaatgcacagatccttgtaatttgcgagaaaaaatgtgtagaactcaaatttacacttgactttacccaaaattcagaaaaaaattttataatttttttcagaaaatttatgtcttttaggctaaaaaaactacgatttttgaaaagtttcacaccaattttcctaacttttatcacccaaaacgtgaccaaaattgcaataatttcacagttcttccacactaaaaatgccactaaaagtcatagaacacatttttcagtgataacaaaaaatgcta

SEQ ID NO: 29024 - DNA, 732 bp, Caenorhabditis elegans
cactcactgatcttactatttgtgtttattttcttggcttctgcctcaaaagagcctatatgtactcatgggtataaattagttaagaatagatgtttgaagctgttttccgagccatcaaattacaaaaatgctcagcgacagtgtgtccaaaacggaggaacgctggtgactataagaagcgaggaagtgagtttctgatgttggttaccagaaatattatatttttcataggaaaaccttcacgttattgctctggctggcaaggaacaaaatctttggattggcctgcactgtaaaatattaggaaagtgaaaaacggtgaatgtgtaatagtcgctagatacttggaacacgatgatattactgattattggttcaccacgtcatgcaatgtgacaaggaaatatatctgcaaacgtcctgaaaaagtattgtgaatatcgaatgcacactccgggtttctacagtatactgctaacattcacgacctttgacattgacccaaaaagtgacgaggtaaaagtctatgatggagatttggatgaaaaccgcttaatcggaacattcaaaggacacaacagtgatgagttctctgtggcatcaagtggaagcgcaatgttggtgacattcaggtcgaatggcaccgggaaagggaacggatttgaagcccgattcgagaagattccctctcagaaaccactggaatacatcaaatcaataacttcctag

SEQ ID NO: 29025 - DNA, 896 bp, Caenorhabditis elegans
atgaagtcacgatttttattgaaaatcttcatatttttagcggtttttggagttggtaggtcgaatttttcaagaactacgacactccgaaatcccgcttttcagatagtgtccgggcagctgattgtacggaaaaaacatttaaaaccggaacagtatgcgtttgtagtctcgattcttgcgatgaggtgagatttgaaaaaaaaaacatttttggaaaaaaaattgaaaaccaaaattgttatgaaaatttcatataaatttttgaattctcctcgcaattaccgttgatttaacaccaatatcggccatatttcataaaatttgaaatttgaattagtttcccctgcggcgcggtcgcgtcgcggtcggacttgaaaattttagaattcttgtagaaaccaatgaatcaagcaaggatttttagaaactaagtaaaattgattgagattatccaaaaagaatctttaaaactggttaaagggggtctataaagtttgaccgcgacgcagccgcgacgcatgaccaaaattcagtttttgtctgaatatagccaatatgggtgtcaaatcaaaggaaatttcacgggaaactcgaaaatccccatgaaaatgcattttaaccagtcgcttttttttaatctaaaattttcaaaaaataaaaaaaggtaattttccaaaagaaaattttttcccttttttttaattttaattgttactttaagccaaatccgacactttcctgaaccaaaatttcacgaaaaattcaaaaaattgtataaaaattccagattccacctctggacatcactatgggtcaggcggcactctacaccacctcccataccggcgcccggctccacagggatgtcatctatgcgacggatactgagccat

SEQ ID NO: 29026 - DNA, 905 bp, Caenorhabditis elegans
gatttcaataattgggttaccggatggacggagcgtaacctggtgctagatgctcaaggtggaccgtcctgggtttcgggattcgcggatgctccggtcattgcgttccccgcattggctcaattctacaagcagcccatgttttatgcaattgcacattttaggtaggtttctataggtttttgcgaaaaattactgaaatatttgaattttccgttaaaattgggtctagaaaatctgaaatttgaaattttatgggagatattttgaaaattccaatttatagctgaaaattgtctgaaaatgtccgaaaattagcttaaatctcattttattttagttttcatagagaaattcaaattcctcgtcaaatttcagcttaaaactcaaaaactagaagtttctagctcaattctgaattttagtgggttactgtagctccaaaaatacgcaaacaccgactacagtacccccaaaacatcgaatttgacgcggttttccgaattttgagctgaaatatcagggaaaacgtatgttaaaaaataatgggaaatggaaaagaaactcgaaaaaaaaaattttagggaaaaaaaatttcgaaaaaaaaaaattccaaaaatttttttaaaaaatttttctccgtcaatttcccaacacattttccaattttcagtcattttctgaagcccggagcagttcgaatcgaccattcactgaacatgccaaacccagaaattgaacgaagtgcatttttgaatccggatggctcaaaagtcgtggtgctccataataaaaatcctttggcaccatatagtttatcaattaaggatactatgaagtctactgatcattatcaagttcatttatcacctaaaacaattgttacgttgtatattcaaaattag

SEQ ID NO: 29027 - DNA, 765 bp, Caenorhabditis elegans
atgtggtctcacactttggttccaattcttatcctcgtgacaacttatggcgtaaattgtcatgaaaattccggtgaaaaaagagccgactatagtgggtaagttcggcaacttcccggagggttactgtagttttttttctgtaaatttaaaggtacacactgcatcgttttaaagttgacacgtcatcagacacaatggaaaaattggagggttatgatatgcaattggataaggtggggaatttttttttcgaaaaaaaaaaatttttaagccgaaaaatttttcaaatttggtataacaaaccttgctatttattcagtcagatcctaatttttcagctcaaaattcaaaaatcgcgtgaaattaggtgttttggggtactgtagtcggtgtttgcgtacttttggcgctaccgtacccctcgaatttttaaaattgagctagaagcttctagttttcgagcttgacaccgaaagttagtggtgagtccaattttgagttaaaaaatgcgaaaattcaatttatagttagaaaaaaaaattttttgagactttttctcaacaattattttttttccaaattttttttctatttccagacaacacaaactgctcgtcttctaatcgatatctgggcagaaccatcaaaacaaaacccgtacgcagacattcttgtggctccggaattcctgcaaaaattcaagtcgctgctgacttcagccgagctttcgacgttgaaaatgttggagggggacattcagag

SEQ ID NO: 29028 - DNA, 374 bp, Caenorhabditis elegans
atcaaaaatcattttgataaaatccgtcagtcagttgataagaaagaaaaaggaataattgatgagacaacggcagaagcaacaagaatacaaaaatttaataatgaaaagataacttatttaattgatttgcaagcgagacatgttaaagatattgaggcgatagagaagcaaaaaaatatgactgatattgatttatacaacaccggaattgatctaccttgtttttttgggcatttgaatattgaaggtcagtgcttattaactgtgcttattttctgtaattttgtaaactactttcagtgtttcggccagctgacacaaaggaaatggatatcaaactgcctaattttaaatttgaagatggaagttaa

SEQ ID NO: 29029 - DNA, 231 bp, Caenorhabditis elegans
cccctcgaattggttatcaatggtccaccaatgccaaatgtttcggaaatcgaggctctcggctatctggctcacattcgacagcccactgcggtaatttccagcgattttcggccacatttcagccaaagattggaaaatttacaggaatacattgccggcggctacactccaatgctcggatgctcacgtgctctttttgaggctcgaatcgatttgttttcgttctaa

SEQ ID NO: 29030 - DNA, 1176 bp, Caenorhabditis elegans
atgaacgggacccactgtagatacgagatcgccggagatcatatgggaattcggacagcttttcgggtttttgaaaaagtgaagaaagaggataggttcaggctgcccggcttggaaatgtcggaggaacagttgttcttctataactatgcatttgtgagtttaggccaatgagcaggccactaaccttggccggattagaccgttctagtcccataaggcataaataattaataggcctgaaagtacgaatcgatactaacgtaggcgcttataggcacctgctcccatcatatgttcttggctttgacctttggcctaaggtctgaatttagcctgagactaggccttgagctaagatcaggcttcggcctaaggtctgggcccataacttcacatctgaaaaatcgttagtctcatctatctacaacatggtctctgacttagacagacattggccagagttccttttcggcgaatccgacaaatcggcaaaccggcaaattgccgatttaccgaatttgccggaaaaacggcaattgccgaaaattttgggcaaattgtggttctgcacattctttttttttttttggaaaattcagaatttcaattttaattccagcaaatcggcaaatttccggaaaaaaaaatttcctgcaaatcggcaaaccggcaatttgccggaatttaaattttccgacaaatcggcaaaccggcaaattgccaatttaccgaatttgccggaaaaacggcaattgccgaaaattttcaagtgtttccgtcttaaaaaaagaatcaaaaacccctctaaaaactaaaaaaaaacttccggcaaattgatattcggcaatcggcagatcgacaaattgccggaattgaaaaattccggcaaatcggcaaaccggcaatgtcccgggaataaaaaattccggcaaatcggcaaaccggcaatatgccgatttgccgccccccatccggttcatgtatccatatttccagcgacaatgtgacgtgtacaacccgaataagttgccgagaaacatgcttgcccggcaacacccgacaaatcgataccgcgtgaacggtgtcattcagaatattccagaatttgcggaggccttcaactgccccaaaaattcaccaatgaacccggagatgaagtgtaaattgtactga

SEQ ID NO: 29031 - DNA, 904 bp, Caenorhabditis elegans
atgaggcccgacgaggaaggtgaggtagagcgcgatagctacacagttcggtggagcgcagtttctaaagtagtaattcaatgatcctgtagttgtttggagcgtccttacagtgagcctggagtcctgtagagcgccattgtagaggccctagtccagtggagcaaaatttgaagcttatagttcagtagagcacagttactgatcctctctcgtttcaaacttcccagtccaccacaaatcttcctacttccagatggcaccacaaaaagccccggatcgcgatggacgaggatatgggccatcatcgcactgatattgctcattttattcctgttagtcttaggcgccgctatttatttctacatcaactataaggacagctcagacgtttgtctttcgccgggatgcatcaaaactggtgggttttttttgggggaagttaatttggggttcattagggcgagcgtaatgagttccaaatttggaagagttccgggaagaaaaagatagagggatctgtggttttgtgggataggtatcaataggtcctagtagtcccaaattgtccacaggcccaacccacagatgtttccatgggtaggccccaaagacccatacttacctctttgaaggatcctagtcagtccataggtcccatagcaaatgcctactcgacccacatgatccttagcaagggccataggtcccatagaagtacccatacttatcctcattccagcatccgtgatattatcatccatgaactcttccgtcgacccctgcgatgatttctacgaattcgcttgtggtcaatggatcaaaggacacccgataccagacgacgcgccgagtgtctcaaattttgagaacctcggccaggacctcgagtttgcgctgaaag

SEQ ID NO: 29032 - DNA, 1532 bp, Caenorhabditis elegans
gaaatcggaaaaccggtgaattgccggaattgaaaatttccggcaaatcggcaaatcgaaaaatgccggaattgagaatttccggcaaatcggaaaaccggtgaattgccggaattgaaaatttccggcaaatcggcaatccggcaaattgccgaaaatgagaatttccaggaaatcggaaaaccggtgaattgccggaatcgaaaattaccggcaaatcggcaaatcgaaaaatgccggaattgagaatttccggcaaatcggcaaaccggcaatttgccaatttgccgagtttaccagaaaaacggcaattttcaattttaattggcaaaattgtacgcatcctatgaatgttcctacgactacgtaagcaaattttataaaaatatctaaagaaagcgagaaaagcatttcaaaaagacagtttcaagtgtttccgtctcgaataattactctaaaacttccggcaaattgatatccggcgaatcggcaatttgcagaaaattaaattttccggcaaatcggcaaaccggcaaatttgcggcataccactgctttagactggtattgaaggttttcggctgcctgacagccgactaataatgtttgtcggttttcgactggttaaaatttacatatataaaaaattcaacttaagaattttgccaattttgctaaaattcggccaagtttgtccagccgacagtcggaaaaaagcagccaaggcccctaactgttcatttcttccagatccctgctactacaactacaacaactattgctacaccttctcccataaccagtcatccttcacaaccgctcaggcaatctgcgaggaggaatgcggaaacctagtctcaatccactcagctaacgagaaccgttatctcatgaacatagccagccatagagcttccgataacgttcttattggaggcatgtggcctatggatcacatgaacacctgggtggatggaactatgtgggactacagtaatatcgactcagtttataatccgaagaatcggtgtattgccatggcgaataatggaacatcggaatataatttgggacaatggttcggtgttgattgcgaaggtctgtccagcttcttctgtaagcggcctgccggggtgccatgctccacagaccagccgaaggtcacagtgacacctgtcccatcaaatgagtcattctgcaactctactgtcctgatgacccccggaattataacatcaccaaattacccacaaaactatgacaataacgtgtactgcagctacaagctctccaccttgggatcctacaacatcctccttgaatttacatccttctcaacagaggagaatgtcgatctggttacggtatacgacggggaatcaacaaatgggctgaaaattggaacttatagtggatctcgtgagccattccacttgatttcaaaaggaaataacttcttcgtcacgttcgcaacagattcgaggaatgtcttcaaaggattcagtgccacttttgtggcgtattctacttaa

SEQ ID NO: 29033 - DNA, 911 bp, Caenorhabditis elegans
atggtgagtcacgtttggcaagccattacgcgtaaaaaacgtttcgaaggtgactcccacctggactcgaatctccgaagatgtctaggcctgatggacattactttcttggcactgggccaaatgatgggagccggaatttatgtgctcacgggtactgtagtcaggaatcaggccggcccgtcaattatattctcgtttgctctggcaggaatcgcagcacttttgtcggcttttagttacgccgagtttggagcaaggtaagccccagcctgagcctaggtcttagcctgaatctaagtctgggcctgggcataaacctaatcctaagcctaaccgtaagcctaattttgagcctgagcttaagactaagctaagcttatgctgactaagcctgctgactaagcttatgcaagactaatactaagctttatgcctcagcctacgcctgagcctacacctaagcctacgcctacgcctaaccctaaacctaagcctaattgtaagcctaaagcccaaaatttttcagatttccacgtgccggaagtgcctacacctacacctacattggtttcggagaactttgggcatttatcgttggctggactattccgctggagtatatgattggaaatgcgggtaggcttgggaaatttgagacgaaaattgaaatttcgaatttttcagccgttgcccgctcctggtccgcatatttcgataatatgctggacaactacatcaaaaatacgacgattggagctttgggggagctctcggagcccggtggcttcttttcaacgtacccagatattttgtcattcctcctgatttgcctgtgtgcttgtgtcattgcagtcgggccaaaagtttcggcaaatgtgaattctagttttgtggtgttgaatattgtg

SEQ ID NO: 29034 - DNA, 740 bp, Caenorhabditis elegans
atgtcttcgctctctcaacatgctgcactgtttctcgaagcaagaactttctcgaaatgtcgtggcttggacacgtggcgacaagtaaacgcagagaagctagagtgtctagctgtctgcgctctctccacatgctacgatgtctcaggatactctgtactcttttgtgtagacgcagacaagccagagtgtctcgctgtctgcgctctccccacctcatcttatcaaatttcagttagcggtgtcgcggagcccggcgaagttctcgccttgatgggagggagtggtgccggtaagacgactctgatgaatatcctggcccatttggatactaacggagttgaggtgagcccagctccccgagctacctatcattttctcgatttttcagtacctcggcgacgtcactgtcaatggcaagaagatcaccaagcagaaaatgcggcaaatgtgcgcctacgttcagcaggttgacctgttctgtggaaccttgacggtccgggagcagctgacttatacggttggttagaagctagaagaagctgttaactagtcctgaatataatgttcaggctcacatgagaatgaagaacgcgacagtgcagcagaagatggagagagtggagaatgtgctgagggatatgaacctgactgattgtcagaataccttgattggcattccgaaccgtatgaaagggatttccatcggagagaagaagcgtctggcgtttgcttgcgag

SEQ ID NO: 29035 - DNA, 473 bp, Caenorhabditis elegans
aatcgacaccaggaaacggaagtaattcaacgtgaagtgttcgagaacattcggaagattggctcctggccaattgcggataaaaattggaatagctctcattttaatctaaatagtaggtgcccagctttaaatgtaacaacttctttccaacttcagatatgctctcaaacatggcctcaatccatatgctcccgtttggacttttcgagacgcgagtcatagagctctatccgatgaatacgacagctaagcagcttgtgattaggcctaccaaactgaaattctcgattccacaggaggagttggtcagggtgagtttgactattatttttttgcaaactcattctgctcattttattgatttccaggccattcgagatctgctcagcgtgaatgggatcacctcaattatgaagaaagtgaaggaagatgtcgcggagagttttgcgcttgataaggagattggaaat

SEQ ID NO: 29036 - DNA, 932 bp, Caenorhabditis elegans
atagatacatctccagccgactctttcatcactttgctccaaaaaatcaagagattcaatttggagctcaggatggcatacgtgtccggagaatcagagttgaatttaaaacgcgcgttgcttcaggtcaatgcgatgtacgttccgcatgagaatttgatgcgtaagttagccccccgagatgtgtcggctgctttagatctagcaatgttcctctttggaagcagcagacatctcataggatcctcatttcagaaatgtttgccccgtatatgtccacgcctcattttgactccacctacccagactatgcaaaactggcgaccattgggatggttatcgggcatgaaatgggccacggttttgacacacgtgggggcgaatacgatgaaaatggaatgagaaacaattggtggactgatgagaataaaaagttgtacaagaagaaagttgggtgccttgtggagcagtacaatgcatatgatgatccggagcttgggaaaaatgtaagagttcatcagcgacttcagccaaaggaaaattttcagctgactggctcaaaagtcaaacacgaacttatagcggatggcttcggcgcagaggtcgcctggaaggcttacaagaagcttgatctttcgaaacagccaagactgattggttttcaagatttcaatgttgataagctctttttctacattcgcgcactggttctcaaaattgttttttttttcagtacatcaatgttttttcagaaattttttgggaacgagatccccgaaaagcaaaaaccgcggagattggagaaggcaactcatcccactcatagtttccgtatcaatggagttgtttccaattggaaaccgtttgcggagactttcaattgtccagtcggatcaccaatgaacccggagaagaagtgtgaacttttttga

SEQ ID NO: 29037 - DNA, 246 bp, Caenorhabditis elegans
tacttctgccgtcccccgggtggttcaaccggtgaactaaccgccaaagatgctcgccaacattactcgactcgtgtcaatgaagcattcaagaacatgccacaattcgccaaagcttttggttgttcttctaatcagaacatgaattcaaagaccaagtgcacttttttctgaaacgttttgattttctggggtaataaatgttattacgttttcaattttagacgttttgaagagcatggatag

SEQ ID NO: 29038 - DNA, 301 bp, Caenorhabditis elegans
ttcacctagtatttgatgcagaagaacagaaaaagctaattcaaaaagttaaagctatcggaattgttaccgaatatccacaggaagttttggatcgagatttcgaaagggtagggggaactctataagaaaaaagaaatataactgaaaacttgcagtttttcagctcaacctgacgccttccgactccatatacagaaccattcaaaagctgcgtcgactccgatctgaacagcttatagagcatcttggtggagatctggatcccactgacactagggtttggggaagtgctcattat

SEQ ID NO: 29039 - DNA, 388 bp, Caenorhabditis elegans
atgaatggaacatattgtatcggtgaaattgttggtgattgggttggacgtgatgtgacctggagggcttttaagaaaatggatctatcgaaaatgcagaagctgattggatttgaggataagaatttggaccagctttattttagaattcagtctctggtaagacatgcggccgacataatctaggaaccaaaattcttcaattttttttcagttcttctgtggtcctcgcagtatgaagagtttggagcagctcctcagtgatccccacccaactgaagttttccgtgtcaatggaatctactcaaatatgccacaatttgcgaaggcgttcaattgtccgattgggtcgcctatgaacccggagaagaagtgtaaaatgttctga

SEQ ID NO: 29040 - DNA, 670 bp, Caenorhabditis elegans
atgaatgttgagaaaatgagagagaagttctccagcccctggatcgctttgaaccttttacttttgatggtcttcctcgctttggtgactgttcatatcaaaatgactgttgaggtgaaaccggtgaagttagatgagctgttgtcaaatgctgctgactctagaaatctctgtgaatccccggattgtataactctctcccacgaactggtttgtgatttccaaattcaacttatagttccaaggcttcagctcaactaccaagacccatcagtggatccgtgcgtggacttttttcagcatgcgtgtggaagattccatgaacagtcttcagttgagtcaagaactcagaaaaagcggtatattcttcaaaaacagattcgaggtttgaatgcttctccatctcttatcatttttgaaattcagagtttctacacaacaacaagacttcaacttcaaaatccgaaaatttgatgaaactggtattcgataaatgtgaagcgttacaaaagagccaagtacagtttggcgtacgatttccaaacatgaaaaatttttcagaatacaggttatcttcaagaagtccatgaagtatttaatgatatcaaaaaaatcggtgcgtggccactattggataagaattgggatgaatctaaatttgacttgaatg

SEQ ID NO: 29041 - DNA, 624 bp, Caenorhabditis elegans
atgtctgcgaaagataagctggccaatcctctgattgctctagtcgtgttcctggttctcacaattattgcactcctcgccactattattatcatgaagctcaatgaaaagccagtggagccgccaagagttgctccgattgctcagaagttggtagctcccgagaagaagtcaaggcctgagccggtgacaaatccggtgacgatgacaaggcctgagccggtgactcaggcttcgaagccaaggaatgtctgcgaaactccaggatgtgtaactttggctgatcagcttgtaagctttgatagcaaaaaaatagtttacacatttttttaaattatgaaattttcttccagctcaacttccaagacccctccgtagacccatgtcaggatttctacaaagccgcttgcgggaagtattcggagcacgaggtggcaaatcgaagactgcagaagaaggatatcatcattcagagaatgattaaaagttggaaaattcttggaaatgcttgaaaaaaaacgaacaatttcagatttcctgctgaaaaatgagacttctgagtcgaaatctgaaaatgtgatgaggcaggtgtatcggacttgtgaggggttgaaaaacgaagaa

SEQ ID NO: 29042 - DNA, 446 bp, Caenorhabditis elegans
gtgaacggaaaactgacccaaggagagaacattgccgacaacggtggagtcaaagaagcgttccaagcctatcagaaatatgtgaccgaaaatggagaagagcctaggttacccggtctccagcagtacacgaatgagcagatcttctttgtcagctatgcacatgtgagttgtttgcctgttttgaaatttgtagtaaaattggcaaaaatgaaccaatcgttcactaaaaatccctcagattagcgaaaaaatcaaaatttttccagttctggtgtggcaagaagaaagaagccgcagcgatgcaacaagtgctcaccgatgagcattctccagaggtgttccgagtaattggtgtcctgtcgaatatgcaagcttttgctgacgtctacaagtgtccccgtaatgctccagttaacccagatcataaatgtattgtttggtaa

SEQ ID NO: 29043 - DNA, 478 bp, Caenorhabditis elegans
gttggtgtatggcttcccgaagagtttatggaaggtcgtattggagtggctattaccgtacttttgacgctttcgaccgaatctgctggagctcgagagcatctgccaagtgtgtcgtatttaaaggtacctattactttaactattcatacaatcaacaattttttttgaggcaatcgacttatggttcggttttatcactggattcgtcttttttacactgcttcagaccctttttgtcattggttttgataaaagagcaaatcagctcaaaaaatgggctggtcgaaagacagcagacatcactgaagaaattcgagaagctcttctacaaaaagctacacgataccataaaactggacgataccttgataatttctgccgtgtcttttacccattaagcttcattttattccttttgatgtattatttcgtgttcacagaaggacgccaagatgattgtatgaatcgccgatga

SEQ ID NO: 29044 - DNA, 555 bp, Caenorhabditis elegans
atgtctgccgaagctgttgctgctgctccaatcgccgaagaagccaccccagtcgtctactacagcattgagtctaacgacagagtggtcttgaaaatcagcgagcaagccatcaaacaatctgcaactctctcgaactccatcaccaacctcggatacagcgctgagaacgccgagtcaatggtcccgattccaatcgagaaggtcaatgggaaaactttgaagctggttgttgaatggtgcgagcatcacaaggccgacccggttccagaagcctatccatctggtaacacagtccttccagtgtgggatcgcaagttcgtggacattgagcacgacgccctaaccgatttggtgaacgcctcgaacttcctcgaagtcatgacacttttgacttattgctgcaagttcatcgcgggtttggcaaaaggaatgtcgccggaagagatgagagtgtttttctgcattccgacggatgaggaggatgagaaagcggagaggtttggcaaggagaagaccgaggcatctgcaacttctgctgatacaactgcatga

SEQ ID NO: 29045 - DNA, 237 bp, Caenorhabditis elegans
atctggtgccgacagcgtgacaccacagatttgcagtacgcattacaacgagaacacccaacgaacaattttcgtgtgaacgggatttatgcaaatatgccgcaatttgcggagacattcaattgcccgttaggatcgcctatgaatccaaagaaaaaatgtgatcttttctgattaattttacaataaagttacaaatttcaagcttttgaagtatttttgaaaatcaaagaatag

SEQ ID NO: 29046 - DNA, 804 bp, Caenorhabditis elegans
atgtcgcaagaagaggaagatgatatcaatttcaaaactgtaagttttttttaaatctttggaagttgcgtgaaatttatatgctgaatttcagggatccgaaatcagcagtagcaaggccacctacaccgtcgttcgtcttctcggagaaggaggatttggtgcagtgtacctcgtcgagcaagccaagaccaagaagcaatttgcaatgaaagtcgagaaaaagatggacactagaaaacactcaaaactgaaaatggaaattgcaatcttgaaacttgttgggacttgtaagcatttcacaaagattgaggatcgtgggaaaaaggataaagaaggatatttctttattgtcatgcaacttgttggcaaaagtttgtcgggtttgaagaaggaacgtcccaatcagattttcacgtttggtacaggaatgggtaagcattttttttgttagataaagtggtcgaagcctaagcctaagcgtaagcctaattataagcctaagcctaagcctaagcttgagcttaagcctaggcctaagtctaaggctaagctaagcccaagtctaagcctaaactacaaaatttcaatttttcaggcgtcggaagtcaatgtttggaagctgttgaggagctgcacaagcaaggattcatccatcgcgacctgaaaccccaaaactatgccagtgggcaggatgatgaaagacatctcatatacattctggatttcggaattgctcgcaagtacctgaacgataagaaggagatgaagacgccaagggagtcggttgcgttcaaggcgagt

SEQ ID NO: 29047 - DNA, 276 bp, Caenorhabditis elegans
gaaaaaactcgaatcaactccagaagcaccggaaaatgttgagaaattgaggaaagaactgcgagattctgtaggtttttgccttgtggccgagtttttccctccgcggccacatatccagaaccaattaatttcgatttttaggaaaaaagacgcctatcagaaaaggaaaagcatcaggcgatcacttccgagctgaaaagtgctctgaaacgacttgaacggagctacagagacgctgtgatcaagttgcaggagaaaattcccgagttttga

SEQ ID NO: 29048 - DNA, 751 bp, Caenorhabditis elegans
ggagtctcagtcgaagcggtcgatccagtattccaggcgaagatgctcgacatgctcaaacagaccggaagacccgagatggtcgtcggatggtaccattcccatccaggattcggatgttggctctccggcgtcgacatcaacactcagcagtcgtttgaagcgctttccgacagagctgtcgccgttgtcgtcgacccgattcaatctgtgaagggaaaggttgtgatcgacgcgttccgtacgatcaacccacaatcgatggctttaaatcaagaaccacgtcaaactaccagtaatttgggtcatttgcagaagccgagcattcaggttggggaaattatcggtttttagtgaacatttcaataattttcggtttttttttcaggccctaatccacggactcaatcgtcactactactccatcccaatcgcctacagaacccacgaccttgaacagaagatgctcttgaatcttaacaagctctcatggatggacgcagtcagcgtcgaaaactactcaaaatgcggtgaacagaacaaggagcacctcaaggcgatgctcaagctcgccaagaactacaagaaggcgttggaggacgagaagaacatgacggatcaggagctcgcgatcaagaacgtcggaaagatggatccgaagcggcatattgctgatgaagtgagcaagatgctcaacgacaatattgtgcaaagtttggccggtatgatggcgacgacttcattgcaataa

SEQ ID NO: 29049 - DNA, 1839 bp, Caenorhabditis elegans
atgagcgaggcgtgtatggtggagagcctggatcgacgatggtacctggtagcagtttgtggaacatcattatcggttttatcaattgtttcaaatatgttgatatcaaaagtgagtgtttttcatagttttgattttaattggaaaatgcttaattcagcttaatttgacgaaaatttttgtcttttaaaattgattttattttcgaaaaacttaaaattttgcttttccactaaaaaaagtgtggtcttttaaaaataatttcattcaagatttgtcggaaaaaagacataagaaaacgtattagaaatattcaaaaattcttttaaaaaaagttgaaaaattgagagagtttaaaacaactttgagagttataaacaaaattgccaaaaacccatgttcttcacacgaaatttcaaatgttttgggtaaatcgtatggcgaccaatgaacgatgaggtaggggaggggccagcgcctgtgattggtccaattgttagcctgaccaatcagcaaggcgatcgggtctgcaataagaaaacatctttttaatttccaggtcctactatcctcgaagcacacgcacttctacttcctagccctactcgccttatccgactgcttcttatctctaaactacggtcccgtgatagcaatggacataatcaaagatcgtgtgaaactgcgttggctctcaaatctttatattcaatacgtgggacccttacttgctctctcacaaacctcaatgactttctcatgctacctgatcatcctggcgaccatcgagcgatatctgatcacactacgcgcaaaatgcctcggcacatttcgacaatgccggggactctctgcactttgtatgttcattttggctctgttgctcagggcgcccatcattttcgaaatgcaaatagaacagaatcccgattgtattggcgagattagcgagtactatttgaacttgtcgccgattgtgaacacgttttggtatggaactgtgtaccggttttatgtcaggtaggtgcagggatttgttgaaaaattggagaaattacagagagaaatgaactgaaaatttttgaaattaaaaaaaaattgtttgtccgatatttttgaatctaaaatttattttaaactaaaattatcaacaaaaaatagaaaaaaaaatataatttcaattttttaattgcatatttgacctaattttgaataattagacttaaaaaagtacttgaaatttcaaaaggaatttatcgaaatttcagaaaatggaaaactctggaacattttttttataacaaagtattgtttttaaccaaaagtttttcaaaactaggtcgcctacctacttgcctgcctaccgcctatttttctgtacttttggcaataggcatgagtgtaggcacaaggcagatgtataaaccatgaaatcagacctacaacttgctgaaaataaaaaaatttaaagttttccgtatcctttttctgctcaattttgtctctattcaagcatcaaaaaagttatattaaaacaattatttaaaaaaataaaataccaagccaaaaaaatctttcagaaacatcatgacagtcctggtacccttcgttctgctggccattcttaattacaaagtcgtgaaaattcttcgaatgcagcagagatcggcgcaaatgttccgttttctatcaagtgatcataagacgaaaatccgatcggcaacaattttgatggtatgtatcgttttctcgtatcttctcgcgaatattctaaacgtcggtgtcacactgtgggagtacgtggcatttcaatcaacacaaaccggagacgcttatgcg

SEQ ID NO: 29050 - DNA, 490 bp, Caenorhabditis elegans
atggttctgttggctgcaatcgaccaaggcacctcttctagccgcttcctcgtttttgaggcagacaccggagagcttgtcactagtcatcaggtacggtagcttttgtcgggttactgtattttttgttttaattttaatttctccaacttcagatcgaggtccgtcaactctttccccatggtggatgggtcgaaatggatcctatggagctctacgataccgtagtctcctgtatctccaaaaccatcgaaaagctcgaaaacctcggaatctcggccgacgagatcaagtcggtgggcgtcgctaatcagcgaggtactgtaggaggagtactgtattctgaacaataataaaatttttgttttgtttcagagacaagcattgtttgggacaaggaaaccggaaaaccactgtacaatgcgatcgtgtggcttgacactagaacctcctccctcgcagatgaagctatctcgagaactgcttccaa

SEQ ID NO: 29051 - DNA, 1636 bp, Caenorhabditis elegans
atgctcgaattctctcagaagctggctgctggaacacccggaccacactcctctacacataatattgagtcaagtgccttcgcaactgcagacattaccctcggattcttgctttgtggtcgactgtcgtttacgacacaggttaataataggtgagtgtgatgacctagaaaatcttaggccagaaacattttacaatttgatttttttgaattaaggaaaattgttattgaaaaacaaaaactggctctgtaaaagttttcttgcaacttttttttcaaatcgaattttttttaaatttcaacattttgcagggtaaacgtatgcggcggcaccgaaatgtcggcggccgatatggccagaaaaaacagtttaataaatcgtcagctagaaaaagaaaagattgatagtaaaaaaatgctgaaaatcctactcctcggtggtccagaatgcgggaaaagtacaatattcaaacaaatgaaaataattcatatgaacgggttttccgatttggattacgtgaattttcgatatttaatctacagtaatatcatgcaatcaatggatcaattattagaagccgccgaattttttcattttccaccggatgatagtccttcgattagaagggcacttaatcattataaatcatataaagttcggtatagtacgtcggaagtcgagttgaatcgagaattggcggattcgttgtcgaaattgtataatgcagagtttattaaatcggttttaaatcgaaagaatgaactcaaattgttggattctgcggtttagtgagttttatttatttgctgaaaaattgaaaataaattttgaaatttgtttttttttgttttgaaatttttttttgaaatcaaagttttgaagcatgtatcacgtatgcttttcttcaaggcgcccctagtaaacaggcgtaggtggctggtaggtaaaatgaaaaatgcagaaaataggcggcaggtaggcctgcctgaaggttgaaggaatttttttttgagaaaatataaattatattcaaaaaaattaaatctgttataaataatttttgtagaattaacattaccaactttctgaaaaatcaatcttatacaatttgaaacaagctccaagtttgtacaaaatcggaaattttggaatttcagctgatttttacaaaaaaattttataaaatcgcagaaaacacgtttaaaatgtcaattgtttccatttaatttgaatattgttaaagttaaaaaaagccagagatttttaaaaattacaccaaatatttgataaaaaacttttgaaatttttgaaaaaaaaacttttaaaaaattgttttcaaaaaccgaaaattgtgcatttttgtttaaatttgttctaaaattttgaaaaaaacgtactaatttttgtggtggcttatcagaaaaaaatcaaataaaattagaaatagctgtatttaatttttcaaaaattcaaatttctcaaaatctcaaattttcccattcagttttctggatgacattgatcgaatatcagcacacgagtacaagccaacagagatggatgttctaagagcacgagttccgacgacgggtattacggaaattgagttcccatttaaacaagcaagtttaag

SEQ ID NO: 29052 - DNA, 2070 bp, Caenorhabditis elegans
atggactcaaacgtgaaatatttcatgtatgaaatttttattccatcaattatcatactatgttgtgtcgccgcatttctcaatttcatggttgtcatctcccggttgtactgtaaaatgcgatcagcctcactggaattgacctactcgttggcgctatctgacacgtggacaagcatcgtcattggattttcccttttttggaatagttacaagccggtcgtcctgaatattccacattccagttattgctttccgttaactcttgaggttggttttttttgaaatgtggctcaaaaagcctagaaataaagaaaagctaggccactttcaaaacttgttaaaatatttctaaaggtatccctacctattttttgcctgcctgtcgcctattttctgaactcgatcggcgtacgcaggtaaaagtttccacaagtatcttgtaatcatctatattaatttgctcaaaattcaatacgtgtacttagggagtaggcacgcatgtaggcaaaaggtaggcctagacgaccttgaaggcaagcaggcaggcattttgggctctatccgaaaccctactacgcctgccttgtgcctacatgcatgccgaggtacctactaccgaaaaaaaaacacctttttttcattttccggttgaaaatgcaatggtctcatcaaaaaagaaaatgtctacaaaccctaaatcctggaggtcatgtccaaattcaaaaaattggcggtaggcatgcaggcagggaataggcatcactacgtgaacttttcgaaattcttgatctcttgctactcgccgagccgtgaagaaacttgataggttgagcaacactagttcatctaataaataaaattaaacgcaacaatgcacacaaaatgcaacacttgaattgagttgacgtgatgtacggaggataaaattattctgttagatggagagtgctcttctatttggaaaaataatgaaattaggaattggttcagaagaaaatcgaattgagaaacaaaaaatgatgttagaaatgttcaaagtttaatgaatggttgttattttgtgaagttgaagtttaaagtttagaagttttttggatttaaaaaattgcggtaaacatgaacaagaaagtgacgtcataaacctgccagtttgccgtaatttctagaaatcaattttagaaaacatttaattttatgaaacttcacaaaacccccaactttcaggcattccgaaccggaggtctgcttaccggaattttccatctcgtcgcactggcattcacccattacatgaccattaaacgaccattcgaccatcataaagtactcccgattcgaacaatctacattatgatcttctttatgtgggcaacaccgccaatggctcttatgatctatttcgccagcaattcgggacagggatatcagtaagtgttgtaacggatttgaaaagcctttgatagctgttctaggaacaaaagcccaatcttgagcctaagccttagcctaagccaaagcctaagccgaagcctaagcctaattgtgagcctaagcttatgcctcagcctaagcgtaagcataagcctaagcctgagcctgagcctgagcctgagcctaagcctaagcctaatcctaagcctaagcctaagcccaagactaagcctgagcctaagactaagcctaagactaagattacgcctaagcctaagcctaagccttagcctaagcctaaacccaagtcgaagcttaagccttagcctaggacacagccaaagcctacgcttaaatttaagcttaagcctaagcttaagcctaagcctaattagccttaaaactacatcacaagttaaacgtattcctattgtcagtcagcaaattaaatgaaatctaactactattatacatacaaaaccacccattatattccattattccagaagcgagaaatgcatgggcatcaaattttacgagaacttctatttccgcgcacttgtctctcttatcattgtctttctcatcattcttaccaccatcttctacatcaaaatgttacaaaaaattaccgag

SEQ ID NO: 29053 - DNA, 302 bp, Caenorhabditis elegans
ccgtccgtagatcaaactccgtcgacagttctccgcgaaacggagctcagattacgcgatttcactggaaaaaatgtgaaagatgagtgggatcgggaacgcgaagttatgctgacattgatagatttatttctggttgtgagaatttgttttatagttttattcaaatactcgtacaattccaggccggcgatgaaaatcacgatatttatcgcgaatactgcacatctcgtcgaaactacgtagcacttcggcagagtgtcccggaacttttggagacactgcgaaaagactctacttga

SEQ ID NO: 29054 - DNA, 4684 bp, Caenorhabditis elegans
atgtccttgtacactggggataaagttagttttgttgcggttttgggtggaaaaaacccagcggatgggaatagaaatcaaaggaactgaccgcggaagtcataaatctctttttttttgaacggaggggttgcaaataatgagatccggaagatggtgatgggcatatggaagatttgaaggaattctgaaaagagcactttttgctcgaacgtagcccgacaacagaccgaattccataatgaattttcttatattaaatttctaaatattggaagaagtgcaaacttctgctgaaacctgaaaaccaatattttggtaaattccaattttttggtaatctcctattattaggtgaattacaatttttgataaattccaatttttggtaaattcgaaaaattggtcgattccaacaattggtaaataccaacattttggtaattgccaattttggtatattccaaaattttttggtaaattccaatttattggtaaatttcaaaacttggcaaattccactttttttggtaggttccaatatttttgaatttggatgcctctcaacctaaaatataccaatatcaacgatttaatgtgatatgtacgacgaaaaatgcagaatttggcttttttttcaaaattttgaaatttttttgaaaagtattctaacgaaaccccccccccccccccccccatcagcctaacatgccttttaataccccattttaattccatttattttcagatttactaccgaatatgcgacgaattcaccgatcaacttgtctacttccgaccacaagttaccgggccaaaagagactgatatggtccgaatgaatggttcgtgtattccgaatgcgtcgaaaaagatcccgggagtcgatttgatcggattgtgtatgtcgactggaagtggtatcaaaacgtctggcgagtgcgtttgtgatagtggatattctcaaattgccgattcgaatggagctcggtgtgagagtgagtttatttgtttgtagaaaattatacaactatgcctgaatagatataactagaaaaggtcctatgtgttttctgacttctttcgcggaggtatgcacacacaccttttcttcttctccagagtgggggggggggtcctctgactaattgcatgtttttccggagggcacggactcagcggaccgtgagaagagacaaggagaagaacaacggaggaagttattgtaattattattattattattagtattagttgggattgtattatgggggcaacaataggtttagcaaatatttgactatattcctgacttttgaatggttttggattttctggcaaggtttttgtcgaatagatttgagtttttctgtattttcagagttaatcggtagatcaaaatattaccaaaaatacactagaaaaaacccagtttcccatgccaaccataagttattcaactctttctcgggattcgacctcctcacaaatctctaattaactcctcggctacacctaccgatcctaattggtttttacgacacacaccaccaccgcggcgatgactgcgtaatcagagcggctcggattaaagacgacgcctatatgcatacggtacccgagccttatggctggtagacaaaagcccatttagaggagcaagtcgttaaaattactggtattgcgcactgaaacatatggctcgataggcatttatgggattttttgaatgaataatttgttttgtttcaaaaatcccagatagagagaatgccaggtggcgccgcttgatccatccaaattttcaaacaaagattcgaatcagaaatgtaatagttagatagccgtaattcatcatgttttccatactaattactattaagaagtaccaagaattagtagagattcctatattagataaggaaggagagctttgtgatataaatctacttttcctgctgcagcagctactacttcccttcccatcaaagatttgtatctagaagaggggtcttttttgttggagaactgtcacctctagttatcgtatatggaattgacagatgggtaggtggtagtgtcaattggtgtcggccacttgaaaagggtggaagaagcaccatcatattggctcacctgcacacaagctgcacccatgcgcatccacatgagaatgtgagaatgatatgggttgggggtatgtattgatatggaattggaatttcggaatttgtagattttttggaagtttttggatcattggagttctacagtaaccttagggatttgaaatcagcaaaaatttcaaaaactcgatacaatatttcgaaaaaacggaggcaccacgaattcaagatctggtgagattccggatctacgattttctgacctggcaccgcgccaacacataagacgccatttttctcgaagaaaaccgtgacaacgatgctccgacgtcgcgtgttgttaagcgtattttatggaagaaaagtttaagaaacagcgtttttcatcgagcaaaattgcgtagatccggaatcccaacagatcttgaatctgtggtgcctcaaaaaacgaataaccagagggtctaccgtaatcgaatcaagtcaaatctggattttcccttcaatcttctatctcctaatcacctatgccttcattccccttctctccaacaacgaataataattcaccgagagtccagttacccctgggatatatggagcctgctaactaattttcaatttgtgaaaatggtccaacaacacacccacgacacgagtgctaatccaatttatcctttggctctctccgaaacgaagaaaaggacaagtgaccttaagaagaacgagatgagatggagagttgaatgaactctctctccggaacaaatgagattgcgtaaagtgttgagagctgtctgatatgacattgataacgtctattttggcggcgggacatcaaaaagaaacgcgcaatatcggtttatctcgtgtctctatatgtgttgtttatgatgatgaggagagaatgaaaaggaattggtatgataaattgattggcccgttgtgttctagatatatactgaaattgacccgaaaagtccaatatttgggaaattccaatattttggcaatttccaataatttggtaatttccaatttttttgataatttccaatattctggtaaattccaataatttggcaaattccattttttttggtaatttccatttttttggtaaattctaatgtttggtaaattccaaaaatttggtaaattctagtattttggtaaattccaatttttttggaaatttccactattgggtaaattccaattccttcggaaaaagtgcaaacttctgccgaaacctgacatttggccaattctaatttttggaaatttccaaatttttggtaaattccaatctgttggcaaattccaatattcacgaaatgtggatgcctatcaactcaaaatacggttaattcaacgagccaacacattgaaatgcctgagaatttttttctattaggcgcaactcattaatgctcctaattaagcctaataaatcttcaaaaagagaattccgacgagatgatcccaggtgtatttgattaggatcatgatagtcgtggggtcaccacaattggttacattttacgacgaccctctcttttcaaattgtttcctcgattcggttcgttttcaaattgtgcacctgtcgtcaggcaggcaggcacccgtctgtcccatctctcaggttttcaaacaacacacaccccaccaccacttgactgctctaaatgggattatcacggaacgtttgtgtgtgtggtatacatacacaaacacatgtgccccgaacgatgaggaaaagcggagaggcgagaaaaaaggcggtattccttttttaaaggcatgtgccgctgccgccgcctggaggggtcaaatagaaaacaatagccactttaatgtgggaaatgaatacagagagagatgtattaagaaaatgaggaagatggaattatgacaaaggaccataaaattgggctttttctatcaaaagggggaattattccggcaaatcggcaagttgccggaattgaaatttccggcaaatcggcaagttgccggaattgaaatttccggcaaatcggcaataattgcccatttgccaagaaaaataacaaattttgcacttatttaaaatttcggaatttcaattttaatcggcaaaattgtactatacatctattttaaaaaataagaaaattctatgaaaatatctaaagaaaacgggcaaaaattttcaaaaaggcacagcttttatgttccgtcgtatgacaaatccctctaaaaatttctggcaaattcatattcggcaaacggcaaatcggcaatttgccgaaaatcaaaattttcggcaaaccggcaatttgacgatttggcgaatttgccgacaaatcaaatttgtagattctaagaccttaaaaattaaacattaaaaattattcaacttccaggctgtccaacgaacacgtacaaaccaaaaggccaatccctttgcaaatcgtgtccatccaattcgatatcttcggaagctgccagctcttgtcgctgtcttaatggttatttcagagcagaagatgagctcatttcgatgccatgcactc

SEQ ID NO: 29055 - DNA, 610 bp, Caenorhabditis elegans
ctagaagaagagaagggaaaaactgaaaaggccgttcgagaaaccatgaacgaacgtcgtgccatcgacaaatctctcgcgtcaatggaacgagaaaatcaacagttgtataggaattgtgctcaacttcaagctcaaattcagaatctggagcgcgacgccggaaatcggtcggtaaccaagttggctaaggagcattcattgctcgaagctcgaattgcagctttaattgaagaaaaacgtcaggtttgtgaaacaaaattaggtggtactgagcagggatgtgcggctgtaaaattaaggtttttcggctggtagcgccagccgacagccgactgataaattttcggctggtgaaaatttttatgaaatttgataattttcaagaaattcataggctaatctacattctaggtttttgcagctccaatcaatgcttgaccaaaaagacgccaactactctcacaagcgaaaactcttagaatcccaaatccagttgctccgcgagcaactcgaagccgaacgccgaaagcgtacaaagggagttgtggcgactggtcccaccgttagccgacggggcgttcagcacacatctgcctttagggtatga

SEQ ID NO: 29056 - DNA, 1011 bp, Caenorhabditis elegans
atggaaagtagtgaatcttctcggttccggtggatttggagatgtgtacaaagtgcatcgggagagccaggcatccaacaaatgctacgcattgaagactgaaagtgaagagggagagaagcgatacttacgtctgaaagtcgaggtgactgtgatgatgaagactgccgagaagaagaaggataacaagttcaaaaatttcattgaatttgtggatcgtggaaagtgtgagcagctcaagtgcaagtttgttgtgatgggtcttgttggaccatcccttgaagacattcgccgcaagtacctcctcgcctcgttttcaaagcacacttcattcaacgttgccatccaaactgtcactgctctccgggatcttcattcacttggctatctccatcgagacatcaaaccagcaaactatgcagttggtcttgatgaacgtgaggatacagtctacatgctcgactttggaattgccaaactttacgttgatgagaatggagttcacaagataaaaagaaagaaggtgaagttcctgggaacgctgagatatgcttgtcgggcatgtatgatgcagcaggaacagggaaggaaggatgacttggaaacttggatctacttggtatttgatttgatggatgaagcacatggaatgccttggagagctttgtgcgatcccagggagattttgaagtcgaagaacacattctttgctacctgtaagttttattttcttagtgtaaaaacaaggaaaataatctggtttcagtcgacaatttccaattctcaaatattctgaaacgcttgaaagatttggtcgtgtacgtcgacgacatgcaatacgacaccactccagactactcgtacattctaaacttcctcaagacaactgccaatgatgtaggtgccaagatcactaagaagttggattggatgggcaaactgaagcaaaaggagtttgacagtgaatcggagaagtcggaaaaaaagggaactggagatgatgaagaataa

SEQ ID NO: 29057 - DNA, 1257 bp, Caenorhabditis elegans
atgcacttttccttcattttcctggtactggtgtacctgacatttgcctttggtgactctttgatctgtaacaacggatttactgtagtaaactctaacaagtgcttgaagctgtttagctcagcggtgaagcaccggacagctgaagccaactgcgcatcttatggaggaactctagtgaatattagaaattctattgtgagttgatttactaaaatcatactttttttgtgaccaaattaaaaaaaatctctcgatatccaggataaccgagcagtcacccagtttgttggaaatattggcttgagcttctggattggtgtctactgcctggaatccaataatccatcttcttgctattttgatgatgacctaggaactgataccgctttcaacaattttgcaaaaggatttccaaataccgatattggaggatgtgtctacagtgcaactagtgggtctttggctggacaatggattagttcagagtgtgataatgtggaaatggcatatgtttgtgaaattccgatgacaagagcaggtaattgtgacttcatagtaaaaattattttaagcaacaataaatttgatttagtttcgaaattttgataagacagaaacgtgacttcttggaagagtacaagagtttattgagaacttattgggcttcaggagttgatcacaaactgtcaattgtgctcaaaaagtgagaccgacccttttctatattttagtaacacttttagtacctgattccgataaggatatatctaattatgaaatgtgtttctaagaagacccacatttggccacggacttgttccaatcggtcatcttaaattgtttcttcctcccccactattcaatcgtttgttttatattttgatttttgtctgtaattgattgctttttttgaaattttgaatggttgagaagaaataaacaaatataatataaaaaagataaaccacctctctacttctcatttaatcttccagaatttcagattcctgcgctcacaattacaatggctactgctacataatgtctcatgaaaactcgacatctcccatcctttcattcaatgatgcctacaaatcctgtcaagacaactgtgcaaacctggtctctattcactcgagaagagagctcagctacattcaaggaatctacagcccattcaatatatcgagtgttacaattggcggtctatcaacggctcccatggctccatattggtctgatcttagccactga

SEQ ID NO: 29058 - DNA, 1674 bp, Caenorhabditis elegans
atgaaaacccttctgcttctcgccttcttcgtcggggtgacctgtggagaagagatcaaggatttgccaggattggactttgagccgaatttcaagcattattccggattcttccaagtttcggataaccatgtgcttcattattggtgagtatgaaggacagaagttagcctaaaaagtgcaaactagcatgaaagtaaaaaaagtcttgtaccttttcaatttttcgtcgatcgaaaggttgtttgaaacagtgttcaaggtgtgaaataggttcagaagcttacacaacgaaaatcttacacaacaaatcttacacgaaaatcttacaacttacacaacgaaaatcttttgaatgcgagcttgccttcataccggcttgtctaataaatcatcctaaatcattattccaggttcgtcgaatcccaaaacgagccatccaacgacccactgatcttctggttcaacggaggaccaggatgctcttccttggacggacttctcaatgaaatgggaccatatgttgccaatgaagatggaaagactcttcgtgaaaacgagtactcatggaacaaaatggcttcagttgtctatattgagtctccagctggagttggttactcgtatgccactgatggaaacatcacaaccaacgatgatttgacttctcttgagaactacgaagctgtcaaacaattcttcactgaattcccacaattccgtcatcatcagacattcattatgggagagtcttatggaggagtttatgttccaactcttaccgcaagaattgttgatggacaaaaggacttcccaattaacttgaaaggaatggcacttggaaatggatatgttaatgagaagcttaacattgatacctctgtcagatttgcttatggacacggacttattgatgagaagatctggaatactcttgagagagattgctgcagaggatgcattgattcatgtgatttgactcaagtcaccggacactgtgcaactctcgttgaggacatcttccaattcttgtggttcggaggattgaatccatatgatttgtacagagattgtgatccaaatccatcagtgaacagcaagagaatgaagcacatgttgagaggagttgctccagcaatggcccattttgatgagctcttgaaaaatcaaacaaagacttccctttatcaatttttgaaagtatgtggggtagcagcaatgggaaaatgtaaaaatatcattggaaaacttttcagaaaatttttcagtactcagttttcacctagtgtcacggtaggtgtcacggtcatgagatcattatcagcagtttttttttttgaaaactttgaaaattgttttgtgaacgaaaccctgcaaggattatattcaaacaatttttttgccatccaagtaaaaaaaattaaaataggaaaaaggttatagaattttttttggtcaaattgcatatttaaaacttttttaatttgatcaataattaccaccatagcagtcacttcatatttgtatctttcagaacaaatctcaatcccaaaagccacttaaggctgatgttccatgcctcaacgatactgagatgctctcctatatgaacaatccaaaggttcgtaaggcaatccacattccattcaatcttggaaaatgggatatctgcag

SEQ ID NO: 29059 - DNA, 1062 bp, Caenorhabditis elegans
atgcacattttctgtgtaatattattcaattttaatttatttattattaaaaattttaaattttatctcatttctaaaatatccctcagcctttgttgtataatacgctttcattttcttctgttcctaggtgaaaaatgtgattataattatttattagattcccttttttccttttcttgtgttctgactcgatatccattacatgactcatttcgatcaaaaaaaatgatgttctatgcttgttcttcagatcaaacaaatcacgttttcaccaccaaagaactcatttcgacgaaggtttcttctcccttcaacctcttatctttgttgccatttttaagaatgacaaatcgagaatacgagacgcagggccaacaacatctcgttataagaaacggtcaacccgatcaattcacgattttaattcagttttctacagcttcctgttttcaagcactgcagatttgaaacaaaaaccttgttttaaacttagaatctacctgaaaagtccgataaaaactgaaaaagttcttactcgtagaaaaaattatttttaaaagaaaaaaaatgcagaaattgatgaaataaggttaaaaaccaaatcaagcatttttgaacatcattttgaaataaaaaattgaaaatttacggtattgtgcatattttgtgcaattagaatgcgaaaactttgaaaaaaaacttccaaagttgaattttaaatagaagttgcctaattttcttgaatttttcattttaaagcattgtttctattacagaaaattagatatttcagaaatgctcagtcgtctagtcagctccgtccatccacaaattgggctccgtgccgcttcttctgcagccaacaatattgtcagtcaagctcagcttcaatccgatccttcgaaggttgctattcaatatccttctgaacgttttttccataattttataattttccagctcctctttatcgatggcgatcgcaaaacgacttatggagaatttgttaaacgaactgggcaatatgcaactgctctgactgaaaagtacaatataaag

SEQ ID NO: 29060 - DNA, 1514 bp, Caenorhabditis elegans
atgaggtggtacatctgtgcaatagttacgggattgatgactcttgttcaagcaaatgttcatgtttataattttacggttttatgtatgcaggaagaacaggaaaaggcaaataatggtgagttatttcaagtatccaacaatctgatttgatttttatttctatttcagaaagcctatcaagaaacgagacaattctcccatcatccttaaactttaacttttcaaaattcgagcaagatcttctattctcagctgcctacattgctccactaccttctattatcattttatactttttgaccaatagatccggagttaaaacaacattcctgatctgctcgatgctctcattcctatccacgatcctcacgccaatcgctactcagtatggcttttggttcttctgggcggctcgcttcttccaaggacttccaactgcaattcttggaatcgttgtctccgtggtgacatgtcactggtcaactctcactgaaaatggaacatatgtatctattctggcagctcactaccaaattgctccactgttaaccatgcctctgtcagctttgatgtgcagtgtgggaggatggagttcagtttattatactcaaggaactattacagctattctgattgtcttgtttgctgtgttctacactgacaaaccatcggagagcaaatttgtttcaaagggagagctgaaggcaattgaagatgggaaatcattggaagagaagcatgttgagaagagtaagactccattcgtcgcaattcacaaggatccagctgtctgggcgatttggatcacatcagttggaggaacgatcggattctccattttcttgcaatacggcccaacttatctcaataaagttcttcattacaatctctcgactactggatggactgcagcagttccttacatcttctcttgcattgcccgcattgttgctcaaccattgtcagccaattgctcattcctcggagaacgtcttgctgcaattgtcaccactacaatttcccagggcacaatggccatctgcttccttgtcctcatgttcatcccacagacatggtcctcagtcgggcaactctgctatagtttggtgatcgttgccaatggactgaatggagttggaattacaagaagtgctcagctggtttgcaagcagcatatgtcatttgtctacactgctagagcattttacaatggaagtgttggattgttcctgccattacttgttaactttgttgctccaaatgatacacacaacgaatggacacgacttttcttgtaagtttctttacatttaatttcaaaaacttctacttctactttccccattttcagaatcatcttctgcattgtcttcgtctccaatctgatcttcattgccttctccagcactgaaccagctcaatggacaataggaacatctgaagttgacaatagatccgagcaagatttggaagatcaaaagagtacttcgactactgtagagaaattctaa

SEQ ID NO: 29061 - DNA, 692 bp, Caenorhabditis elegans
tcttccctgctggaattcttcaattcccaatgtttgtgcccgatgcaccggctttctccaattacggagcaatcggaatgggcatcggtcatgaaataacccacggatacgatgaccttggagctcaatacgacgacaaaggcaatctgcgtggatggtggcatactgaaacaatgacaacattccaaaagaagaaacaatgttttgtggcacaatatggaagtaaaatcgaaccacaaactggccgaaaagtcgatggaaaaatgacaattggagagaatattgccgataatggaggattaagagttgcgtttcaagcttatcaattgagatctgatagggaaaaggaaacgagaagactgcctggattaaccgatttcagtccgaatcagctgtttttcctagcctacgcaaatgtaagttcttggaaaatagagttttacgtagccagataataattaggacagaacacaaagtaagcaatactaaaagccaccaatcaattaatatttcagacatggtgtgaagccctgaaaccatcagcaattgatcatataatggacacagatgttcattcattgggaatgtttcgtgtgaatgtgccccttcaaaaccttccagcattttctaaagaattcgattgtccaattggatcacctatgaatccatttgaaaagtgtcgtatctggtag

SEQ ID NO: 29062 - DNA, 421 bp, Caenorhabditis elegans
aaggatacctacactacaattctggaatggtcatccatcgaacttcagaaaccgaatagaacagaaaatggatgtggatataaagtaagttttgaagaatctgaattcgatgtttaatatatgaaaattccagatcttcatctacatatctgaaactgctactgaagcaattgagcttgacatgccactgcaacgtctttcggatcgtcggaatccatcggctcgtctagatggattgaagctgatgtacatgtacacaattaaagttgcaggatataatcctggaggcatcggtcctatcagcgagcctcgaagtatacgactaggttccccgggaaccatggattatacaactggaagctccgatgtaccaattccatctctattgttattattgttattattactatggagactctaa

SEQ ID NO: 29063 - DNA, 992 bp, Caenorhabditis elegans
gtcaacaaggaaaagtatggaagcatggtgcaaggtttcaaagtgacaattgccgaggatggagttcgtggtcttgctcgtggatgggctccaacattcattggctattcggctcaaggactgggaaaattcggattctatgaagttttcaaaaacatctacagctcggctttaggagaggagaatgcttatatttggagaacttcgatctatcttgccgcatctgcctctgctgaattctttgccgacatattcttggctccaatggaagcagtgaaagttcgtatgcaaacatctccaactgctccaacaactcttcgtgcatgtgctccaatgatttacaagcaggaagggctcactggattcttcaagggacttccacctctttggactcgccaaattccatacaccatgatgaagttcacttgcttcgagaaaactgtcgagcttctctatcagtacgttgttccgaaaccacgtgctcaatgctcaaagtcggaacaattggcagttactttcacagctggatacattgctggtgttttctgtgcagtcgtgtcccatcctccagatgttcttgtttcaaaactgaatcaagattcaaatgctagtgttggaagtcttgtcaaacaacttggattcaagggactttggggaggacttggcccaagaatcattatggttggaactttgactgctcttcaatggttcatctatgattcgttcaaggtaaggttgttctctacgtttctttaaaactatatctcttgcttcaggttgcaatgaatcttccacgtccaccaccaccacgaatgccagaatctttgaagaagaagctcggaattccgggaaccactgaagttgctccagttgctgaaaaagttgctgctccagaaaagagtgcgaaatctgagaaaccaggaaaagtcgacaagaagcaagaaaagaaggagaagaaagaaaagaaggccaagaaggaagaagctgtttaa

SEQ ID NO: 29064 - DNA, 422 bp, Caenorhabditis elegans
attcgaaggccgagggtattcgttgcaaggatgcaattcacttcccaatcggagaagtttgtgctgcaaagggattcaagaagaagactgattgtgatcaaggttagattatataattttaaactattcactaatgacactttttttcagcttttgccgccaagggaatcaaggtcggagacactgtcgtcattagctgcggaatcggactttcggcttctgccatctgcctcgccgctgctcgttctggaatcgttgccaagctgtacaatggaggagtccacgagttggcttacaaggctccacaacacctcaacatgcgagtcactttgttactacacgcgattactgtacttagatgtacatacatacattttacctttttgtatgcaattgtaataaagattgaaagaattgtctga

SEQ ID NO: 29065 - DNA, 1513 bp, Caenorhabditis elegans
atgggaatcgccgtcgttgaaacccccacaaaaccattcgcaggacagaaacccggaacatctggtcttcgcaaacgggttccggaattccagcagcagaattacacggaaaactttgttcaagcaattttggatgctggtcttggatcgaaaaagaagggttctcagttggttgttggtggagatggacggtttctttcgatggaagccacaaatgtgattattaaaattgcagcagccaatggggtaagaaatattgagaaattttagtaatttttttataaatttgagtttttcagctttcccgtcttatcgtcggtcaaaacggtttcttgtcgacgccagctctctcgaatcttatcagaaaaggacacgaaggtcgtgttgttgatggaggaataattctcactgctagtcacaatccaggaggtccaaagggagattttggaatcaaattcaactgcgaaaatggtggacctgctccagatcaagtcactgatgccatttatcagatcacaactaaaatcgataaatacttgattgccaaggatttagaatgcgattttacacaagttggaaggtaaacacatcaatattttgattacattgatgtacattaattttcagatatgaatatgatattgagggagttggtcactttgtcgttgacgtcattgattcagttaccgaatacatcaacctcatgcagaaaatctttgatttcccaaaaatcaaatcccttctcgctggtgaacttactggacgcaaactcagagttttacttgattcgatgcacggagcaactggaccatacatctctacaattcttgtcgatcatcttggagctgatccttctgatcttttgagaactgttccaaagccagatttcggtggaggtcatccagatccaaatctcacctacgcaaaaactcttgttgaacgcctccacaccggagaacacgatttaggagctgcatttgatggagatggtgatcgtaatatgattcttggaaagaatggcttcttcgtttgccccagtgattctttagctgttattgctgataacattgattatattccatatttcaagactcgtaaggttgctggttttgctcgttcaatgccaactgctggagctgttgatttggttgccaaggcaaagggacttcaagtgtatgagacaccgaccggttggaagtactttggaaatcttatggatgctggaagaattgctatttgtggagaagaatcattcggaactggatctgatcacattcgtgagaaggatggcgtttgggcacttcttgcatggcttcaaattctcgcagaccgaaaagaatccgtcgaggaaattgtgacgaagcattggcagaaatatggaagaaatgtgttcactcgttacgactatgagaatgtggatgcagctggtgccaacttgttgatgactttccttgaagctcaattgccagcatttgttggaagagatttctcggcaaatggggttacatataag

SEQ ID NO: 29066 - DNA, 592 bp, Caenorhabditis elegans
gatacagtgttattccacgtcaaacaccatcaatcacaacaactgcaactcgatcgaatccattcgaattattgattgcaccatgtccacttggaatgggagaaggaacattgtattgggatgacggagagacaattgtcaatgatttcaattcttatgattatcatcaatttgatttcatgtataattcaactgcaactggtggaagtgttactataactcactcgaaaaaggtatcaggatcacttttctgattaattgatacattttgcaatttcagagctccaaaatctcgcttccaactttggatatcattgaaattttcaactatccaagtgctccaaacttccgatcattcacaatcaatggaaaattagtgaatgtcaatgttcagagatcaacatattctggaattaccaaaatattgtacatttccacagaagggctcgtaaatttgtcatctgctgattctattgtacttcagtggtcgaatgctggaaatagtatgttcgatatttcgtccgctagttcagatgaagtgggaaagatgaaggcgttgaacacaaaccgatacgacgaattgtatttttaa

SEQ ID NO: 29067 - DNA, 1080 bp, Caenorhabditis elegans
atggtccactataaactttcatattttccaattcgatttgctggagaaattccacgacagattctggcatatgccgggcaaaagtttgaggatcaccggattccacaggctgattggccagctctcaagtcgagtgagtttttgaaactttttttttcaaaatactatttattcgtgattaaaatgttgtgccgctctaaccgctgtgggcgtggcgagatccacttgataaaatcttgattagacctgacaccaatattctgggtcttattataaatcattgatttttgttcacaaaaactgacctgaaagcaatctcagaactaccttttttggttcaaagttcccgtataaatctaacttttttgtagggacctatttagaaggtgctctttgaaatgaaatatgtatagttccaaaatcgagatatatgttaaagtatcttccatgtaatagaataacaaatacgatcacttttaattgcgaggctggcgggatatttgtgtacaggtttttctaatttaatttttttatgtctaaaaatgttgtattgaattttctatatttccagctatgccgttcggaactcttcctgtcctttatcaggatgggaaaccacttggacaatcccatgcaatttctcgttttcttgctcgccaatttggaataaatggaagatgtccatgggaagaagctcaagtgaatgcaattgcagatcaattcaaagattatctcaatgacatccgatcttataatctcgtgaaaatgggatttgcacaaggagatgccgatgctctttacaaggacacattccttccaaatttcaagaaaaactaccaattcttcaccaatttccttaaagccagtggatctggattcttgatcggtgactctgtcacctgggttgatctgttgattgctcaacatacatcagatcttctcagtgacagtggatctgtgtttgctgccagtcaatcacttctagacgaattcccagaactcaaggctcatcaaaagaagattcattctattccaaatatcaaaaaatgggttgagactcgtccagttacaccattttaa

SEQ ID NO: 29068 - DNA, 765 bp, Caenorhabditis elegans
atgggaattgattcctacaatccaacagtgcgtgcacgccttgcaaatgcttctaaaacgcgagtcctgagcctgaaggagtctgccctgcaccgtattcctgatgacgtgaaagatctaacaatgttgaagcatctggatatgagtattaattatctgactcaacttcccccgtttattgggtcaatgtctcatcttaagaatttaaatttgtccagaaatcaactaggtttcaaatcccactgtttaaacaattaatttatcatattttatagaatctcttcctttggagatcaactccctggcgtgtcttgaagttttaaatgtctcacaaaacaaactgacagagcttcccgatctgtcacagtgtgtctcattaaagacagtagaggcgatagaaaaccaattcatcatcttcccagctggtgtgtgcaaatgtccaaatctcgaaacatgcttgttaactgaaaatcggatcgagaaacttccagacgaagtaagtctacgcacagtttgcccagtcacctttattctatttccttgtagattcattcgctacgggcaattagcgtgatcctcaacaaaaaccggcttctctctctcaacaccgctaatttgcttcgctgtgaacgcttgcgtgcagtaaacgtggacgataaccaactaaatcgcgacgaaattgaacaattccttgtgaatgcgccacgagaaattcgtatttcatttgaaagaaatgtttcgcaaatgcatacaactgatttgcag

SEQ ID NO: 29069 - DNA, 611 bp, Caenorhabditis elegans
atgtgtgtgcattgcttcggatcttcgtattggagagcagatgacaacaattgcaactgatcagaagaaagtgcataaggtgacagacaaggtctacgtaggacttgctggattccaatccgatgctcgcacagtcttggagaaaattatgttccgcaagaatttgtatgagctccgtgagaatcgcaacatcaagccacaagtgttgtccgagatgatctcgaatctggcttatcagcaccgctttggcagttatttcaccgagccactcgttgctggtttggacgacaccaacaagccatatatctgctgcatggacactatcggatgtgtatctgctccacgcgatttcgttgctgtcggaacgggacaagagtacttgcttggagtttgtgaaagtgagttttttgaattttgtttaacgttcaatttaaatactttttacagacttctggcgcgagaacatgaagccggatgagctcttcgaggctactgctcagtcgattctttcttgcttggagcgtgatgctgcatcaggttggggagcagtcgtgtacacaatcactaaggataaggttaacgtctcaactatcaaggctcgtatggattga

SEQ ID NO: 29070 - DNA, 583 bp, Caenorhabditis elegans
atgagcaagttctatggtgtggctcacggtttcaagcgtggagttttcactgagtgggctgaagctaagaaacaaatcgacaagttcccacagccagtttacaagaagtttgaaaccgaggaagaagctcaaaaatatgtggatgatcgtaagccaaagaaagttgaatgtgagttgcctttctcatattttcacatttataaaatcaattttgcatttaataaaacatttcatttacagcaacctttcctgaatcaactcacgacacctactatgctgtagcacgtggacattctgttggagtcttcaccaactacaacgaggttaaggagcatgtaagtttattattatttttattatttcaagtttaaaattttaattttcagatcaaaaactacccacagccattgcacaaaaaatggtcgacccttgaggaagccatcgcctacttccacaaatactacgagggaaaagaggaagccaagaaagctgaaaatgaagagaagccggataagtccgagaaacgagaatccaagagaaaggctgaccaggaggaatccgtcgagaagaagaagaaaaagaa

SEQ ID NO: 29071 - DNA, 1224 bp, Caenorhabditis elegans
atgggtatagcagcagagtcgaaacaacaatcaaaacttttgaaagcacaaacgtcgaagaaacgaaaagcagtagcagcatcaaaagcaagaacacctgaaggttccggtcgtggcaagaaaccaactgtgagttactcgttcccctacctatacgtcagcttcatgcctacttgcctatctcagtgcctaattttctagtgcgttcgtgcctcttttgtgcattttgttcgaaagtttttaagtttatagtgagagcatacgagagatggataaaacattaattacagtatatttcttcagacaccgaacggagtagcaaatccaacaaagtcgaaaacaaaagtgagtactgcaagcacaatgaatgaaaagaaaggagcttctactggagatatgaagaagaaggaaccatcatctcgcaagaaaccttcaccaatgaaatgtttcgcgaatggagaaattgtggaaggagtgaatcagttcaaagtcttatcacagattcgtaaaagctccagacttctggatcatgatgtttatgtggtgaaggatgttgaagcagatgaagagtatagaatgaaagttgctagaaaggacttacagatattaaaggtacattggctttcaagaagatacatttagtttaagtgtttaattttcagattgaagcagctcttctcagacgcctcgaaaagattcctggagacaaatgctttgtttcactggtagaatacggaaacgtttcgaaagataagctcgagttcttagtcgtctcttcatatggctcaacactgcaagagattctgaagaaaactataaatggaccactttcaatggattgctcatttgtagttggtctacagatgttgagagctattcaaaatcttcattcactgggatacgtgcaccgaaacatcaatccatcagcgttcaattgtgggctaggaatggacgagacttctttgtatttgcaagattttcgtcaagttagaaaatttgaagagaataagaagcatgtcacagcaagatcgactgttaagatgtttggatgtggacgctttgcgaacagagcttgtcaaaattcgaaggatcagggacggaaggatgacttggaaagttggatatacactctattctacttgattgatcatggatccttgagttggaagaatgaggcggattcgcaaattgttgtacagcaaaaggacttgttcatgactggtg

SEQ ID NO: 29072 - DNA, 523 bp, Caenorhabditis elegans
atggcctcgcaagacagcgatgaggctttgccagcaaattataaagattatccggatggatctctccttcgcgttgtatttcataattttctgtaagttaaacaagaaaaaatcaatgttataacttttttaacttgaagaacatacgaacacacctcattccttccaactgcaagtctgaatatgattttgggacataatggaagtggaaaaagttcgattatttgtggaatttgtctggcttgcggcggaagtccgaaatcattgggaagatcagagagaatcgtggaatatattagacatggatgcacagaaggatacgttgaaattgcaatgtaggtgttgactgtgtcaatgttcggaagaacatattaaaatgtataatttcagtgctgacaaacaaaaaggtccacaagttgttcgcttaacgattcgagtgggagagcagccgaaatatcgtttaaatgatagtgcaacaacacaaagtgaaatcgccgatctaagaaagcattacaatattcaa

SEQ ID NO: 29073 - DNA, 523 bp, Caenorhabditis elegans
gatcaggtcttgacatcaaggatcgttactggtttaagatcccaatccccatgtctttcttgggaactgatctagtcgagtggcttgtcaagcatgttcaagggcttgagacgaagaagaaagctcgtgagtttgctgaggaaatgttgaagcttggatacatcagacctggagttggaaagcagagttttacgaaagaatgctactacgtcatgggagatgagtgtgcaggtaaggatttgaagaaaaattccaatttaaaacatttaaaattcattttctagactacacccaactgcgaggacctgacggaggatacaagtatccacaaagtcacgcatcatctgcgtctggtcatagcagcaacaatctgatcttccctccatcaatgtacccaccacaaccgccaacagctggcgcagtgcaatcatcgaaattcggtcattctaccttcttcaatgactggcggatacgcatcactaccggcgtctccatttcctcacggaaaggcatctgtcaatga

SEQ ID NO: 29074 - DNA, 383 bp, Caenorhabditis elegans
gttttccgctcctaccccaccgatttcgtggaaacttttgaagagttccaaaaatggacatcacagattccaatgtccgaatattctccacaacaagctgaggaaagagttcgagatctaaaaggtttgtactttggagtgtctagtttagcgttgatgataactcctcttatcacttgagacatttacaacttttggcctttcaatttacgagagaaaatgtgaaaatgtcactgatgtcatttcctcgaatcgtttccgaaaaaaaccatttttttgcaggtgtcctcgtcgatttcccactcaacttcctttgcaaagcagttctgactccaggaataacatcaaaagagggacttgttccaagtgctgtattcacataa

SEQ ID NO: 29075 - DNA, 646 bp, Caenorhabditis elegans
atgagtgcgagaactacgctctatagagcacctaattattattccaccaatattatagagcacaaaacatattcaatttctaaaaacactgtcaataaggtaatagtattttcccacacaacatatttattcgtggattatgatagaaattgtttaattaaaaatcaatatttcagagtaaaatggcggctcctgcagagtcacatgctcgattagacggtcggttttggttagaaggaacaccgtatttggcagaggaaaatgttggagcaggtgcttatggtgtggtttgcaaagcaatggatacggtatgttcctttaaactttgaaaaacaattaaaaacttgtgaaaaatcaattacagagaaataagaaacaagtggcaatcaagaaaatcccacgagccttcactgcacacactttggccaaacgatcattgagagaagttcgaattcttcgtgagctgctccatgagaacatcatcgctgtgttagacatgttcactgcagagggcgctcatggaaaggacatttatctagttatggatctcatggaaactgatcttcatcagattctccactcaagacagactctcatggaacaacattttcaatactttttctatcaattacttcgaggattgaag

SEQ ID NO: 29076 - DNA, 834 bp, Caenorhabditis elegans
atgctacacgatgtcatctatatgctgctcatttctacggtagcaaaagaagtaaaaacagagtctctagttgatccagcacattgtgaatacaattcaaatcataggaaaagtatattaacagtaagtttcaatttgaatagttttctttatgctcttggtcttggaggcacccatacatttatttttgcgcaactcttcaaaaagttaatttgtaatgaatttcatgatcttctacaagactacgataaaacaatggtaccatcaaataattcagtacaagttagtgtggaactcacagttcaggtaagaaatttgactcgaataataaaagttgttgcctcctaggatatctagacaattttgagattaggttagctttctattcaaaggaataaatcatatctgctatgtagcttgcaaattttgaatacaatagagtcagagaaaaatatgaatattcaattttacataccgatttttaatggaagaggtttaaaataatagactgtggtaatttgcactgccctaagactaatcttcagttttttcaggacatctcatcaatatcagaaatttcaagttcatttatagccgatgtttggttcagtcaagtgtggtatgatcctcggctagaatatcggtgagttattcccaaattactcaaatatctttttctattttttaggaacatttcttgcaaaacaaatttgtcattagacagctatgttagcgaacgattgtggacaccgaatgtgtgttttgtgaatagcaaaagcactcaagttcacaaatcaccagcatctaatattcttttaattatttatcctaatg

SEQ ID NO: 29077 - DNA, 281 bp, Caenorhabditis elegans
attttgctgccctgagtcatctcgtcggaaagtgatatcagaagggaacatggtcccttttatggttttctcaaaagaacatgatttttcggtttcatttgagtactcttttggtgggttcatccgaatatgtacttttgaaaacttgattttcagtttccaccagcgcaggatttgacgacgaaaagaatgattcagatgttatcgttgacaatttggatggagtttttgtgtccgacacttccctacttcaaaggataggatttagaagacagttatag

SEQ ID NO: 29078 - DNA, 669 bp, Caenorhabditis elegans
gatctgatctggtcgaatggcttttggatcatgttgaagggcttcgagaacggaagacagcacgaaactttgcggcggatttactgaaattaaagtatattgcacatgtggtgaacaaggtcacattcactgagcagtgctattatgtccttggagatgagtgttcaggtaggaaagtatacatttattcggaaaatgtcaaagtttttgtatatgaagatggaagtgggtcttttgaaatctttaatgcaatttttttgaactgaaatgttaaaaatttgttttaaaaaattatttttttcaaattatatttttaaaacaaatttttcactgatgcacaaaaatgtctgcctgtaatctccataggaatgcaaaaaagttggttgcattcaaggctgccctgcctgattcaaaacatgaaattcaacccttcttgttatatcttctaaattacttccagactatgcccgattccgaaatgaagatggtggacccaaataccaatggaccatcggaatgaacggaatgtctgctggcaacggaagctctgtgatgctcccacccccacatttacctggaggtatggctggccctcctggagcttttaaagggatggctccgtcaatggtaagcgacggcgaatcgcgcatgtatgtaatgcacatttag

SEQ ID NO: 29079 - DNA, 1989 bp, Caenorhabditis elegans
aatatttatctagaaatgcttggagaaatttttaactacctcattatcattcacaccgcctcaacatttttcatctattacatgttttcggagaagttccggcaaataatcaaaggaatttggaagtgagtttttacgaattttaaattcatacaaccctaacttcatatagccctaaaaacaatgtattttggttgaaaatgatgtaaaaaacttgaagtttatttaaaaattaatcaggcccgatcaataccgacacggtagccttcctgatggaactctgaacattactgacaggtatcaaaaaattttgtgatggtattgctttttgaaactgcccagcttcttgatatgcctcttgctaatgtctaaaaattatatttcaaatgtttttattgaaaaatcaattaaaaatgtattaaatttaaaattggtacaattttaatgtaagtcagcacgattgtatacgttttttggcagacattagcttttggaatgttgaaattaaatgcctctcgtaaatattccctaataatattgcatgtggttgcttaaattttaaacaattccggtaaaaagtaaacttttataagagcctgtaactgtctaaacatgccttcttgcggcttattgcttgttttaattttaatgattaaaatgttgggcaattttctactcaggcaactcaaatctaatatgaaaatattaaatagcaatatttttgtagtaaaaacgagaaatagtgcgtccatatacgattactaaaaatttcgaatagatttcaattttgtctcaaaagattacaatttgatctcaaaatattgcgaaagtgtgaaaatttctaggaagacttccgttttatctcaaaatattactaatttgtctcaaaagactgcgaactagtctccgaagattgagatttcatctccgaagattgagatttcgtctcagaatattgcgattttgtctcaaaatattgcgaatttgtctctaaatattaaaaatgcattcatcgactattctagaactgttttgtgataactcgaagaacttttgttgccattgaggggagttgaacttgtccgtcgcttgtcgttgagtctatgaaccattatcttacctgttgagccatcctgtacgtgtcgcatctagatatagttattgcttaagtaaatagttgatgggcgcacgtccttttcgttacctttgatgggaaatcagtgacttttcgcaaattttctaagtgtcagagcgaaattggataactttctttgaaagcgaatgttgaaaaacgatttatttgttatgcttttaaaaatgttagaattgcaatttttccgaatttttgtcaaagagagaataacattttattttttcaatatttattttcactaacaatttgattaaaatgatgagtatactgggaacatgcttgctgttgacaatattttatgatttcaattgaaatcagaaaatctcaaacgcatcacgcgtgaatgaatagttgtaagtctactttaatgtatttgaccaatcttcgtgattgtttgactgaatttataatatgaccggccaattatctagaaaaaattacatgagtggacagatttgtgaattctgtggctttctctgcaaaaactccttctacaatatgcaacgaaaaatcaaatatccgttaacagtgagatactccattatatagattttcatgtagctgtttttttactttgaaaagtcttttatcatttggaagaaaagagaatttagaacggaacagtaatcataattgttgtatatatatatcacgatcatgtgaagccgatggaaatttggaaatggtgttttgtaatctttatggactgcaaaaagattgcaaattaatcttagaatattacacatttttttgtaatatttttagatttcagaaagattgcgaaccaatctcaaaagattgctatgtcatctcaaaatattacgaatttttcgtaa

SEQ ID NO: 29080 - DNA, 678 bp, Caenorhabditis elegans
taagcagtcatttgctgagctagtaccgattattgaaatgatgaaggaagtaaaggggaatgcaattgctgaaacgccaataatgctcgttggaaacaaaaaagatgaagaatcagtgagttttataaatgtttagcagaaaacttttgaatgtaacatcatacttattctttaaaacacacatcaagaaatattcaaaacctataatttaatagtctttgtcagtttacttcaaaagagtatattaaaatttgaaaatggaatttgaggaaagttttggtgtcttaaaagttaccggaaacggtacctaaaactcgctcgtgaagctttgggaaaaataattttctgaatctagatcaaactgagagctgagacatctcaggtagctcatggcggataaaatatcacattttaaaaataaataacaataaaaaattagaaaaaatctgaaaaacaaaatttgcaaaatttcagaaacgagaagtctcttcaaactctggacagaaagttgcaacaaatatggaatgtggcttcatcgagacatccgcgaaaaacaacgaaaacatcacagaactatttcagcagcttcttgcactggaaaagaaacgacaattggcactgacaatggatgatccagatgggaaaaatgggaagaagaagggatgccatattatgtag

SEQ ID NO: 29081 - DNA, 1094 bp, Caenorhabditis elegans
atgtcgtctccgacatcattagaggaggacggagatattaagctaaaaacgaggtttcaaggacaggtgagatatgaaaagtggcttttgaaatgctcaaaaatcgagaaataccctaaaaatgaatttttcgttgcagtgagaatgtgtaaatcatttcgccgtcaatgcgaaattttagtttgtcaaagctttaaaaattcgtaacagagagaaaattccagacaaaaaatagaaaaagaccgtgataaccgaataaaactgtaaaaaattaatttttctgaacttttaatgatttgattaatagtgtttaaaacttaaaaagctcttttccggctaaaattaaaaaaaaacaaccactgattttttaaaaattctgcaaaattgaaaaataatttttgttactgtataactttttttttttaatctgaaaaattccagactcccaaattttaataaaaattaaattccaggtagtagtactctatgctcgaccaccgctcattctcgatgacttttttgcacttttgaaagatgcttgtaaacaacacaaaaaacaagatattactgtaaaatggattgatgaagatggagatccaatctcaatagactcacaaatggaacttgatgaagcagttcgatgtttgaattctagtcaagaagccgagttgaacattcacgtttttgttggaaaaccagagctgcccgggcttccgtgtcaaggagaagacagtaagtatcatgaagctatcagaaaaattatttagaatttcgaaaaaatgtgcgccttcaaagaatactgtaaagcggaatttctatcaatttttataaaaagattgaaatgaaacaattagaaacacataaattttggaattttggaaaatagatcaaacttccgcagtttgaaactacagtaatctttaaaggcacacaatttctcgcgtttaacaagaaatttgtcggaggaaaaatcggaaattttcgagtctgagaaatgttttttttccagaaactgtatatcgaagaggtgctcgacgatggaagaaaatttatctgtacaatgggcatcgattccaagcgaaacggctgaatcg

SEQ ID NO: 29082 - DNA, 1439 bp, Caenorhabditis elegans
atggaccagcttgagcacctctcacttgtgagcaaggtcctcagtgaagttgagaaccattttggtgtcgtcgaaaaagatgtcgctgagtttgttattcatttggctcaagagaatccaacatttgataaactgaaaaaggctttggatagtcagggacttggggatcaggtatgttgaaatatgagaaaatttaacgactaaattatttttttaaaggaaatttcaaaattattttaattcaaggtgttttaaaatattttgatgaatatcaaatatcgagatttaaaaaaaacattattcgtctcataaatataaaagtctcgatattcctctctttaattctaaatttcagtttgatgattccctcactgcgaccatacttcgtatagtacaaagcatgactgctgttaaaaagaaaaacaagaaaggtggtgattcaaaagaagatatcaaggattcacacaaaattacattgatttctgatgcaaaagaagaaattaaagcacgacttccagctctagcgatggcaaatactgcgaaagaaaaggaagataatgaagatgatcttatggctcagttagaaaagatggaaggccgatatgaaagtgaggtacgtatctttgatatttgaaatttgttaaaataaattttccatttacagaaacgtcttcaaaaggaatcagattcaaaacgaaaccgttcaagaagtcgatcaaggagtcgtgatcgaaaacgaagaagaagtcgtagtggtgacagggatcgtcggagacgtagtaggagtcgtgaagacagaagagatcgagataggagggatcgggacagagacagagacagaggacgtggggatcgaagaggagacgacagacaaagagatcggcgtgatcgacgagatgatggtggtgctagaaaatccgaagttgcagaaatcggaaaaatctacgatggtcgtgtaaacagtattcaatcgttcggagctttcatcacactggaaggtttccgtcaaaaacaagaaggacttgttcacatctcccaaattcgaaatgaacgagttcaaaccgtcgcagatgttttgaaaagaggagaaaatgtcaaagttaaagttaataagattgaaaatggaaaaatctcgttgtcaatgaaagaagtcgatcagaatagtggagaagatttgaatccacgcgagaccgacctgaatccggatgcaatcggagttcgtccacggacaccgccagcatcaacttcctcgtggatgaatcctgaagcaagtggagtaggacaaggtccttcgacctcaattggtggtggaaaggcgagagttcgaatttcgacacctgaacggtgggaattaagacaaatgcaaggagccggagttctcacagccacagatatgcctgattttgatgaagaaatgggagttctaagaaattatgatg

SEQ ID NO: 29083 - DNA, 634 bp, Caenorhabditis elegans
atgcgaataaatcgatggatctggtgggccacggtcattcttttgtatctcaggacgggattagcggccgatttgtaagatttgttttttcattaaataaatattctaataaatgaattagcttcagatcgagtgaggaaaatgatagaaaatcatcagacgatttggataattttaattcaactaaaatcgaaccagataagccaaaaactgcaaaagaactcggtgagtttttttaaaagaaggactaacgatggttctgggtgttttgtgatttctcgaaaattaattaaaaccgaaaaagtgggaattttcgctaaaatctcaaaattttccaacttttccgtttcgcagcgtgcagattgtcatatttggttggagatttggagattttagctggaaaaaagcctatttctgtaaggtttaattacaaaatccgtttatttggggtaattttgagtctctgtaagcaaaaacgcagaaccgccagtcagaatcgtcaaaaaaaaatcaaatttcaatttctcaggtgtaaaatcatgcgaatcgaatcaagactgtgtacatgatggagtatgtcaccgtggaaacgatggtcatggaatatgtatgtgcccgagaagttgtccagcaa

SEQ ID NO: 29084 - DNA, 214 bp, Caenorhabditis elegans
atggactcactgaaagaagctgaaattcgtgaagtatttcgagagtttgataaaaatggagatggaagaattacaagacaagagttggaggtttgttgttataatttgtgaattttcggacaaatataagttttacaggttgctcttcttcaattgggagaaaaagcgagcaattcgaagattgagacaatgattgagcaagctgatttagatg

SEQ ID NO: 29085 - DNA, 460 bp, Caenorhabditis elegans
atgtcgaagtgagtaatttttacttcatttaatattaataatctcccaatttcagagatcaatcttcaatgttattctttaaagatccggagaacaaaaataaaaatcatgtgtcacatgttgaaatcggagttcctgatccaatcgaggaactgcaaaaactgcaaaatcgtccagaaccatgcaccgttctagctgtcatcacgaccctggtcatcctggtgcttctcatttttgctctcggagcgctgggtctccatgatatttcggcgtttaaatgggaaccaaaaccccagaaagcactgagaattatgctggatctaccgtgtcaaacaaaggaatgtgtaaagtattcagctgaactggtaatggttttacaatatataatcacattacaaaatattttcagcttgaattgatggattcttcggtgaatccttgcgaaaactttcatcaccac

SEQ ID NO: 29086 - DNA, 903 bp, Caenorhabditis elegans
atggattctcaaaaactacgcacagaaggaacccgagtgattgacatcgtggctgattattggtatggactaaggaaaagaaaaccacttcccaatgtgaaacctggatttatgactgctttagtaagttttaaaattctctttttttttaattattcactttttaaaggttccatcaacaccaccagaagcgccggaagaatgggagaaaatctatggcgatttggagaaagtggtttttaatccagcaactcactggaatcatccacacttttttgcctatttcccagccggacttgcttatcattcaatcatggctgatattcttagcagtggactttcttcagttggattctcgtggatggcgtgtccttcaatcactgaattggagaaagttatgttggattgggttgtcactttgatgggacttcccgaacatttcaagaattcacacccgggccctggttgtggaattattcagttctggctcagactcaattcttattgcaattttgacagctagagcttcaaaagtactgtatttttggattaaatcgctgaaatgaggtattctttcaggttgaagaaatcaaatcaaatccctcaattttcaagtggctctgcaattctctgataggaaaactcgtgtttgatcttctcactcttaacttttctggtccaaatggaaatggaataagctatgattcaacagatgttatcactccgttctaccacgatccacgtgtcttccaacactttgtcatgtatttctgtgatcaaggacattcttcaattgagaaaggagcttggttggctggtgtcagatatagaaagttgaaagcatacaagaaatatttgggaaattatggattggatccggatgctctgcgcaaggctatcaag

SEQ ID NO: 29087 - DNA, 423 bp, Caenorhabditis elegans
atgtgttcttttttctcaagttttccattaatttcagaagacttatattcacgtcatcttgattggggatgtcacaattgggttgcagtcgctttaggacacgaattatacctctggaacactgagacatgtgtcatcaaggcaagattttgatggccactttcaaaatattgttttgtttttttccagaatctctttgaagacaatgctccgactaacgaaggtctgatcacctcagtacgatggagtcaggaaggtcgatatatttccctaggatacgcatcaggagctgtcaaggtacaattgctgtcaatatatttgatcaagttttcctttttcagatctatgatccaaatcgtccgaaaaccactgagtatgtgcgtgagttgagaacccttcgagtcggtggagcttcacgatgtg

SEQ ID NO: 29088 - DNA, 488 bp, Caenorhabditis elegans
atgacggaggctcccgttattcagctaagtattgactatagagttcgtcgttacaaggttttcaagaaacttgaagatggtgaattcggagcagtgtatgctgtgcgagatgatgctggagaggagcatgttttgaaggctcagttgaataccaaggagatatatgtgagttaatactgtcgaaccattaagcagaaaatgttatttttagtcgctgagaattgagctttgtgtgatgacaaaggtatctgagaagtcgcccagccacatgcctactctcattggtatgtagtacacttttgtaggtaaccgtaaccccatctttcagacaagggacgccatgacaactttaactatattgtcatgaagcttcttgggaaatccctgcaagatgctataaagactgggcctgatggtcatttgacatttgggctctgcgattggggcatcgtttcaatgcttggaagcattggaagatttgcattgga

SEQ ID NO: 29089 - DNA, 372 bp, Caenorhabditis elegans
ggtcttcaacaccaaattgcaaaaattcaaacggaaattgaagctgctcgtctaatggtttataattgtgcacgaatgaaagattgtggaatgccatttgtcaaagaagcttcaatggcaaagtattacgctccagaagtatgatttccaaaaatctcatacaaaatgtttgattcctaactgtttcaggtggcttgcaaaacaacaaaacaatgtattgagtggctgggcggtgtcggattcactaagaattttatggctgaaaagttttatcgagacgcagttgttggaggaatttacgaaggaacatcgaatattcaattgaataccattgccaaatttatagataacgagttcaaacacagaatttaa

SEQ ID NO: 29090 - DNA, 1644 bp, Caenorhabditis elegans
atgtcggcggttagttattcgatgcacagaaccaccacaactacatcctcctcatcacacggaggtaagcacttttcttcaaatttccaacagtcacacgacctcgagagttttctccgaggaatccataatatggtgacactagtttgtctgaaattgatctcctccattgtctcaatctttttctttgtttcaaatctctttgtcggctttattgacaccgttgtgaactcctttcacacattgccgactaatcctagcagtttctctagattatgggcttaagttaaaataactgatgtttaaataaaaccataagtttcgacaaattaaactcgatcttaacttttaattcacgatatcaataaagaattgagacgagaactgcagcgtagggacaaactgcaaaatggcctgttcctagatggtagcatataatacttttcagtgaaaaatcagattgtttatgacaagatagatcactcttataagtaggaattttctgattgctagcccaaattgtgaaaaaaaaagaataaatatgccacatttaaccaatttactctgctcctgctttgcattactttgacaaatcatatctcgattgttattatttcatcaaataattttcaacactaaaatcactctacattgttataattaaacaattttgatgaagcctacaacaattaatatgagctgtcaaaatgaagcagtgggagtgcaagactaataggaaaaacggtatataacacggaaaattgtatatcttaaatctcaaagtacaacattagctgtaactaactctattttttaaaatttctattttaatattgtgaaaaaatttggaaaacagaggtttattcagacttttgttttacatattcgtactaaattaatttttaaaaaatgagtttgtattgctttttccaaacccttcacaataagacactttcacaaaatttagtttataacaataaaaaatatggtccttcttggagcactgcttaaacatcggaacacagtttacataatatttcaggtgtctcagccggccatgccgctgaggagttcgttgcctctgccgagcgcgagaagcaagagatgcagcagttgaactctcgccttgaagtttacatcagccgtgtccgtcaacttgaggatcgtaacaaggagcttgtgattgaattggacaccctccgaggatcacttggaaatgacatcggacagatcaaggtttgtgccccgaaattacaggagaatctgaaacacttttagttgttgacacaatttctctcttatcagataatatcaattcttctcaaacaaagcgcccgttgccaaatgtgcaggcgtaaggaatttaaaagagaaactgaaaatggcactgataagatgacaagtagtgctctggaggaaatgggtgtgtatgtgtgtgttaagattgccaataaaattaattgaaattgatcttgaggggttaataatgttgcatcagaataataaactcaacgttttgtagttcaaattcaacgattcgttggtcaaagttcgccgtgagatctcagaagctcattctggaactattggagttgaagttaaggtcgacagattgagagatgatttgaatgactacagacacag

SEQ ID NO: 29091 - DNA, 1644 bp, Caenorhabditis elegans; identical to SEQ ID NO: 29090

SEQ ID NO: 29092 - DNA, 4127 bp, Caenorhabditis elegans
atgtcgtctcacaaggaatcttccgagtacgagatgcaatacagatccaccatccagccaagaacagcggttcgctctcaatcacgtcagtctggaaactacgtgtctggtggaaatggagcaggatccggaggttagttagattttaaaaaaatttaaagttgaaaacggtaaagattaaaaaaaatttcagctattactatatcctttcctctgaaaataatcatcaataccaggagcatttcttgtttcaaattcttgatttgaaatccggatagttatatatcttttaaaaaaatttcctactgaagtctaagcttcagagatcactcaatttccaacgtattttctatactttcctgttagattgagagtttcagaatatacttttattttttcaaaagtagtaaaccttcaagctatttttctcctggaccggtcttatagatgaccttaattcaagttgacactatacatccgatcaactattaactgaaccaatattccaatattcttttttcctttctttctctatttctctgtttacatgtttatccgtctactacccatccataattatgtatttgaattcaaagcgaattagtgaacagtcgcatcaatcgaaccgaacactttattctctctctctctctctcgttcatccgattgcaaaaaaatagtttgggtggttttattaatcaattggaagatgaagtaaatattggtttttgctgtgctatacaatagaaatgaggatggaaatatagacctggaggatgaaaagaaaatataaaaacgagaaaaagagagcaagagtcgttatcagtgcgaacgcgttgatttgttcttggctaaacgaaacgtttttgagaaaggtgaacagtttggtagaggataatattttgagcagggattttacattttttctactcggagttgatccaaaatcttctgcttaaaaatatcacttaaaatcaattattttcgaaattataaaagttaaaagataaaaagtaatactttatgcctttaaatgcaatttttaatttaatgagttttcttaatatttgctcacttggcaagaaaccacactttttcatagtttaacaaaaatctagaaacaggtttttatgaagtgaaatttctgtgaataaatgggggaattcctcaaaaattaaacaaatattaatatttttggagttttgaggcaaaaatggggaaaatttgaaattggcaattttagcataaaatgtcaggataattaaaacttcaaaaactgcagtcgaaatatatttaattaaaagctaaaaacagtttttaacagtaaaaatttgaaattgaaaattgtttgttaagtcagagatttaggtacgtaaacttactacatagtattagcttcttataacttgccgtaagcctacgcacgtatctgctgcctaaacacaagttatcttttatgtttgtaatttttagttgttctttgagcaagttaactcactgtgaaaatagaaaataggcaggcattaccataacaaaagaaaaattgttcttttttattgttttaagcaaatctggagatcaagatcaaaatataagaccacaagatttttttccggcagcccatatcgtttcctattcaaccgtcattaaatccactttttctcatccaaaaaatcccataaatctctgggttttctcgtctctcgatacagtctcacaattagcataatcactgaggaacgcccttcattttcaaaccaaaaatctattgaatttaaaagttcaagttccatcaagtttatagtgcatgacagaaagagttgttaggcaaatagtcttcaactatgcatatacataaaaatggcaacatttttggaaataaaatgcaaaaagcaaataacagattgaaagaggcaccaaaatttcagacagttttaaatacaatatttcaattttcgtaaccagttgagataacatgtataaaaagatacattgagccgattaagtcaacaaaatgtttagtttgttgtttcttgggcacactttccgccagccggctgactgctcaacacacttgaaaacttgacggactttgaagaaatccgagcttttattgattttattcatcatttattttaattttgtttttttttgggtaacgaattaaaattaaaagaatcccctgaataacttttaatttagaatacagttacgaaatagatgagaaataggtgagaaaggaaggaatgaccacacccaagatgtgactattttgaatgatgagaaactgagacatggaaaacacccattttttatgtgtgattagtcatttagttttaatgagtgagaattgggtggaacagtgacaagaacttattatactgattatcacttgatttatgagatcttctcggatagaatctcggatttctccgatttattgcaagatggtgtagagttttttttttcaattagaaatgtcccatcttacatttaagttgtcaaaactaattttttaaccaattttgttctaacttgagataagtcaatttttgcggcccgtgtttcaagattcttaaacttaaaaacatttttgaggactggaaatgatgtttttcttaattgaatttctatcaaattgacaaaaataaaacaggtacgttggcctaaaaataagccttcctaccattagatttagtttctgaaacaaaaatatctcccttaccaaaaaatgtcaaaaatggaatcctagttaaattaattagcttccccgcaatttaaaaaagataacaaaaatgaatgattgagatctgatcaagatgattatctttagttgactccgcccacaacaaccttgacgtattcttcatcttcaatttctaagtaagtagtgtcttgatctctttccacttttcttccaatttatccattcattcataggcacagtcaactcgcaatctgtacgtatgtgtacatgtccgttgtcttcaacttatcaccattatatcttcttctctttctccattttctatcatcggtgatgatcgggaaggcaaaaccattgacacaccttcattctttttctctaagttctccacaaatttaatgctatttcttcgttgggtggagtattcagaagagggtcagaattggtcgacggtttccgttattttgcatagtgtttgtgacacttacatttagtttctataccatttgtttttcatttttcattcagaaattttcgaacttgttcctcattattttttttcccttaatcttctagaaaaactttaaaatttcaagctaaaacacatcagaaatggaggctgaatcagcgccacaggcaccaatgtcaggaggtaagaatagaagaatatcgaaatataaattcccaatagaaatataaaaacactcaaatcaaatctaatctcctaattatcattataaaaacgttcaggacgcgtgctaaagatggtgacagagatgggatcagctacagtcggaggaatttcaccggccttgtccgcaaacgcagcaaaatcgttccttgaggcgactgataaggaaaagaagacactgcagggactcaatgatcgtctcggaaattacattgatcgtgtcaagaaactcgaagagcagaaccgtaaattggttgctgatttggatgagcttcgcggaaaatggggaaaagacacatccgagattaaggtattttagtgaatttcaaataaattttaagcaagcttctgcaagcaaaaaactgaagtagttgtagaaaaaacatttattatttgattgtgaatcagtaatttctatttagatatatattcgaaactttcaagattttatttactatattagagaattctctcaaacatccttaaaatcttcaacttaccagaagaaaatctgtgcgcttcctgtccagtgtttttttaaaatttcaacctatattttggaacaaacttcttaaagcttctttcctattcaaattgttaatttcagatcaaatactccgaatccctctcaacagctcgtaaggacattgacgatgctgctcgtagaaaggcagaggttgatgtgaaagttgccagacaccgtgacgacttggctgagtacagatccag

SEQ ID NO: 29093 - DNA, 808 bp, Caenorhabditis elegans
atggaggctgaatcagcgccacaggcaccaatgtcaggaggtaagaatagaagaatatcgaaatataaattcccaatagaaatataaaaacactcaaatcaaatctaatctcctaattatcattataaaaacgttcaggacgcgtgctaaagatggtgacagagatgggatcagctacagtcggaggaatttcaccggccttgtccgcaaacgcagcaaaatcgttccttgaggcgactgataaggaaaagaagacactgcagggactcaatgatcgtctcggaaattacattgatcgtgtcaagaaactcgaagagcagaaccgtaaattggttgctgatttggatgagcttcgcggaaaatggggaaaagacacatccgagattaaggtattttagtgaatttcaaataaattttaagcaagcttctgcaagcaaaaaactgaagtagttgtagaaaaaacatttattatttgattgtgaatcagtaatttctatttagatatatattcgaaactttcaagattttatttactatattagagaattctctcaaacatccttaaaatcttcaacttaccagaagaaaatctgtgcgcttcctgtccagtgtttttttaaaatttcaacctatattttggaacaaacttcttaaagcttctttcctattcaaattgttaatttcagatcaaatactccgaatccctctcaacagctcgtaaggacattgacgatgctgctcgtagaaaggcagaggttgatgtgaaagttgccagacaccgtgacgacttggctgagtacagatccag

SEQ ID NO: 29094 - DNA, 1315 bp, Caenorhabditis elegans
atgctcactcgtctttcatctggaaccacctggaatcggattgccgttcaaagccgacaaatgtcatttggttagtttaaagaaatgtttacccaaatgcagttgtaaagatttttacttgctttgtcaatgtttttgagtatgttatatgccagttgacaattgactgactttgacttgacttgaaggaatattttcatagtctaagctaaataatacgacgttccaaaaatgtatcaaataaataaatcaattgtttaatttcagaactgtccgacactcaaaaggaaattcagtcccatgctataaaattttcgaaggacgttcttgtgccaaatgctgcaaaattcgataaaagtggagagtttccatgggaaatcgtgaaacaggctcactcgctgggattcatgaacacaattattccggagaagtacggtggaccaggattatccaatttggataccgccctgattgtggaggccctatcatatggatgttctggacttcaaattgctatctttggaccatcgctggcagctgctccgatctgtttgtctggaacagaagaacaaaagaaaaagtatttgggaatgttggctgctgaacctatcattgcttcgtattgtgttacggagcctggagctggatctgatgtgaatggagtcaagacgaaggctgtgaaacaaggagatgaatatatcatcaatggatcgaaggcgtggattactggtggaggacatgctaaatggttcttcgttcttgcaagaactgatgacaatccaaaaactccagctggaaaagccttcacggcattcattgttgatggggatactcctggaatcacgagaggaaagaaggaaaataacatgggacagagatgctctgatacaagatcaatcacttttgaagatgtacgtgttccaaaggagaacattcttggagctccaggagctggattcaaagtggcaatgggtgcatttgatttgacacgtcctcaagttgctgccagtgcagttggtctggcatggagatgtcttgatgaatcaacaaaatatgcaatggaaagacatgcatttggaaccccaattgccaatgtgagaaacatatcagcttttcaataattattgtagaatttcagcatcaaggagttcaattcatgattgcggatatggccatcaaccttgaattgtctcgtttgttcacatatcgtgccgcagctgaagttgactcttatggtgtctcttcttacaatgcatcaattgccaaatgctttgctgccgatactgcaaatgtagcagctaccaatgcttgtcag

SEQ ID NO: 29095 - DNA, 483 bp, Caenorhabditis elegans
atgcctgtgttaggccagatatgggagcttagcgactctcaaaaagttggatcattagataagagaggagcatttgttgcttttaaactagtcgcagctgctcaacaaggtaacttttattacctatttggaatcatattttgttgaaaatacgatatgctcaaaagtaaccttaacagcaaaatatttcagggaagcccgtcgccaattcttccctctacgattcttcccttcagccaccacggtttgcaccacctgtaccaccagcaaacatgcagcatcatttccaaccatcgttcccatcggtttgactgaaaagtggttcctctatttctaagtgttattattcaggttggccgtgctcctccagtgccaccaccaccacatccatcacatccttattcgatctcttctcaacaatcttctccagctcatccatcgtcagcttttccaccacaatggccgataacaccaactgaccag

SEQ ID NO: 29096 - DNA, 790 bp, Caenorhabditis elegans
atgccacgcctagcgctgcggtaagatcgtgtatatactctaactagttcataatcgaattttcagacaatacaacttctattaccgcgtgaatggtgaaaaggccgaagaattgctcaaagagtatggcgaagatggagattttcttcttcgatacagcgaatcaaatccgcaaaatttctcgatttctgtcaggtttgttgtagtcattcactaataaattaatacaatttcggaaatcgttttcagagtcgccgaagacaaaattctgcatatcaaggtgacaaagtatgaaagcgacatgctcagtattttcgaagatgaacggactacgccaaatcaattcggttccatcaccgaactcgccgaattctacatggagtttccagaaaaactcagggagaagaatggactctttcttgaactgaaaaaacctgtttatgtgccatatcatctggaagcttgcgcagaagagcaacgacgaacgcaactttatcgctggtggcatggaaatttaccggcaagtagtgccaacaaattgctgcaaactgaaaagaatggaacgtatcttctaagagcaagtcaacacataccaggagctctcgtaatttccgctaagacagaaggacaagtagtacatttgactatctatcaagatccaagtactggaagattcaacattgatggtgatagaaccaagtttcaatctgcttggttgcttatagattcgtattccaaaaatccaatcgtcgagaaaggagaagcaagtcgagttctttatttagaagag

SEQ ID NO: 29097 - DNA, 986 bp, Caenorhabditis elegans
tttctacccaatgttcgcagtcatcaagggacctaacattgattatgctcaccagcaacgccagattgacaattaccgacagtcgattggatcttcaaaatatgtgattaaaaataaaaacgaagagccatcagaaaagtattggctgggattaatgcgagactggctcattagtattcaacgcggattcgatgaagaagttgctaaaggatcattcaatcttacatctggaacagttattggcagcaatgtttccgaggatgctcgtcttgctcacgctctcatgtgctctcatggttctctatttgagtgtgctggaagaataggaaagattcgactagttgatgcaagtggaattatcaactctgatggattctacaactttcttcccaacaccaccaaaatgggaattgagcaagaataataccgaaaacttcatcccaactgctgagccacttgcatattcgcagattccattctacttaactggcctcacggatactgctgtgattgtcgatgccataaaggacatccgaagtgtttgtgaacgatttaccgatcaaggacttccaaatttcccacaaggaatcgcattcacattctgggaacaatatcttttcttgactggaaatcttatgcaagccatttcgatcattaccatctctgtcttctgtgtcatttccgttcttctttttaatccatgggctgcacttatggttgtttgtattctcggaatcatgacttgcgaacttgccggattcatgggactcgttggaattaagctcaatccggtttcagccgtaactttgatcaccgcagttggaattggagtcgaattcactgttcatgtggttgtctcattcctgacggcgctcggaacaagatctcaacgaacgtcatctgcagttgatcgagtttttgttccagtaattcatggatcattctccacacttctcggtattttgatgcttggattctcagtttga

SEQ ID NO: 29098 - DNA, 1279 bp, Caenorhabditis elegans
tgttcatgtgaaacttggaaacaaaatttctgttgacctcgcagcttctgccagcgatgcaacacttggaaaagagtgcaaatttgctggaaaagcccttcttccaaatcaagaaatgaccgtctacgctatgaatatcgctgatgataaattgccaaagactatcgtaccaacaagtggaagtttccttgctggaacatttagtgctctcaaggattctgatttgagtgatgtagacaaatctgaagttatttactttctcagtgagtactctactcgtcctacgaaaggattgtcaatggttacaacaaagaaagatacgaatcaaaatcaggaaatgactggtagataataattaaaaattgtatcttttattaaattcatatttacagacgccattcgcgatttggaagtatcatgggtgcaaaaattgacagacgaaaaggcagcgaaagaatttttcgaagcttgtctgcagaagtatccagatcatctcccactacttcagaatcgagtaaagcaattgatgcaagcaaaacttgtggatcaaacaccggaaaacgtgcagaagattattgaattatgtggtcaaattttgcaaatcacaaaaccgaatgaaactcttcagttctcatccgtcaagcaagaacatgatgatgatctccttactgttgacaaatggctggcactaaccggaggcagtgaggaccagcgaaaggatgtggtgaagttgatttcacaatttgaggaacggaagaaaagtattattctcgctttgcaagctctttcatcattggagcaggatattgaagttcgtaagagcaagttcgacgttccagcaagtcttcgtttcggaggaatcactcctctaattttcggtggaaagcaaggagaagtgatcaataagaagtctgaaggttatgaagcactgaaatcaaaatctgaacaaattgatgcaactgtctctgaagaactgaaaaagttggatagtaattggactggaaatcagttttacgtcaagcttctcgtttggttgtctgctgatgatactaaaactgcactgatctctgccaaacatgcagctgctcttggacaatttggaagatgtgcaaagcttctcaacaaagctggagatgaactgaagtcgtctgctactgattcgcaagctgttgatacatcattggctgaagtctgcgaaagtctcgagtggaatcatcttgctactcactttaaaaattcggctctgatcaaaaacagaacctcctaccgtcttttctaa

SEQ ID NO: 29099 - DNA, 264 bp, Caenorhabditis elegans
aagcgacagcgggaattctcttcgtgaaatgtcacagatgtcaacgaggcagcgactgagggcccggaagacgtcaaacatgaacttccggaacaacggaggtttgtttgaaaatgggaataaaatttaaaattgtcatgttcaggtggttcaattccaattaatgaagaacatcaacagatgctaacagttccaaatggtgaagataaaatggcaaatggagatgataaagaggcaaataataacggaagtaagtttttttaa

SEQ ID NO: 29100 - DNA, 278 bp, Caenorhabditis elegans
gaaaacaaacttgaaacaacttacgccgtcgagttctacaccaacaccgaaatcaatgtcattttcccattggacaacgccaacgagtttctcgtgaaagatgtacatttcctttaatctggatatctgattgactaattcaaatcttattacagtaccaatcgatcgacaagcttgagagtgaagccgccaagaaaagatttgactcatccgaggaggacagcgagagtgagccagaaggagctgaggagccagccacagaggaaaatgaacaataa

SEQ ID NO: 29101 - DNA, 394 bp, Caenorhabditis elegans
actctggacaactctacgtcaagcctttgggaaatgggattttacattgcaactagctcaattcttgtcaattctggtcatctagctctacaagttcgctattggcattggcaacttgttgcactattctcatttttcatactttttaattttgcatttttctttgccgaatgtcttactgcggcagctgcaatggttcctgatccaccagtttggatgccaatacatgcaatgggagatcctagattttggtattatcaatttattacggttattgtggcattatgcccaaggttagttaattaatcacaatcacattttataattttaacttttcagatttacatcaatgtgtctaatgtcttctttgaaatctgaaacatcaaaaagataa

SEQ ID NO: 29102 - DNA, 1270 bp, Caenorhabditis elegans
atgcggttacatgggacagtcttgctggttatactcctcggttgccttttcgcaacttcaggtaacaaaaaaacggtattggaaatatcataattattatttttaagatggacagttggccgccatgacaattgacctcgggactcaattccttaaaattggaattgtaaaacctggaattccaatggacattgctctgaatacggaatcgagaaggaagacaccgaatgttgttatgattcaggatggccaccgaactttcgctgatgcagctatcggaatgcaagtccggtatcctcatcttgttcatggacaactcaacgatttagtcggcaaatccacacaacatccttcatttgagctattcaaaagacgaaataccttcttcgaggttgatgatgctccgaagaatgcttcttctattaacttcaagcttgggtaggcatcgtttctttatgtttcctataaaaaataataatgtatttttcagcggagaaagctatacagttgaagcactaactgctatgattttagcaaacgcgaagaagtttactgaagaatatgcacaagctgctgaaatcaaagatgttgttatcactgttccggtctactttacacctgctgaaagattggctgtagagcgtgcagctcaaatggctggactcaccgtccttcaacttatcaatgatggtacagctgcagcattgagtcatggaatcttccgtagaaaagaaatcggtgagaaaccgcagagattaatggtctatgacatgggagcagctaagactactgcaacaattgtcgagtttaagttggtcaaggagaagtacgagaaacaaccaaaaatgacagtcctgggagtagggttcgatcgaacattaggaggaattgagatgaccaatcgtcttagagatcatcttattgagatgttcgagaagaattataaaccgaagacaaaggtcaatacgaacagaagagcgatgacaaagttttcaaaagaagctgaaagattgaagcaagttctatctgccaatgccgaacattttgctcaaatcgagagtgctcatgaagatatcgatgctaaactgaaagtcactcgtgaggatttcaatcatcttatttccgacatggaatctcgttttggcgagccaattgaacaggctcttcggatggctcagattcctatcgatgatattgatcaatttgtgctgatgggagctggaaccagagtgccaaaagtacaggaaattgtgcagaaaacaattggaac

SEQ ID NO: 29103 - DNA, 311 bp, Caenorhabditis elegans
caacacgaccagctcctcgtccagttgctccaaagagccatttggcacaacaacctgctccagtgactgctccagttgccaagccaagagtaagattacacctcttaattgaaatctgaattttaaattttcagactgccagtgcaaaattcctccagtgctgcaagggacgtaaggtgcataattcttgcgaacgaatttgtagttttgatgttctttcgaagaaagttctaactggaatgttccttggaactgatgcatgcccacaacatcacggtctagatctgatgcagtgtgctgctgataatgat

SEQ ID NO: 29104 - DNA, 646 bp, Caenorhabditis elegans
atgaacatcacctttatatttattctcattttcggatttttcaatactcaaaaatgctcaaaagactatgatcactttgacgatgaagacttagcgttgagcattccaaaaaatgcaataggagttccaaaggagttcaggtacatgagtttttatattttatcaaaaattcagtttttcttatcaggcaacaagttttaaaagagatgaagcttcggaacagacccaatgatattttgaaaaatcgatgttattgcaattatgatcagtcgatatgtggaaataatatgacatgtgtgaaacaagatggagctgcttgttatcatgccgttgaagaggtaaaattaacttgtagctcttgaaagtttccgttttattttttggaatatttttacaccatggaggttagcaacatatgatctaggcgttaccagttttttaatgaatggatttttctcatttcttgaaactgacaaattataataattttttttttttgaaaaatcgatgttattgcaattatgattattttcaaaattataaaaataaattttaggtttataacaaagctgaaaaacgaatggaaactcttcataaatggggatgtgcaacactggaaagaggaagtggagcttcacatttgacg

SEQ ID NO: 29105 - DNA, 363 bp, Caenorhabditis elegans
tttttcgaaagtcgttttcttaatccaaattactgtcaagaagtagctgtcagttattggccatcatttgccacttcgtacttaaactattggaagaatatgcttggattcaaggtacactctcaatttacagataaaccaatatttttaatttttctgagtttttagatcccagaaaacattctaaatcacgttgcattccgtttgttctttgagaaaactgttggatttcctaataagaaactgcgcctgttattgaattctaaaccggaaatctcacaagaagaggcattcaaattgtacgcgaactccaaagcttcgtattcgaaggaggcagtaaagagaccaactgtgcaaggataa

SEQ ID NO: 29106 - DNA, 1042 bp, Caenorhabditis elegans
atgaaactactttctatactttttatttttgtatcctcatattccttctgtctagctgctccagctacggataaagtcaatgatttaccaggattgactttcacaccagatttctttcattattctggatatttgcgagcttggacagacaaatatttgcattattggttaaccgaatcatctagagctccaactcaggatcccctagttctatggctcaatggaggaccgggatgttctagtttagatgggttaattgaagaattgggaccatttcatgtaaaggattttggaaactctatatactacaacgagtacgcctggaacaaagtagaattccacttttaatattgtatgagaaagtaacaatttcagtttgcaaatgtcttattcctggaatctccagcaggcgttggatattcttattcaacaaatttcaatttgacagtttctgatgatgaagtatctctacataattacatggctcttcttgattttctatccaaattcccagaatataagggtcgtgatttctggatcacaggagaatcgtatgcaggagtttatattccaactctggccgtacgtattttgaatgacaagaaaaacttcccaaatttcaaaggagtggcgattggtaatggagccttgaattttccaaataactataatactatggttccattttactattaccatgctttagttcgtgacgagtaagttggtttataattaatctagatattgtacgttggtttgcaataagttgaagcatagtcctataaaaattgacttcaacgtttattgaataatcttcaaaaattggcaccgcgagtgatgagatcgtgacaagacctaacggaaattgccacattttgataactttccttctacctgatttttcaaatgatacttcttcataattgtatattttttcagtttatacaatgacattgcaagaaattgttgcaataacaacattggaacatgtgacatctacagcaaattctttgatccaaattgtagagacaaagttatcaat

SEQ ID NO: 29107 - DNA, 1622 bp, Caenorhabditis elegans
atgcggagatttagagaaggcaagcgcgccctaaagcaaagagggcgtgcacgagacggcgggtcgattcaagctctaactgtctgcgtctccactattgaaaggtgcttcaccgctgtctctaatccgattttctttctcttttctaccttcttttctgtcttttcttttttgtttccttctcgtaacactcaaatcttcctttcgtatagtcgttcgttttcatcgttttccgttagttgtgtattttcaggaaaacctgagatattttcaatttccgaacgtttgttctcgtttaatgcccaaccgcatcataaaaacgttaaatatgtttctcccaaatggagaaaagagcaaatttatgattgaaaaactaaaaaaaagtcatgactaaatagttattatgctcatcgaaaaatttgccagtttaaatgctattttatcgattttctgaaatgccctgaaatctttgattaaaatcactattttgattctctatcgagacatataaaagattcttgatttattttttaaaataagttgaaattataaacacaaatttgacgataaacaccaaaatgtgcgttaccttttcatttgcaatacatattatttaataagttttttaaatgtcaatcttcaaatattgtgttgttaaattcaaactcccagatgttttatttgctattttcagctgaaattcagatattcctataacaatttatttttctatttggattaaccagttcactgattctgtaaaagattacgaaatcaagagaattctcgaaacaaaaaattcattgcaacgttgatacaatttcatcttcggaacattttccctttaatttcctttaaatttcgatgatactgattaactcacctgattatatgagatctttccgactttaaattgatttttacacaaaaacattgttctctaaatatcgacatatttttatcttctaatcaatcaacactcaataatatccatttaattcaggacattaaatgtcttcaccgcaccgagcttcaacaactcagcagctggcggacttatcgttgacggaaggtgaacacgatgagggcaaaccgctttctattgactaccttcaagggcacgaaggcctgatcgaggtaaggaaaacgagatttcccgtcattctagcgccatcataatgtcgttttgattttttttttttttttttttttgatttttcccaaatctttcttcaactatcatcacctttttcaggaagtattaaaatggagtgaacacgaacagctcgattttatggacaaaattgttcatcgattatcacattatcagttgggaaaagtcgacaactttatcaggcccatgctccagagagatttcattagtaatttaccaggtaaaatttttgtctgttcagtattaaactaatctaattctattttatttcagcacatcttgtcgaattaattctgtttaatgtaaactcggattcattaaaatcttgcgaagaagtgagcacaagctggcgatgtgcactcgcccgtggtcaacattggaagaaattgattgaaaagaatgttcgaagtgattccctgtggtggggactttctgaaaaaagacaatg

SEQ ID NO: 29108 - DNA, 452 bp, Caenorhabditis elegans
tcttactgataataaattaacaacattcaatccatttcaatctaccgtggctcctgctgtgaatcaacatggaactattctacattctctagaattgaaagtaagaaaacggcttatgaaatcttctagtttctgaataactaattgaatttcagaataatccaattaaatgcgattgccaatttaaatggatggatgattttattcgagtaacaaaattcctttctgatcatcatatctcacacgacttcgataaagtggaatgtgctgatgctcaatcatcaaatttagaaagcttcgcctctgccgctaatgagcttttctcgtacaaaactaagatgacactgctctcaaaatcggaagatttcggtctcgaatgtgcggtaaagtacagtaacccacttaaaccattaatttatgtgctaatgttagtttgtttatcctatttgtaa

SEQ ID NO: 29109 - DNA, 593 bp, Caenorhabditis elegans
tgataagcgagtcgttggagagatgaaaagactacattccgatgaagtcgttcttcaaaatagtccgatggagttcttagagattgccaagtacttgaggtagatctttatgattgtatcaatcccaattaattattttcagaagtcttacatacttccaccgcccggattaccacaaaattttcatgcttctcatttcggtcatgagtaaaggaaaatttgcatggaatgatccatttgattgggaaatgcctatctccacaacaccatcaaaatcaacaccatctaaatcagttacaaagtcgccagcccaattgagtaaggaaacagtcaaaaaagcaagtagagagaagacattgagtaaggagaagacgagcaaagaagacattaagacggcacggaaaacgagtattgagaaggatgttaaggagaagctgagtaaggacatggcgagcaaggagaaaatcagtctctcggctgagaaaattaatatgtcggcagaaaagatagaagaagataataagaaggaagaatacatgagaatgttgccatttgatcctgatttctttgcttctgaccccattggtttctga

SEQ ID NO: 29110 - DNA, 408 bp, Caenorhabditis elegans
ataaaaataacgacgaagttgtgagtcaagatgacttcgtgaacggaattcctggaaccgttgatgaattgaatccagaatttgagaacatggagaaattagaaaaagaaagaaggttgcgcgaatttaatgaagaaatcgacgaaaattctgacggaaaagcaacttttcgagaactttatgattacgttgatccacagaacttccgacttgcttcgaaggaagtgaacgatgtaagttggaattaaatgccttccttgaaaataaaaattgattttacagataatgatgctgaccgatgccaacaatgacgagaaactgtcgctcgaagaattgcttgaaagagattggctccttgctcgatctagcttgttgtcggcccggagcagcttgcacgatgagatgtaa

SEQ ID NO: 29111 - DNA, 713 bp, Caenorhabditis elegans
atgctttattttaatcaaaagtacttttcagtaaagcatactgacaatggaacagtggaattgccaaaaggaaaaatagtcggatgctcgtggcaagttattagaaaactcggagaaggtggctgtggaagtgtatacctcgtcaaaaatcttgaagatgagactgaggcagcaatgaaagcagaatcaaatggtgcagcaggaggatgtgttctgaaattagaagtcgcaattttaaagaaattgtcaggcaaacctcatgtctgtcaatttctttttgctgcaagactgacggatttcacttacgtgattatgacacttcttggtgaaagtttgaataaaattgtcaagtaagaatatttatgaattaatactttttttgctataattattaattttcagaagaatagctcgtcaaatcaccgtctcttcgcaagtccgtattgctgctaatgtgctcttttgtttgaaacaaatccatgacgtaggaattgaattcaaaaattaattgaaggacatcaatatgttcagattggtttcatccatcgtgatctgaaaccagctaacatggcgctcggatacaagacaaataacgacgaatgccgcttttttcatgtccttgactttggacttgctcgtcaatttgttgtgtcacaatccgatcaaccaagcaaattgatgatgagaagaccaagggagaggtctcttttcag

SEQ ID NO: 29112 - DNA, 539 bp, Caenorhabditis elegans
agtcgtcatacattgattcttcttgatttcggacttgtacgaagatataaaatggaaagtggagaatggagagagcccagacttcgcgcaggatttcgtggaacgactcgctatgtctctatcagagttcaccgccgttgcgagcaatcaccgtatgatgatcttgtgtcagttatgtacactgcttacgaacttcttgctggtgaactcccatggaaacatcttgaaaaatcagaagaagttgtacagctgaaggaggttatggtaagcgacacacaaaaccgtttgcctggaagattacgagctttcagactgaaaatggaatcaatccagagctgttccaaggagacaaaagtgttcttatcgacttcttcaagcaggtttctgaaatggatccaatgaaagaaccttgctacgagaaactgattgaatgcatcaaagttctctacgctccgaaagtcttgactgatccatatgaatgggaagaaagcagcaaaggacaagatgaagtttcagaagagaacacaaacagcaaatga

SEQ ID NO: 29113 - DNA, 404 bp, Caenorhabditis elegans
acaaattcaaaattaattgcacaaatcgcctacacagctgctattgtcctcgcagggatcaatattgtaggagtggttaaatgcgctcaaatggtaacatttcctaatccttatctaaaactggaaaattttaacttcaggttgcccgtcaacatgtacattttgtgatggcagttatctctttgagcgcctggggagccatttttcttcttcccatcataattggttttgtgtgtccaaaccatacagcgtcagaatgggcagttttttatactgctgttggaatatgggttattataatgaatgtaccatttccatttttcgcaactatggatgccgcggagtacacgaaacctgagtgggaacagaaaaagaacactgttgctccggagcaacgaatttaa

SEQ ID NO: 29114 - DNA, 356 bp, Caenorhabditis elegans
atgctgtcttatcgacagacactacaatttcagagtaagatatacatttttcgataaacaaaattgtttaacttttttcagtggtctcaagtggcttagcgagagttatccggacggaacaaatactgttaccattgtcgttggataccagtaagattatttatattacacgccgtcttcaaatatatatttcagtgttgatgataacaatggaatgacattactctatcttaagactttgagagatcaaggttataaagttataacggtagctgctggtgtaggacatggagatttatctggaattgctgacaaaccagaatggtctttccaagttaataatttctttcaactat

SEQ ID NO: 29115 - DNA, 441 bp, Caenorhabditis elegans
accagacttttcatttttgcattgattcctcaattagtgatggcaattggatatttaataatgtcatttgtaagtttttccgaattcaattaaattctaaaatattccttttttcagactgatcacgtgattatcgctcagctggcatatacaatttcagttattttggcaggattgaatgttattggaatggttaaatgtgcacaaatagttgcagaaaaacatttaacattgataatggcagtaatatcaatgagctcatgggtttctgcatttattcttccaattgttattggagttatatgtcctacaaattcgcatgccgagtggtccagattctatctttttgtagctttcttcgttgtttgtactaatctaccattcccgtttttggcacgagttagcaaaagaacgaaagtggctcccgaaataaaattctga

SEQ ID NO: 29116 - DNA, 564 bp, Caenorhabditis elegans
cgtctttcgccccaccgggaggtgttgccactccacttgtctcagcagctgccgaacttggagatatcacaccacaagccacattaacacgacgttcacaacaggacaagattcttcgtggcgccgagaaagatattgatcgagttgatcgaagtcttgctaggctaaaatcacaacaatctgcagcggcgaatgcatgttcagcagttgcagttccgtcacctgaagtaccttcaacaacggcttcttgtgcttccgaaccgattcttactgcatcgacgacatcgcagtcacacacgcattcgaatgcaaatcataaaccaccaccacctccacggaaaccttgttgctcacaggtaatattattgaaggagtttaaatgatctttctgaactttaaattttttcatatgaccttaaattgtattttgagaaatcacctaaatttgaatgttttcaggcagccctacctccatcatcaatagtagctcttcctccagcaatgccactagcagaagatggtcctcttgtgataactcacacgcctacagtaacagatgtttga

SEQ ID NO: 29117 - DNA, 652 bp, Caenorhabditis elegans
atggaagctgttgttctcaggtatcaggttctatgaatatttctcaatacaaccaaaagctaatttcagaagccttctcccaattcgttcaccttatttctgtcgtgtcttcttttgcgggaaagcggaaaaattcaatttccttattatgactcttgtcggaaagaatttgagcgagcttcgtgccaactgcccgaatcgaaagttttcacgtcgaactggtcttcaaattggaattcaaatgatcaatgccatccaacaacttcattccattgggtacaaaacatttattatcattaatgtgttttaactcaataattcagattcattcatcgtgacataaaacctgccaacttttgcataaatctcgacaatccacatcaacttgtgatggtcgattttggaatgtgccggaaatatttgaatgatggaggaactcaactgagacatccaagatggtctgttcatggttttaggggaactgttcgatatgcaccactggctactcattatggaagagattcttgtcgtaaagaggatttggaaacaatcttttatgttttggttgaacttttagttggaacattgccttggatgactatggaagaacatattcatgttgagcattctaagcaagttgcaagaactacgg

SEQ ID NO: 29118 - DNA, 350 bp, Caenorhabditis elegans
ttcgccgtccttgcgcgtgctatttcggtgccacatgccataactgggcctgtacttgcccaacttgcaatctctcatcaaactatcccatatgtggatctgacggaatagtatacaacaatcagtgtcatcttaacacaatatcatgtcgagatcaaagagaaattcacgttcttccactaatatcccagtgcaacgagaaagatggtctggggttgtgaacaaaattttggattggtgaatcgagagttttagattcttgtcaatgcaaccgtgtcgggtcgtttggccatacttgtgatgaaactggacaatgtaagtgtcgaccaggagttgctggaatcaaatgt

SEQ ID NO: 29119 - DNA, 809 bp, Caenorhabditis elegans
atgcgccagcacgcgaaaggcgcatcggtgaaacgcgcaagcaatctccctccttctttgtttccacccgaggagaccgtgcgttgggatttttacagtatttacgaatatttgtaacttttcatataaagtcggcgttttagaagtaggtttcgcaagtttttctgtttcgataaataaatctcaaaattttaatattttgtaaatattcatttcttcattttcgtatatctcgtgcctttaaagaaaaatcattttccgcaaaaaactatttttgaatacccgcatcaatgagggcctaacattccatgcggcggcctagaaaattatggacgcgtactcctctcggacgattattgtttgaatgatttttttttattttcttcagtttatcaccaaattattagtcttttgccctttctttgacaaaattatatcgaaaaatatattatgagatttactaaaaacctatttactcaattcatttttgtttgttctcaaatgatgcattttcaacaaatattatgttttcagaatggagtattcatcaaaacttcgttttgcggtcagttgttccagtaatatgaatcgttcaatggaagcacatggcatcttaaagtaagctattgaaataactgagaattctaggatttttttttcagaaaacgtggcttcaatatcgaatcgtatgggtctggaaatcaagtgaaaatgccaggaccaacagtagataagcccaattgttatgagtttgggccaacgacgtatgaagacatttatgcggatttaacaaacaaagatcttcactt

SEQ ID NO: 29120 - DNA, 556 bp, Caenorhabditis elegans
cctcggaatatttgtgaaagcagttttactttttgtagtctactcaggattcctaattcaagtatttccaattgttgcaatgatttggccagcaattaagaagaagcttcgaacaacttgtggagtatctacaactacaaaaagaattgttcattttgcattccgatattctattgtgattgttgtttgtaagttttttctgagggaaatagtttggtaacttaaaatttttttgctgttttttgagatcggtaaaaaatgtttgatgaattcgaaaaaacattctgaaaattggacaaatctttattatttttcagttcttctgtcatacgcaattccacgtctttctgatatggttccacttgttggagtgactgctggaatgctccttgctcttgttttcccatcacttttccatcttctcatattcctgccacagtttgaatgccgtattggtttcctttttgatatatttcttgattttgtgtgcattattcttggaatgttctttgtcatttatggatccataactcatgttcaacacctgatgcattaa

SEQ ID NO: 29121 - DNA, 489 bp, Caenorhabditis elegans
atgaccgtcataaatgaacagctgacgagttcgtttttgaaattttctcacatttcgtcttcttctttttgttattacttttttccttttagctttattttgaattttcaggaaactctggaaatgaggataatttatttaatatcgactgtattattaatatatacaaatgcaacagttttaagaacaaaaggtttgatttctttattgagatgttcagttaatgaatgcatttattttttagaaagtattcaaaataaagttacttacgataaatacggattccaaccactttgtatctcatgtacaggattaatatcagttgccaggttggtcatttttatttgcaaagtcatatcataacttttcagttttttcttgaaatttgatgtttctgagccagtaattctcgagtttgcaaccattgtctgtaagctttttgccaaacaaccatgggcggtctgtgatggaatttcttcacaatttagg

SEQ ID NO: 29122 - DNA, 2418 bp, Caenorhabditis elegans
atgatggttggttaatttgtagagtttcctgaatctaatttgcttcttttcagccaacgagtcgctggtaatgtctgaagaagaccgaaacgtgttcacgtcgatcgacaaaaaaggtggtggctcgaagcaaatggacgacctcaaccaaaagtgccccaagaggaagacttccaagctgaaggtaacaattcatctaattcgtggccttgttttaattaatatttattttagggcatcccaaagctcgaagatgcgaacgacgctggaaccaaaaattcccaacagtgtacattgattctgacggagggagactcggccaaaacgcttgctgtttcgggactttcagtcgttggacgcgacaaatatggagtattcccatttcgaagaaaattgctaaatgtctgcgatttaaatgtgaatcaaatcgccgatagtgctgaggtcaatgccatcatcaagattctgggactccaatacacgaagaagtacgagacagaagatgactttaagactcttcgatacgggaaattgttaatcatggcaaatcatgattcagacggctctcaattcaaaggacttctgctcaacttctttcatcgcttttggcctgcgctctttaaacgcgacttcgtcgaggatttcatcactccaattgccaaagccaccgaaggaaaagaggaagtttcgttttattcgctcccagaatattctgagtggagaatgaatacggataactggaagtcgtatacgatcaagtactacaacggattggggacattgacttctaaggaagctaagaagtgcttctcggacatggttcgtcatcgtatccgcttcaagtacaacggagctgatgatgataaagctgtcaacatggctttttcaaagaagaagattgaagcaaggacagactatctcatgaagttgatgcaggataagaatcaaagaaagcagcaggggctggctgaagagtgcctctacaacaaagaaactcgatttgtcaccctaaaagatttcttcaactacgaaatagtttgctcatggaatttgcattcaattccatgtcttgtggatggtttgaaaccaggacagcggaaggttctcttcgcgtgcttcaaaagagcaaacaagcgtgaagtcaaagtagctcaactggctggagctgtcgctgaaatttctgcttaccatcacggagaacagtcgcttatgggaacaattgtgaatctcgctcaagattacgttggctcccacaacatcaacctgcttcttcctatcgggcagtttggtactcgtctccaaggtggaaaggacagtgcttcagctcgttccatcttcgctcaactgtcgcaagtcactcgtacactcttcccggctcacgatgacaatgtccttcgtttcctttatgaagaaaatcagcgtattgagccagaatggtattgcccgattattccaatggttctcgtcaatggagctcaaggaaccggtactggatggtccacgaacattcctaattacaatccacgtgaactggtcaagaacatcaagcgtcttatcgccggcgagccacagaaagccttagctccatggtacaagaacttccgcggaaagattattcaaatcgacccgagtcgatttgcatgctatggtgaagtttctgtgcttgatgacaatacaattgagatcactgagttgccaatcaaacagtggactcaagactacaaagagaaggttttggaaggattgatggagagctcggacaagaaatcgcctgttattgtcgactacaaagagtatcacacagatactactgttaagttcgtcgtgaagctctcgccgggaaaacttcgtgaattggagcgcggtcaggatcttcatcaagtcttcaagctccaagctgtcatcaacactacgtgcatggtacttttcgatgctgccggatggcttcgtacatacacttcgccagaagcgattactcaagagttctacgatagccgccaagagaagtacgtacagagaaaggagtacctcctcggagttcttcaggctcagagcaagcgtctcactaaccaggctcgttttatcctcgccacgatcaacaacaagattgttctcgagaacaagaagaagacggcgattgtcgatgttttgatcaagatgaagttcgatgctgatccagtgaagaagtggaaggaggaccaaaagctcaaagagcttcgtgaatctggagaaatcgagctggacgaagatgatctagctgcagtcgccgtcgaagagggcgaagacatttcctctgctgcgaaggccgttgaaaccaagctatccgactacgattacctcgtcggattagctctcatcaagctttcggaagaagagaagaataagctcatcaaagaatcggaggagaagatggctgag

SEQ ID NO: 29123 - DNA, 1505 bp, Caenorhabditis elegans
gtggtcccgccaatcagcttgtcctcgacctacaaacaggataatccaggagagccaaagggacacgattattctcgtgctggaaacccaactcgtgatgttcttcaaaagaatctggctgctctcgaagacgcaaaacactgccaagtgttctcttcaggacttgccgcaacttccgcaatcatcaatcttctcaagtacggagatcatattgtgtgctctgatgatgtctacggaggtactcaaagatatatccgccgtgttgctgttcctaatcacggattggaagtcgattcggttgatttgacggatgttcagaatctcgagaaagcaatcaaaccaaataccaagatggtttggtttgaatctccatctaacccacttttgaaggttgttgatattgccgcagtggtccaaactgcaaagaaagccaatccagaaattgttgtagttgttgataataccttcatgtctccatacttccaacgcccaatttctcttggagcggatgttgtcgttcattcaattaccaagtatattaatggacattctgatgttgttatgggtgctgttatcactgataatgacgagttccaacaacatcttttcttcatgcaacttggttagtttactgtgctgttgtacgcagtgaaatctagtcgtataattttgtcattttgaggcatagatacggtaaccggtcttgaagctagtgaaacttggcagctactgtattcgcaagtgcttcgaattttttcttaacggttttcactgaatttcaatattaatttcttcgtgtttttctagaaaagaaatcagtttctctgctttagaaatcatataaaatacattggaactataaaaaaaattgctaaatacttgtgggtactgtagaagcaaagtttcgctcatatcgagaacatgtaccttgagtcaaatgtcgcaaaattataaaactgtttaaaatctcattggatagctaaattaatcgttaactcaaaattttaatgctattattttcagccgtcggagcagtcccatctccatttgattgcttccttgttaatcgtggactcaaaactcttcacatcagaatgagagctcactatgaaaatgctcttgctgttgccaaataccttgaagccaatgatcgtatcgaatcagttctctatccagctcttccatctcatccacaacatgaagttcatgagaaacaaacaaagggaatgtctggaatgatctcattctatcttaaaggagaacttcaagagagtcgtgctttcctttctgctctcaaagtattcactttggctgaatctcttggaggatatgaatcacttgccgagcttccatctatcatgactcatgcttcagtgcctgctgaaactcgaattgttcttggaatcactgataaccttatccgtatctctgttggaattgaagatctcgatgatttggttgctgatttggatcaagctttgaagattgccattccaaaagtataa

SEQ ID NO: 29124 - DNA, 505 bp, Caenorhabditis elegans
atggttttcgtgtccaaagctgcttcagtaaagctgtcaactactacagttcatgagagaatcttcgaagcttgtcgcattcacgcttcagctaacaaagatgccgtttgttttgtgagttcttaccttaacaatttttatttacggaatttggattaatggtagaataggattggaagttgtgtcagactatctattgtaattgaagatcaatatagattgaattggacattatgtgcattattcagatcgatgctgaaacaacgacaaaaaagaaattatacaaagatgtggaaccaacagtgaatagtttggcaacagctctagtgaaactgtattaaacttcacatattttctgaatattatcaactgaatttcagaggcttcaagcctggggatgtagcctctcaagcatttccaaattgcccagaattccttgttgcaatgcttgcagttatgaaatgtggaggagcaatgtctaatgccagtgcaattttcacagatt

SEQ ID NO: 29125 - DNA, 248 bp, Caenorhabditis elegans
cacggagcgagactatgactcagaacgccgtaggatcaaagtctacatgaaccatcgtttcagagaatgtgctgaatattttatggttcgttttaccgtttttacatgaacaccaacaattttttaaggatacgcacggcgagaaatggaaggaagagaaggaagctattgataaaatgaaagctcttcgaaaatatttggtcgatgaattagccaagattgacagtcaggagcaaatgtgtcaataa

SEQ ID NO: 29126 - DNA, 825 bp, Caenorhabditis elegans
atgttgtcatcgtctggacacgcaattcgccgcggaatcaccacatctgctgcactatcaaacaaacatgctttcatcgtcggagccgcccgtacacctattggatcatttcgttcttctctctcttcggtaactgctccagagctcgcctcggttgccatcaaagcagcattggagcgtggagcagtgaagccgagttcaattcaggaggcgagtgtgttctttgtttgcatttttctatactagtaatatctgaaattctatatcacttccaaaaactaccgatttaatcttaaaatgcctcaatttcaggtgttccttggtcaagtctgtcaagcaaatgctggtcaagctcccgctcgtcaagcagctcttggagccggactcgatctttcggttgctgttaccaccgtcaataaagtgtgctcttctgggctgaaagcaatcattcttgctgcccagcaaattcaaaccggtcatcaagattttgccattggcggaggaatggagagcatgtcacaagtaccattttatgttcaaagaggagagatcccatatggtggatttcaagtgattgtgagtttaatttatttttctaaaaaatattaaattgtctaaaaatagtctttaaacttctttaaaagaaatcaatgctcacattttcttattcaggatggaatcgtcaaagacggactgaccgatgcttatgataaagttcacatgggaaactgcggagagaagacttcaaaagaaatgggaattacacgtaaagaccaagacgaatatgctatcaacagctacaaaaagtcagctaaagcatgggag

SEQ ID NO: 29127 - DNA, 1146 bp, Caenorhabditis elegans
atgtcggataaaaaagttttcattctgagtggagctcgcactcccatcggagcttaccgaggatctttcgctaactttggcgcagttgagctcggaacggtcgctgcaaaggcagcaattgaacgatcaggttaaattactgataatgaaattttgaaacaaatattaaatatttttaggagttgctccggagaaaatcgaagaagtaattggtggatgcgtacttccggccggtctaggacaaaatgtgacccgacagatctctttgtcggctggtcttccagtaacaacgcaagctgttacggtgaacaaggtttgctcttcttcgatgaaagccttggtgacagcagctgtggaaatcaaagcaggatattatgacactattcttgttgttggaactgaaaatatgagtcaagttccattttacgtgccgagaggagaaattccatttggaggaatccagatgacagatggaatctcgaaggatggacttgaagatattaaagagaaaggtccaatgggattatgtgctgagaagactgtaaaagattatggaattactagagaagaacaagatgcatatgctattgaaagttataaaaaagcttcaaatgcatggagttctgaaaagttttcggaagaagtggtaccagttagtgttaagacttcgagatcggaagtagtgatcactgaagatgaggagtataagaaactgatcgagtcaaaggtatgcagaaagaaaatgtttatcaaaaatattaaacttatttaggtttcctctttgaaaccagtcttcgttcgtgacggcactggaaccatcacaccggccaatgcatcttcgcttaatgatggagctgtcgcaactgtcgttgtcggagagaatgctcttccacaaggagctcatccacttgctgaactcgtggcatttgctgaagctggaagagctcccattgatttcaccgtggcaccagtggacgccgttcgtcttcttctcaaaaaaagcgggctccaagtttcagacattgcattgtgggagctcaacgaagcatttgccgtcactgttcttgctttcatcaaagaacttaatattgagccaagtgttgttaatgtaaaaggaggtgcagtagcgattgggcatccacttgg

SEQ ID NO: 29128 - DNA, 1046 bp, Caenorhabditis elegans
atgcttcgcaaaaccagtgggtcaaacattcgacgtactaagctcgaggcttcagcggaaattgttgccatagacaataaagtcgatgaggcgaaaacgacaaaggatcttgatgacgttctcgaacgtattcaggctctagtccagagcgtcatcgatgctccaaaattgctagagtcaactggctacgtaaattctttgagggagattatgagcagatatttcaaagccaagtaagttgaactccataataaaactaatttgtttcaaatatataaatattttgaaaatttacgattcatataagtaagcaaattaaacatattaagcgagaacaaataaacatcagcctctttaaattatattttttacgtatcaattcaatttcaaagacaaaactaggttgtttcaaaagtctccaatgtcaactcctcctgtaaattcgtcttctatctccaatcttttttcagaatgttgtcattggatggacacgcaattggccgcggaatcaccacatctgctgcactatcaaacaaagatgctttcattgtcggagccgcccgtacacctattggatcatttcgttcttctctctcttcggtaactgctccagaactcgcctcggttgccatcaaagcagcattggagcgtggagcagtgaagccgagttcaattcaggaggcgaatgtgttctttgtttgcatttttctatactagtaatatctgaaattgtctatcacttccaaaaactttaccgattcaatcttaaaatgcctcaatttcaggtgttccttggtcaagtctgccatgcaaatgctggccaagcttccgctcgtcaagcagctcttggagccggactcgatctttcggttgctgttaccaccgtcaataaaggatggtcatcaggaatgaaggcaatcattcttgctgcccagcaaattcaaaccggtcaccaagatctggccattggcggaggaatggagagcatgtcacaagtaccatttttccttgctcgagtcgaacagtcgtctaacaaatatcaggta

SEQ ID NO: 29129 - DNA, 435 bp, Caenorhabditis elegans
atttgtggaattgtaaccgccttctgctacaagtttgatggatatattctattggacatctacgctgtactcttcggatttacgattgcatcgtatgtttgtctgacctctgtcattcttgttgatctgttaggacttgacaagcttacaaacgcgttcggattattgctcctgtggcaaggagttggaacagtaatcggaccattggtatcaggatatttggcagatctgactggcaattatacactttcgtttgttttctgtggaattaatctcatggtgagtaagaactgaaaagaattgtcatgaatcgagaaaacaatttagcgtgatttattcttatttcaggtatctggactcatgctcttcgtcatcccgtacttcaagagaaaagacgatgtagacgtttccaataaacaaagaagtagccaataa

SEQ ID NO: 29130 - DNA, 847 bp, Caenorhabditis elegans
atgcctaccgagatacgagagatacgacctcagagtatctctcggtacggtactgtaaatggcagtttggggatcgcgtgtaatcatttttataattagtaattttcagccttaaaaacatagtattatccataaaatgttctagatcccatcttgacatcctggatcaatcgacataaactgttcaaatcgttattaattaaaatttcactgtgacgtggaattttttatcgataggctgacgttgtggtatgtagtccctctgtcaatctctctcttggatactaatcctccaccctctcaattttctcccccgccccatgaagatccagcttttattgaaggtcttcacacctatgttcgttttttcttctactcgaaatatttatgcttttttctttcttttgctccatttttcttacttttcaattagcaagtttgatttatgtctcttctttccaagtcaattccaaatttattcccctctccgcctaattcccaaatcttttttctcatatttcgttgctcacgaacaaattgcctcatttttcagaggagatgatgtctccatattttgccggttttctttacatagccacagttcttaccggactatttggaaatatatgggtcgtttgctcagtagccagaagtcgaaaaccaaagtaagttctgaaaagctttgaggaaaaactagttataaaaatgttcagatcccttatgtccagaagctccccttcagatcgattacgtgcttatatttcagtgttagcagtgattgatttaacagttttaatggctcttttagttagagcattatatcattttctaccacattttatgctcg

SEQ ID NO: 29131 - DNA, 346 bp, Caenorhabditis elegans
atcgtcaatatgagatgcaccgtgttgccgacgctgccatcaacatttacagctctgccgctgttctttctcgtgccacctatgccatcaagaacaaatcttcaagtgctgattttgaacgcaaagttgctacttactacgttgataaggtaatttttgataactgccaaattttaagttttaatttcgatatttactctttcaggcgatgaaatcatcaaacagattcctgaaggatgccggaagtggtgttgagaatgcttcgaaggtagcaacaattgaatcattggcgaaggaagtctgtggaaatggaggactcactcttcaacatccagttgaattgtaa

SEQ ID NO: 29132 - DNA, 719 bp, Caenorhabditis elegans
gtcgattcattgtttaatcctaaacgctggagtctttggaactgcgtcaaaaactacagtcgacggtttggaatcacattttgccatcaatcatctttctcattttttggtaaatcaaaaattccagcaatcttctataaaaaaacatttttaagttaatccaagaactacttccaattgttcgacagtcgattccttctagaattgttttggtatcttcatcagttcatgcaacatgtggagtttctcctgaaatgtctatagaggagaagttgaagattctgtgcccagagagttcatcagatgcttcatggttccgactatattctcgatcaaaaatgtgcaatatgttggttgcattcaaacttcacagagatgaatatcacaacggaatcagcacatattcagttcatccaggaaatggggttaggacgagcatattccgagattcatggcttgtaagcattgcgagtattctatcaactccatttacaaaaaatataagtcaaggagcatctacaacagtttactgtgctggacacccagaagttgcaaatgtttctggaaagtattgggattcaaattgggatgatgagaaaggtttatacgaagaagttgcaagagatgaacaattacaagatgctttatggaaacattctgataaaatattagataatatgttgaatgataggaaaaagtcatgtcaatttgaatgctga

SEQ ID NO: 29133 - DNA, 1444 bp, Caenorhabditis elegans
atgtgtcgaactctacttggtgtagcttttctagttgtgacggtcctatctcaaggagaaaaggatttgatccagaatctgcccggtcttttgttcaaagccaatttcaagtcatattctggatatgtcgatgcaaatgcaaatggaacatggaaaatgcattatatgtgagttttatattctcggcaaatctggaaatctgaagtcttattttcaagtgaaccattagtgaatgtatttttttcgaattcattagttctcaaaatttctcaaaattccagctttttgctttcatatagtttcttagatcttctttgaaaagtatactccttactcgaatgcacgttttttttgtgaaatttcgcagtttacacaatgattgaagatcattctattttcggaactcattgaacttcaaaacgtatttctcatcaaaatttcaaaagttcccttgaaatgtcatttctcaattgaataatcatcaattcattttgttgtcactatttcttctgtttaatttaaaatttccacctcacgaagcatcaagtagtcatctaattcagtcataattcttgtgtaattctctgcaaatacaattaaaaatttactgataacgtttttcgctgtccatgcgaaaactgataaaattattggaaatacaaattaaaaagaaattgtgcttccaggttgacagaatctcgatcaaatccagatactgatccattattggtatggttcaatggagggccaggatgctcatctcttggaggacttttcgaagaacttggtccattttatgttaactttgatggacaaactctttatgagaacccatatgcatggaatgcggtaattattatttttggggaaaaggataagctgtttgcaattccaaagaccagagttttattatgtagttaaaagaatttcaaatcagattcctgtaacactcggttgcctatgaaaaccgaaatgataatcataactttcagtttagactacaactcttttcgatcaaaggcggtttgctaattaccattcgaagaccacgttatgatatttagttctcgttgaattgatagagaaaagaaagtttgaatagaaaatagtcttgcttacgcaaatttcaagttttattgctttttgcaatttatcgttgaaacctcatttattgtatagataacaaatttaggcacataaaacacaactttgtgtagtttaaaaatgaaaccaaattgaaacataaaaagggacagggacatgtattaggataataaaaactataaatttaatatttaaaatttcagaaagccaacgttctctacttagaatccccaattggagttggttattcatatgacactactactccaggatacttccaagctaatgatgatcaatcagctgcacagaattatcaggctctcacaaacttcttcaatgt

SEQ ID NO: 29134 - DNA, 313 bp, Caenorhabditis elegans
atgcgcggcgacactgaaaatcgttccgacggagaaatggacgatgtttcaacaagcagcgaaatcagacatggaaatggatttattgagaatttcagagtgagttattaatttattaaaatgttcatcggtgggaagttttcagagtcaaaccggcaattcttcacgcacaaccgcaacaaatgaacgcatcaaaaagaaacttgtgataaagaactttaaaggtaatatttgtaaagttttcattagttattttgatttccagcgaacgcgaatcaaaatgatgttgcgatgggggacaccaatattgata

SEQ ID NO: 29135 - DNA, 782 bp, Caenorhabditis elegans
atcgtcgacaagtctaataagcctaatgttgaggtgaaggttggatccgagacgaaacaattcactcctgaagaagtctctgccatggttcttacgaagatgaagcagattgccgaatcctaccttggtcacgaggtgaagaacgccgttgtcaccgtgccagcatacttcaatgatgctcaaaaacaagccaccaaggatgcaggatctattgccggacttaacgttgtgagaatcatcaacgaaccaacagcggcagccatcgcttatggattggataagaaagatggagaacgcaacattcttgtcttcgatttgggaggtggaactttcgatgtatcccttcttaccatcgacagcggagttttcgaggttcttgccactaatggagatacccatttgggaggagaagatttcgatcaacgcgtgatggaatacttcatcaagctgtacaagaaaaagtctggaaaggaccttcgcaaggacaaccgtgccgttcagaaacttcgccgtgaggtagaaaaggccaagagggctttgtcaacccagcatcaaactaagatcgaggtgagttatttcatctttatcatacataatttcaaaataatatttgcagatcgagtcactcttcgatggagaagacttctcagagactttgactcgtgccaagtttgaggagctcaatatggacttgttccgtgctacattgaagccggttcagaaagttttggaagatgctgacatgaagaaaactgatgtccacgagatcgtactggtaggag

SEQ ID NO: 29136 - DNA, 567 bp, Caenorhabditis elegans
gttgcattagtagcacaggaaccagttctctacaatggatctgtacgacataacatcctttatggatgtgattttgctactgaagatgacatgctcaatgcttccaagatggcgaatgtgcatgattttgtgatggaattggagaaaggatatgacactaattgtggagagaaaggagttcagatgagtggaggacagaaacaaagaattgcgattgcacgagcattggttcgtaatccagctgtattgattcttgacgaagcaaccagtgcactagatacagaatccgaggctttagttcaacaagccttgagtaggtgtgctcaagaacgaactgttatcatagttgctcatcgtttgtctactatcgagaaggctaataaaattgctgtcatagtcaaaggatgcctcgttcaggtaactctattggaagatatattatttatacatgacacaaaaatcaaatttcagatgggaacacacaccgaacttatgacagacacagacggaatgtattactcattggtgtctcgtcaaatgctgagtgctaaagttggagaagattaa

SEQ ID NO: 29137 - DNA, 757 bp, Caenorhabditis elegans
atggcttatttggagcgtgcctattttggtcttcagtgcttctggggagaatctgcatgggcgaagctgaaaggagttgtggtgacacgagttggatatgctggaggaaaacaaccaaatcctacttataagaatatcaaggatcatactgaaatcacagagatcacttttgatccaaaagttattgaatactcaaagctcaccaacttcttttggaagcatcacaacccagctgaaaggagaaagaaggtaattttcgaattgactttaaagtttcaaatattgttctactggaaaacgtaacaaaaagtaagttctaattgattataattttttaggttaaaatacatttaaacttcaaattaattcgtttcaatttcagcaataccaatctgcgattctctacgtaaatgacgaccaaaagaaagtcgctgaagaaactttgaaagtagcaaaggacaagcatggagacattgaaacatatattgagccattggacaagttctatcaagctgaagattaccatcaaaaatattggttccgtcaaaagaagattcttttcgatgaactgtctcttcttgatactcaagttgctgaaggagaacttgccacaaaattgaacgcatattgtgctggcttccaggacttccacgatcttgagcgtcttgcaaaagagtacggattaaaggattcttttgtcaataaggtgaaggactatgctctgtcaggaggagatccaagaaactgtcatgcttaa

SEQ ID NO: 29138 - DNA, 331 bp, Caenorhabditis elegans
aagcctatttgatgatttctaccgttcgggaactcccaatgaagatctcgaaggtgcaatgaaactgaacattcacaaaatgaatacatccgttcgtctaaatcgtgttattcgagaaaattctccagactctcagttgatcttattgaatctaccatctcctccaagaaaccgtcttgctttcaacaattcttatatggtcagttttttcagtttgcatttaaaattggtattcatttttcagacatatttggacgtgttgactgaagatttgccacgtgtacttttcattggtggaagtggccgtgaagttattacaatcgactcttaa

SEQ ID NO: 29139 - DNA, 1027 bp, Caenorhabditis elegans
gtatttggatacgacgagaagcaatcactattcgctaaacatttggttaatcgaatggctaatttccaagtcaatcgtctttgctttgatatttcgttcgaatccctaaagagaactctgaccaatcacgccttttcgcaacctcatgatctttctgcacactttatcgatcttctcgtagtcgataatatttggagcaaagaacaactgcttgcggtttgtgacagtgtcactttagaggatgttcacggatttgcgatcaaaatgcttcaagcattccatatggaactttttgttcacggaaactccactgaaaaggatacgcttcaattgtcaaaggaattgtctgatattcttaaatcagttgcaccaaattcacgtccattgaagcgtgatgagcacaatccccatcgggagttgcagttgattaatggtcatgaacatgtctacagacacttccagaagactcatgatgttggatgcgtggaagtcgcttttcaaattggagttcagagcacctacaacaattccgttaataaattgctcaatgaactaataaaaaatccagcgtacaccattctcaggactaatgaagctcttggtaaaagtgacaagaatttcagtttctaattgcattcaattttcaggttataatgtatccactgaatcacgtctaaacgatggaaatgtttacctccacgttattgtccaagggccggagagtgcggaccacgttctcgagagaattgaggtattcttggagtctgctcgagaagaaattgtcgcaatgccacaagaagatttcgattatcaagtttgggcgatgtttaaagaaaatccgccgactttgagccaatgctttagcatgttctggagtgagattcattctagacagtacaatttcggacgcaataaagaagtgcgtggcatttcaaaaagaatcacgaaagaggaagtcatcaatttttttgacaggtatcacacttgccaaattattaattacgttgaatatgttctctttttatag

SEQ ID NO: 29140 - DNA, 1182 bp, Caenorhabditis elegans
atgatcccaactactgtcttatcgaacaatgttgaaatgccattaatcggccttggaacaactcattctggaggctattatcatgacgctgttctccattcaatcaaaaaatgtggctaccgtcttattgatacggctaaacgatatggagttgaaaaacaattaggaatagctgtcaaaaactgttcagttcccagagaagagatgtttttgagcacaaaactgtggccagttgactgtggagatgaagtgtacaatgcatttcagacatcatgtgaaaaattacaaacggattatttggatatgtatatgatacacatgccacaacttcctgattggattgtgaatcagaaagagacaaaagaaaagacatggagacaaatggagctcctttatgaagatggcaagttcgggttttgttttaaatgttttaaacttgcatttggtgaagcaactagttatatagctttaaaaatcagctgtaacgagctatgcaagttgaacctaaaactgccaatgagcattagtcgttcaaaaaatccccaaactaatttcactatcattacagaacatgtccgttcaattggtgttagtaattattcaatcgaagatctagacgagttattagagtttgcaagtatccttccacatgctaatcaagtagaacttcatccatggttccaccaggccgacctcaaaaattattgcgatgaactggggattctcacgatgggttactgtccacttgccaagggaaagtatttggaagatgaaacgctctgtaaaattgcttcaaaatatcaaaaatctccggcacaaatctgtcttcgttggagtattcaacaaaacgttccaactgttccaaaaagtacagactgtcgcagattgaaagagaacacgaatgtttttgattttgagctgtctgcagaagatatgaacactttgaactcattctcatctcaaaatcgaaaggtagacttcaaattcaaattaataataaaccttttattccaacactttcagattgtcgatctatcaaacatttgccaaaaaatgtctcttcctgacggctacaagttaaatggacgagtcttcggagttccagaagaggatgagactattccgaaaagttgctcaaaatgtgctcaaaaacaaaatgtaccacttccagtgtgtatataa

SEQ ID NO: 29141 - DNA, 817 bp, Caenorhabditis elegans
atgacagcaaaaataaatagagtggcgccttattcgactcatttcgtttttttttctccggatattagattgtgtggcaggcggctccattgtatattacgtgccgaattccagaagcaccacgccatcggatatctaaaagaggaggtgtctttgtttgcgcataataaaacaatcaatcaacacagcaaagacccctctcaacctcatttcatgattttctttggtttttaggtagcattgctctcttcaatcatatggattcgttgtttcagatggcatccgcaatgaagtttcaatactactcgaagaaagctgctggaaagacaatgtctaatagtgtgtaagttttcatctttcaaatcttacatacacttctcccgttcaattttgaactgtaggagtgaactccaggcaatttatttatacatagactctcattattttttctttacatggaatgcgaatgttttctttcatataacgcaaaaagtataatattcttcgaaatggtttttgcaaccggaacgtttgggttgcaagtgatatgaagtttaacctagagaaatgttaagtaaaaaagatcagctttagaattataaacaacaaagcgcaagcgcaagatttcttttaatttgaagtcaactatgttgaattgttcaagaacaatctgatgcatggactacaataaaccatcagtaatttctgtactttcagctccatgtccagtgacaatcgcatggaggattttaaacgtcgttttcgtcgaagtggatcgttaggaattccatttgtcccagaagaagatgttaaacaa

SEQ ID NO: 29142 - DNA, 821 bp, Caenorhabditis elegans
atggatgtggatgcgccacttcaggcgcctgaacaaccggtcgcagacgctgacgatgaagaagctaactgggaaatggaaaaagccgaaatgaaacggattgagttcaaccaaaatcgggaactgaccgatatgcgtgagcgtgtggaagacgtatcgcgatcgaacagtcgaatgctggaagaacttactcgtcatgcggctgaaattaaagagcatataaacagacaaagggttctggaatcaacgcgaaatgagcttactgacaagaatgtgagttcacacgaatatagtgaaaactgaaattgtaatatttcagttggagttggaaactgtagtttctcgtttgaaaattgagaaggaagaacgggacgccgctgttgttaacgccacaaagttggcacaaactgctcaagtcgagacatttgctctgaaagatgaaataaagaagctaaccaacgagcaagcaagtttaagacactcgaaggaagctcttgaaaaagaaatccaaggaattcaggtaggattttattgtattttggtgatcaaatgtccattttcagtttgaacgacaaaaatatgccacagaacgtagtcttcacgctgaatcaaaaacgtggctcatgcaagaggtttcagagcgggacaacaaagtttcctcgcttcgtctcgaactcagcaataaagatatacaaggcgccaatgaacgtttgcagtatgttcaacagatcaatcttctcaactcacaggtcgagaatttgaatgaaaaacttgacatgctcaagtttacaaatgccgatttgattaaaagaatggaaaac

SEQ ID NO: 29143 - DNA, 589 bp, Caenorhabditis elegans
atgcagacgatcaagtgcgtcgtcgttggagatggagctgtcggtaaaacttgtctcctgatcagctataccacaaacaagtttccttctgagtatgtgccgacagtcttcgacaattacgccgtaagtttaagaaaaaaaaattattttatataaaaataatttccgaatttcaggtcacagtaatgatcggtggcgagccatacacattaggattgtttgatactgctggacaggaagattacgatcgattaaggcctctatcgtatccacagaccgacgtgtttcttgtttgcttctccgtggttgctccagcttcattcgagaatgtccgagaaaaagtaagaaatattgttctcgaatttattctatatatctgaaattgttttagtgggtgcctgaaatttcgcatcattgctcaaagaccccattcttgttagttggtactcaagtcgatctcagggatgatccaggaatgctcgagaaactggcaaaaaacaagcagaaaccagtgtcaacggatgttggagagaagttggcaaaggaattgaaagcagtgaaatacgttgaatgctcagcgttgacgcag

SEQ ID NO: 29144 - DNA, 320 bp, Caenorhabditis elegans
atggcggcaattcacatcaatcacgatgtcttcaataagtatcatactaacgggaaacttcgacttacaacaggctatgttcaggtaaagaaatcaatgtagaaaaccaggaaatttaattttgatgaattttcaggaggctatcgaaaacaatggatatcctggacatgatggaatcgttcaagttttggtacttttgactaattcaaaagtttcgcaataattcgataattttcagaaaggcaaagtagagcaaggagagcaacttggtcacgcattcactttcagaattcgtatctcagacggtgttttccaataca

SEQ ID NO: 29145 - DNA, 353 bp, Caenorhabditis elegans
agtaccttcgacaagaccaacagcgaagaaaccactccgattgcagttacttggggagtattcccaggatctgagattgcccagccaacagtcgtcgatccactctctttccgcgcatggagagatgaagcttaccaaatgtggatggcccaatggtaaggtatctaatcactcgttctgtctaattgtttaattttaggggagatttttatccaaaagaatctaaatcatatggagtcatcaaggctgttcatgatgagttccgtttggttactctcgtcgacaacgacttccagaagccatcagttcttttcgacgtacttcaaaaggccctcgacgagctgaaaaagtaa

SEQ ID NO: 29146 - DNA, 612 bp, Caenorhabditis elegans
atgtcttctgctcgtcgttgccttttcggtcgtccgacgcccgagcaacgctccaggactcgaatttggcttgaagatgctgttaagcgcatgcgccaggaagaaagccagaaatggggattcgactttgaactggagactcccctcccaagctctgctggattcgtttatgaagttattccagagaattgtgttccggagttctacaggtaattgaattttataaatttttcatagttattttactaaacagtttcatttttcagaaccaaagttctcactgtcagaaccacatgctcatcgctggacatcagctcaacgactttgactccattgagctctccgagcacatctgataaggaggagccctcgctgatggatcccaacagctcgttcgaagatgaagaggaaccgaagaagtggcaattcagagagccaccaactccacggaagaccccaacaaagcgtcagcagaagatgaccgacttcatggcagtttcccgtaagaagaattcgttgtctccaaacaagctgtctccggtgaatgtgatcttcactccaaaatctcgtcgtccaacgatcagaactcgatcttcatgctctccatactag

SEQ ID NO: 29147 - DNA, 557 bp, Caenorhabditis elegans
atggcggcaacaacagccggcgacgggaagcgaaaggcggctagatgtctcttcggaaaacccgatccagaagaggtaaataattattttaaatctgatattcatagttaaagttagcaggtttctcgacagctcaacagcagtctggaagaaatgtataaaaaggattctcgcaagtttaatttcgatttttctggcggagttccaatcgttggatcacgaggagactatgaattcgagtcgatttctgcttccgaagttccaagcttttaccgagagaagattgttcggccgcgaaaaatcattgccagacggaattcaacaccggtttctgacactgttgagatgccttcagaatctcctcctgtcgtggaatcgaacgagactccacttttgattgcttctacgtctactgaagtaaccgtatacgagaagcctgtgaccaggtaaatcagaaattcagtactttgaaaataattattttaatagatcgtctgctgctaaacaatcaatcgaacaacaggagacgtacaacttgaagcagacaaaattgacaa

SEQ ID NO: 29148 - DNA, 1065 bp, Caenorhabditis elegans
atggattcgcatgtcggcgaagtcgatattttccaacaatgcaagtatattcatgaggtttgttctaatttcagtttgtttttggtttaactagtgtcactagttgcacaaagtttgagagaatattttaagattttttttttctgaaattgattgaaccatttttcactgagtttattaaaaaattgtgtaccagaattctaattcacattccaattattgttcaatttcaggtggaactcgtaaatatgaagttgcaaatgcgaattctggagacacacattgagacaaaagaccgacttctgagaaatttagaagatattatagacgaacaagagtcacgaattgcaaatatggaagattttattcaaggtacgcactgtcgtgtgtagtgaatttttgtgaagttttgcatgattaaaaccccgtattacttatccgtaatcttagacacttacttgatatattgtcatgagtaccgtgttttttaatcccaattttttgatcgtcgtgtgatttggctatctttagctcaaaagtgttatcttttaatacgcatttttgttttttcttaaagtaattgtgttgtggtggtcggattggcatgattttatagtgtttaatctttattattttctacttggttttttggttgacagtgccttttttcaatttcacatattctaccaaaatcatttcaatccggccgatactgataatatttttctaacatcattacatgttcactttaatttcgcaagtccaaacaaaacttacaacagcttatttctaaacaataatctagcaaacggctaattggaatgatcaggttattaaatgttgaaattgaattgcaggccgtgccacgtcatacacaaatcggtcaaatatgctgaaaggaatttcagttctttcactggatttcggaaatctttcggaagaaaatctacgattgaaaaatgcgctgagccaaatgcaaaaagtggcaagagtgaatgagttattggaaactgatgaagattatgaaagtgatatgacaagcaatgaggatcgatttgctttgag

SEQ ID NO: 29149 - DNA, 656 bp, Caenorhabditis elegans
gatccgaactagctaatatattggtcacaattttgaaaatgtacgaagtaatggtatcccaagtcgaaagaattcggaaaaggattgcactaaaaagaaaaagaaaggatatccaggtttgaaaagaatatatttaaaatgaaaagataaatagtcaataaattgagtggccgtggaagagaatgtccttctgtttggactgtctgagtctcttttagagagggaagaggcatagagtacttcgcggaaaaaatgagtctggtctggacaacgagatagatagagagagccaaccgtactcggtcaaatgtaatgcatgtattatattgtcatatatgccccaaaatagggtttaagttattttatacaattgacaacattattaacatttctttttagagttagatcaaccttatagttcaatactttatttcctctattaccattccagtctcttatagtcacacttaccagcaaataaaaaatagtcctacatgcaggcctaataaaaaaacaatgtttatttcaaattttaggacgaatggaagtttgcagctcaagcagttgaccgattctgccttataatcttcacaattgtttttataatttgttgcttcatttttgttgcaattccacctatcaaaatattggattga

SEQ ID NO: 29150 - DNA, 574 bp, Caenorhabditis elegans
gggaatcttcacaacgggatcttcaattctcggaggaggagttaaggcaccaagaattagaacaaagaatcttgtttctattattttctgcgaagctgttgctattttcggtattatcatggctttcgtgttcgtcggaaagctcgctgtaagtttcagaaactattattacaaattaaaatttatgttttctttttgaaactcagctttcttgtaaaaaaattacaattaaagattaatttttaaaaagttttagaaaaaaaaacatggaatgatttttcaggaattccgtcgtgaagatcttcctgatactgaagacggaatggcaatccttgctcgtaacctcgcttcaggatacatgatctttggaggtggtctcaccgtcggactctccaaccttgtctgtggtcttgctgtcggaatcgtcggatctggagctgccattgctgatgccgccaatccagctcttttcgtcaagattctcattattgaaattttcgcttccgctattggactcttcggaatgatcatcggaattgttcagactaacaaggcttcattcggaaacaaataa

SEQ ID NO: 29151 - DNA, 397 bp, Caenorhabditis elegans
atgcttacgcttctggagccgcccggggctaaacggtccccgacggtcggcaattataacaacagatcggctcaacacttgttaaatctaggtaatatccctaatcaatttttcctagtaaattaaaaaaattacagcaccagaggaagacgatctgtacgaaacatacgaagaaactgaagattatgcagaaaatgagccaacgggaaacattctcaccagagtaagttatttaaaattcatttatttctaataaatttgtcagtcatttcagtttctggatcaatatcttgtcggacaatcatcatcagctgattacaacgatcgttggaaaagagaatttcgtgcaagaccatcgtggtgcgatgctgatctgtgtcttcaacaaatgaaccgg

SEQ ID NO: 29152 - DNA, 296 bp, Caenorhabditis elegans
atcggtggaacctacgcctctccagttgtcttcccaccacaagtggctattggagcaattggaaaaatcgaaaaactcccacgattcgataaacatgacaatgtaagaaaatatttttcaaaatttgtgagacgtgttgataacaaatatttatttaggtcatccctgtgaacatcatgaaagtttcgtggtgcgcagatcaccgagttgtggacggagctacaatggctcgcttcagcaatcgctggaagttctacctcgaacacccatctgcaatgctcgcccaacttaagtaa

SEQ ID NO: 29153 - DNA, 415 bp, Caenorhabditis elegans
agtgtcagcactgaaagaattcaatgttatgcatccatttgcctacctcatcgagaaattgacacgacagaagaaagatttaaacgcgaatgagaggtttgactctattacttttcaaattatttatttaaacgttcttctcttaaatagctatattttcatttgacagttttcagaccttctccaattatccaatctgtaatgaaaatttctaaaattctaaaattctgaatactatataaactgaataattccttcaacattttttcagcgtttcagaaaacagtcttcgtctgtaaattctacatcaacgtcaccaccatctactacagttgaagcttgggttgaaccggttcccacggcgacaacaacttcggctcccgcacttaaaaaagataaatgcacactgatgtag

SEQ ID NO: 29154 - DNA, 393 bp, Caenorhabditis elegans
ggttacgatacaatagttggtgaaggaggagcttctttatctggtggacaaaaacaacgaatagccattgctagagcaattattcgaaaaccaaaaatattacttttggacgaagcaacaagtgctcttgatactcaatcagaagaaattgtacaaaaagcacttcgatcggcaacaactggaagaacaagtataatagtagcacatcgactgagtactgttcaacactgtgatacgtaagtagaaaatatgataattcaatacaacagttgtttattttccagaatctattatatatctcgaggagcggttgcagaatatggtacacatgctgaactagtggcaatggatagtaaatacgcacgattagtggctgctcaaagtttaagctga

SEQ ID NO: 29155 - DNA, 1452 bp, Caenorhabditis elegans
gccaacttcatccaatgaaacctcaacggcttgtggtgtgcaacgatttagtagtttcctatgaaatgccaaaatatatgacagttgttgaatcaccaaagttagatgctgcagatatttctgtatttcacactgaagattacgtcaactttctgcaaacagtgacaccgaagctcggtcttacaatgcctgatgacgttttgaggcagtttaacattggagaggattgtccaattttcgctggactttgggattactgtactttgtatgctggtggatctgttgaaggtgctcgacgattgaatcataaaatgaatgatattgtgattaattggcctggaggacttcatcacgccaagaaatcagaagcttcaggattttgctatgtaaacgacattgtgctgggaattttggagttattgaaatatcacaaacgagtattgtatatcgacattgacattcatcatggtgatggtgttcaggaagcattcaataattctgatcgagttatgactgtgtcatttcatcgttttggtcaatatttcccaggatctggaagtattatggacaaaggtgtcggtcccggaaagtattttgcgattaatgttcccctgatggctgcaattcgagatgaaccttacttaaaattattcgagagtgttataagtggcgttgaagaaaattttaatcctgaggcaattgttcttcaatgtggttccgattcattgtgtgaagacagacttggtcaatttgctttgtcgtaagttttaaaattacttttttgcaatctaaatattttaattaaatctaaacatattaagattcaatgcacatgcacgcgcagtcaaatacgtgaaaagtcttggaaaaccattgatggtccttggtggtggtggatatacacttagaaatgttgcgagatgctgggcccttgaaactggagtcattttaggtcttcgaatggacgatgaaatccctggaacatcattatactcgcactatttcactccacgacttcttcgcccaaatttggttccaaaaatgaatgatgctaattctgcggcatatttggcttctattgaaaaagaaacgctggcatgtttgagaatgattcgtggagcaccatcagttcaaatgcaaaatattgttggaatcaggctcgacgaaattgagcaaatcgaagaaaatgaacgactacaaaaatcatcaaaatcttcaattgaatatgaagttggaaaagtatcagagaaaatggaagaagaatgctttgtagaagaagactcaaaacctccatcatttccaccgggtcaagatcctcgtcggattggtcagtactggggatatgacaggtctggattggctccaccgagaagtcactcggatgttattgaagaagcaaaatatgaagatcgcgacagacgaaaagatctcaatattcccggaattccgtaa

SEQ ID NO: 29156 - DNA, 1312 bp, Caenorhabditis elegans
attagttccaaacagtattgtgaaagcgaaacatgaaaagaagcgggtttttgttgcacacgagcaagaagaatgttcggacaagttttcgctattctatgtgcgaccaattgaaagaggatatgtggtgaattgggatacacaacagcaaatctgggagaaaacgttcggatctatggatgtggaggcgtctacttctcgaattgcactcacagataataactatctaatcccagctcttcctgatgtctctagtgaaatattgtttgattatttcggcttcacagaggtacacaaaacgtctgcttcgactttggtggcaaaacattcaaataaaatcaacaacgaaaagtgtgcagttgttgtggattccgggttttcatggactacggtagcttcatttgtgaatggaatgcttattcaggatagtgttataaggttggaaagtgttttcaaactacaattagctttatttttaaggatcgatgttggtggaaaagcgttaacaaataaattgaaggactgggtatcttaccgacaattgaatgttagcgaagaaacatacgttatcaacgaatgtaaagaggatctttgcttcgtctcacaaaattttgatgagagcatgaaagaggctaggtaggtataaaaatgaagaatactaattatattgtttttattcaggaatcgatttcaagaaaatacaacaatgaaacgatatattatgccggatttccactcgacattccgaggtgtagtgaaagacgttaaagagccacacgatccacaaattccttcaattcatttgggagttgagagattcgccattccggaaatcttattcaagttagtaatttcggcaaaaagtataaactattttatctgttgcagtccctcggatattgatattgatcaatgtggtgtcgcagaagctgttatcgagagtatttgtcaatgtccagaagcattacggcctgctctggcagaaaatatcatcgtgattggcggatcgtcgtgcttcccaggatttcgtgaacgcctggaacgagaagttcgatcaatgctgccagcagaatatggattgaatgtttcaaatgacgtaataaacccacaaactcattcctggcattgtggtcaagagcttctcactgcttctaaagttccatggatcaaccgaaaagattgggacgaacgaggagactcgttggagttctctaactttttccagactcttgtgcaatccgatgaactgaagggaactcgtaatttcgatgatcagagggagaaatccccaaaggaagatgaagatttctga

SEQ ID NO: 29157 - DNA, 1324 bp, Caenorhabditis elegans
atgtctttattcgcgagacaacttcaatccttgactgccagtggaatccgcacacagcaagttcgtcttgcgagcacggaagtatcattccacacaaagccatgcaaacttcataaacttgacaatggaccaaacacctctgtcaccttgaacagagaagatgctctcaagtactaccgtgacatgcaggtcattcgtcgcatggagtctgctgctggaaacttgtacaaggagaagaaaatccgcggtttctgtcatctctactctggtcaagaagcttgtgccgtcggaatgaaggctgcaatgacagaaggagatgccgtcatcactgcttaccgttgtcacggatggacctggcttcttggagctaccgtaaccgaggttcttgctgaattgaccggtagagttgccggaaatgttcacggaaaaggaggatccatgcatatgtacacaaagaatttctatggaggaaacggaattgttggagcacaacagccacttggagctggagttgcattggccatgaaataccggtatgttaacaaattttgatgtatttttttacgagaacaactcatattttttcatctaaatattttattttattttcagtgaacaaaagaatgtatgtgttactttgtatggtgatggtgccgctaatcaaggacaacttttcgaggcgactaacatggctaaactttgggatcttcctgttctgttcgtttgcgaaaacaatggattcggaatgggaactactgctgaacgttcatctgcttctaccgagtattatactagaggagactatgttcctggaatctgggttgatggtatggacattctcgctgttcgcgaggctaccaagtgggctaaggaatattgtgacagtggtaaaggaccacttatgatggaaatggccacctatagataccatggacactctatgtctgacccaggaaccagctaccgtacccgtgaagagattcaagaagttcgtaaaacaagagacccaattactggattcaaggaccgtatcattacatcttcattggccacagaggaagaacttaaggctattgacaaggaagttcgcaaagaggtcgatgaagcgttgaagattgctacatcagacggtgttctcccaccagaagctctctacgccgatatttatcacaacaccccagctcaagaggtaagtaataacattcattattttttcgtcaattattgttcacattttcagattcgcggagccactattgatgaaactatcgtccagccattcaaaacttctgctgatgtactgaagtctattggaagagcttaa

SEQ ID NO: 29158 - DNA, 299 bp, Caenorhabditis elegans
ctattacttcatgtttacaaagcaaccgagtattgttccggagaggctgtcttcaaaagatactattccgatgatgtaagaattcctctctaattttggacaactctataaattaaacatttaaggttcgtgctcgaatgtatccaattgtggaagaagaagagagagtaagaaagaagattaaagaagaaatggcaaatgaggtgtgggcacgagcaccaaaacctgtcgagcaacgaactcctctaaaattggataagaggaatatcaaaaagaaatcaaatccgaacaccgattaa

SEQ ID NO: 29159 - DNA, 712 bp, Caenorhabditis elegans
atggcctcagttccgactcagagagacgagaaggaaaagaagaatgatgagctggctacggctatcttgaaagtaggtttttctccaaggtaatcatttcaatataattaactctttcaggacaaaaaacgcccaaacagactcattatcgatcagtctgacaatgacgacaactccatggtcatgctctcacaggccaaaatggacgagctgggactcttccgtggagattcggtgattttgaaaggaaagaaacgaagagagactgtctctatcgttcttaatgcggacaattgcccgaatgacaagatcaagatgaacaaagtggttcgaaacaacctcagaagccgtcttggagacgttgtcagtatctcaagtgctcaactcgaatatggaaaaagggttcatgttcttccaattgatgacacaatcgagggattgactgggtatgttcttgccacggagaaataaagactgtattttttattttagaaatctatttgatgtcttccttcggccatactttaccgacgcctaccgcccagtgcacaagggagacatattcactgttcaagctgcaatgagaactgtcgagttcaaagttgtcgagacggatcctgctccggcgtgtattgttgctccagatactgttattcactatgaaggagatccaattaaaagagaggaagaagaggaggctctcaatgaagtt

SEQ ID NO: 29160 - DNA, 1926 bp, Caenorhabditis elegans
ggatacgatgatctcggaggtgttcgtaaacaactcgctcagatcaaggaaatggttgagctcccacttcgccatccccaacttttcaaggctatcggagtgaaaccaccacgtggaattcttctgttcggtccaccaggaaccggtaagacactgatcgcaagagctgtcgccaacgaaacaggagcattcttcttcctcattaacggaccggaaattatgtctaaaatgtctggagagtcggaatcgaatcttcgtaaagcatttgccgagtgtgagaagaactcacctgctattttgttcattgacgagatcgatgcgattgctccaaagagagaaaaggctcacggtgaagtcgagaagcgtatcgtctcgcaacttctcacacttatggatggacttaaaactcgcgctcatgttgtcgtgatcgccgctactaatcgtcctaactctattgatggagcccttcgtcgtttcggtcgctttgatcgtgaaattgacattggaatccctgatgctgttggccgtctggaaattctcagaattcataccaagaacatgaaattaggagaagacgttgatttggaacaagttgcaaacgaatgccacggatttgtcggagctgatttggcttccctctgctctgaggctgctattcagcaaattcgcgaaaagatggagctgattgatttggaggatgatacaattgatgctgaagttctcaattctttggcggtcactatggagaactttagagtaagttatcatttttttgcacttaagagacgtatcattaatcatttttcagttcgcaatgggaaaatcatccccatctgctcttcgcgaagccgttgtggaaactccaaatactacttggtccgacatcggaggtcttcaaaacgtcaagcgcgaacttcaggagctcgttcaataccctgtagagcatccagaaaagtatctcaagttcggaatgcaaccatctcgtggagttttgttctacggtccaccaggatgcggtaaaacacttctcgctaaagcgattgccaatgaatgccaggctaacttcatttccatcaagggacccgagcttcttactatgtggttcggagaatccgaagctaatgttcgcgacgtgtttgataaagctcgtgctgccgctccatgcgttctcttctttgacgaactcgattcgatcgcaaaggccagaggaggaagtgtaggagatgctggaggtgctgccgatcgtgttatcaaccaggttctcactgaaatggatggtatgaatgccaagaaaaacgtgttcattattggagctaccaatcgtcctgatatcattgatccagctgttcttcgtccaggacgtctcgatcagttgatctacattcctcttcctgacgaagcatctagacttcaaattttcaaggcctcactccgcaaaacgcccctttccgccgatctcgatttgaacttccttgccaagaacaccgtcggtttttcgggagccgacttaaccgaaatttgccaaaggtttgttataaaaattagttaaaaaaatattcgcatttgtcaattaataccattttcagagcatgcaagcttgccattcgtgaatcaattgaacgggaaattcgtcaggaaaaggagcgtcaggacagaagtgctcgtggagaagaacttatggaggatgaactggctgacccagttccagaaataactagagcacacttcgaggaggcaatgaagttcgctagacgttccgtgactgataacgatatcagaaaatacgagatgttcgcccagactcttcaacaatctcgtggatttggaaacaacttcaagttcccaggagaagctccttctgctggacaacctgttggaggaaacggtggctccggtggaaatgacgatgatgacctgtacaactag

SEQ ID NO: 29161 - DNA, 523 bp, Caenorhabditis elegans
agtaaaaccggagcctccgttacttcaattactgctgcatacgcacgttctggtgccccattcattgttccttctgctgtttctaaagctggagttgagataatgactaagtcattggcaactgaatggtcaaaatatggtcttcgtttcaatgcagtatctcctggaccaattccaacaaaaggtgcatggggaagattgttttctggagaaatgggtgacgtcgccgaaaaaatgaaggaattgaacccagaaggacgatctggaactccagaagaagttgcgaatttagtggcattcatctcgtcagatcacatgtcatttatgaatggagtggtacacttttactagatttttaaaaattcagttccataaatttttttagatcatcgatttggatggtggacagcaacatttcaaccatggttcccatatgggagacttcttgcacacttgggatcaggatacctggggagatgttgagaacgttattcgtggaagaactggaaaagagaaaccttga

SEQ ID NO: 29162 - DNA, 917 bp, Caenorhabditis elegans
atgttgaacgtaagttaatcatctcctccgtgtccaacatattattttttaaagcgtaaccgaaacgttaacaagcaaaacggtcatcagaaacaaaatggagctcaaaagtcagaacttcgaggaaaaaatgcaccaccatatcttgaaagggaaacttgtctggggagaaacgatatttttgtcgttgaaaaaatgattgctggtggaggatttggacaagtatatagagcaagaaatactgtaagatttgagatttttctgatttttttttcatttcattttaattttcaggaaactcaagaagaagtggctgtcaaagtggagcgagcaacaacaaatgactctcagagaatgattttggaatcaaaagttttggatgatatgctcggttcaaagcattttccaaatgtctattacattggaccatatcactcgtacaactttattgtgatgcaaatgcttggaaagaatattggagatattcgaaaaatgatgccaaacaaaaagatttcaatcttatcttctgttcgaattggcattcaaatcattgaagctctatctttgcttcattcaaaaggatggcttcatcgtgatttgaaaccaactaactgttgcctgggacttgatgaaaaacggaagacggtttatctcgttgattttggaatgtcccgaaagtttcgtaatgataatggaagtctccgtgaaagtagaacatattgtggattcagaggaactactcgttattgttcgtatagaatgcatgaccgccgggagcagggaccagttgatgatttatggtgtctttattattcgttgggtgaattgattgaaggatgtttgccatggagagatatcgaatcagctgatgagatggctcatgttaagaagattttgaaacatgaggacatatttca

SEQ ID NO: 29163 - DNA, 280 bp, Caenorhabditis elegans
aggttcctgcagttataaaaaacacgtctcggatttgcgctgagcttttgatcattgaacgagatatcgaaaaaatgttggacaaaattgaagaggatacgaaggaagatatggttatttctttttttcttttacactcttgtgttcccgttttcagcttcgatcggaatggagattcgctgcgatggcagttgaccgactatgtctttacgtattttctgcttttatcacaatgattacatgtggattgattgtcccacatatactggcaaacatttaa

SEQ ID NO: 29164 - DNA, 837 bp, Caenorhabditis elegans
gccgagatctagtcgattggctcgttgatcacatggctgatattcataatcggaagaaagctagaatctatgctgcgagattgttagctgctggtcttatcagacatgtcgtcagcaagttgacattcacagaaaagtgctactatgtattcggtgatggaattcttggcaatgatcgtaattccacggacaccactggtacgagtggaactacaatgcgagttgaagcaactactgaagtgacgtatgttggctcaccagcaccacatgctctggcagcacgagttggaagaaatattcctcatcgattagaaaccactactctaagcccagttgctcatgaccaaacatggcttcgaagacgtcgagattgtgagagtcctatgacaaatgattacgcatcgatggtcggagaaagccaaattggaatgaatccagtcggaaattatcatgtttttgggacgaaaaataatcaccgtcaggtaccggcaccttctcaagtgacatcctcaagcttgacaaacggtgagaaaattaatcgtttctatagggtgcaggagttaaatttgaagcaaatattcatttcaattgatatagtatttgctgtttcttgactactgtaccctttgtatccaaatgacttttcacataacagtatttccccaaccaaattagttacaaattccaggaagtggtggcttaggaggccctccgccgactcctctatccagtactatggttctagcagcttctccgattcagtcgcagaacgcagtcaaccacgatttcgacggggagaacagtagcaacagcagaacgcgtattttacggacttaa

SEQ ID NO: 29165 - DNA, 894 bp, Caenorhabditis elegans
atggcatcagctggagattccattcttgccctcaccggtaaaagaactactggacaaggcatcagatctcagaatggtaacaccgaaagctcaatataagtatacattaattaattgcagtcaccgcggcagttgcgatcgccaatattgtgaagtcatctcttggccctgtcggacttgataaaatgcttgtcgatgatgttggagatgtcattgtcacaaatgacggagccacaattctgaaacaactcgaggttgagcatccggctggaaaagtgcttgtagaacttgcacagctgcaagacgaggaggtcggagatggaactacttctgtcgttattgtggcggctgagctcttgaagagagccgatgagcttgtgaaacaaaaagttcatccgacgactattatcaatggttaccgtctcgcgtgcaaggaagccgtcaagtacattagtgaaaacatctcattcacttccgactcgattggtagacaatcagttgtcaacgctgccaaaacttccatgagcagtaagattatcggaccgtgagtttggtgttgtctatgcttcaagaaaattgatttttcagagacgccgatttcttcggagagctggttgttgatgccgcggaagctgttcgtgtggaaaataacgggaaagtcacttatcctatcaatgcagtcaatgttctgaaggcccacggaaagagcgctcgcgaatcagttttggtgaaaggatatgcactcaattgcacagttgccagtcaggccatgccacttcgtgttcaaaatgccaagatcgcatgtctcgatttctctttgatgaaggctaagatgcacctcggtatttcagtcgttgttgaagatccagccaagcttgaggctattcgcagaga

SEQ ID NO: 29166 - DNA, 486 bp, Caenorhabditis elegans
atgggaactccaattgcgccagtgaaagtcaatatgggcgacaaaatcaaggatcagttcactgtgaagaaaaagttgggagaaggtgcttgtggtcaggttttcctcgtggatctgattcaaggagttagtttgaaagaaagtattcaattactataagaactattatagaagggaagtgctgcaatgaaagtagaaccattgatgaagaataaggaggatgaaattcttaaaatggaagtgtatgtgttgaagaagttgcaaaagtacataagtccaaattgtaatttttatctttaattttcctttttcagctctcgccacgtttgtcgtcttttggggtccgggaaaaccgaaacatatacttacatggtgatgagtgttcttggaaaagaaattggagatgttcgtcgaagactgccacagcgtaaaatgtctgcaccatcaactgttcgtgttttcattcaacttgtcaaagctctccag

SEQ ID NO: 29167 - DNA, 663 bp, Caenorhabditis elegans
atggtttacgggcttggcgaggcgctgaagaatcttaacagttactgccaagagagaactactcgcattcgaaactctttgtctccgtccagtatgtttttttgtcatttctattaaaagttaaatatcttctcaatcacttgactcgtttgaatataattgaatttgaagggccttcgatgagtgaggcgacagcgacaggaagcagtagcagctcaagagcatccactactattccttcaacgcctaacatggatgtgacaccgactgtggaggatccacgccagaatgacaataacggtaaattgaagaaaactttcagctgtaaacttttataaagcttcaggaatgacacgtgacgaattccgtcaatacggaaaggaaacagttgattatattgtggattacttggaaaacattcaaaagcgacgagttgttcctgctattgagcccggatacctgaaagatctgattccatcggaagcaccaaacactccggaatcatttgaatctgtaatggaagactttgaaaagctcatcatgccaggaataactcattggcaacatccgagatttcatgcttactttcctgctggaaattcattcccatcgattatcgctgatatgctgagtgatgcaattggatgtgttggattctcttgg

SEQ ID NO: 29168 - DNA, 717 bp, Caenorhabditis elegans
atgaaaattcctgatttaactaactatgagcatttgattggaggattatgtggaggtgtgacaagtacagttgtatgtcatccatttgatcttttgaaaattcgattttcaggtttgatttcaatttaattacgcataaaaattaattttcgtcattaatttcagcaaatgaaggaagttcactcaggccacaatattcaagttatgcggatgcagttcgtaagattgtccgcgtggaaggtgttcgaggattatatcaaggatggacgccaagtctgattggtgcatctctttcgtggggactctattttcagtggtataactctttgaggacaaaaatctacgaaaatttctcgacaggaagtaaactggcaaataacttgataagtggatgcatatctggctcagctatcatgtgcattactaatccaatttggctcacaaaaactcggtattaaaatgattcgagatcaaattaaatgttctgaataggatttcagactatgccttcagtatgaaaatcaacagtctaaaaagtatgcaggaatgatggattgcttgaagaaaaccgttaaacaggagggattttttggattgtatcgaggtttcgtcacgggtgtcataggaacaacacacggagcagttcaaatcgcagcatatagctggataattgataaaagatgtcaatcacaagggttacctaaagattcatttttg

SEQ ID NO: 29169 - DNA, 1475 bp, Caenorhabditis elegans
atgccaccagcagttccagccgcagctgcaacagcccgacaatcggcttccggtcgcgagcgcaatttcaaggataaggacaagccagagagtgttcgcaataggtgagctttgttcctttttgtttttaaatcactagttcattttcagtaacatcgttgctgcaaaagctgttgctgatgccgtccgtacatccttgggtccaagaggaatggacaaaatgattcagtccgggaatggggatgttaccatcaccaatgacggggctaccatcttgaaccaaatgagtgtcattcatccaactgctaagatgctcgtcgaactttcaaaagctcaagatatcgaagctggagatggaacaactactgtcgttgttatggctggagctcttcttgatgctgctcagaacctgctttctaaaggtattcatccaactaccatttctgaatctttccaaagtgctgctgccgaagctgaaaagattcttgacgaaatgagttcaccagtcgatttgtcaaatgacgctctgctcaacaagatggctacaacatcgttgaactcgaaggttgtttctcaacactcatggttgctcgcacctatggcagttaatgctgtcaagaagatcatcaattcagagaacgattccaatgtcaacctgaaaatgatcaagatcatcaagaaaatgggagacacggttgaagaatccgaactcatcgaaggagctctcattgatcagaaaaccatgggacgtggtgctccaacaagaattgagaaagccaagattggactcattcaattccagattagccccccaaaaactgacgtgagttgattgaagaaattaattttttaaattcgcattcaaatttcagatggaaaatcaagttattatcactgattatgctcaaatggatcgtgctttgaaggaagaacgtcaatacttgctagaaatttgcaagcagattaaagctgctggttgtaatgttcttctgattcaaaagagtattcttagagatgctgtcaacgaactcgccttgcatttcctcgccaaaatgaagatcatgtgcatcaaagatattgaaagagaggatatcgagttttattcaagaattctcggttgccgaccagttgcctctgtcgatcattttaatgctgatgcactcggatatgctgatcttgtggaagagattccaactggaggagatggaaaggtcatcaaggtgactggtgttcaaaatccaggacatgctgtctctattcttcttcgtggatcaaacaagttggtgcttgaggaggctgacagatctatccacgatgctctttgtgtgattcgatgcctggttaagaagaaggctttgttgccaggaggtggagctccagagatggaaatcgctgtaaaactccgaaatctggcacaaacccaacacggagctacgcaatactgctggagagcatttgctgatgcacttgagctc

SEQ ID NO: 29170 - DNA, 435 bp, Caenorhabditis elegans
atctaaacttccaaagaaaagacgaagagttcttcaaccacacgaaattaagccagttgttggaagaagtacaactgcagttatgataagtgctctcacacaaagaggtccagttagtggtggaggttcaaatccttcagatggtaagttaactggttggcagacggtggttactttctggaaaaaaacattgtcaacttattgaaatttctcaagtggttctataaagtctcaaaccgttgccaagcagttgccaccgattaccttgtataaaacacactttcaggaggccctctctctgcgttttctaacaacactccacttctcgtgtgcccacctgacggatccacaaaacctaaaaaactcagtcaaaacaagaatggagggaccacaccgattcaaaacaatggatccaaagcgagcaagctaatctga

SEQ ID NO: 29171 - DNA, 601 bp, Caenorhabditis elegans
ccaatggaagtctacgtcgacgacgaagccaagctcactctgcacggacttcagcaacattacgtcaaactgaaggaagccgagaagaaccgtcgtttgctgaatcttctcgatgcactcgagttcaaccaagtcgtcattttcgtcaaggccgtaaaacgttgcgaagctctccaccagctcctcacagaacaaaatttcccatcaattgccattcatcgtcaaatggctcaagaagagcgactttcaagataccaagcattcaaagacttccaaaagagaatcttggtggccaccgatttgtttggacgtggaatggatatcgaaagagtcaacatcgtgttcaactacgacatgccagaagattccgactcgtatcttcacagagttgcacgtgctggtcgttttggaaccaagggtttggccatcactttcgtttctgatgagaatgacgccaagaccttgaacagcgttcaagaccgcttcgatatcagcatcactgagctcccagaaaagatcgatgtctctacctacagtgagtttatatataccaacgcccattcaaaaattcttattttcagtcgaaggccgaaccaattga

SEQ ID NO: 29172 - DNA, 354 bp, Caenorhabditis elegans
atgagcacacttcaagcagctgctcatggaagaattgttcaactatctcgtatcagaaaggtacttttgaaaatccggtcagtttcttaagcgcttttcaggaaattgccgatctagcaaaaaataagcgacgttttatcaaggatttccgaaaaattgaaaagtgcaaggatatcttccaattcaaaattattggtgtgagtctaactttcacgttttcagaaacatttaatttttcaggatggagttctgtacaagaatatgattttcacattgactctagatgtgaatgtcgaatatccattcaaacctccatatttgaaattttgccataatgtagaaaacgagataatg

SEQ ID NO: 29173 - DNA, 265 bp, Caenorhabditis elegans
atgtcaaatagattgtggcctgttaaacaagtgtgtattttcgcacttattgcgtttgcatctaattttaattatggattttcaactacctatatcaatacatctgttgatgaatttaaggtaaatatgaaatacaaataaatctcttcatatttttgtttaagacatttttgaatacatctttaagtcgtcgtcatgtcataatgactgaagaaaaatatgacctaatttggaatgtttttctgaattgttggtttattggatc

SEQ ID NO: 29174 - DNA, 362 bp, Caenorhabditis elegans
attttttggagtttggattaactcgatttttagtgaaagatttggaagaagaggcacgatttcatgaactataaaggttcaaaatatagttttcagtgggctttttgattggaaattcggttgcattcatttcttcaattttacaatgcttgtctcttatttggtattgtcctgaactactgatcgtttctcgattcattacgtcaatttgcatggcagctacttatcaatcatgtattttgtttttgcaggttagtaccatatgatttcttgatattccatatctatggattctagaataattttaggaaaaaataattttgagacgcaacattatgcgaaaggaatgcgaaattccaata

SEQ ID NO: 29175 - DNA, 799 bp, Caenorhabditis elegans
atgggcttcttgaagattctccgtaagcaacgtgctcgggaacgcgagatgagaatattaattcttggattagacaacgctggaaagactactttaatgaaaaaattcctcgacgagccgactgatacaattgaaccaacattaggatttgatatcaaaaccgtgcatttcaaagattttcaactaaacttatgggatgttggcggacagaaaagtctaagatcttattggaagaattatttcgaatccacagatgctttaatttgggtggtagattcgtcagatagaggtagaaacaaatatttaggatacattcaaatttataaaaacttttttcagagcgtcttctacaatgctccgaagaactcaaaaaattgctcggagaagaacgattagccggtgcttctcttctagttcttgccaacaaaagtgatctgccaggggccattgatgtgaattcaatagcacaggtaattcagatgtcttcagtatatacttccgaaaagaaatgctttcttgtaagccttaacatgtagatatttatattagattcattattcacatgttactctcgtaacatacattttgaaaatgaagaaaatctttaaagaggcacggaaacataggaaccttgaaactactcaacctattaagaattttctaggtactcgatctccattccatcaaatcccatcactggaagatctttagttgctgtgcactttctggtgatcgactggtccaagcaatgacatggttatgcgatgatgttggaagtcgattattcatacttgattaa

SEQ ID NO: 29176 - DNA, 377 bp, Caenorhabditis elegans
ggttgtccaaaatcattcttggaaattgcgactacccttcggaagttaacttacaaagagacacctccatatggcagtttcatggagaagttgaaggctgatcttccaaaaggagtcaagatgtatgatacttgaacagtcacttttattatattttcactttcaggactgatccattcgaatggaacttgaaaggtgcattggatgagaacaacaatggaaacaagtcggatcgtgaggatgcagagcgtggcggtggagcagatacagtcaatgaggttgatgagagtgtcattactgaagatcgtgcagacacaacttcttcgtcgaagaatggagaagactatgctccagaagacactcttgacaatatctag

SEQ ID NO: 29177 - DNA, 546 bp, Caenorhabditis elegans
atggcttgcaagaatccgaaaaaattctttccaattcgtaagtctccggttcttcgagatggagcttttaaggtatattttttaattcaagcaataaaaataaagccaatttatgcataggggaaattagtattggtcactggcggaggtaccggtattggaaaagccatcgcaacaacatttgctcatttgagagccaccgtcgtcattgctgctcgtagaatggaaaaattggagcaaactgctagagacataacaaagatcaccggtggaacatgtgaacctttccaaatggatattaaagacccaggcatggtcagcgatgccttcgataaaattgatatgaagtgagatttctgaaaataactctattataaaaactatttcagattcggaaaagttccagagatcttggtcaacaatgcagctggtaattttattatggcaactgagcttctctcttcaaatgcatatggaacaattattgatattgtgctcaaaggaacattcaatgttacaactgagctcggaaaacgttgtattcag

SEQ ID NO: 29178 - DNA, 716 bp, Caenorhabditis elegans
tttggatactgctgatgtggacgaaattgtactcgttggcggttcaacacaagttcctgccgtcagaaaaattgtgggcagatttttcaagtgagtccttattttgattaactttgaaaacatcttattaattacccggacgaaaattgtctgagttttacaccaaaagtacagcacctggtctcgacacgacaaatctttgttaaatccagaaaggtatgcgcctttagggagtactgttatttcaaaatctcgttgctgcagaattttaatatatacatttttgcagatttttttcgtttggtgaaaatttatttgtttttgttaataaattaatttattttcattgaaaaactagaaaaaaaataatgaaaattccgctgcaacgaaattttgaagctacagtacccctttaaagcgcacacctttttgaattcagcaaaaatgtttcgtgtcgagaccatgcaccgtagtcttgagtgaaaatttcgcatctggataacaattagattaactttttcagaaagtctgccaattacggtgtcgacccagaacttgccgtcgtaacaggagcttctgttcaagctggtgtcatcggtggtggatggcctctacaagtagccgcgatggagttaccagcaaaacgaagaaaacgtcatttctttacagaagagcaaaaagaaaacgaaaaagatcgaactatttcagaattgtag

SEQ ID NO: 29179 - DNA, 1403 bp, Caenorhabditis elegans
atgtcggaaaatcctgtcgtttccgataaaaaaccaggcccatcaaaagactcttcctttttctccgatttgtatgacaatttgaatcaaaacccgtattttaatgcgggagctggtctagcgggaataggaatagcaatgagctttctgcggaggacagctcaaatcagcaacacgtattttcgtaggcgttttatgatcaatcttcaaattaataacgaagacgcgtaagttatttacagaaatccatcagaaaatataatgattttagagcgtatccatggcttctcgatttcattaataatcgaagtgctacccaaacacggaatttatcagcgaatacagttgttcatcaagctgaaagtggcaaaactgaattatcaatatcattcctacctggccatggaactcattttttcgtccatgattatcgatggatcaaagtcgaaaggcagcgtgaaaagcaagttatccagcgagacggaattcgtacaccatttgaaactgtcacattgactacgttaggctcagatgtgaagtttttcaaacggatgctcgaacaatctgcaaaagaagccattgataacgctgaaacgggtcttgtcatctatcaagctgttggtccacaatggattcgatttggtgttccgaggaaaaagagagacattgaatcagttattcttgatgggagaatctgtgaagagctggttgaagatttccaagaatttattagttcggcgacatggtatgcggatcgaggagtaccttatcgtagaggatatttgttttatggaccacctggaactggaaaaagtagttttatttccgcattagcgagtcattttggatacagtgtgtgtttattgtctctaagtgaaaggacacttgatgatgacaggttagtaatatttttaaaaacaacttagttcttttttggagaataataacaaaaatttagagaataaaaacaattttgtagttaaatagatatatttggtgatacggttgatattttaataatttaaatcaaaatacccacagatggtactctaaatttttagtaaatagtttgtgaaaatacagtcttttcaatgtgatcttatttcagactgaaccatctattgaatacagcaccaccaaatagtgttgtgatcctggaggacattgacgcagcattcgtcagtcgagaagatcccatgtccaatcatcctgcatatcaaggtctatccagagtcactttttctggtcttctaaacgcattagatggtgtcgcttgtgctgaagagcgactcacatttatgacaacaaactatgtagaacgactagatcctgcattgattcgtcctggacgcgtagataggaaacaatatttcggaaatgctacggatggaatgttgagcaag

SEQ ID NO: 29180 - DNA, 648 bp, Caenorhabditis elegans
atgggaggagtaatgtcatattttcgtggcctctttggcgcccgcgaaatgcgtattctcatcttgggacttgatggagccggtaaaacgacaattttgtataggctgcaggtttttatttctggctgaaaacaaaaccatataagctaagtttcaggtcggtgaagttgtgaccacgattccaacaattggttttaacgtggaacaagtcgagtacaaaaatttgaaattccaagtctgggatcttggaggacaaacatcgatacggccttattggagatgctattatgcgaatactgatgcaatcatttatgttgtggattctgctgatagagatcgagtaagtttgaaattttattttattttttgtagtaaggattttaatatcaactgttttaggttggaatctctcgtcaagaacttgcaacaatgctacaagaggatgaacttcaaggagctgttttagcagttttagccaataaacaagatattgctggatgtttgactgaaactgaagtgtacaaagcattgggattggatgctcttcgtaatcgtaccattcaaattttcaagacatctgcttcaaaaggagaagggctcgacccagcgatggattggctggcgaatcaattgcaacagaaaaagtga

SEQ ID NO: 29181 - DNA, 786 bp, Caenorhabditis elegans
atgatgactggccgtggattcatttttacagtcattatgggcctcctgttggccgtgagtacggtatgttgtctacttgacaaatagattaactactaataaatgtacttaatgaccaagatagtcttaaatacgttttatatgcatgacgctttcgttatcttaaaaatataattgatgagaaatttataaaactaacaaactattttacaacaaagtttataaattttcaaaaaaatgcctgaaagaaggtcagggtttatcattaaaatagttaacacaaagtgttaattttctgcgaacggaagataatttgatttaaattttccctttttacaaatagaaatattaaggtaacatgcgccgatgctgttgaaactgaaggatctattgtttctggatctgaggatgtcaaggtgtctcttgaatccaaatctactgtagctccaacatcttccgttactcaaaaatcctcaaattcaactgaatccccagaaactgattcaacggaaaagggagatgatgaaaagccgatcactgaacaaattcgtacttatattgaggattctgtcaaatcagttaaacatgcggtaagattttttacttttttggcttttaatctgatcatattgatttcagatttccaaaattggaaaattcgtcggagagttgtttgaaccatccaattcaactgttccttcaaatcgttcgactactgtccctgttgcatctaccgtaatcccatctgtcgtttcttctctgccaaatgacaaggatcaaaagtaa

SEQ ID NO: 29182 - DNA, 614 bp, Caenorhabditis elegans
caaaatcttgccagcacattggatcttgccataaaaatgaacgcgaacagtgttgtgatttggagtacatctcaatcgatcggaagtcgttgtggatcacttcagacttatgtagataacacattgggtccgtatcttcaattaacagaccgaaatttggacaaatgtcgcatggagagatgtgaagggcgtggggaatgctatttaccacgaccgaaaacgtaagttaggggtccaggcagtttttaatcgttaccgcgagcttgcaagctctgcaggctctacatagcaggctcgcagagcaagcgttatgttcttgtgtctgcaagataattgatctttaagctttaacttctttctaagtttctcaattcagaaatccagctatctataactttgcctgccgctgtgaacgtccatatttcggaaaaagctgtgaataccgtggccgtcgaatgggtgtatcaatgccaaaagcttctcaaactcctcaagtcattccagatgtcactgcctacttctcaacatcttccaatggaactaaaaaatataatgctccaaatcagttctattcaagaaccggcggagacattaaattagcaaggaagttgtaa

SEQ ID NO: 29183 - DNA, 929 bp, Caenorhabditis elegans
atgagagcgactttgcatctcgaggacgggtccacttttgtgggctccatttatggagcaaccaaaagtgtagttggagaaattggtaagttttcatcaagtttttattaaaattttatttgaattttcagtttttcaaaccggaatggttggttatgtggaatctcttaccgatccatcatacgccaagcagcttctcacacttacatatccacttattggaaattacggagttccatctgcagagattctggatcagttcaagctaccagctgaatttgagtctgacaggatctggccagcagctctcattgttgagaaaatttgtgtcgatggagaacacagtcattggcaagcagttcagtcgttatcagaatggctcagaaaagctgatgttccatgtctttccggaattgatgttcgccaattggtgaagaaaatcagagagactggaacaatgaaggttagtgatactgtagttgggttaaagcattttttaaaaatatttttccaacatcatgttttcaggcgaagcttgtgatcgaatcagacaatgcacaaaacttcgactacgttgacgtcaatgctgaaaatttggttgacttcgtgtcgagaaaagagccagttgtctatggatccggtgatcaaaccattctcgcagttgattgtggtctcaagaataatcaaattagatgtctcgcaaaacgaggatttcgtgtcaaagtggttccttggaatcatccaattgatactgaaagtgattatgatggacttttcctttccaacggaccaggagatccagaaatttgtgcaccactggtcgatcgattagccaaagttattgcaagaggagacaaaccaatttttggaatttgtctcggacaccaaattttgtctagagctatcggagcgaaaacctacaaattgaa

SEQ ID NO: 29184 - DNA, 390 bp, Caenorhabditis elegans
atctcgttgatgctcttctaaaagcggttgatcgtcgagaaaaaggtctattgatggatcctactgaaaaacatgaagctgtttcaaaaatgtacaactggccggatgtagctgcaagaactcaagttatctatcaaaaagccgtcgagtcggagcctacaggaagattaggaagattaaaagggtgagcattttaaaataatcgaatttaattttaatagcctttcttttaggtattacgatcaaggaatcgggtttggaatcatgtatatcgttgtttcgtgtatcataattttctggttaacagtcctcgatttgtttgattctccaaggaaaaacgggaccaacgacaaaacgagtgagaaaaatgttgatcctgactatcagtga

SEQ ID NO: 29185 - DNA, 559 bp, Caenorhabditis elegans
gtccatgttggtccaatgcggtctcaatcgaaaggatacataatgttacaagccaaggatcctcgccgtgctccaatcatcaatccgaactatatggaagaagattcagattggcgagaattccgtaaatgtatccgagtgtctcgtgaacttttcgcatcaaaagcgtttgacgaattcagaggaaaggagttggctcctggaccagattgccaatcagatgctgatattgatcgatttgttaaagaaaaagcagcatcagcatatcatccatcatgtacttgtaaaatgggatcagaaaatgataaaatggcagttgttaatccagaaacgatgggagtatacggaacagaaaatttgaaagtaaggaatcaatgaaattctcacacttcgtgcattcattatatttcaggtcgtcgacgcaagtgtaatgccatcaattgttagtggaaacttgaacgccccagtgataatgatggcagaacgagcagcggatctgataaaacacaaaaaacaactacttccaccgtcagatgcaaatgtttggcaccataactag

SEQ ID NO: 29186 - DNA, 384 bp, Caenorhabditis elegans
gttaagaactgggttctcgaaataaaaacatgcctgggaaatactgcagagattctgatagtcgggaacaagattgatcttgaagaagaacggcaggtcactcgacaggatgcggaagcatacgcagaatcagaaggggcattgtatatggagacttctgctcaggacaatgttggaatctctgatgcttttgaatctttaactgcgagtaagttggcctaaacgttttgcatggcttgggtattgcctaaataaaaaataccaaaaatttcagaaatgatcgaacattcgcgtactcgttcgacagaaccaccatctacgaatcgatccatccgattaattgacaacgacgaagcagaaaggagtaaaaagtgctgtcgctga

SEQ ID NO: 29187 - DNA, 1622 bp, Caenorhabditis elegans
atgatgttcgaatatgaagaagatgaagatcccatggaacaacaaaaacatgaagaattcaaacatcattcaacggatcactctggtgagtcaataaacacttttgccgtttcttatcgaaagaaatatacaaagcgtctggttcctatcaaagaataggtcaaagtataaaattgaatcaggctggtgaccaaaatatttaacatgtattattacaataatctgcgaagcatccagtttttatttctcactgatcttcgttgaaaaattagaaaatacgaggagacaaaccagtcggagtctgccatctgatcacacaacaacaacaacaggctttttttgttttcaggcagtcctcaggagaatccgttccgtttctcgtatgacactgggaaacgagctgcgtcgatgttcgtcacgccgtcgtctgaagatcttattgcgtacggaaccaaacatctgctcgactcgccaaccgctgtacaggtatcgttttcattattgtactttgcactgctttcgtctcttgggttgaggaccaattgttattacgttgctgaagaatgtactttgactcagcacgtggggtgtatgtacgaagataataaagacaactactactaacatttgtagtcgggggacaaagaataacattttctatgatattcctgcttctgtatagtcagatcaaaatgttcgtcaaactaaacacatgacttcatggaactgtatagcgacgagtcacttatgaatttggcctagatgtatcgtatgttgtagccacgtgggggttttcggacatgacaactgttctcatctttttctttcgtcatattattgcaaaaagctgtatctttttcggcggttccgacttaacactcccctcagaatcacgccatgagctaagagtttgattaggtttctgtctcttttccattgatcctagaaaaaaattgatgaaaatagaagctggtgattgggggttaagaaaagaagagaataattgattcgcaatgcaaagaacaactaatctgatcaggttttttttgaacactcagtgtcaaacttgtgacctattgtaacattttgtttttgaataacaaattgattgctctttcagcgttcattggttctgaatgcaacaacatcgttgaacattgactgtgacttgtcatctgatgatgatcttagcccaacaactcaacgcaagatttgtttctgcgccagccagaatccagcggaaactcaagaacaaggcctccgtccagcaaagtcgacattggccatctcgttcccgtgtcaccagcaccaaatcaccgaggactataccatttctgccgaaattattggaatcggcgaatcgggaaaggtgatggcgtgctaccagaaggttaccggtgaaaagtttgcacttaaagtgctgagagatagtcagaaggctcgacgtgaagttgagttgcactggctgaccaatgcgcatgaaaatgtcgtttcgattcttgacatttatgaaaacacttttgacaatgtcaaatgtcttctgatggttgttgagtttttggaaggaggtgatttgctcagtcaattcgagagtcaaggaagcattccatatactgagaaga

SEQ ID NO: 29188 - DNA, 450 bp, Caenorhabditis elegans
ctctactggttcacaatcgaatttggaatctgtcaacaagatggggagaaaaaagcttacggagccggacttttgagttcatttggagagcttcaatatgcgttgagtgataagccggaagttgtagattttgatccagctgtatgttgtgtcaccaaatatccaatcacagaatatcagccaaagtatttcttagctgaatcatttgcaagtgctaagaacaaacttaagtaggatcaaatagtcagtttcaactgtaatctagataatttcagatcatgggcagctaccatcaatcgtccattccaaattcgttataatgcttacactcaacgagttgaaattctcgacaaggtagcagcacttcaacgtctcgcaagagacatcagaagtgatatttctactttggaagaagctcttggaaaagtgaacaatctcaagatgaagtga

SEQ ID NO: 29189 - DNA, 813 bp, Caenorhabditis elegans
attcatcattccaaaatcaagattttccaccaggtaattgtacacggggttcgctttttgtttctccacttgtcctacccattttttgaacaacaattatttgaaatcactggattgagattattttaatagtgataattagttcaaaaattagaaaaatgttttcacgaattttgatgtttaaacattgaaactttcatcgaattttgttttttttttaataattaaaaacattagggtttatatgattctcacgaaatatcccaggaaaatatctttttctcaaaaattataataaaaaatctgatttttttgtaactttttttcagtaaaaatccatacaataattaacgaaaaactttttttttaataattaaaaatagagaaaaaattaaacttttttttgaattaaaactaactgaaccccctaaattattaaatgtgcacaaatgctgatccgcttttgtcccgttcacataacaatgcttttgcatgtgcggtttccacattaaacatacaatcaattcagctgctgggggcaaagtgcacccttaccgcggtaacagacgcggaaatcatccatatgctcaaaatcgtccctatgctcctcccaattccggaatgggctatcagaatttcaacaactcaggttacggcgccagtggcgattggaacgccggacgtggcaattacggcaatgttggaagcggatatcgaggagctggcggcggcggcggttaccgaggtggtcgtggtggaagaggtggtggccgtggcggtggtggcagaggatggaatgcatcgaactggtag

SEQ ID NO: 29190 - DNA, 481 bp, Caenorhabditis elegans
atggctgattggggtattgcattcgacgagcagtgtcgatcggaagggcttgaagtgccagaaaaggtggtcggatttgttaatgtctatgtgtgttcgtgattgtttgtctgtttgtccgtccgtgttccgagagtttcggctcttttctcttgcactgtacaattgctttttgcttctacctcgcacaattttcatgcttcttccctgtatgtgtgcgtggaaaccgagtgcattttttcagcggaacggaatatattaatttctttcagaccgaaaaggtgcaatcaggctcggaaatggatcaaaatgaagagaataaaggtaagattcatcggagaaacttctttcctaacagttatttttacaggatcaaatggatggggaattagccgaggaggcatgttcggcggaccaaaagccagtaatgctccaccacctcaaacttcattcggatcaacttcgggaacccgtgttggtg

SEQ ID NO: 29191 - DNA, 481 bp, Caenorhabditis elegans; identical to SEQ ID NO: 29190

SEQ ID NO: 29192 - DNA, 946 bp, Caenorhabditis elegans
atgcttccagtccaaattttaaaggacaatgctcaagaggaacgaggagagagcgctcgtctcagctcattcgtgggtgcaatcgccatcggagatcttgtcaagtctactcttggaccaaagggaatggtaagagcgttttgattgttaatcaaaattaaatattaattttaggacaaaattctcatcagtggaaacccagaaagcgcaggaggaatcaaagttaccaacgatggagcaacgatcctgaagtcaatcggtgttgacaatccagctgctaaggttcttgttggtaagtgctcattcactgaattttgtttttacttttacaaacgttttgcatctttcagatatgtcaatgacacaggatcacgaagttggagatggtactacttcagtaactgtcctggccgcagagctcctcaaagaagccgagaaacttgtcaatcaacgtattcatccacagacgatcatttctggatatagacgtgctctcgggattgctcaagaatccttgaaaaagtccagcattgaatccggagataatattcgtgatgatcttttgaagattgcccgtactactcttggatctaagattctcagtcaacacaaagagcactttgctcaactcgccgttgatgcagttttgagactcaagggatctggaaatttggatgccattcaaattatcaagaagctcggaggatccatgaatgaatcttatctcgacgagggtttccttctcgaaaaactccctggaatgttccaaccaagaagagttgagaaagcaaagattctcattgccaacacaccaatggacactgacaaagtgaaagttttcggatcaagagtgagagtagatggtgttgccaaggttgctgaactcgaagctgctgagaaattgaagatgaaagaaaaagttgacaaaattctggcccataactgt

SEQ ID NO: 29193 - DNA, 793 bp, Caenorhabditis elegans
aatgtcttcatcaaccgtcagttgatctacaactacccagagcaactttttgccgatgctaaggttatggctattgaacacgccgattttgaaggaatcgagaggcttgctcttgttctcggaggagaaattgtttccacatttgattcaccacaaactgctcaattcggatcttgtgatctgattgaagagattatgattggagaagatagacttcttcggttctcgggagtcaaattgggtgaagcttgctcagtcgttcttcgtggagcaactcagcagattcttgatgagtccgaaagatccctccatgatgccctttgtgttctcgttactcacgtgaaagaatcaaagactgttgccggagctggagcgagcgaaattttgatgagttcagccatcgccgtcgaagctcaaaaggttgcgggtaaggaagcccttgccgttgaagccttcggaagagcccttgctcaattgccaaccatcatttgcgacaatgctggacttgactcggctgaacttgtcacaagactccgtgcagagcacgccaatggacgtcacaatatgggaatcggtttgttcatttggaaatctaaccattatacaaaattatctttcagacatcgagaaaggagaggttgctgatgttacgaaattgggcgttattgagtcttacaatgtgaagttgtgcatggtttcttccgccgctgaagccacggaacaaattcttcgcgtcgacgatatcatcaaggcagctccacgtgcccgtgctcaagataaccgaccatgctaa

SEQ ID NO: 29194 - DNA, 1506 bp, Caenorhabditis elegans
atgccaatcaccaagatccacgctcgccaaatctacgactcccgcggaaacccaactgttgaggttgatcttttcactgagaaaggtaagcgagcattgtataaattctatcaaaacttgaaaaaccaatctagatttgaataaaataagattaatcttgttttattcaaatctgaaatttcatgaagtatatttcaacattatgacgcaattccgaaatcacatcatttcttgtttccaggagtcttccgtgccgcagttccatctggagcttctactggagttcatgaggccctcgagcttcgtgacggtgacaaggctgttcacctcggaaagggggttctcaaggccgtctcgaacatcaacgagaagatcgctccagctctgatcgccaagggattcgatgtcactgcacagaaggacattgacgacttcatgatggctttggatggatcggaaaacaagggaaacctcggagctaacgccattctcggagtttcacttgctgtcgccaaggctggagccgtacacaagggactcccactctacaagtacatcgccgagcttgcaggaactggaaaggttgtgctccctgttccagccttcaacgtcatcaatggtggatctcacgctggaaacaagctcgctatgcaagaattcatgattcttccagttggagcttccagcttcgctgaagccatgcgcatgggatcagaagtctaccaccacttgaaggctgaaattaagaagagatatggactcgatgccaccgctgttggagatgaaggaggtttcgctccaaatattcaagacaacaaggaaggacttgaccttctcaacactgccatcgacaaggctggatacactggaaagatttccattggaatggatgtcgcagcatcggaattcttcaaggacggaaagtacgatttggatttcaaaaacccagcttcagactcctccaagtggctctctggagagcaactgaccgagctctaccaatctttcatcaaggagtatccagttgtctctattgaggatgctttcgatcaggatgattgggataactggggcaaattccacggtgccacttccattcagcttgtcggagacgatttgactgtaaccaatccaaagagaattcaaactgccatcgacaagaagtcatgtaactgcctccttctcaaggttggttattttcttattctgcttcatacataagtttcttttcaggttaatcaaatcggatccgtcacagagtcaatcgaagcagccaagctctcccgtgccaatggatggggagttatggtctctcacagatccggagagactgaagacacttttatcgctgatctcgttgttggacttgccactggacaaatcaagactggtgctccatgccgttctgagcgtttggccaagtacaaccagcttctccgcatcgaagaggaactcggagctgatgctgtttacgctggacacaacttcagaaacccacaagtgtag

SEQ ID NO: 29195 - DNA, 541 bp, Caenorhabditis elegans
tgctggagttggtcgttctggaacatttatcagtattgatcgtctcctacaatcaagttcatttggtgatccaattgatgtatttggaactgtttgtgaaatgcgatacgagagatgtcaaatggtacagaatgaggtgagtattaaattgaattttgagttggcattttgaaaaaaacttttagtttcaacaaaaagtaattcatttaattccaagccagtccgattccgattgaacctgacttaccagtgtatcggattttataatagataattttgtttaatttgaaaatctccaggcaaatttcaaacaatatttataagtaaaactgtccagaaatgagttcaaaatccaaactcaacattattatttccatttaacattttccgatattttcagcaacaatacatattcattcactattgtatccttcaagttctacaaggatcatctccgtctccaacatctacttcaacaggtgctcatcataatgctggttttgtacaggatggtcaaatgattgtcgaatcgggattttga

SEQ ID NO: 29196 - DNA, 880 bp, Caenorhabditis elegans
atgctggtttaactttgcactttcaccgggagaacgtttcgatttttcgatttcttcgatggcaaatgagtctgcaagtcagaaacttcagaagagcatcgtgctcacaccagcttttgatttcaatgcatttggattaacactgcaggtaaactttctagttttaataaataaaaatttaatttgttctcaaattttttatttaaatacaaatatataatttttcaggaatcgaacggaggaattgaattgatatggccgaaaagtgaggtttttatgacacgtgtcaaagatatttggaacaaagtagttggagcggaaagtcttttgaatatgagaataactccaattggaaacaatgatgagacagataaaactctaaagtttgaaacatctccaaaaaatatagatcccgtattcgcgaagaatcttgtaaaaggagcatgctatcgtgttcaactattcactgttacaaaaactggaataatatctgagacacgtcacaatgaaacaattcgaatgtcaagtccagcagtgaatgtttcattggaaagtgttacaaggtcatctgcaactcttcgaattgtattttcaactcatcacgattccacatccatatcaaattgtcaaatgcatattgttgtacgagatatgaatgggaaaagtgttttcgataagagaatgcaactcactgcaacatttgctccattgctcaatttggatggattaagcccatttcacaagtatacagtaaatacacaaattatatgtggaagtggaagcagtgagactccacagtgtccagcggctacaaggacaatgaggcaattgtcgttttctacgagacaggataaaccagcggctgtgcaagatctgaaag

SEQ ID NO: 29197 - DNA, 311 bp, Caenorhabditis elegans
aaacgagcaactggagagattaatactttggctcactggacacgtggattcgtacaatctcatcctgcatacaaacatgacagtgatgtaaatgataatatagtttacgatcttttgaaaaaggtttgttgaaaaattatgtgttgttgtaaaatgcagctttatttcagatggatgccatctcaaacggagaagatcactgtgagaagctgctcggatgctaccgctctaaaaccgatcatgccatttctgctgctgttcgcaaagctgaagagcacatgatcgtgtccagccaaaaacgtgcacattag

SEQ ID NO: 29198 - DNA, 659 bp, Caenorhabditis elegans
atgtccgctctcgaggaaacacaatcgttgtgcaagcaagttgacgatatttgcaataatggaatggaatccgtcgaacaatgcaataagctgctcgaccagttgtcgaaaattccaatgagcatcgaaataatccaggtgagttctactttaattttgtccatcaagtaataataaaattgttttccagaaaaccaacattggaataaaagtgaatatgatgcggaaaaaagtcacagatgatgctgttgcaaagcgggctaagaacatcattaaggtactttttttcataaatgaaatgtagctacttccaattattttttttctaggattggaagaatgtagttgatggaaagagcaagtcacaggatgatggtggtgctccacctgcgaagaagcacagaaaggaaagtgttgaagaggcaaaaccagagaaaaagaagatcgaggctccatataagcggccagaaccatctagtcggccagaaatagttgctcaatttgccagtgcatctttcccaccgaaacatcttgaaaatgacgagacccgtcttaaatctgcacaacttctactttcggcacttcggtttggagacatgccacaaggaacactcgatccagaggagttagctgtccaaattgaagagaaactctattcg

SEQ ID NO: 29199 - DNA, 1002 bp, Caenorhabditis elegans
atgcgataccctccctctatcggttcaattttattgattattcctatttttctaacattttttggaaattctaatgcacagttgtggaaaagatgtgtttcacctcaagactgccgtaagtggataaaatgggaaattgtcaacaatggcaactgattttttttaaatcatagaatatacatatgcgatttgatgtgttctttctaaaaagtttcaagacatatactttaaaaaaatgttcattaaagtaatacaatactttttgtagaaatttaaatttttattaattttgacatgaatcatgatatttcgattacagaaagttatcaaaagttcattacaagtacagtaaccggtagacacgtgagaactttatcatttaaaatgtcattcagaggacaagtaatcggatcatcaagaaaattgaaaggctccatttttttctttttttttgagataagaaaaatttttaaaataattctagttaatttttagagaaactagattttttgaaaccaaaatatgcatcccctctgtgaatttttcctctttgaatcaaacaaaaacttacacgaatttcattcttgattttcagtttgttctggcacaaccaatggaatatcgagatatggaaccggaaatattttggaagatctggaaactgtaagttgttgaatagggatttatctttgatttctgctgttaaaccatacgattagaattttattttaaaaaaatttaaaaagttccggatcgacgaagtaaccatccaaaacaaatagtcaaatagccccaggcaaaactaaattttttgccaaaacaaggaaaaatgtcttgatttagatgtaccgagggtgtcgtcgtgtttatggaaatcttgaaataacatggatagaagcaaatgaaataaagaaatggagagaatcgacgaatagcactgtggacccaaaaaatgaagattcaccattgaaatcaattaacttttttgataatttagaggag

SEQ ID NO: 29200 - DNA, 791 bp, Caenorhabditis elegans
atgatatttcacggtgaacaacttgagaatcatgacaaaccagtgcatgaggtgttacttgaaagattcaaggtgcaccaagagaaagatcctgataatgttgcatttgtgaccgctgaaaatgaagatgactctttaggtttccagcaacttggaaaaaaggttctacaaatctctgaatggtttgtggagaatggatataaaaaggtgagaggcttcactgaaaaatacttgatgttttggcatttgaagaaatacatttccttgaaaatatcataccaattttaacctctttacttcaaataaattcagggagatgtatttctactggcttcatacaacaattggagatgctttgccgctgctctcggagcctggagagctggacttattgtgtcggcagctgcaagtcaatttacatcatgtacggtattccaataaataaaaaaaaatcaatttttatactttattccagttgaaatgaactatcaaattgaagattcccagagtcaagtgatattggttgataaacatactttacctgttgttcaggaagcctgcaagaacttgaaatttgtgaagcaaataatttcaatttcggcaaaccctccatcaccagtaattaaattcgatgtgctcacttcccgtctcgttcgaaatcttaaaatgccattgattgatccaaagaatgatattgtattcttaccctattcatcgggtacaactggaaaaccaaaaggtgttatgatcagtcatttgaacttttccatgatgttggaatcttctttgag

SEQ ID NO: 29201 - DNA, 462 bp, Caenorhabditis elegans
atcaattacaaaatcctactatcggaattctgttggagtccttgcaatctacgacacaacgaatcgagaaagttttgagcatgttgaaaattgggttaaagaagcagcattaaatttgggtggtccaagcccatcgaagtgtgtcttccaattagtcggaacaaaaagtgatatggattcacagcgacaggtaatttttgaacaaaagttgtgtttaaaaaattggttaaaagctttcaggtaaactatgaggaaggcgagtactttgccaagtaccataaaatgaagtttatcgagacgtcgtcgagaacaggagacaatgttaatgaagcttttcatatgattgcacaagaggtttttttgaaaatgtttcaattttatgatgtaattttcaaatttttagattcaaaatcgagtcgacgacggagaactgcggcccgtggatggctgggaaggccttaa

SEQ ID NO: 29202 - DNA, 1290 bp, Caenorhabditis elegans
atggcttcgaatttaactgtcaatgtccacccgggagtctacatgaatgttgtcgacactcatatgagacgtaccaagagttctgcgaaaaatacaggacaggaaaagtgcatgggaacacttatgggatactatgagaaaggatcgattcaggtaaaaatatttataattacagaaaaaagagcctaattttttgaaaaaactgaaattttgcaagcttattggtgtctggaactgtatttaatctaatttttttaattttatgtaaataccatcgaccgaaaaagtatctaaaacaacgaataaaaactcaaaatgaccgaatgctcaagtgctcacacaaaaatatgccaaaattttgaaaaaagtatactttcagctaaaatcttcaattttgcaagctttcccgtgtcacaaaggtcggaacttaataatattcaattattacaatttattgcatttttgtggaactagaagcaagttctggccgctgtaaccctgaaaagtttgcaaaatggatgattttcgctaataatattttttttggaattcatgatattttctccaatttttattttccaggtcacaaattgtttcgcgatccctttcaatgagagcaacgacgatttggaaatcgatgatcaattcaatcaacaaatgatctctgcattaaagaaaacttctccaaatgagcaaccagttggatggttccttacaacatctgacattacttcttcgtgtctcatctatcacgactactatgtacgtgtcatcactgaagcatcggctcgtcgtgaatctccaccaattgtcgttttgacaattgacacgactttctctggagatatgtcaaagcgtatgccagttcgtgcctatcttcgctcaaaagccggaattcctggagctgctggaccacactgtgctattttcaacccacttcgtgtcgaattagctgcattcccgggagaactggttgctatgcaacttatcgaaaaagctttggattccagaagaagagaggcaactcttgaaagtggattggagcaattggagacgagcacagctcagatgattgagtggttggagagaatgttgcagtgagttttaacatttaaaattatcttaattggagaataaaccgtgattttcagttacgtggaagatgttaacaagaacggtgagaagccaggagatgctcaaatcggtcgtcaactcatggatattgtcactgcctcgtcaaacaatatgcagccagagaagctcgatactcttgtcaagaatactcttcgt

SEQ ID NO: 29203 - DNA, 364 bp, Caenorhabditis elegans
gatggtctctacgagtgtattctctgtgcttgctgctccacgtcatgcccatcctactggtggaatgctgataagtacctcggtccagctgttctcatgcaagcctacagatgggtcatcgattctcgtgatgactacgccaccgaacgccttcaccgtatgcacgactctttctcagctttcaagtgccacaccatcatgaattgcacaaagacatgcccaaaagttagagtgttctctgttttatatctcgacttaaacgaattaatttcagcacttgaacccagctaaggccatcggagagatcaaatcgctgcttactggattcacatcgaagccagccgctgagccatcagcattttaa

SEQ ID NO: 29204 - DNA, 661 bp, Caenorhabditis elegans
atatcaaaaacctacaaacatacatgaacacttccctaatagtctgttcctcgacacgatgatttctgaaccgatagactgcgatctggcacgtgatctgctattccgcatgctagtgataaatccagacgatcgaattgatattcagaaaatattggtgcatccttatttagaagaagtatggtcgaatattgtggtaagttaaattttatttaggaaaaaaactgtgttgtgcgccaactttatcggcattcgatattgcaactgctttcacaactttgacaacatatattggttcagaatattgtaaaactgaaaccaattttttttatctgtgcaagattgcgaccagtgtcttacccaagtttaagtcggcacaaagtttgggtgtaagaattgcaagagtcggatcaaacttgatctaagttctgttgcggtttgagccgagtactttctaagctttgtcgaaattcggatcaagcattgccaaataaattttcagattgacaataaaattgaagaaaaatatcctccgatcgctcttcgaagattttttgaatttcaagctttttctcctcccagacaaatgaaggatgagattttcagtacactgaccgaatttgggcagcaatataatattttcaacaactcaagaaattag

SEQ ID NO: 29205 - DNA, 318 bp, Caenorhabditis elegans
ataattgcctgctcatccctaatggctggaagcttcttggtcccagctctgaccccatccgatagcttcagcgaatggcaaagagtttttatgatttacggagcagtgcttgcaattacaaatactattttcattgttttcgccaggtaagaaacttaaactgttgatgaaaaaagtaacttttacagagctgaacctgcaaaatgggctcaacagaaaggagacttaactttggcagaagctgttatgggttcagaacccaaaaatacagaagtgatgcctgtggattcagaagttggagcatctcctagaatttaa

SEQ ID NO: 29206 - DNA, 270 bp, Caenorhabditis elegans
atatgatcttatgaaactttgctggcatgagaaacccgagctacggcctaacttctctaattgcgtcgaatacttcatcgggcacatgaaaaaatctgctagtaaagtaagtcaatagctagcagatttttttttaattttcaaaaaatttcggaaaaaagtattatctttcagcttctcgaaaatgtagatgaaatgttgcgagttgaagctgaaaatcaaagaaagctagaagattggataagggtagaacgatcggaatcggtttag

SEQ ID NO: 29207 - DNA, 816 bp, Caenorhabditis elegans
aaacttcattgattcaattttagcatttttggtggagcatcgtattgacggagttgacttcttctgcaatggccaacagttcaagacactttcaattatgttacatttatccgtgagctgagacaaaagttggatgaaaataaacgcaagcattttttgatttcaatgacagttccggcagctggagtagacaactgggagctgggatttgatttggaagaactccagaatcatgtcgattttttcaatgtatactctatggattatgcgggaccttggcctaatcaatggggtgttccaacgggaccatcttcaccaatgttctataatattggcgcacggaaaaacttctatgtggactggacaatgaagcattatacttgtaaactcaagcaacctagcatgcttaatatggttattccattctcggcaagaatttggaacaatgttcaagaagcaattgataatagaactgaagtatttagaaatgcagaactgaagaataatatggcagaaggaaggacacaaatatctcgatggacagccgagcatgaaggtcttgaactttcaccttcttcgtgggataatttaacaatgactccgtatatcttggatcttaaagcaaaaacctttttaacatttgaagataagagaagtataaaaataaaaacagattatgccaagaaaatggatctgggaggagtttggttatggtcagtggatatggatgataggcttaacagtcttctcagtgacgttttttccaaggagttctgttcaactggcagtgggaataaaatcaaatattcttgctga

SEQ ID NO: 29208 - DNA, 1196 bp, Caenorhabditis elegans
aacatcccgattgcaacaaacgaataattgggtattactcggagaatgagacgactgatatcaccaaacgacaactatctcagttaactcatgcgatatttgcattcataaaacttcagcctgatggaacactacagtttcagagtggttcagcaaagcagagatttcttattttgaaaactaatgcggaaagttcaactttaaaagtgatgatttcaattggtggcatggatattaattcagacttttcattggttatttcagatgagaagaagagaaggtaaaaatttttgcaaatttcatgaaagaggacatacatttcttgtccaaattcattcgagattgtttgaaaataccaggaaaaaataaagttcattttcagatctctgatcgagtctattgtttcatttctaacagaacaccaaatcgatggagtcgacatattttggaaatggtcatcaagtcgggataaattcaatttttctgtattcatgcgcgatctccgtgaaaaattggacaaacaactgaaatcctacattgtatctatactgcttcctcccgccggagtcgatatttgggaaatgggttatgatttggatgaaatcattgatcatattgattttatgaatgtctactcaatggattacagcggaccatgggataataaatggggaacccctactggtccttccgccccaatgaactataatattggtccgagaaaacatttcactgtggattggactatgaaatactatgcatgcaaaacaagacaaccaaacaaatttaatattgtgattccattttacgcaagaatatggagaagtgttggagaagcaataactttgaaaactgaagtattcagaaatgcgaaattaatcaatggcaaagctgatggagatccgtatatatcacgattaagtgttaaacaaaagggaattgaattatttccctactcttgggataatgcaactaaatcttcttacatctggaaacccaaagaaaaaacttttctgacatttgaaaacgagagaagcatcgaaaaaaagctccaatacgtaaatgaaatgaacttgggaggagtatggatttggtcagtggatatggatgatagaatcaacactcttctcgatgctgtttcttctgataaattttgttcttcaagttctgcgaattcaattaattttaaattctaa

SEQ ID NO: 29209 - DNA, 1394 bp, Caenorhabditis elegans
atggctgctaaacatgaatataataaattaagtctagtacatcttcccaggtatgttattcattttattgattaccaaaaacttgctgaattgagaaaagaagtacattccgaaaaaagaattccgtcgattttaacaagaacgatcgctgttctatttgtttttgcacttcttgcactcgtttccattggttcagaaggtgttccacaattaagaaattcaagagatttgacaagtaagtgataagaaatccgaacaaagagtttagaatcagatatatcgtctaaattatagaatctccatgcaagaaacgagtcgttggatactattctgaatgggaaggaactgagataacaagaagtcaattgggcaagctgacacatgctgtttttgcttttattcatatggactctgaggggaaacttcagtttaagacaaatcagaaggagaggtttgagaaattaaagacggctgtaaagaatgcaaactctgacactaaagttatgatttcaattggcggagatcacaacagtgaaaactttggttctgttttgtctgactcagagaaaaaatcaatgtttattgattccatagcaagatttattcgacagcataaaatccacggagttgatatttactggaaatggcttggcaattctgaaactgagcatcacgattttccatcattcttgaaagatcttaaggaaaagttgaagacagttcgagacgattcaatcatatcaattgtggccccacaggctaagatggatcgtcgtcatgatggttataaatttgatgattttatggagtatattgactttgttaatgtattctctatggattactatggaccatggccaaaccaatggggaactcctacaggaccatctgcaccgttgtatggaggaatcggagtaaagaaacactttaacgtggactctacaatgaaatactatacttgtatgacagaagatccaagtaaattcaatatggtcattccattttatgtaagactctggaaaaatgtgaaggaaccaatctccagtggaacagaagtattccgaagagccgatctgaaaaatggtgcagccgtaggtaacagttacatgtcgcgatggacggtagatcatgaaggttgggaattgacaccagcattgtgggatgatgttacaaagactccttatgtctggaatcaggaaaccggaaactttttaacttttgaaaataagaaaagtattgaagctaaacttgcgtatgcaatagagcataatttgggaggagtttggattcatttggtggataaggataatgaaaacgaagaacttctgagagcagttgcatcaaaaaaattttgtgcatcagaaagtgaaaataaagtgacatacgactgttaa

SEQ ID NO: 29210 - DNA, 870 bp, Caenorhabditis elegans
aagaaagaatacagttaaggtacacttatagtttgtaattaatttcaatatttcagaacattcattgaatctattttggaatttcttgaagcttacgatcttgatggtgtggacttgttttggaaatggccggaagaagaatatagagatgcctattttgcatttataaatcaactgagaaaaacatttgaagccaagaaaaaatactatattttgtccatagtaataccgccgcctacattagatggatggggaaagaaacgattaaacaaaattatagaaagtgtggatttcattaatgcttactcaacagactactatactccattagctgataacttgtcagatgacattgctggtccttcagcaccaatttattttggagcacagggaaaaagtgaacggaatgttcatcacactgcaagaaattactcatgtctaacgaagcaagctagtaaattcaacattgtaattccattctacgcaacactatgggagaatgtttatgaaactgttctcgattctaaacgaggtgtctatagacatgttgcaccattttatggaagaactgttggaaaaacttatttgtctcgattggctgtaaaacaagaaggttttcaagtagaatcatattcgtatgatcctgcaccaagagctgcattctcatataatagaacaataggaatatatctaacatttgaaacaaaagagagcatcagagcaaaaattgattatgtgaaggatcggattctgggtggagtatggatattttcagtggatatggatgatgaaacaaatagtcaattgaaggcggtttcctttgacgggttttgtactattggaaatggatctaaatatgaatgtgtataa

SEQ ID NO: 29211 - DNA, 542 bp, Caenorhabditis elegans
accacaatatgaacagcgggtaacaaagcagccaacttccggaaagtatattattattacaatcacactcatatcgattataattgttggatttggacttggattgtgtgcccaaatttatttccaggctgaaagtgacggtgagtttacaggaaaattaaaaagtggcctagaaacgaacttttgctagcagcccgccactgggccgtcgcaatttttcgaatgttccacactttttttaaatttccaaacggattttactgtttcagtgttaccaatttgtgataaaagaataattgggtattattctggatcaggaacttccaatattacaagtacccaactttccaatttaacacatacagtttttgcattcgtttatatgaccccagatggaacattgctttttaataatcaaattgaaaaaaatcgatttttgaaattaaaagaagttgttcgaaatggaaattctaaaatcaaattgatgttttccataggaggaaaagacaattcaaaatatttttcatcagttattccaagtg

SEQ ID NO: 29212 - DNA, 2201 bp, Caenorhabditis elegans
aaccttgattgattctattcttgctttccttgatatgtacgatcttgatggtgtggacttgttttggaaatggccggataaacaggacagagaaaattattcttcatttattcatcatttgagaaaaaaattaaattttaaaagagacgcctacattttgtcaatagtcgtgccaccgttgaatgtagaaagactgaaatacgcaatcgatataaagaatatcacaaataacgttgattttgtgaacattttctcgatggattactatggaccgcaagataatataactggaccgacagctccaatttacgatggagcagctgaaaagaaatattataatgttcaccactcagtaagaaaatatttctgtagaatgaaagaagcgaataagttgaatattgctattccattttatgcaacactatgggaaaatgttcaaggacctgtcaaaccacccggaaaaggggtgttcagaaatgcaaagccattcaatgaaatcatgtcggaaacatcttatttgtctcgattggatgtaaagcaacttggatttgaattggataaattttcctacgatggttcatcaagaggcgcatttttgtataattcaacaaccaagacatatctaacttttgaaaatgaaaaaacgatcggaaaaaagattaattatgtaaaggatcgattattgggaggagtatggatttggttaatggatatggatgatgaattcaatagtcaattgaatgcaatcacctttgacggatattgttcaaatggaaatggatcgaaatttgattgctaattttttggtaatactgtttatttcggaacgacaatccaagtagtgttttaggtctttcagaactttactttcaaacactaatcagtttcaaggcaattgaacattttcccatattttttaaaactactttttgattcgaattatcatacgaagttcaatgatttcgtagaccctcacattttttgaaatttgttgtgttttcaataaatttgttaatatctgcatgactgtttgtttgtaataattctaaccataatgcatatttcttatcaatttgttcctctcatttcaggatctttcctgcatcgtgcgttggtatacatttttagataacaaccgttttcagtttgattttttgagctaccgaattccatttctaatcggatgaatctaaaaacatattgatttgttctgtgttaaattgatatttttaatacaatgacaaatccaaaggagtgctatgaacttgtgccagttgatgccaggtatattcgaacagtatattaacatatacatacataattaacaattttaagttcgaaaaccaagaagtctgcagaaaaaccatctattcatgttggaaaatatgaaatcattttgattatctttatgtcaatagtgacacttggacttgtggtggtaataagaagtttcgtttttgtggaagaaaatggttaaccaactttctaaaactttatataatcaaagattaaattttctttcagcaccaacagtctgtgagaaacgagtgattggatattatgctggcacagaaaaatctcagatcacaattgaagaggtttctgaattaacacatgcagtatttgcattcgtttatatggcaactgatggaactttgatgtttagtaatcaggcccaaagaaatcgatttttgaagttaaaagaactaacgaaaaatgaaaactctacagtgaagatgatgttttccattggtggtaaagataattcacaaaacttttcaccagtgacagcgagtccggatagaaaaaaatctttcataaatgctatacttgagttgcttgaaaagtatgacctagatggtgtcgatttattttggagatggccaaaatcagatgacaaggatgaatatgctgtatttcttcgagagttgaaaaaacagttgaaagccaggagaaaggattacattttgtcagtagttgtggcaccacttgatataaatagatgggattctaaatttgacattaagaaaataattaaacatgccgattttattagtatctatggattggcaaaaaatacgacagattcagaatcgccaatgtttgcttcagcttggggagcagcaagttcttcgatgctcgaattaccagggatccagcaattaacttgttcaaatatactattgactcggtctctctaa

SEQ ID NO: 29213 - DNA, 363 bp, Caenorhabditis elegans
gtttgcaatgtggcatggtcgaagcatagcagcgagctcgtctctacgcacggttattcatttaatcatgtaagttgtttgcgaaaaattttaaattttccgtagaaattcgaataattcaaaaacagtgtttaatgaattcttaagcttcaggtaatcatctggaaatacccaagtcttcagcctgtaaccaagttggttgggcatcagtatcgtgtattgtaccttgcaatgtcaccagatggcgaatcgatcgtaactggagccggtgatgagactcttcgattctggcacgtctttaataagggaaatccaccgacgatcaccagatcaaaattgaatttgcattctaccatccggtag

SEQ ID NO: 29214 - DNA, 255 bp, Caenorhabditis elegans
ggaccgacttcgtacatctgtcaatgtgatcggtgatgcattgggatgtggattcgttcatcacatttgtgcagatcatctgaatgctgacgttgcagaagctgagaagaatcatgctgtagtagaggctcatgtaggataattaacttgaagaattttcattttatcattaattttcagggagtgaacttcgatgaactcgaaaaggaatgtgaacaagaaaataataatcaaaaacaaattgaacaagtttga

SEQ ID NO: 29215 - DNA, 539 bp, Caenorhabditis elegans
atgttgcctgtctccaccagaccctacaccatgagtatttcggccattcttacccgcaaaaagtgagataatgtagttaaaaaacgcaattttatatcctgccgacccctcaaccagatgtcgttcgaatgcttctgccacacgtcgtttgagaagagagttttcggaaattttttatgatttcaaagtgaaatggaaactactctcgtgaaaagataaatatatttatgtttttgcttgttcacaacggttcttgattttttgaactcgaacattttattgtaagcagttaatttgttgtgcacttcaaatttaagattttctttgactttaaaacttcctgtttctacatgtgttgataacagcaagcaatctgaaatttcatgcatttcttaatacgatatattttttattttaagcagagccgctgaaatggcatctggcaacagtgaagaaggaaaaggaatgctattgaggaacggggacgaccggattcggctcccaagtccgcaacgtggaactcctgatacttcgagcac

SEQ ID NO: 29216 - DNA, 364 bp, Caenorhabditis elegans
gttgatacttggacacttcatactgatccaaacatttggggagatgatgctgaagattttaaacccgagaggtaatgtttttccagttaatttccagttatttttgtttttttctatttccagatggcaaactccaaattctgatcaaatttaccaaaagagcggatatattccatttggattaggaccccgtcagtgtattggaatgcgtttggcttatatggaggagaaaattctgttggttcatattctcagaaaattcacatttgaaactggcgccaaaacagaaatcccgttgaaactaattggaagagccaccactcaaccggaaagtgtttggatgcatttgaatccaagaaactaa

SEQ ID NO: 29217 - DNA, 462 bp, Caenorhabditis elegans
agttcacaaccgaaagtgcatgaagaaaaccaatgttcttggagttgaaatagatgaaggaacaaatgtgcaagtggatacatggacacttcattatgatccaaaagtttggggagatgatgcaagcgagtttaaaccagagaggtgcgttctatgtttttaatattagatgaactccaattttaatttttgttctcgaaggaacatcaatattgcagatgggaaaccggggacgaactattttatgcaaaaggaggatatcttccattcggtatgggaccaagaatttgtattggaatgcgattagctatgatggaagaaaaattgttattgacccacatcctgaaaaagtacacatttgatacttccacagaaactgaaattccattaaaattggtcggatccgccacaattgcaccaagaaatgttatgctcaagttgacaccaagacactctaattga

SEQ ID NO: 29218 - DNA, 468 bp, Caenorhabditis elegans
cgttcacaaccgaaagtgcatgaaggaaacgaatgtacttggagttcaaatagagaaaggaacaaatgttcaagtggatacatggacacttcattatgatccaaaagtttggggagaggatgcaaatgagtttaggccagagaggtatgttctatgttcttaataagatgagctatgagcttcaagtttaattttttcttcccaaagaacatcactttttgcagatgggaatctggagacgaactattttatgcaaaaggaggatatcttccattcggtatgggaccaagaatttgtattggaatgcgattggcaatgatggaaaaaaaaatgcttttgacccacatcctgaaaaagtacacattcgaaacttctacgcaaacagaaattccattaaaattggtcggatccgccacaactgcaccaagaagtgttatgctcaagttgacaccaagacattccaattaa

SEQ ID NO: 29219 - DNA, 433 bp, Caenorhabditis elegans
agcaaacacgagaaaatgtatgcgagagacaacaatcaacggggtgaattttgatgagggaatgaacattcaagttgacacatggacactacatcacaatccaagaatttggggagaagacgtagaagacttcaaacccgaaaggtaatcttagtgatcttgttttcatcacaatcttctatattacaggtgggaaaacggagcttgtgagcatttggagcacaatggatcgtacattccatttggctcgggaccacgtcagtgcattggaatgagactagctcaaatggagcagaagattttattggctcagattctcaaagaatactcattcagaacaacaaaaaatacacagattccggtgaagttggtaggaaagttgacactttcgccggaaagtgtaattgtgaaattggagccgagagattcataa

SEQ ID NO: 29220 - DNA, 221 bp, Caenorhabditis elegans
atggtcaacattcccaactttatcgataaggttttatcaggtaaattaatttagcagatttaaagtttcatactgtaacgttataattttcagtcaacgacacttctaacgcctctctaacacattgcatcaaagaggcagatattgatggcgtcatcgaggaatgtaaggatatcctctcagcgcaagcgacaatggttgaggttcaggcgccgattgcg

SEQ ID NO: 29221 - DNA, 313 bp, Caenorhabditis elegans
attgctagaggccatcaggtatgatatcacttaataacttttgataaacaattttcaatttcaggttgttcaagatggatacgaatttttcgccgacaaacgcctcgtgacaatcttctctgcacccaaatactgtggagaattcgacaacaatgcaggaattatgattgtcgacgaacggctcatcatttccttcgagatcctgaagccagccatgagagaagtaaaaattcaagctcgtgcagccgccaaaaacaagtcaaccagaagtatactcgtgagcagcagaggaccgaagtctaaaaaaggataa

SEQ ID NO: 29222 - DNA, 378 bp, Caenorhabditis elegans
atgtggtggacgtcattagtattttctgtattattatttgatctcatattcatttcaaactgtgactatattcatttacctggaaattccgatattccagatctaaagttacagtcaggatatttaaatgccaatgaaaatggaactcaaaaaatgttctacttgtaagcttcaagcacagaaatttctaaaattaattttaaaatttgcagtctcctcgaggcgcgggatattccagtaggagaagcttctttaataatatggttcaatggaggacctggatgctcatcactaagtgcattttttgaagaattcggccctttgtatgtcaattttggagggaaatcactatttgagaatgttcattcttggtatcat

SEQ ID NO: 29223 - DNA, 403 bp, Caenorhabditis elegans
atggcagatgacggtctcggtgacgtgccaatggaaacggaaagtgtgagttttagaatttgccgaattgaagtggaatttattttgcagatgccacagtacacaatttcccatgttattgaagcccacaaatccgacacaaaggctttggcagttactcaaggcggatgcttgatatcgggtggtcgtgatgagacggttaaattttgggcaaaaaaaggaaaacagtatacgaaaacgcacgcctttgaacaaccgaaaggaataactgtgaactccattgcatacgctgaactagcggacggatggagactttttgttggccgaagagatggaacaattgcagtttttggcccgagtcaggcggaaccatatgcaattttcaatgagcataaacagaatg

SEQ ID NO: 29224 - DNA, 543 bp, Caenorhabditis elegans
ctcttaccggagacggtggatatcgtgcgtccgcacctgaaaatactggaagtcatgccgttcctctatcatctcttccacaaaacaagaagaaaccacgtggaccattggttccagttcctgatttttacattgtacgttttctaattcttctcctcaaaattcaacatacttaattcaatgtattcagattgggcttgctggaaaaggcgagaaagcaattgcaaaactgaaagagctaaatgaaaagcaggatgcattccaattgaatcctgatcagattaatggccttgaggaactttttgttctcccaacctcttcgaattattcatcagaagtcacgcagtctgcattcgaaatgtctctacaatggccagtggagcacttgacgccagttcttgattttctgagaatcgcactaactcatcattcactgaattcgtatttctgtgatcgtgaacgtggtcaggaacttgtcggaagattaattgctattcttgtgtcagatccggctgatgtggctttgaaggttctggtttgtag

SEQ ID NO: 29225 - DNA, 3500 bp, Caenorhabditis elegans
aatcaaatgatccgtgacaacattgctaaaggaatcgatgtgatctgcgatcggtattgctatagcggagttgcatattcattggctaaaggtaatatttttcaaaaattcgataaattatatagattttagtttctaaaagagaaagtagtataaaagttaaattatgaacgggattttatagtccaaaaagaccgaatatcataataaaacactaaaaactttttttaaaaaaattttctgtcaatttacgaacaattttagcatttaaaaaaaattagttcaatttttcatacctattttaacacctaaaatatttttttaaaaatttgaaattaaaaatttgaaacataattgtagagtttgcagaaataaaaaatagaagaaacccatgttttggtcggctttcaaagttggagaactgagttatagccacgtttgattgttaatgtaaaaaaacttcctaaaaatgttttgaaacgttttaatattatattcggtcattttctaagtaggagttctctaaagtgggaatttttaattcaaccctctgcattacctaaatacctctaaaaggtgttgaaaacccctccaattcatctcctggtgcccttatttgaccctataattattgttgtcacttccgttagctcctctccgttccgtttgcttgtcgataattgtcttgagatgctgctgctgctgccgttcaaaagagagtacctgtggtaacaggtgcgcgacaagctaatgaatagagaggaagtgcgcctttcctgagatggaaagaaacggttcacgcatccgaagtcattcaaattttgagtcggagatatctgaaagtttaaaagtttgcaacgaatatttgaactagaaaactcattagtgaagggatgtagagtaataactagtgaagatcgactacaaaagtccctcttgaatctttctaacctaagagacaaaaagagacattctggagacgtaccaaacaaaaaaagatgatgatgatgatgggcaggaagttgttatggaagaatagaagaagcagaataagtagaagaagaagactgacaaaaaacggagaaagagaaggaagctaactattttggagatgatggcaaggaaacggaaacggacagaggctccattgagtgattacttgagagagagccagatttggcaacatccggtttatgtaggtccatgaggaataagagtacattctgatattcgaaaaacttaaactgaatccctagtaattcaatcatcattgtagatttatcagggtgttcacccatccatcattttggcgcgttttgtttgctattgtttgccaaaccaatagacaccttcaccaatagatgataacctgtcggctcaatgcggctccccacatagtaatcaaaacatttgctcgcgcacttactagagaatagcgagacctatgaagattatctcggaaaggacaccgacaaggtgattagaggacagcgccacgtgtcgttactcaagtacctaattggtgtcaatatgaagtattaataagtagtttaacaaagacttcttgacttattttagcttttgggttcacatcaaagacgttgatataaccaagagccacctgaagttttctacactgattttatagtcgcgaaagctgaccctatgcttccaccggtaaaacatatgttcatctcttaattcatcactaattggaataatctcaggttacctgaaccgtctccttaatccctaccaggcagacaatcggtactcataactgactaatgtatcattgtgtatgtggtgctccttctccatcgcagaccgattatgatgacgtttcgggggtgaacgaacaacatattaggatgtccggtgtgtgctagggcaatacttctcagatgctgccgtcgcgcaatacggcggctaattaaacttgttgcaaaagggcccagccggctgtcgtttgctccaggtagtgaagatttatgagtctctatgttttggaagaatgagaagaaagagatactaataataataattgccttccggcaggcggcatcggcttgtttgcttctccttaaatgtctcatattggtcctctggaagagaataaatgatatcctggatattgcttcctattaatggattcccgatactcaatgatataagaagattcaaacttcgtttattagggtttcagtagatcccctgtgagtcttcttaaaaaactgacttcagaaaactcccctattatttctagaaggcagtgttcccaacacacctcccgggacttattgacacctcgatgactgtgatgatccacttaaaagagccctattatgacagtatgttattcatcatgtcttcgtctccaaccaacagacgtacaaatacgcatgtgcatacttggagcaaacatgtcgtctctccgaatcttctcacaataatgccactgtgttgctccccaaaggaggcacacttgctttttagattgaatgtttaccttggcctattccttcttctttgcagtccatgaaaggacaggaaacggagaagagaggaaaagttggatgatttgtattggtgtgcacttagatacctccgttccatctattcgaattgctcggtattcgaattgaacaaagttagtgaatcccttcagtaaaacattacactaatgcatacttccttctgtcccctaaaatatattttatcagcacttcacctgtcgatcagacagacgagttcaaatgatatgaagaatgaagactggaaatattttgagtcatgaaatgtctagaaacggaactccctttacaagcttaaccatggaatgcatttttctattaatgtcaaaagttgttccctgaaaaaaaatcatcagaataatttttgtgatggtttgtcgagttcttgtgtttccttccggctcaaacagaactttcgattttttttaaatgacaaattgataagaattcaaaagttcacaaaaaccaatagagcgaaaggaactgatgcaccacgcatcaactatacaggaagttcaaactttacggaaactgtagcagccttgatgtttttgaatttagcaggctaaaaataaagtgtcgtattaaatactttctaattgtaagacaaaaattgtttcttaaaataatatttctgaagaataagtgtttcaattttttatttttccaggtcttcccgagcaatgggtccgctcttccgacgttggacttccaaaacccgacgcagttctcttttttgacgtttccccggaagttgcagctcaacgtggtggattcggagaggaacgcctcgagacagcaacaattcaacagaaggttgctgctgtgatgccgactcttcgggatgatgcctactggaaaaccgtgaatgctgatggggatttggattctgttgaaaaaaatgtttttcggatttacgagaatctcgatagagagaaaccattcgagtcgctggagaaaatctga

SEQ ID NO: 29226 - DNA, 360 bp, Caenorhabditis elegans
atgaacatcccatcagggcaatggagactcgacgtgatgatgatgtgcctttaccaaatggctctgtttttctctgcccagctcgtttttgttatatttctggagtatatgccaaaaactgcttgcaccgaaagtaattgtttcttgaattttagaaattaacatttttatttgttcagaaaactattgctacaaactcgagagcaaatgtttgtcggattacgatgaaaataagccgaacatttgtctcgtaccaaatggttcaaaatctcaatttgatgaatgtgtgaacgataagaagtatttgtattttgaatcagctcaacattattatcaacaagattgcacgtctttgactca

SEQ ID NO: 29227 - DNA, 589 bp, Caenorhabditis elegans
aatctgttcaaccatctcccattgtgcgcgatgatctccggacgaatcttctgcatgcatggtggattgagccagaaattggtttcctggacacagcttgccgaaatcacgcgtccattcgatccaccaaacaattcccttgcaatggatctcctttgggcagatccagagaacaacatgaccggatgggcggagagctcgcgcggagtttcgcagatttttggagccgacgtagtaaaggacttcacggagaagatgaatatcgatctcattgctagaggacatcaggtatgatatcacttaataacttgtgttaaacctttttcaatttcaggttgttcaagatggatacgaatttttcgccgacaaacgcctcgtgacaatcttttctgcacccaaatactgtggagaattcgacaacaatgcagcagttatgattgtcgacgagcggctcatcgtttccttcgagatcctgaagccagccataagagaagtgaaaattcaagctcgcggagcagcagccgccaagaacatgtcaaccagaagtatactcgtgagcagcagaggaccgaagtctaaaaaaggataa

SEQ ID NO: 29228 - DNA, 974 bp, Caenorhabditis elegans
atggctaaaccacttcgttcatacaaaattagacatcgaacaagatttttcattctgtttctttgtctattatgtctttcaatatcccaatcaaatactcttactttaaactttacaattatctgtatgtctacattgcacaatttcactgcaacagaggcttctgaaaaatcaacaaatgtcctggacttcatgcttcataaaattcttcagaagacctatgtatacacagcttctcaatctaatttattattctccgctgtcgcaattggtgcaatgtgtgcggtttatccatttatgtatataattcaggtatgtactttttttggaactaaaattttgaacggattacatgacacagctggtcataatccaagctaaaaaaggttgtgcgatgttctttgtagtgaggatttgatggagattttgaaaatgttaagtcagatttataacaggagatctgagattatggtgcaaacaaacaaaaaattaccatcagctttgcatgtgaatttacaaagccttggttaaaaatgtgtattcagtagttctaaacgagaaaattttttccagaaaaaaggatctagatctgttgtaacatttgttggactattctcagctgcaaccactgcgatgattccatgggcagcttatttgggattctacccactacttgccatgagatttctacagggaattggtttatcaacgggttttactttaattggaatagtcactagacaatggtcaatgcaggttcagggggcgtttttttttgcatgcttgtcgtgtttttttcaagttcgtcatattcaaatttcaaaaaaaaaactaaaagttttacagataggtccaattttcacaatgcctgtagctagtgcattttgtacatcttcttttggatggccagcagtatattatacacattcaattgtaacaattttcatatttcttctattttttacattatatag

SEQ ID NO: 29229 - DNA, 758 bp, Caenorhabditis elegans
tcgagtacgctcaaaaggctgtcgacaatgcaggaacaatgattgcaattcgtggcaagaacggagttgtggtcgttgctgacaagctgatctcttccaaactttacactgatgtgagtaatttaagagattttcaagattttatctataattttcagaacgctaatccaagaatgtttaacgtgaacgacaatgttggtgtcgcagttgctggaaactatccagatggtttcgctctgaagaactatgcttacggagaagcaatgaagtggctcaaagactaccgtgagccaatgccgattcagaatattgctaactcagttgctgagtacattcacattcacactctcggcattagtcgtccgtttggagcaggagccttcttcatgtcatggaacaaacaaactggaggacgtcttttccttgtggagccatcaggtctaaactatgaatacaaggcatgggctgtcggaaaacatcgccaagccgcaaaagctgagattgagaagctgaagatcgaggagctggatgtgaatcaactcgtgaaggaagctgctcgaatcattatggtggtgcgtgacgagaacaaggataaaaacgttcaaatcgaaatgggatgggtcggtgagcagacgaacggaaagtacgaagaagttccaagcgaggttgtcactgctgccgaggaatgggctattgcaagcttgacgaggacgacatggacgattgaatcattctcgtgtatttattcacatttttaa

SEQ ID NO: 29230 - DNA, 1008 bp, Caenorhabditis elegans
atgtcgaaagccaacgtcggaatcaacggtttcggaagaatcggacgtctcgtgctccgcgcggctgtcgaaaaggacacggttcaagtggtcgccgtcaacgatccgtttatcacaatcgactacatggtctaccttttcaagtatgactcgacccacggtcaattcaaaggaactgttacctacgatggagactttctgattgtccagaaagatggcaaatcatcgcacaagatcaaggtcttcaacagcaaggatccagctgccatcgcatggggatcagtcaaagccgatttcgttgtcgagtctactggagttttcacgacaaaggaaaaggcctctgcccatcttcaaggaggagccaagaaggtcatcatctctgctccatctgctgatgctccaatgtacgtggttggagtaaaccatgagaagtacgacgcttcgaatgatcacgttatttctaacgcatcgtgcaccaccaactgtctggcaccactggcgaaggttatcaatgataacttcggtatgatcatcatcaaatcaatttgtttttttctaatttattttattttcaggtatcatcgaaggactcatgacgacagtgcacgctgtaaccgcaacccagaagacagtcgatggaccatccggaaagctgtggagagatggacgcggtgctggacaaaacatcattccagcttccactggagccgccaaggctgtgggaaaagtcattccggagctgaacggaaagctcactggaatggctttccgtgtccctacaccagatgtttccgtcgttgatctgaccgttcgcctcgagaaaccagcttcgatggatgacatcaagaaggtagtcaaggccgctgccgatggaccaatgaagggaatcctcgcctacaccgaagatcaagttgtgtcgactgacttcgtgtccgaccctcactcgtccattttcgatactggagcatgcatttcgctcaacccgaacttcgtcaagctcgtctcttg

SEQ ID NO: 29231 - DNA, 527 bp, Caenorhabditis elegans
atgcaacacggctcacttggcccatcatcgtcgtctcgaaagactacagtaaccagcacagcgggctccgttcaccttcatcaccgctcttcaaatggtttctcgacagcatcacgagctcaattgaaccgtcacaatgaaatggattttgggaaaatgtttgcggcaatggagaaaggtcacaaagtgtgcaaaattgcggtgttgaagaaatgggatccagcctataaacaattaacgttggatcggtactcgaggcagatttttctgacaaaattggaactgtcagctgttaggtaagaggataagtaacatcgcatgaaattcatttacatttttttcagaaataaaccgacaattctagatattcgacaaatccgtgaagtacagacattgaattacaaattgaacacaattaaagtagatgataaatggaaaaaggatcgagaaatcgtaaattttgattcaaaagccattctaatcatctcatatggaatgggatttgctctttcctattggattctttt

SEQ ID NO: 29232 - DNA, 311 bp, Caenorhabditis elegans
gcatggaagtctaacggaaatcagaacagcggacggatgcctggattagaaaagtattctcaagatcagcttttctttttggcctacactcaaggatggtgtgctctcagatcaaagagctataagttacaaccacatatggaagagagaatacggtacgtcaaattcttaaatattccttgtttccactgatgcaaaaaactattttcagaatgcttggctccctacaaaactctccagagttcgcgtcagcgtggaaatgctcatcggagagttttatgaatccgcccgataaatgctccatttggtag

SEQ ID NO: 29233 - DNA, 286 bp, Caenorhabditis elegans
atctatgagcaacttcctatccttctggctccagaaaaatatcactataacaaagaacttacccctgaaatgatttatggaaaaatggagggtcccccagtgacaagagctctgcaacaggttggagaagagctctcggcggttcttggttttgattcgactgatgaaaaagttcgaatgatgattgcaaatatgatctacctcgagtaccagatcactatggctggttctactgtaagttttattcatatttaacttttaaattgatttttttcagttctacaaa

SEQ ID NO: 29234 - DNA, 175 bp, Caenorhabditis elegans
gtcgacaatcacacacaatctatcccagctgttcttgaaatcccatcgaaggaagctccatacgatccatcgaaggtgagctaaatttccctccagataaagtgtagtaactgttttccaggactccatcctcaacagagcccgtggattgttcaacccagaggatttccgataa

SEQ ID NO: 29235 - DNA, 291 bp, Caenorhabditis elegans
atgaacttcatacttctagtgtttctagccgctctttcaacgacttgctattgcaccaatccgagactgaaggctctctggaacctggaggaggtcgctgaatgcgaacttcactacaatgcattggtaagttcctttgaataaagtttttttgatgcgaaataactattaaagcactacaataattatggatgctggtgtggaatcggtggatctcatgagcctgtcgatggaatcgatgagtgttgtatgcaccatgacaagtgctatgatgctgctgtcgataataag

SEQ ID NO: 29236 - DNA, 1008 bp, Caenorhabditis elegans
atgtcgaaggccaacgtcggaatcaacggtttcggaagaatcggacgtctcgtgctccgcgcggctgtcgaaaaggacacggttcaagtggtcgccgtcaacgatccgtttatcacaatcgactacatggtctaccttttcaagtatgactcgacccacggtcaattcaaaggaactgttacctacgatggagactttctgattgtccagaaagatggcaaatcatcgcacaagatcaaggtcttcaacagcaaggatccagctgccatcgcatggggatcagtcaaagccgatttcgttgtcgagtctactggagttttcacgacaaaggaaaaggcttctgctcatcttcaaggaggagccaagaaggtcatcatctctgctccatctgctgatgctccaatgtacgtggttggagtaaaccatgagaagtacgacgcttcgaatgatcacgttgtttctaacgcatcgtgcaccaccaactgtctggcaccactggcgaaggttatcaatgataacttcggtatgatcatcatcaaatcaatttgtttttttctaatttattttattttcaggtatcatcgaaggactcatgacgacagtgcacgctgtaaccgcaacccagaagacagtcgatggaccatccggaaagctgtggagagatggacgcggtgctggacaaaacatcattccagcttccactggagccgccaaggctgtgggaaaagtcattccggagctgaacggaaaactcactggaatggctttccgtgtccctacaccagatgtttccgtcgttgatctgaccgttcgcctcgagaagccagcttcgatggacgacatcaagaaggtagtcaaggccgctgccgatggaccaatgaagggaatcctcgcctacactgaagatcaagttgtgtcgactgatttcgtgtccgaccctcactcgtccattttcgatgctggagcatgcatttcgctcaacccgaacttcgtcaagctcgtctcttg

SEQ ID NO: 29237 - DNA, 194 bp, Caenorhabditis elegans
atggtaagagttttgttttattggtaatttgtagctaattatgtctataaataaatctgtgaatatgtgcaattttgtagggagacgtcgttgctgatgctttggaaaagctttctgccgatcagatcgagcaattccgtaaatactttaacatgttcgataaagagggaaaaggatatattcgtgctacccag

SEQ ID NO: 29238 - DNA, 380 bp, Caenorhabditis elegans
agcgtgtaagctggctattcgcgaatcgatcgaaaaggaaattcggattgagaaggaacgtcaagatcgccaagctcgcggtgaggagctcatggaagacgatgcagttgatccagtaccagaaattactcgtgctcacttcgaggaagccatgaagtttgccagacgctctgttacagacaatgacatcagaaagtgagttttgataatggttttattgtatgtctataaaatatgtttgtaggtacgaaatgtttgcacaaacattgcaacaatctcgtggctttggaaacaacttcaaattcccaggagaacaacgcggaagcgatgccccatctgcccctgtacctgctcaggatgatgacgacctttataactaa

SEQ ID NO: 29239 - DNA, 407 bp, Caenorhabditis elegans
atgagcaccgacgggaataacaacaagaaaggatcgaaagaaggtaagcttgttctcgtttgggatgctcgcgctggtgttgggtctcaccgcgacttgctgtgcagcatctaataccagtgggtcttgaaacgaccaaaacctgtcagctaccgtggatccgactcggcaaatcgggggattacaatctggtggattgtctacgcccaggaactatgcactgatctgcccgattggcattcaccgatccaccgggtctccttttgctcaaaaatcacagattttcgtactttctaatgacactctttttccaggtccaaaatcatctgagatatcaaagttcgatctggcgaaggagaatccgaaattggctgaatggatggatgattgcatcaagagaatgaata

SEQ ID NO: 29240 - DNA, 414 bp, Caenorhabditis elegans
atggccgatgaggacgattatcaagatatggataatgatgatttcgttgacgacaacgaaatggaggacgtgatcgaagaagatccacaacgccctgacaatgaggacgaggacgatgacaacgtggacgagaatttcgagcttttcgatcaaggaaaggctgttccgactagtgagcatgtgacaactccattcatgacaaaatacgaacgagctcgagttcttggcactcgcgctctccaaatcgccatgggagctccggttatggttgaacttgaaggagagaccgatccattggagattgctcgcaaggagcttaaacaacgccgtatcccgatcattgtccgccgctaccttccagatggatcatacgaagactggccaaccgatcaacttcaactcgctgattggtag

SEQ ID NO: 29241 - DNA, 570 bp, Caenorhabditis elegans
atggcagcagtagtggcagtgaagcaaaaggaaaagggtccacaatgcaagctttcgactatcatcaatggacagtttatggtatgtattcagcctgagacgtgcctgcatgcctacaggctatggtctgcattttttatgggcacaagtcatgcgtaggttacatagaaggcaaccgtttctacaaggccagtgttcgacttcaaactgaaatttattcagtgaactatttccgcaaatttcaagctccataaaataacaaaaacgcttttccaataagcttccagaacttttcaggcagtccaaatgattggtaaaggtgcatacggagtcgtgtacgaggtggttcgtcgcaactctccgaatactcgattcgcttgcaaagctgagctcgcaattgaccataacaatctgaaaacagagtgggatctgatgacattactaaaggataacaaatcgaaacacaacattatcggcgtcgaattgggtagtgaacgcaattttaattatattgtcatgcatcttgtcggtccatcgttgtccgacttgaggaagacagttccaaataag

SEQ ID NO: 29242 - DNA, 311 bp, Caenorhabditis elegans
atcttccatgggagaatatgagtaaagaggacacaaaaaaggcgaaagaaacgaaactggatggattgttggcgaggtgtccgccggaatttcggatgattcgatgctacttgctcactcttacttattcaaaagaaccgggtatgtggagttttttatagattaaaaattgaattgagaatttttaaagattacgtgaagcttcgggaggttttatgtcaaataatgacatctaagaagttcacaccggatatgcctctcgattggcaaaaaggtggaccttgtgaggcaatctttaagcctcaggccgc

SEQ ID NO: 29243 - DNA, 436 bp, Caenorhabditis elegans
atgaaacattgcttcatgataattggtattttcgttttcaacgtctcagctcaaacacttcaaccacaagaaacatgcggtcagccagcactgaagatcaaggctatccatccagaattcggaagtgccactggattttatggaatagcgaaaggaatgtcggacggagtgcacacaaatccaaattctaaatcgtatgaggtaagtcagagatcgaaaattttttgataatttcaatattttttagaatctgaacaagtggctctttgaaaacggaactgtaactttaaatgatgtttttgcggatttagtagccggtcaacctggacccacaatcttctggaaattggggttcattttggtctttgttacactggctttgtgcatcgtcacagctatttggctgtgtttttattcatgtgctcccaagaaaaat

SEQ ID NO: 29244 - DNA, 409 bp, Caenorhabditis elegans
atgggagacgtgagaagcgccccattacgagcgtatgcaatgcctagttcaattggaacatgtaaaaatcaaggatccacctttaaacctacaaagctagaaatagtactaaacaaatgtagaaaaatatcagattacgataacaagataattttacttcaatgtgcctattttttcattcatttcaggatttccaagtggatatttatttccaagagaaatgggtcgatcatcgacttcaacacaataacaccaaacgaatacttgtgaaagatcccaaattgttcggtcttctttggcatccggatctctattttgccaacgcgcgaaccgccagctttcatgacgtcactcaacccaactttctcgtttggatatatccaaatggaactgtgtggtatgattgtag

SEQ ID NO: 29245 - DNA, 2632 bp, Caenorhabditis elegans
atggttaagtcctacactttggctggactagcggcgattgcttgtctgctgctggcaataggagctgtgatttctacagtgtatattttaaacgatatttctgacttttacagtgaagcacaggaagagttggtagaattcaaggtgagttattgttctagacataattgaaattattttaaaattataggatatcgcaaacaatatctgggaagaaatggttttcgaattgacaccagaggaaatgagagaagccgaagacaacgatcgtgagaagagatcctatgagcctgaaggcccttatcaatctgaaaccacaacaccttcaacaaccacttcaactgctgccacaactaccgaagctgcagaagatgaatctggttacgattttgtgaatgataatggaccaccatcttcaagacctagaaaaccagaaccaccgaccatgcccagaactatccaaggtacacataaaagttttagtataaatttaaggataattatttcaggtttccgtgcacctcctccagctgcgacatccacctacagaccaccacatggatcaaactatgacaattacggtagagagccggcgtcttctagaagaccgtatccacctcaacagcctcccagtacatcagctccgcacagcagtccgaataacagaacatcattgtacaatccacagccacctccaaaaactggatatccaacaaatcctcgtgtaccgtacaatccacctcagccaaactatactcggcaaccaacgtatcctgaagacaaccgcgcgccatataagccaacaagatcaccaaacactccaccacctcgtcaaccttctggcggatacgattcagatgggcagactccaccgtcatcgcctagaatttacaatactcgtcgtccgaacaatcatggtccagggtatccagaggatcaagtaccaacagcgccaccagttccaggacaacaaagagttccaccgactcaaactcgaaatccaccaaatccaactaatacccgtcaaccatcgagaccagtgcctccaacatcagatggacatattgaggcaaccactccgtataatccatctgctcaatatcccacaggaaaaaggggttcacaccctggatttggacctcagagacctcgtccaggaactagaccaagaggcaatccatgtgatcaatgttctgctcagccgaatcattgcccatcaggacctccaggacctcgtggtagaccagggcctccaggattcccaggacaagatgggccacgtgggcttcgaggtctcaatggtggttattctggtgttcaaccatcttcttatgatccagtaattggctgtgtacagtgcccaattggaccacctggagaacgcggaccagacggtacaccaggagtgccaggagaagatggtattgatggcgagcaaggagtgaacggacaagatggtcaaccaggagcaccaggggcacctggatatcatggaatgaatggttctccgggaacacctggaaagcctggactacctggaagaaacggccaatcatgcaagtcaattccaggacctccaggtcagccaggagtaatgggtgtaccaggaagagacggagatcctggaactgatggtgagcatggacaagacggaagcccaggaattcaaggcccgccaggaagagacggaacatcagggccagatggccaaccaggagtgtctgctccgggagcaccaggaacagacggcggttattgtccatgtccaaagcgatcttcgaagtttgattttaatgatgcatacaatgatgatgagaagagaggcctagaggaacatagaccaagaggatacgattcagaacgcgccgaagagccaagaccaagacagactgttcgtactaatacctatgatgaaaattctggagccgaacatcaaagaagaccaaactacgaaccttcagcagaagttgctccaccacgacaggatcgttatgaagacgaagagagagttagagaaccaccaccaaagagaccgccaccaccacaccgacaaactccacacgagttgtacccagaagagcaaccatatgtcagaagaccaccaccaccacaaaacagaggaaattatgaagttgaaagatcaagagaatatgtgccagaagctccaagaccaaggcaaggttatgaacattcatctggatatggaggtgatgacaggaaagagcagccaaaatatatggaaagtcgaccagttgatgagccaagatacgaaactgatgctccatcaagaagtcgcccgctgaagaaggttgagatcatcagacacccagaaagaggatacgatcgtcgtcagccatcttatgaggattcgaagccaagacaagaggagccaagacgatatgaaacggaagctgagccacgctatgaagaagttccacggaaagagacacatcctccaggatttggaagaccaaaatctgaggaaaatccaagggaaacaggaagaacttactcagaagaagcaatgccacctgtgcaacaaactgagaaatataatggagataaaagaaagaagaatcagccagagtatgaggatatttcaaaaccagaagaggataaagaaagagcaatg

SEQ ID NO: 29246 - DNA, 264 bp, Caenorhabditis elegans
atgcacattaaatccatccatctggatggctttaaatcgtaccaaaagcacaccgatattctcgatttttcgccgactttcaacgcaatcaccggtgagtatagttttgtgctgaaaactaatagtttgaaaaactttaatttcagcataaaatatagtataataattgttttatttcaggatacaatggtagtggaaaatccaatattctcgattcgatctgcttcattatgggaatcaataagctcgataatatcagagcaa

SEQ ID NO: 29247 - DNA, 962 bp, Caenorhabditis elegans
atacaagtaaggttttgtgtgaaaattcattttaaaagagttataccgtttcaaaatttaaaaaaaaaaacctattttcataataaaacccgaattttgtcaatttttcagtatcgcagcgagcggaacttggtttttattcaattatcgcctttttattgcatatttaaatatgaaaaaaaaaaaacatatatttttgtagtatattatgcgtttttttttcgtgaattcaggtgcattttctgcacatttttggtgaaatcgaccgaaaagccatcaacattaacgaaaaaacgtgcaataaagagtgataatttactacgaaccaagttccggccgttatgacactgaaaagttggtaaaattcgagatattagctttaaaaaatagttttctttcggaattttgagaaaactttttttaattttaaaacagttgtttttcaaaaactaatgctttttttcagctaaaatttcaaatttcgcgaattttttttcgagagtttcggcataatcaactgaaaaagcaccaaaatttaggaaaattgcgtgataaactatcacaatatgcaataaattgtggctatttaaaaccaaattccggccgttactacactgaaaagttggcaaaattcaagatcttagctgaaaaaaataattttttttaaattttgaaccggcatagcaaattttcaaaacgtctcaatgatatttttggtttttttttcagaccaaaaaacaaaaaaaaacgaaaatttaatttgcaacattgaagtttatttttttaaacaaatttttctttccagggatggtcgatatgcattgaactaccaacgtcctccactacatatcgataaatttgatgaaaagcgggacgtattcggatatgtcgcccatcttatcaaaatgaaaccaggatgcgagcaattcgctgttgctgcagatattgctcttggtggtgtg

SEQ ID NO: 29248 - DNA, 5186 bp, Caenorhabditis elegans
cttggcaacgtcgtcgtcagcactcaagatattgcccgtattctcatcgacggtaaagcgtttacgtcacgtaaaacgatgattccagtatctgagaacgcgagaaacgcgagtagctacaatacattgccggatgtaaaacttaggagggctaaagaaattgtgagtggaaagattacttttttttttgattaaaatgttggttgaaaattgcaaaaattctgttgaatttgcacaaacatatttgacgcgcaaaatatctcgtagcgaaaactacagtaattctttaaaagactactgtagctcttgtaacgatttacgggctagattctcgaaattaaaaaaattcgagcccgtaaatcgacacaagctctacagtactcatttaaagaattactgtagttttcgctacgagatattttgtgcgtcaaatatgttgcccaatacgcaatatcagaattttgtgtttctgtaatagtttgtgaaaaagtgaacgtttctttttatttttttaaactaaaaaacaaaagaatcaatttttcgtcaaaatatcagcaaaaaaaccaaaaaatctctgtgcaccaccatatcaatttactatatataaagcgcgtgtccttccgtccgtttgtagtttgtagtttgatctttgatctttcaactctcttttctgtagttggaagaggtattgggttgggagatggtgagggataatgtcaaggtactgtagtagtactgtaggagtactgtaggtatacggtagggttactgtagtttaggaaaaattgagtttttgtatacagaagaggtattgggttgggagttgctgggggataatgtcaaggtactgtagtagtactgtaggagtactttaggtatacggtagggttactgtagtttaggaaaaattgagtttttgtatacagaagaggtattgggttgggagttgctgggggataatgtcaaggtactgtagtagtactgtaggagtactgtaggtatacggtagggttactgtagtttaggaaaattgagtttttgtctacagaagaggtattgggtagagagttgctgggggataatgtcaaggtactgtagtagtactgtaggagtactgtaggtatacggtagggtttctgtagtttaggaaaattgagtttttgtctacagaagaggtattgggtagagagttgctgggggataatgccaaggtactgtagtagtactgtagtagtattgtaggtatacggtagggttactgtagtttacgaaaaattgagtttttgtctacagaagaggtattgggtagagagttgctgggggataatgtcaaggtactgtagtagtactgtaggtatacggtagggtttctgtagtttaggaaacattgaggttttgtctacagaagaagtattgggttgggagttggtgagggataatgtcaaagtactgtagtggtactgtaggagtactgtaggtatacggtagggttactgtagtttaggaacaattgagtttttctctacagaagatgtattgggttgggagttggtgagggataatgtcaaggtactgtagtggtactgtaggagtactgtaggtatacggtagggttactgtagtttaggaaattttgagtttaaaacattttgaagaggtgttggctcgaagaggtgtagtttttctctacagaagatgtattgggttgggagttggtgagggataatgtcaaggtactgtagtggtactgtaggagtactgtaggtatacggtagggttactgtagtttaggaaattttgagtttaaaacattttgaagaggtgttggtcgggagttggtagggaatagtgtcaaggtactgtagtggtactgttggggtgctgtaggattattgtaggattattggagtttggtggaaaattgcgttttaagtttttgaaaatgtattggcttgggaattggtgaggataatgtcaagatattttgatagtttcttgcttagagtcgggaacatttgggaagatgtgaaagtttcattattttttcataagccatttttgaatgattgtgtcaaacatttcaaatgttgccagtcgttggccgcgccataggcgcggtcagcggctggtaagattatatgcaacgtacatatatgtgtgtatataaataaacgtatgtttttatgagacctcaagctcaaaagctctatttattcggtgaggttggtgtttgaggaagaattgggagaaaaacagatttttgattagatttatttaaattcttttgaaaacagaagttctttgaaaagatgaattcaattttgaaacaaattctaagaatcgcaattattttttatgggcttctaggcttttcagaacaaaaaatctcactagaatcaattttataaaattaatatcatcaaaaaatgaatattgaaacataggattaaacataggacataggaaaagttggattgtcacagtgaacagggaattggtaaatttaagtttctgcgtcatttttcttggttgtgacgtatgcagtcaagcccctagtgctccacctccacataacaaaatagaacgaagctttgggggaggggggacccccaaaaaacactatttttctcctctttttctctgtcttctacttagcgcgaggactgaattcattaagcgaataggtgatgcagagctaactatatccggagatgaaaatatttgttttggggatggagttgtggttcctgaagtattggaacttcccagagttatctgaggaatgaattctatagagcattggactaatctagacaacgttcaccgagccgttccatgaatttccatacgattttgagaacgagatgaaaatgaagcagagctagtaaatatggagagaaaggaataaggacgtttttttcggtagtattagattaaaatccgtggatccaagacacacaacgagacgaacacaaaacgagaatacgctgaaagagagaaattggtggaaaaacaacaacgtagcgaatagaagaagaagaacgacgtaaaatagaagacgatgtgaatgctgctgtaaatacacaaacacatacacaaattcacggaaaatgagacaaagataagaagaaaggaaacgacaaaaaaaaacttagttagccacgacgacgttttgagtgaggaagatggaagatggaagagccatttttcgggttgaacatacgactggaaatagcacatctatattggagatgagctcttctcacgcgttgtttttgggtagagaagagctattacttgttcgtagtcgttgtcgccgagtacaatataatataataataaatggagcattttttaatgagaaaatggaacaatagagtagtcgttggtttctgagaataacttcatacttttttatatgaagcttctgggacgggggagaatttttgaaaaaatgtaaggtttagagaaccttttgtagttggaaagcgcttctgccggcttttacttaaactttaatagaataaagttggatcgaagacaaaaagaaaagaaaaaaagcaacactagaaagtgagcttcacgtcgcctcaggaagtcaatcaatcatcggttgccgtcttgtttccgtcgtgtttttctgtccattttagccgctctccctcttcaactgagtttttttttgcaattttcatgcaaaattcacatttgaaatcaccttgtgtcgaacagaaaagggcaattttctaactaataaaactgggacatcgttatccagaattgcttcttacggatattgtcatatattgtctggttgggtgatggagaaaagaataattgtcggacgccattaagtccctggagtcgggtggatacgtgcatggatgatggaagaaaaaaaagaagagcacagcaaaaaaagaagaaacaccattcttctcgaagtgatgcaaacatttgaaaagttgaaaactgaggagcaccagtgtgaactagaaggaaagtggacgatgatgtatgctgctcgtgtgcgtgtgcgaatataaatttaaggaaaaatgccatttgcatatgttgtgctcttttgtctgccatcttctgcctccttgctcttttttcctggaaaaacggtctctgacacgtcttcttcttcttctgttgagggcatctccaataagttgaaaaggaaaaaaaagtttcctctggaggaatgtgctagcaaacggcaaaagcaacgtgaagctaatcgtcactgttaattgtgaatgacttttttatccggaagttgttcgggactcttttctgcacgacgcgagacttaatgtattgatggatgacacgtagcacgggggcaggaggaaccaagtagacgttcggcaacagggatgttcaaagtagaaatgtgcggaaagcgaacaaaactgcttgtttcaatatgatattccaagtttatgaatcaaaaattgatataacaacatagaaaatgggtttgctcaatctgaaaaaatatatattcattttagttgcaaaattagaaaaagacctcaaattctgcccgagtgttgccatttgaagtttttttttcgaattttgcaacagagattaatattattttcagatggagggaacccattttctacatttttataccaatttttgattcgaaaagttggataatcatattcaaacaagcaatctccgagtattaggaatgtatcaggggtggattcggcaaattgccgatttgccggacatcaatttgccggaagtttttcaaggatttttttataacacaaaaaaaagtagatgtatgaacattcataggatgcgtacaattttgccgattaaaacttaaattcctaaagttccaacaaaaaaagtgcaaaactaaaatttcggcaattacggttttccggcaaatcgacaatttgccaaaaaaaaaaaacgtttacccctggaatgtatatatttctggaagaaagttaccattctaatttttcgcagaaatttgaatttttggtatagaaaaaacaaaaaaaattatataaagaaaaattaaaatctctggatgtgtacaaataattttttttcaggcagaaaaatacaacgatacagtcaccaaaatgattgatttgattgagtatcccgatttcattagcaatacaattctgaacgctgttgggcag

SEQ ID NO: 29249 - DNA, 169 bp, Caenorhabditis elegans
atggtattttaataaatattttaaaaacaatttataataaatatttaccagggagaacaacagctcgattgtgccctcgacttgatgcgaagacttcctccacaacactgcgacaagaatttgacggacctcatcgatctgtgccctcatcttgttgatgatcttctca

SEQ ID NO: 29250 - DNA, 1380 bp, Caenorhabditis elegans
atgccacggccaaaaattttgaaacgagcaactgtccagcccagtgccgccgttcctgtgaaaaaatcgactccagaaaaagaaggatccagacagaaaaagacgaatggaaaagagaatgcttctagaaatttgcaatcaaatttagaagaagatttggaacaactgggcttcgagtatgtatctattatccagatgaattcttgagcaaaaccgggtctcgacacggcaatttttgttgaaaacaaaacgggggtgcgtctataaggagtgctgtattatcacaatatgtgttcttaaaggcgcacagatctattcaggcgggtctctgcgcggaaaacagtatcgtagtattttctttttctttaaatttttccggttttttaatagaataatagaaggagaactaaatacaaaaaacggagtaatttcttgaaaaatgaaagtaaaaaactaccataaaatttaaaagtttttcgcgcgccgagactcatctgaatgattcggtgcgcctttaataatggtaggccaaaatttcgttgcggaatttccatcgatttttcattgttttttgttaaaattttttttaaataaacaaaaaactaggataattaaaagcgcatgaattttaacgaacaatcgataaaaattccacagtttgaaactacagtactctttaaaggcgcacacccgtttgtaattcaaaaaaaattgtcgtgccgagaccgggaattttggcgcaaaaattagaaaatcttccatctagctaaaaataagtacattttcgaagcaaatcaatcatttttccagggatgaaactgtatcaatggctcaatcagcaatcgaaaattactttatgcaaggaaaatcggcgtcagaacgaatgaataatgcgaaatcccgtcgtggaagacgtgctggaaatggaaatactgaagaaattgaggaagacgatgagatcagtaatgctatcactgatttcacaaaatgtgatctccctggacttcgaaattatattaccaaaaaagataacacggaattcgaaaaacgattggagcatctcgcggataatgatttcggaaaatggaagctttacctagcagctggatttaatattcttttgcacggtgtcggttcgaagcgtgatgttctcacagaatttgagaatgagctatccgattatacatatatgagagtggatgcacggaaagatgggctcaatgtaaaagttcttcttggagctatcaatgagaatatgaagctgaattgtaatgtgaagagaggccaatctacgattagttgggctcgatctattcgcagaaaaatgaatagccaacagttgattcttatcattgataatattgaagctcctgattggag

SEQ ID NO: 29251 - DNA, 621 bp, Caenorhabditis elegans
atgcgtgaggtaatctccattcacgttggacaggcgggagttcaaattggaaatgcttgctgggaactatactgtctcgagcacggaattcaacccgatggaactatgccttctgagcaacaaaatgagggtggatccttcaccacgttcttctcagatactggaaatggacgctatgttccgagatctatttttgtggatcttgagccaacagtcgtcgacgagatccgcactggaaactacaagaagctgttccatccagaacaaatgatcactgggaaggaagacgctgctaataactatgctcgtggtcactacaccgttggcaaggagctcatcgacactactcttgacagaatccgtcgtctcgccgacaactgtagtggtcttcaaggattctttgtcttccactccttcggtggaggtactggatccggattcacctcactgctgatggaacgtttgtcggttgactacggaaagaagtcgaaactagagttttcaatctatccagctccacaagtttccactgcagtcgttgagccatacaactcgatccttactactcatactactttggagcactccgattgtgcattcatggttgataacgaggcgatc

SEQ ID NO: 29252 - DNA, 646 bp, Caenorhabditis elegans
tacgacatttgcaagcgaaatttggatgttgaccgaccgagttacaccaatctcaacagaattatctctcaggtttcgcaaaatacttgttttaatgtatcctatgtgtttccttttcttttcaggttgtgtcttcaatcaccgcttcactcagatttgacggagctctcaacgtggatctcaacgagttccagaccaacttggtgccatacccaagaattcatttcccattggcctcttacactccattgatctctgccgagaaggcatatcacgaggctctgtctgtcaatgacatcaccaatagctgcttcgaaccagcaaatcagatggtcaaatgtgatccacgcaacggaaagtacatggctgtctgtcttctgtaccgcggagatgttgtgccgaaggatgtgaacactgcaattactgccatcaaaaccaagagatcagttcaatttgtggattggtgcccaactgggttcaaggttggaatcaactaccaaccaccaactgtggttccaggaggtgatcttgccaaggtgccacgcgccgtgtgcatgctctccaacactacggctatcgccgaggcctggtcccgcctggactacaagtttgacttgatgtacgccaagcgcgcctttgttcactg

SEQ ID NO: 29253 - DNA, 545 bp, Caenorhabditis elegans
atggcgaattttattcggttagcttacaatttggaggtttggaagcttatagaggttcataaaaccacaaaaaaagcaatttcagcgcacaagctatgtggaagtgggagattttcaaacgtttattgtggtcaaatgatatctccaattgaaaaagaggtcgccgtgaaaaatgtgtggtctgatacggaaacacgtcacctagcaactagtgaatatccggaaattcaaattttatcgaaactttttcatccggccatttcgaatcttttgtatttttactcgagaaatgcgaatgacaaggtttggaaattagagagaaaaattagaaatctcaaaaattggatattgtttaggtaataaactgccttgttctggactatttaccacaggacctggcaagattaagagatcaaggtgtgaaattcgatgtcctcgacgcaaagctctacacttttcaattattctgtgcaatcagtcacttaacttcaaaaaacattgttcatatggatataaagcctcaaaatgttgtcatggatcgcatg

SEQ ID NO: 29254 - DNA, 1151 bp, Caenorhabditis elegans
atggtttcctacaagttgacctacttcaatggacgtggcgctggagaagtgtctcgtcagattttcgcctatgccggacaacaatacgaggataatagagtcactcaggaacaatggccagcattgaaagaaagtgagtttggaattattattactcaattgtgaaggcgcctgggtctcgaaacgacttaaaattcgcagttaccgtaaccaaatttttttttgcgattttctatgatttttttcctgatttttttctacaaaaaatcatattttttgggttagtattaaaaaattaagtgaattgcagttttgggtacggtaccagtgaaatttcggtcgtgccgagacctatagttaccgtatttcagcgccggaaatctcaaaatcctgcaattagggaatatctacagttttgtggaacaaaaacatgaaaagcgaaaaaaatcacttctcgtggtctcgacacgatttctacatttttgaccaattaaagaattcacttcttttgaaaaactatactttttccataattttctcaaacataagctaaattttttgtaaaataactttgtaaaatagcttaaaatcttttcctttttttaatccaagagaattattttttgaataaaaaatattttaaaaaactattttttccagcctgcgctgctccattcggacaacttccattcctcgaagtcgacggtaagaagcttgctcaatcccacgcgattgctcgtttcttggctcgtgagttcaagctcaacggaaaaaccgcctgggaagaggctcaagtgaactctcttgccgatcaatacaaggattattcaagtgaggctcgtccatatttctacgctgtcatgggattcggtccaggagacgttgaaactttgaagaaagacatcttccttccagcatttgaaaagttctacggattcttggtcaacttcttgaaggcttcgggatccggattccttgtcggagactctttgacctggattgacttggctattgcccaacattcagctgatttgattgccaagggaggtgatttcagcaagttcccagagctcaaggctcatgccgagaagatccaggcgattccacaaatcaagaaatggatcgagacccgtccagtcacaccattctaa

SEQ ID NO: 29255 - DNA, 789 bp, Caenorhabditis elegans
atgatccaattcagaaacaagaacaacagtatgaatcggatagcgcgtcacttacgaaatgtggcacgccgaaaaggctcgtcgctgcttctgtttctaatgctaagtaccgtactggtcgcggcaaaagaggacggtaagttgggggaagaggatgaggatttcgggtggaatgatgaagagccacctgataatcaggatgtgcaggacgggggaattccgttggttcggaaggaagagtttacaaataatcagctttatgctgaagcttatcagagttatattcaagctcttgcgtgtaagttatagtgcaggtttggttgaaaaataatggtttttcgagaaaacagaaaaacctttggaattttttttcagaaaaaaattggaaaacattttttattaaaaaaatgtttcaaaaagctttactacccctagacacttgtaaaatcaggaaaaaatcaggaaaataattcagattcattttttttgcaaccacataggcccggataaagctgtaatactccctaagattccagctcagtttcaaatttaagcgcagttttatgcggaggattcaattctaagttgtattgttggcaagaattcaagtgaactatatttacagtttctatttttataatcttcagaccccgcccgactagtcgtccgtccagactcatcaaccgtcgtcgatgaatcgaaaatctcatttttctgtcgagcagatggaaatccgttgcctagtgtgatttggagagtcaatggaaaatccataacagatcataatcg

SEQ ID NO: 29256 - DNA, 348 bp, Caenorhabditis elegans
atgggaacgccggctactacaatagcagcgattaataataattttcgcaaattcttcatacttttcttattgttactggcacctacttgccggggccagcagaaaggtaaaaattggtggatgaggaggacgtccttggtgggattgggaggtgaaaaaacattaattaacaccttcggaaggaaacgaagattgattgatgggaatcaattttgggagggggggggggggtctaactgagggggaaaagatgcaactaaattattgactctccttaatttatggtctttattttcagtaccatcagcgcctcgaaacttcaatgcagagctgaccagtgccacatcg

SEQ ID NO: 29257 - DNA, 2019 bp, Caenorhabditis elegans
atctgattcttgacaataatatcgaggaagaagaaggaaaccaggatccaggagaagccacaatgggagaaaatcgaaatccaccgaaaaaatccaaaatctctactgccgacgtgtacagtgcgattctgcaccatgcgccggggccattaacccacccgatttcggcagcgctggcgaaagcgaaaccaacaataggtgctccaatgcccgcaccgtacaccaccacatcaacaccttccacactgtttttccaagttacattaccctttatgacaaccgcctggaatcgggttactaagctagaaagttggtaaactgtttattctaggcctaggtttaggcttaggctcaggcttaggctctgagctctaaccaaatttgaaactgctgtaaaccatttgataagcgctgaactaaattttagggatttgttagaaaatcctatatgactcgagtcatacttaaatattttgcttgcttgtgtgtgttttttcccgtgcatcatccccttagtttccatccgttttattgcttgcatgtgaattcatttccaactaaaaagtatgtatattttatgtcgttgtgcgagcgcgcgcgtcattcgaatcggcactgcaatttctcaaatttcgttcatctctaacggcgcgcaagctcacacacacgaaaaacagcgaagtacaaacacttgataagtattcaatgtgagaatgtgaagaagatgcccctcctcctcctacgaaaataatggttcaactaattgagtgttgcccctgtgtgaggcgtgttttcaagaaatatgagattagtccccgcatgtagtaacaagaagaaggactgcttgccccccccccccccccccatttttctcttctattgctgctaagagttgggaccctgttgttgttgttgttgttgtattactactttcctcaagttgctggtcaacctcgtcttcgtctacttgattgcacttgggttccgctctcaattcatataaagagagctgcccccaacgggcaaagaggaggacacacacgagagaggaggaaaattactgcgcaacagcaggtagacgacggcgacccaaatccggagccaaaaggggcgtgtgcaattgaatgcaactggagccccgggtctctcagcgccagtgtctctagcgcagagcaacacaagcatcagcggcagcaaatttatgcggagcacgcgagagaacctttttcggatttgatacgctgttccggtagctcgggtcccccacttacatggaaaattgcgccgtagattggctcaaaacacttccatgactcgttcgtttcttttcaataggaatattattattcattctattcgacgaaataagaagactcaacactgtcggaatagtttttgatgtccgaccaccagttttacacccagttgtgcttatactcatgaataattcgcgcaacctcggcggcggcggtagtgtcctccactccgttttacttttgcttgtcatcgtcattcaacatcatatttcggttgctgaatacacgtttaacgagctcgagctggcgacatcggaccgcgcgcgacgcggaaccgaacgtgtccgctcgcggcagccctttggtaaaggattcttcggatccgaaactataaaggaggtgcctaaagaagaacgacgagagtcacggcctatgctgagaagctcgccgacatcttctgaaccatctccagcatctcaggttcaacgaaaaaacgggaatatattcgctgctgtaatcaatactcttttacataaagatgaaggtgcggtatctttttttgcatggttttagtttttgcattgtcgtataaactttattgtgtctgttaatgttgagtattgtcgaaaaaattcaagattttccctgagactttatataaaatatttatttttcagcacttgtcggacctcctaccaatgttcgcgttgaagccacaagcaattcgacagcagttgtgcaatgggatttcgaatcacagaag

SEQ ID NO: 29258 - DNA, 526 bp, Caenorhabditis elegans
aaaaggatggagatggcaagatgactcgctgagcaaaagcgacatggaaaacattatcagcatccataacgctaacaacgaggaggcatggagagaggtgttgaaatgggagaatcttcttcatccgtaagctcatgaaaattccaacatctgaataatttataatttcagggaatgcgcagagccgaaactgaaaagcttcaaaggagatgccaagaacctatcgccaagagctcgtttccgcaacttgttcctcggatacgatctcccattcgatcgtcacgattggattgttgatagatgcggaaccaagcaagttcagtacgtcattgactactacgatggtggtgctgtggatccaagctcaaagcttttcactattcttgatgttcgaccggccgtgaatgatattggaaacatctgggatcgaatggttgttgcttattggagattcaaattcgagacacttggattcacaccgagcctgccgattccaccaactgaaggacacaatgtcaaccattaa

SEQ ID NO: 29259 - DNA, 703 bp, Caenorhabditis elegans
gcaagcttcgctcacgacgtcggcaccgcagctggaaaagaatgggtcattgttaatggacaaaatgtgacctacaccatcaacgaccaatgttatctccagcagtggtatccaaatcaatccctcgttgaacttatcctcctgctcatcgccgttgtatctgttccagttatgcttctcgtcaagccattctacattcgttggagacactcccgcggacttcacattgatttgggacatggtcctgatgaacacggagagttcaacttcggtgacatcatggtgcatcaagctattcacactattgagttcgttctcggatgcgtttcccacactgcttcatacctccgtctttgggctctttcacttgctcacgcacgtaagttttattaggtgattacacaaacaactcattccacaattttcagagctttccgacgttctctggacaatggttctccgtatgtcattgacaatgggtggatggggaggatctgcagcaatcaccattctcttctacttcatcttctccattctttccgtctgtattctcattcttatggagggtctttccgccttccttcacgcaatccgtcttcattgggtcgagttccagtcgaaattctacggaggtaccggaatccagttcgagccattctgcttcaccaaaattattcgcgtttacgagggactcgatcagtag

SEQ ID NO: 29260 - DNA, 899 bp, Caenorhabditis elegans
atgggctcgatctatagatcggagcacatgaaattgtgccaaatcttcttccaatccgagtccgcctatcaatgtgtcgccgagttgggagagctgggcatggctcagttcatcgatttgaatgaggaacagaatgcgtacacgagaaaatttgtgaacgaagtgagaagatgtgatgagatggagagaaagattagtaagttttagatcaaagtacaaaagtgcctacctgcctgccttgtgcctactcgcggcgcgcgtgtgcttcccgaagaataggattctggctaagaggattttgaacaaattttagtcaattgttcttgaattttataatcatccaaattgtcaatttcagatgaaaatcgaaaaaaaaactcgctgactgctgtaaactagaattcataatttttcaagtgcaaatacgtccattttcagctaatgtgaaaaaaacaaatataatttgcaaagtttgtcataaatcaattatttaatccaaaaactgaaaattcatctgcaaaaaattaatgtttacttattaccataattccagatttcgtcgaggatgaaatcaccaaggatctggtcccaattccagactacgatgagcatattccggctccacagcccaaacacatgggagaaatggaggcaaacttagagaagcttgaagaggagctcgttcaaatcaacaagaactgtaaagtgctcaaaaataaccatgttcagcttcttgaaatgaaagctgttctggagcatgtcacctctttgttggatccacattccaagagagaagctgctatgtcaatctcggaagctgctcgtggagaggctggcccaattagttttgggatgaaggatgagtttgacaagccagtgaaggatgagaaggagttgaa

SEQ ID NO: 29261 - DNA, 385 bp, Caenorhabditis elegans
atggtcgtcaacgtgttcatctcggctgtgaccactgacacgctgagccggaaggaagcagttgcttgggtcaataacctactcaaggtttgaatttgcgggaaatgttcaaattatttaatatttcaaatttcagagtcacttcaccaaagtggaagagatggcgtctggagccgcgtactgtcagctcactcatctcttgttcaacgccatcaacctgaagaaggtcaaattcaacccacggagcgagcccgatgttctgaacaattggaaggtgctcacaacgacctggaaggatctcggcattgacaagccggtcgatgtcgagaaaatgaagaaggccaagttccaggacaacatggagtttttgcaatggttctacaag

SEQ ID NO: 29262 - DNA, 588 bp, Caenorhabditis elegans
atgcggtggttaggtaggtcattttgaattaggaattattagaaaaagaaactaatcgtttagatttacgtaggctcgtgtattctgctaggagaatctcaattttttaaaaatgattttgtatctatcatgctcttgttcataggttcctagacatgtattctttcctttttttcagaaaacaagaaattaattttaaattttaaatatccaaatttcgtaaaaattgccgctttgctttatacgcgctcgctatttttctgagtaggtctcttcacgatctcagccgcagtgggtggtggctacaactttcaaattccacatagttgttcaatttgcaacctgctaataaatactagaaaattagtcaaaaatctagccttttagttagaaaaatacacccattctttacgttcagttaccacgttgctatgttgctccctggctcatgggctcaaggatctcggagctccgaactggtcgtgtgacgctagtgttatggcaaagagtaagaaagttcccaccagtgctcatagtgttcgatttgctgatatcaaggttattggagcacttggggactcgttgact

SEQ ID NO: 29263 - DNA, 424 bp, Caenorhabditis elegans
atcgactcaaacactggattcgatattcctattcttcgagaagctcgtgcaagatctcaagtatcgcctgatctttatctttaccattttccgtattttaatccagccgagtttgatgtagactttccagttcgggctacttatcactgtcatgaattcccatacatttggggagtctacaaggacaattatttcgaatttaacgacgatgatagaacagtctccgcatttttaatcacatccttgacaaatttcataaagacggggtatctgaaaaagtatcagcatagcagcctacagtagcttccaaactttcagaaatccttcaagctcggaatttaattggcctttatacgactcatcagtttctcatacagttatcgggccaaagccaacaactgataaacgtctgttaactctttaa

SEQ ID NO: 29264 - DNA, 590 bp, Caenorhabditis elegans
gtaaagataaatggatcgaagacgaatgtagttggactgaagaaaatcgaaataggaaacatctccgacgttgatgtgattctgaatcttgccgattcgcaaagatccgtagcttcaacagcatctaatgagcattcatctagatctcatgcaattttccaaatcttcgttgatgggcaaaacgcctctggtgagatggttcaatgctgtctcaacttggtggacttggctggttccgaacgggcgaaggagacgcaagctcgtgggaagcagttcaccgagctcacaaacatcaaccagagcttgagcactttgaaaaaatgcatccgagctcaaatgacgaagatgtcgcatgttccatatcgtgacagtaagctcacaatggtgcttcgcgagtatttgggtgcaggatcgtcgaaaacaatgttcattgctcatgcgaatcctcgtgatgttgccgaaaccaaacggacattggaattcacttccgaggtatttgtgcatattttttttctgacatatcttttaaatttcagcttcgttcaacaaatttgggaaaagcagttgttcaaacaggacaaaaactatga

SEQ ID NO: 29265 - DNA, 647 bp, Caenorhabditis elegans
gctaggtatcgttatcgtggaatttctgacgccgtacggacaatttattctcaacgtggactatccggattctcgtgtggattacaagctagggtcatattccaggtaatgtctaagatttttgattttcgtgccaaaaaatacggtaaccggtctcgaagcgatcgattgttttgaatgcaaagggtctgcacctttaagaattactgtaattcccaactaacggttacagcgaaaaaaatttagatttttccagagaaaatctagaatttccgattttttatttttttgtaaaaatcggaaaacataaaatttagattttctggaaaaaaaaatgttcagaaaaaaaaaacacaaaaatttagttgccaaatttttatgatattattccaataatcaagaaaaatttcgaaatatcagaaaatcacaataacaaaaaatcgaagaacaactttagtaatccttaaaggcgcacactctgttaaatttaagaaaatcggccgcttcgagacctggtacagtatccgggcaatagaaaaacctcagtttaataatttttattccaggttcctgcaactgctctctcctggtccgtttacgagcttttcaaattcatgttgtctttcgaaggaggtcattcgagttga

SEQ ID NO: 29266 - DNA, 513 bp, Caenorhabditis elegans
atgctgaccagaggattcacgtcaattggcaagattgcaagtagaggtaattaatgtttcagttaatatttaaggctggtgtagtcgaatttaattaagactgctgtaaaaatacaataaaaaccgcaacaatcacctaaaattagccgaaaacaataatcaacatattaattatatgattgtccgagaggagtacacgcagagggcgctcgttcgcgcgcgaagttcaaaaaatttagaattattcgctatttcgaagccataactcacgttaacgaaatttttgtgatgtatcgtttttacatatcgtctaaattcgactacacccaaaaaattattctcaaacttgagctcaccctccaaatatttcaggtctctcgtcgacgttctaccaagatgctttccagctttcggatcagctcactgaagacgaaagatctttgatgctctcggctcgggaatactgtcaggagcgacttttgccacgtgtcacagaagcttacagaactgaaa

SEQ ID NO: 29267 - DNA, 234 bp, Caenorhabditis elegans
atgcgagatgtcgacctcactgcagcgcctgcgaaaaaagcgaaattggataccggaggtttgataatatttacagaaacgttccttttataattctgtttcttatagagagaatcgccgtttctggacgtgttgcttcagtaaaacttaccaacttcatgtgccacgcaaatcttcaaatcgatttcaaaacggcacaaaacaattgcttttatatcggtggcccgaatggaa

SEQ ID NO: 29268 - DNA, 1525 bp, Caenorhabditis elegans
acaatccaaaatcacgatcacactgaccaatgcaggattgaacgctcatccagatttcgatgatctcatttccattgagagaacgatcaatcaggcatcgtcaacctatattatgaaaagtgtaaaagtgacatcctccgataatcacgttgagcgaattgtgagcaggaaaaaggccgacgtcgatcgcattgtgagccgattcagcattcatctctcgaatcctgcattttggatgagtcaagacagatcacgaagttttcttgcaaacttcaaaccagcaaatgtctacaagctgtatcttgaatctacgaatcttgagaacatccgattatcttatatccgatttgccgacgctttggatgaatgcttcgcgttgatacagctgaaggctggagaaattttgaacgagcagaaaaagctgaagcgaatgcaagaacaacgtgatctccaagcgaagctagaccaggatcgtgcacttgttgccagtttttgctggaagcttctcttctgtaaagttcgcgattacaacgatcaaatcgaactgactcttaagaagcaggaagctcagaaaaccttacaagatgaaaccaaaaaggaatacgctaaaaatcgtgctgccagaacagaagttgagaagaaaattcaagagtttagagacgaggtcgaagttcaggatgcggaaatagctgaagcaagagaggatttagatgcgaagaaaagaaaagttctcgaattcgaagagaagattcgagagtgtgaacagagtattaggaaaaagacatccgagaagaaatacatggaacggacgatcgttaatgctaaaaatgaagttcgcattcttcttgaaaagcagggaaatcaggatttgacaaagaggctgaccaaagttgagaacgattataaggatatctctcaacaaagagagaacatggagttaggaggcgaatcagcaaagctgagggaaaaacttgacacggtgattactgactacaaaaggaaagaagaagaaaagtatacaatacaaagagatataaatcaacttcgtcggaaaattgaacaggatatggagacaatgcgacggtccagagccaccaagaaagacgccatcaacaagtaagtttaaaaatattttaaaatatatttatttcctatttattacctatacatttttcagattcggctcacacatggctgaaatactcatggaaatcaaccgaagcaagtcccgattccaaactgttccaaaaggtcctcttggaaagtacatcacgttgatcgatccaaaatgggcattcactgttgaagaatgtattggaaatcttgcaaacaacttcttgtgttccagtcatctagatgcagagatcctccgaaacatcttccaaagccttcgaattccagcacaagaccggccgacgattattgtagccaagtgcaatggaagagcttataccaatcttcatgagccaagctcagactttaaaagtatctaccgggtgctcaagttttcagatccagatgttca

SEQ ID NO: 29269 - DNA, 302 bp, Caenorhabditis elegans
aaatcgttgaatgcacttcaacaagtcgttgctcgcaaaggagctccaatcatcattgccgactgcaccgttccagaaggcgatctcgctggaatgaagcatattcttcgtgtaccaaaaactgttgattgtgtccaaaacattctcacagtcattccactccagctactctcatatcacattgctgagctcaatggagctaatgtaagtttacaatcgtcttaatcttgaaatgtacacgtataatctattttcaggtcgaccgaccccgcaacttggccaagtcagttaccgtcgagtaa

SEQ ID NO: 29270 - DNA, 2355 bp, Caenorhabditis elegans
atgcgcaaaaccgatgatggtggtggaagtggtcgtctatcgagttcgtgttcatcgatccgtagttccaactactcaagatcctatactccaaggtgagaaataactcggtttccatgccaacgtcttctaccaattctctctttttcttttctccgtcggattaacgacacatagaaaagtcgcaatgagatggatgtattatggaaaagagtgagagaaaaccgagtagtgtatttgtatgtgtgtcttgtgaagccgaataataacttttaacaatttttctttaatatcaaatttatttcaaaactggcaattttgagaaaataaacctctcaaagttaccagaaaaaattaattaattaatgtttgcaaatttaacaaaaatttaactgaaaaatgaaaaatctttacaatttagtattaaattcaacttcatctttaaaggaggacccataattttattgccaatcaattgattatttttattttaaaaaaagttattttcggaaaattattgacaaaaggttttttataatttaaataaattttctctcatttctgatgtttttttgtgaaccttccactaaaattttaaattgtatgcctacgcctggcgtcactctttacaattagtaactgccaagtggatcaactacacgtgattatatatatatatatatatatatatatatatatatatatatatatatatatatgcatttaacactttcgatcatgaaataactgataagaccttcattaagataagcccgaagaaacctttttacaatttctgtgtagtttttcattgtacaaacaatttggagcaataagacgtagatagtcagaaagtgagagcattttagtgagagcaatgcgccattgattgaaagtagactaatgcaaataaataaattttctgactgcttttgtgtactggaataagagaaaaagaaagaaaaaagagagaaagagagaacgaaaaaaaaagagttacgagtatattctcatctccattttccttccaattttgctttcttccagtttttcctcttgttctgacttaatccttggctagtcgatttttatggtttaatctagattttcaagaagaaattttaatttttaaaaacatttctacctggctcctattatttccaaatgttttccaaaccaagttttttaaagtttttattagacttttggcaaaaattctaaagtatttccaaagttattaaaatgctcttaatgctttttttttcttctaaaaaagtgtttacttttaaaagttatagatactttttaattgaaggtttgaatattttcaatgctaactattttttcttgctgagtcacttctatttgagagttttttctcatctttttccacccatctgataaactttcaaaccagtttttttttgacattttataggaaaaatagcgtaaacacattaccacacctatttttaagtttgattttttaaaaattttagtagttgtttttttaattaaaaaattaaattttttaaatttcacaatagaatgcatgagattaacatgtgggtgatttgcttgaattaattaaaaaaaaaacaggtcgtacatttgaactctttgctgaaaaattgaaaaaatcataaacatttagaaaaattaaaacattttttgcagttattttcggtcaccacgaccaattttcaatcattttaagcaatgctttttcatatacctttaataatattttctatagatcgcaaatagaggaaactcggtcatatcttcaaaaaaataaacctctgtatacccgcgtctcaactgaaatttaaattgattttccagcttcaacaccttcaaatactctccatcatcatacacacccaacatctcacgtaatctgaacacaacgtccactgggtcgacgacatctgatactccgaaactgtcatcgtcgtcggccccacgttcgcgtctatccttcaccacaccatcctcaacttctacaaatcttccgcgaacaagcatcacatctcacaagactttgtacagtagtcctgctgctgcacgtgtctccgtctccacaaatgatagtctctcacattcgacaccacacaatacatatcgaggaatctccaagtacagtaccatcgaacgatctactgttgcagacacaaaaccgtactattcgtctgccacatcatcactttcaagtacttatgatagtagaagacactcaagaagcgatagaatatcttcatccacattgcctgatgtgaagattgaaactggtccgactacgaggacccacatggtgcatccaacatcttctcatatcagaagccgatcgtcata

SEQ ID NO: 29271 - DNA, 312 bp, Caenorhabditis elegans
atgaggcaggcaggcatttttagccacctaaaaaatttctggaaaataatactacgtgtgtcttattctcttaccataactgaccagctgccaaatttgttggcaaacagtttttgccctcaacaagctaaccacctgattctctttctctcttctcttttttgtgtttctttgattatttgacacgtgctatcaatcgcatttttatttttttatttcagaattttctaaattaaaaaaaaagcatatcgttatgtcaagtgaaaaccagaaaatcgtggttttcggaagtatcgttcaggatcttgtcag

SEQ ID NO: 29272 - DNA, 870 bp, Caenorhabditis elegans
attctcgacgattctgtgaaggtcggagaagtcggattcgattcttcgaagttcgttgttgtgatgctcagcaaaaggaaagtcacagaagttgcaccttcatctaccgttgccacagctgctgagcctgttccagtagctgccgctcctgcgtcaaacccagccccagctgccgatgttgctcctgaagctgctgctcctgctgaggcggaggcgcttacggatgagcaagaagagaacgttctcgcaatcactggaatgggctatgaccgtgaacaaactatcgctgctctgcgcgcagcattctggaatccagaccgcgcagtcgagtttcttctcaacggacttcctgatgatgctgctgaccaagaaccagatttggggcccgagcaaaacatcgataacgtggatgaggatggcaatgacgatcttaacatgcttgcaaacatgccacagcttgcagaaattagagctttgattcaacaaaatcctgaaatgctcgccgcagtccttcagcagttggctgctgtcaacccaagacttgttcagactattcagaacaaccagcaagctttcatggatcttttgaatggtggagctcaaggagccggagccgctgcaggaaatgcgccagaaagaaacaccccacgtcgccatgttatccatctcagtcccgaagaagctgctgctattgagagaatcaaagccatagttgttaatgcaccagaagctgtggttgtggaggcttatttcgcatgtgacaaaaacgaggaagccgctatcaactttattttcagcaacctcgtgagtttatttccatacgtagataattagaagtttaatttttaattatttcaggatgaggaataa

SEQ ID NO: 29273 - DNA, 549 bp, Caenorhabditis elegans
atttgaaagtctcaccaatgagcagctcttcttcgttggatatgctcaagtttggtgtggagccaagacgccagagaccaagactttattgctactcactgatcctcactcaccagaaactgcaaggtattactgaaacactaaattccgagaatgcgtattacataacatatttgacgcgcaaaatatctcgtagcgaaaactacagtaactttttagagggctactgtagtgtcgatttacgggctcggaaatttatttatttttcgtttaacaatcgaaaccactacagtagtcatttaaagatttacctcgtgagtttatttccataagtagacgatttactatttacatgtagttttcgctacaagatattcaaaaatatgttacgcaatacacatcatcgttcattcaacttttttggcaacaattatttataattttttcagagtgaacacggttctaacaaatcagccagaatttgccgaggctttcaaatgtccagctggatctccgatgaatccaacgaaacgctgtgttgtgtggtaa

SEQ ID NO: 29274 - DNA, 1122 bp, Caenorhabditis elegans
attgactggaagaaactgacactttcaaccactccattcctggttcactcttacctcaagaccaatccaagcatcattatctccgacgttgaatatcttcaaaaaatgaacacactacttcaaaacactgatccacgaattgtcacgaactacatcctccttcgttgggctggatcatggagccaagaaattggaaagaaatatgaggatttgcaacaagagttcgcgttccaaatgtacggacgaaagcagagacagccacgctggaaggattgtgtcagcagtgctggtggaaaacttagctatgcttctggttagtagatcttttaggtgacactatttaacttttaactaaatttcaggatctatgtatgttcgcaagtacttcgatgccaatgccaagaacacaacactcgacatgatcacagatcttcaagaggctttccgaaacatgatgcatgcaaatgattggatggacgctgaaactaagaagtatgcattggagaaagctgatcagatgcttaaacaaatcggatatccagactttattctgaacgacgagaaacttgatgattggtacaagggtcttgagggagcaccagaggactcattcagtcagcttgtcgagaagagcatccaatggcgtaacaacttctattatcgcagactcctggagccagttaacagattcgagttcatctctagtgctgctgttgtcaacgcgttctactcgccaacaagaaatgctattgcattcccagctggaatccttcaacagccattctttgatgctcgtttcccgaaagctctcaactacggaggaattggtgcagttattggacacgagatcacccacggattcgatgataccggacgtcaattcgacaatgtcggaaatcttcgtgattggtgggataacaccacctcttccaaattcaatgagcgaacccaatgcattatcgagcagtacgctgatgtgaaactccgtggaactgatctccgaatcaatggaaagttgacccagggagaaaatatcgcagataatggtggaatcaagcaagctttcaaggcctacaagtcatatctggagaaacacggaggccaagaagctcgtcttccaca

SEQ ID NO: 29275 - DNA, 894 bp, Caenorhabditis elegans
atggcaagcactatcaaggaagtcttcgcggaaattgcagcgcctgttgagaacagtcacggaaaggtgacagtcgtcggagtcggtcaagtcggaatggcgtgtgcctactcgatccttcagcaaaaccttgccaacgagttgtgccttgttgatgtggtcgctgataagttgaagggagagatgatggatcttcaacacggacttgcgttcacccgccattgcacggtcaaggctgatactggttagtttaatattaatgtaaatattttccccccacaaaaaaccttgaattttgcagactactctatcaccgctggctccaaactgtgtgtagtgacagcaggtgctcgtcaacgcgagggagagacccgtctctcgctggtccagcgaaacgtcgagattttcaagggaatcatcccacaacttgtcaagtactccccggacacttgcatcctcgtcgtctcgaatccagttgatgttctcacctatgtcacctggaagttgtctggactcccacgcgagcgagtcttcggatccggaaccaacctcgattcggctcgtttccgcttcttgctctccgagaagttgaacatcgccccgtcatcgtgccacggatggattatcggagaacatggagattccagtgttgctgtgtggtctggtgtcaatgttgccggagtcacacttcacgagatcaagccagacatcggagagaagactgacaacgaacactgggaggctgagattcacaagaaggtcgtcgacagcgcctacgagatcatcaagctgaagggatacacttcctgggctatcggactttctgttgcaaagattgctcagggaattttcagtaattctcgcaacgttttcgctctttcgactaacgtgaag

SEQ ID NO: 29276 - DNA, 244 bp, Caenorhabditis elegans
atgttgtctcgtcttgctcgtgttcaggtaggagtttctttttataatattttttaacaaaaaatcgtgtacttcacacatcacttgcagtctgtgcgacagttgtcgtatggggtgacacattgaaaaagaaaacgaaaatcaaacaatcaaaacttcaaaacttcaaataatattctaatttcagccaaaatgccaacagctcgcccacttcagcacatcgaagtctgctgccgccgcacca

SEQ ID NO: 29277 - DNA, 381 bp, Caenorhabditis elegans
atggtcatgagcaggacacttgtacttgtggcgctcctcggcttcgcatatgtttggtaagtaacctttagaaggcttctaagctttcatgcctgcctaccgcctattaaaaaattaaaatacaaaaaacctaaaaacaactgtgtagtttctcatttcagcgaatccgctctgatcacaaatctccctggagctccaatctcaaacttcaagcaatattcgggctactacaatgtgggaaccaagaagaatcatatgctccactactggttcgtcgagtctcaaagcaacccatcaactgatccagttcttctctggcttaccggtggaccaggatgctccggattgtcagctcttctcaccgagtggggaccatggaat

SEQ ID NO: 29278 - DNA, 401 bp, Caenorhabditis elegans
ttcttcccatccggaaacgcgttcgccaccggatccgacgatgcgacatgccgattgttcgacattcgtgctgatcaggaacttgccatgtattctcatgataatattatttgcggaatcactagtgtcgcattctcaaaatcgggtcgcctgttgttcgccggatacgacgacttcaactgcaatgtttgggattcgatgcgacaggagagagctggtgagtgcctttagctcctttttttgaaattttccaagttgaaagtgatgaaaaactaattgttcttccaatttcaggagtattggctggtcacgataaccgagtttcttgtctaggagtcaccgaggacggtatggccgtgtgcacaggatcatgggactcgttcctcaagatctggaattaa

SEQ ID NO: 29279 - DNA, 2047 bp, Caenorhabditis elegans
atgtcttcatgcaaagctattggtatcgacctcggtactacgtactcgtgtgttggaatctatcagaatggaaaggtaagtattttttggcattttcaattttaataacattttgttaaaattgtagattttagttaatattttaaacataatactttcaatatctaatttgtttaattttcaggttgagatcctcgccaactcggaaggaaataagacaactccatcatacgtggcattcacagatacggaaagattggttggagatgcagcaaaagatcaagcagctcgtaatccagagaatacagtatttgatgcaaaaagattgattggacgacgtttcgatgaatcaacagttcaatcagactgtaagcattggccatttggagtgaaaggaaaacaaggaaaaccagtgattgaagttgaagtgaaaggagaaaagaggcaattcaatccagaagagatctctgcaatggtactccaaaagatgaaggaaacagctgagacttatctcggacataccgtgaaagatgcagttatcacagttcctgcatacttcaatgatagtcagaggcaagcaacaaaggatgcagctaccattgctggactcaatgcaattcgaattatcaatgaaccaactgctgctgctcttgcatatggattggataaaggaattcaagatgagaagaatgtattgatcttcgatctcggaggaggtacatttgatgtttcaattctttcaattgctgaaggatcgatattcgaagtgaaatcaactgctggtgatacccatctcggaggagaagactttgatcaacgaatgcttcaacactttatgaatgagttcaaaaggaagaccggaaaggacatttcacccaatccacgagccatccgacgtctccgaactgcttgtgaacgtgccaagagaacactttcaagttcatcggaagcatgtgttgaagttgattcactgtttgaaggaattgatctatgcacaaagatcactcgtgctcgtttcgaagaactgtgtgctgatctattccggaaaactctggaaccagttgagaaggctcttcgagatgctaaacttgacaaatcaaagatcgatgaagttgtgttggtcggaggatccactcgtgttccgaaaattcaaaaattgctgaaagacttcttcaatggaaaggaattgaactgctccatcaatccagatgaagcagttgcatttggtgctgcagttcaagcagctgtactttctggtgtcaaggatgaaacaatcaaggatgtgttgctggttgatgttgctccattgagccttggaattgaaacagctggaggtgtgatgaccaatctgattgatcgaaacactcgaattccaacaaaagcctgcaaaacattcactacatatgctgacaatcaaccaggtgtctcaattcaagtgtatgaaggtgaacgtgcaatgactcgtgacaatcatcgccttggaacattcgaattgtctggaattccacctgctccacgcggtgttccacaaattgaagtcacttttgatattgatgcaaatggaattctcaatgtgtcagctgaggataaatcaactggaaaatccaatcgaatcacaattcaaaatgagaaaggacggctgacacaatcagatattgatcgaatggttcatgaagctaaacaattcgaaaaggaagatggtgaacaacgggaacgtgttcaggctcgtaatcaattagaagcatatgcattccaaatcaagcaggctcttgatgagtattcatcaaaactatcaactgaagatgcatcacgtgcaaaagaagctgttgatgaaacacttcgttggttggattccaactcattggctgaaaaagatgaaattgaagcaaaggataaggaattgaaatcagtttgtcaatcaattctcactaaaatgcaccaatctggacaatcttctgcttctgctggatgcgctggaaatcctggaactgctggattcaatcctaacaattatccacaaggacctactgttgaggaagttgattaa

SEQ ID NO: 29280 - DNA, 2047 bp, Caenorhabditis elegans; identical to SEQ ID NO: 29279

SEQ ID NO: 29281 - DNA, 376 bp, Caenorhabditis elegans
atgtctgctgcccgcccgcccgttgcctcgtatttcgcagccagaatcgctgttccatgcgagaccactgcagtggagacccctctgtgcctttaaacaaaagagagagtgtgcattttagagagagcgcagagttagagcgcgcgtgcttcaaaaaacaaaagctttttcacgatttcggaaatctttttcctgtttttgattggttttttttgttataaataaacgtttctaatagattttcaaaaaaaagcgtacaattgtcactaaataagacttttttcagatctcttggggatggagtctcgcaaaagacagctccaaaatgtcaattcagaatcacacgagccgaaacgtctaaaagaggaattcaagg

SEQ ID NO: 29282 - DNA, 361 bp, Caenorhabditis elegans
atggccgacgccgtgttccctacacaggcaaccgcccaaactcgctacatcagcctgttcggcacgagaacgcgattcgtgattatggtgctgatcttgttgtgtttgacgagtatttggtacgtttttttttggtagttttccaaagtttgacaaaaagtttccaaagttcggcagaaagatgtcttccaaattgacgataaaatatcagtagctaaactttctgtacttataatcaaatataaatcttccaggtccaatattctcgccttcaactttgcagtggtatgtatggatgatgatgattcagagatgggtgcatcgctcaacggtaccgcacgaaaaacgcactttacaagca

SEQ ID NO: 29283 - DNA, 484 bp, Caenorhabditis elegans
atgagcgactctgatagtgaattctctatcgaagattcacccaagaagaaaaccgcaccaaagaaggagaaggcgtcaccgaagaaaaagaaagatgatggttggttaatttgtagagtttcttgaatctaatttgcttcttttcagccaacgagtcgatggttatgactgaagaggaccgcaatgtgttcacgtcgatcgacaaaaaaggtggtggctcgaaacaaatggcgatcgaggatatctaccaaaagaagtcccaactcgagcacattcttcttcgcccggacacctacatcggttcggtcgagcataccgagaagacgccgatgtgggtctacaacatggaggagagcaagctggagcagcgtgacatctcatacgtgccgggactctacaagatttatgatgaaattcttgtgaatgccgctgacaacaaacagagagatccgaagatgaacacaatcaagatcaccatcaataa

SEQ ID NO: 29284 - DNA, 2673 bp, Caenorhabditis elegans
aattgtcaaagccaccaaaggaaaagaagaagtttccttctattcgctcccagaatattctgagtggagaatgaatacggataactggaagtcgtacaagatcaagtactacaagggattgggtacatcgacttctaaggaagctaaggaatacttcttggacatggttcgtcatcgtatccgcttcaagtacaatggagctgatgatgataacgctgtcgacatggctttctcgaagaagaagattgaagagagaaaagactggctctcgaagtggatgcgggagaagaaggaccgaaagcagcagggacttgctgaagaatatctctacaacaaggacactcgattcgtcaccttcaaagatttcgtcaatcgtgaattggtcctcttctcgaatctcgacaacgagcgttcaattccatgccttgtggatggtttcaagccaggacagcggaaggttctcttcgcgtgcttcaagagagcagacaagcgtgaagtcaaagtagctcaattggctggagctgtcgctgaaatttctgcttaccatcacggagaacagtcgcttatgggaacaattgtgaatctcgctcaagattacgttggctccaacaacatcaacctgcttcttccaatcggacagtttggtactcgtctccaaggtggaaaggacagtgcttcagctcgttacatcttcactcaactgtcgccagtcactcgtacactcttcccggctcacgatgacaatgtccttcgtttcctttatgaagaaaatcagcgtattgagccagaatggtattgcccgattattccaatggtactcgtcaatggagctcaaggcatcggtactggatggtccacgaacattcctaattacaatccacgtgaactggtcaagaacatcaagcgtcttatcgccggcgagccacagaaagccttagctccatggtacaagaacttccgcggaaagatcattcaaatcgacccgagtcgatttgcatgctatggtgaagttgctgtgctggatgacaacaccattgagatcaccgagttgccaatcaaacagtggactcaagactacaaagagaaggttttggaaggattgatggagagctcggacaagaaatcgcctgttatcgtcgactacaaagagtatcacacagatacaactgtcaagttcgtcgtgaagctctcgccgggaaaacttcgtgaattggagcgcggtcaggatcttcatcaagtcttcaagctccaagctgtcatcaacactacgtgcatggtacttttcgatgctgccggatgtcttcgtacatacacttcgccagaagcgattactcaagagttctacgatagtcgccaagagaagtacgtacagagaaaggagtaccttctcggagttcttcaggctcagagcaagcgtctcactaaccaggctcgtttcatcctcgccaagatcaacaacgagattgttctcgagaacaagaagaaggcggcgattgtcgatgttttgatcaagatgaagttcgatgctgatccagtgaagaagtggaaggaggagcaaaaactcaaagagcttcgtgaatctggagagatcgagctggacgaagatgatctagctgctgtcgccgtcgaagaggacgaagccatttcctctgctgcgaaggccgttgaaaccaagctatcagactacgattaccttgtcggaatggctctcatcaagctttcggaagaagagaagaataagctcatcaaggaatcggaggagaagatggctgaggttcgagttatcgagaagaagacctggcaagatctttggcatgaggatctggacaacttcgtgtctgagttggacaaacaggaggctcgcgagaaagctgatcaagatgccagcatcaaaaatgccgccaaaaagcttgctgccgacgcaaagaccggacgtggacccaagaagaatgtgtgcacggaagtccttccatccaaagatggacagcgcattgagccgatgttggatgctgcaaccaaggccaaatatgagaagatgtctcagccaaagaaggaacgcgtcaagaaagagccaaaggagccgaaagaaccaaagaaggtgaaaaaggaaggccaggacattaaaaagttcatgtctccagctgctccgaagactgcgaagaaggagaaaagcgacggcttcaactctgacatgtcagaggaaagtgacgtggagttcgatgtaagatttcctctgtaatttcttcaacttctaaaatattttttgcaggaaggaatcgatttcgattcggacgatgacggtgtggagcgtgaggatgtcgtctcaaagccaaaacctcgtactggaaaaggagctgcgaaagcggaagttatcgatttgtcagatgatgatgaagttcctgcaaagaagcctgctccagcgaagaaagctgctccgaagaagaaaaagagcgagttcagcgatctgtctggcggcgacagtgatgaagaagctgagaagaagccgtccaccagcaaaaagccgtctccaaagaaggctgctccgaagacggccgagcccaagtcgaaggcggtgaccgatttctttggtgcttcaaagaagaacggaaagaaggccgctggttccgatgatgaagacgacgaaagcttcgttgtggctccaagagagaagag

SEQ ID NO: 29285 - DNA, 637 bp, Caenorhabditis elegans
cccccgcgatccagaccatttcccgtttgtcctgctcggaaacaaggtggatttggagtcacagcgtgccgtttcgtcaaaacgtgctcaatcttggtgccagacgaagggaaatattccgtattacgaggtttctgccaaggaagctctcaacgttgaagccgcatttttggcaattgctcgtgatgcgttggctagagaatctcaggtaaaaatgcggcgaaattggattttcctgtgaaattaaaaaatgtgaaatttcgggcggaaattgatttttttgtaattaaaaactagttatatagtgaaaatagctttaaaatcgtgaaaaaagtacgcagaaatcaagaaaaactgccaaatttcggttgaaaatggcataacttagcgattttgaagctaaaaatcaaagaaattggttagaaaactggttttttcaaaaaatttgaaaaatctaaaactaaataaatatatcaaaaatatgctgcgttttatgtaaaaatttgaatttttccaacaaaaagcaaactaaaaattttaaatttttcaggaaaccaacgatttcccagagtttcccgaccaaatccgtctcaacccaaatcaacagaaccagcagaattcgggatgcaattgttaa

SEQ ID NO: 29286 - DNA, 377 bp, Caenorhabditis elegans
aaatggaccgggctaacttttgaaattgccgccgaggagatgcgtcggctcaagtccgagccaaccgatcgagagcggctgaaactctacgcattgtacaaacaggctctccatggggacattccaaatgaggatgtgtatcgtaagggtctcgaatggaaaataatccaaaatctaacattctatatttttcagcagttcccgccggtgacgaggtcggcaggaaaaaatatgccgcctggaaatcgcagaaaggcgcgaattcggagaaatgccgcgcggactacgtggcaatcgccgaggaaatgatcaaaaaatacgggcggaacattgtccgttgcaagtggaacagtgaagtttggtctgtggattattga

SEQ ID NO: 29287 - DNA, 1310 bp, Caenorhabditis elegans
atggtttacgtgaaatcactgctccgcagagccgacaattttatgtatattgtgaagaagagctcagaagcacgagcggctcttttggtggatttggtgaatgaggaggattataaagagcttgctgataaggaaaatgtgaatttttttaaatggaaaaattagaaagtaaattatctaatcgcgaattgcttcgaaaatttatttttttttaaatttggtaattttagtttaaaattgcccaattttgtagtaaaattacgtaaaaaattcaattttttcaattctaaaaataattttaacttgaaaaatgctgttaaactgctttatttaaaaaactgttttcttttgaaaaatttttatagtccttatttaatctcctgataccgaatataaatgtgaaaaaattccacaaaattccctgattttttattaatttttaaaattcgaaaatccattgatttgttaaattcaaacgacaaattttgactgattaccgtgccgcaggtgtggatttacgagattaatatttttaattaatttttatttaattttcataccaattttcccgatttttctcgttttctcgttgttttacattgaaatttttgtgatttccattaatttattactttattgataaaaataaataaaatttaaatgaaatatctgaaaatataatacttcatgtaattttatttgtttctatcaataaaaaattcatggagctcacaagaaatttcaatgtaaaataacgaaaaaatagaaaaatcgggaaaattggtatgaaaattaaataaaaatgaattaaaaatattaatctcgtaaatccacacacctgcggcacagttatcattcaaaatttgtagtttgaaattaacaaaccaatggattttcggatttttaaaaattaatataaaatcagggaaatttttttgaatatttttagatcgatattcggtatcaggagcatatatagggttaatagaatttttttttatttaaaaataaaataaaaatactttcaattaaaaaaaatttccaaaaaatgatttttttcccattattcactttccattttaaacagtttttattcgccataaaaattttgtcaataattaatttgttttctcctacagatcgatataacagcagtactaaccacccatcaccactatgatcattgtggtggaaatgaaggatttcgtcgtcaattcccgaatgtcatgattctcggtggagattcaaggattccggcaatggatcggcacgtgaagcatggtgatatggcagagttcgctgggcttcag

SEQ ID NO: 29288 - DNA, 2765 bp, Caenorhabditis elegans
actgtctaccacaactaccaacgaatcacaatgcaagaatccccgaacaaagttgccgctggacgtcttccccgttctaaagatgtgattcttctcggtgatctctgtgattcatgtaaacctggagacgagatcgaggtgaccggcgtctacacgaacaatttcgacggatcgctcaactataagcagggattcccagtgttcaatacgttgatccacgcgaatcatatcaccaataaagacaagatggcgtcggatcaactgaccgatgaggatatcaaggcgattcgtgagctctcccaggatccgaatatctcgcaacgagtgttctcatcgattgcaccgtccatctatggacatgacgatgttaagagagctattgcgttggcattgttcagaggagaagctaagaatccgggagccaagcatcgtcttagaggagatattaatgttcttctttgtggagatcctggaaccgcgaaatctcaattcctgagatatgctgctcacatcgcaccacgatccgttctcacgactggacaaggagcatcagctgtcggattaaccgcctacgtgcaacgtcatcctgtgacacgtgaatggacattggaagccggagccatggttctcgctgataagggtgtctgcctgatcgatgagttcgataagatgtccgatcaggatcgtacgtcgattcacgaagcaatggagcagcagtcgatttcgatttccaaggccggaattgttacatctctccacgcccgatgcacggtcatcgccgcttctaacccgatcggtggacgctacaacccgacgagaacctttgccgaaaacgtggatctcaccgagccgatcctttcccgcttcgatgttctctgtgtgattcgagattctgtcgactcggtcgaggatgaacgtctcgcgaagtttgtcgtcggcaatcatcggacacatcatccggatgcgaagaagattgttaaggagggcgatgagttggaggaagatcagatggatgaacgtactggtgtcaggctgattccacaggatttattgaggaaatatatcatctacgcacgtgagaagtgccatccgacgcttcctgaacagcattctgagaagttttcgaacattttcgcgcagatgagaaaggagagtatggccactggatctgttgccatcactgttcgacacgttgaatctatgattcgtttgtcggaagctcacgcgaaacttcatcttagatcgtacgttgttcccccggggaaattctaattttcgaaaaaaaagaggcaccacagttttaagatttgttcaaaaactagatccacgaaaagaagatccaacaaaacaagatctgcgaaaacaagatccaccaaaacaagacgcgtaacatcggagcatcgttgtttcgtttttcatcgagaaaaccggagttggcacggtgccagatactgaaaacgtggatcttgaaacgtagactacacccacaaaatggttgtgttcttgatgatcactttttgaactgaaaaaaatttttttaaaaatatagattcctattccagactgcgcttttgaaaattgaaaaaaattcagaaatttcacagaataccattttgtgggcggggcatgtgtaaccacgcccccttctttccaaaattttcaaaaaattatctcaaatccttgaaaaataatgaaacttttctaacaaaaaagtgaaatttttatattaaaaaaaaaatacaaaaaccgttttaaaaaatgggcggagcttcttagccacgcccacttaatggacttttttctaaaatgaggcaccacgttttcatgatctgttcaaaaacaagatctacattttcaagatctacgaaaagaagatctacgttttcaggatcctcgaaatcctgaaaacgtagatcttgttttggtggatcttgtttttgtagatcttcttttcgtagatcttgaaaatgtagatcttgttttcgtagatcttgtttttgaacagatcttgaaaacgtggtgcctcattttagaaaacggaaatttaaaaaatttgcagaaaaatccattaagtgggcagggcctaaaaaggtcccccctttttcaaatttgcagcgaatccttatcaatttcaagaatttcagatattttcgcatttgatctttaaaaaatatgccacgcccacaaaatggatttttctgcaattttttaaaattttcttttctgaactacaaagttagcgttatgtaaattaaatttcttttttctaaaaaaaaatcggaaaactattcaaattttctcttacaaaccgggccccttttcaagattctgaggtcagaaaaaagtaaaaatccttcaaaattatccaaaaaaaatcggaaatttcttgcagatacgtgaacgacgaagactgtgccgcagcgattcgtgtcatgttggaatcgtttgtgaacacccaaaaagcctcaatcatgcgtatgatgaagaagacattctctcgtcatttgacagagaatcgttcggctaacgagcttctcctcttcattctcaagcaactgatccgtcaacaaatgcactatgctacagctcgtgcggctgctggcaccattcttcaatcggtcacgattccagagtcggaattcatcgaaaaggctcagcaattgagaattgagaatgtcaagccgttctacacttcggaaatcttcgcttccaacaatttcctctatgatccatcgaagaagactattgttcaagagattttctaa

SEQ ID NO: 29289 - DNA, 1338 bp, Caenorhabditis elegans
ctgatcgctgagaagaccgtgcatgctctcgaggctggaattaaggtcgttttctgcattggggagaagctcgaggagcgtgaagccggacacaccaaggatgtaagggagcaaaatactggaaattatcgatttttcgcaagaaaatttgaaaattcaacattttcaaactttcagattttttttcttaattttttcgggtagaaaatcgatttcttctaatatttcagtagaaaaatcaagtttttgagattttttgaaaattccaaaatggttttgtttcgaatttgcacgtttttcgggaatttttcaaagtttcttcttaaaaaatccctgaattttatagttttgagctcaatttttcctcaaaaaaaacgcaatatttctctttctgcaacgaatattagaaataatcgcttcgagacccgatttttatgaattttcgtgaattttgaacagaaaacatttaattttatcattttccaaaaaagcggaaaattccaacaaaaaatggtcgccaaaaataattctttttttttttgccaaattttcaacaaaaaaattggttccggcaataaaaaagaaaaaactcctgaaatagtcgtttcgagacccgatttcttatgaattttcttgaattttgcagaaaagttcaaaaaaaaatctccgaagaaacatttttatttaaaaatcttcgaaaaatcgattaaattccctattccacgtggtaaaacaaaaaaagttcaaaaataatcgcttcgagacccgattttttaatgaattttcgtgaaatttatataaaaatacaaatttaaattcccaaaaacgcgaaaaattcaaaaaaaaaaaagaatcccgaagaatataaaattttcgaaaaatcgataaaatttgaaacaaaaaattcctgaaaaataatacccaattccttataaataaagattttttttaatgttgtagaaaaataaatttcaaaaatcgatcgcttcgagacccaaattttccaatttccaggtaaacttccgtcaacttcaagccatcgtcgacaagggtgtcagctgggagaacattgtgatcgcctacgaaccagtttgggccatcggaaccggaaagactgcttctggagaacaagcccaggaggttcatgaatggatccgtgcattcctcaaagagaaggtctcaccagctgtcgccgatgccacgagaatcatttatggaggatctgtgactgctgacaatgcggctgagcttggaaagaagccggatatcgatggattcttggtcggtggagcatcgttgaaacccgattttgtcaagattatcaacgccagatcttaa

SEQ ID NO: 29290 - DNA, 2645 bp, Caenorhabditis elegans
atgggcggccggagcaactcagccaccacagccgcccaacaaaatgcagtgctccgaatcgttgtcgtcggcggtggaggtgtcgggaaatcggcgttgaccatacagtttatacaggtttgttttatttttttatatttttaagttgaaaaaatatttttaaaatgtggaaatgggggtagaagtggtagaaagggataaaaaataaatccaaccagatttgacagcccataactttgttcatttttaagataaaaataaacttttaactacaaaattatagaaaattaaatgaataatactgctctagtgaaaatatttttgataactaatgaaagaactgagatatcaattgtcaaagttgagcaagctcggtgtagtagacaaaataaactcaaccaggttcggcacccatatctttgttaattttcaagataaaagtaaatctttagattcaaaattatagaaaattaaaaaattaatattttgttagttgaaaattttttaataaaacttaagagaactgagatatggcctggcaaacttaggggaaatcttgagtttcaaaaaaaaaattgttttttttttttttgaaaaatcgaaaagcagaattgctttttaatagattatttaaaatagtttaattttaattaaattcaaaactttttttaaagggtctttgattggaaaatctaaattttaaaaaaaagtctaaaaactaattttaaaaagttaaaattaaaaaaaaaatttttgaatttttggaagttgtctagaacttcaagtattatattttaggtattttccaaaactttgtaaattaaaatttttactttttttttgatggagtttgaatttatgggcatttttcatttctatacttaatcaatttgcgcataatttttttttcaaatttcccgggatcctcctccaaaaaatgttgttcccataatttatgttaacatttattgtggttttgttagtgtgatgaccttcacgtcttcttgtctctgaatccaattcacgattcaattcgaccacacacatacacacggccccaaacatacatacatacagagagagatacaaaagaaatagggggtacaaacaaaagatgattagggggtctctttaggctgacagagaaaaggtgtgtgcgcgaatggcagcagcagcagccaggcggtaacatgataatgagttaggtaggttaagaagtgacattgatttttataggtttacagacaactgggtggcattaggggtactgtagggggtactgtaggggtactgtagaggtactgtaggggtactgtagaggtactgtagtggtagatatttttttataatttttagagcaccaaaattactgaattcttagcacacgtcagatttttcgtataaaattcgaaataattcaattttatgttatttcactagaatttctggaacaaaaaagaataatttcggtcaaagtttttgttcaatttgtggcttgtgcagcaaattcggcaaattttccgcacacccacgctttcaacgttctttgataaacgagcaattagtgttgtcaatttacaagcccctagttttatggttcatgggctctgcgatatggtgcatcgagttattgggtaatatgttctactttgatcctctaatgttttcctgcgtctctcactatctccccaataacacgttcaccgctttcctcaataaaatcacaaagaacactgcatattgcaacagatcaggagagaggagaaaaaaatttcgttccgcataaaagggaatacgaaaaaaatttgtacgaaatgcagtcatgacttcacggaaggagtaagagagtgaaactacctgagtcattgaaaacggcgaacaatttttttttggggatcttactttttctatttttaggcctgtaatgatcattccacacctttaaatttagacggaaaaaagtgtgctctcaaattacacgttgtcctatctcgccctatagttcttctttctcttcccatctcgcgaccttttgtaagcttttgcctcttcgtcgctccgttttcttcccgaaaataatcctttttcaatgtttgtacgagggtgagcgcaaaggcgtgagtctcatgtgagtgtcttgtcgttcttgtcgaaaaaaggaggggaaaaaacttttgggagagagagagatggaaaacacagtactacttttgtgtttgtgtgtgtgtcccctttttcacacatgtgtatatactagtaccgttttctcgagcacacacacagagtcgagagggaggggagcagctcttgaagtttggtgggaacggctcgggaaatgggatattgggacttgaaaattcgaaatcagcggctttagaaacctcaatgggggtcgaacctgggaccttctgcttggaaaccagcaggcttaccgactgagctaggcgtcgtggctcagtcggtaagcggttgggctatgaagcaaaaggtcccgggttcggatccccggaagcttttagtttcaatgctttggaagattcaatgccctttgtttcagaggtactttgtgcaggactacgacccgacgatcgaagactcctacaccaaacaatgtttcgtcgacgaggatctttgcaaactggaaa

SEQ ID NO: 29291 - DNA, 1322 bp, Caenorhabditis elegans
gaaactccgatgtggttctctgcgccggatttgagcgcatggctccgggatcgctagaaaatttggctgctccaattgatgatcgggctctttctgtagacaaacacatttctgtcatgtcagagacttatgggctcgagccggctccgatgacggctcagatgtttggaaatgcagcgaaagagcatatggagaagtatggtaagtgattttgagcgaaaattcttgaattttttttttgacatgtgagcttttatttcaatttttctatttttaaaaccatctctaatttaatttcgtcgttttcatattaaaaaattgaatttggaaaaatcttcaaaaattaaaaactttttggaattattcaaatttttggtgttttcaaaactagttaaattttattttgagttttcaaaaattattaaattctcaatttttgaaactctcgaagcttcactttttcaacgaaaaaaactggaattttatttttagaaattgtgaattttttaatttaaaaatttatataaagtttaactatgaacaattcttgaaaaaacttttttttgaaaataaatattacattctccttttcaggttcaaaacgcgagcattacgccaaaatcgcctacaagaaccatcttcactcagtccacaatccaaaatcccagttcaccaaggaattctctctggatcaggtgatcaatgcccgtaagatctacgactttatgggtctcctcgagtgcagtccaacatccgacggagccgccgcagccgtcctggtctccgagaaatttttggagaagaatccaagactgaaagcccaggccgtggagattgtgggcctaaagctgggaaccgatgagccatccgtgttcgctgagaattcaaatatcaaaatgattggattcgatatgattcaaaagttggccaagcaactgtgggccgagacaaagcttactccaaatgatgtccaggtcattgagcttcacgattgctttgctccaaatgagctcattacctatgaagccatcgggctctgcccagtaggtcaaggacatcatatcgtagatcgaaatgataatacatatggcgggaaatgggtgatcaatccatccggaggcttgatctcgaagggacatcctatcggagcaaccggtgtggctcaagctgtcgagctgtccaaccagctacgtggcaaatgtggaaagagacaagtgccgaactgcaaagtcgccatgcaacataatattggaattggtggagctggagtagttgggctctatagattgggattccctggagctgcacagtccaagatttga

SEQ ID NO: 29292 - DNA, 827 bp, Caenorhabditis elegans
atgtccgagaagactcagtacgagcgagctattcttcagcttaataatgatccggttgttcataaagaggtatgggcttgtattgtcagttatggaaaaagaaagttgtggtttcaggtagcattgggtcgacggataggtttctatcggcttggcaaggagctgggcgccgggaatttctccaaagttaagctgggagtacatcagttgactaaaggttagttttacatttgcaataacactatgttcccacataacgttagtatatactattatccccattatgtcatatagctaggtatatagaatatactgaactatgccccgaccctataaactcacccacgtggagtcagaatgtcttatttcggtttgatcttcaaaaaatgcgggagaagaagcacagtcatctcatctggttttgcacggttaagagcgtgctgacgtcacaatttttctgaaaaaatatttccgcatttttgtagatcaaactgtaatgagacagcctaacaccacgtgcacatcctatcggctcccacaagttatgaaaaattccagaaaaagtagcggtcaaaataatggacaaggcgaaaatggacgccaaagcccaaaagcttctgagtcgagaaattcaggcaatggaggagatgaaccatccgaacattgtaaaactattcgaggttgtcgagaccctcacacgtgtccatttggtcatcgagtatgccagtggaggagagctctacacatatgtccacgagagggggaagcttaccgaaggagatgcaaaacccttgttcgcgcagattgtatcagcggtgtcacatatg

SEQ ID NO: 29293 - DNA, 200 bp, Caenorhabditis elegans
atgaagctgtctctagtctttcttttattcgtggcatttgccaaatctgcggatacagcacctgtggtgagttcaaagtcttcacaggatgctcttctaattgagttttccaggatttcaataaaatttttgtaactttcgtcgaagaactgatggacgcaataaaccagcttattcttgagcagatgggagcaattagg

SEQ ID NO: 29294 - DNA, 738 bp, Caenorhabditis elegans
atggactttgagtcgtcgtcggctggtccgagcacatcttacgcagaggagccatgcacattatcgatgcttcctcaagtttcagcagttttgtcggaaacatctattaccgaggtaacatttttttttctggtgtttaagttgtgtgtgtgtcgcagtaggagacttgtccttctctatttttttttggtagatttttttcggcaaaattttgacacctttttcgtcgcccactctttttctctccctcacgcttaatttctaattttcctccaagtgaaaaaagataagaatcttcttttcgaaaatctcgaccacttcatctattcaacatgtatgtacataattattgattttcaattttaaattttaaagtacaattttaaaatacaattttcaattttccagtcaaatgtgagctgtcaattacacccatctcgatcggctgctctgaacgataatgtccgaacactgatttataaccgtacggatcctcatattcaactcgacatgcgagccttctataactgtatggagtacgaggaggcgctacagcccaactatcactacttcaccggcgttcaggagaacatcacgccgtttcatcgagagcaggcgatcgattggatttacgacgtggcaaaggaggagaattgtgatggcgacgtcttcttgttggctgtttcgctgatcgataggtttatgtcggtgcagaatattttgaagcatgatattcag

SEQ ID NO: 29295 - DNA, 850 bp, Caenorhabditis elegans
gctatctacttgattgctcaaaacgggaagccagagatcaagcaacgcgacagactgtcttcagagttcaacaatttccttgacaagtgtcttgttgttgatccggatcagaggtttgtttgtgaaaattacgtattttattttaaaaatatagcatctaaaacaacggtgccggtttttcgacttttttttaatatccaaaaaatttaaaaatttaaacatttctcgattatttgacaaaatttattattatttttttcgtcaaaaccaaaatggtttttgatagatttatgttttttgagaataaatttttctcgatttttctattttcagagaaaaaaaaacgaaaattccgatttttccaccgaagaaacctaaaaaatgaaaaaaaaaaacaaatgaaccattttcgaaatccttaattcggaagtcaaaaaataattttcaatatgtttcgattttttaaaaaattttcttcttttttccatcaacgtcgatatacttttgataagtttatgtttttttaaaaaataaattaaaaaactttaaatttccgtttttccactgaaaaatcttgaaaaaaaaatcttaagttgaaaaaagtcaatattcattttttaaaaatcttttttaaaaaaatcttcgaatttctctgaaaaataaccaaaacttaaaacaaaaaacatcgaaatgtttctttctaattttgaaaaagtccttcaagacactttttctaattaactcaattttcagagccgatacaacggagctcttggcacatccattcctgaaaaaggcgaagccactctcaagcctgattccatacatcagagccgtccgagaaaagtag

SEQ ID NO: 29296 - DNA, 388 bp, Caenorhabditis elegans
gaatcagctacatgtttggcaaaggagtcgtcgagcaagcgtgtaaatcgctggagattgatctgatcattcgtggccatcaagtcgtccaagatggatacgaaatgatggctggacgccgtctgatcaccgtcttctcggtgccaaactactgtgcccagttcaccaacgccgccgcagtggtttgcctgaacgccaacttgcaggtaatcttaaatgactcgaagtctaataaaacctttaatttcaggtctcgttccaacagctgatcccaccaccacttccggatggcaccaaggccaaggcagctccagcgattgcaatcgacacgaatattgaggcggctcgtgctgacaaagaagccatcaaaccatatgtcaaggaatag

SEQ ID NO: 29297 - DNA, 291 bp, Caenorhabditis elegans
ctgccgtgtagcagctattccatgtatctatcacttgccaatttttttctttttccactgcaactttttcctcacgagggacgaggaaaagtggtttctaggccatggccgaagggccgacaagtttcagcggccatttatcttgctttgttgttttccgcctgttttcttttgtttttcacagctttttcccgttttttcttattaaaactgataaataaatactttttgcagatgctaaaacgatttccaagtaaaaaaattatgtattcagtgggcaagcagcggtga

SEQ ID NO: 29298 - DNA, 910 bp, Caenorhabditis elegans
atggccggcccgggctccggcaacatcgtacacaccttattactggtgagtttttatggtttttttgggttaaaaattgttagtacagtggttcttaaaaaaggttatgcgcctttaaatatatttatgtatgttgacaaattatttattttaaaaaatttaaaaattgtacagcctgcaccttttgttattcactttctgaacctgcctgtaacttcaaatttttattcgatttttatagttactttgtgcttaactttccgttttacaaattttgatagaccaataaaacaaagtgataagtgatataacaaagggggaataggttctagtttgtgattccagtttttaggcttcataacttcccggaggtgagagctatataaatattttaacaagcgaaatgttcttcataaaatttacaatattattgcagttgaaattttttgatagctatacgctccgcagagatgcgagcttgtgaaaagttaggaaaaagtgtatggggataggagagacgcagagagcgagcgcgtctgcgtctcctctcaccccattgtatttcttctcctcctccttccaactttaaacgcgcataactccacggggaagagagctatcaaaaagttgccaacagacgaaatgcttaaaattttataggcaacattttgctaattgactatttttcctcaactctattggtttcaaagatacccttttttcttccaggtagcaggaattgtcctgaccgctggtgtcctcggagtagtcatcgcaatccttgtaaatgagaacaacaccaacaccaacaccaacacaatctacaatggcaccaatacctacaactcgacaatccaatataactctacatatgtctacaatagtaccatcatcgaaatcgatatcgcct

SEQ ID NO: 29299 - DNA, 2641 bp, Caenorhabditis elegans
tttctggagtcaaggcgtcggctcggaatcggacatgcgattcgtattctgtgcagtagccatcagccatattctcgacggagacaaagagcaaacaatcgactggaccaagctcgccggctttctgcgtcaaagcctaaacatcgacggaggaatcggccaggctccgggagacgagagccacggaggctctacattctgtgcaattgcctcgttggctctgtcgaacaggctttggactgaagaagtgctcacgcgacgggatatcgatcggcttattcgatgggctattcaaaaacaggatatcggatttcacggaagggcccataagcctgatgatagttgctatgcattctggattggggccacgttgaaaatcctgaatgcttatcatttggtatcgaagcagcatcttcgagaatttctaatgatttgtcagcatccacatattgggggtttttgcaaatatccagagcccgggggctattcaggtacagacgaaattccgggaaattttagaagaaacagcaaaaaaattctgaaaattgcagaaaaaatctttaaaaaatgcaaaaaaactgaattttttcagagcctaggtacattgaacttcggccgaaaaataggaaaaattgcagaaattactcggaaaaagtcgttaaaacttgtttttttgtatgttttgaatgtttttttagttattacacattcgtaaaattttttagggtgaaaaattaccacgaatgtgtaatacacaaaatttctgatggctttttcaacggaaatagcttgaaacgcgaaaaaatttgaacatttcctagaaaaacagcaaaaaacttttaaaaaaactggaaaaaaaaactgaaaatttcaaagaaaaaatcgaaaaaattctaaaagtttcaaaaaatacatcttaaaaaatgcaaaaaaaaccagactttttttaaaagcctaggtacattgatatttctgccgaaaaataggaaattttagactttactgggaaaaagtcgttaaaatgtgactattttttttttggaatttgtagagttttttttagttatgacacattcgtggaatattttagaaacaaagttttccacgaatgtgtaataacgaaattctgatggttttttctcaggaaatggcttgaaacattgaaaaaaaccccattttttgttattacacattcgcggaattttctagggagaaaatttccacgaatgtgtaataacgaaattctgatggttttttctcaggaaatggcttgaaaaattgcaacccaaaaaaaaaacgcttattttgttattacacattcgtgagatattttagagaaaaaattcttacgaatgtgtaataagaaaattctaatggctattttcttcggaaatagcttgaaaaattgcaaaaaacacgtctttttgttattatacattcgtaaaattctgaagagaggaaatttccacgaaagtgtaataaaaaatttctactatttttttttctccgaaacacgcttgaaacattgaaaaaaaacaccctaattttttgttattacacattcgtggagtttttgacggagaaaatttccacgaatgtgtaataaaaaaattctaatggctattttcttcggaaatagcttgaaaaattgcaaaaaaaacttatttttgttattacacattcgtggaaatttttgcgggagaaaatttccacgaatgtgttataacgaaattctaatggctattttctccgaaagagcttcaaaattgcagaaaaatcaatcatttttgttattacacatttgtggaattttttagggagaaaatttccacgaatgtgtaataacaaaattctgatggctttttctccgaaagagcttcaaaattacaaaaaatgcaattttgagcaccgaaaagcttttaaattttagattttcaaataatttttctttcgaattttcggagtattttaaatatttttccgtcttcggaattttttccgatgattccataatttttacgattttttaaaaaataatttaaaatttcagaatatgtcaatatttctagaaaaacaaaatcgatttttgaaactttttgacttttggggtccgcaaaaagaccggctagtttttattacaaattctttcaaaaaaaaaaaaaagaaatatttcacaaaaattcacaaaacaagtgttttttgtttgttatcacacattcgtggaaattttcttcctaaaaaatttcacaaacgtgtaataacaacatttttttgttgttgcaattttcaagctattcccggagaaaaaccattagaatttttttattacacattcgtggaagttttctccctaaacatttccacgaatgtgtaataacaaaaaatgagtgatttttttgcaatttttccagctattatttcagaagaaaatacttgtgaaaaattgcaagtttaaaaaatttcaaagaaaatgtcaattctcaacccgtaaacaaccacattttttgcagatattctccacacgtacttctccatcgccgcactctcactgctcggcgagcccgccgtcaatccagttcatccatcgctcaacgtgtcgatgcgagtagccgaacgtattgccagacttcaatttgattaa

SEQ ID NO: 29300 - DNA, 564 bp, Caenorhabditis elegans
ctcttcgccctatccggcaccaaatacgaggatatccgcattgagcatgcagactggccagctcaaaaacccaaaatgccctttggccaaatgcccgtgctcgagctcagttcgggactccaaatcccacaatccatggcgatcgccaggtacctcgccaaaaaattcggctatgccggaaaaaccgacgaggaggcagcgctcgccgacgccctcatcgatcagttcaaggatttctacgcggagatcaagccatactattacgcgaaaatcggcgttcttcagaatgacaccgaagaggagaagaagaagacgctgattccagctagagacaagttcctgacgattatcgggaagttcctgaagcttagcatctccggattcttgttctccggcggacttacctatgctgatttgatgatttgtgataatatgagaaccctaatcgcgtggtggccggaatacttgaacgagtacccagacatcaaggcctggtaccagaaagtcgatggaatcccggagattcgcaagcatcttgaatcgagcccggataagggattctaa

SEQ ID NO: 29301 - DNA, 60 bp, Caenorhabditis elegans
atggccgagtacaagttctattattttaacggacgaggattgggagatgtttctagacag

SEQ ID NO: 29302 - DNA, 815 bp, Caenorhabditis elegans
atgccacaatacaagctctactatttcaaccttcgtggatgggctgagccggctcggcagctcttcaagctggctcacgtcgagtttgaggatgttcgtattgagaatggaactccagagtggggagcgttgaagccaagtgagtttttgaaacatttttagtggtatttgtataactgtcacggattttgagaattttttaaaaatcagatacggtggtccactctaagcctaagcctatgcctcggcctatgactatacctaagcctaagcgaaagcctaaacctaagcctaagtctgaatcccaacccaggaatcttccagaaaccccatttggtcagctcccattcctctcagtcgatggcttcgaaatcccccaatccgctgcaattctccgctaccttgccaaaaaattcggctacgctggaaaaacatcagaggaagaagcgtgggtggatgcaatcgtagatcaattcaaagacttcgtcaccccactacgccaactcatcatggctcaaagatccggaaatgcggaggaaatcgagcgaatccaaaaggaggtcttcgcgccggcccgggatacattcttcaaaattcttaatggaattcttgagaagagcaagtcaggattcctagtcggagatggtgtaacttgggctgatctggtgatagctgatattttgacaactatggagatgctgggagtgtttgataagcacggagaggagcagaagcttgcagcgctccgtgagaaggttaatgagataccggagatcaaggagcacaactcgtcgagaccagattctgttgtttga

SEQ ID NO: 29303 - DNA, 1149 bp, Caenorhabditis elegans
atgccttcctacaagttgacctactttgccgttcgtggactcgctgagcccgccagacttttatttcatcttgccggagttccgtttgaggatgaacgactgacttttggagatggaagctgggagaagctgaaggacagtgagttttggcttagtggaacggtagtgcggcaaacatcaaaatttgccgagctctgccaattcggcaaatttggcaaatttgccgtgctgagcaaaattcgaaaaattagaaattttctgatatttctagtagcaccaaaagtactgaattctttgcacaattttgatttttgaatagcgtccgtgtggtcggcctacccggcatttggccttagcttcttgcccaattttggcccaaaaaatattaacttggatcagaagttgtctaaatttgggcaaaacttggattcaggtgggccaaaaatttgggccaaaatgggtcgcccgaaaccgtttaggcaacttctgattctgaagttaattttttgggccaaattccaagtacataaaatttgaattacctcaattttatgatactttactataattttttaaacaacaaaatcaataatttcggtcaaatttttcaaatccttctgtgttgggagcggcgaatttcaaaaagtagtattttcagaaaccccaatgggtcaaatgcctgtcctaaacgtcgacggatttgaaatcccccaatctgctgccatcactcgctaccttgctagaaaattcgggttcgctggaaaaactcctgaagaagaagcttgggtggacgccgtcgtcgatcaattcaaggatttttttggagaattcagaaaactaattattgctcagcgagccggaaaatcagtggaagaaattgaaaagctcaccaaggaagttatcaatccagctgtaagctcgttcttcaaaattctcaatggccttctggaaaagagcaagtcaggatatctcatcggggattcgatcacctttgcggatcttttcatcgctgaagatatgcaatcccttaaaaactttggattcctgaatgctacggagcaaccaaaaattgcagctcatctcgaaaaagtgtactcccatccgaagctgaagagttatatcgcaagtcgtccagttaccgagatctaa

SEQ ID NO: 29304 - DNA, 167 bp, Caenorhabditis elegans
gcgaagaagacaatgtgaactctccgtcggctcgtctcgtaatgggagcccttccgcgtggcggtaccggatcgttcgacttgctgctcgacacgaaaatgcaatccgaacgggaggagcacgaggcggcgagggctcgaaagcggaacgccaagcagaagttttaa

SEQ ID NO: 29305 - DNA, 5675 bp, Caenorhabditis elegans
agaagtcgaactattcatcgtccatcaaactccgggaatcgagcgatgcgtcgagacgactgagcagaaaaacggaaaagaaatgacaattctgcagacgcaaggagtcaatttggctgcattcttcaagcacgcagacgtgctcgacgtcaattcggtctattcgaacgatctgaacttgattctcgagaattatggagttgaagcttgctctaaggctatcactactgtaagggagttttttttttttttttggagaagtttgagcaaaattgggtgaaaattggcatttttgagttaaaaaatcgccaaaaatcgccaatttcctatagaagttggtcaaattcgtctgaaaacatcacttttttactaggaaattgttaaaatccgactgaaatagcacatattctagcaaaagcctggtaaagctggaatttcagaaatttaaaagaaaattctaagtttaagcccaaaaaatctttttaaaaaaaccgaattcgtctgaaaatgccaattttatcaagaaaattttatagcacaaagtctaggaaaagctggaattctccacaagagttttgaaaatttttagtgaaaattccaatatgcctaaaagaagcctaaaaaatgtcgaattttgaaaaaaattcaccgttcatcactgacttggattattcttccgcggaaaatttgaaaatttaagcaaaatggagtggaaattgacatttttgattaaaaaacgtaaaaatttaccgtaaaaaccgtcagtttccggtaaaagttgacctaattcggcaatttgccgttttgccggaatatctcaattccggcaatttgctgatttgctggaaattttcattttaggcaaatttgccgatttgccggaaattttaattttaggcaaatttgctgatttgccggtaattttaattttaggcaaatttgctgatttgccggaaattttaattttaggcaattttgctgatttgccggaattttcattttaggcaaatttgccgatttgctggaaattttaattttaggcaaatttgccgatttgccggaattttcaattccggcaatttgctgattttgccgttgccctggtttgagattctagttgttctgctattattgctcatctctgactcggatgaactagattacggtgccagcttctccgacgacttcctctccgatacatcaaagacaccgtacaccaggtacacttatcacaaaaagtgtgtcttattcttcttctgaacctattcttcactttgttaattgttggttataaccacacacaattaacacactctcccacggcatgtcacatggcggcaatctccgagaacagaggaggagaaagatttatggttgctatcgccttttttgataacaaccatcatcaccaccgtaataaagacggcgcgtcttctccccgacacgtgtgtgaacgatgatggttctattaatagacaatttcaactgcaccgatgctttgaggatcggcggcaaatcgacaagaaacacagaaaatcagacttctcggcacttttgcaaaaggatctttccgcggcaactctagagaaaagctaggatcagccaaggatcggctataaagaaactcggcttatttgatcagtagatccatagatccacacggcgattcacttgaaagtgttctttcgaatcagtccacagctcgacgaacttcggtaatgatctgccaagtttagtttggcaatttctcaatttggccgccaaataactgttttgccgttccgttccaaggtccatttcgacattttggcaatcttctgaagtctgacgatttaccaattccaattcagcaaactatcttcatttaacgattacttcctcaaattcgaaattgccagtttccaatttcagcttgaaattgtactgaaattggcgaactctagtctaactaagtacctctaatttaggttcctactagaattagcggattttgaaattcggaatttcttaaatcgaaatttgaattctctagacgcgatcacaaaaaaatgtgctacatcccgtgattctgtcttcttcaccacgcgaattaatatcttgaagttccaaaaaagaaacattttttgtcgataaattcggcaaattgccggcttgccggaaatttccaattccggcaatttgccgatttggcggaaaatttaattttcagcaattttccgattttccggaaatttcaattcctgcaatttgccgatttgccgaaagttttaattccggcaattttccgatttgccgaaaaatcgttcgccgcctacccttggctccaattatcttccaatttcaaccttggtgcccttctgacctcggcacctcgtcaattcttgaccgacattcggcactcttagcgtactgcagcagtacgacgtgccgccgtcacaatgataccgtccgatttgttcgtttcgccactgtcataaatctttttttcgctattaatagagtgaaagggagaaaaggacatctcatgtgaacgacacgtgtgtagaatatgaaagtttttgatgaagatttgaaggaatatttattcttttttttttttggcttggcttggctgtattcctatgaaacaagagttttactctctctgacgtagttggtcttttaaggaaggcgataactgctgcagcagcaggcgaagaaaacgacgatgatgatcgtaattgcggaagctttccgaattgtcagcaataaacttcgaactattgtcgtaagcatcgcagccgtcgttttctctttaatgttttctcgaatgatgagactagagaaatttgattgtgtacagtcctaatttgggcaacacaagctgctgctgctgatgctgcttctgcaagtcgaggtcaaaagaggcttttgcgcagacagaattgtgtcatgtggcttgaaaagaagaaaagtattgccccatgaagcttgtcgaatctgaaaatgaaggaaaacctggacattgaagctcaggttgtcctgaaagacttttcaaggcaaaaagcacaagctctccgccaggggtgtgcggcaaatctctaaatttgccgagatcgggaaattaggcgattttggcaaatttgccgtgcttaactgactccaaaaaatgttactactttgtgatgttttacggcaattggcaatttcgtctcttgccggttttgtgaatttcctgcaatcggcaatttcggcacttgccgtttttggaaatttccggcaatgtgcaattgcggcacttgccggttttgtgaatttcctgcaatcggcaatttcggcacttgccggtttttgcacaatgagtcatattgcatgattgttgtcccgaaatgttgaatttaatgtcaatattttcaaatttcgacatatagagaaaagtcccccgcagtcctccaactcctccaaaatgtaaataaaaacgtagcctgattcatttgtgtggagaggggtacggtagcaggcaggcacctacccacaccgatctttagtgcgtccttcctctctgaagactggacttcctcacaatagagagtgagagagagagagaaagaggtccgaaattgcattccattcgtctctatctctctgccttctctgcctggttgatggtacctgttagtgattcgcgacgatcggagagatagacacaaccacactcgaatggtgttcacagctgaaactgtacggtttccagtggagacgcagatggttggaagcatcggaaggcggtcgaatcgtcgtcgcaccagcatcgtcttcttcatcttcgtctactagtgtcgtcgtgtcgtgttgtcgtgattaagtgtgtgtgtgtgtgttcgcctctttctgatcttgcgacgtcaccgcaccgcgttcttctgatgtctttgactattcaattctctgatgagatgccccccgatgctctcagttcttctctctttcatcgattattgactatttggatgatatgaagatgattgagagagtatgaagaggagaggtgattggggaacttttcctcctcctcctcctcctcctcctactataaaatggtgagaattatttattgaaccattctatacacattatacatcccaattgttcgtgctgacacaagagattcacgtgctaacagcacactggaaatagaaacaagtccagttgaattgaggacgacacaaaggaacgggaaattcgagttttttttctcagaaaaattttggtttgattgatgaagcaagtctattttccaagaaaaaagttggaaccaggaaatgattctctgaaagttctcacaggcccaaataggccctgaatatggcccaaattcagacgtagattctgatttgaagccgagaaatataattgaagccgagaaatatatttattaataattcaaatttccgagcttttttctagcaattttatgagaagctcctgaaaatggcttaaacaaaacggtaacagtaaatgcgaactgggcactcatgggcttgacaacgtgaagcttttactccaattcactaaatttggcgagaaattgcccaattttagacattgaatctgacttaaagcccggaaaactgaatttccgagatttgtacaccatgaggaagcgcctgaaaacggcctgaaacgtagttttctcggaaattctcacatcgatcgacaaatttgaccagcaaaacctcaaatacatatgatgttcctacttgaaatcggtgaaattcgggggaagactgaatttccaagcttttttctggtagaaaagggcctgaaaaggtctgaaaagggctcaagctcccaattttgagagtggaaaagctattcggttttcgaattttcgcattctcagtaatagaatgtgaggaaaattgtgttcaccgaatccggcaaatcttttgccgatttgccggaaattttcaactccggcacatttgccggtttgctggaaattttctgaaaattgccgatttgtcggaaattttcaattccggctaattgccgatttgccggaaatttcgtttccggcaatttgccgaattgccggaaattttaattttctgcaaattgccgatttgccggaaattttaattttctgaaaattgccgatttgccggaagttttcagtttaggaaaattgccgatttgccggaaattatcaatttcggaaaaattgccggttggctgaattgccggaaattttcaattcttgccgatttgctagaaattttcaattccggcattttgccggtggggccgatttgccggaaaaaatcgcttaccgcccacgcctgattcaagctaaagatttggaaaaaacatgaaaatttgataaaactttttaaaaaataagattaaatttaaatttttatgaatctagttgaaaaattcggaaaaaaatttaaaaaattaatttccaacacacaactaatcacatatatattttttgcaggaaatgaacaacgtgttcgccgtctacggtatcgaggtctcgaagcgacatctctctctaactgccgactacatgacattcaccggacaaatccaaccattcaaccgcggagccatgtcgtcgagctcatcacccctccaaaaaatgacgttcgaaacgacgatggccttcttgcgagaggcgctcttgcatg

SEQ ID NO: 29306 - DNA, 654 bp, Caenorhabditis elegans
atgacctaccgagcaatgatatataattgtctagaacgcccgactggctggaagtgctttttgtatcattttagtgtattcttgattgttctgatatgtcttatattatcagttttatcaactgtcgaggagcatagtcattttgccgctgagctactttacatcttggtgagtttgaattttttgaaattttactttttttttgcaatttccgataagtttaaaatttttaaaacttaaaaaaaaaatttaaaaaaaacgaaaaaaaccccacaccaacaaacgcgccccacagtactacctacaaggcgcggttttaggacctgacgcctgcctgaaacctgtccgcctgacgcctgcctttcgcctactttctacaactttaaagtgaaatttcaaatttcaagttttatcatttccatcaattttttaaaaaaacattgatgtgaggcgagaggcaggtcgccttaaggtcaggcaggcaggcatttggaagcccttagaatacacttttatttttcaggaaatagtgcttgtagtctttttctccgtcgaatttatcgtccgactatggtccgccgggtgccgatctaaatacattggtgtctacggccgcctgaagtttgtgaggaagccgataacgctgattggtag

SEQ ID NO: 29307 - DNA, 2195 bp, Caenorhabditis elegans
atgtctacctaccaagcggcgacaattgtggcggctcccaacgagtttcgcgtcccgtttcccccatttgtacaaatttccaaagttcagttccaaagagaagccggctcacgtttgctggccgcttccggctgggatggcacttgtcgcgtctatgaagtcggaaagttgggagatatctcggaaaaactcgtttttacacacggaaaaccacttttgacgtgcacttttgcggtaggggtttcaggtttttaggtttttattaaaaattgctttaaaacatgcccatggggtcacaatgaccgaatatcatgataaaaaaattcaaaaaagttttctagattttatatgatttttagaaaattgaaaaaatctcagttttccccgctaattcctatttaaatttccgccaattggatttgttcgatggagcgtgctttcaattggcggagattcaaacactgccaaactttttcctcccgagggacgaggcaatgcgatttctaggccatggccgaggatccgacaagttttagcgtcaatttatcttgctttgttgttttcgcgtggttttttttttgtttttcaccgattttttgtcccgttttttcttattaaaactgagaaataaatattttttgcatttgcagatgctaaaacaatttccaaatgaaaaaattgtgtattcagtcggaaagtagcggtgaaagtgggcaatgtaatatgatcgattactggaatactaaacctaaactttttctgaaacatgataaatatgctgcttagatgctgaaactacctgattttcagaacgagaccgctgaaaaagttttgaggttttcaaaattcaacttttttggtgaaaaagtcgagatttttgcacaaaaagttgaattatgaaaacctcaaaactttttcagcggtctcgttatgaaaatcaggtagtttcagcatctaagcagtatatgtatcatgtttcagaaaaagtttaggtttagtattccagtaatcgatcatattacattgcccactttcaccacatcttgccgactgaatgcaaaattttttcacttgtaaattgttttagcatctgcaaaaaaatatttatttctcctcagttttaataagaaaaaacgggaaaaatcggtgaaaaacaacaaaaaaaaccacgcggaaaacaattaagcaagataaattgacgctaaaacttgtcggatcctcctcggccatggcctagaaaccgcattgcctcgtccctcgggaggaaaaagtttggcagtgtttgaatctccgccaattgaaagcacgctccatcgaacaaatccaattggcggaaatttaaataggaattagggggggggggggggaaactgactatgagatttttgcaattttcaaaaaaaaatcatataaaatttagaaaaatttattgatttttttaatcatgatattcggtcatcgtgaccccataggcgtgttttaaagcaatttcccctgattttaattaccaaaaaaaaaattacacaaattatttttttataaaaacaaaaattccagggttacaacaaagtagcgttcggaggagtcgatcacaacgtaaagcttgccgatatcgaaacaggcaacggaacccaactgggatcgcacgcgctggccgtccgatgcatggaattcaacccaatgtcgagcctcatcgtgtccggtggctgggattcgtcggtaaagctgtgggacgcgagaagctacggaaacggcgccatcgagtcggtcaacgtgtcgagcagtgtctacgcgatggatgttctgaagcatacgatcctagtcggcacgaaagatcgcaaaatcttcatgtatgatagtcggaagctccgcgagccgcttcaagtccgtgatagtccgttgaaatatcagacacgggcggtgcagttctttccgactggcgaagcgtttgtggtgtcgtcgatcgagggaagagtcgctgtagagtatgtagatcagagtggagaggagatgatgaagagaaagtatgcgttcaaatgtcatcgagagaaggatactgatggaactgagctgattcatccagttcataccgtcgcatttcatccgaaatatggaacttttgcgacaggaggcgccgatggaattgtcaatatttgggatcctttcaatcggaagcgtattattcagcttcataa

SEQ ID NO: 29308 - DNA, 1476 bp, Caenorhabditis elegans
atggctttccaaccagaccaacacgaattagagcaggtgagcgtcgttaaaaaatcgattatttcgcaaaatccgagttttcaggtaattcaactcttacaacacgctcactccacagacagagatgttcaacgtaatgttcaagtgcaattggtacagctcaatgagcatcagaagttctgttgttatctggtttacatactgagcgacatgaaggagatgattgacgcgacgagtcgatcgctggccggcttgttgcttaaaaataatattcgagcaaaatggaataagtatccgcaggacgtgaagtttttcgtcaggacaacatgtttgaaaagtataggcgatcaagagccactgattcgtgcgacagtaggtatcattgtcacgactatcgttatggaggagaatatgtgcgattggccggaccttctagacactctggccacagttctgatgcaacccgacgagctgatgcaagaaggcgctcttggagcacttcagaaggttttcgaagactcggcggatcggtatgagtcggaatttcttcggccaatcatgccgaagcttcttgttttctatgagcatcatgctgcgaagatgcgggctcttgcaatgaattgtgtgaattgcattctaatggttaataatgatccaattgattttgcaatagatcaatttcttacttcgcttttcgctcgccacaatgacaatgatgaggaggtgcaaaaacagttatgtagatcgctgacgcttctgctggacacacacatcgagaaaatgatgcctcatttgccgaatgtcatagaatatattattaagaagactcaagatcacaacgagtcgattgccttagaggcctgcgagttttggctttcaattgctgagaatagtgatatttgccgaacaatggtgcttccacatctcgataagctcataccagttctgcttggctccatgcgatattctgagacagatcctgcgttgaaagctaatgatgaagatagttcggttcctgatagagaggaggatatcaagcctaggtttcataagtcgaagcagcatggtcttggtggccttgtggagtcggatgatgaggaagacgaggacgatgatgacgatggtggtggcgactggaatatcagaaggtgttcagcagcatctttagatgttctggcttctatttttggaaaggatctgttggataagctcttccccctcctcaaggacacattgatgaatgacaactggctggtcaaagagtctggaatacttgcgctcggggcaatcgcggagggatgcatggacggcgttgtgccacaccttggcgagctcataccattcatgctggctatgatgtttgacaagaagccactcgttcgatcgatcacgtgctggacgctgtccagatatagttcgcatattgcatccgacgagaacttcaggcaacagtttttcaaggatgtgctcgccaat

SEQ ID NO: 29309 - DNA, 429 bp, Caenorhabditis elegans
atggattgcttctcattctctgaacctgttctcggagcccattcaccgtcatctcgacttctttttgcaaaagacgtggcgaggctccggcccctttcagtggacttattcaagcgagtcaaaaatagtcctccactaggaatggatgagttgagaacggagttggtgaacatggccaatgtgagcaattttatgcttaacataatatattagtaaattttccaggatgtgtccacgtgcaaaggatcttccctagcgctctccgaacttctgtcctgggttcgaggaaacggaattcgcatttcccaactgttatcctcaaatgagcagttcagccaacaacgtttgcctcaaaaactctcacaagttctccatgtttgcttggagactgacaatcatatttattcgacaatttctgattatgaataa

SEQ ID NO: 29310 - DNA, 350 bp, Caenorhabditis elegans
atggaatgcaacgactcgagattattcgatacaaacaacaatttgacatattttgtgatagagcaattttatcgatttagatagtaagttaaattattttttttttttgttggaaccaaaccaaaaaatcttgatggtttaatgatttttggaatacttactaatttaaaatttttagcctatactctaacgttcatcctttcttgtcattcatcctatgtgttcttggattagctgccaatgccatacacatcactgtcctcacaagaccacgaatgcgccactcatctgttcataccgttttagtgtgcattgcaatttctgatatgggaacaatgacctcctatttg

SEQ ID NO: 29311 - DNA, 175 bp, Caenorhabditis elegans
aatttcctattccggaatctccacccgtcaaggaaccttgaaatctcatcaacaccctggagcaaaaacgttggtgcagcgagccaactcagttgaggtggcttctgctcgatcaccgctggtcgacaaagcagcaataacacggccgaattccgcacagcccacagatttttaa

SEQ ID NO: 29312 - DNA, 1900 bp, Caenorhabditis elegans
actctctccgacagttttcctcaattcgaaaagttcaaacaacaggatgccaacgaatgtctcgtatcgatcatgagcaacgtcacgagaatttatggattgtccgggtggaatattgaatcacttttccgaatccagacagagaccacgatgaagtgtctggaaagtgacgaagtttctgagaaaaaagtggagcggaacaatcagttgacttgctatgtgaatcaagacgttcgatttttgcaaactggaattaaagctggatttgaagaggaaatgacgagaaatagtgaagaacttaatagagatgcgaaatggcagaaaaatactcaaatctcgcgtcttccaaaatacctcactgtgaatatcaatcgattcttctacaaggaaagcaccaagaccaacgcgaaaattctgaaatccgtccaattccccatgcaattagacacctatgacttgtgcagtcaggaactcaaggataaacttgttgctcgacgagctgatatcaaattggaggaggatgcgaagctggagcgagagctgaggaagaaggtgttggacaaagagcaaggcgataagattttcgatgatggagttgctctgcctaccgctttcgaagatgatgcaggatcgaacaactctggattttatgatctcaaggtagacagcgtgaagcttgaatattaaaaaaaacacttcaatttgaacaaaatctggaaaaaaattatgaaaaattgataaaaattctgattattataaaatttaagtattttttttaaatataggtatttaatttttctaaatagtttttcatcaaaatacaataagaaatcgttaaaaatcccgctacaattttttttgtcggcaaattcgtcaaataggcaaatcgccgatttgccgttcgccggatatacctgaaatgcctgaaagatttgtttgaaatgtttatacggatttttttatgagtcggaaacaggggtgtgcggataaccgattttttcggctaacggataaatcggcttatgccgattttgtgagaattggctaacggctaatttcaaaattttcggctaacggctaattcggctaatctcagtcattcaaatcggctaattttcggataattcggaaaatattcatttggttaagttttttttgtccattctgttaattcaagttttgggttaattttttcactgttattgagcaaattcagggataaacgactgttcaaataggataaaatcatacaaattcaccacattttgttttccaaaaaaatatgttagttgaattagccgaaatagccgatcggcgaattcggctaaatcggctattatccgcacacccctggtcggaaacaaactgtgcctttttgaaaaattaccgttttctctagatattttcatagaatttgcttactttcaaaataaacgtagggacattcataggatacgtacaattctgcaaatttgaattgaattactgaaatttccaaaaaaattggtgcaaaacctcaatttgccggtttgccggataaaaatcgtttgccgctgacccctgatttatacctaaaaatataaagtaaaaaatgttattaaaatcatgtttccagggaatcatcacccacaaaggccgatcctctcaagatggtcactacgtcgcctggatgcgatcatctgaagacggcaagtggcgtctttttgacgatgagcatgtcactgttgtcgacgaggaagccattctgaaaacgtctggaggtggtgattggcacagtgcctacgttcttctctacgaggcccgtgtcatcaagcaattccctgaacttccaccagcaccagtaccgactgaagttgccgctgatactgctgagccaatggaagtatcggagaagcaataa

SEQ ID NO: 29313 - DNA, 108 bp, Caenorhabditis elegans
atgcctattgtcaatgttaaatggcaaaaggagaaatatgttgtggaagtcgacacctcagcacctccgatggtgttcaaagcgcaacttttcgctttaacacaggtg

SEQ ID NO: 29314 - DNA, 239 bp, Caenorhabditis elegans
atgctgaaaaggcctggtgaatatgagcctccgttaggcaaaatttggacaaggttggtcaagtttttctctaaaaattgtaaaaataattttttaaaacaatttttttcagagcggaatctcgaatgtggacgatcacaatgttcagcggcacgtgtgttttatacgcgtctcgcgcaagtttaccgattagtgctgcagctgtagcgaaggagtttgcatggaataaaacggattcg

SEQ ID NO: 29315 - DNA, 360 bp, Caenorhabditis elegans
atgcccgaaacaaaaagagttcgtcaattccattcccggacgtatgctgacgaagtaagaattttttagttttttcataatttttactcaaaattttcaggttctgaaagggattgatgtggcagggaaaacatatgctattactggaaccacatcgggaatcggtgttgatactgcagaagtactggccttggctggagctcatgtagtcttaatcaatagaaatttacgagcatcggaaacccagaaaaggaaaattttggagaagaagccagatgcgaaggttgatattatttattgcgatttgagcgatttgaagactgctagaaaagctggagaggagtatttgaagaaaaagtg

SEQ ID NO: 29316 - DNA, 607 bp, Caenorhabditis elegans
atgtcggaaatcgaaagtggatggctgttagaagtggcgccccattattataaggtaattattattttttttcttttgaaaattgcttttgtctcacaatctttatatttaagaaaatcagaaatcgggtgacatttttgaaattttttgaaaatttcaaaaaaaaaacaaatatttggagtttattccgaaaaaaaatcttttctcaaaaaaaaacattatcaaaaactgcttttaaaaaatttcagaaaaaaaaatcaaaaaatgagaataattacataaaaattttgaaaaaatcccaaaattttaatttttagaaaatcaatggcatatttagaagtagaaaaaaactcaaaaaaatttaattaaaattttttggagtcaataattaaaaaatggctatttaatttttttgttgttttttttctaattctgaaaaaaagcgaaaaatagaaaaatcctaaagggggaaatttattgaaaagtagaaaaaatacccgaaatttttaatttaacaattttattccagggtcgagaactggaagacgcgacgaacaagaaaatgccgaagaataagggaaaatcgggaaaagatttggaacgatga

SEQ ID NO: 29317 - DNA, 1068 bp, Caenorhabditis elegans
atgtccgtggaacaattcatcaacgaccaactacactcaatcgtgggtatcagcgatcgatcaatatgtcaatacgtgcacgcactagcaaaaaaggcgaaaagcgcgccggatttagtggaaaaactgcgtgacgccggagattttccgatttccccagcgatccagtcattcgcagatcagctgatgagtcgaatgccccggcaggcaacttcagcgcgacaacgtggtccgacaacagcagagcttgccgagcaggagctaaaccgtctgaatcgggcggtcggagtgttggaggattattcggcgagctccacaaaaaccaaaaatgtcagaaaaagaaaagagagcagtagtgaagacgatgaagctccgattaaagctagtaaaccaggaaaatctgtgaaaccttcaaaatccgacgattctgagtccgatatagaggcgatggaggcaaagctggacgcagatatcgctgaaagagacgccttggcagcacgaattaacaaaaaagaaaaggataaaactcgaaatgttatggagaaaaagcgagatgataacaaggacaaagagggttcctccatggacaaactccgagaggagtccagaaggcagtacctgaaaaaacgaaaagtcgacaagctggaggaactggaggcgatagttcacgatgatcaaactctattcgctagggagaagctcacgaaacgtgaaaaagcggatatggagtaccggaaaaaagttctcgaatacacgaaagcccatggaaaagccggtgacgtcatgaaaatgaagagatatcatctgccggacgcctcaacgaaacagatcccttcacagtacgtggaggatgatgaggaggacttcaggccaggcggtgatggtgcaaagtgggaagaggagcagctgatggcctcgatgcttcacctgggagccaaggatgcgaagcggaaggagcaagagtttgagctgttgcttgatgagaaagtggactttattcaggctcttcagatgcctggaaccaatgaggaagtagtagagacagaagccgagaaaaagaaaatgtca

SEQ ID NO: 29318 - DNA, 422 bp, Caenorhabditis elegans
caacccgagctcatctattatgctatgtcaaaatcggctctggatcaatataccagaagtgctgcaattgaccttattcaacacggagtgcgcgtcaactcggtgagccctggtgatattcgtactggaatctacgaaactatgggaatgaataaggagtcggtggaaaacgtaggagtattatcatggaaaacttttattatattttctaaatttagatctacaaatttatggagtcccgaaaagaatgttgtccaattggaactattgctcaacctgtagatgttgctaatattattgtatttttggcggatcgaaagctttcttcttacatcattgggcaatctattgtagctgatgggggctcatctttggtgatggaagtgcaagctcatgattggatggagctgttgaagcattga

SEQ ID NO: 29319 - DNA, 1610 bp, Caenorhabditis elegans
atgtgtcaacccccccccccccccctccgtccgttttcccaaaaaacaaaaataatcaataatcaatcagtcattgcgagtattcgaaagagttctttcataatgttcggatgcttcaaaaagaagaaaacgaacaagtcgctggaggatcttaagaaagatgtggtcatcgacgatcatgagataccgctcgacgccctgttcaaaagatacaccacatccgaaaagaatggaatatcggaagccgaagcaacaaatcggttgaacagggacggtccgaatgcactgacgccacccaaacaaacttccaagtggatcaagcttgctggttcgattttcggtggatttaactttctactttggtgtgccgcaagtgcttctgccgttggctatggaatggatttgtcgatgagcgacgacgaggaggttccaaaggataatgtgagtgatcttgtgaaatctccgtaattgtaagggttctcaaaaaattgcctcaacacactttttgagaggtcttgtcagctcgttaatgagctgagctctgggaaaactgtctgttttctactcaaattcttacgaaatactcccacgtcatttgttttttgtttttaaaatatgacagtttctcacggaaagttacctgaatttagattttttcaagaagatccatactgtaggaccacgtaagggagacagcaggattactatatgttactgtagtgtcactaggattactgtagtagtgctgttggattcctaaaatattctgtaggatcactgtagaaccactaaaatattccttcggggttagtgtaggattaccgtaagcttgctgtgggattccttcagacattcttccgaattactaaagaataccctttgaattattgtagggttactgtagaatcaataggaactaggaatactaggatgactgtagctttatatttactctagtaactggacactttcagatgtacatggctataattctggcgaccgtagtcaccgtcaccggattgttcgatttttatcaaaaccgaaaaagtggaaatttgatggactcttttgccaacatgattcccccgaagaccctcgttgttcgagatggagccacaagagaaatcgaagtcaaagatcttgtagtcggtgatcttgttcggttcagaggcggagatcgtgttcccgcagatcttcgtgttaccctagcgcgaggcctgaaagttgacaactcgagtttaaccggagaatcggagccccagacaagaaacatgaactgcacaagcaaaaacgcgctggagacgaagaatctgtgcatgttcagtacgagtgttttggaaggatctggcgagggtatcatcattggaaccggggaccgcacgtttgtcggacgaatcgctgcattgactactcaagtggacccaggacccactccattggctaaggagatcaatcatttcatcaagatcatttcaatcgtcgcctttaccgtaggaattgcgtttttcatattggctcttgtctacgagtatccacctctcaaagctattgtcttcttcatgggaattgtggtggcaaatgttccagagggaattgttccgactgtaacg

SEQ ID NO: 29320 - DNA, 580 bp, Caenorhabditis elegans
cgtcatgttctcctacatgcaaatcggagcgattcaagcgtgcgccggcttcaccacctactttgtgttgatgatgtcgaacggatggttcccgcaggatttgttgaatattagtgagcaatgggataacaagtatatcgatgatttggaggacagttatggacaacaatggagttatgaaagccgaaaagctctggagtcttgctgttatggtactttcttcttcacgattgtggtcacccagtggtctgatttgtttgcttcgaaaactagaaagaactctttggttatgcaaggaatggagtaagtttttttctaatataatttttggatgatctttacattttgccaattcagaaaccatgtgctcaatacatcagtgatcttcacctgcttcttggcaatatttgttctcaacactccgtttgtgaatgaagtcttgggagttcaaggattccgattggaaattggatttctcgcattgccgttcgcattcttcattggcttgtatgacgaggttagaagatatttcattcggacttatcctggtggatatatctacaaagagacctactattga

SEQ ID NO: 29321 - DNA, 840 bp, Caenorhabditis elegans
atgggactcatcgatgttctgaaatcattcaagtcacccagtggccgcgaaatccgaatccttctactaggactcgacaacgccggtaagacgacaatactgaagcagctgtcctctgaagatgttcaacacgtcacaccgaccaagggattcaacgtgaagactgtcgccgctatgggtgacatacgtctaaacgtctgggacatcggaggtcagcgatcgattcgtccgtattggtccaactactacgaaaatatcgacacactgatcttcgtgatcgatagtaatgacaagaagcggttcgacgagatgaacattgagctcggcgaactgcttgacgaggagaagcttcgcaaggttccggtgctcatatttgctaataaacaggatcttgtcacagcagcgtcatcagaggaaattaccagaaagtaagtatttttcttcaacaataacaatttatggttgttaaaacgaatgacctggtttgtcctttgccttcatacataaaaagcgaatgccatttccctcaaggactttttctctaataagctaaaccttcttatattaataacactgatagaaatagaaaatgtattcattcagttttttttgaaaagttatcatcagctcacatccaatttcaaattgcaataaaaatgcattgacagcttaattcctaaactccaaattctaatctccaaaatcaccttcagactaaacctggaccttctccgcgaccgcacttggcacattcaagcctgctcagcgctcaaaaacgagggcatcaacgacggaatcacttgggttgctagtaacctgaaaccggcttctaaaaaatag

SEQ ID NO: 29322 - DNA, 1155 bp, Caenorhabditis elegans
agtacttcaaagcagctatggctagaagaggcgaatctacttcaacctccaccactactacagagcaacaacatcaacggcaacatcatcaggcgcagcaagcccaacaacatcagcaacaacaagaacgtcagcaacaagagcgtcagcaacacgagcgtcagcaacaagagcgtcaacagcaagaccgccagcaacaagctcaacaacatcaccaagcccagcagcatcattctcagcaacatccagctcaaccagctcaaccttcgcaagatcatcacgaggaacatcgtagacgtctcgaggagcatcgccgccgagaagaagaacaccatcgtcggcaagaggaggagtcgcgtgccagagctcttcagcaatcactgctacatgctagccaggttgagagcaccgaagtgacattccaagatgagtatgatggagatagtggagttgggtgcttggagcacgagttccagtgtgctattggagagtgtattgataagttggttttttgttaaattttttcaattaaaattgagaaacttaaatgtctttactactttgtttttttgtgagctgcaaacgcgctcttaggcttatagggttaggctaggcttaggcttggcttagatttaatgttaagctgggtgggggctgaagaagagagaaaaaataatcgggattggagagttgaactcaaaaaaaaacatttcgaaatttaggtttgcttcagagattcccttgtaaaacctgttttaatttatctcaatagctatttttagacgccgtgtgtgcgacactcgtcccgactgcctcgatgcctctgacgagcaaaactgtgcggaccgggctccagctcctctaccgactcattcacagcaacatcatcatgttgcgcaaccagcagcaccaccatcactcccatcagtgaacacttatccgggtcagttgcaaattttcaagtggttagcacttaagttcaggttgttggcggaggatttgcgtgtgtatgtgtttggatgtatatatatatacttcgagctcattgtgccctcaaaatgtttgactcttttttttttgaaaaaaagaagtagtttgcactttatgttcattctttctgccgccaattttgaaatgtctcaatttttctgttga

SEQ ID NO: 29323 - DNA, 660 bp, Caenorhabditis elegans
aagtgcaatgcaaatcgaatgagttccgatgcgagtccacaaatgtttgtgtgccaactgtcgtcgtctgtgacggatggaaagattgccatgatggttctgatgaaaaggtaaggggttggggaattttaaattcaacaaagttgtactgtgaaactacagtagggaaatcgtagggatacattggacccacaaaaagaccgcatttttgcaatacagtagtattccagagcctgtatggatactctataagatattactgtagatgcactaaataattcaggaatgggcggcaattgctgttcggcaaatctggcaaatcggcaaattgccggattgccgatttgccagaaaaatcgtttgccgcacactcctgataaaaggtgcctttattgcatttttttagacaattgggattactccaggagttttcaaaggcaatctttaatttcaagttcctttaaatttcaattttccagaaatgctcccatccacgcaagacctacaaacctcatcatgtccaccacgtaaaggtcaacgcagtttgccaagatggctcggagcccgagttcagtcttcacggctcgagttattgctggtccaacaaggtgtgcccagccatgaccgaatgtgtggctggactgtgttgctccatttcta

SEQ ID NO: 29324 - DNA, 861 bp, Caenorhabditis elegans
accccgtagcccaacatcgacatctcaaatgtctaccatagtccgatcgagaagtcctacaggcgcatcggacacctcttcattgttcccatcaaggtatgcaaactacaataccggcaaattggcaatttgtcggaattgaaattttcggcgaatcagcaaaccggcaaaaattgatgttcgtcaatcggcaaattggcgatttgccgaaaataaaaatttccggccaaccgaaaattttttttagcatttcggcaaattgccaatttgcagtttctcgagcatcaacttgccggaagtttttagagggattttttataagacggtttataagaaacatttaaaactgtgcctttttgaattttttcccgttttctttagatattttcatagaatttgttacttttcaaaatagataaaggaacattcaaaggatcacagttttgccgattaaaattgaaattgtaaaatttccaaaaaaaaagtgcagacacaatttgctaaaaatttccggcaattgccgtttttccggcaaattcgttaaatcagcaatttgctgtttttttttgccggaaattttcaattccggcaatttacctgtttgccgatttgtcagaaaaaaatcgtttgcagtccactcctgttgtataccctctttttgaaatttcaaaatttatgttatgctcctttaaatctatattcctagaagaccatctgattaacctaacctacatatatttcagaacaagaagtccaactctccaatcaaacacatctggtcaatccatggaacgaaccacggaccgactgagtgtccgtgacgctgtccgaccaaaaacaccgccagcagtggttgtctag

SEQ ID NO: 29325 - DNA, 1479 bp, Caenorhabditis elegans
aatacttccaacgcttcgatttggaccgtaacgggcacttggatatttctgagtttgtgccattggtctatgagatgagccggcggccagttgacatggattatgagttcttcaaaaaaatggacttgaatgatgatggaattgtggataaggctgaggtggagaagatcagaaaggataataatgataggtaagagtttcggagatgatactactaaaaaatcatttttatagctcttttcctcgcagagatagaacggtttaaagtttgcatgccaagagagtgtggggtagggggagggtgcgagacgcgcgcgctgtcttgcactctccccttctcccacactctctgcatgtataaacttcagaccttgatatctcagctgggaaaagagctatccaaataattttaactaacaaaatgtagagctaaaaattctctacaatctgttagttgacaaagtcttgaatactttactagttttcaagatattgcaatttttaccttctatagtgttgtgccctaacaattattggcatttatgtcatttattagtaaggataatagagaacctaggataggcattgaaactagagtgcctctcatttacaacataatttacaacctacacagggagagggagggaagaccaacagagcaagagggaagaatgtgaaccttaatagaccgccaaacaggccgcataaatcaaattatagataacacatcttatgtgcataggaccacacaacatatagttttcagaattatcgacggaatcctctcaatcgccgacactaacagagatggtcagctcacttatgccgagttcaaaaaccacctgagcagcggagccaagagcctgagcccagccgaggagcaaagaaaccaggctctccagctcctcagctttattgacgccaacggtgataacaagttggaccagttggagctttacactttctcacagaaaacttccactaataaggtgagtttatggtatttttaaaatgttgtgtgaagtggaaaatgtagagctggaaatttgctatactttgttagttgaaaactttttgttagctccattctcagcagagttattcgcttttaaagttggagatgtgaaagagtgtggggaagggggagacacagacagcgcgcgcgtcccgcaccctcccccctccacactatttcatcgcgcaaactttaaagcgttgtatctcggcggtggggaaagataccgaaaagttttcaactaacaaaatatagtaaattttacgctctacaatttcttttcttgtaatttttttctagtcatcacagttaccaagttacaggtcaccaaatccgatgtccagcaaattttcgcaatgctcgacaagaaccaggacggttatttgaccgaaaacgagttgctccaacttgcacagcaattttcaacaatcggaaatgtcagatcaacaattccaaaggtttag

SEQ ID NO: 29326 - DNA, 892 bp, Caenorhabditis elegans
atggcaacgacactccgaaataacggtagcgcgcactctttaccgtaaatcctcctcattttcgaaattattttttcaccatttatttttctttttcttcgatttttctttgttttcttcagcaattctttgatttttcggcaaaaataattatttttcgtatatttattcgtgtttcagcattttcgacgttgacgcgaacgattgggataacacggaaatggctggaggagagaagtaccggcggtggcgacagcattgcttcgcgaagaacgaaagatggaagataaggttagagttgaactcaaaaatgaaattattcataacaatatgttttcagagtcgtacagatccgtcgcctcttcgacattgaccacaagcgtccactaaaccacctcatccttccattttgataaaaatcaacgtaaaaaggaactaaaaaatgaagaagctgtgaagtagattcaaaagaaagtagaagaatcgagcctcacgcgaatgctttgacaggcaaacacaagttaataagagatgcgaacaattcacatcgattggttcagcgatgccgtgagagagtacaatttccaaaaggaagcatttcatctcgctgtgagcctcgtggatcttgctcttccaatgttcatcattgataaaatgcgatttcaactggttggaattacgtctatgatgatcacagtgtatgttcataattaaatatttaaatgtaatgtaaattttaaaaattttagaaaatacgaggaaatcttcccaccaatcgagtgcccgactttcttttgatggagcaattgattggaaagttcgaatttgtcgtcgctaagcccacaccatcttggctcggagcatgctttgcaaagagaattaaccttacaaa

SEQ ID NO: 29327 - DNA, 1997 bp, Caenorhabditis elegans
aaaaggtgatcaaccactggccctgcaacccagagaaagtaatgatcgcccatcgtccaaaggagcgcgagatctggtcattcggctcgggctacggaggtaactcgattctcggaaagaagtgcttcgctctccgtattgcctgcaacattggaagagacgagggatggctcgccgagcacatgttggttagtgattcgaaatcccaaaattttagggggaaagtttagattttgaagtagaacttcaaactttaagcttaaactactgaagttgatccaaaagtgcaaaatttagacgtagaacttttggattttgttgagaaatgcgaaatttggactaaattttcaaattttgacatatgtacaaacctatgaaattagattccaaatcccaaatttcaaggaaaaacctcagtagaccttcaaatttcgaccataaaactctgaatatggtctagaaatgcggattccagttcacaaacttcaaatttggaagcctcgaaatctggcccattttattactcaaatttttaaaaattgggctcagaaatccattaaatttcaaatctagaaatgataaaaccactgagcttgacctgagaataagaaatttggatcagaaacttaaatctgaagcagaaaaaaaataagattttggcccaaaacttcaagtttcagttcaaaaattaacatatcttatctgtaaacgcaatttttggttcactacaatttttttccacaataatttatttccagatcatgggagtaaccaacccagaaggcgaggagaagttcatcgccgccgccttcccatccgcctgcggaaagaccaacctcgccatgctcaccccaacggttcccggctggaaggtccgagtcgtcggagacgacatcgcctggatgaagttcggagccgacggtcgcctctacgcaatcaatcccgaagccggattcttcggtgtcgccccgggaacctctcataagacaaacgccatggccatggagtcgtgccgcgctaacacaattttcacaaacgtcgccgagaccgccgacggagaatacttctgggaaggtctggagaaggagttgaaggaggccaagggatatactgatgagcagttgaagcacttggaaatcactaactggttgggagagagatggcatatcggggatgagggaaaggctgctcacccgaactcgagattcacggctccagctaagcaatgcccgaatattcatccagattgggaggccccacaaggagtaccaatcgacgctatcgtcttcggaggccgccgtccagagggtgtcccactcgtcttcgagtccttctcctgggagcacggaatccttgtcggagccctcgtcaaatccgagaccaccgccgccgccgagttcactggcaagaatgtgatgcacgatccaatggcaatgagaccattcatgggatacaactacggtaagtacttggagcactggatcaagctcggcaaggctccacacaaggcgccaaagatcttccacgtcaactggttccgtgagactaaggatcacaagttcttgtggccaggattcggagataacatccgtgttcttgattggatcttgagaagagtcgctggtggagaggaggagatcgctgtaagttttttttttcccccgttttccgatttgaaaattaaattttaagcaaaactggaggcttttacttgaaaattactagaaaattcagttttttccacttcaaaaccttccaaaaccatcaaaaatatccagatcgagaccgcgatcggatacgttccaaagcgtggaaccatcaacctggacggcctcccacgcatcgactggaacgatttgatgagcattccaaaggactactgggttgaagatgttgacgagagcagacacttcctcgacacccaagtcggatccgatctcccacaaccgatcagagatgagctcgacaagcttgagaagagagttcacgcactttga

SEQ ID NO: 29328 - DNA, 1654 bp, Caenorhabditis elegans
gtccgcgtctggttggacgatcacgagcacgatctcaacgtcggagacgatcacgccttctcactgctccactgggccgcgaagggcggccacgtggcgattgcagagatgctcctgtcacgtggagcacgtgtaaactctacgaatatgggagatgacacgtcattgcatttggcggccgcccatggacaccgacaaattgtggtgaagcttttgtcgagaaaagccgatgttaacgctaccaacgagcacggaatgactccactgcattatgcttgcttttggggatatgaacaaattgctgaggtgattttattgataaattcgaatagagcttgtttagagcttcaaaataagtataaactcgattgggaaaattttttgggaaaattggaaaaaaatgatttttcaaaaaattcagaaaattttttttccaaattttcgaataagttcttctcggaaagttttaatttcgcaatgaaaatgtatagtttaggtgaaattatttttataatcaaatataactagatttgagctttaataaatgtataaattcataaaggatgcgcccacttttgaccaaaaattttgagcttttttttgccggaaaaaatttctgaaaaaaaaatcattttttcaacactttataactttggaagttttttggctatttttttttatgttttcatacttgcgtcctaaatattttaaaatttcaatttattataccaaaaacacaaaaagtccctatttacagtagcccctgggagttttcgtggcgggacccaaaaatttatcgaaaatttgtagaattttcaaaacccgggcatgattatacttttttgaaagctcttaacaagctgaatttgaatttgttaataattaccttgatttcttgcaaaataacaacttcaggacctaatctcctgcggcgccgctgtcaacgtgtgcaacaagaagggaatgaccccactggacgtttgccagccaatgtgcaaaaacactattttgggtaagttttttgtgcattttaatctgaaaattgaatttttttagtcggaaaacatatagataagatttttagaagaaaaaatgcattttttgaaaaaaaaaacatttttcaacatttttacaacttttcaaaaactcataactttttagttttcaagcgattcgatttaatttaacgttaaaataagtctaaaagatcaagctttttggtaaattaacttaaaaaattgaaaaacataaactacagtaaccctataagttttcgtggtgagacccaaaaattctgaagtcttctgggcaatgctcattttgtgtggagcctgggcatgattatacttttcagaaagctcttggtgagcaaaatttaattttgatacttaaaaataatgtgtacaaaaatttaatgtttttttcagcaaagacttttgactcgcaaaaagttttttttttgggatgacttttttctaataaatttttaaattatcgattttttctagaaattgctcaagaacatggacaatctccaaatgaccgtgtaccattcaaggataccacatggaagggtacaaagtcccgtactcgggacgccacactgtcccgctacaccggagtcgacgtctcctcgctgaatttgatcactaaa

SEQ ID NO: 29329 - DNA, 280 bp, Caenorhabditis elegans
gtcatgatcggattaatcttcgaaaaccgggaatggtcgtggacagacggaagttcagttaactacctcaattgggcagctggagagccaaataatatgaagcatgagttatggactgcggttagttataccttgtagcctccagctacacaaagatatttaaaaatttcagctagtttccgatgtgaaccctaaaaaaggtcagatgtacacccattggaacaatgtgaacatggatcgtcagagagcatacatttgcaaacgtgctccactgaactag

SEQ ID NO: 29330 - DNA, 418 bp, Caenorhabditis elegans
atgtcgaacatagcattcaacagactccaacgagaatgcaaagaggtcgtcacaaactcggaaatcagcgaaaccggaattatgatcgagatattgaacgagaatctcaccgaaatcaaggtaaaacgccgcgaattgtgtgtcggaaatctcaatttttatcggttttcagggacacatccgcggtccaccagacactccatacgccggtggaatgttcgatttggatattaagattccagaccaatatccattctcgccaccaaatgtacgagtttttctgcctggaaagcttgaaaattgtcgaaatttgtgtaaaaatcgcggtttttcaggtcaagttcagcacaaaaatctggcacccgaatgtcagctcgcagaccggcgtcatttgcctcgatattcttaaggatcaatg

SEQ ID NO: 29331 - DNA, 753 bp, Caenorhabditis elegans
atgtcgttttccagaaaaaccctccgctcctcaatcatcaagcatggcgggcgtgcaaagtcccccgctggcactggcagcggacgtaagactgtctccttttcgtcgaaaaacagtgacgccaaaatttcaaatggtaagtgcctcgtatctttcttctttcaaagactgaagagttgttgcagtaagcgattgctggaactacatgcagactggaagtgatttcgtgaagctgcggggcacaaatcggcaattcaggcgatttttcagtctggacgccgacctgtcgtatattcgatggacgccaacgaacaagaagccgcataaagctaggagtaagtaacactcgtgtggcactcggcattttgccacagagttccctcgcacttctacagtctccccctcgctcatcgtcgcacctcttcgcactttgtcgcgctttataagggtttacgcttgtcgctataatttcccgcgcgcttcttcgcacattaccgcagattgcggaagatcttcgcgctttgtcttactctgccataaaacaccaatcaggttcgcgctgttgctgctagtagaattgagctaggagtaagtggcacatggcaaatttagggctaagcttaagtccagctgaagcctaaagcctgataaaactcccgatttccagtagccatcgatgagatccgagagatccgactggggaagaacaccgagctgttgagatcttcggatgaagttttcactgacttacag

SEQ ID NO: 29332 - DNA, 745 bp, Caenorhabditis elegans
atggcagacttggaagcagtgctggctgacgtcagctacctgatggcaatggagaagagccgaagtcagccggcggctcgtgccagcaaacgcatagttctgccagacccgagtgtgcggagtataatgcaaaaatttctggaaaagtcgggtgatatgaagtttgataagatcttcaatcaaaagctcggtttcttgttgttaaaagattacgcggaaaatgtctccgagagtccgtgtcctcaaattaaattctacgaggcggtgagtatcagagttaccaaaatatatctctgatctcaacaaagtttcagatcaaagaatacgagaaaatggagacaccagatgagcgattaacaaaagcacgagaaatttatgatcatcatataatggttgaaatgctcgcacatgctcacgtaagactcagtcactttaattcttcaacaaatcgcaaactatttcagaactactcaaaagaatcattacaacatgtacaatatcatcttcttaaacaaaatgtgcctccagatctttttcaccgatatgttttggagatttgcgatcagcttcgtggagatatttttcaacgatttctcgagtcggacaagttcaccagattctgtcagtggaaaaacttggagttgaatatgcagctgacaatgaacgacttctcagtacatcgaattatcggtcgaggtggctttggagaagtctacgggtgtcgtaaagctgacacgggaaagat

SEQ ID NO: 29333 - DNA, 258 bp, Caenorhabditis elegans
agacctctcaagatcctatcgagtatctgagcagttgaatgctggaaacgtctatgtcaatacctataatgatgtttgtaagttgctccgaatcccactagatctagaaaagaacctgtaatttcagcgccactggttccattcggaggagtcggagaatcaggattcggacgtgaaaacggaacagcagtactcgaacattatactcacctgaagtcggtctttgtcaataccggaacgtgccccaacccattctaa

SEQ ID NO: 29334 - DNA, 1198 bp, Caenorhabditis elegans
atgggagcttatctgaacaagccaattatcgaaaaagagaaggaggaaggctctggaaatgggctaagctatgcgtgtaccacaatgcaaggttggagagtcaatcaggaggtatggattttaaaaatgttgaatatttttatttaaaaaatttccaggacgcccacaattgtgtagtcgatttacacacagactggcacatgtttggtgtctatgatggtcacggtggcacagaagtctcaaaattcacttctgcaaaacttcccgactttttgaaagaacgaaagttctgggaagccgatgatgtggccgagtgtcttcagaaagctttcgttgatttcgatgacttcattcgtgccgaggaatcgatgaaggagttaaaggatattggagatgagggaaaaccgaagaaagcaggcggggaagccgattcggaagatgaagcagatcgcattgacacaattgaagaagcaagcgttcctcttgccgagctactcaaaagatacggtggagctggagttgggaaatctcttctctctgcgtttttggctaagggagatgtttcggatgactctgaggatgaggatgaagacgaagaagaagcagaggaacaagatgatactgaagaaaagaaagagaatgaggatgcatctgccgaagttgtcattgaaaatgctgaagataaggaagaagaagaaggatctccaaagaagaagggacaaaaaagatgtcaaaaatctcctattcaatcagaagccaagaaatcgaaaagcgaaacggatgcggaaactgctccatcttcttcaaggtattttttttagcgaattttaaatttaaaataatttatatttctaatttcttatttcagcggcgtggacggagttgcaactgaagaagaagacgaagatgattcggacaaggaatttgttgcggatgaggaggaagatgatgaggatgcagaagacgagcaatctgacgaggaaatggtagatggcagcctggctccattgcttttgggatccggtggagcagaggttcctggggaggattctggaacaactgcatgcgtttgcttggttggaaaggacaaggttatcgttgcgaacgctggagattctcgtgccgtgctctgcagaaatggaaaggctgtggatttgtctgtggatcacaagccagaagatgaagtagagactaatag

SEQ ID NO: 29335 - DNA, 739 bp, Caenorhabditis elegans
atgttcatggcatcttcactcccggtgtttatcttccttctttccctcccacatggtttgacgttcaactgcaccaactcaggtgtttgtattgaaaagatgaagcagcaccgaacagagtaccttaaggtgagcattatttgatcctgtaagatcattcaagcttatccggatttgacgaaactttactagtccactagtttgtttgatcactgtgattgtgtcttactttaatgtttcattttacattctttagaacgaaattctcgaccagctgaacatgaaagaggcaccaaagggattgaagccaatggacccagaaatgaagtcagtctacctggagatgtatagggacttactggagaaggacgagcaggatatgggcgttgaaatgtcattctacaccgccaaagatccaagttatggagagaacccgtcgcagcttgttgccaagtttgacgtcacaaatgatttggaaagaagcgatattcttcaggtatcgtttggtttttttttaaaaagaatccttttattaaatttcaattatcaaatttcaggccacactcacagtatcaattgagattcctgcaaaggattcagggatgcttcaagatgttcaagttcaagtttacgagaagaacgaggatggatcaatgggagagatggtcacttctggaattttcgctacaaagggatccgaacgtatcagcattcaacttccaattgatactgtcaaaag

SEQ ID NO: 29336 - DNA, 319 bp, Caenorhabditis elegans
gcacaaatcacttgctcaaatccccattctgtattcatccgaagaccggaaacgttgctgttcctctgaatgtcgaaaaaattggcgagttcgatgtaagcaaatgcccacgaattgagtaagtgaaaagttgtatttctaatattattctcaaaaaatttttagtcatgtcgtggaagagttaagcagtctgttgactgaacgaggaaacgatggggacgaggattcgaagaatcgaaaattcctggcgtacaagcatggagctctctcgccttacgttgaaaactttgaaatgtttgtatcggcttgcatttcataa

SEQ ID NO: 29337 - DNA, 954 bp, Caenorhabditis elegans
ggtttcaccggacgtcagggaaccttccacagcaagcaaatgctcgaatacaacacgaatcttgttggaggagtctcgccgaacaaagccggtcaaacgcatctcgggcttcccgtgttcggatccgtcgcagaagcgaaagaccgcactggagccgacgctactgtcatctatgttcctgccgcaggagcagctcgtgcaattcacgaggctatggatgctgaaattggcttgattgtggcaatcactgaaggaattccgcagcaagatatggtccgcgtcaagaatagacttttaaaacaaagtgagtatagtatgatagataacatcgatacttggcctgaaaatacagattaactaattttgaaaaaattagaaaagttctataaactgcatgaactttcatttgcagacaaatctcgtctacttgggccaaattgccctggaatcattgcatctggagattgcaagattggaatcatgccagggcatattcacaagaagggttgcatcggaattgtgtcccgatcgggaactctaacctacgaagctgttcatcaaacaactaccgtcggacttggacaaacgcgttgcattggaatcggaggtgatccgttcaacggaactaacttcattgattgtttggaagtgttcttggaggacgaacaaactaaaggaatcattctgatcggagaaatcggaggacaagccgaggaacaagccgccgagttcttgaaatctcgcaactctggttccaatgccaagccagttgtttcgttcatcgctggagtcactgctccaccaggtcgtagaatgggacacgccggagctatcatcgctggtggaaagggtactgctggcgataagatcgaggctcttcgcaatgcgaatgtggtggtgactgatagtcctgcaaagcttggtgttgccatgcagaaagctcttctcggctag

SEQ ID NO: 29338 - DNA, 492 bp, Caenorhabditis elegans
gaaagcttccaatcttaaaatggagtgattgtgttgagcgaatcacaggactaaatcttccatggatagcactagcaccaaaagttgcaactctcagcgaagacggaaagtacgtgatgtacaaagaagatagaagaattgctcaagttggggggactcatgcacaagagaaagatattgtagagtcattatatcgacataagagcacattggaaacattattccgatttatggacaaagataactctggtcaagtatcaatgaaggagttcattgatgcatgtgaagtatgaatttgttttctttttttattttctttggttttataagcaatatatgttgcaggtccttggaaagtatacaaaacgtccattacaaaccgactatatttctcaaatcgcggaatctatcgattttaataaagacggtttcatagatttgaacgagttgctggaggcctttagattggttgatcgaccgttattacgttaa

SEQ ID NO: 29339 - DNA, 2173 bp, Caenorhabditis elegans
agacatctggctcgtgctcatcgttgacgtgatcgtttcgctagtcggttgcctacttaccttctctgcaatcggattcacctgctacgaattcgccatctcgcttgacaaattccatatccgagatggtttccatttggtcttcgtattcctagcagaagcgttagccggtgtatcagttgctccactttacgcaggactattcttcattatgattctgctcgttgtccatgcaacccaaatgtttgtcgtcgaaacgatcgtctcatcgatttgtgatgaatatccggaacgtcttcgtcgaaatcgtcgccacgtattaaccactgtctgtgctctcttcattctgctctctattccattttgtctctcatctgggctcttctggatggagcttctcacccaatttgtgctcacttggccactggttgtcattgcatttttagagtgtatggctattaattgggtatacggagttgataatatgctggataatgctaaatggattgttggctactggccgccgtgttatattttttggaaggtatggaagcgaaaatgagcaaaaattcatttttcattcacgaaaaaagtctgagaaatgttccatttgttggaagagttctcagcagtaacagtttttttgcaaaaaatgtgaaaattgtctcattttttgcatctaaatgattttatagcacatttctagtgtattttctcgggttttcagttggaaattgagtttctcactcatttttacccctttttaccccgaaattggttttttgcgcacaataatttggtggccgggatttctaggctaccaatctgaaaatgatggtttcaagccatttttcattgattttttttggggattttatttcaaataatagcaataaaaacgattttagcttgaaaatcacaaaattttcagtttaaatccctaaaatacactataaatcgatatttcccctgtgacttgtgcgtttctcagatttctggaataaaaactgtatttattcacattttcagtcataaattggctgaaaatgtgaataaataccgtatttctgccaacaatttgacaatagagcacatttgtcactcggagatgcggaagctatgcccaaattttcaatttttccaaaaacttgtgattttcacagtttttcaatacgaaattcgaattctccatcaccttttacccccgcaacccggttttcagccaatttggaccaactgtcgtaaaattcggtgccgagtacgcaagcctcggtgtttgcgtacttttggggctaccgtacccctcgaaattccaaatttgagatagacgcccggaaaaaggtttcatttaggggtgaaatgaaccgaagaatccgaatttcagtgtgaaaaatgctgaaaaatgctggaaacttctgaaaaaaattttatcaacaaacaattcaaaatttccagctttcaaaatgtttttcctccaattttcatgccaaaattcaaattccccgcacattttcacccctgtgactgctttttcagccaatttgtgtaaaatttcgtaaaattccgagtttgcgtactttcggagctaccgtaccccttgaaattcaaatttcgagctagaaatccaattttggtgaaattttgtgaggaattcggtagggatagcgatttttttggttttttgtaggaattttaaattttcaaaaaaaaaattccaaaaaataaaaattttttttttttcaaaaaattttcctttcagattttattcaaattcatttgtcctatggtatatctggcgattctttgcttcctttggcttgattggaactcaattcaatacgaatcctatcaattcccgtattggtcaattctgacagcatggtgcatcgccagttttccgctaatcctcattccaatcgtcggaatctggcaattttgtatcgctaagggtacaattacccaaaaatggtggagggtactgtacccggacgacgcttggggacccgcgatggcaatacatcgagccgaaaaatttccgctacaaattccagaggcccggaggttgctgctgccgccagaagtcgaaattgccagttcgcggggggttttacaggtagatcattgggagaagaaactacgacgatccgtttttacgccaacgcgtgttgtttag

SEQ ID NO: 29340 - DNA, 1566 bp, Caenorhabditis elegans
atctggaagcaattgaagctcaatgtcaaaaagtggcaaatgattcgctaagatgtgatgtttcattgatttttccaccacatgtcattggattatcaagtattatggttgcaatggaattaatgggccgtggagaagaattggaagcttggcttgtcgaagttgacactgattttgaaaaggtctcggatttctaccggaaaattgagatttcccgtgaaattctacccaatactcgagaaatttgccaatttttagagaatttgcaagaaaatccagcaaattccgcgaaaatagacaattttttaagcatttttagccgaaaaaaagttggtggcctaacttttttactttctaggccaccaataggaattttcgaacatttttctttaaatgtggaaaaccccgagttttttaacccattttgccaattttcagccgaaaaatgatggtggcctaactttttgcaatttctaggccaccaatcggaattaagggaatttttgtgattttagaaagtcaagaacggaaactttgacatttttggcattttcttgaaaattgaactcaaaaattgcaaaaacctgaatttttgtgcaatttgagctggaaaatccccgaaaatcgatgcttctgtgattttcagtgaaaaaaaactgaaaaatcgaatttttcggacctttttacccatgtggccgagttttttggctgatggccgaacttttgtaatttctaggccaccgattgggaataaggtcattttttgaactttaacgtttttttttgtgttttttactgaatttttgattaaaaaaatcgagttctctgcaaaatttgaacccaaaaactaattggtagccgaactttttggttttctaggccacgtgtcaaattaattttcaaaaactggaatattgcccactttttggccaacaaaccgaatttttagtcgaaaaatcggattctcggtggtttttggaatttggtggccgaactcttttgatttcctaggccaccaatccgaaaactctgagttttcgttcaaattttgaaattttcgacggtttttttcggcggagaatcgctttttaatcgaactctgcatctaaaaccgaattctattcagtttttgaatttaaaatcaattggtggcccgaaattggatttctaggccaccaaatttctgagcattttcccctgtgacttttgtgcctctactcgtattgtttgcagtaaaaattgtatttattcacattttcagtcataaattggctgaaaatgtgaataaataccgtatttctgccaacaatttgacaatagagcacatttgtcactcggagatgcggaagctatgcccaaattttcatttttcccggaaactttggatttttatgattttttttccaggtaaccgactgcgttgagcaaatctacaaaatgtacacactttggaagtcatttgatgagaaagaagaagtgaagaagttgatggcgaaattgccgaaaccgaatcagcaaccgcccccgcaacagcagcatcagcaccagcagggatatcatttgtag

SEQ ID NO: 29341 - DNA, 1931 bp, Caenorhabditis elegans
atgtccatcaatatgaatgccaactttttgaagcttctcacccattttcggcgtcacgatttggtaagttgaattttttcccaaaaatttgaaattccgacctatttttgtttaagtcttaattaatgcaataaaaatgcgaagatttttctttgttttgtttaaaaaaacatttttatagcttaaaaatgagcaaagttataggattttttctaaaaattttttattccaaaaaaaattttattttttgaaattttcaacatttttttagtacgattgtaactttttatttgaataaaatatttatctacaatctgctttaaaaattataaaaaaaatcttaaaaatgagaaaagttatggtactttaaaaaaaaaaaaactcaaaaaaattttttcaaaaaaaaaatttttttttttcaatttttttttaaaattcccccccaaaagtacatttatttcttattaatgttattatgtactatcacatcttatcagtacgaaacccttcgtgttcttctgttttattgaaaccaacggaatataaggtgacgaaatgaatttgacctacttttttctgttatttgcgccgccgccgaaaattggtgaagaacaaataattattgtgaccttgttaatgacaatgtcaataatagttttataataagaaaggtatttacttttccggaaaaaaaaaattgaaaaaaaaatttttttgaaaatttttttttttggaaaaacatcaattttttttaaattttttaacttaaaattagtatcaaaatcagattcgtcgtcaagttctacccctgaaacacttttttccgactttcctacgctaaattcaactttcgcgggatactgtagcctcaaaagtacgcaaacacttcaacacaccagatcttacgacaaaatgcagaaaaatcaatattttaacgcaatgtcatgcttaaaactgaattttccgcaatttcataggcaatttaagcatttagtaaaatttacagagtagtactgtagcttcgaaagtacgcaaacaccgattacgagttttcggcgcgaaaattggggttcaggggtaaaaaactacggaaaatacgaattttcaattaaaaattgctcaaaaccaaccccaaaaaaaatttcagacaaatttcaagtcggagcacgacacgttgtacgaaaaagctctggaaactggagatcatttggaagtgacgtcacactattacagtgttatgagtactgtaatcgatgagtattttggcgggaattttcattttgtaccgccgaaattcgaggggcaaaagcttgaggaggcgttgaagtctcttcactggtgcgtttttctactgtaactttgagaatgtatgatgaaaattttggaagttatcaaatttgaattgagctcactgagagctcttatttgatactaattttgattccattttttttttgaaaaaaaaaaaaattttcacccaaaaaaaaattttttttcctgaaaacttcctgaaattgctaaattacaaatttttcatattcagcgcacacacagcttcaaaataacacccatatcgactatattccgttgatttttagattttagggtcccaccacgaaggggtactgtagttttcgcggcgagaccctaatttttcaaaattgatggaacacagtcgataagggggtcattttgaagctcgtgacacgctgattacgatttttatattaaaaattggaaaaattgaattatggagaaaaaaacaagaaaaacattttaaaatttcagccacattgctgaaaagctggaattgtcggaaaatgtgcattgtctggatattggatgtggaattggtggagttatgctggatattgctgatttcggagccaagttgacaggcgtcacaattgctccgaacgaggcggagattg

SEQ ID NO: 29342 - DNA, 366 bp, Caenorhabditis elegans
ctgctgaccggctccgaaatgagcccatccagtgatttatgggcattctccgtgacattgtaccttttcctaacaggaatctatccgttcaacgatatgtcggaatatctcgtttttcgacggattcaagacattttatacactttttccgaagattttcccgatgaaaatgcaaaaaatttgattgagcggcttttggttaaagaggtagcgaatatggagcattatctgggattttgagccaaaaatttggaattttttcagcaaaaatcccgtctgacaagccaggaaatcaaggagcacaaattcttcgaatcgatcgattttgagcatttggagcagctggagccaccaaggatttattga

SEQ ID NO: 29343 - DNA, 1412 bp, Caenorhabditis elegans
atgtcgctggcaactaaattccccaaaaacttcaagttagcaactgcaactgccgcctatcaaattgaaggtgccaaggatttgaatggttagttgctttatgtgatggagttttaaatttttttttttttgaaaacttttttttcaggccgcggcttcagcacctgggatgccatccgcctggaacccggccgaatccttgacaattccgacccggacctttcttgtgatggtctcctaaagtacaaggaggatgtagctcttctcgctgaaatcggtgtcaccaactatcgattttccatctcctggtcccgaattctcccggacggaactttatcgactatcaacgaggaaggcatcaaattctaccgggatctgtgcctattgctaaaggagaataatatcgagccagtggttaccctgttccatttcgacatgccacttgcgatatacgataacggaactgcttggcttaacagggagaactgtgagcattttgagaagttcgcagatctatgtttccaaaagttcggggatctcgtgaaaacatggatcacatacaacgagatcaactgtcaagcatggggatcgattgtgaaggttgaaggggagttctggttgtgccccgagcgtccggagattgagaatcacaaacaggcaccgtatttgtgagtttgtgaagaaatggcgacctgaaaggtccgtcggcgttcggggaccgagtagttgacggactgaatcgatttgccggcctgtaaacggcccgtagtcggccatgtccgttctacaagtgtatagattgatagttaggccaatatacaccactggcataagttgagttgttccagactacctcaaagttttcgggacggcaggtttcacagctgattcgtgtcgatatacggagcgttccccttctccgtaaattggctgaaaggctccgtaaattggctgaaagactccgtaaattggctgaaaggctccgtaaatcgacacaatgcattttttgggccggtaattgtagaataattaaggcgaacccttcacggtaggcaggcgagagcgccttacaacttcacgtgatcaaaccgtaacgggggaaacctgacaccacgtgtggcatgtgtttttagcataaaactcagtccagtcacctcagtccaaacttaaaaacgaacctagctgctgttgacctttgtagatcacaaagagatttatccgtctagatcacactcttgccggccttacgaccaccctattttttcagcggcgccgccaacatgctcctgacccacgcgaagatctaccgaaactacgaccagaactacaaaccaacacagcatgggatccttggaatcacgaatggaggaaggttctgcttcccggcaaccgattcgcaggaagacattgag

SEQ ID NO: 29344 - DNA, 1812 bp, Caenorhabditis elegans
atgaaaaacgacaaaattttcataatttctacttgttaccaccagactttaaaaatttttttttccatccaaaagtttctacctgaaaaaatctttttttttctcaccgtaggtctagaaaaaagcctaaactcaaagctaagccttagcctaagcccaagcccaagaaaaaacctaagcctaagcctaagcttaagcaagaacctaaaccggagcctaaacttgagcctgagcctgtcgaaccctgccaaagcctaagcctaagcctgattgatggaatcaatttgaaacttcagacttaagcttcttggtggtctatacaactctgtgttaaatttcgctttgatcggccaacgggaaccctttgaaaaatgaaaaaaacgctataaacccaagcctgagcctaagcctaagcctaagcctaattcaaagcctaagcctaagcctaaacctagttcaaagcctaaacctcagccgagaacgtgctagatcttctgactttatacctacaccaccatgataagaaatcacggtgatctttatactatgttctattcaacttttcctttttctttttccatcccaccgttcatgacaaaagagtaataatagagccaatatcgtaaaccgcgggaacattttttattcccctttcattcccaaaaatacccaggtaggtatgacgtagagacccccacttctataaaaggcgaataagatacccgaggggcagagaacacgaagagatagatacgtaagacgctgaatcgattttttgcttgtttcttaaaggttaagtgttttaggccattttaagcatttttagacagcggacaaaacatagatgtcgattatgttgcgatgcaccatgttttacttatctttggcggcttatatatcaattatttttggttttatcgaaaaattttcaactgacaaattactcttcacattttaaactatgactttgtaatgaaaaattaatcgataacttaaatatgagccgagatatgtgctgtcttagacatgatgcatcgatgaaacaacgtcgtaaaatttttacgaacgatgcaccatgttgtgctcatctttgacggcttatatatcgattatctttggttttatccaaaattttcaactgacaaattatgcgttataagtttagctgtaactttgtagtaaaaaatttattgataccacttatctgaagcgagatatgagcagtcttagatatggtgcatcgacgaattctagtgcccttttctagaaccgtctctccctttgttcctgcttctacaaatcatcgttccaatatacacctcgccctctatattattcctattactccccctctttccgaaaaacggcctagttttcttcgagagtgaagatgaagaaaagagattttctcgtagaaaataagtgatggattggcgcaataacatgcgacaaaaaactgcttacggtcatgtaggtcaatggcgaggtgccgaagaatcagtgggggaggaataagacaaaaagttttcaacacacacaactgtgcaagtttttcagggtcaaatggaaaagtatggttatctcaaaggcatcgatcactcgtcaccgcaagaatttcggcaagctctcatgttcttccaagtgtgcaactaacgcatcagacacgattaataatctcgaaattgttttaggaagttctcgaggtggaacagactggaaacgtcgatgagatgactgtcgaggcggcgtcaaagccaagatgcacacagactgatgttcgacaagagcagacaaagcggacgaagcgattta

SEQ ID NO: 29345 - DNA, 3449 bp, Caenorhabditis elegans
atgggtccagctccagttttcccaaattcgcggaagccggcgacacttgacgcgaactctgacgagcagacacttcgtccgtattttaagacgaaagttgaacaagcggaggtgaattttcgagaaaataactggaaaaaacgaattatttcccaaaaaaaaaaccaagtttttgacgaaaaactcaaatttttaatcgaaaaactggtattttttcaaaatttcgagtttctgcgatgatttttcatgggaaaatctaattttccgtctattctggcgaaaatgacttcctaaacatttcccctgtgactcatgtgtctctactcggattgattgcagtaaaaacgggcatttattcacattttcagctgaaaatgtgaataaataccgtatttctgccaaaaatttgacaatagagcacatttgtcactcggagaagcggaagctatgcccaaattttcaatttttccgaagaacatgtgattttcacagattttcaatacgaaattcgagttccccgtcacttttcacatctgtaacccagtttccgtccaattcagacgaatatgcgtattattcagtgtttgcgtactttcggggctaccgtaacccttgaattttaaatttcaagctagagattcaaaaaaaggtgctacagtggtaaaatctacaggaaattcgattttcattaggaaaaattctgaaaattcctagatattttggtttccggctccaaaatttaaatttcgtgactcatgtgcctctactcggattgattgcagtaaaaactgtatttattcacattttcagccttaaatttggctgaaaatgtgaataaataccgtatttctgccaacaatttgacaatagagcacatttgtcactcggagaagcggaagctatgcccaaattttcattttgaaccgattttttccgggaaaaagtaaaacttgtgattttcgcagattttcagttgaaaattcgaattctccggccctttttacgcccgggacccggttttcagacaatttgggccaactgtcgtaaaattcggtgccgagtacgcaaacatcggtgtttgcgtacttttggagctaccgtaacccttgaaatttaaatttcaagctagagactaagaaaaacgtgttatagtggtgaaaatcctcaggaaattggtttttcataatgaaaaatgctgaaaattcctagaaagttgaaaaaaaaaaccttaatatttgtttttcgttcaaaattgaaaatattgagccaaaatttgatgaaaagccagaggaattctcatttttcaagcaatatcacatctggtggcctaactttttggatttctaggccatctcaatttttcataatttcagtggctcttgtgcttctactcttattgattgcaggaaaaactgtatttattcacattttcagtcataaattggctgataatgtgaataaataccgtatttctgccaacaatttgacaatagagcacatttgtcactcggagatgcggaagctatgcccaaattttcattttgaaccgattttttccgggaaaaagtaaaaaataatcaaattttcgctatttttcagcaaaccgtcgccgaaaagtcgatcaacgttcgccgcctaatggctcaacaaaaagagctcaacggaaaagtgcgactgctcaaagaagagatctcacatcttcacgagcagggaagtcatgtcggagaagtgtgcaaagcgatggataaaaagaaagtgctcgtcaagaatcatcccgatggaaaatatattgtcgatgtggcagccagtgtggatatttctacattggcagctggaactcgtgttgctcttcgagctgataattatgcaattcatgaggttcttccgagtaaagtcgatcctcttgtgtcgcttatgatggttgaaaaggtgctgataatttatttcgagtagatttttgaaaaatttcgaatttttacgttcattttcaagaaaaaaaaaaagattttaccgatttttttctgatgaaattttggatttttcgccctccaaacatttttgaaaccactttttagagaaaaattgaaaaaaaaattcctaagaataaacgaagctagatcttctctgcgagaccctgaaaaagcaccattcttttcagaaatcttatttatcagctctttattaaatcgaaaaattcaataaaattgacaaaaggggcttttttttccggaaaaattaaaaaaaattccgaaaagtaaaaacagtttttttaaagttaaaattagaaaaaatgtaaaaattaccaataaaaaactcaaatttttttttttgattttctagttttttttcagcaaaaaacgaaacatttaccaaaaaaaaagattttttcggattttcagaaaaaaaaaaacatttttttcaactatttccgtattgaaaaattaaaaaaaaattgacaagaaataagttttctgaaaaagcaaaaaaaaaaaaccgaaaaattagggcttttttttttcaaaaaaaattgtttcccgaaaaatctaaaaatgcaattttagctatttttccgtaattttttccggattttcgctgaaaaaaaaccaattttttttatttcacagatttttaagcaaaaaaattacattttccgtatctttttcagatgtttgcaaaaatgcccattttttgagtattttttttccggattttcgctgaaaaacactgaaaaaatcgagtttaatgtcgaaaaatccggtttagcggatttttgttcaaaaaaaaaaaactgaattttttaatcaatttttcgagggaaaatcggaagatattttcggcaaaattgcgaaaaaaaaaagaaaatagggttttttcttctaaaacccttctattagaagtttggccatttttccgtaattttttaaagattctctgaaaaaaccgaaaaaaacaaattttatgccaaaaatttaactccacgatttttacaaaaaaaaacattaaaatcagattcttgcaaaaaaaatcttttttttcattatttttacaagaaaaaattgaaaaaaaaaggaaataaattttttccacaattttttccaattttggccgaaaatctcctaaaaatagggatttttgatgtaaaaaatccacatttttcagatttttacaaaaaaaaccgtttccaggttcccgattcaacatatgaaatggttggaggcctcgacacacaaatcaaagaaattaaagaagtaattgaacttccagtcaaacatccagaactatttgatgctcttggaattgctcaaccaaaaggagtactgctctacggacccccgggaacaggaaaaactttattggctcgagcggtggctcatcacactgaatgcacatttattcgtgtatctggatctgaattagttcagaaattcattggagaaggcgccagaatg

SEQ ID NO: 29346 - DNA, 983 bp, Caenorhabditis elegans
atgccgtgttgtagttttagcgcaagagagtgtgtggggaggggagacgcagtgtgcgctagccgcctgcgtctcctctcctcctacactctttctttgtgtaaaattttaaacgtggatatctccgaggagaacatagtttggaaatttttgaggtttttatgacaaataattatttaattgaaatattttctaaaataaaatattcaaaaaatgttttcagttcctgaaagtcgacgagcgaagtggtgaaatttcaacaattgcacatttggattatgaaaaacgatcgaaattcgacatagttgctgtgaaagttgaagaatccggagaaacgatcgatattcttgtggaagttgacgacgagaatgataatgcgccaagttttgcggatcaggtggtaaaggttagcataactctttttgcgggggagatatcgcaaagttgtcaactgacaatatgtttaaaaaataatttgaaacaaattgttagttgacaattttccgatagcacttctggttaagaagttataggagtctttggaaaaaaaaaggtttttttttttattgtctaatgtacctcataactttgttctctttgaagagcagcaaaaattgtcaactaacaaaatgcaaattaaatatttttgaacaaatttttagttgacaactttttgatatcttttgaagtttaaaagttatggtcgttttaagttttaatctactgtagccaaaaaaagtcagttgataattttttttggaagcatctatgtatacttaaaacgcttctgaatactaactcttgataaacatacagtaaaaataaaagaggtactaacctattataatttttagctagaaatctccgaattcgcccaactgggcacctcttttgccctgccaacagtgactgatggggatggtccgaaatttgatgtgcaccgatttgtgattcttcagggaaatgttaataatgtgttcaag

SEQ ID NO: 29347 - DNA, 3325 bp, Caenorhabditis elegans
atgagtgtagatttacgagcaatttttcagcacctcactgtcgacacgatgtctggaacggtttgcatccagaaaacttttgatttcgaaaagcagaaaagttatcaaacaacggttatagctaccaatgcaagtaagtatatatatataaatggaaaaaatacaattttgagcaacccgaaaattgtcatggaaacacggcatttttccagaaaattataggcttgctcgggcaatgagcaggtgaatatatattaattataaagtgtgagagtttgggcttattttttgaaattttccatttttcagattctgagacctcaacgtctctaatttcaatccggctaaaagatgtcaacgacaattggccaattttctacccaaatgagtatcatttaacagtccgagaaggcccaaagcctgaagagccactgcttgtcgtttcggcttctgatatggattctgggacttttggagaagtttcctatcatattttaagcgaatccagctcgttttctattaatccagttactggggaagtttttgctcaggtaagtgggaaatttggtgaagaattacggagaagttagtgtagatttacggagaaatgaatgtagatttacggagtgttgaaggcactatgtgtagatttacggtagttagtgtagatttacggagagttgaatttagatttacggagaaggttaatgtagatttacggcagttagtgtagatttacggcggtttgtgtagatttacggagaagttagtgtagatttatggagagttgaatgtagatttacggcagtatgtgtagatttacggtagttagtgtagatttacggggagttgaatgtagatttacggagaaggtaatgtagatttaaggagaaggtaatgtagatttacggcagtatgtgtaaatttacggtagttagtgtaggtttacggagagctgagtgtggatttacggtagtttgtgtagatttacgggaaaatttaatgtaggcttatggtaggtagtgtagattcagtgtaggtcgtgtagatttaaggtagtttgggcagctttacggagagttgaatgtagatttacgattagttttggggtgtagatttacgatatgcggattaacgagaactagtgtagatttgcggtagtttgggtagatttacggagatcaaagttttacggatgtttgtgtagatttacagagttttgtgtggatttacggaaaaattgatgtagatatacggacaattcaatgtagatttacgaatcagtttgaaaactacgaagatttagatttacggaagccagactagttcatcaatgactttgtgtagatttagtgtagtcaaactaggtttgcaaagtattcgagcagttttacaaagatctatgtagatttcctgagtttttctgtagatttacaagacttgaaatagctttttctttcagaaaccacttgcacgcggacgcttccacctagtggtcagtgcaaaagacggtggaggtcaaagctcggagaattctgcaaacattcatattaccgttattgataaggacacgaaaacccctcaattctcaagatccaagtatgaaatccgaacaactgaggatatattaccgggaatcgcaattggaagtgttggtgcaatgtcaaaagtgaaatactccatttactccggcgatcaggaccataatttctccatcgatgaagacacagggaaaatctatgtgacaagataccttgatgcagatgttcatgatacagtactcctcaatattcaggcaactttgccaagtggggagtcgaatcagactcaggtggtgatctttatagaggatcataacgataacccacctcaattctcaagttcattagttgaaatctctattcgagaggacctaaagctccatgagccgttctacgtggttcaggcaagtgataaggataagaagaagaatggagaagtgagatactcgattataagttcacatccgggaagttccatagaaatcgatcaattcaccgggcagctgagcaccgggagtttgctggattacgaggccactcggaattataagctgagagttaaggctactgatcttgggattccaccgagatcttctaacatgacactgttcattcatgtccttgatgttaacgacaatgcgccggagtttgagaagagctggtacacgatggaggtattggagaattccccaccgaagactattgtggggaaggtggtcgcccgtgataaggactccctggagaatggacaaattgtgtatagaatcacaaatggttcggagtactttggaatcgacgagaagcttgggaacgtgtacaccaagagaagcatagatcgagaagtcataagccatgtggacatttccattgtcgccgaggataagggggtcccgccacgatcctctactgcttcagcgagaatctccgtgctcgacgtcaatgacaatcctccatcctgtctctctataacccctattgtagtgccagcgggctccccactgagcacagcgattggtaccatagtcgcgatggatccagacaaggggctcaatggatcggttctctatagagcgcaactgcagagtagtctttttgtggtcaagtctaatggagatgtctacttgagaagacagctcaacgcgtcggatgagagacatcagaggctatcggtgattgtgtcggatcaaggagttccacggaaaagtgtggtgtgtcatgtgccagtgagaatatcaaagggcagtgcggatattcaaattcaagagcccttccaaaaatatatagaaatcccgaagtcttgtccaacggggtgccgacttacaactctcaacgctactggagtgagcagctggttaatccagagctcggaaatctcgaatcactttgctatccgggaaggtgtgctgttcatgatctctcatcctatccatcgcccaccatattccctagtgatagtgttatcagataagaatgataggcagaaatccatccaactgcgggttcttgcatcaggggaagctgccaacaaagaggagacgatacgaatctcggatagcaactcaattggaacaaagatcggaaggcttggagagaagtcagcggatggaagcttcttctacaggttttctagtgaagaaagctgcccgctagaattggatcagactgggggattgctgtacttggctgatggacttcggagaggagatactcataacttttcatgtttctttgaaaagttcaatactaccgatggaagtgcagaggagatgagagttgatttagag

SEQ ID NO: 29348 - DNA, 2393 bp, Caenorhabditis elegans
gcaatctacgacatttgccgtcgcaacctggacatcgaacgtccatcctacacaaatttgaatcgtctcatcggtcaaatcgtcagctccatcaccgcttccctccgattcgacggagccctcaacgtcgacttgaccgagttccagacaaacttggttccctatccacgtattcacttcccgctagccacattttctccggttatctcagcggaaaaagcctatcacgagcagctatcagtggctgaaatcactaatatgtgcttcgagccacataaccagatggtcaagtgtgatccgagacacggaaagtatatggcagtttgtctgcttttccgtggagatgtagtgccaaaggatgtgaatgctgcaattgcaactattaagactaagagaagcattcaatttgtagattggtgcccaactggatttaaggtaggtttctgaataaattttatttattttaataattttaaatctcaaaattcgccacgaaaaatttataaacacacataaaaataccgccaaaaattagccgaaaatcttgaaaaaagtgaagttgaggtgtcttgaacttttgtcaaaaacccacaatttcaggcaaaaaattgaaaatcttaagattgttctatgaactttttggcttttaaaagaattttttcttaaaagaaaattttctttttcttacttaattcacaacgagtctcagtttacttcataaaatattttttctaattttgctttacagtttcagcaaaaaataaaaaaatatgctgaaaatcttgaaaattattgaagttatagggttttgaaatttaaaaaacccaggaaatttactttgttttcttttaatttttacatttctcagataattttcaaaggacaaaattaggtaaaaaaaaattagctaaaatcctcaaaaactaacagagttatatggttttgaaatttttccaaaaaatattaattgattattttttctagtaataattttttcataaaacaattttagattaattaataacaaaatgggtcaaaaacgcatgcaattttagtcaaaaaatagcggaaaatctctaaaatgagtaatgttatgctgttttaaaatgttgtccaaaaaaaaagcttttcaatttactcgaaaattttcacagaacaatttcagattattacatatcaaagtgctccaaataaatttctacagtttcaataaaaatttaactgaaaatctttaagtaacaaagttcaggggtttcgagtttttaaaaaatgttctgtcaccttttttttgttgataattttaaaaagttttcaatcttgaaaataaattatttctacttttagattattaaatattgataaagtataaatattttctacattatttaaaggttttttttttaattttctccaaaaaaaaagtttcacagaacaattttagattgctatgtagcctatagcaaaaccgtccaaaaatttgttttttacctaattggctgaaaatcttaaattggaagagaaattaaaattacaacatattttcaaaaagaaaaaaaaacaatttgccctcacttcacttttttcctttttttttaattctcaaataattgtgtccttccaagaaacaggaaaactaataaaacgtcattcatgtttaccctctatcatctttaccacacatttcgtcaaagtaaattttagttgtgagaaaaatatttcgatttcgaaaaacactacctagaattgacaaaaataacacatttaactaactcccacaaaatatagcccataaaaattcctttattttgatagtttaactttttttgtagctcttctccccacggagatatgcgcttccaaagtttagacagcgagagagtgtgggaagaggtgagacgccgactgcacgcgcagtctgagtctcctctcaccccacactctttagtcaccttcaccttgaaacgctgatatcttggctgggaaaagagatatttaaaaacttttaactaatgaaatgtttgaaattttaagggctatatttcaaatataaaagttaattgataaaaatactgttatagctataatactgctttcaggtcggaatcaactaccaaccaccaacggtagtcccaggaggtgacctggcaaaggtaccccgtgccgtgtgcatgctctccaacaccaccgcaatcgctgaagcctgggctcgtctggaccataaattcgacctaatgtatgcgaagagagcattcgtccactggtatgttggtgaaggaatggaggaaggagaatttagtgaggctcgtgaagatttggctgctcttgagaaggattatgaggaagtcggtgtggacagtatggaggataatggagaagaaggagatgagtattag

SEQ ID NO: 29349 - DNA, 671 bp, Caenorhabditis elegans
gacgaaaacatcgtgatcgacttggtcaccggctccacaaaactcatcgatttcggcgcggccaccgtactccgaagaagccaatactctgatttccaaggaacccgactctattgcccacctgaatggttcttacattctctctatcttggacgagaagctgctgtctggtcgttgggagtactcttgtacaactcactcaacggtcgactaccattcagaaatgagaaggacatttgtacggcacatctgttgggcccacttccattctttgttcctgttagtgcagaggttaaagatctgattagcaagtgtctgacattcgatccattccaaagatgctctcttgaagcaattcttaatcatccatgggtcaaacaacagacactttcatgggatgctttgacaaagaataaggttcagaagaagacatcggaatcttcagatggtaagttgcataagaaaaggtgcatcgatcaacaatctaaaaaactaaacaatttccagaccatcacagcgagactctcggtgatcactctgaaaccgaggaggacagaagccccccgaccagcagcgtctcccagcagcctggcagtgctgatgaaggagtcggcctatcagcgagttcttcgaatacggtaagaatttttattccggtagttaatatgtaa

SEQ ID NO: 29350 - DNA, 857 bp, Caenorhabditis elegans
atgatcgacacaaaccttcttcgggtgacagtgtgcgatgaaggagagctcgaaaagagcacaacgcattttattgggtaccaaattttggatatttcaagcgaaaaatgcgattttccaagcacaaatcgctttgtgtcgatttacgcagctcgtgtactcctcgaggagaagatttttatagtttttggagaaaatgctcaatttttgaccaatttaacattaaaattgtcattttaattattttaaatgaaaatcgactacaaatcatcgtttccagcagttttccatattaaaaatgctgaatttcagcataaaaattaccaaaaaagcgaaaaatcggcgatttgaacgttaaacttttaaaaaacagcgaaaatgtaaaatctagcattttagtcgaaaactagtatttttctcctcggggagtacacgagctgcgtaaatctacattaggcgatttgagcttggaaattgattttttttactcaaaattgaaaaattctgcgaaaaatttcgaatttttttgcaaatttctaaaaaaaaacttaaatttcagctccaaaattatacaaaacttaatttttttcatttccagatctcgaaaaatagagccggagcaatggattacgtgggcgagcgaatgcaaatacttgcccgaatctgacgctgttgctctttgtgcaacgtaagaaaaaagcaattttcagcaattttcggctcaaaaactgaacattttttcagattaatcgatcgtctatcactggaagccaatgtggtgcccgtttcgtcgcctgtcacaatttgtggagatattcatggacaattttatgatttactcgaattattcaaaactg

SEQ ID NO: 29351 - DNA, 901 bp, Caenorhabditis elegans
atgccaaaggacaagaagaaagacgaagtgacagaggttgagcatgtcgatcggaatatttcgtcgttttctcaaatttcacatctcagtaagcatttttttgagctctgcgccacatttgacgcgcaaatcttcaattattccatggtttcgtatgcattagaaattgatctggcggagcagcagctgttgctctgtgctcagctcctccgcgggaaaatcgtaaatagaatttgcgcgtcaaatacggtgcattgggtctgtagatcaaaataaatgtgttgcttcttaggctgaggcttaggttcaggcttgggcttaagcttaggctcaatcttaggcttagtcctaggcttaggctcaggctgagggttaaacttaggtttaggcgtaggcgcaggcgcaggcgctggctcaggatttggcttaggcttaggctcaatcttaggcttatgttaggcttaggcttacgcttaggcttaggcttacgcttaggctcagacttaagcctaagcgggataaattttcgaaatcttccaaaaattgaattccagtcgatgcggaaatcatcactcgtctcactttgagccacaacaagctcacttcagtaccaccaaatattgcggatttggtcagtcttcaggtaagccaaccctacatcaaggtaatcttcttaatccaatctttaaaaaattgcagtccctgaatttgtggaataaccaaatcgaggatctacctccatcgatttcatctcttccaaaacttcgaattcttaacgtcggaatgaacaagctgtcgattctgccacgtggattcggatccttcccagagctggaaattcttgatttgacctacaacaatttgagtgaacgatcattgcctggaaactttttctttatgc

SEQ ID NO: 29352 - DNA, 1339 bp, Caenorhabditis elegans
gatactgtctaccattcccatcggatgactctagtgactactctgccactggaatttgtgaattctcgaatttgacaaacaatggaacagatttcgagtgggaagacacctattgtcacactaaattcacagtattgccaattattattatggtcttttaccttttatcattctctgcaggtgggttttgtaaattaaaaggcaaatgcgctccattgcaccatgcacaatattctgggtctcgtgggcgttttcaagaatttttttggatttttgaattttttaaaatgtaaaaatgtgtttaaaaatagtttagaaatgtaatttgacataaaacatcattaaatttgaaaatttgaatttttgggttttccgcctattgcgttagagcgcgaatgcacttaggattaaaaaagcgcaattttcagcgtcgccatattattgcactcaaaagcgaaagtttgggtcttgacgcgacaaattcgtgttaaacgcaaaaaggtgtgcgcctttaaagcgtactgtagaatttttaacgatttttcatactcaattatttactcgacgatggtatttgtttttattaaaagactatgaaaaactacaaaaaaaatggaaaaattgaaaattccacatcaacaaaaatttgaagctacagtactctttaaaggcgcacgccttttttgcatttaacataaatttgtcgtgtcgagaccgaagataaagtggaaatgcgctccaacgctaaaaccgagaaattcaaatttttcaatgcatttcacacatttttaaaactagcttttacaaaaaagttatcgaaaaaatgcctgaaaacggccaaaatgagagataaggcacgaatttacggctttgcctccaactcctaccgagacccaaatagttcgttggagcgcgattgcacttcaaaacttcaaacttcaaaatgcttaataattcatcaattcacgtaattccaggttacgccccgctaccatgggttctaaacgccgaattttatccattatgggcgagaagtacagccgtatcggtatcaactgcatgcaattggatatttaatttaatagtctcactgacattcctgtcactttcccaggcagcaacaaaatatggaacattcttcatttattgtggatgcaccatggttgctcttgtattcgttttcttctttgttccagaaacaaaaggatattcaattgatgaagttgagatgttattcatgacaaaagaagagagaaggaaagctcagaaagttctggatgagagtaaagaagggaagcatcggaattctgttgcaatgtcttttgatactaaattctaa

SEQ ID NO: 29353 - DNA, 455 bp, Caenorhabditis elegans
aaagctactcatcacacctcgcagcgctgaattctggacaatgtacactaggaaaacgaatcgaagacgatgggctcacccttcagttgcacaggtttgttgggaaaaatttaacattttctaatgtaaattaaaattttaaaaggtattttaaaagtttacagttgaaaatgctttaaaaaatttatattttccaatttttggaacacctaaaacatgatagataaaaaaaaagtgttgctgaaaaatagcgggaaaaaatttaaacaatttcaaactttcgactaacttttgataaacgtaaaaaaacggagaaaaacttctaattgtacggaaaaatagaggagtacacattcgagttttttttttaatatattaatttcagaaacgtccaacgaacaccatccttcacaccacgtggcggaaaattcgaaaatgaaaaagatcgtcggtag

SEQ ID NO: 29354 - DNA, 351 bp, Caenorhabditis elegans
aaattgatggtctggattcttgtcaactcttcaatctatactatccgttggatccttgtggagctaggatagagcctgttctagatggtcagctgtcatgtgtcccgccgtataatgttccaaagtgagttctcccgtgaattgattcatgatttattgattgctccgttgcaggtaccaaaggtatccattgggagacggaaaatcccaaaagtttgagtcaaccattgacgcaacccagatgtggggaagcaaacgtatcgacaaccttctctactgccccaactcaatggttgctcttccgtcatcagctcttccgaacattttacacgcttcttattgggaatcttg

SEQ ID NO: 29355 - DNA, 1459 bp, Caenorhabditis elegans
tttccgttacaatgtccggagtcaccacgtgcctccgcttcccaggacaactcaatgctgatctccgcaaacttgcagtcaacatggttccattcccacgtcttcacttctttatgccaggatttgctccattgtcagctaaaggagcacaagcgtaccgtgcacttacggtcgccgagcttacccagcagatgtttgacgccaagaatatgatggctgcctgtgatccgagacacggacgttacctgactgtagctgcaatgttccgtggacgtatgtcaatgagagaagtcgatgatcaaatgatgaatgtgcagaataagaactcttcgtattttgttgaatggattccgaataatgtgaagactgcggtctgtgatattccaccacgtgggctcaagatgtcggccacttttattggaaactcgacagctattcaggagttgttcaagagaatctctgaacaatttacaggtactattatggagacgcggaaaagttcattttattgcggattcgaaagcgaaaacgcgaaaaaattatcgacttttcagaaaatcaaaaaatttaaaaaaattaaaatgtttattatattttgtatccaaaaattacaaaaattctcattaaaggctttttgaaaattaaatattgaaaaaagttgctggaaacgtgctccaccgccaatttacaacgctccgccctaatcagttgggtctcgttaggtatttggaggcgaaattgtgaatccaaatgttttaccaaatttcagccatttttcgtcttttttgtgatttttttccgtttaaaaaaaaatttcgtgtcaaaacgattttttcaccaatttcgacataattttttcaacgaacagcatcacaaaaatgaataaaatcggcaaaaaaattcaaaaaaccttttaattttcagttgtttttttattgaaaattggcgaaactaattgaaacattctaaatttacggtattaaatatccaacatgtcggattttatagcgaaaattatcgatttttcagaacataaaaaaaaacgagaaaaatttcaatattttatcgaatttggtatattttaaatttaaaaaaatcataatttttctcaattttatgaaattttcagcaattttttggttaaagtttggtaaatttgggttaaaaacatgaatttaggcgaaattcgaaaaagaatttccaattatcgaaaaatctaaaaaaaaaaaaaattttctatatttttttttcataattttcccctaactctgtccaaatttcagcaatgttccgccgcaaggctttcctccattggtatactggcgaaggaatggacgagatggaattcactgaagctgagagtaatatgaacgatcttgtctcagaataccagcaataccaggaagcaactgcagaggaagatggagaacttgatggaactgatggagatgctgaatag

SEQ ID NO: 29356 - DNA, 1021 bp, Caenorhabditis elegans
atgctccgatttcgctgcattttgagcacttcgaggtattaaattgttactttttggtttaaaaaaagtttttgtagtctttgtggagtcaaatttccataaaacctctcgaatttcggaagaagggcggtcacatgtttgtagtcgcgctttgctatctttgtaatttgtcatcgtttttgcgtcagtcgattttgagtatttcattcgaaaaataaactttaaagtccacttcgcgactgaaaagaaataaagctttgatttttctgcgaattttcaatcgcgcctctctttcgatgttcttacaagttctgttattttccaacttttaattattaaaattcgagttccaggtcgatcatgtctggcgtcaaggagttcgactatttggtgattggtggaggatctggaggtatcgcttctgctcggcgtgctcgtgaattcggagtttccgtcgggctcatcgaatctggacgtctcggaggaacttgcgtcaatgttggatgtgttccgaagaaagttatgtacaattgctctctccacgccgaattcatccgggaccacgctgattacggatttgatgtgacgcttaacaagtttgattggaagtgagtaatttttaattagtttaatcaaataattcttaattgttttgttttttagagtgatcaaaaaatcgcgagatgagtacatcaaacgactcaatggtctttatgagagtggactgaaaggatcctcagtcgaatatattcgaggacgtgcaacttttgcagaagacggaactgttgaggtcaacggagcgaagtatcgtggaaagaacacgctcatcgctgttggaggaaagccaaccattccaaacatcaaaggagccgaacacggtattgattccgacggattcttcgatctcgaagatctgccaagccggaccgttgtcgttggagctggttatattgccgtagagattgctggagttctcgcaaatcttggttcagacacgcatcttcttattcgttacgataag

SEQ ID NO: 29357 - DNA, 1730 bp, Caenorhabditis elegans
cacgcggactggatatttctgaaattcgaaccgtaatcaatttcgatatggctcgtgacatcgatactcatgttcatcgaattggaagaactggaagagctggtcacaaaggaacagcatacactcttgttactgaaaaagacattgaaatggtcggacatttggtcaaaaatctggaaagtgtatcacaagaagtaccaaaacctttaatggatcttgcaatgaagagttcatggtttagaggacaaagagctgggaatggaggaccaagtactggaacacagacacgtggaagaatgggtcttggatatacaccaaaagttagacaagttggaggaggtgccactggagcacaatttgatccattaaaagagcaaaaaagttgtagaggtggagggaatcagacagttgatggaatgatcagaaatgcacaaaggtataaatttttaattaattttttaataaaaaaaatagctaccgagacaaggaaaatgtaaaaattgtagtttacggattttccggaaaatcgaaaaattatattttgaaaattaaagaaatgtgtcgtttttccatttttttgaagggaaatcgaaaaactaacaatttttgagtatttgatgttccgaaaaattaaaataaaaaaattcagagaattaaccataaaatatttttaaaaattttcatctaattttattttatattgataagaaaaaaacacataaaaatttaggagaaaagagatcaaaatgttaagattttttttaaaaatcggaaaattttactaaatatcggaaattagaaataaaacgaaaattatcggttttcaaaattcgaaaaaccgacaccgttggtgctgaagaaaaaaaataaattttttactaaaaaaaagaaaaaagtggcaaaaattttgaactatatttcgaaaaagaaagaaaatcattttttaattcaaaaagagttatttgcacttcaaaaaattgaaaatagaccgaaatagccaaatataagtgttaatctaaattctaaattttttacgattttttttcaattttcccacaaaaacgggctgatttatctttgaattcccgcaaaaaatggcctaatttcgacatttttgggggttttcggctataaaatttggttctcttaaatttttttgtttgataattgatttcaaacatagtcaatcaaattttcagaagttttacgcgacaaagtttaaattattgatttttaggaaatttttcagagaaattatcaagttttttatacggagcatgtttaaaaatgtgggaaattgagttttaaatagaataggaattaaaaaaataattcaacaatttccaaaaaattcaacaaaaaaaatttctaataaatgacagtatttaaaaaaataatttcatccaccccaccacatttaacataaaaatcgaattttcagctttgccacgtcatcctcttcctcctcctcttcaagcagtggcccagcttccggagccaatagagcccaaatgctcaaaagtgcatttcagaaatcattccaaacaacatttcaacgacctacaaatgaatcttcaaatcttccacagcaagtagcatcagatccaagaccagaatggaaaaagaaagtggatgaattgaatgcaaagattgcacagcaacaggcttcttcagcttctggtggctcttcgagcagcagctcttcctcaaaacgaagcagatgggaataa

SEQ ID NO: 29358 - DNA, 336 bp, Caenorhabditis elegans
accaacaatgatccctatctattctccgcaaaaacaatttcatttgtgttatcttgatatcaatcgtcgtcgattcttccgatatgagcattcggctcgagttctgaaaagcaagatggatcctaacgaaacggagtttgcaatgggatttgatgtagattctgatggtggagctcttgtacttgatcatcccactgaaaagagccgagagatggagtaagttgctcgttttatcgatttaattcaaattcttttttttatagattaagctattaccgaaatcctatgaaacctcaatcattggcacagctagcaacttattcagcatacaggtaa

SEQ ID NO: 29359 - DNA, 1170 bp, Caenorhabditis elegans
gtgtattggtcgtgctttcgaacgagtaaagaaaatgactccaccacttcgtatcgttgatgactactttaattctgatattattcgcttgaaatctgaagatcgtactcgttttattgattttctgcagactgtctttgagggcacatccaactgatctcttacaggcgtttctacctattgcaccatcttgttccaatgcttttaatgaaaaaaaaagtcttaaaatatagagcattacttaatttatcggaaaatagctgaaaatggcttggaaactgccatttttaggcgattttcctgcgttttctgtgataaatcaagtgattttctatattttgacactaatttttaatgaaaaacatggtgcattaggctattttgtagaattgcctcctactgttataatgttcaatctttctcatacacgggcacactgactttccgagtttaatttttattatcaatttctgaaattatttcccctatttacttctccacttctcatttcattgtcacatattcactttattttgatcagttttcacgtgaacatattgtaattttttttctgatgatgatttttttctgatgattgattaaatcaacttccaacttcttcaaactaatttattttatattttatctagtctcaaatttacgcacttatcatttttctactcgaaaatgtctacgcataaggtatgttcgagttggccgattttcctgattaattgaggattttctagcaatcatattttgtgagttcaacaccgaatggtcttgatggagctcaatatcttgctgtaaatcgtgatggaagtgttctttatggtcttaaagttcgcatcgtattgagcatagttgaagctccggaacaagctccagaagtcatcactacagcaactgaaaagtctatctgcaaataccacgtggcatccggaaacacaaaaacgttccaacttgacgacgatattgatccgcttcttctcgctcgaattattgaattttatatgatttcggataatattgtcgcgctgatttcttacgattcagagcattttcaagttatacagacacttattcatctggaacattcgaaagaatgggctcagacgattgtcgtgagaagattgactattagcagaatgtctgggcccccattagtta

SEQ ID NO: 29360 - DNA, 1857 bp, Caenorhabditis elegans
ttttcatgtccgcaaccaaatgctcctgacgtatgccaaaaagcccatttttccacatactcgttcgcaatgtggactatcacaacagccgtttttgttcgttttccatcagtttatctagcaattcttcttatcatttctcttctcacctacggcctacaaatctatgtgacaagacctgatgaatttggaccaagagaatttatgactgaattggatctttcgtgttttctaatctcccttgtttcaatggtatttctacattcaagacgatgcgagcgacttttgagattggattttctagcagttgtaaaaggaattgaagagacttcaatgaaagataaactaatcaatttaaataatcaaatgcttctgaaccttgtaccagctcacgtggcaccaggtgtcattcaaaaagccggagacgtatggcatcattctcatcaatcagtcggaattgcctatatcgcagtaagtggattcgatttggaaggagaagcaggaatcaatgggttgaactacgttttctcacattttgaccaagctatagcgaattataaaggagttgagaaggtgaaaagtgccaatcgattctatattgttgctgttggtctgttgccggatgctgctcaaaatgttaatgaaacgccatggactattggagagcttatgagcacgttggctcattttattattagcatttcacaatttgcaatggaaaatgagtttcatgttcagatcggttagttttcatttttgatatcctgataatttcaaattgtcttcgaacaattccttttatgttctcctgaaaatatattctttggcttaaaaattttccagaaaactacaaatttgtatgaaaatttaattttttagcttgaagtttccaagtttcacaggtaattttaaaaagtgtgaaaatttttgtttgcctgaaaatttagttttactctgaatatatagatattgttgccagtaaattttaaatttaccgtaaaaattcaaaacttcgtttaaaaatgattagtttctgagttttaaattgtagaatttttttgcttgaaatttgaaattttttatgatcttttttccgttttaatattttaaatataagtctaaaattccgcgttcagtctaaaaaattttaccataaaattttaaatttttactaaaagtatcaattttctctgaaatttcattcttttttcctgaaaatggtacattttatctggaaaattcattaatttccctccactaattgtaaagatctcatttctgaatttttcataaaaacttttttaaaaaattaaatttaaatattcatttaagtttttaaatttgttctgaaatgctgaattttcaatttgaaacatcaaagaatagaattcacatattttcaaaatttcataacgaaaatgactcagtactttttctttacaattaccgaatttccgtaaactaaactcttattttctaacaggtgttgattgcggaagcactcttgcgtttgtagcgaacaccgatcagccccgttatgaaatattcggtgagactcttgatagatcccgtacactcatgcaagcagccggacatgacacaactctagtttctgaagaagtgttcttggctcttcgtcctcgtccgttaagattcagttcacagcctgtgaaagttgcaatgaatttgaatgcatatgaattggttacgggacttcgagatgtgtcagttgatattccaacaatgccgagagaagaacaagaaaggcatactcaaggaatggttgaagcacaatttgctaatcaatcgagaatgtatgatacacaaacttctgaggtagggtttttcattttttag

SEQ ID NO: 29361 - DNA, 304 bp, Caenorhabditis elegans
aggtgtctacgtatcaaatgaaactcgtcgtttccttggttcaacgggagaatttgaactggaaaaatgtccaattggatggaaactttatggacacttaccatcaccagaacttttccctgttaataaaaggtatgaaatgtaacagaacaaaatctaaatactttaatttcagattctcattggtgacagtaccccaagccgtcaaccgagtgctccaaagcattgtcgccatgaatccaactctcaaaaccatgggaacgaataaaaagcgaaaaggagagaaaagtcaggagaagtttga

SEQ ID NO: 29362 - DNA, 910 bp, Caenorhabditis elegans
cttatcaccaatggcggagatgctagtttgaagtttgtggaagaaggaaaatctaccgatcccttcgatggtggaataaagttcagtgtacgtcccgccaagaaatcctggaagctcatcgagaatctatctggcggagagaagactctggcctctttatgctttgtctttgcaatgcaccactaccgtccaacacccctctacgtgatggatgaaatcgatgcggcactggacttgaacaatgtcagcctgattgcaaactatatcaagcattccgagcgaacacggaacgctcaatttatcataatttcgcttcgaaatcaaatgttcgaggtcggaaatcgcttgcttggtatctataaaatcgatggaaaaacttataacattatggtggatccgatcgcggtggagatcaagaatcgtccgattttgaagattttcgaggaggagatcaaacggcgcgagaagctacgacgtgccgagattgaaccggaaattgatttgagtaatgggctcagcaatgtcgttattgcaccaaaacgtaagtaataattagtgacatatcaactgcactttaattgtaaaataccaaatcaaagtagcaaccagtccaacttaaacccatctcaacaaataccaattttcaggtaaacaacgccggctggaaatgctgaaactctcggactttggtctcgatgatgacagtgatcttcctgaatttaatagattcccacccgcaactcgtcgtgaattaagtgttgaggattcagatgaagacgatgagccagtaagaagacgtccgcgtcgtcaagttgaagaggaagatgaagaggatgaattgatcgaagaagcaactccatctccaccaccaattgtcgttcaacgccgtgtgcgaagaagcagacattaa

SEQ ID NO: 29363 - DNA, 1369 bp, Caenorhabditis elegans
atgtggctgaagcatccattcgtcgagttaaccgtgaaaatgattgaaccccagattattgtcagaggtcatgcgaggatattctttattgaacacctcattcatccaattttggaatttttgacaattaaaggagttgtcaattatggagcatttgatttcagaattgatccattgaatggaatgagaccggttagtttgaaggaaaaatgaaacttgaaaacatgttttattttagaaaattgcaataattggagcaggaatatctggaatctcaacagcccgccacctaaaacatttgggaattgatgctgttctcttcgaagcaaaggatcgcttcggtggacgtatgatggatgatcaatcacttggagtatcagttggaaagggagctcagattattgttggaaatatcaataatccaattactcttttgtgtgaacaaattggtattaaataccgaaattcgaactttttctgtccacttattgatgagaatggacggtgctttacattggaacgaaaggagttggatgatcaagttgatttgcattataataatgttcttgatgcaattcggaataagtatcagagcgatcggaattttccggatgttcctctagaaggtaggtcagaaattataagtaggcacgaagattctgcctgcctactaccaaacatgattttttctctgaaaattgaaagaagaaaaatttccaaaattccaattattccagttaccaatttccggcactttacagaaatgttctcgaaaatgagttccggattgctctcggccgccgacttggactctctctacactcctgaatttgaaaaacttttggattttcatctaggaaatctggaattctcttgtggaacccatgtttcaaatctttcggcaaaagactatgatcataatgaaaagtttggaaactttgccggagagcatgcagttatcactgatggagcacagagaattattgattttttggcaactggattggatattcgactgaattgccctgttaagtgcattgattggggcagagatgatcgaaaagtcaaaatattctttgaaaatgctgaacaagcagcggaagagtttgataaagtagttatcacaacttccctatcagtactcaaatcaaatcattcaaaaatgttcgttcctccacttccaattgaaaaacagaaggctattgatgatctgggcgctggattaattgagaagatcgctgtgaagtttgacagaagattttgggatactgtagatgctgatggattgcgaacggaatatttcggaaaggtttccgattgcaagactgatcgaagtctcttcaatatattctacgacttttctggaaag

SEQ ID NO: 29364 - DNA, 458 bp, Caenorhabditis elegans
atggctctcctgattttaagctctttagtaatttctatttttactttctttatctacattattttggcaaggagagaaagattcaaacttcgtgagaaaatcggattatctggtccagagccacattggtttttgggaaatttgaagcagactgcagagttcgtgatattaaaaatcaagaaaacttatcatttgataatactaatttccagacgcaaggaaaaacttggatatgacgatgcaaatagatggtttaacgagcttcacgagcagtatggagagactttcgggtttgtggttactgtaacttaaaatttaatagttctaggcttctagaatttactatgggtcgcaaatgaatattgttatatcaaatgagaaagatattaaagaagtttttatcaaaaatttctccaatttttccgaccgatctgtaccttcaatttacgaggctaatc

SEQ ID NO: 29365 - DNA, 451 bp, Caenorhabditis elegans
atggctcttctgattctcacctcaattttaatacttttggtatcttttatcatttatattctttttgcaagaagggaacaattcaaacttcgtgagaaaattggattaactggaccagaacctcattggtttatgggaaatttgaagcagatcgttgagtgagtaaaatataattttattttgtttattttgtggaaattttttcagccggaaagaaaaactaggatatgatgattcaaataaatggttcaacgagcttcataagcaatatggggagacttttgggttagtatacctgcgcattttcaaattaaaaaaaattatttcagaatctattttggcgcgcagatgaatattgttctatcaaacgaagaagatattaaagaagtttttattaagaatttctcaaacttttccgatcgaattgtgccaccaattttcgattctaacc

SEQ ID NO: 29366 - DNA, 378 bp, Caenorhabditis elegans
cttctccaaccgccgttgtctcaaagacattacgattcgtggtcaattctatccgaagggagcaattgtagtttgtctaccacacactgtccaccgtaatccagaaaattggattcccccgaagaattccatccggaaagatttgagaattgggaagaaaagagtagctcattgaagtggattccatttggtgttggaccaagatattgtgttggaatgagatttgctgaaatggaatttaaaaccacaattgccaagttactggatacttttgaactgaaacaattcgaaggagaagctgatttgattccagattgtaatggagtaattatgagaccaaaggatcctgtcagattgcatttgaaaccgagaaactaa

SEQ ID NO: 29367 - DNA, 1061 bp, Caenorhabditis elegans
atgtcggacgttcgcgtcaagttcaacctagccaacgatggagaaggtctcgacgaggatgtaagaatttatttcttcgaaagaatacttttaaaaccaatagatttcagattttcctccctccagccccactccttgccggtgctcactgtgctggccttcaatcttaccacgatttgtaccgttcctcgatcaacgatgctgacgagttctggcgtaccgtctcatctgaactccatttcgaacaaggaacctctaagggtctcgaatggaatttcgactcgaaagctggaaatgtcttcgtcaagtttatggatggagccaagactaacatctcgtacaactgtttggaaagaaacattaaacgtggatatggaaacaaaatcgcctacattttcgaaggaaacgagccaaccgacacctccacctggacatacaacgagctacacgcccaagtagtccaattctccgctgttctgagatctcatggcgtcaaacgaggcgatgtggttgctttatatcttccaatgattcccgaattagcagttgcaatgcttgcgtgtgcccgtatcggagcaatgcattctgttgttttcgctggtttctctgccgaatcacttgccgctcgtgttgtcgacgctcgctgcagagttttggttacggcggacggagtttttcgaggagctaaaccaattgggctcaagtcaattgcggatgcagctgccgttctcgcatcgcaggaagatgtcaaagtggaagctatcattatggtggaacacttaaaacgagtcacgaagcctgatggagtggaacttcccaaggtaactaaatataataaatttaatgctctaaaatgctcaaagtagtctcaaattcagaaaaaccagaaaaaaattaagttttattgatttttcatttaaaattacaacaaaaaacatttttcaggtcgattacaccgatatcaccgtcatctacgattcggagatgctcaagtgtgcaggcgtggattccccggtagaatggatggattctgaagatccgctatttattctctacacatc

SEQ ID NO: 29368 - DNA, 412 bp, Caenorhabditis elegans
atctcaacgaaactacaccctgccaatttgtggatccagctgatgattgtacattctattatctctactattacgatgaggccacagataatgcaacagtctgggtcagaaaacataaagattgtcctccacctgtccctgtgctcgcaattgtgctcggagtcattgcgggtatcgtaatcctcggaattcttctcttgttgctctggaaattgctcacagtacttcatgatagatccgaatacgctactttcaataacgaaaggcttatggccaaatgggatacggtaagtgacacggaacaaaaaacatataaatttatcaaattatcatttttcagaacgagaacccaatctacaaacaggccacgacaacatttaaaaatccagtatacgctggaaaagccaactaa

SEQ ID NO: 29369 - DNA, 961 bp, Caenorhabditis elegans
atgtccaagcaaaataactttcgccgctacaacccgcttatcgatgaatgggttattgtagccgtaaatcggataaatagaccttggcaaggtgccaagacggagaaatcaactacaatttcaacttcttctaacactgaacaatcaatcttaaatccgcttgctcccggcggaactcgatcttcgggaattgctaatgagaattatgtcagcacttatgtgtttgataatgattttccttctttcacggagtttgaagaatgcgctgggaaggatggttggggcgaataaaatatattttagaaatatgaagaaattttagaaaatgatgatttattcaaacaacacgaagtgaaaggagtttgtaaagtgatttgttatcacccaaatagtcaactcactttagcaacaatggatgttaaagaggttttttttatatttgaaaatggaagaccttgtgtcgatttacgctgctcgtgtactccccgaggagaagtgttcatttgttttctgcagggaaaaatcgttaacaaaaacttattaattttcgattttcatcagttaaacactaaattgaaagcttacgaatggcgaaaattatctgaaattaagagatcaagccgaaaactgaagtttaaactgttatattccgttccaaaacagttctcctcggggagtacacgagctgcgtaaatctacacatgccgaggtagagatttcacggctattctcccatttccaagtatgagcccaactacatctaaaaattaatgttcaggtccgcgttgtcattgacatttggaaccaacaatatctggagctcggcccgaaatacgaatgggttcaaatcttcgaaaatcgtggagcagttgtcggatgttcgaatatgcatccacatgggcaactgtgggcgtcaaattatcttccgacgctgccaatgaagaagcatgagagtcaaaag

SEQ ID NO: 29370 - DNA, 723 bp, Caenorhabditis elegans
tatccctcaccatgtccggagttaccacctgtctccgattcccaggacagctcaatgccgatctccgcaagcttgccgtcaacatggttccattcccacgtcttcacttcttcatgccaggattcgcaccactttccgccaagggaacccaggcttaccgtgcccttaccgtcgccgagctcacccaacaaatgttcgatgccaagaacatgatggctgcctgtgacccaagacacggacgttacctgaccgtggccgctatgttccgtggacgcatgtcgatgagagaggttgacgagcaaatgctcaacgttcagaacaagaactcgtcctacttcgtcgaatggatcccgaacaacgtcaagaccgccgtttgtgacatcccaccaagaggactcaagatggctgccaccttcgttggaaactcgaccgctatccaagagcttttcaagcgtatctcagagcagttcactggtaagaaatttgaaactatcatccagtatcagttttaaaaacgttattttttcagctatgttccgccgcaaggctttcctccattggtacactggagaaggaatggacgagatggagttcaccgaagccgagagcaacatgaacgatctcatctcagaataccaacaataccaagaagcaactgccgaagacgacgtcgacggatacgctgagggagaagctggagagacttacgaatcggagcaataa

SEQ ID NO: 29371 - DNA, 419 bp, Caenorhabditis elegans
atatctcgaatttcggtttgcgcagaatcgaatggccttttcgtgattcatgttggcgataacgacattgtcggatgtgcaaagaacacgaaaaatgaggagagagtcggagaaatgattggcactttgttggctcattatgacaagtaaggagcactgatcggacaaaaaagagcacaattgagagtgcaagtcttagcctaagcctaagccttaacctacccctaacttgaactttcagaattacaatgcgacgttccccagtcctgattcaatccgccgtcgtgtgcacattgggcggaaaaacccgtacaattcgtgtgtttgatgccgagaacaacaacgtgcctccagttttcaagaagaatggaaatgacgtggatttgatctgccatcagttgactgctcaagttgcttga

SEQ ID NO: 29372 - DNA, 430 bp, Caenorhabditis elegans
aaaatgacgacatcagtcgagcacttgtgcaaaggattcccagctgagttcccaatgtacttgagctacacaagaggacttcgtttcgatgaatctccagattacatgtacttgcggcaactgttcagaattctcttcagaacgctcaatcatcaggttcgtgttaaaacaattacaattacagaaaaccttttcaaacataattaatacttgaatgaatattttaaaaaaagcaacattgtttaagaaaatataataaaatgcatatttacagtacgactacacattcgactggacaatgctcaaacaaaaggctcaacaatcgcaatccagtggcgtccccggaaccaacactactacacagggagctaccgttccatcagctggagttccagctggagttgcaccaggaggaactactccacagtaa

SEQ ID NO: 29373 - DNA, 793 bp, Caenorhabditis elegans
tgcgaacgattctcgaacgaagttcaagtctcagaagcacggtttttctacggattccagattgccattgagaacattcattcagagatgtactcgaagctgattgagacttatattcgtgatgagacggaacgaaacactcttttcaacgccgttgatgagttcgagttcatcaagaagaaggctgactgggctcttcgctggatttcggacaagaaggcttcgttcgctgaaagactcattgctttcgcagctgttgagggaatcttcttcagtggatcattcgcttcgatcttctggctgaagaagcgtggattgatgccaggattgacacattccaatgagctcatctcgaggtaattattattattacgagatttaaataattttaatgtaatttgataatttttgcagagacgaaggacttcatcgtgatttcgcctgtcttctctactcaaagcttcaaaagaaactcactcaacaacgcatctacgatatcatcaaggacgctgtggccatcgaacaagaattcctgactgaggcacttccagttgacatgattggcatgaactgtcgtcttatgtcacagtacatcgagtttgtcgccgatcatttgctcgtcgagctcggttgtgacaagctttacaagtcgaagaatccattcgacttcatggagaatatctcgatcgacggaaagactaacttcttcgagaagcgggtttccgagtatcaacgtcctggagtgatggtgaatgaagccgagagacagttcgatcttgaggctgacttctaa

SEQ ID NO: 29374 - DNA, 253 bp, Caenorhabditis elegans
atatggattcgaaggactcgtcgtgaatcagtggtctcaagtggacaatccgaaatgggatcctttcgtaagttctatttttgtgacacatgccactttaatcctttttcagtatcgagaattgattctgaaacagttctcattcaacaaagacaactatcaattggatgttattggactctgctcaattgtgatctttttctatttggctggatatattgcacttttcattcgaattcgattatctcgatga

SEQ ID NO: 29375 - DNA, 504 bp, Caenorhabditis elegans
aaatcggtcacctggtgcgtagttcaatggcaaccaaaggaatctccagtttctacctcggttggacgcccacaatgctccgtgatattccattttctggaatctactgggctggatatgatttattcaaaacaaatcttcaacgacgtcaaggacctgatcacaatccgtttgtagtgtcattcgtgagcggagcagctgcaggagttgtcgcctcgatattcacacatccatttgatgttataaagacgaattgtcagattagaattggtggaagtattgatgatatgaataaatcaattacaacagttatcaaggatatgtatcattcgagaggaatttcagcgttttcttcaggtaattctaaatggtttttactaaaattttaaaataaaaaaaaatgtttcaggtcttgtcccacgcctcgtcaaagtttcaccatcctgtgccatcatgatcagcttctacgagtattttaaattcttgttccaaaaaaatcattaa

SEQ ID NO: 29376 - DNA, 1285 bp, Caenorhabditis elegans
ttacatagttcaatgcctgatggagactgatttgtacaaattgctgaaaactcaaaagctctcaaatgatcacgtttgctactttctctatcaaattctccgtggtctcaaatacattcactctgcaaatgtgctccatcgtgatttgaaaccatcgaatttgttgctcaacaccacatgtgatctcaaaatttgcgattttggattggcacgtgtcaccgacccacaaaccgatcatactgggttcttgaccgagtatgtggctactcgttggtatagagctccagagattatgctcaattcaaagggatacactaaatcgattgatgtctggtctgtcggatgtattctcgcagaaatgctcagtaatcggccattgttcccgggaaaacattatttggatcaactcaatttgattttggcagttgttggatccccgtcaaatgctgatttacaatgtattattaatgataaggctcgatcatatctcatttcattgccacacaaaccaaaacaaccatgggctcggctctatccaggagctgatccaagagctcttgatttattggacaaaatgctcactttcaatccacataatcggtaagataatttaatcttgaaatattgagaatttattgaaaattctcattggagcgcaccgggctgtgtcgatttacgtacgagttttttccgggtaaaaaagtgaaatttttattatcaaaaactggtagaatttccgaatttttcgtcgagtttcaattcgaaaaaaaaatttaattttatgttaataaaattgacacgaaaaaaacacatttttaagtaaaacacccgacaaaaattaaggaaaatagtagaacaattttaaaaaatctcgtaaatctaaacaagcagcgcgctctaatgagaatttctctagcacgagtttgaaaatagtttttagtctatttacagttacaaaattaaattcttcacgatttcaagctaaaatatataatcagagaaatttttttgaagtgtttcacatagatattcgctttaacaatccataatgatttcgattttcagtatcgacatcgagcaagcattggctcacccatacttggagcaatactacgatccaggagatgagccagtttgtgaggaaccattcactttggaaatggaattcgacgatttaccgaaggagaagctgaaggagctgatttgggaagaagccgaggctcatcacagacgaatggaggcagaagcggctgcaaggaataatggagggcagaatcctgtttag

SEQ ID NO: 29377 - DNA, 739 bp, Caenorhabditis elegans
accctcgcgaagcacgtcatcgaagttcatgtgaatgcatctgctgctaaagaacgtgatattgcaggagtcccaaaaacagccacaactgattcagatggtgtgatgacaatgttcgatacggatggtttcttgactatcgagttcctcaagaaattcgtcacatatgctcgtttgaactgtggaccacgtcttactccgcaagcttctgagaagctcgttaatcactacgttaagatgagaaatccagttgtcaatgctgatgcttttagtaagtttaaaatatcattttgtaatgaaaacccataaattttcagaatcaggaaagaaggctcataattcggcaattccgattaccgttcgtcaactcgaagccattgttcgtattgctgaaagtattgcaaagatggagcttcagcagtttgccactgacaagcacgtcgaggaagcgctccgtctgttccgtgtttcaacaattgaagcggcggcaactggaaatttggcaggagtcgaaggatttacttcaacagctgatcaagaagcattgaatcgtatcgaagtgcaaatgaagaagagattcgcaatcggtacacacgtttctgagcatttgattgttcaagactttgttgctcgtcaacattatagagagtctcttgtcaagaaggttatcgataatttggtccgtcgtggagacttgcaacaaaagatgcaacgcaagatgctctaccgtgttcgataa

SEQ ID NO: 29378 - DNA, 380 bp, Caenorhabditis elegans
gctggatcaagaccagcaccccagaaaagacacaaaaagcgcttgaaattctacttccaaagtcggaatggcaaccaattaatcatcttctcgttggattcggtcagatgcaatgccaaccagttcgtccgaaatgtggaacttgtctctgtagatttacgtgccccagttccacagctaaaaatgtgaagagcgagactgaagaggtttatacctttttataaataaaagacaagcggattttttttcagacttccacaagtatcgaggttaaacaagaagttgaggatgaatttgaagatgaaaaacctgcgaaaaagattaagaaaaccagaaaaactagaaccaagattgaagtgaaaactgaatcggaaacgtag

SEQ ID NO: 29379 - DNA, 538 bp, Caenorhabditis elegans
atgcttgatcaaattggcgagggaacttatggacaagtctataaagcagtcaataatctcactggtaagctaatttttttttttggaaaatcaatattaatgctgtaaatttccaggtgaacaagtagcactgaaacgagtacgattggaaaatgaaaaagaaggattcccaatcactgcaatacgagaaatcaagattcttcgacagcttcatcataagaatatcgtccgtcttatggatattgtgattgatgatatttcgatggatgagctgaaaagaacgagagctaatttctatttagtattcgaatatgtggatcatgatttgataggacttcttgaatcgaaagagctcgtcgattttaataaggatcagatttgttcattgttcaagcagcttttggaagttcgttttttttttcaaagaaataattttcaaaaaaaaaaaacgtttttactttcagggactcgcctacattcacaatacgggatttttacatcgggatattaaatgcagtaacattttggtgaacaataa

SEQ ID NO: 29380 - DNA, 612 bp, Caenorhabditis elegans
atgttccacgtgacgtcatctacatctgcaactccgtatcttttgagaattcatcgacaaggtccaagtcatgtttttatggatactgtcaattttgcaattttctctggtatgttctttatttggcactgtctgacaaaattcgtataaagtattgatttgttgccaaaacttttagcaagttgtttctgagtttaatgaaaataattttgccaagaaattgtggctaaatgataatttattttaggttttttttggtattatgttttcgaattaattaaaagtttaatttagaacgaggacttggcccaaaactatatggattctttgatggaggacgaatggaagagtttctcccgagcagaacattggattcagattgcattttggatccggagtaagtctagattttttttcaggcgaagaatatttcgacccacgcaattagacatttttaaaagtgataatggatgaataaaaaggttaccaaaataattccagaatctcccgccgtgtgggtgccgtgtaccccaaataccacgctattgatgtcccagtttcaaagaaaagacgttgctttcaagtcatgcgagaatctttaaaagaatatca

SEQ ID NO: 29381 - DNA, 611 bp, Caenorhabditis elegans
atgccgcctaaaaaggtatctcccgggattaccgtaatccttatcgacgcaggatccaatatgtctgtgaaagacactgaaactggaaaaagtgcatttgaaaatgcgatcaatgctgcagattggattgtttcgagaaaagtgatactaaaattcgagaaaactttcaaagaaaaaattgttttcagctattttccaaagatcccgagctcttctcagtgatggcctacaatttggatccgaaagaatacaaaacagaagttggcggtcaaacatttaatggagtccagtgtcaaaatgaaaagtttacaccagccagctttgatcatttaaagtttatcacaaaggaattgcagcaaaatacagaaatgatagatccaaattgtgagagaatatccaagacaaattcaaaaatcctatttatttttttcagttttcaaaggtgttctgggagccgtcgcagtgctaaaagatcaaatcgaatcgtatccgaatccatcaggaatcacgttgattgtactgacaaatggattaaacgagaacattcgacaagaaaatttcgatcttttagttgaagccgttagtgaaagtaatgcagatttgatgataat

SEQ ID NO: 29382 - DNA, 476 bp, Caenorhabditis elegans
atggcaactgcaaagatccatttcaagccgtattttgatgaggtaagcctgtgggaaactagtaaagttaagccgaaaattgtaggttgccgcctcggagcaactagagaaggctcttagaaacaaggagaaactgaagattttggaaatcttggtttcggttaataatacacagagacagatggtaagattttaatggtaggtaggcatgcctgcctactcacctgcctatgtctaaaagctccatatttccagatccgcacaccctacaaaactcgttacggaaaggatttggaagatgaaatcaaaaaagcattttctggagatttcgaagattttctcgttgctctacttcaaactcctactaaactagacgtgactgagctgaatcgatctgtgaagggtcttggaacaaatgagaaaaatttgatcgaaattctgacaactaggactaacgaggaaattgaagcggcgaa

SEQ ID NO: 29383 - DNA, 356 bp, Caenorhabditis elegans
gcaaaacaaatcgagactggaaagtcttctcttggaattgacgctgtttttgctggaaccaatgatatgaaggagcagaaggttatcgagacattgctcagcaagcgtgaacagatctcattggccactcaggtatgatttatctcttataaaatatgcattttcgaactgatttaattttaatttaatagttaacatcaaaattcaaactaaaattatatttttgaggagtctatagtttaatttgtgaaaaaaatatttaagttcatttattgaatgaatatttgcaggtggttcgcatgattctgaaaatcgacgatgtgcgtgttcctgacgatgaaagaatgggatattaa

SEQ ID NO: 29384 - DNA, 441 bp, Caenorhabditis elegans
atggcgcagtcatctgcgcaactactgttcgatgagagcgggcaaccgttcatcgttatgcgtgagcaggagaaccagaagcgtatcaccggagttgaagctgtgaaagtatgtaataattatttttttaaccggaacatttagtttctaaatgttatgttttcatgtttgacaagtcctgaagtttgttcttaaaattaacttcattatttcagagtcatattcttgccgctcgtgctgtggccaacactcttcgcacatctctcggtccacgtggactcgacaagatgctcgtttctccagacggcgatgtcaccatcaccaacgacggagccactatcatggagaaaatggatgtgcaacatcacgttgccaagcttatggttgagctctccaagtctcaagatcacgaaattggagacggaaccactggtgtcgttg

SEQ ID NO: 29385 - DNA, 1406 bp, Caenorhabditis elegans
atgaagaaacatcgggtttttcatttatttcttctcatattttgtaaagcgattagtctagtcaccacatcttcttctacggaacaaatattcgaattcaccgctcccctctataatttatccgtcgaagaaaattcaatcggctcaaagtatgcacgttccgagaattctacgaaaatcggagttccacttccggaaaaggatgcgaattgcaaatttcgagttgctgagattgtggtaagttgggattttgctttagaatatgaaattttttaaaaatatcctcgaaaaccacaatacaaaaatttaaaaaatagcaaaagacagaaaaatgtacttttgaaaatcaagatttttcaattattgtcaatctccctatttgaaattcctccaaaccgcaaccaatcagcgatttgctccacccactttcgaacgtagtttggaggaaattcaaatagagagattagcaaaacttgaaaactgtaattgatattttttgttttgtggtatttcaacacatcggaaaatttctttaaataaaaaaacattttcagggtgagaagtcatcacttttcaaagcacattctcgacaagtcggcgattttgtgtttcttcgaatacgatacaaaggcgataatccactgaatcgagagctcaaggatttttacgatattctagtcaaagctatgtgtaaacgaagagatctttcgaatctagagacaactgcaagaattcatctacgagttattgatcgaaatgatgcgagtccagtatttttagttggtgaacaaggatatgaagctgaaattgatgacgacgtaggtttttcttgtgaatatttttcaaaaaataaatattacatagttgtctaaagatgataaattcgccatatcttacgcgaaaaggtctcgccacgcggatcacaaattactgtagctcgtcccgatttataggctgatttttcataatatcctttaaattaatttttaatattaacaaaataaattgaataggtgccggaatattatcaaagggtcgttaatcgacacaaattaaagtaattcgttgtcagcgtggcgagaccttttgcgggatagatatgaccaaaatgttcatccttgacgtaagcgtaatattgaatcgaattttttcagctcgaaccgttctccacagtcttacgagtcgaagcatctgatgcagatattggaatcaattcagcaatatatttctcattagtaaaccgatctcatgacttcattgtggagccagtgactggatgggttcgatctctacgacacgtgaagccaggaaaatattcattgaaagtaaagtcagaagatcgagcttctcgtttgtattatttcgatgaaaatgaagtacaaccatcgtggactgctgatgtcttg

SEQ ID NO: 29386 - DNA, 2182 bp, Caenorhabditis elegans
atgacaattcgagcagatgcagctggtggagtacatgcgataactacggttactgtagatataggagatgttaatgataatgcccccgcattccatggagattacgaaagatttactatttctgaagatgcagctgttggaactagtgtcactatattctcagcaatggatcgagatgattcacctagtggaagaattcgattctcgttagttgaagaaaatccatatttcgacttgaatgagaacagtggatggcttactgtagcatcgcaacttgatcgagaaaagattgatcattataaattaatcgctcgagcaacggatgaaggtggattcaatacagatcttccgttcactattgtcgtcagtgatgttaatgattcaccaccacaatttgagaaagaagagttcaacattgatctacaccttccatcaacttctccaattcttcatttctcaatcaaagacgatgacttatcaccaaacaacgtttcacagtttttcattccgaagggaaatgaagaaggtgttttctggatagattcaaacaatgatttattgctgaaacgaccggaaattgtggaaaacaagatgcaatatcaactgaaagtcactgcttttgatggagtcttcgaaactagtacaaaagtcaaaatcaatttgaaatcttccaaagattctgatatcagatgcccagaagccaataaaactgtaattctagcagaaaactcgaagaagggaactgtagtgctcggcgaatcaagtctgcttggtccaaatgtaacattcaaactatcagataatgatggaaatgtttttgttgtgaacttccgaaatggaatagtaaaagtgaaagaatccgatcaaatcgactacgagaagaatcaacaattggaattccatcgactcacaattcaagacaattcggaagtttgcaaagaattgattactgtagtgattgaaaatctcaacgacaatcgaccgaaaatcattgagaaactactgaaagtatctattgacgaaaacctgccaacaagtgaagatgctcgacaatatataaccagaattgtagcagaagatgctgattttgatgaaattaaattccgaatggtagacgatttcggtggtttattccaaatcgacgatatcaatggagttgtcacagtagttaagcctctcgattcggaaattttgggattcttcaatttgactgttgttgccagtgatggagaatttgaagacaaaggtaagatttttgaaaagttttattgtaatacttggaaatgggaaaaaaatttaacaaacattgaattttcagccaccattctggttactgtaatcgatcaaaacgacaatgcaccaacatttgaaaagtctacatactcgatgaaagttatggagtctgaatcaattggatacgaattggctcatttccgagcatctggaggagatcaaaacgagacgatcgaatactatctgaaaccgtctgatgttactagttttgtcaatttgaatgctcaaaccggaatattgactttggcgaaaccattagattttgaaactctgtctgctctgaaactgaccgttgtcgcaaaggattctggtgttcctcctttggaaactgaagctcaagttgaaatttctgtgatggatgagaatgataatgcgccgaaattcgaaaaggaaaagtacgttggaaaagtcaaggaaaactcgaaatctggtgaaaaggtgttaacagtaaaggcattggatgttgatagtgagcattttggagcagtttcatatgaactagaaattgtttctgaaacaacaactgatactcctgtgcttccatttgcaattaactctaacggagatgtgctgattagccaatcaatcgactatgagaagattaaaaaatacaatctcaaagtcattgcaaaagacggtggaagacctcctcttcgatcagaagctcttctggaaatccatgtggaagatgagaacgatcatgctccaacattcgatgactgcaatatgactgcacttgttcaagaaggagaagccattggccatcgacttttgaaattctcggtttcagatcttgatggacctaaaaatggagcaccgtttaccgtagagattcaaggagatggagctaaatctttcaaagttaatgaaaagttggaattgctcacgg

SEQ ID NO: 29387 - DNA, 2640 bp, Caenorhabditis elegans
caaagaagctggaatatcgcaaaaaagataagtatttgctcactgtaattgcaaaggatgtgaagggaaagacaacagattgcccgttgactatctttatcagacaaacaagtcgccatgctccaacgatgaagccaatgaaaattcaaatcaacactctacagaatgagttgccagaaggaataattggacgattgaaagcatcagatgaggatgaagaagatcagaatgggttgttaagatttggtctcgtcgaaggatcgattcaaagcccacgtgcacaagttcaagaatctcggtcaacacatttgttccgtgtcgatccgaataccggtgacatttggtcagatcattcgattactcaaggacttcatacattcaatgtcactgtcactgatagcaagtttaacacagtgagctatgtagaagtacacgtcacctccattgacaatgacgtcatcgatcacgcagtttcaatcagaatacgatcaatgagtgtcgatgaattcatgagaaagcatgtgaaagagtttcgacggattatctcacatcacttgaatcttaatgatgatagtagtattcaattgattagtgttcaagctgttccatcaacagaatcagaacgaagaagtagaagaaattctatggaagacgtggagatccttatgacagctcaaagaggacttggtcgtggatatttgaaaccagatcatatatattcaagattgaaaaatgatttccaaaacatgaatgatcaaagtcaaagaatgcgttatcaattgattactgaaatgtgcacaaccggtgtttgtcttcgaggagaatgtcgtgaagttattgaattgattgaagatagctggacgaaagtgtcaactgacgatttttcatttgtttctccattccattctcgttctgcacaatgtctatgtcctgatggatttggtggaaaacgatgtgaagttgaaacaaatcaatgcgccaaatcaccatgtgaacaatggcaattgtgtattccttctgtacataactcaacatatgaatgtgtatgtccattaggaatggaaggagacaagtgttctgtaccatcttgtcaaaacgacggaaaatgcttggaagaagctgaactttctgttggcggtgatggttactttgagatctcactttcgaatgaaatcgaaactcggatggaattggaaattgagctaaaaacgacaactcacaatggtattattatgtggagccgcggaaaacgtgacttccacatgctgcggcttgtcaatggaactccagaatatcattggaacgctggtaccggaacaggaattgtcacatcgaaaacatcggttgttgatggacagtggcatcgtattgcgatatcgagaaggcagcgaagaactcgaatgactgttgatgatgaggatttgcaagaggcttttaggtatttcatcgattttttctaagttgttttaatgtttttattttcagcccgattggatcaacagttattaatctacatcgatactctcaaaaactggtacttggtgcaaaagttgatgatggagagctcactgatggagtttcggcgtgtttccgcacaatttcagttgatggaatgaaggttctcaaaacaagacaaggaatgaagctatttggagcacaaccaggatgttctgcactgacgtcttccccgtgtaatgatcttccatgccaacacgcgggaacttgcatttctcaaggaaaatcacatttcaagtaaatttacttatagttgtattcatcaaataatggtttttctttcagatgtgaatgtccttcgagatattctggaaatgtctgcgaaatcgatcttgaaccatgtgcatcatccccatgtccaactggaatccagtgtattccattttataacgattatctctgcaaatgtccgaatggattcactggaaaacactgtgaagcacgtggattcgaagatcacgaaacatcgtcatgctccaaaaacgtgtgcggaacctccggacagtgcatctcaattcctcgacacagtttggaaagttcggatttcatatgtaattgtaccggtggaatacttcaatcgacaccatgcgctgagaagtctgatattttatcgacggttcttgaattcctactcaaagctgaaattgtaattgtcattttgggtgttctactattgttactcgtcttttgtttaacattcatcacatggaaatgttgtaagaagaacagagatccaaaatatggagctcactgtgatgttcctcacatgagaaacacacgagttctggtgccagtcgtacctccaccacttccgccacgtggattcaggaacgattcatctaacttcatatcaacatcgtctgtaaccacatctcatcgtccaatggttcaagttaaaccatattcttctgatatccgtgactcaagatctccatctgcgtgcggaagttcaaagggaactcgaagagatccattgccatcggacaaattccggagagtagacgaaactgcaaatagaattcgtcattccgataggaaagatccacgtggagatgtactctcatctttgagagattcatcagatgaatggatgggaattgatgatcgaattgattcttcattgaa

SEQ ID NO: 29388 - DNA, 559 bp, Caenorhabditis elegans
atgtcgagcaacgtcctcggtcatacacttcgctcttcgaagaatgtcgtgcaaaaggcgttcgtcgcgacttcaccgaactccgatatgctccgattccgttctccagttcttcaaactaacacagtaagtaattcatttttatctgctattaatatcaattttcagactaagctggctcgttatggaggacgtcacaacgtcacagtcttgccaggagatggaattggaccagaaatgctccatcatgtcgagagaatcctttcagcagttcaagctccagtagatttcgaagtggttaatttgacctcaaaggaagatgcatctgaagatcttgctgaggctatcactgctatcaagagaaatggtgttgctttgaaggtatttttgttgaaagattaaaatcaaatttaattttttttttttgaagggaaacattgaaactaagtttgataacccaagcttcgtttcccgaaacttggaacttcgtcgtcaactcaatctttacgcaaacgttcttcactgttccactattccaactgttccaagcagacacact

SEQ ID NO: 29389 - DNA, 628 bp, Caenorhabditis elegans
atgcctccgaagacttcggcggcgccgccacaatcagacgaatctgattctgattttgatgacgctcctgttaaaaagccgcagaaaaagacaacgaagcctgtgaaccgacacaaggaaggatcaaaggacccggaagaagaactacaggtatccctctcagaatatttaaaagcagcaataaaactgaaatttttattcagagagcggtaaatgaaaaatttgatggaagcgacggagaggacgacgacagtgatcttttctcattggtatgttactctgtttttaatattaaagtcattacattttacagcaactgccatcgcgacccgatttccttacaaaaccgaatcgggcggatcgtttgatgattcgcaatgttgaagtggacaatttcaagagttacttcggcaaggcttccattggaccatttcacaaaagtttcacatcaattatcggtccaaatggatctggaaagtctaatttaatcgattcgctcttattcgttttcggtttccgtgcttccaaaattcgttctgcaaaagtgtcaaatttgattcacaaaagtgctggaagaaatccagacaaatgcacagtcactattcattttcagcggatcgtcgatatt

SEQ ID NO: 29390 - DNA, 1289 bp, Caenorhabditis elegans
atgcacatcctcatcatattgctctttacgagcatcatctcatcgattcaagcagatctttgtgctcattgtgattgtgattttatatctcatacagttgtatgcaaccgcccgtctcttttaattcgaacagtatcgatgcttccaacaattcgacaacttcatcttaattcattgaatctcccacaaccacctcatttcttatttcatccaaatcttcgagtacttcggatgagtcgatgtggaatgcatgagattccaggaagtacatttttaccactgccaggtttggaggtaggcaaatttcttgaaggcctacatagatttgttggtgttagttatgtgtaacctgagttttacaaactaaaacattatagcgcttgatttttatttttgcaagctcaatacaagttgaggaaaaccttagtttgagaaagaatgccggacgttgtatcaaatacaaataagtaggacttcaaaaaatattagcgtatctaaatgtagctgcagactgcaagctatacaattttgaattattgaaactaaacaacgaaatatttcaaaaaatctgtaaaatttcaggtgatcgatctctcaaacaatcatctagaaactcttccacctacagtacttcgcagtcttaaatttcttcgagtccttatactcagtaacaaccgattatcaaatctggaccaactcacatggattcttgcaccgggagttgttcttgaacaattagatttgtctggcaatccaattgcaattgcaacatcaatgactgtttttccacctgttcgacagcttttcctatccgatacaagaatggaaagtgtgaatgaaactgcgattatgttcaaggtatttttgattttcataaactatgtcgcaaataagttttgtgcgaaaatttacagaatgtgctaactgacactacaaagttagacaatctagtgctgagaatctaatttgtaaaagttttcaagtacatcaccactcaagaaaaactactacactacccgaactttatatgtatcttaaatttccagaaactccccggaaaatgcgatagagatgtgtgccgtcacattccaattcacaatttgaatgtttcaattatcactacaattgatttttcatcgaatcgagatttggaaatcgattccggcgcattggatgtgttttcgaatgcaacatacgtggatttgagtaatacaagattgccagttggatttgaggaatggttggagagaaagagtcgagttaaaagcttaaatatcagccactgtcag

SEQ ID NO: 29391 - DNA, 1492 bp, Caenorhabditis elegans
atgggacaaacactcagtgagccagttactaaaaaagagtcggcgtcatgcgccaatgagaattatttggtcggtagcagttgtatgcagggatggagagttggtaagaaagttatcagagcaaaaatgtgataaaataaattaggatatttaggaatttaggatattgttaagcgtttacttccattttaaacgtttgtaatcaagaaataacatagcgaaattaatttgttttaatgtttagtctaaattaaaaaaaaaaatcagcgaatattagtccctttctcttcagacagaactccttagctcattttcatcattttcatcatttttaggtacttagcgacttgaaaatccattagcttcactatcttcaaaaatgataattagttcaataaattgttctaaatgttcttttttttcagacatggaagatgcccatacacatctcctttctcttcctgatgatccaaaatgtgcattctttgctgtctacgatggacacggtggatcgaaagtttcacaatattccggaattaatcttcacaaaaaagtcgtcgcacagaaggaattttccgagggaaatatgaaagaagcaatcgaaaaaggattcctagaattggatcaacagatgagagttgatgaagagacaaaggatgatgttagtggaacgacagcagttgttgtattgataaaggagggagatgtttattgtggtaagagacacggatttgcactttgaccttgaaacgtcaatggaaggaaattgaggaaatgttaaagacactgagtatttttcaaaaaaatcacaatactaagactaacagttttcagtaaaaatcgataaaaaattaacttccaagcttcgaattttgcagtattagaattcatattgttcgaaattttattagattttgaactttcacggtattacaaaagttatctttaaaaaaggagaaaaattattggtacagaaaataaaaacacatttccatattttttcaaaaattttaatttttgattacgcacacatttgtgataactgtgtatcataaagttgtaaaaatcgtacgctgattttttaatacttctgagtgggtcccaccacgatctcagccacagtaatccctacaagcttcaaacttcacagatttgtttatgtgacatagaaaaaaacgttgaaattaaatatttatttaaactgtatagggaagaccaggatttaatatttttaaatgtcaatttttaatttttctccatttttcaggaaacgccggtgactctcgtgcagtatcctcagttgttggagaagctcgtccactttcattcgatcacaagccatctcatgaaaccgaagctcgacgtatcattgccgccggtggatgggttgagttcaatcgtgtcaatggtaatttggcactttcccgtgctctcggagattttgcattcaaaaattgtgacacaaagcctgctgaggagcaaattgtcactg

SEQ ID NO: 29392 - DNA, 1000 bp, Caenorhabditis elegans
atgggcgcaaatttgacgtcaccattgccacatcatcatcgcacacagacgacgtcggtgtgcaatcatctcttttcacccggagatggaggacccacttttgcaccacaaagagattcaaatacgtcctcgagaagctcatcaaatgctaaagagagcgttttgatgcagggatggaattggagtaaaaggaatattcaaccggttatgagcagaagatcacttcctaaatccgggtcatcgtcaggttagaaaagtttggaaaaatattttttagaggggaaatcacttaaagcgttttgttccgttaatacaagtagaaatctttttaaaaaacagagaaaaacaatgataattctttgaaataaaccgattcccgatcagcaaaaaaactgttactatccttttaattaaacatgctgaacactaaacctaaaaaattcggcatttcgtcttgtcttgattgtctatatgtgaagctgactacgataaaaacggctagaaataaatattaaattgttgcaaacttttcaaaaaagcattatgctcaattatattttattatctttttaatacattgttgccaggaagatcaaacaagtaatttttgggtgaatttcacttcacatccattgccataaagttttcaaaaaaccattaaattttccagaagccacgtcatcaaaatcaagtgatagtcttgtatccttcactcgtaatgtcagtacgtcaacttcaagtcagtatgggaaaatatcgatatcacttgatcgaaatcagaattataaatcgtgaattaaaattttcaaatttaaaatagaaatgttccaatttccagagtgccccgaccatcggatacaactacaattatacccaactattacagtcttcgagaagaatttcgacgaggtcttcaaattaatacacgacaagatctggtgaataataatctggcatccaacgatctcagcgtcataggttcgccgaaacatgtgccacg

SEQ ID NO: 29393 - DNA, 1228 bp, Caenorhabditis elegans
atggtcaacacacgcccaccaaaaatagatgaattgctgaaaatcgatccatatttgcacgatttccaagatgagatttcgagaagatacggtgtctttcttgattatcaacgccgtatcgaagaatgtggtggcatggaagaatttacaagctcgtacaaacaattcggtctgaatgtgcaaccagacaattcagtgaaaggccttgaatgggctccagcagccgaaaaattggcattgattggagatttcagtaagctgttctactgaatttgataatgtctcaattgttatgaattcgattcttcttaacattaaaggtttaacaatagatcctagatattaatgtttctcataattaaattaattcgaatcattttcagataattgggatcagaatgccaatgtgtacaaaaaggaggagcatggcaaatggagtattactgttcctgcaaaagaagacggatcctgtcccattcctcataactcggtgattaaaatcgcagtttctcggcatggagcaactcacttcaaattgagcccatgggcaacttttgtgacatgcccaaatccaaaagaaacggtcatctaccatcaaaacttttggaatccacctgagaagtatcaactgaaagaagctcgcccagctcgtccggcgtcccttagaatctacgaggctcacgttggaatcagtagctcagagggaaaaattaacacatatcgtgaattcgctgacgatgtcttgccgagaatacaaaagcaaggatacaatgcaattcagttgatggcagtgatggagcacgtttattatgcatcatttggatatcaggtttcgaactttttcgctgtttccagtcgctgtggaacaccagaagatttgaaatatttggttgataaggctcattcgttaggaatcttcatgcttcttgatgttgttcattcccatgcttccaaaaatgtggaggatggtctcaatcagtgggatggatcaaatggcggatatttccatgataatgcacgtggatatcataatctctgggattccagacttttcgattatactcagttagttcgattgttttcttcaatatatttataatgtattaattcagaactgaaactcttcgtttcttgctctccaatgttcgttggtgggttgaggagtatgggtttgatggattccgattcgatggtgtttcctcaatgatttatcattcccatggaatga

SEQ ID NO: 29394 - DNA, 2792 bp, Caenorhabditis elegans
atggacgacgatgtcggtgaacgaacaccggctctcggtggttcatgtggaccatcagttcgtgcacacagtagttccccaagacgtgttccattatttgagagagcatctgctagatggtggaatcctcaatttcgatctgcaacactagaagctcaatattggaagtgtagtttcagtcagttaagagatcgatttcgttctggattaatatatattgccgttgtaattgccgcttggacactttatttagctttattcgatagaacttttattcagcattgggtgagtttttatttgttttttttttggaaaaaaatctagaattcattgctaaaaaaatatcaaaacaaaaaattctcggcccggcttgtgtgaattattcaaatcgtggagctccgtaaaaaattcaaggaggtcatttgcattttctatggttccttccttccgattttctcatctactgtaacttttttgtataggatctttgcaaaagtggaaatgatgtaaaattttcaattatcgaattataattctcgacataaaaaacgaatgttaaagtttccacaataaaaagttctggaaagtttgaaagtttgaaagagggttctagctcggctattggttaaaggaaactctgctgatcggttggacacacccactttttgagaaaaaaaatctggtgtggtttgcgagctatcttggcaatctcgcggctgtattttttaattaaattaaaaatgaaaaaaattcccatggtaaagctgtcaactgatatatttcaaaaaataaagtaatgaatttcccaaaaaaatttggagctgaaaaacaggaaaaatgtgaaaaaaaaaaccgcccactacataaggactacacacccggactttttagaaggcaaattttatcgttatttttaggctatgatttatttcagacccagcagttttaggctcagagtaaactgttaaaaaattgaaaaaatcagccatcaattttggtttttcggtcatctgacgaaactttggagagctaaattttttgtctctcaaataacactttaatagttttttagaactgtgtttttctgccaaaaacctcaaatcacaaagttcaagtgtattacatgttgtttttgactttacctcaattcattctcaaccaaaaattcaagaactttctctgaacacatttacttttctttcccatttctcttccgtccgtccaactattttttattattatttcttcattcgatttcttctcactcggacacccctctctccattgtataccgcgcacgcggtttgggacgactggtcggacaaataaatatgtatagatagtatatatataggtataatgcaaatggttttaagcaaacattacggaaaactgcgaaaatttctcatttcggagaggtgaggggagataagtttattttgatttgtttcagagcgaattcctttgttttaataactgtatcaaatagtttttcttagacttaggcttaggcgatggcgtagacttaggcttcagcttggacgcctaaagctaggctctcaagattgagtgggtacggtagcctttcaaggtggccttcatctacttcatgtctacattcgtgcctactgccgaagttctcataccatcctgtattagcccgggctctgggaaatttgaaaaatcttctgaaacttcgaaaaacagtcacacccatctttgtgtttaggctcaatcctttcccgttctaaaaataagttggcttcatcgtttccacttcctcctccttctccttctcgctgtcaattttcatgagctcagtgatatagagagaaaaaagaaagaaagggtgaaatagggatagagacaacaaaacagaaaagcaattgttgaaaaaaaaaaaaaaaaaaaaaaaaacagaaaaccgaaaaaagtgagataaagtgagatagaacgagaaagagagaagggccccctttgtaaatctgcaatgttgtgagatgcgtgtgctccctccatttgctcgggcgccaggagagaacgctccatgagttgtgaggagcacaacggtgcggatgtgccaaaaaccaatttcacggggaaaggcacgcataacaatgtgacagactcttattttcggaagatgattgagatgagacagaagtcaatttagacgttgttcttgcgcaaagaaagtaccgagaggttgaatcaagaacaaataattttggcggcttgtatcccagttgtcttaaatttaataaaaactttgaactgaaaaaatatttgctatacatatgtttttctataatttcgtatttgatcatttattaataacttccaaaagaaccaagctatgtgccctagaagtaaagtggcggactgaaaaaaatctcaaaaaaatatcaaattctcctgcaaatttaaattctaaaatatcgattggtgtctggatcacaagaatatccataaccaaaaatttcagatcgtttcactatgcctctgtgccattattttcgcgatgtttgccttcacggcgtgcgccgctcaataccaaaggtttgcatttaatgtccacttctttttctttatttcgggggctgtaaactcggaaaactgtcggaacacgttctgttagaaaatgatactgtatgtgttgaatgttcaggttctacatgccaacctcatttctatgcacttttttgatatgccttgtcacgttgctcatcttctccgcagagaatcaagctgcgtttatgactccagttgcaagtcttgccacaagttttcag

SEQ ID NO: 29395 - DNA, 982 bp, Caenorhabditis elegans
ttctcgacacagctgggcaggaagagttctctgcaatgcgtgagcaatacattcgtggtgggagaggatttcttcttgtattctcagtgaccgaaagaaaatcattcgaagaagcgcataaattgtataatcaagttcttcgagtcaaagatcgtagtgaatatccggttcttttggtagcaaataaggttgatttaatcaatcagagagtagtttcggagcaagagggacgtgaattagctgctcaattgaaacttatgtacattgaaacatcggcaaaagaaccgcctgtcaatgtggatgcggcattccatgaacttgttcgaattgttcgcagttttccaagtgatgaaggagatcatgaggtatacttctttattagattaacagttcccaagcagcattgtataaacaaaacttcaaaaaactatcaaattgtttgactactttcaagacaacctacgactgaatttctgtcttcccattgatttacttctgaagtaccagtctatgtacttatgcagacaggcatgagtcagatacataggcacgcagacatgaactatgcctgtagtaagacaagaatgagataaaaactacattaggtaggagttaggtatgaatgtagacatggtaggtccatagttacgtaggcacacaatcatgaagtagacacatcgtaaggcacgagctatgtgtgtagtcaggcaggaatgatataaaaaattaggttggaacagggctgcgcggcaattggaaatttccgaaattgtcaaacggcaattgccgcgcgaccctgggttggaaggaacacagtaggcaagtagtcatattagacaggtaccaaggcaggaaagtagagtgagcatgaagttgacacctatccctcgaattttgaaaattttgaacttttcaggcatccatggcatctgtcccacgaaccaaaaaacgaaaggataagggaaaatgtttaatttcctag

SEQ ID NO: 29396 - DNA, 602 bp, Caenorhabditis elegans
atggcccactggagcgcccacgttacggcttttccatgtgaaatggttagtctacatactgcgaatagcatctaactgaacacataggcaggcaggcgtttacgcgtgcctgcctgttacggtagctacaattctgaactatctaagtttgcgtacctttcaaaagtccatgtattcctagaaacatatatctaaactttctctttttctccgtcaagagccctcgaacattggatcttagtcttttttttcctaacggagaataatttccggattaaaatcaattatattcacttcagatctcaagagatggatcagtgggattcacggaaaaacgacaaaagccttctgctcttccagtcgaggaaccaacaattgccgtcttttggcagccggcaacgcttggaaatgtttggtatcgagagacttctggtaaatttggaatcttagctttaatttctacagttccttaatttttagatatcaacataatgaatcttgcccataacgaagtgaatattcaatatagatatggtgctcaatttagagttcgttcagttgtcctcattacatgggaaggtgtcaaagatcctctcgttccg

SEQ ID NO: 29397 - DNA, 257 bp, Caenorhabditis elegans
attccaatagtcattcttgccaacaaaatggacatccctggagcgatgactgcttcggatattacggtagctctaggtactcccactttttcccttcccaactcttcgacatattatgttttacaggcctaaacctgtatcgtagtggtacctggtcgatacactcaacgtgtgcactcactggagatggattggacaaggctatgcaacaactttcagctgaaatcacaaaatatatggaatcaaggagaacttga

SEQ ID NO: 29398 - DNA, 971 bp, Caenorhabditis elegans
atggagcatcgtgaatatgttaagaacaacatgccattgatcggaattggcacgtggcaggtattgacttcgaataaatcaattttttgactaaaaaataaatttaaggttcaaaaagaagaaattcttcgtcaagtgattgatgcaggtttcaaagaaggatatcgattcattgatacggcacaagtctataacaatgaagctaaaattggtagaatcttggaaaaattgcttccagcaaatgggttgaagaggtaggttttaaaaaatttataattgtttctaaatctttttttaatcctgcgagaaaaaactggttttggtgtttctttgatttgaaacccattttctctaattttcagcaaattgtttcgctaaaaatgtttaaattgaaaaatgaaaaaaaattcgacaaattatattctaaaccaataatcaaagcaaacatttaaaaaaatttaaactaggttattcattcaatattatgtaattcaaatatagttcagccacttttaatctacaaaattgagaaataatttttaaaaattcaataaaaccacagagccaccaattgaagctatctttttttcagagaagacatctggatcacgtcaaagttagccccatctaatgctggcgttaagaaagctcgggaaagcattgaggagtcactgagcaatcttaaagtcgaatatttggatcttttgctcattcactggcctggaagttccctgaaaagcgaaaatccggcaaacaagaaactgagagtggaaagttggaacgttatgtgtgaaatgatggctgaaggaaaattgcgttcagttggggtctctaattttgagatttgtcatttggaagaattgaaaaaagattctaatgttgtcccagcagtcaatcaagttgagtatcatcctcatttccatcaggacgatctggtcaaatactgtaacgaaaataacattcatttccag

SEQ ID NO: 29399 - DNA, 1853 bp, Caenorhabditis elegans
atgtcgcacataaaaatgtgtgcctttgaggagtactgtagtttccactttatctcgtttccttgcacattttgctgtttattaaataatcttttttcacaagtattaataagaatgccagaaaaaggaaaaattgagaccggggaccgtattctggcacgttgcaacacttgtttgatgttgattgtcttcttgtaatcctatataaaccaatagagggttcaaaaataaactagagaaagtttccgtgcgagtttgctcattccaataatatttctggtatgctcatgtttcatcattcttgtaaaaactattagcactgcctaacccccttatgcaaatacatatgcaatagatctatatttcctcagttcttcccgtttttatctctatatctctttctcttccacattatttccccacacacagttttcttatcagtttgtatcacctttcctctcttttctttccgtataccgccagtgagtcatctacacacttcattcacttctcactttttgattcgaaacgacatttccatttttttcatggagagaaaaggaagagtagtagagtcaataaatggtcttgaagtgacatctacttctttttttttgtttttattttcaaatcggtctttacattttcagcatatatttttttatgtttaggatcttgcgataacccccttattcttctcactacacatttcaccagattcaggcataacatggttttcattgatgttttataggtcttcgattgaaatatatatttttacacacgagaacaatcacataacattttttaaaaatgagaaaaattaaactcgatctgaaaaatcgatggtaacttcccaaaaacaaaattttgaaactacagtactatttgaaggtgcacatcgtttaacgaaaaattttcgtgtcgagaccgggtaccatattttcggggcaataatcgaaatttcgccttttttgttgccaactgataatacagctcaaaatttccaacttttcctcaacttatcctcttagtctcttctcttatcgtttctactaatctttgcactcgtttcgaccgcacaattccaattttcagttctccttctccacaacatgtttagtagcgaaggaaaattccgaaaaacctaccgtcatcagtttaatcaactacggacaggagatgagacagagattccaatgtcaacacttgcgtctcgaattgaaacacgaaaaattccattgacaaacgggcagattcatgcaattaaggaagctccagatgagttggtcgatattgatggatttcagaaaatcgtaggtttccagctatttttaaacttttttgttgcaaagtctgtgatgactagattattttgtaaaaaaatgagggcgactggttaagtaccaatgactcaattggtaggtagtaatttctgaggaaacatttcaaaattatttcgtaatccgaaaaatctacaattccgtaatgtagatcgtgccagacccataagcaaaattactatgagcctttaaaaactcgcggtttcgctgaaaaactatacagtatcatacatttttttgaataaacatagcaaaagtaattgtatgaagtttgcccacagttatgggcagaactattttgaactgagtgaatttaataaagtattccaaatacacatgtaatttcaggtgacttcaaaagctgcacaacgatcaacaatcaagcgtatcatgtatgacatggcagatcctataatgagcgacagtcagaagatcgaagttcactcctatattgactcatattcatggtgcccaccgccgatttttatgcttttgatcaccatcatccag

SEQ ID NO: 29400 - DNA, 1749 bp, Caenorhabditis elegans
atgtacgatgatgaggatgagatggttaatgacccgatggacggagactatatcgatgattcggatgaaatcagtgcagaagcatggcaagaagcatgttgggttgttatcagtgcttatttcgatgaaaaggtatttttgattataaaatcatgaaagaatctcttttttgaagggtctcgttcgtcaacaacttgattccttcgatgaattcgtccaaatgaatgtgcagcgaattgttgaggattctccgccagtcgaacttcaatcagaaaatcagcatcttggcacagatatggaaaatcctgcgaaattctcattgaaattcaatcaaatttacctctcgaaaccaactcactgggagaaagacggagcaccaatgccaatgatgcctaacgaagctcgtctccgaaatttgacatacgcctcgccactttacgtagatatcactaaagtggtgacaagagacgattcagcaacggaaaaagtgtacgacaaagtgttcgttggaaaagttccagttatgctacggtctagttactgtatgctttccaatatgacagatcgtgatctaacagaactcaatgagtgcccacttgatcctggaggttattttgttatcaatggttcggagaaagtacttattgctcaagaaaagatggcgactaatacagtttacgtgttctcaatgaaagacggaaaatatgcattcaaaacggaatgtcgctcttgtttggaaaattcatctcgtccgacatccacaatgtgggttaatatgcttgcaagaggaggaggtggtggaaagaagacggcgatgggtcaacgaattattggaattttaccatatattaaacaagaaattccgattatgattgtgttccgagcgctgggattcgtatcagatcgtgatattcttggacacattatctacgatttcaatgatccagaaatgatggaaatggtcaaaccttcgttagatgaagcttttgtcattcaggagcaaaatgttgctctcaactttatcggagctcgtggagcaaaaccaggagtaaccagagaacaaagaatcaaatatgctcgtgagattcttcaaaaagaacttttgcctcatgttggtgtatctgagcattgcgaaacgaaaaaagcattcttcatcggatacatggtgcatcgtcttcttctagccgccctcggacgtcgtgaacttgatgatcgtgatcacattggaaacaaaagactggatttagccggaccacttcttgctttcttgttccgttcccttttcagaaatcttctcaaggaggtgagctttcaatataattatatctcgaatgtattcaattttcagatgagaatgacagctcaaaagtatatcaacaagaatgacgactttgctcttgatgtctgcgtcaaaacttcaacaataactcgtggattgacatattcattggctaccggtaattggggtgatcaaaagaaagcacatcaatcgagagccggtgtgtctcaagtactcaatcgtctcacctacacggccacactttcacatttgcgtcgagcgaactctcctattggacgagaaggaaaacttgccaagcctcgtcagctgcataatactcaatggggaatggtgtgtcctgctgaaactcctgaaggacaggctgtaggtttggtgaagaatctggcacttatggcatacatctctgtcggttcgttaccagagccaattctggaattcttggaagaatg

SEQ ID NO: 29401 - DNA, 922 bp, Caenorhabditis elegans
atgtggccaccactaaattatataattctggcgaatgacgtcattgtcactttgatttttattggagaagccgctgttacgattaatcagaacggtttattcgataatcaaaactcgtatttacgggatcgatggtatcaatttgaattttttcttctcattaatcacattctatcatgtgttattcatatttatgaactttgctcaatatggtttccagcacttaattttgtggtaagtgccttttttgttgcaaaatttatgattttttacaaaaaaaaaataaattgaaactttataaaaattgcagtattatccatggcttggagcacttcgatcagctcgaccattcatttttcttcgatttattcgatcaatagtgaggtttaaacttcccaaaaatcgaattaaattaatcataaagtaagtttgattcgattttaaacataaatataaaaattaaaatgtttattcctcacaaaaatatccaaacaatttcagacgatcatctcaacaaatccaaaatgttacaatattcttcatgttttttgtattttcgtatgcaataatgggtgttcaattatttggacgactcaattatcactgcgttgtcaatggaactgatccaaataatgttacaattgccgatctagcaatccctgacacaatgtgctcacagaaaggagctggtggttacgagtgcccagggaatatggtttgtatgagattacaactgaaaccacaagaagaaggattctacggacaatttagtgattttgcaagctctttgttcacagtttatctggctgcatctcaagaaggatgggtttatgttttatatgattgtttggattcattaccttcatttcttgcatttttctattttgtaacgctcattttctttctggcgtggttggtgaag

SEQ ID NO: 29402 - DNA, 1075 bp, Caenorhabditis elegans
atgttctatgaagaaacgagctgctgtgaactcacaatatctaacctcattcacctgtaaatttttattttgcgtcctctttctaatttctttaaaatcttgccttattcgggtaaatcctttataatttttattttcagaatgctccgttcagctctccgggcaacagttcaggcacgaaatgcctccggtgttccaccaggtctttccaacatgaaaccacaatacaccggcgtaagtttctcagaacgttgttttaaaaaaattgcaaaaaagataggaatcacacaggataaccttgaaaatggagacaatgttgagagagactctaatttgaattttgaaagaaaaaattacggagcccattggatcgccaatttctaaaaacgttgattttcaagtaatttgtgtttaaagaaaaagaaaacaaaagtggaaattgtgcatcgaatcttattggtttttctcaaaaatccgtattttccgcgaaattcaaagttacaagaacatcacattacgtgcgctttgaaaccgccgttatcagaaactgcaacagaaaccaaaaagatgaatttgaaccttttgatctgtttttctgctgcaaaaatgttctcttctcatgttttcattacattatttcaacggaaccacgtgccctcaacgttgtgctctgttgtgtacctagtacacagagtacgatcaatttaaaatgatgataataaaaagaaaaagaagagagctgatactatctcatagggaaaacgtggtcgcctgaggtggagaacgaaatgaacaatgaactcggtcaacagtgagatagggcaatcaaaactgaacgatgatcggatttgagaaaataaacttagagggcagaattaggacgaaatgtgatacttctccaaatcagggattcaaatttcaaaaaagtttatatctaaatttccagatcttcatcaacaatgaatttgtgccagccaagtctggaaagacttttgagactatcaatccagccaacggaaaagttttggctcaagtcgcagaaggagataaaacagatgtcaatatcgctgtcaag

SEQ ID NO: 29403 - DNA, 728 bp, Caenorhabditis elegans
gaactctcccagctctagctgcaaatgttgctgaaaatgcagttctcttcactgcctatggttactgccaaaaaacaattgccacactgaatggactcgaagatgtcagacaaatgacaccattggaaaatgcattctccggatctcttgccgcagtttttgcagctaccgtactctgtccaacagaacttgtcaaatgtaaacttcaagcagctcgtgaaatgaagaagaagtgtacaccattctctgtttgtcgggatatcatgaaggatactggtgtccgtggattctttgttggaatgactccgactcttgcaagagaggttcctggttatttcttcttctttggagcctacgaaacatgccgtttcttattgactgatgaaggacagaaaaaggaagaaattggacttgtgaagacagcaatggctggatcagttggtggtatggcattatggacatccatttatccagcagatgtcgttaaatcgagaatgcaagtcaccggaggaggaacttttatgtctactttgggcgctgtcgttaaagagaatggtaagtcattattgagggataattaattcaatttcttataaaaattcaattttacaggaattcgtggactctacaaaggacttctaccaaccaatctaagaacttgcttcgcttctggatgtcttttcgtcgcttatgaagagacacgaaagttcttccactacgtcctctag

SEQ ID NO: 29404 - DNA, 1022 bp, Caenorhabditis elegans
atgacttccccatacgctacaatcgtcgacgctagagagttcaatgctccgatgttcgctgagaagatcgaccgtgctcttcgtgccggagagaaggacgctgttgtcaacgtcatcacctcgatctccaacgctcagcgccagcagctccgcgagccatacaagctcaagtacggaaaggacatcatccaggctcttgacaagaagttctctggagatctcgagaaggccatcttcgctctcatggaaactccattggattatgatgtgaagcagcttaaggctgccatgaagggattgggaactgacgaggctgtgctcatcgagattttgtgctccagaactgttgatcaactccgcgccattcgtgtgacctacgagaaggagtatggaaaggctttggaagctgacatcgctggagatacttctggagaattccgtgatcttttggtcagcttggtcactggatccaaagacggatctcatgataccaacgacgctcaggccaaggatgtaagttttctttattttttcactgtgatcaattattcattttcttattttaggatgctgttcgcctgttcgccgacggaaaagccaagcttgccaagaaggacggaacacacttccttcacatcctcgccactcaaaatcaataccagctccgcaaggtcttcgcctacttccaggaactcgctggtggctctatcgagaaaagcatcgagaaggagttttccggagatctccagaaatcctacctcaccattgtccgtgccgcttccgacaagcagaagttcttcgctcagcagctccacgcttccatgaaaggactcggaactcgcgataacgacttgatccgtgtcatcgtcactcgttccgaagtcgacttggagctcatcaaggccgaattccaagagctctactctaagagcttggccgacacagtgaagggagacacttctggagcctaccgtgacgctctgctctccatcatcaatggaaaccacgctactgcccactag

SEQ ID NO: 29405 - DNA, 512 bp, Caenorhabditis elegans
atgcaagcctggcacggaaatttttccatttcgttgcgagacccgctgccccgctcatcgggcggtctagcctgtttcagtgcaagtaagctaaccaagcgaattttttgattttctcaggcattttaggtgttcttttaaatattttttgcagaaagtcgtagtttttaatgttttttcttttttataataagcaccgaacaattttgttgctcgttgttacggctttttgaagttttaggttgaaaatttatacaatccaaataaattatgttttcaggggtacaaactatggcttcgcgttcgttagcctctatcagccgttcggcttcccgtctccttcaaagcaacgttcagaaatgcgctcttccagcagcttccagtgagtttttaaataaattatataaatttttcacaaaactattgcagtccgcctcagctcaaacaatgttgagtccaagaagggaattcacaccggtgttgccacccagcaagctgccgctgccaccaag

SEQ ID NO: 29406 - DNA, 353 bp, Caenorhabditis elegans
aatgttcaacgacaaaggactcactactcgaacaaccttggtgtctgttgaacttcctcctccacctcctccacctcctcaaaagccaccaaccaagcaactcaaaagtagaaccagaacttgaacttttttgccaatgaaccgattttagtcatttttttcatgttcattctacaagtcatgtttcaaagttacaagctttcaaaaaacatctttctgttatgataatgattagatttgacacagtggaagaattagttgagtctactaataacaccatttatagatcggctgctggagtaaatacaaagggtcttaaattaaaaaaaattctttcagttgcagaaagatga

SEQ ID NO: 29407 - DNA, 1156 bp, Caenorhabditis elegans
ccgtgttaaacttgcctacgaacatgcacaggatttcatcgagaacccggagaaggacttcacatgcgacgagcttcccgatatttcagatggaaatacgccttttgagatcaaggaaaagactctgatgttgcacagaatcgcgcaagttcttcgacaaaagcgtgaagatagtggagcattgcggatcgagcttcccagattgaaatttgcattggatgaggataagaagccacaaggagtttctatatacgaggttaataaacagttttttgttaaagaaaatgtgtttttatattaatttttgttttcaaacagcaattttttggtcacattttttcggttctagcaacaaaaaagtaatccataaatttagattttcaaaaatcggaaatttaaaaagaattgccaattttataaaatacaaatgttaaaatttcagatcaaagattcgaataaactcgtagaagagttcatgctgctcgccaatatggaagtggctaaaaagatcgctgaaaatttcccagaacacgcccttcttcgtaatcacccgccaccaaaagagaaaatgataaaggacgtggctgagcaatgtgcaagaattggatttccattggacggaagaacgtctggattactttccacgtcacttcgcaagtatcaaggaaaatcccgtttggatatgtgcattcgacaagtaatttcctcattgacaattaagccaatgcaacaggcgaaatatttttgcactttcgagatgcctctttcattttatcatcattttgctctcaacgtggatcattatacacatttcacatcgccaattcgtcggtatccagatgtgattgttcatcgacaacttgctgctgctcttggttataatgaaagatctgaaagagttcctgaagagatacaggagattgtaagttttcaaacactcaagaaatttttgcatttaaattttcagtgcacccgctgcaatgacacaaagctcgcatcgaaggaagcttcggatgagtctgcgatgctctattttggagttttcatccatcaaaccggtccgatgaagtgccaagctgttgttcttggtgtaatggatctctcattcgacgtcctcatcgttgagtatggagttgtgaagagagtttatgtggat

SEQ ID NO: 29408 - DNA, 409 bp, Caenorhabditis elegans
atattgagattctcgccgcaaaatccaactacgtcaccgacctcgacttgtcggataacgtcgagattagtgatccaggcctcgcagtgattctgaacaaattcccgagacttacgacaatttctctcaatcgatgctacggattggaccctaatatggttgtgtgagtttatttgaaaattagtttaatttatttaaacaaaacatttccagacacttcaacagtaagccttcgctcgtttatctcaacgttcatggctgcgtctctgacacgaacatggagcttttcctcgaaatgtgctccaatctgaaggtcaaccgtcagtacttcaacttcaccgccaaaccggtcagctaccaatgcgagtcgaatatgatctggggacagacaatgatggatatcgaatag

SEQ ID NO: 29409 - DNA, 1150 bp, Caenorhabditis elegans
atggattgtgctattgcagtgagagagagatggccgttctctgcttctctgcgtatcactgtcgcagctgtttctcttcttctcctttcgccgctctttttttgcatgttcgtcaggttcactatagcgatttcttaatatcgaaatttcacgagtttcagagttgattttcgaaagatcagtgaaaatattgtccacgtggtagagtttttcactgatttctcgaaaattccaatagtttctttaaaaatcacactcttcttctttgaacaattccatttcattgattttctatattttcgtacagaaataataatgtttcaacaaaaatatgttttctagcactgaacattcttaaatttgaatttaattttcttaatatcagatattcaaagatgactattcgtagattctgcaagttctttcaaaatactcaatttttctattttctctccaatttatttctccaaaaaccacccggtaatcaatatttcaacacattgctgtgttatcttcactgcgtctcctctctctctcttgttctcctcatgcccgatgataatccgtttctcttcccgttctttctcctttgaatagccgcgagattaattttcataaaacaaatttcagcactcttcatcatgtcggttgtcgaagaagccactgacgacgcgctctacccgattgccgtgctcattgacgagctgcgcaacgaagatgtcacgttgcgactgaacagcattcgcaaactctccacaatcgctttggcgttgggtgtggagcgcacacgcaacgagctcatccaatttttgaccgacacgatttacgacgaagatgaggttctgcttgtgctcgccgagcaactcggaaatttcactccattggtcggtggtccagatcatgttcattgtcttctccttccacttgagaacttggccacagtcgaggagaccgtggtccgtgacaaagccgttgagagtctccgcaaaatcgccgacaagcacagctcggcctcattggaggagcatttcgtgccgatgctcagacgtttggccactggagactggttcacatcccgtacctcggcttgtgggcttttctctgttgtttatccacgtgtcagtccagctatcaagtcggaattgaagag

SEQ ID NO: 29410 - DNA, 2256 bp, Caenorhabditis elegans
atgtctagctataatttaatttttccgggtgtacaaataatttccgtgcctttttcagctattcgccgtatgaatataaagtttttttttgtttttgaattttatttccagatttctattgcaaactgttattttctgtttttgtacctctttttcaaataatttttattctagaatttcagattttcaataccaattttcagatgacaattggccaagtgaacggccgcgctcgcataaaatccgagtgcggcaaggatcagaaatgcatgccactcgaggacaaatggcttctcgttcccgcgtttttgaaagttcgaggactcgtcaaacagcatctcgtcagtttcgatcatttcgtgcaggaggagatccgaagtatcatgctctccaatcagaagatcacttccgatgcaaatccaaacttttatctcaaatatttggatattcgaatcggaaaacccagcagtgaggagggtctcaacatgactcacgataagattacccctcaagaatgtcgactacgagatatgacctactcggcgccaatttcagtggatattgagtacacacgtggtaatcaaagagtattcaagaaggatctgatcattggtcgaatgccgattatgcttcgttcgagtaaatgtattctcagagatcttgccgaagaagagcttgcaagagttcaagaatgcccatatgatccaggaggttattttgtggtcaaaggaagtgaaaaggttatcctgattcaagaacaactctccaaaaatcgtattatggttggaagaaattcaagtaaagaactgcagtgtgaagtactttcgtcgacgtccgagaggaaaagtaagacatatgtgactatgaagaagggtaaatattctgttcgccacaatcagctcaccgatgatgtaccagtttccatcattttcaaggtaaattttgagaattttgatgacaactgaaaaaaaaaatgttcggcattcattcctaaatattttatttaaaaaaaaaaacatccaatacaaaaacattctccgaaaaatatttttccaaattttgatgcaaaaaatattctcaaaaaatgttttagaataaaaaataatgaagctttctttctttctgattgtgagaaactgaacattttacgatattttcaatcgaaattcctcaaaaacatttattatcgaatctggagtttttcagatttttttttccaaaattcgagttcgctttttttaattcaagaaaattattacaaaaaatagggaaaattttaaaaaaagtgtagcattatgttaaaacaaaaactaaaaaccgcttccttttcaaagtttcaattttccaggcgatgggagtcgaatcagattttgacattgtgagtacaatcggtcacgaggagaagtacgtttcagcatttgctcaaactctcgaagaatccataaatgccggagtttatacccaacagcaggcactcgcatatgttacctcaaaagtcaaggctcgtaaattcacaccattcggatcacttccaggaacttcagtgagcgtcttgactccaccgaaagaacacgaagcagtcgattttctgtccaattcaatgatcacacatattgcttgcccagatggaaatttcaaaatgaaggcgatttatttgggattaatgacaagacgactgattcaaacggaactcggagaaaatgggcttgatgatcgggatttctacggaaataaacgtttggagctcgctggatcattgctttcgttgctgtttgaggatgtattcaaaagattcaactctgaactgaaaagaattgcagacaatgcgttgatgaagacaatggctgcaccattggatattgtgaagcatatgagacaagatatgattacgaatactatagtgaatgctatgtcgacaggaaattggattatcaaaagattccgaatggaacgacttggtgttacacaagtactaagtagattgtcatatatctcagcacttggtatgatgacaagaatcaactcgacttttgagaaaactcgaaaagtctctggtcctcgatcccttcaaccatctcaatggggaatgctttgtccgagtgatactcctgaaggtgaagcttgtggtcttgtgaagaatctcgctttgattagtcacattacaactgattccgatgagaaacccgttctcagattgttactcaattcgggagtcgaggatttacataatgtgcatttctcgcatgtcaataagcc

SEQ ID NO: 29411 - DNA, 533 bp, Caenorhabditis elegans
atcaagaagatccgcagtggtgttacgataacttcatcaactacagaactatgaaaactgccgacacagtccgcacacaattgtcgcgtgttatggacaagtacaatcttcgacgtgtctcaacagacttcaaatctcgagactattatctcaacatcaggaaagctcttgtagctggatttttcatgcaagtcgctcatctggaacgaagtggacactacgtgacggtgaaagataatcagctcgtcaaccttcatccatccacagttctcgatcataagccggagtgggcactctacaatgagttcgtgttaaccacaaagaacttcatcagaactgtaactgatgtgcgccctgaatggtgagttaatttgcaaattatattattcaaaacctaactagatatgcgtttcaggctacttcaaatcgcccctcaatactatgatctcgacaacttcccagatggagacacgaaacggaagctgactactgtgatgcagaccctgcagagaaacgctggcagaggctattga

SEQ ID NO: 29412 - DNA, 588 bp, Caenorhabditis elegans
atggctctcagactcgccgtcagctctgctttgcgtccggctctcaatagccaggtaattttcttgtgagattgctaaaagagaaataaaaactcttaattgaaaataaaattgaaagttgtatgcccacaggtcgcatggagaacgtaacaacgatgataatgtagaaaatctaattaaattaattaattttcaggttcgcaatgcttcatcagctgtctccgtgaaggacgtgcttgccagcgctccacaagctgaagttaccaccttgaagaatggcttccgtgttgtcaccgaagataatggatccgccaccgctaccgtaattttgcccactagttttctaaaatttcttttgttttaaattgtaggtgggagtctggatcgagaccggatctcgttttgagaacgagaagaacaacggtgtcgcacatttcctcgagcgattgatccacaagggaactggaaagagagcatctgctgctctcgaatccgagcttaatgctatcggagcaaaactcaactcgttcactgagcgtgaccaaaccgcagtttttgtccaagctggagctcaagatgttgagaaag

SEQ ID NO: 29413 - DNA, 1305 bp, Caenorhabditis elegans
atggactcccaaaaattgcggactgagggtaagaagatgctggattttgtggcggactactgggatggtattcgtgatagaaaaccactgcctgatgttaaaccaggatatattaatgatttggtgagtttgtgcccataatgaaagttgcactcgtttttaaggttttttttgtctttaaatcagcggccgatagtttactaggccacgagccgacaatgtattacaattaggccgcaaacccttttaaataaatttccaggtaccagcccaagcccctgccaccccagaagactgggcaaaaatctttgacgatctcgaaaatgtggtggtgaacggagccactcactggcaccacccacacttcttcgcatactttccaacagctctcagctatcaatcgatcatggctgatatcctatccggcggaattgctggaatcggattcacatggaaatcgtgcccatcaatgacagaactagaaatgtcatctttggattgggtggttgatcttatgggattaccagaacatttcaaaaactcacataatggtccaggatgtggaattattcaaagtaccgcatcggatagtacaatgattgccattatggctgcgagagctacacatgttgagagaatcaagtcggagccaacttttatgaaatgggtctctgaaactggagttggcaagacactcaaaaacatattcgatagagtcaaagttaacaaggtgagccattaagttcttatgatatcaaaagtcaactggagaattattttgacaatagtatgatatctgcaagattagaaaaattatgcctatttcggccagatggcaatttcgcacatattttagacgttggttgcacgagcttcagtgactgtaagttgatcgtattgtgattgtggttgagaaatgtacagggctaacatttaaagagtacgtacgacaccactaatgttcacggtgttctaggtcagtgattacgtcaccaaaccgcttctctcttagcggtccccgcgtttccatttcagacttaacgttaccaacgccttgcaattttcaaagccaatacgatcatcaccacagttcaggtggacgacgaagcatctggaatgataacaccgtacttccacgatccaacagtttttgagagatttgtcatgtattgctctgaccaggctcactcttccgttgaaaaaggagcaatgctctccgccgttcgaatgaggaaactcaaggcgacacgtggatttttaggaaactacggagtttccagggagacacttcagaacgctattaaa

SEQ ID NO: 29414 - DNA, 1126 bp, Caenorhabditis elegans
atggattccgcaaagcttcgagtcgagggaaagaagatgattgaaattgtggcaaactactgggatggaataaggacccgcaaaccgattccggatgtgaagcctggttatattgagaaatcggttagttttttgtcgatgtgaactacggcacaataaagatttccaggtgccatctaatcctccaaccacgccggaatcttgggaaaaagtgtttggcgatctggagaaggtgatcttcaacggaagcagccactggaaccatccacatttttttgcctacttctccgctggaattggttatcactcgattctggccgacattattagtagtggacttggatctgttggattcacgtggatcgcgtgtcctccgatcactgagcttgagaagatcacattggattggctcgtagatttgacgagtcttcccgtggagtttaagaattcccatccaggtcatggttgtggaattattcagagctctgcatccgattcaacgctcatcgcaatcatgactgcaagagctgcaaaggtggagttcatcaaacagaatccatcaactttccaatggcttattaactcaacttctgagcatcttcggagcatctcctactggactcccgtgaatcggacaatccatgattccactgacatcatcactccgtactatcatgatcccagagttttcaagaactttgtgatgtacttcactgaccaggcacactcttccgttgaaaagggagcaatgttggctggagttaggttcaggaaactgagaagtgtgaggggatatatggagaattacgaaatggattcaaagattttgatcgacgctatagaggtaagtggaagctcctagggtgtagaaatctcagcgaccaataagcaacgttagaaacgccctctgctgatcgctgattggtcagcgctctcaatatttgcgcgcaaaaaaacctattttctaaatcccaatacagaaatttctaattttttcagcaagaccgttcccgtggcttcatcccatttatggtggctctcacagtcggaacaactgccacgtgtgcagctgatgatgttgagaaaatcggtcaaatctgtcagaaagagggtctctatctccatg

SEQ ID NO: 29415 - DNA, 938 bp, Caenorhabditis elegans
atgtacacatttcagtcggtctcacagcagcggagtgaaagctacatacaactcaatcaatataggctaatggaggaaattggacaggtgagccggtttttttaattgattttaagttaaactgttttgttattgttttagaattctatgcgtagatgattttagttactgcaaaaaacaatttccactttttttagtcagattttgatattcaaatgaaatctaagtttttataattggatggtgtattggattggattggatggtggttagattactaacccgtttactgaaggattttaaaataaaaaatcgaataacaaattctgaaaaaattgaaacttttcaacaattttttccttccagggctcatatggaattgttaaacttgcgtacaatgaggaggacaagaacttgtacgcattgaaagtattggataaaatgaagctcttgaagaatttcgcatgttttcggcagcctccaccacgaaggaataaggagaatgcggcaccgtctgtgctcaggaatcccttgcaattggtacaaaaggaaattgcaattttaaagaaattgtcacatccgaatgtggtaaagcttgtggaggtatgaacaagagacaagctttttgaaaaatgacaccgaagttttgatatttttggaattttgtaaaatttaatttttagttaagcgaaaaacttcaccacttgttaaaaaattacaattttcagagaaaatttaaattttcactgagttaataccaaatatacagtaatcaaataccaaatttcaggtacttgacgatccaaatgacaactatttgtatatggtatttgaatttgtggaaaaaggttcaattctagaaattccgacggacaaacctttagatgaagatacggcgtggagctactttcgggatacattatgtggattagagtact

SEQ ID NO: 29416 - DNA, 640 bp, Caenorhabditis elegans
atgggaaacgtgttcggcagcttatttaaaggcctcttcggcaaacgggagatgcgtattctgatggttggattggatgctgccggaaagactacgattttgtacaagttgaagctgggcgagattgtcacgactatcccaactattggtgagtcattgggacgtttttttgttgcgaaagaacggttcacaatgagtcataatttttattcatatttcaggattcaacgtggagactgtcgaatacaagaacatttcattcaccgtgtgggatgtcggaggtcaggacaagatccgtccactctggaggcattatttccagaacacacaaggttagtgatttacgagaatagtttgcggatcagcttatcacccgcaagaattcacagactgtccaaaaaaaatgctctattgattatattttcttgcaggacttatctttgttgttgattccaacgatcgtgaacgtgttggagaggctcgtgaagagctgatgcgtatgctcgccgaggatgagcttcgtgatgccgttcttctggtcttcgccaacaaacaagatcttccacaagccatgaacgccgctgaggtcactgacaagctcgggctccactcgctcagaaatcgatcgtggtatattcag

SEQ ID NO: 29417 - DNA, 752 bp, Caenorhabditis elegans
atggatcttgcgcagtggctcctagctcagatcccgattgagctctgccacgtggttcctctgggcgttgggtcctagatattgaaattttattgggatttcagaacttggttaattcgattgaaaacctagaagtcgatggactcactcaatatcgcgattacactggttctcaagcatattattcagacactttatttgagttaaaacttaaaaatacatttcatttgtattatttttcgattcacgtgttttcattatttaaatattttttgcggaaaaatatttcaactaaaacactttttgaataacgcgcgcttttcttgcgggtttcgcaacgattacagtaccccactgaaaattttcaaggcgcgattatgattttcggaagttagtcttgaagcgactttacaaaacatctttgatctagactttgacccaccgttattcttagcgggaaaatataaattttcgcccaaccctaacttgatttctttcattcacgatgcggttttgttttttcttctacgccttttttccatcttttcatcaaatttaaaattttcaggctatgagccagcaacccggatccgctcgacgtgtgaacttcccagaggagccaatgtaagaaaattagatttatttcatatttaagtttcttcaatttcaggacgctgggagaaaagttcagccatcgaatggatcagttaaaggaaataatagccgatggaggttgctcacgtgctgcaaag

SEQ ID NO: 29418 - DNA, 894 bp, Caenorhabditis elegans
atgggttttgagatgaaaaacaacaaaagttcagatggatctgaagaagtgaagttttgttgtaaatccttgaataaattagaaatagatttataagtcaacctctcttttttaaattccatccaacttctcgattatgaattcattctttttccattctaatttccatttccaagtcagcaggtgatatagattttcggtcagtgacacgcaaaaccaacaaggctaaactaaaatgacaggggcaaaccaagaattcaacatttttcaggctgcaaccttagcgaaaatttatgcgacaatgacgaatcgtgctatccagacggtgtattcggtcagtgctactcatcagagagcggatcgccggagccaactgttctagacaacttagatgatactcaactggaattattgaaactcgagttgacaaggttagtaaattatgaccgggagttgacatttggtgtctaaactgatgagtgttatcttgatggctgtgccaccggtcgcatcaaaagcatccacagtacatcatgtcttaagcggaaaaaagtagaccgtctgtcaccactttaacagacagttatagaattaccttcttaatatttaggcttgccgccaaagacaaggattggggagacgaggaaacacaatgcgtactcgcttacttcaaaatgtcaatgttctaccaattgcaatacgatccagacttctgtcaagtccgaaaacctgccaacgtatgggcactcattcaactaatcgacactggtctcaccgaggatccgactattctcgacgaggacgtgaatccggaaaatgtgaccgatgaggatatggctcaaattatcgagcaactcaaggaaccatccctgccaacggaagaagatattgaag

SEQ ID NO: 29419 - DNA, 495 bp, Caenorhabditis elegans
gtatcgacgtcaaagatgtatcactggtactcaactacgatatggcaaaatcaattgaagactatactcacagaattggtagaactggtatgtttttattcactttttctgtggaaattttttgatgaagtgtaattttctgttttgggaaaatatgagattcttgaggacatcatttttttaaaatttatctccacatagtatgatttattacaacggaaaaaagataaagaacagcggagcagtaagaaattatttaaagaaaattttaaaaaatgaaaaaaaatgcgtagaagttttcataaattttgaagctactagcatctgaaaacttccacacttttcttcttgatcacatataataatttcttttaaatttcaggtcgagctggtaaacatggaaaagcaatcacattcctcacacctgacgatactgccgtctatttcgacttgaagcaggtaaaaattgtgacggaaaccggacaccaaaaatga

SEQ ID NO: 29420 - DNA, 1157 bp, Caenorhabditis elegans
atgcgttgtcgacgccgttttggcaatccgtcgtgatggagaggaaccagatcttcatatggttgaaaagatggaaatgcaccacgacagtgatatggataccacacttgttcgtggattagttctcgatcatggagctcgtcacccagatatgccaagacacgttaaagacgcttacattctcacttgcaacgtttctttggaatacgagaagactgaagtcaactcgggacttttctacaagaccgccaaggaacgtgaggcacttctcgctgccgaacgtgaattcattactcgtcgtgttcacaagattattgagttgaagaagaaggttattgataattctccagatggtaagaataagggattcgttgttatcaaccagaaaggaatcgatcctccatctcttgacttgcttgcttccgaaggaattcttgctcttcgtcgtgccaagagacgtaacatggaacgtcttcagctggccgtcggaggagaagccgtcaactcagttgatgatttgactccagaggatcttggatgggctggactcgtttacgagcattcccttggagaagagaaatacacgtttatcgaggaatgccgtgctccaaaatctgtgactcttcttatcaagggaccaaacaagcataccatcactcaaatcaaggatgctattcatgatggacttcgtgctgttttcaacaccatcgttgacagtgagtttaaattttattaacttctgttctagtaacctattttcagaggctgttctccctggagctgctgctttcgaaattgctgcctacgtgatgttgaaaaaagatgttgagaacctgaagggacgtgccaagctcggagctgaagcgtttgctcaagctcttctcgttattccaaagacactggccgtaaatggaggatatgatgctcaggaaacacttgttaagcttattgaggagaaaaccgccgctggaccagatatcgccgttggactcgatctcgaaaccggaggagctgtcgagccacaaggaatttgggacaatgtgacggtgaagaagaacagtatctcgtcggcgacagtacttgcatgcaatctcttgcttgttgatgaagtgatgcgcgctggtatgaccaacttgaagcagccacaaccagaataa

SEQ ID NO: 29421 - DNA, 1437 bp, Caenorhabditis elegans
atggcgtcgcaattgctgatcaacgattcaaagtacggattcctgaaagagcttggtctcacggagaacaacgccggagtctttcatggaaaatgggcggcgagtggacaagttgttcagtcatttgctccagcaaataactcccctattgctaatgtaagtttcaaaaacataccctaaacgttttaaaactttcaaattccaggtacaaaatggaaacgtacaagactatgaaatcgccatctctgaagctaaaaaggcttataacgattggtgcgaggtaccagcaccacgacgtggagaaatcgtccgtcaaatcggagacaagctccgtacgcagttgcaaaacctgggaaagctcgtgtccctcgagatgggaaaaatttctgccgaaggagttggagaagttcaagaatacgtcgatatttgcgactacgctactggactctctagatcacttgaaggaaaaatctttccttctgagcgtccaggacacgctcttctcgaacaatggaatccacttggagttgttggtgtgatttcggctttcaatttcccatgtgcagtgtatggatggaataacgctttagctcttgtcacaggaaattctgttgtctggaagccagctccatccacaccattgacagctattgctgtgaccaagtaagctcgcttatttcataattgtaatcactaaataactattttcagacttgtcgaggaggttcttgttgccaataatgtaaatccagctctctgttcccttgtctgtggagagggtgatgtcggtcaagctcttgtgaaggataagagagtcaatctagtttcattcaccggttcatcagaaattggaaagatcgttggacaacaagttcaggctcgtttcggaaagcttctactcgagctcggtggaaacaatgctatcattgttaacgaggatgctgatttgaacatggttgtaccggcaacagttttcgccgccgttggaactgctggacagagatgtacaaccacgagaagactcattgttcacgataaggtttacgatcaagttctcgagagattgaagaaagcttatgctcaatttgaatcaagaatcggatgtccattggattccaacacaattattggcccacttcacaaccaacaggccgttggaaagtacaaggcttcagttgccgaagcagttgcttctggaggaaagattgagtacggtggaaaagttcttgagagggatggaaactttgttctcccaacaattgtcactggattgaagcacgattctccagttgttcttcgcgagacttttgccccaattctctatgttctgaagttctcaaccctcgaggaagctattgcaatcaataatgaagttgatcaaggattgagttcttctctatttacaacaaatattcaaaatgttttcaaatggatggg

SEQ ID NO: 29422 - DNA, 1028 bp, Caenorhabditis elegans
gcacaatcggaaagcgtcttgatgccatcaacctcgaaaacaacgagacaaatcgtcagaagtatcgtcaactcctgttcactactccaaatctcaaccagcacatctccggagtgattctctacgaggagacattccatcaaagcaccgataagggagagaagttcaccgatcttctcatcaagcaaggaatcgtcccaggaatcaagctcgatctcggagttgtcccattggctggaaccattggagagggaaccacccaggggctcgacaagcttgccgaacgtgccgctgctttcaagaagggaggatgtggattcgccaaatggcgttgtgttctcaacatcggaactcacaccccatctcacctcggaatgctcgagaacgccaatgtgctagccagatacgcttctatctgccaggccaacggacttgttccaattgtcgagccagaggttctctgcgacggagaacatgatttggctcgtgcccagaaggttactgagcaagttcttgcctttgtgtacaaggctcttgctgatcatcacgtgtatctcgaaggaactcttctcaagccaaacatggttactccaggacaatcgagcgcgtcgaaagcttcacacgaggcaattggattggctaccgtaaccgccttgagacgcggagttccagctgcagttccaggaatcactttcctgtctggagggcaatccgaacttgatgccactgctaacctcaatgctattaactcggtaaatttaaacgaaatggaataaccttatatcactcatttctatttacaggttcaactcggaaagccatggaagctcaccttctcttatggacgtgctcttcaagcttctgtgctcaaggcatggggcggaaaagacgagaacatcgctgccgctcagaagacactccttcaccgttccaaggccaatggagatgcatctctcggaaagtacgccggagaagacgcagctggagccgccgccgagtctctcttcgttgccaagcattcctattaa

SEQ ID NO: 29423 - DNA, 590 bp, Caenorhabditis elegans
gaaatcgtcttctctcccatgatgctacaaaaggagccatgatgatctacttctaccgtgacatgccacgtttctcacagccatatcagatccttacattcctgatggatatcgacagtttgttcacaaagtggagatgtaagtttttgaattattaagaatttttaaatttttttctaaaaacgacattaaaacactgtttaaatgcatcacatttcacgcccgactttgatttctgtggttctagttctataaactacagaactactgtaaaaattacaaagtactccaaaatccccgtcaactaccaactgcacaaagagcaaaacaaatcatttaacaacatttcagacaaccacgtgcttcttgtacaaagaatgctgggtgctaaacaaggaaccggtggctcatcaggatacatgtaccttcgttcaacagtcagtgaccgttacaaagtattcttagatctattcaatttatcaacatggttgattccacgtgaatacattccaatgctttctcctcgaatggtcaaaactctttccgaacattcaaatctttcacattcccaatcatcagaaagtgattag

SEQ ID NO: 29424 - DNA, 824 bp, Caenorhabditis elegans
gttctcatcgctcgcgccatttcaaaacatgttccactttttcaaactcctccggtatctgcctaccaatttgctcgagatatatcaccaggaatacgtggagcacatcaattctccaacgtttccatggctcttcaattggttcgtgcatgggcggaaaaatgtggcttcccactgccaggagttccattgtccactgacaccagtggcttcaatgttccattgtggatgtgtgatgccatagaatcttgccgctggcctggaagaagtcaaatcgtttctacagatcgtaatgtcacgtatcttttggacggagcacatactccaaaaagcatggaagcctgctccgagtgggcagccgaggaaattgtgaatttgaaaaaggagaatgtgaagaagatcctcctgtttcaatgtactgctgacagatgcccatctactttgattaaatatttgaaggtaatatctcagatgtttgtatttattctctaacctataaaaagattcagcctctcggaatctcccaaatcgtttcatgtccaactcaactccactcgagcattgataaatctgctgattcggccaacctgaacgcttctcgagatgaacaagcagagaaggcaaatcaatgtgtgcaggcatggaaagaatctctggatcaaccggaatctgttactgaagatcaaatgaaagtatttgactgcatatcaagtgcgtataagttcatcgaatcccaagcagcatctcaggaaatcctcgtccttgtcactggaagtcttcatcttgttggcggagttcttaatttggctggaaaaggaaaataa

SEQ ID NO: 29425 - DNA, 836 bp, Caenorhabditis elegans
atgggtaacacgttaactggacgttcgaacgctatcgcaccgattatcagtgcggaagatgctaaaacttatagtgagtttcagggatgttacaaaacaaacataaactcaaatttttagtatcggacgaggagtatcgacgaattcgccaagctttccaacgcttcaaaaatggatgcattaattatgacgtaactgtttttaattatttttttaacttcaccatttaaggaattctgctatcatgttctcggaggcgcgcagataccagaagaaaaacgacgcctgctgttcagcttcttctctcatggcgctgaaaccatttcctttgacaatttgctttcatctcttgttggattgtgtagagtagaagaagtacaatcgagtcagtcaagaaacatttcagaaataatattaaattatttattttcagggtttatcgaagaatatcacgagttcgcgtcatggggattgagtcctcctaagcttacgattccgctcaatgattcctatatctcattttacgaagtgatgtcttatgtgacgcattgtaagatttaaattatcttgatttccgtatttcaaaaaccatttttcagtatccgtgaacgaggttatcgagttagagaaagtgttcgccacgatcagtgatcgagctgtctgcaaactgaatgaagagaagtggaaacaagcattgggtggatgcttcccggatagttatgctgagagattattcgctgttttcgatgagaatcgagatggtcaaattgacttcagagagctcgtttgtacactttcggctctttgtcgtggacctctaccagggagaatttctc

SEQ ID NO: 29426 - DNA, 684 bp, Caenorhabditis elegans
atgaccgacgatgtggacacgcacattcatgagaaattcgacttgcaggttagttgttttgtataatttattttcacatttgggaaatgtttttttttgagatatataaattttcaagattaataaaaaaaattatattcaccaaaattcaatttgaaatactcggagcgtgagtcgttgctgattggcaaatttcttcccaaattcaaagtttttctagcttttctggaattgttgtctttgtctgttttatccacgaatacatataagtatgattatatataaataaatattaaaaatagatttataataaatattgcaagtagcccaattgagctatgtaaattggaaaaaaaaataggcccctgtctctaaatatcagggggggggggggcttgccacacaagtgagactaaaaatcataattttagaaacgtctcggaaaaggtgcatatggaattgtgtggaaagcatacgacaagaggtcgagggagacggtggctctgaaaaaggtgagatttcttaaccaattttcataaataactgtttttttcagattttcgacgctttccgaaatccgacagattcccagaggacatttcgagaagtgatgtttcttcaagaatttggaaaacatccaaatgttataaagttgtataacattttccgagcagataatgatag

SEQ ID NO: 29427 - DNA, 397 bp, Caenorhabditis elegans
atacggttatgaagctctcgcgatcaatgaatgggattcgatcaaagtgattccggagtgtttcaatagttcaatgactgcgtttgcgttggatagctgcccaaaaaatgggcatcaagttttggaatcggttagtgttttggattattagaaattaatttaggaacatttaaaaaatctgtttctcagtgttggattacttaaccaaactaaatcgtagactttttggtgtttattttctgaacatcgaataatgctcaaaagaagtttttcacaacgaggtggaactttcattgttcaagcttttatggtttaaaattacagatcgatttctcggcttcgcataaaatttttgatatttcaattctgtttggaatgttcatcggaattcgcataa

SEQ ID NO: 29428 - DNA, 1174 bp, Caenorhabditis elegans
acgaaaccgtaccagccgatgtgaactgtgctattgaagagaacatcgctcttgacaaagtccgtgcggagccattctcccttccagccggattccgctggtccaacgttgacttaagtgacgaggagcagctcaacgagctctacaatcttcttacccgcaactacgttgaagatgatgattccatgttccgcttcgactactccgctgatttcctgaagtgggctctccaggtgccaggattccgtcctgaatggcattgtggagttcgtgctgacagcaacaaccgtttattggccttcatcggagctgtcccacaaaccgtccgcgtgtacgacaagactgtgaacatggtggagatcaacttcctgtgcgttcacaagaatctccgttctcgacgtgtggctccagtgctcatcagggagattacccgacgtgtaaacgtcacaggaatcttccaggccgccttcactgctggaatcgttattccaaaaccagtttccgtgtgccgctactatcaccgatcgctcaatccacgaaagcttatcgacgttcgcttctcgcatttgtctgccaaaatgacaatggcgagaacaattaagctttacaagttgcctgaggagacggccacacgcaaccttcgcgagatgaaaagtaccgatgtaccacaggttttcaagttattgactacaagtctgaagcaatactcattggctccagtctacaatagcgaggaagaacttgctcatgcccttgttcctaaaaagggtgtcgtgtattcgtatgtagcagaggtaagaataattagattagttatttgtttgatgtttcaaaaattgtatttcagaatcaaaacggtaagattaccgatttcgtctcgttctactctcttccatcaactgttatgggacacacgacccacaagaccatctatgccgcttatctctactactacgttgctggatcagtgacccccaagcagctcatcaatgattcccttattctagccaaccgtgaaaagttcgacgttttcaatgctctcgatctgatgcacaacgagaaaatcttctcggatctcaaattcggcaaaggtgacggcaatcttcagtactatttgtacaactggaagtgcgccgacatgaagccaagccaaatcgggcttgttcttcaataa

SEQ ID NO: 29429 - DNA, 1007 bp, Caenorhabditis elegans
acctagaagagttcggctccgatctgatggaaattgctgcagagatgggtgataagggtgcaatgctgtacatggcacacgcttatgaaactggtcagcatctcggaccgaatcgaagaacggattataagaaatcgattgattggtaagaaatttatgagattctagtgaagatacagtaacccgactttatagagaatacttttaagaaacctaaaaaagctaaaatgtttgatgctatagcttctaattttttttaattgaaaattttttcgaatagccggaaaattgaaaatcgaaaaaaaagatttagaatgtaattaacagatttgaaatttcatcaaactttgtttgtttcgatggaaattttttttcttctaaataaaaatttcaatttacgaaaaaaaaaatcaaaaaacgaagattttcgattttttgaaatttgaatttttgaacatttaggaaatttggaaattgaaattgaaattttttaatcgaaaattttttaaaattcgaatagaagtacccgtctctgattcattttttataagaaaaattgtgaaaaaccagaaaaactaggaaccttcaaaaaatatgttcagaaaaaactaaatctacttgttgtatttttcaaaaagaaaatcatatatgacctatttgcgatttttattctggacttcttggatgattttgttccttaacattttttctataaacttgagaaatattctaaattttgtaggtatcaacgcgtcgttggattccaagaagaagaagaacttgactctgattgtggaaaaacgacattctcctcatttgctccactgactcgtcacgagattctagccaaaatggctgaaatgtacaaagagggaggttatggcctgaatcaagacttcgaacgagcatatggtctattcaatgaagctgctgaagcagcaatggaagcaatgaatggaaagctcgcaaataaatactatgaaaaagcggaaatgtgtggagaatga

SEQ ID NO: 29430 - DNA, 2328 bp, Caenorhabditis elegans
atgtcgaagaagacgagagtcccagaagtcgccgatgattgcacgaagactgtttatcccgatccgatccccatgccaacttgcccgcaactgatcaatgacggaacatcgtgcttcctcaatatcatcctccagatgctgaaaagagccaatttccacgatcatttcaaaggagattggcagaaaggaaaacagaagatgttgatgcacaaggaactgcaacaaatattcaacgggaaaccagggccgaaggatgtcagtcgtttgcgggagatgttcagcaatgaagcactcaaggatggcccccatccactcttggttgctttgaaatgtcttatcaaagtgagtaatagatattaatataaaagttataacttattaactgataaaaccggtgtacatatttatcgtagagctgaccatccggactgcgacatccggacacgactttccaacatttagccacgcccacatagagacccacgggtggcaaatgatgctggcagtttttttttattaatggacttatgggagcgtacatcccgacagtttctgggctctgccgcttactatagaaacgcaggaatttcagagtgatacgcgggacccagaaaatgtcgggatatatgtacgctaccataagtccaatgattaaaagagtgcccagcatcatttgccacccgtggagtctccatgtagacgtggctcaattttggaaagtggatcacatacaaaaagatcagtgggtacgtgtggacgacgcaaacgtcccgacactctatcgaagcccagagacactggacaagatgatgagacctgaggactgttcttgttcgcaaagtgttgagaacttctgttttttttttaaattctgtgtaataaacttattctttgattattttctggagaatagctaaatgtaaaactaaaactatcggagcgcttcgttgcaatgttttccttagagctggccatccggactgccagacgtccgggtatccggatttttggcatccggattcccttcctttagccacgcccacatagtccccacatttcacagtgaggcgcggaacccagaaaatgaccggatatacgctaccataattttcagcatcatttgccacccttggagtctccgtgtacataatagctattataatagacgacattgctggtgaaatcgaggaacttaagaattaaaaactaatgtgattttatgtaaaaacaataaagttttatttttcaaacgtgaaattgatgttccaattttcatagttgaaaaaaagtttgagggggggagttcaatggaaataaaatttatttattcccaatcttcaaaaaatttgaagtgaacattttcgttctttattcattctattattgcaaacttggaatttgacaaaaagtgatacaatgtcgaagaaaccgagagtcccagaagtcgccgaggtaagattttggtgttaattgatttgatgaagtaattaaaagcgcaaccagacggaaaatatagcgatttgtgtgtcaaacatacggtatccggtctcaaaacggcaacatttcgttcaatgcaaaaagcttcgcgcctttaaagagtaattccaaacttttctttatgtgtaatattcatcgattttcacagttgttttcgctatgtcgcaacatttcggttttcgagaagcaatatcctatgttcactaaatgttgaagttccttactaaatgcgcacagacagttttattcggatgggtctcggcgcgcaaaaaattttatggtagttattttttaagtttgagctgcgaaatctgtttttaaagatgtttacagagaaacagaaaacaacaaaccgatcgaaaccgcataaatttaaacaattaactaccataaactttttttgcgcgccgagacccatttgaatttaaaaagaggggtacaatgtcgcattcgcaatattcgaaaaacgaccgtactcatttctcggataatgacgtcacgcatgttttgaactgacatcgtattgtaaatcgaatatgacgtcacagttcctgaaaaatggtcccaaaggtcaaacacaagttgactctcagttttaatattacagatgagtgctgtttctgacaacgatgtaatcaaggaaaaaggagcacgtgataagatgttccagaaacaaagtgatgaatctaatagtagactgaaatttgcgaatgttgtcgccaaaatcaatcctttaattttcagaaatgtttgctgaacattttattaaaaccctgcttgcctgcaaaggaatgactaagattcgaaccatggacatttttagattgattc

SEQ ID NO: 29431 - DNA, 414 bp, Caenorhabditis elegans
gctcaaactcgaattcctgatttctttgctgccaccaaatcgaagaatttcacaccgatcgtagagccatgtgaatcacttgaagactacatttctgcaaataatacttggatgagaaaacgaaaacgatcagaatctccacaaattttacaacaccatgcgaaacgacaggttccagacagaaagcgatctgtaaaaatacggtgagactttgttggaaaaattatgaacatttgacaataaaaattgtaaaacgaaaaatctatttcgaaatcactcaaaattaatattttcgtgcaaaataacttatttttaaagtttgtttcccgttaaaaaaaaacaattaaacggttttattgcagtgccttcaagccatatcccactgatgtcatcgaacttggcgactcggattaa

SEQ ID NO: 29432 - DNA, 499 bp, Caenorhabditis elegans
ctctccgccggaatccttccacaaatggtcgcacgaaaggctggagtcattgttaatgttggatcttcagctggagcaaatcaaatggctctctgggctgtgtattcagctacaaaggtttgaatttcaaaatatcttccgtcttttaattataattttattccagaagtatgtctcctggctcaccgctatcctccgaaaagaatatgaacatcaaggaatcactgtccaaactattgctccaatgatggtcgccacaaagatgtcaaaagtcaagagaacttcattcttcactccagacggagccgtgttcgctaaatcagctctgaacactgttggaaatacctcagacaccaccggatacatcacgcatcaacttcaactcgagctcatggatctcattccaacattcatccgcgacaagatcctcacaaatatgagtgtcggaactcgtgctgctgctctcagaaagaaggaaagagaagccaaatctcagtaa

SEQ ID NO: 29433 - DNA, 1073 bp, Caenorhabditis elegans
atgcagtgcgacgatgtgacttggaacattctcaacaagggacaatgcgcctacaaagcgtggacaaagccaaaaatgttctgtaaaaatgaaatgaatttgactggtttgtgcaacagagcttcgtgtccattggctaactcacagtatgcaacagttcgtgaggagaacggagtatgttacttgtacgcaaaagttgtcgaacgatctcactatccacgtcgtttatgggaaaagacaaagttgtcaaaggatatgaacaaagcattggaacaaatcagtgatcaacttcttcattggagtgaatatgttagacacaagtgcaaagctcgtctcatccgaattcatcaatatttgatcagaatgcgtaaaatggcagtccgtggaaagtaagtttaaacttatagaaactgaattttgcatagtattatttattttcagccagaagaaactcattccaattggacggaaagtggaaagacgtgagaaacgtcgtgaagagaaggcacttgttgcagctaaacttgatcacgctattgagaaagagctcttagccagacttaagtgagttgatatattagaaagtgcacattttgaatgaaacaacttttagacaaggaacatatggcgatgtttacaacttccgtcaagaggcattcgaacaaatgctggaaaacactgaaaaagagttggaagtggagcaagaactcgagcaggacgacgcagacacgggtgagactcagttcgtcgctgactttgatagttccgacgatgaggatcaggacatggaagacggaggtgatggacattggtcaccaggagatactgacagtgagaacgaggataattggcagccagaacaagaacaagaggattcggatgaagatgatgaggaaggaggtgatgagccaatggaaattgaggagccaccaaagaagaaggtaaagaaggagccgaagaaaaagactgggaagaaagctgctgatggaaagaagaagaagctcaagaaacgagctcatgttgagattgaatacgaagaagaaacggagccacgacaaagggtcaaggcataa

SEQ ID NO: 29434 - DNA, 361 bp, Caenorhabditis elegans
attctccaagaagaaaagctcgttgaaaattccgctgttatgggagatctccttatgtccaaactgaaaacccttccaaaagatattgtatcaactgttcgtggaaagggacttttctgcgcaattgtcattaataagagtaagttaatattccagtaacagatataattaatccccactattttcagaatacgatgcttggaaagtatgcttaaagctgaaggagaacggacttcttgctaagaacacccacggagacatcatccgattcgctccaccactctgcatcaataaggagcaagtcgaacaggcggccgatatcatcatcaaaacagtcaccgattttgcaaagcaaaactaa

SEQ ID NO: 29435 - DNA, 1053 bp, Caenorhabditis elegans
atgagtttcaaatttccttcacttcataacctacaccaaatgaagaattttgaaaattttgctacccgtataaaccactttgactgagatcggggtgagacccactttgaaaaacagcgtgttccatgaaaatgaaaatgatgaaaagttccatgaaaatacgataacatggaaaattgtttcaagttggctgtgaaactttaccaaacttccgtaaattcagagtgacaaccataaaagagaagagactattgttgaaaaatgtgagtggatacgcgaaatccggagaattgcttgcattgatgggtgccagtggagctggaaagacaacgttgctgaacatgctcatgtgccgaaatttgaaaggattgagtacggagggaacaattacggtcaatggaaatgaggtaattaaaaagcgtataaggattactgttgtcatttctttactgcagttattttggataataacaatatttaaaaaatacgaacaaattctaataatttacagaaaattctatacaaaccaaaaatacaaccagatagcttaatctgaagtttttgatatttttgtgtataaccatttaaggtgaagtagtagctcccatttccagatggcacacaaaatctcctcgatatccggatttgctcaacaagaagaattatttgttggaactctgacagtcaaagaatacttgatgattcaagcgaaacttcgtattaatggatctaaaaaacttcgagaagatcgagttacagatgtacttcatcaattgaaactctggaagtgtcgtgattcaaagattggagttattggtgaaaaaaagggaatttctggtggtgaagcacggcgtcttacttttgcatgtgaaatgttatccaatccttcacttttatttgctgatgagccgacaactggacttgattcttttatggctgaaagtgtaattcagatattaaaaggaattgcaaaaactggaagaactattatttgtacaattcatcagccgtcttctcaattgtatcaaatgtttcatagagtcatttatttag

SEQ ID NO: 29436 - DNA, 1380 bp, Caenorhabditis elegans
atgtctgccgctgctttggaggaaatcggtattgctccattacaggagaatacttctctccgtccgccaccacttccagccacctgcgttgatgtatcatcagacgactatatcaagcttacaacgctggaacgtcaactggcgcatcttcaagttatggaggactatatcaagctggagacaagaaaccttgaaaaagaattgcttcatgctcaggaagaagtgaagcgtattcaatctgtgccacttgtcattggacaattcctggaagctgtggaccaaaaccatgctatcgttggaagcaccaccggatccaactattatgtccgtgttctatcgattttggatcgtgagctgcttaagccaggatgttcggtggcccttcataaatattcaaacgcacttgttgatgttcttccaccagaggctgacagctccattcaaatgcttcgtcctgatgagaaacctgacatctcttatggagatattggaggtcttgatatgcagaagcaagaagtcagagaagctgtcgaacttccattgactcatggagaactttatcaacaaatcggaattgaccccccaagaggagttctcatgtatggaccaccaggatgtggaaagactatgttggcgaaggctgttgctgcaaatactgctgcttccttcattcgcgttgttggatctgagtttgtacagaaatatcttggagaaggtaattatcaagttttaaaacaccattattgtaacttttagtcttttaggaccacgaatggtgcgtgacgtcttccgtctggcaaaggaaaacagcccatctattatttttatcgatgaaattgacgcgattgctacgaaacgtttcgatgctcaaaccggagcagatcgtgaggtaagattacttcgagattgatagttttttctccgaattttaggtccctagaaaaaagttttgttaaacaagtggtatttttccaggttcaacgtattcttctcgaattgctcaatcaaatggacggttttgatcaaagcactaatgtgaaagttatcatggccactaatcgacaggatactctcgatcctgcacttcttcgtccaggtcgtctcgatcgtaagattgagttcccattgccagatcgtcgtcaaaagcgtctcgtattctcaaccgtctgctctcgtatgaacctgtcggatgatgttgatttggaagactgggttgctcgtccagacaagatttcaggagctgatatcaactctatctgtcaagaagctggtatgcaagccgttcgtgagaatcgttacgttgtgcttaccaaggatcttgagaaggcctacaagaatgttgtgaagaaggataccaacgatttcgagttctacaagtaa

SEQ ID NO: 29437 - DNA, 1258 bp, Caenorhabditis elegans
gttggtattatattggaataattatggtgattgttgttggaacatttctagcaacaggagttctggcaattcatggacaaaagcattataacaaaccgatttctgacaggatacgaaaattgatatataatccggttgttgaatttttcatattaaggtgagagaagtttttgcgatttccagacaaattttcgtcctgaatttttttctcttaatttccttctatatttttcaatataggttttcaagtgaaatatgtctttttcaaaaatcaagagaaataaccaaataaaaagaagagaaataaccaaataaaacgagacgaaccctaaaagagttcaactcgagtaaaagttacaaaaaaaaaagaaaaaaagataatagggaacaggtgaaacggggagaaagaagagaatggaggtaaaagtgtagttataaccgggggatgttgagatcaataaattcacagaactgatagggggacataaaaaccgttacatttttgaataaattgttccagactgggatgataagagcaaagaaatgcgtggagcatttgtccttcctaactaaaatcattgggtgcctattagaactagagaaagtaacaaattgtctaaggttagaaaaatgagaggtacctgttaacagtctatacagtagtttcaattgagccttaattctattgtgtctggtggagtggagctccattatactgagtcgattttcataagatgagaattttgtattgcatctttgaagaacgcgcttggtaaagtgccttagaggttgttcaagttttgctgaaagcaatgagtttgggtagggagcatagacttccgagcaataattcataatgggagcaacataggtattataaaggtgggcgtagaactttggggaattggaggagaatgctttgagaatttgtttagacctaagcatggctagacaactaactttaactatgtggtgttcaaactttagcttgcaatcaataattagacctaagtctcgaactcatttctagaagactcgttaattaatcttaccttatttcagtcctccaacatctttaatcgatttatggacagaatttggagtgatatccgaacagcgacactctacacatctagacccacttcttttgcaacatatggatcctatttcagtaagtcttttgccttttccttctccccagtcaacatgtcgctttgttgtatcatgtcatctgctttatcttctcccaaatgtttag

SEQ ID NO: 29438 - DNA, 460 bp, Caenorhabditis elegans
agaccaggtccacctgtaatccattgttcagctggaattggtagaactgccacgttgatcggtgttgattacggtaaccaaaggatcggagaagttggcgagatgaacgttcttgatattgttcgtgagatgcgtcaaatgagggataaagccgttcagagtcatcatcagtttatattcatgcttatgtgtattgcagatcgaatggttttggtaagtttcctccatgcttttgatttgaataaagtcattctaggatggtgtcccacaaaacgataatatgctggacctggcagatttctacacggaattcatgaagaaggtgttgatggagagaaaaaagaaagatgaagctgaaaaagcaaaaaaggaaaaggaagaaaaaaggaaaagggatgaggctaatgataagactaatgaaaagtcagcattgtcgaagacacagtctgtacttcaataa

SEQ ID NO: 29439 - DNA, 659 bp, Caenorhabditis elegans
atgtctcttccagcaaagaccctcgtccaggctgccgccaactctggactccgtgctgtctccgtccgtcattccagccaagctccaaaggtaaatttgatattgtattagaagcaaaaaagcataaaatatcaggtcgctcttcttggagctgccggaggaattggacagccattgggtctccttctcaagcaggatccacttgttgctcacctcgccctctacgacgtcgtcaatactccaggagttgccgccgatctttcgcacattgattctaatgccaaggtccgtttcttcagctataaaatgtaatgttgaagtttctgtcttaggttaccgctcacactggcccaaaggaactttacgccgccgttgagaacgctgatgttatcgttattccagccggagttccacgtaaaccaggaatgactcgtgacgatctcttcaacaccaacgcaggaatcgttcgcgatttagctgccgttatcgccaaagcttcaccaaaggctctcatcgcaattatcaccaacccagtcaattctactgtcccaatcgcttccgaagttctcaagaaggctggtgtctatgacccaaaacgtgtcttcggagtgacaaccctcgacgtcgtcagatctcaagcattcgtttccgagcttaag

SEQ ID NO: 29440 - DNA, 710 bp, Caenorhabditis elegans
atgatacttttattgtttataactttatttgcacttggttcaactgctcctgccgatcaacaaattactgtgagaaatatttgagtcttaaaaaataaaactaaaaatgattgtagagtcttccaaatcttacggaacctttgagatcgaaacattacgcaggatatttaagtatttcagacgtcaaacaactattttattggtaagattttttcattaaaaaaaaggactttatgcatatcgcatatattatgatgtaagttttctgtgaaagcattgctgtgaagacaggaagacttattcctgtcttgtaaatttattagaaatctttgagactctgctttcaaggctctacctttcctctttgtttaattatgttaacttttatttgatcaattaaagaaaacacatttttcaggtacgtcgaatccgaagaatctccggagactgctccagttgtcttatggcttaatggaggtccaggatgcgcatcaatggaaggtcttttcattgaaatgggaccatttcgagtaagaaattatggagaagaagtgaatcgtaatccgtggacatggaatagaattgccaatattatatatttggatgcacctgctggagttgggttctcatattataatactacaaagaaagttttcactgatgatgaagttgctcaagataactttaatgcattgaaaatgtggtttgca

SEQ ID NO: 29441 - DNA, 321 bp, Caenorhabditis elegans
acaaataacgctgacgagtttggaaaactttctccgttcccgtcaaggagtaaaaaaggtagcgatgattccacgacgaagctgatgaaagatgcagtggtaagaatttgcaaatatacatttttttagctttctgttttttgctgaaaatgcttaagttagaattagttgctgatatgagtatatttccagcaggatgtgtcaacagttgtttgagtagtaaaaagataatttcagatggaagaagaaaagaatgcaaacaataatggatacggatcggctggtgaaatgacacctcttcgtgaagggtatgaagagtag

SEQ ID NO: 29442 - DNA, 641 bp, Caenorhabditis elegans
ggaaatgaaaagtatggtcgtgaagatttggagagtatcgcgaaggaaatggaacgtccacttgaagagattcaatcttacgctaaagttttctgggaacgtatcgaagagcttcaggactctgaaaaagtgctcagtcaaattgagaagggcgaggcacgaattcaacgaaaatatgctgtgaagaaggcgcttgacgctaaaatagcaaagtacaaggctccgtttcaacagttgcgtatttcctatggtacaaataaaggaaaaacgtacaccgaagaagaggatcgattcctggtttgtgagactcatcgattgggacatgataaggaaaatgtgttcgaagagctgcgtcagtctgttcgcatggcaccacaattcagatttgattggttcctgaagagtcgtacagcaatggtaggtacattcaattgagatttatatttagaaacttattttttcaggagcttcaacgccgttgcaatactcttattactttgatagaacgtgaaatgggagaagttgtggagtcaaagcctgtcatcgtgaccgctgccgataagaagaaatctgtcgctaaggacctgtcaaagagtagtggaactccaactgctaagaaagtcaaagctactcctaaataa

SEQ ID NO: 29443 - DNA, 1045 bp, Caenorhabditis elegans
atggatcgtcttatccgttcgttgttgatgaatcagaacaagcaggcaactgataaacttgatcatccggacacttctgaaacgtaagtttaaattttttatggattccagaatttgttgaaatttcagagtgaacatttcctcgttggctttgctgaaaatgctgcgccatgctcgttctggaatcccgttggaggtgatgggtctgatgctcggagactttgtggacgactacactatcaatgttacggacgtttttgcaatgccgcagagtggaaccagtgtgaccgtggaatcggtggatcctgtgtatcagacaaagcatatggacttgctgaaattggttggaagaactgaaaatgttgttggatggtgagtaaaggggacccaagaatataggcaatcttttagaatctacgacgcagcagatatagttttcagtttttataatcaaagcctctattgaaattatataacaactttcaggtaccattcgcatccaggattcggatgctggctatcttctgtggacgtaaacactcaacagtctttcgaagctctccatccccgtgctgttgcagttgtcgttgatccgattcagagtgtgaaggggaaagttatgctggacgcattccgatctgtaaacccactcaacttgcaaattcgtcctctcgctccaactgctgaaccacgacagactacttccaatcttggacatctcactaagccatcgctaatctctgttgttcatggtcttggcaccaagtactattcgttgaatgtcgcctatcgcatggggtcgaatgagcagaagatgttgatgtgtttgaataagaagagttggtatgatcaattgaatatgtcaacttactcggagcttgagaagaagcaggaggagaagttcaagagcatcaacaaactgattgcagtcttcaataaggatattgacgaagttaaggagaaaccaattgcagataagaaaggaaagactcaagaagaagtcaaaaagtttggaaaaatcaatgcaaaacagcaattgcaaatg

SEQ ID NO: 29444 - DNA, 889 bp, Caenorhabditis elegans
atgaccgatgttaaaaatgatgtgaacgtatcttcggtggtcgatgccgacggcttgatcgaggttagttaatgtacataatttattataatttgaatacattcaattttagggaaactatgatcaagtcgtcgaatctttcgacgacatggagctcaaggaggagcttcttcgcggaatctacggattcggtttcgaaaagccatctgctattcaaaagcgcgcaattgttccatgcaccactggaaaggacgtcatcgctcaagcccaatctggaactggaaagactgcaactttctcggtctctattcttcagagaatcgaccacgaggatccacacgtgcaagctctcgttatggccccaaccagagaattggctcaacaggtaaactttctcactcagtgtattttagttatagattattagcagatacttttaaagaaaacttttcaaaatctttctttgtagatccaaaaggtcatgagcgccctcggagagtacctcaacgttaacattcttccatgtatcggtggaaccagtgttcgcgacgatcaacgaaaactcgaagccggaattcacgtcgttgtcggaactccaggacgtgttggagacatgatcaatagaaatgctcttgacacatccagaattaagatgttcgttctcgacgaggccgacgaaatgctttctagaggtttcaaggatcagatctacgaggttttccgttccatgccacaagacgttcaagtagtccttctttcggctactatgccatctgaagttcttgatgtcactaatcgtttcatgcgcaatccaatccgcattcttgtcaagaaggacgagctcacccttgaaggtatcagacagttctacatcaacgttcaaaaggat

SEQ ID NO: 29445 - DNA, 632 bp, Caenorhabditis elegans
gctaaagtctctgacttcggtttatctcgagttggaacggagtatcagatggatccgagcaaaagagttccaatcagatggctctcaccagaaacgatcgtttccttcctttatactccacaaactgatgtgtttgctttctcgattctctgctgggaggtgatcgagaatggagctcagccgtatccggagatgttggtggtgcaggtacatcagaaggttggacgcgatgattaccgtatgccgattagtcaaaaggctccagctatgcttgccgatgttattgtaagttctatttcattccactattttcatagcaatgtggaattttccagaaaaagtgctggattcgcgatcctcaacagcgccccactatgagccaagttgtccagatgatgtacgaaatcacaggaaagaaagataaaacctcggtcaacaagtcgacaggacagctccgtgcaaaaatgatgtctactggaccaatgtcagatccgatgagagataaaactgctaaaaagactggaagacgtaacaagaagaaaccgtcaagcgcatcgaacggtccaggtggcaactctgggcctagttcgggtccattgtctggtaaggattcgagactgaagaagccatga

SEQ ID NO: 29446 - DNA, 1108 bp, Caenorhabditis elegans
atggagctcaaggaggagcttcttcgcggaatctacggattcggtttcgaaaagccatctgccatccaaaagagcgcagttgctccatgcacaactggtaaagatgtcactattcagtctcaagctgggagcgggaaaactgtaatttctctaattgatattcttcaaggaattgactgtgaagatgcacacttacaggtcattctattggctcctcaaagggggatggctcaacgagtaagaataatgaattttttattattctaatgccttatttttgtaatatctaggcgcatgagcaattgaaatctctgggcagaaatctgaatgtaaatgctacttgtttgggatttgatacaactgctgaaaacgacaaaataagtcatgtcttgatgggaactcccaaagattttcttagcaatatcccttccgatacatccagaattaagatgttcgttcttgacgaggctgacgaaatgctttctaaaggtttcaaagatcagatctacgaggttttccgttccatgccacaagacgttcaagtagtccttctttcggctactatgccatctgaagttcttgatgtcactaatcgtttcatgcgtgatccaatccgtattcttgtcaagaaggacgagctcacccttgaaggtatcagacagttctacatcaacgttcaaaaggatgtaagtttactcgcccagtctaagaaattgcagttgacctcctttttcctgatgaatgaaaaaaaaacaaactttgaaattacggagatacggtaggttttaaaggcgcgcgcctttccgctcattcgcattgaaaatattttgatattttgagaattataaaaatgtttcaggaatggaagtttaattgcctttgtgatcttcttaagacatccagagaaacgcaggctttaattttctgtaacactcggagaagggtcacccagctcaccgagcagttgatgtccataccaataaaagtatcatgttttcatggaaatatggaacacaatgaacgcgaggatatggtaaaagatttcaattcgagaaatactcgtgtactcgtcaccactgatcttatggcacgtggtatgaatattcgt

SEQ ID NO: 29447 - DNA, 568 bp, Caenorhabditis elegans
atgcattcaacttcagggttggcccccgtttttcgtgtggaggaaaatcatatgattcggaatcgagagaatttggagagacctatctccaaaaaaggtgagtattttttaagctaatataaaaatatgtaatttgttcttcaagaaacgatttatgattttttttaatgaagggaaattatttattgaagctgttttataaatttcacaatgttgttgaaatctttgaaaaatttgcaggcaccatcacgcttttgtcgaaaatgccgatgggattcgtgttgaatagttgctcttgtgcttatatcgacaatcttcttgctcatagcagtattcatcgtgtgaaacctcactcgttcatgattcaggtaggataatcgaatgaaaactaaaattttgggaggaaaaagctatttttcagcgtctcgtagtcatttgtggtcgttcatcaccatcattgccaaatcatgcagccaatatcattctctctgcattcaatttctgtcaaatcgaagcaccggcgaaaaagtttcttgaagaagacgctgcccttagtctttttcacact

SEQ ID NO: 29448 - DNA, 1128 bp, Caenorhabditis elegans
gaacatcccaggccgattgcgccgtcttggtcgtcgcttgcggaactggagaattcgaggccggaatctccaagaacggacaaactcgcgagcacgctcttcttgcccagacccttggagtcaagcaactcatcgttgcctgcaacaagatggactccaccgagccaccattctctgaggcccgtttcaccgagatcaccaacgaggtttctggattcatcaagaagatcggatacaatccaaaggctgttccattcgtcccaatctctggattcaacggagacaacatgcttgaggtctcctccaacatgccatggttcaagggatgggccgttgagcgcaaggaaggaaacgcttccggaaagaccctcctcgaggctctcgactccatcattccaccacaacgcccaactgaccgaccactccgtctcccactccaggatgtgtacaagatcggaggaatcggaactgttccagtcggacgtgttgagaccggaatcatcaagccaggaatggtcgttaccttcgctccacaaaacgtcaccactgaagtcaagtccgttgagatgcatcacgaatctcttccagaggccgtcccaggagacaacgttggattcaacgtcaagaacgtctccgtcaaggatattcgtcgtggatccgtctgctccgactccaagcaagacccagccaaggaggctcgcaccttccacgcccaggtcatcatcatgaaccatccaggacagatctccaacggatacactccagttctcgattgccacaccgctcacatcgcctgcaagttcaacgagcttaaggagaaggtaacttatttgtcttattgtttcgtttatgtaccaatttgtttttcaggttgaccgtcgtaccggtaagaaggttgaggacttcccaaagttcctcaagtctggagatgctggaatcgtcgagctcatcccaaccaagccactttgtgttgaatccttcaccgactacgctccactcggacgtttcgccgttcgtgacatgagacaaaccgtcgctgtcggagttatcaagtccgttgagaagtctgatggatcctctggaaaggtcaccaagtccgcccaaaaggctgcaccaaagaagaagtaa

SEQ ID NO: 29449 - DNA, 327 bp, Caenorhabditis elegans
atggaagaaccaatggaagttgacaataaaagaccaaaggtgctcacctggacagaaaaatagttagttttttgtttttcgatttgcaaagtaaattcaaattttcagtcgtccaaaaacgctagacgatattgcataccaggatgaagtcgtcacaatgctgaaaggagcgcttcaaggaagagacgtattgcttaaaaaattattcaaactaatcgttttaatttttcagttaccacatcttttgttctatggaccaccaggtactggtaagacgtcagcagctcttgcattttgccgccaactcttcccaaaaaatattttcca

SEQ ID NO: 29450 - DNA, 1639 bp, Caenorhabditis elegans
atgggtaacgtggcgactagaaaacggcccggatgtcatcatcacattggaagaaatgaggaaaatctagacgacgatgaagatggaccagcgaagaaaagattaagaattggagaaccgcaggctgaaaatgaatatcaaaaggtgactgagaactgaaaaaaccttgaaagatccacttattttctttgttttaactaaaaaattattcaaaaactcagacaaaccatatcatactaactcagagtaaaaagcggagttacataatggtaaagcacactaaccgcagttcggtgcaagtgtggttttactcggagtaaccacgctttactatgcctagctcattcctagatctgcctaactatgcctagctcggaattggtctgattgtactttgtcgatctgatttactctgaataactcttcctaactatgtttagagctgcctaactatgacttaataggagttagtatgatatggtttgtctgagaagtcatcatgatgatgcatcagtcatttcaaggaaggaagtttcctctccaaacagtgactcttcagctccttttgagttctgaaataggcgatatttccgaatttatggggttattcaagtaatgtagcaaaatgtatttaaatacatttgtgacgtcacaaatgtatttaaatacatgttttttttacttgaatacatgtgtgacgtaatttttctacactttttaattttttttttcccgacactacttgaataaccccataatttttgagtcagaaaatcagtacccggtgtcggcacgacaattttttgttaaaggcaaaaaggtgtgcgccttcaaaggttactgtagtttctaaaattttctgcgcagattctgtgaaattatgatttttgaagtctttcgataaaaatatggtttttttttcattaaaaaattgaataaaacagtaacaataaataaacttttacaaatcatatgaatcatgagaaatactatttatgaaaaacacaccgtatatttggcccaaaaatgtgggccatactcatttcgtgaaaaattatcatctggtgtgctttgatgttatagcatgttttcttaaagaattacactctagtatcattactcaaaatgtttaattctaaagtctacttgatgtcttcttgatctgatcattacactatcaagaagtatcaattttctctatacaaacatcagactacagtaatcccccaattcttcagctcgccttcaaatctcgtctacaaaaactgaaaaaatgtcgtcctcacttgaaaagaagaacgtataaagttgaagaaggtacgatctccagatttgatttccacaatattaaaaaaaaagagcattgtttacctacatttgtgagtacatctcaatggcagcccacttcttaatcttgataatgatccgtatttcggcgggacacacttaagatcaatgacatcaggtgatttgtgatgtactctctggatttgataatacacaataatggtaatcttgctgatgtgaacttctgaaagccaactttgaagaaaaaaaattctagagacaaaaaaaaaagattaaaaatttgcagctgatccccgtccaccagtgccaagattcattgtagacgattatg

SEQ ID NO: 29451 - DNA, 1015 bp, Caenorhabditis elegans
atggtggggacacacccagccaatctcagcgagcttttagacgccgtcttgaaaataaatgagcaaactttggatgataatgacagtgcaaagtgagttttttgtttttagtttttgagatttggtttttgaaagaaattcagaagacgagccataatttttggagatctagaaagttgttttcaattttagtaatagtttgtgaaaatattcaaaaatgataaaatttttgagaacatctccacagtatattttccaaaacctaaaattttatttctttcagaaaacaagagctacaatgtcatcccatgcgtcaagccctattcgatgttctctgtgaaacaaaagaaaaaacagtactgacagttcgtaatcaagtggacgaaactccagaagatcctcaattaatgcgacttgataatatgttagtggcggaaggcgttgcaggaccagataaaggaggttcattaggaagtgatgcaagtggaggtgatcaggctgattatagacaaaagcttcaccagattcgagttttgtacaatgaagagctgagaaagtatgaggaggtacgctattttcaaaagcaaaaactcagatctgactcaacattgtttaattgaaatttagttttttttgtgagtgttcgcgaaaaaaaaggtccgaataaaaactaaaaatattttttcaggcttgtaacgaattcacgcaacacgtgaggtctctgctgaaggatcaatcacaagttcgcccaatagcacataaggaaatcgaacgaatggtttatataatccaacgaaaattcaatggaattcaagttcaactcaaacaatccacatgtgaggccgtcatgatcctcagaagcaggttccttgatgcccgccgtaaacggcgaaacttttcgaaacaagcgacagaagtgcttaatgaatatttctatggacacctctcaaatccatacccatcagaagaagcaaaagaagatctcgcaaggcagtgcaatattacagtatctcag

SEQ ID NO: 29452 - DNA, 413 bp, Caenorhabditis elegans
atgatcaaacgaaaattacaagatttagccgtatgctgctcgtaccaagtggatttcctacacgagaaaagtgagaaattaaaaaaaaattaatttaataattttgaaattttcagaacattcggtaaaagagttcaaacggaaatacgaagtattagatgaaattggacgtggtggattcggaatagtgtatgaagcaacaactcgacaggatggacaacagccagttgccgttaaatttgtgcaacataaacatgtcagaagctggacaatggttagtgttttgtttgaataaattatttttcaactaattattttcagacatgccggcaactaattccttcagaagtatgtcatttggagacgtgcgaagacattccaggtgtgataaaaatcctcgattggtttgcaaa

SEQ ID NO: 29453 - DNA, 1047 bp, Caenorhabditis elegans
atgtctcttgttttcatttcaagtctgttattccgaatgtcatgtcacattttgatacatttgactcggatttcgcctctccgtttagtttctcggaatggaagggaaacaacggagaaaaattgatgatgaacatatcggaatgacgagaagtgaaatggaaatttgaaataataagagacgtttattgaaaatgaagaatacaatttcaggggcgaaagtaacgaaaatttggaaaacaatgtgacaaggttattggataaattgatagcaagtcatgatcggagaattcggcctaattatggaggtaagttaaatgtattactttgaaatagagcggtaatcgattcattttttagagaagaggaccagtttattacgttttcaatttttgaaatagttttacagaattagattaaaaaatatttattttgaatattgttcgaactccccaaaagtacaactagatttttctctttttttctctgattctttatcctttttttcttaactttttctcccttttcccactccatttggctcctgagcaaaactcttccaatttacggaacgcacacaaaaaaaatgttgaaaactttttgacggggcggcttcttctttcgagcgatgataaaattgaattccatttctctttttttggggccagtttttcattcatctatttctctcgatttttggtgatggcggtggcggtagcagatgaagagaaggaaaaaaaatgaaaaagttgaaaaaagtttttggaagttttgttcccaaaaaagaagtgaaagagtaggggtcatatttatgaccggcacacaaaatttcacgccttttagaatcctttgtgacgtcatgttgaaaacgttttttgatggaaatagatgaggaaatgagcggaaattatttaagtttcggtggaaaaaaagtatttcgcaggcacgaaaataaaaagtttcactctaaaaaatttcaggtccgcctatagaagtgaacatcactgcacatgtgaccacaattagtgcagtttcagaagtgtcgatg

SEQ ID NO: 29454 - DNA, 607 bp, Caenorhabditis elegans
atttgctctcaccgacttccatcattgcattgaatcgtcccgagtgaatgcggatgaaattcgaaaaactgttcaactgacagagaataacattaaaaaactggagaactgcttaaaagtgtacaaaattcaaggagaacgtgatttattcgacgagaagatgcggccgttccacgaaaaagctgtcaaagagttctccacagtttcgtcaatgtgtggaaagatgaaaaacgattgggagtcgttggtcaagtattatgcatttaacgacaaaaaatatccgatggaagaatttttcgccgatattcgcaccttctctgagcaatattcgaatgcttggaaagagttggatgccgaagcagaagcaaaacgaaaagaagcagaatttgagacacagaagcggaagcagctgcaacaatctcaacaagaaaggaagccgttacaagagagacaggcgattaatagagtgccaagaactccggctgcgatgattcgagtttcgactggtgagttgatatttttgaaattgttttttaatataattttttcagctgccgataaggctggtgtgctcgatgagttggagcgtgcctacaggaaatgctga

SEQ ID NO: 29455 - DNA, 1020 bp, Caenorhabditis elegans
aaatgcggaaagaactgcataaaagccagcaaagtctgcgatggcatccctgattgcgatgatggttcagacgagcaccaatgtgattgcaaaacgtgttccggttctgagaaagccctttgcgaagacggtacatgcattatgcgctcccaagtttgtgatggaaaacacgactgtttggacggaatcgacgaggaaaactgtccaggatcgtgctccaatgaacggttctcatcaaaattgaaacttttaacatgcgatgatggcaatcaatactcagaagtagaagcttgttctggattagttgaagcttgtgagcttaattgcccgaaatgcgacccaaagcacactttcacttgcccagcagtaggaggaattcataataagtgcatcaaaagaagcaaggtctgtgatggaatcttcgattgtgaagatggtgctgacgagaaaaagtgcacacccgtgaaggaatgtgtagtcgagagttccattcagttcacctgcgataataaatgtcttgaatcgagtcgtcgatgtgatggagtttgggattgtgaagacaagtctgacgagaagggatgtgacaagtgcccatctagatctttcaaatgtagtgccgataaaaagtgtctcccattccacacgcgttgtaatggagtagcagaatgctctgatggaagcgatgaacataaatgttcttgccaaggtgattttgaaaaagaaaattaaatgtataacatcttaagttagggaagctcaatattgtttaaaataagtaaatatatacaaaaatacttaaacacatctaaaataatttcccattctataacttatttactacttactactattccagaatgccttggtactcaccacgacacctacatgtgcagtgaatcgaacagatgcttgaaacgcggcgaagtgtgctctccatattcgatgtgccccaatgcaacctacatcgataaggcctactgcgcttctttggctttgaagaattcaggcttacgtccctaa

SEQ ID NO: 29456 - DNA, 447 bp, Caenorhabditis elegans
gataaggagccatacaacaaaggtgcgttcaaagttggaatcacgttccccgttgactacccattcaagccaccaaaggtcgcgttcgagaccaagatttaccatccaaatgttgatgaggaaggaaagttctgtcttccaattgtgacagctgaaaactggaagccagctaccaagaccgagcaaggtaggcatatcatttaatttaacaaggaacggggtagtttacatcgtagaaatagttaaatttagttaaaaagttattctggcttctctcaatatcgtaatttttcagtgatgatggccttgctgtcactgatcaacgaaccagaaccatcccatccaattcgtgccgacgttgccgaggagttccaaaaggatcacaaaaagttcatgaagaccgccgaggagcacactcgaaagcacgccgaaaagcggcctgaatag

SEQ ID NO: 29457 - DNA, 305 bp, Caenorhabditis elegans
atggtaactaaatttattaaacataattttttagaatgtaaaggtttcagagctttgctggacttttagattttgctcggaaggatgtcgatctgccgcaaaattctccaaacgaattactgaaagatctacatgctaactttatcaatcaatacgagaaaaacaaaaatagctatgtaagtggcaatgttatattagatgtggaaataaattaaataattatatttcagcattatataatggctgaacatctgagagtgagcggaatttattggtgtgtcaacgcgatggatttatcaaagcag

SEQ ID NO: 29458 - DNA, 675 bp, Caenorhabditis elegans
tacttccaatcgaatatttgtaagctcatatgcagatggaattgaaaaagttcgtacgagtaaagggaaatatgcatttttgctcgaagaaactacgaataattacgaatcaggacggagaccgtgcgatacaatgaaagtcggacaaaatttaaatacactgggttacggtattgcgacgaaaattggaaatccattgaggtatgtcaaaaattctgtaagcctaaggtggtttttatatcagaaaacaatacgaaaacacattttgattttataaaatttttaattttcagagtttcactaaacttggcaattctctatttatctgaaaaaggagaactcaaaaagttggaaaacaaatggtggtatgatcgtggtcaatgtgatacaggaacgtctgatggtggtactagtagtagtttgaatctgtcaaaagttgctggaatattctacattcttcttgctggaatggttctttcaatgtgtacagcacttgttgaattcttattcagaaagaataaagaaaatcgagagaaagagagaaatcgaatgagaagctctcgaccattgaaacccgggattttggcttcatgtgaaagagcaaaacagaaacaattacagaatagaaggacgaaaagtgaagaagtttctacacccagaagtacattattttga

SEQ ID NO: 29459 - DNA, 732 bp, Caenorhabditis elegans
tgtcaccaataaatacgatgcccgtatgcttgcattcgatggaattccaaaacacgaagttggagagctgtacacaaatccacgtgatactggacacttccttcacgtaatgcgtaaagaggttctcaagtcaccatatggctatggatatattgccaagaatggtgatcatcaagcaggactcaatgcatggcacactggacaccatcttccagaaccatggtaagttgttttcaatatttgaaatttaacttgaaggtggagtagagtcaatttgaaaatttgctttaagtaatagaaaatgaaccgaaaataccgaaaacaaaaaaattataaattttttcaattttcaaaaatgttaaaaattatttttgaattaccacataaatgaatcatgaatatatgatattcggacattacggtctattttctaccatttgaagcaaaaattcgaatagtctccacctttgaattcttatttatgttatttgcattttaaaaagttcaaaagcaacagcataagattttttttaaagctgtactttttaaaaatccgtatagctaaactttcaattttataaaaaattcttttttcgaattaacatttttctattgttcaggtatgaatactacttccgagaggcatactatgatgatttgacatctcacgagacatcgctggatttggattcggattcatacgatccggattatgtgcaccatcatcactaa

SEQ ID NO: 29460 - DNA, 2113 bp, Caenorhabditis elegans
atggcccatccctcgtgtgtgggttttcatatacgattgtcctcaacctacttgcccataccaggtgttcaattcgccaacggaaaagcttcggaagtcggagcgagtaaaggtttgtcaatacttttaatattaatttatccgtattatctgtttcaggcaaattgggttgacgatcgtgatggaccaatccgtaatattcaaggacatgcttcagaaacattcccaggaaaagacacagttgataaggtaggcaagtgtgcaaagatctgcattgcagaattcgataaaagctgaagtagcacatttcatgctttaaattttaggtttggagaaagtgcgtcgaactctacgatgaatcgccatgtttgggaactcgacagcttattgaagttcacgaagataaacaacctggaggccgtgtgtttgagaagtggcatcttggagagtatgtgtggcagagctacaaagaagttgaaactcaagtcgcccgcctcgcagccggtatcaaggatcttgcccatgaagaacaaaatccgaaagttgttatctttgctgaaactcgtgcagattggctcatcactgctcttgcctgtttccgtgccaacgtcaccatcgtaactgtatacgcaactttgggagaagacgcaattgctcatgccatcggagagactgaagctacaattcttgtcacttcttcggaacttcttccaaagattgtaacgcttggaaagaaatgtccaactctgaagaccctgatttatttcgctcctgtggaccagaaagcaccagcaccagagcttgcaccgttccgtgatcagttcaaacatgttctatcactgagcggacttcttactcgcaatcaggaacaagttaaagaatctacagctgtgaagtcagacattgccctcatcatgtacacttctggcacaactggtcagccaaaaggagttattcttcttcatcaaaacgttgtggctgctttgttgggacaaggggatggtgttggaatcatatgcaatgcagatacatacattgggtatcttccacttgctcatattctcgaattggatgccgaattgacatgtttgactaaaggagccaaggtaagaatttttattggatttaaaactcattttacccatttattttaaggttggatattcttcacccttgacacttcacgaccgtgcatcaaaaatccaaaagggaacacatggagattgtcatgccctccgcccaactcttatggctgctgttccagctattatggatcgaattttcaaggccgtctccgaagaagttgctgcatcacctcgtttcatgcaagaattgttcaaacttaattatgagagaaagagatcccgctatttggagggttactgcagtccattccttgatcgcatcgtattcaaaaagattcgcagacttttgggaggaaaacttcgtggtgttttgtctggtggagccccattgaacgctgaaactcaaagattcatgaatatttgtatgtgctgccctgttgttcaaggatacggactcacagaaacttgtggagctgcttgtgttgctgatatcaacgacttgagcacaggaaccgttggtcccccagtcagatgctcagatattgctcttcgtgagtggtccgaaggtggatactcaccattcaatgatccaccacaaggagagattcttatttctggagaaaacatctcacctggatattataaacaaccagaaaagaccgctgaagatttcatcacctataaaggaaaagtgtactttgccactggagatattggacagaagcgtgatgatggttctcttctcattattgacagaaagaaggatttggttaaattgcaacacggagaatatgtttctctcgctaaagttgaatgtgcacttctcaattgcccaattgttgataacatctgcgtttatggaagtggaatggaagacagtgttgttgctcttgtggttccaaaccagaagcacttggagaagattgctgaagcggaaggtgtatcaactagtgaaatgaagacgatgtgtgaagataagaaggtcattgctgcctacaagaaacaactcgaagaacatgccaagaaaa

SEQ ID NO: 29461 - DNA, 590 bp, Caenorhabditis elegans
atgaaagaacctcattcttttagaagggttaaaatgtttggtcgtcaagttggacgcgtcgttttcagaactgcctcggtggtagttcaacggagatctgtgtcagcttcggtgccgcaaatggtcaagctcgtggctccatctgtaaatttcattcaaactaggtaacattcttcaggaaattttgtggtgctaaaaatcaaggcaaatgcttatttgtagaagaaggttttttgaggaaaataagtgaaaaagagaactaccttttaaatcaaactgagtaacgataaaacaatttccacattaaagttttgatttttggagttcagacatactctttagaaaaaaaggtcggtattttcaggggaagcaaaattgaagtcttcggaccattcgaccccccaaagcaactcacattcaaacaggtagctgaaacaaacggaagactttttcaggccgtatattttcaggttgaagatcgtgttttgaaagcagttcgctcatgggatcgtttcccagcagacaaggagtcacttttgaagcttgatgctgatttgagcaaagattttggatttgattctctggatcag

SEQ ID NO: 29462 - DNA, 1425 bp, Caenorhabditis elegans
atgcacaaaatatttatcatattcggattactgtcattatgtgctgctcattcccttcgagacctttcaaataaagatgaggaggaccctccctcttcagctccaggtgttagaaaacggagaatgatgtcagaggaagatcagaaaacagttgactattatatggataaactgaataaattggctgatgagaagcacccagaggtaaaatttttctgaacgagttcattaaaaataattttaaaaactctgatttttgatagaatgaaaaacaaaaaaaaaccatcgaatctaaaaaattaatttagactgaaactcgtagctacaattagacattttatatgacatcccatttttttactcacaaagttgtaaattgcaacactgtaaatttgtgaagttccaagaaggagtaccttttgcaactcttttcacattcgaatagttttcgcctcgagatgataaatagtttattttgtctaaatctcgtggtacttatcgattgattgagttatcaattttcaaaaaaaagttgtcctgatcctctctgtctctctcgacatggtttcaaatcatcgtttttcttcttgtcaatttcctccatttcttcattaatttcttgcgttttctatgtactgattgagtgattcttcaacagcatcgaaacaggtttctcctctcttcattttgattctcgagacacatttgggccagtgataaatgtatgtatgtaaaggggggttaagagaagtgaagacttcctattctgctactaaagaataatgaagaaaatgaagatgaaaatgaaaaatgagtgttgattcagtgaccaatcatatcaactgtgattaaaaacggataataaactgattttttattaaatatcaataacacgagaaactccccaaaaactactgtagggatcttttgaatgtcaaataattattttcgaatttattctggttgtctgacacttgcacagaacacagctcgtgcttcgtgaacgcaaaaaagaaaaatcggtcgctatatgagccccctcgtcatataaatattttcaggaaatcgaacgacacaagaatccagagttggtagcatgggatcgtaagagagatagtgtgctgaatccagaagagcagggaaaattctttcaaggagatattgttctctatccagagcaagcaaaggctctttatgagcaagcactaactgaaggttggtataatattagcgcaccacatttcattttaaaatgtaccaccaaaatttgaaatttaaatttttaagaggcctttttttggtttgcaaaaaatattaaagaatgaatttcaggaaaaacaagagtaaagagaaaattcattgggtctaacttgagaagatgggacgccagtcgaccgataatttatgcttttgatggaagtcaca

SEQ ID NO: 29463 - DNA, 1197 bp, Caenorhabditis elegans
atggccggaggactatttaaattaatgaaaggtattgaatattacgaattttaaatcgcgttttcactctctgctttcatctggaactattaactatttcattgaaaaatatttgcagacaaaagtgtggatcattctcatctgcacaaagatcactcaatccatcatccaactcctcctcgttcattcttctcatcatcttctctagcagtacatcctaacgttgaaacagctcaaagctcatccgaagaagatctcagaatgccaaacattaaggtaagcttggaaagtgcaattcctccaacaatatatgaaatcaaagttgtttattaaattcctagatccttcgatacgaacgttataaaattttctcgttaggaaagctttttcagtttctcttgggacctttggtaatcttcaaggacaagagaaagacaacgaacgttttgtaaagcttctttgcgtctctcttagctgttattatctatatctgtgtcggttcttttgtctctgatactgagtctcctctgtcttttttggaatttcttgacacaaagatactcgtgaagtgtccttttagcctctctctagaatagttttggcaacttatcagttagaataaaatgagcccaacggtaaatgtttgtaatcaaaatgttgcgatcttacattatgatttcaggttttctctggctcatctcacccggatctttctaccagaatctgcgaacgtcttcaattggaggtttcgaaagcttcactgaagaagttcagtaacaaggaaaccaatgtggaaattggagaatcggttcgtggagaagatgtttacattattcaatctgctgctggagagatcaatgataatctgatggaacttctcattatgatcaacgcgtgcaagatcgcttcctcatgtcgtgttgctgccgttattccagcctttccatacgcccggcaggacaagaaagacaaatcgagagctccgatctcggcaaaattggtcgccaacatgctttccgttgctggtgctgatcatatcatcacaatggatttacatgcatcacagattcaagggttcttcgatattccggtagacaacttgtacgctgagccagcaattctgaagtacatcaaggaatctattccaaactggcagacctcggttattgtatctccggatgccggaggtgccaagag

SEQ ID NO: 29464 - DNA, 526 bp, Caenorhabditis elegans
gcaaccatcgtccgagtgagcatccagtcatggtgactgtgctcgatatgggagcggctcgtcatttcttgagaaccggagaaatcaaggatatggagcatttagtgtacttcaaaccacatgttcatgttaatttaacacatccattggtcaaggcaatgtacaaaatgagaaaaacagataaggaaaccgcggctattttggctgagcaggtgaggttttaaaagaaaaatttcgttaaaaaagggtatacccgggtacccggtttcaccacaagtttttttttaatgcggacaagtgtgagcctttaaagagtactgtaatttcaaattttcgtcgttgcggaatttttatcgctttttcctagtttttggttaaaatttgtgtactatgtatattcttatattggagttttgattaaattttcttcaaaaaactgaaaaatttatcaatattccgcagcaacaaaagtttggaattacagtactctttaaaggagcacacgttttcatatatagcaaaataa

SEQ ID NO: 29465 - DNA, 1478 bp, Caenorhabditis elegans
atgtcgacgaaagaagaaattacaaaagagatcgaggagcaaggagccgaagtccgccgtgtgaaaggtgacaagaactccacagaggtttgtcgtttaaaaaaaataggaaaatagttataaaaaatactaattaaatttgaatcaaaagtttaattcgaaattcaattgatacgtacttttaaatatttttcaaggaagcaaaaaaagaagcaatcgacaagcttcttgctctgaagcttacttacaaggaggttaccggacaagagtacgcagctccaaatgctcgtcaatccaaaccaaagaaggaagagaaaccaaaacaacagccaaagcaacaagaaaagaaacaagatggaaagaagcagacattgttaggagttggaaccaagaaagatgataactattcggaatggtacagtgaagttatcactaaggcagaaatgatcgaatactatgatgtatctggttgctatgttcttagaccatggtcatttgcagtttgggaatctattcaagaatggtttgattctggaattaagaaattaggagtgaagaactgctacttcccaatgttcgtatcaaatgctgccctcgaacgcgaaaagactcatattgctgattttgccccagaagttgcttgggttactcgtgctggaaactctgaaatggccgaaccaatcgctattcgcccaacttcagagacagttatgtacccatcttacaagaaatgggttcaatctcatcgcgatcttccaatcaagttgaaccaatggtgcaatgttgttgtaagtattgattttttaattgaaattagttaaaaatttttataaatttctgttgaatttctcctagctgtcttgctccactgcaaaaatattatcataatacttttttcctttacagcgatgggagttcaagcatccaacaccattccttcgtactcgtgaatttctctggcaagagggacatacggcttttgccaacccagcagacgctgaaaaagaggttttccaaatccttgatctctacgcaggagtctacactgatttgctcgctatcccagttgtgaagggacgaaagagtgagaaggaaaagtttgctggaggagattttacgacgacagtcgaagcatacgtggcatgcaatggtagaggaatccaaggagcaacttctcaccatctcggacaaaatttctccaagatgtttgatatttcgtacgaggatccagcgaaggaaggagaacgagcattcgcttggcaaaattcgtggggtctttccactcgtaccattggtgcaatggtaatgattcacggagatgacaagggattagtacttccaccaagagttgccgctgttcaagttattgttgttccagttggattcaagactgagaacaagcaatcgcttttcgatgctgttgataaggttaccaaggatttggtcgcggatggagtaaaggctgagcacgatttgag

SEQ ID NO: 29466 - DNA, 1031 bp, Caenorhabditis elegans
attcgtgtctacctgtctcttccattcaacactgctagccgtgtcattggaggattggcaaatcaagagattcccgtctggctccgcgagcatcttctcggtggatttgcccgaatgtatgattgtcgaatggatgactgtgtggatccagatttcaagaattacccatcatttgccgcatttttcaatcgaaaactcaaggaatcaacacgcccgatcagtgcttctccattagtttctccagcagatggaacagttcttcattttggaaaagttgaagataacaagattgaatatgtgaaaggacatgactacgacgtggataaattccttggtgatgtggatcttccacaaaaagatgaactcgacttgtatcaagttgtcatctatttggcacctggagattatcatgcattccattcacctgcaagatgggttgccaatcaatgtcgtcatgttccgggactgcttctatcggttcgaccgactctgttgagtcatgtgccacatttattctgtttgaatgaacggtcagtgttgaaaatttttgttgaatttgagaatatagagtaccagggatgtcattaaaaattcgaccaaaacagcatactttttgaaaaactttccttttttggtctgaaatagccaaaaaattgtttttgctactaaatttgttttcttagaaaacaaaaactcagcaattttaatattatattttcagagttgtgctcaatggtagctggagacacggattcttttcaatgtctgctgtcgctgcaacaaacgtcggagacattgtcgtcgacgccgaaccttcactccgaacgaacattgttcgcaggaaaactcagaaaataatgaacactgaaacagaaatccatgcaccatatgtttcgggtgaacgtgttggagagttccgtctcggatcgacgatcgtcctcgttttccaagctccacccactattaaatttgccatcaaagcgggtgacccacttcgatacggtcaaagtcttgttgctgatggggtttag

SEQ ID NO: 29467 - DNA, 597 bp, Caenorhabditis elegans
atggacgtagaaaagcttaatctggacaatatcatctccagattattggaaggtatgtgtttgtcatagtgtttattgaaattaatcttaaaatgatttccgcttcagtcagaggatccaaaccagggaaaaatgttcaactcacagagagcgagatcaaggggttgtgccagaagtctcgtgaaatttttctgagccaacctattcttctcgagttggaagctccgttgaaaatttgcggtaagttctatcgaaaaaagttgacgtttcctgctatgagtcattttacttattagtatttccttccacaggaaattgccgtttttatttttgataatatatattctgagaaaatatatttttcaggtgacgtgcacggacaatactacgatcttttgagactgttcgagtatggtggattccccccagagtcgaactacttgttcctcggcgattatgtggaccgagggaaacaatcgttggaaactatctgtctcctacttgcatataaaatcaagtacccggaaaatttcttcctgctccgaggaaaccacgagtgtgcctcgatcaacagaatttatggcttctatgacgagt

SEQ ID NO: 29468 - DNA, 1612 bp, Caenorhabditis elegans
atgaaccttaacagcccagctgtatcaatgcttggcggtgacacccctgcacatggtggaccgaattccgtacttggaggtcaaggaccctcatcaattctcacgggacacggtcccaactctgtaatgggaccaaactcgattcttggacctggaagtgttctcaatccacaatcaattcaaccaatgcaatcacaacaaatgcacagtaagttatttgtggaaaactcatttcagggtttttgcttgaaaaggataaaactagcccaaaattaactaattttttttaaagagactgctcataaaattttcactattttttatggcatgacaaaaagtaaattaacaagaaatcagaattttgctgaatcccgagacttctatcacagcagctgaattacagattttttgaattatcaccctttatagaatattttgttagtttttcgttaatttcggcaaatttttatgtcgttaggcgtctaaaaatgaacataattggcatgtcgatcataaatgggactgaatcgacgatgtgaagcgagataaacaactaaattataaaattataaattgttcaataaaatacactaattaaaaaaaactgtatcctaactgatgcgacaaggaaaagttagcgaaatttcagatttaagcgaaattaatacgtttttttttcgaaattttaatattgtacagtttaaaaaatttatgaaaaaatctgatgaactctctgtgcacgtttattttagccgtgaccagtctttcaactttataaccttttttcagtcttaaagccgtttgtcaaaattaaagatttatattatttcaggccttcaaggttcttcaatgcaaatgcattcacatctcgccaactccaatctcaacttgaacataaatccagcttcagtcggacctgatcgtaatcctggatcagttatgcatcacaatttggacatcaatcctccatcagttgcatatcagaatttgacagttccaatgacaccacttgcatattctgtatatgatcgagatgctctgacacatcaggctccggcaagtaacatcgctgccacaatggttccagcaactccagcaagtcaattggatattccgatgccagctcttcagaacattgtctctacagtcaatttgggagttcaattggatttgaagaagattgcattgcacgcgagaaacgccgaatacaatccaaaacgtttcgcagcagtcattatgagaattcgtgaaccaagaacaactgctttaattttttcgagtggaaaaatggtgtgcactggtgcgaagtcagaagaagcaagtcgattggcagcacgaaaatatgcgagaattgttcaaaagttgggatttcaggcgaaatttaccgaatttatggtaagtgtttctggaaaaaggtcacaaaatcatttgaataatttttttgtaggttcaaaacatggttggttcttgtgatgttcgttttccgattcaacttgaaggattgtgcattactcactctcagttcagtacttacgaaccagaattgttccctggattaatttatcgtatggtcaaaccaagagttgtgctccttatttttgtgtctggaaaa

SEQ ID NO: 29469 - DNA, 389 bp, Caenorhabditis elegans
gtggatcggtgttccatgattatgtttccactgtcttttcttatttttaacgttgtgtgagttttttgaaacgattgtttaaaatttaacaatggaaagttgcttctggtgtacggtaattgcatattaccacactacatagcttcaaaactctccccaatcaataataacctaaatgtgtgtttttccagatactggtcaatatatttcatgaaaatggatcgtcccatgtaaattcatcacattcccttttcccccatgccctccctcccctccttgtctttgttttgttcaaaaatcatcgaattttctcatattattttattactgggatgctaaaacttgcgatcaaatctccgcaaaaatcatggcagtgggccctgcgatga

SEQ ID NO: 29470 - DNA, 1594 bp, Caenorhabditis elegans
atgtctgcagtctctatgttacagggagaaatgcttgctcgtggaggcgccgtcattgcccgcggagcgtctcttgccactgcccgcaatttttcgcgcaccactgttccaatggctaaggtttgtttttttgtctgataacaaccatataaaagttcataggcaaacaagtaatgtaattgagtgtttcggagatattttagatagaactgaacgatcaaaacatatttagtttcgaacattctgtctacatcatgaaatgttctgaaatgaaacacaattcaaaataatatactcatttgacaatatttagcatttttaacagtatctatatgcaaatgagtttttgtagattcgtaaggaacgagatactttcggagagctcgaggttccagccgacaaatactatggagcccagaccgcccgttcccagatgaacttcaagattggaggaccagaagagcgtatgccaatcccagttatccacgctttcggaatcttgaagaaggccgccgcccttgtcaacaccgagttcggattagacaaaaaactggctgacgcgatttcccaagctgctgatgaggttgttgacggcaagctcgacgagcacttcccacttgttacatggcagactggttcaggaactcagtccaacatgaatgtcaatgaggttatctcgaatcggtaaaaactaaaaaaaattgtttaaagattttattgaattcattgcagtgctatcgagatcctcggaggagagctcggatcgaagaagccagttcatccaaatgatcatgtgaatatgtcccaatcatcaaatgacacattcccaactgctatgcacattgccgtcggacgtgaagtcaactctcgtcttcttccagctctcaagaagcttcgcactgcccttcacaacaaggctgaagagttcaaagatatcatcaagattggacgtactcacacccaagatgctgttccactcactcttggacaagagttctcagcttacgtcacacagcttgataactctattgctcgtgttgaatcgactcttccacgactttatcaattggctgccggtggaaccgctgttggaactggactcaacacgcgcaagggattcgctgagaaggttgccgccactgtttctgaacttaccggattgccattcgttaccgctccaaacaaatttgaagccctcgccgcccatgatgctctcgttgaggttcacggagccctgaacacagtcgcagtttccttcatgaagattggaaacgatatcagatttttgggatctggaccaagatgcggactcggagagttatcactcccagaaaacgaaccaggaagctccatcatgccaggaaaggtcaacccaactcaatgtgaagccatcacaatggttgccgctcaagttatgggaaatcaagttgcagtcagtgtaggaggatctaatggacatttcgagttgaatgttttcaagccacttatcgttcgtaatgttcttcaatcaacacgtcttcttgctgacagcgctgtgagcttcactgatcattgtgtcgacggaatcgttgctaacaaagacaatattgccaag

SEQ ID NO: 29471 - DNA, 1079 bp, Caenorhabditis elegans
ggagtcatcaaatcgctaaaaactttgtgaactcatcaactccagatcttcgacccacatttgttgtaaatttcgatacatcaacagttatttgtcagcacaggtgagcatttagttattgaaattcttaaactgattaaactagcaagttatatggatgtgaacatccaaactagattgtctggaaaatttaagagatatcttgtttatcaattctttgttttccaaatttctaagttaaaatttctcttgaattctgacagtagtgcccaaaaacagccaattaaaagaaaaccaaatgggtcatcaggcaagaaaacaggcgtatcaaaagagtgacacagaggtgtcataaacttttttttggaacaccgaagagttgttaaccttgagagaatagcaacacaaaaaatcaatttcatggatgattgaaaagaacaaagtgtcaaatgggtgggagaatatcgagcaaagttgcaaaatttgaatttagaatgattttgtgacctcgaaaaaagaccaaactttgtgggatcaaggagagaaaaaggacaaaaaactggtttaaaattttgaattttcagctccgatccaacagacctgcatattcataacatgagctctttatgcgatggaaaacaagattgttttgtgaatcctgctatgcacgatgaagttttcccttattgtggttagccttttttttttcaaagtgcaggtttccaatcaattttctttcagaacacaaatgccagtcaacatgtagtgggaaaggagcgtgtctctacgatggagccaaacctcaatgctattgtgattccggattctctggttcagcttgtgagcttcaagataagaatgaatgtttggagcatccttgccatatgatggctcaatgtcaaaacacgttgggatcctatgagtgtcggtgtctgccaggatatgaaggaaatggacacgaatgtactgatattgatgaatgctcagataaacttacatctagatgcccagaacattctaaatgtatcaacctgcctggaacttactactgtaattgcacacaagggttcacaccaaaa

SEQ ID NO: 29472 - DNA, 818 bp, Caenorhabditis elegans
ctcattggaggttcccttaccttttcaatcaccgacgcctacgctcgtccgatcgagacacgaattgaaaaacgtgtgaatgatggtcgatggcatcgtcttctatttcaaatgtcagaggatggacgtcgaatctcaattcaagtaaatggacgtggaaaagaagtgaaatcacgtgtacctctccaaatgctcttcacagcaaaaaagatacaactgatgacacctgccgcattttgtttccgacgtttgcttgctcaaaatcaattcgtacatcctattcttaatagaaacaagttttttgaaatatcatcaactggaacatctagaaatgagtgtcaatttgattcaattcaatctggatcaggaggattccgactgttttccaatttctcgaatacaactacactcattctgctcataactcttgctcttatcagtttaattggattttccgtttgtcttctggcaatcagaagacgatggagacaaaaatcacctggagatcaaaaacaaactgaaagaagtaatgggtggacggggcatgtaatgccacgtagaagaggacatatcaatcgatcaatggtcaagtcacctgatgacgatacttatgacgtggcaactgtttatggaatggtgagtaaaccagaaaaagtgctaatttaaagtcgtatttaataatttttgaaatatttcagaaatcgacatcaactgatgacatcactcatatctacacatcttcatcatcacgtcgctatcaaccaccaactgccccatcttaccgtagagacgggcacattaatatggcttacttatag

SEQ ID NO: 29473 - DNA, 604 bp, Caenorhabditis elegans
agtaacgagttcctgggttcaaaacgccactactttctcagcgacaatcgattcttcaacatcacaaaaactttctcaaattgagcttcctgagcatctcacagtcccatctgcaatttcaacatggtttccagttcagtatgccgttcttccatctcttttctttgaaatccgatcaccaccaccactacgtccacgtgacgtggcgatcgcagctccaactggaagtggaaagacaatttgctatgtgctcccagttctggcggctgtcgggagcaaaccatccaaaattctacaagctgttattttagtaccagttcaaacacttgttgcacaaattgtggacgagttcaagtatgtattaagtaacattaaaatgtatgttttaattctgattttaagacgatggaatgacgaaagtggtgttgcaaaagtagtatcacttagtggagcaaacgattttgagaaagaagctcgtcaattggcatcagatcctcctaatgttatcgtggcaactccagcgagacttgtgcaacacctcacttcaaaaattccacctccgattgacctttcaaaattaagattcttgattgtggatgaagcg

SEQ ID NO: 29474 - DNA, 354 bp, Caenorhabditis elegans
attaatttgggatctaatggtcaatgtggtttgatggatgaagatgggcaaaagaaagttgttgttgattatggggtacaattgttttacttatttgaatctggtatattctaatttcagggtgaattggtatggaacagctacgaacaaaatcttatattttctggaacattttggggatcacttattacagtactcccttcaatgttcttcattgagcgcttttctccacgtcacgtacttcaaatttctgtagccctttacattttggttaccgtaataactccttttttggcgacacatttcggatatttttcagttttcctggcaagaattggaatggggttaggagag

SEQ ID NO: 29475 - DNA, 1351 bp, Caenorhabditis elegans
atgcgttatcattttcttttcggttcgctgcggaatcacttgttttcgttccgaggggttatttactgcagagaaaagctttttaattgttccaaattaagttttaggcctgtgtttatgaatattatcctttcttttaatttttttaaataggttctatttctttccctttgtcggacaggaatttctgtgaaaatctttcattgttctgtaatttacaggagaaaccatgaattctcttcttcggttgagccacttggctggacctgcacattatcgcgcacttcactcctcttcgtccatctgggtattcaaacctaagcataattattataaatcttttgttttcagagcaaagttgcaatcagtaaattcgagccgaagtcgtacctcccgtacgagaaactatctcagactgtgaagattgtgaaagacaggtgtgtaaagttcaatttgtttagcttgtcaagtacaaagtatcttcactgctttctgttcgttatcatacaattaatgatgtttatggtgaatagtcatgtgcgccactgacattacaacacatacagttcagttataggttcttttatgttatttctaactctcgaatagtgaaagctcacccaaatcgcagtcacaagccaagggtcgcagagagaaacaaacagagttccgttgtaataagaagatgggttagagcgtcattgagagaaccaagaaaacgtcgaatcttttccatctctgttctctgattaatgtcaacatgttgtgagagggcgttttgaccataatacagtttcataagtgtacatcactattcttttcaacttttgatgatgcaaaatctaatttctggtgtcattaattgtgatgtcacaatagaaattatgaaaattatctagttgaacgttgcatagaaattcatgtggaccacattctctagtctccagactggtcgaactttgaagccgaggtgatatttgccgtgtgacagtactttgaactcatgaaggaaacatcgttaagtctaactaaaaactttaaaaatagattttagtttttctactgataaaaacaaaaaatatattgtttcagattgaaacgtccattgacgctttccgaaaagattctctatggacatttggatcaaccaaaaactcaagatattgagagaggagtttcataccttcgtcttcgtccagatcgtgttgctatgcaagatgctaccgctcaaatggctatgctccaattcatcagctccggacttccaaagacagctgttccatcaactattcattgcgatcatttgattgaagctcaaaagggtggagcccaagatttggcccgtgctaag

SEQ ID NO: 29476 - DNA, 1615 bp, Caenorhabditis elegans
atggcgaaagacttgattggaggaatattcgataatgtggtgaataggaaaggaaagaaggagcaggataactatggtagcgtttgtgttttttttatttgctgttttgtgctttctatagatttgattatataattagcttaatcattttctcaaattttctgaacatggtctgtaatttattatcctcggttttttttctagtttttcattcttggacgtctgggaatgtgaagcttctttgtcttttgttccgtaattgttcaccaatcttcaagcttttttcttgaaaatagcgcaattccacgctcatagcacaaattcatcaacttatgttaaaaatcaggtggaggtcgacaacagccgccaccaaataacaattttggtggtggaggtggatctggcggtggcggagggttcggagacattcttgggggacttttgagcggcggaggtggcggcggtggacaaagaggcggcggagggcaaaattacggtctgagagtttgaaaatacaataagttaagcttctacgcactcaccaacactcacttaaatactaacaacaccactcatttccaaaatttgatttgaaaaatatggctattttgaaagaagctttagacttttaaattctcctgttaattcgcttttgactgatgattcgtgattttcctttaaaaatgcaatattttgcatgtttgctgtgatatttcgtgtgaaatttaggcggaggcggcagtggcggtggcggtggtggaaacaacatcggaagcttggtcggatcacttattggtggtggtggtatgcattaggattgtagtgtgcatgtagtatcataaatgttgtgttaatattttaatagttaatagagctgatgatcagaacatttatagatcttattgacacttatttatcacatctaattgtatttcatttctgaactatctacacaaatgtggcacccatgaaattcaagctagagtaatattttaggcggaggtggtaactacggcggtggtggtggaaatcaaggaggcggcggaggcggtggctttaacttcaatgatatcggtggactcatcaacagtatgggaggtggtggtggtggtggccagagacaaggtatagaacatttattaatatactttgaataatttgaaaaattttaggcggtggtggaggaggcttcggagatatcctcggaggaatcggatctctcattggcggaggaggcggtggccagtacaatggtggaggtggaaatgtgaacccgaataatctcaacggtggaatggtgaatgttatcggaaatctcattggagaagctgctcacagattcctcggcgttgatccgggtacaggcagaatcattggagctgtcgctggaaatgtgattatgggacttggtggaaaagataattctcttggaaatatcggaaaagttattctggacaatattatttctggaaagttccgtagggatgttgatccattcgttcgtccaggaccagatccagatagaggaggtggtggaagtggtccaagccctatttcaccaagaccaactaccgaaccacaagacttctatgagctcagagatcaatgtcttgag

SEQ ID NO: 29477 - DNA, 1328 bp, Caenorhabditis elegans
aaacaccatcgtaaacttcgcacaaacaaaaggacttcaagcattttcgacatcttccaacacaggcactgtgccgtttaagcttgtgattcttgacgaggctgatgctatgacaaaggatgctcagaatgcattgagaaggttagataaaactgattatgaacaaaatataatcatccacaatgtaaatatttatttcagagtgattgaaaagtacacggacaacgttcgtttctgcatcatctgcaactacttggcatcaatcgttccagctattcaatcccgttgtactcgtttccgattcgctcccttagatcaaaaactgattgttccccggttggaatacattgtggagacggaacaactgaaaatgactccagatggaaaagatgcacttttgattgtttcaaaaggtgacatgagaactgtcatcaacacacttcaaagtactgcaatgagtttcgatacagtttcagaaaatacagtttaccagtgtattggacagccgacaccgaaagaaatgaaagaagttgtgaagactctactgaatgatccatcgaaaaaatgtatgaatacaattcaaacgaaattgttcgagaacggatatgcccttcaagatgtcatcactcatctccacgattttgtattcactttggacatcccagatgaagcaatgtcagctattatcactggattaggagaagttgaggagaatttgtcaactggatgttctaatgaaacacagcttgcagctgttgttgcagcttttttcgaggcaaaacgtttgtgtgtgaaagagatgaagaacttggaaattgaagacatggaattttaagagtattctattctcctttggctgtctcggtgattcctatttttcacgaaatgagtaaattgtttgatctctcagtatatttttatattttttaagtgacctcatttattatcctcgatctgtgaaaaagttgactttacacttacatgtatgaatatccaataaactggttgcaacttgattactacattttaattttactgtggagtaagttatcgctctctcaatatcagaatcagaaacggaacaattatgaaattccaaaacttcagcaccaatgaatccgaatcaacccccaaattacccgcctggcaacccaaatcaacctccaccatttccacctacaccatattatccaatgtatcaagctggaatgccgatgccatacattccacagtctcctcaatatcctcaaccggggcctccaggcggtccaccaccgtttatgggaattcaaagtgaggctttagctggaaatatcatgcaaaaataa

SEQ ID NO: 29478 - DNA, 215 bp, Caenorhabditis elegans
aacagcggtgccgtcatgaaagtggcgtcaaacgggaaaataagcatttcaatcatgaaaaatccaaactttgcaatgaaaatgttcctcctccagatgaagtcacacaattgtaagtttccgtttttattttatttgtattcctatttgctttttcagccctggatcatcggaatatgcgtctctccaagaactcgaacaacttgcccagctag

SEQ ID NO: 29479 - DNA, 381 bp, Caenorhabditis elegans
gtggaaatcggtgaaatgaagcgaaaaatccacgacgaggttctcttcgcaaagagccccgttcaaatgctgagctttgtgaaaactgttcgttccactctgttctatcatcgtccagactatgagaagctattcaaattgcttgaagatgtcatgaaatgtgccaattataaatggtccgacccatatcattgggagccagagaagaagaaaaatccagcatctcaagggaacaagtttggattgggaaagaaaggtaacacagcttgaattgtcaaaaattaattttgattatttttaggaacaaaagaatctggagagctcccagaagcttctttctttactgtggatgacttcaacactaacccacttggattctag

SEQ ID NO: 29480 - DNA, 998 bp, Caenorhabditis elegans
atgaaaaccctacaggttcaacgcgatggcttcttcaagtcaggattcatgccgactagacttccagtctcctgcctcactatggtgccaaagttcggaggacacgaaacttcgatgatggaggaaaatgttgctccaagaggggttgatgctcgttcacaacgcccattgaacggaagagctggattgtctgccctcccacaacacatcgtgtcgaacaatgccgatcgtgagcgtgctcaacaacaagctgcagaggcgactttccgggagcccgaggatgcatacctttcacaacttttccaccaagttgctgtgctcttagagcagcgtattccaggggtaagaataaacaagaggttttttttaaattaaaagtttgttacagctggaagaagaagaagctgctcttgatggttatcaatcaccagagtgcctcccggttttctggatttcgaaatgggttgactattcggacaagtatggcatcggatatcaactatgtgacaattccgtcggagttctcttcaatgacaattctcgtatcatgcttgatcaagctggaaacgagttgacctatattgagaagagcaacaaagagcactacttctcgatgcactcaggtgaaatgcctggattgctcaacaagaaagtcacattgcttaagtattttcgatcctacatgaatgaccatttggtgaaagctggagaaggatctgaacaaagagctggtgatgacttggctcgtttaccaacgcttcgagtttggttcagaaccaaatcagcaattgttttgcacctttccaatggaactgttcagataaatttcttcaatgtaagcaaattcataatttaatggaaacacccaacaatataattttcaggatcatgtcaagatgatgatgtgcccattaatgcaagcagttacattcatcgatcaaaacaagcgtatgctcacctacaagctgaacaatcttcagcgcaatggatgtccagag

SEQ ID NO: 29481 - DNA, 1168 bp, Caenorhabditis elegans
gtgggaatcgcttcgaaaaaagaggaagtaataacatgtcctaaaacgaatgaagaattggagaagatcatgaatcgtgcatatggagacgatgcaaactcattcacactcgctcaagagatcattgtataccttgggtcgttggttcgcacggagccaaaactgtttcttgaaatgttccgtctccgcatcggtctcattatccaagtccttgcctctgaattatcacgtcttcgaaatatttctggagctgaagcagctgaaactttacttacagtttcaccatttgaactaaagtcaatgatattctcgcttctctctggtcgattattagaagaatatgcggaggatggaattcattacagcgacacgatcagagagacacgaactggaatcggatccttccgacgacaaatcgaggaacgaaagtcacttcggaaatctactcgaagtgtcggaggattggagataccaaaggaggaagatgaagatgaagaagctgatgaagatgatttccaatttggaatttggctccgtcatcgacgtattgatggtgcattgaatagagttccaaatggattctatgcgatactctgggatactgtacataaaatgccacatggagtgaaaatcaatgacactgttttgcattggggattaacacaagaaatgacccgaaaagaaattaaattcgcattggaatctgaagaagctctaaataggattgcagagcccgaatatcgagagcttgttgtagagactttgtggttattgggaagactggaaaagttggtacttcttgagcaaccaaatattccaagagatcgaccattggatgttgatcacattttgcacgttgcgaatcaaatttttgtagatcataatgtgagttcttctttttattgtatttatcgaaaaaatcatccctcgatgtgctgaattaatttatatactaattttcaattgttttacaaatagtaagaaatcaattatttttcagaaacaccttgaaacaattgtaatggaatgttgtgcatcatcaaacccaaataatacgagatgcgatggagctcgcaatatctgcaagcatttctatgattcggctccagctggagagtatggcaccagtcactacattattcgtgcgttgatgcaactgtattcttga

SEQ ID NO: 29482 - DNA, 1872 bp, Caenorhabditis elegans
atgtgtgatgcaaagacattggttcggagaatgaatgaagtggaaaagatgatgatgagtagaataggtgaagttgatcaattgcgagattttttggataatctgaaagcatcaaaaacgtccgacactttccaaacaactgagctggaaaataaattcgaactgttggatgtggaatggaaccatttggaagaagaattgagaaggagagaagtagatttgaatgattccatgtcacagattctaatcgatgagcaatttgacacaattcgacaatggattaaggaacgcaccgaagcactagaagctgatgtggaagtctcgaacaagacaaagcctgatgatattgaaagaatgcaaaagagacacgatgagctagcttccgatatcaacgattatcacacaatctatgaagattttctcaacaatggccaggttgaagaggaaaaagttcaagtaattcgtcacctatggagcagcctcattgaatcgtcaacaacacgccagaaatcgcttgcacaagaatgtcaaaaaagccgcctttttgaacttctagatggcatgagcatttggctgattgatgctgaaacagatgttcactccactacaaacttcattggcttgtataactctgtagatgctgaaaaagcttcacgtcttttggtatctctaggagagcaagctggagaaaaggatgatatcttgatacgtattcaatgtgatgaatctgtggatgttattgtggagaagttgcgtaacggaatctcacagttgcaaatgctaattaaagcaaataatgaagatttggatgtctggaaaagcatgcaaaaagttgtcacagcaattgatgatgagatatgttggttcaagttagttattattgttttgatcctcatactttatataacaatttcagagagatcaatgtaatcttctcaagtacaaacgttggtaatgatgtttcttcaaatgatgtacttaagcggaagcatcaacgtcttcaactggaaacgcagcgtcgagaacaaaaagtggcaaaagtcgtctatctcacaactgagctagtgtcaagtcatcgacgtccatcccttgaatataaatttgtcgaaatcgatgagaaagtggctgaattgacagaactactggagagcaatcgtcaaattgcggagattcgtacgaaccggctcgaaaagtggacggagtactttgtggtgattttaaaaacacttaattatttttaaactatattttcttcagacaatgaatgaaatccgtgagaaagagcaacttctcgatcaaattctcgatctcaaaacaggcctaccagaaacagtgctagctgatgttgaacgaaagcttcaagttttggaaacagttggagatcatatggacacattgacgatcaaagctgaacagatgtcagatgatgaagtgattcgaacgaaggttgctgtaacagcaatcgatcaattgcgaaagaaatggttgaaaatgaatgaagaactgaagaaaatgcatcagaagatcaaggagtcaattgaattcacaaagtttgtttctacatgcgacactggtattcaatgcattcgtgagcaggaagagaagatcggaaatctggtcaggcatcagaaacctgccagcaattttgaaaacaccgcatatcattctaccatgactttcgttgaaacctacaccaaagatacatttgagaagctcaaagttgtatgccgtaagcttcaaaattctaccgatgccgaaaagaagctgtcacttgtttcggaaagattgaatgcactcaagaagcaactcgatttacttgctgaaaagattgcagtggatgacaagtttaaactgaaagttcagaacattcag

SEQ ID NO: 29483 - DNA, 778 bp, Caenorhabditis elegans
atgtctccaatgaatcgacaacgcaaaaataagtcgaatgttttaaatgaaaaggatgagcgtccaggttgtattattaaagagttagtttaatcttgtaataattctgaaattaatgaacattttatagaaaatcaagcgttcgttcgatggcaaaaactcaaccaacatcaggtcgaactatttctcttagtgagattaataagcctattgctttgtcgaaaaagaatactgaaatcaaagcagcagttgagattcagaatcgattgacgaagaaaatggcgaaaaactctgagagaagaaaaaaaatggcacatggaccggagatgactgcacaaaaccgaacacaggagagaattgattttgttgagttcctcgatcgtcattatcaagtgatgcaagccggtgtaagtacggtaaaagtgggatttcaccttgaaatttgaatgttcttgcgcttagcaccgcccattttaaaatcaatcagcgaacttttggagggaatttaaataaactgaggagtttttaggttttaggtttttgactgatctttttctttttcacgaattctttttccaggttcacaaaatgcactacacaaaggaggaatttgagaatgtgatctacgaggctcaaaccatcttctcatcggaaaaagctcttgttgacatcgatccaccatgtgtcgtagttggaaatcttcacggacaattcaacgatcttatcaacatgttcattctattgggacgtcctcctgagacagtttatgttttcactg

SEQ ID NO: 29484 - DNA, 1235 bp, Caenorhabditis elegans
atgggtattctggagaaaattgcagaaatcgaacatgaaatttcaagaacccaaaagaataaagccactgaataccatttgggtcttctaaaagcaaagttggcaaaatatcgtcaacaattgttagaaccaacaggcaaaggaggtgccaaaggagaaggattcgatgtaatgaaaagtggagatgcgagagttgcaatggttggatttccttccgtcggaaaatcgactctattgtcctcaatgacttccactcactcagaagctgctggatatgaattcacaactcttacgtgcattcctggtgtcatctcttacaacggagccaatattcaattgctcgatcttcctggaatcattgaaggagcttctcagggaaaaggaagaggaagacaggttatctcagttgcaaaaactgcagatttaattcttatgatgcttgatgcaggaaagagtgaccaacagaagatgcttttggagcgagaattagaagctgttggtattcgattaaacaaaaagccaccaaatatctatgtcaaacaaaagaaagttggaggcgtgaaattcacaaatactgttccgttaactcattgtaatgagaaattgattatgacagtattgcacgagtacaagattttcaatgctgacgttattttccgcgaggattgcacgtatgtttttttttaattatcactgagcagaagtcccaaattgatatatttattaattacagagtcgatgagtttattgatgtaattcaaggaaatcgtgtatacatgacgtgcctctatgtctacaataaagtcgatcaaatttcgattgaagaaattgatcgattagctagaatgcctcatcacgtcgttatttcatgtgaaatgaacctcaatatggactaccttttagagaaaatgtgggaatatttggcattagtgagagtctacacgaagaaacctggaaacgcaccagatcttggtaatttttaacgcttaaaatttgtatttaaaattcacattagggttaatcaattttctctcaattcaaaaatgaaaatttcaggacccgaagacggtatcattctccgtggtggagccactatcgaacattgttgccacgcccttcatcgttcaattgctgctcaactccggtatgccatcgtctggggaacatcgacgaaattctctccgcaacgtgtcggtcttcatcataaactcgaccatgaagatgtgattcagatt

SEQ ID NO: 29485 - DNA, 1128 bp, Caenorhabditis elegans
agaaaacgacgtcttctcgccccgagacgaggttccattctccaaactagtctcacttcttcgaagtggtcccttcaatgttgaagcccattacgctcaaccaaacgttgtcccacataaccaggttcatattggatcttggaaagtcaatggagcacgaccaggtgccgatggtggtaatcagaaggttaaggtgaaggttcgtgttaatccagatggtatcttcacgatcgcttctgccacaatgtatgaaccaagaattgtcgaggaagttccagctgaggcaatggaagtggatggagacgctaaaactgaagctcctgctgagccactggaaccagtgaagaagactaaacttgttccagttgatttggaagttattgagtcgattccagtctcttacgatgttcaaaagttccataaccttgagcttcagatgcaagaatctgacgctagagaaaaggccaaggctgacgccaagaactcgctcgaggagtacgtttacgaaatgcgtgacaaagtgtctgatcagtatgctgaattcatcaccccggctgccgctgacgagttccgttctgttctcacctccaccgaagattggctttacgacgagggagaagatgccgaacgagatgtttatgagaagaggctctccgagctcaaagcagtgggaacacctgttgtggaaagatatcgcgagtctgaaacccgaaaaccagcgttcgattcattcgatcaatcaattatgcgtgtcagaaaggcatatgaagattatgctaatggtggaccaacctacgctcaccttgatagcaaagaaatggagaaggtaatcaatgcaattgaggacaagaagaaatggttggacgaagctcgtcacaagcaagagactcgttccaagactgatgcccccgttgtcttcaccgaggaaattcttcaaaataagaatgtgagtagattaaatagtatttatatgacattatatctttgtttcaggtcttcgaaaatgttgtcaaccctatcctcaataagaagaagccggccgcaccagccccaccaaagaaggaagagccccagcctgctgctggagatcaaccacaatctcaaccaggagagatggatgtcgattag

SEQ ID NO: 29486 - DNA, 1306 bp, Caenorhabditis elegans
atggctccgaaaactggagaaaccgtcgttgaaaaaatggaggtagatgaagctaagcaagatgtcccagccaccgagccagcaaaagatctcaacgcaattgcagttgaaagtaagtgaaatacagaaatactaaagttttgattgccttcttttctagatatcaaagaacaattagctgctctcgacaaaggagaagaacatttgatcactcgcgtgttgcaagtattgccgaaaactcgcaagcagatcaatgacaacgttctttacaaactcgtgtcttcacatttaagcagtgatgctcagttcgccgaaggaatgttgaagtatttgcattacacacccgccgctgatactgaagttcagccaatggatacttcgaatgtcaaaacaaagtctccaaaaaaaggcgtcaaaccagtgtttgcatctcccgaatcagattgctacttgcgtcttctcgttttgcttcatctttatgctcaaaaaaagaataccgaagctcttgctctcggcgagaatcaactcacatcaagtaaaaaacatattttaacccaaacaaaacgtataattttcagtttacaactttgatcggcgtacactggatggactcgcagcaaaaaccctttatttcctctgtgtgatctacgaacgagaaggacgtcttttcgatcaccagggattcttgaactctcgactccgtactgcaactctccgtaatttctccgagtcacaagccgttctgatttgctggcttcttcgctgctacttgatcaaccgtcaatatcaatcagctgctcatcttgtctccaaagttgcattcccagacaatgcatctaacaatgatcttgcccgctacatgtactatcaaggacgtataaaggctcttcaactcgattacaattcggcggctggatatttcttgcaagctcagcgaaaagctccacaagaaggtgccattggcttcaaacaagctgttcagaagtgggttgttgtcattggtcttctacaaggagagattcctgatcgaagtgtgttccgtcaaccaatttatcgcaaatgtcttgctcactacctggatctcagtcgaggcgttcgcgatggagatgttgctcgttttaatcataatttggagcaattcaaaacacagtttgaagctgatgatactctcacattgattgttcgtctgcgtcaaaacgtcatcaagactgcaatcaagcaaatttctttggcgtattcccgaatttatatcaaggatattgccaagaagttgtatattactaacgagacagagactgaatacatt

SEQ ID NO: 29487 - DNA, 1164 bp, Caenorhabditis elegans
atgcagaacagtttggcaaaacttatcaaagagaaaataaacccaaatgttgcacaatgggaaaagagtggaagatatccagcacattttgtgttcaaaatgcttggacaacttggagtatttgcggtgaataagcctgtaggtgaggatacttattttaaagaaaaaattttggaagttgaaaattattgaagactatggtgggactggtcgagattttgcaatgtcaatagcaatagctgaacaaattggagcagttgattgtggatcgattccaatgtcagtcatggttcaaagtgacatgagtactcctgctcttgcacaatttggtgagttctataaaacttatactgtaacttaattgatatatcaggctccgattcactccgcaatcgctttcttcgtccttcaatcaatggtgatctagttagttcaattgcagtctccgaaccacatgcaggatcagatgtatccgcaattcgcacacatgcccgtcggtacggcagcgacttgataataaatggctcaaaaatgtggataacaaatggagatcaggcagattgggcatgtgttctagtaaatacttcaaatgcgaaaaatttgcacaaaaataagtcgctggtgtgtattccactggactcaattggtgtacatcgatcaactccgttggataaattaggaatgagaagctccgatacagttcaactattttttgaagatgttagggtgagtttcttaaaatgatctacggcccctttaaccaattttaataaataattcaatgttcatttcaatcgaatcatttttcaggttccctcgtcatacataataggcgaagaaggacgtggatttgcatatcaaatgaatcaattcaatgatgagcgccttgtaacagttgctgttgggcttctcccacttcaaaaatgtataaatgagacgattgagtatgcaagagaacgattaatatttggaaagacacttctcgatcagcaatatgttcaatttcggttagccgagttggaggctgaactggaggcaacccgttctttgctctatcgaacagtgctggcacgttgccaaggcgaggatgtgagcatgttgactgcgatggcgaaattgaaaattggaagactggcaagaaaagttactgatcagtgtctacag

SEQ ID NO: 29488 - DNA, 340 bp, Caenorhabditis elegans
aaaaatttgaaaagtgcattgtcatctcaattaagattatcagtcgaaggaggtgcagttgcacaaccaggatctcaatctcataatgcaattagaagacaacaggttaatatttcttacaacaaaaatttaatcgttgcaaaaataaccaaaacgactcagattaacttattccacaagctcaatcaaataattttttaaaagctattttcattatcactgattttttgccacaaatattattgttttccaggtagctgcattcttgcctgcaaatgaaaaagaagctttcaataatgtggatcgacctgcaaacactctctacaacacagctgtctga

SEQ ID NO: 29489 - DNA, 1140 bp, Caenorhabditis elegans
acaaatggttgttgcaagtttttctgatcgcctggctcgtcgcgtcgatcgttctgtcggacaagaagaagttcaaaaaggtgcatacgagacgacattaatcaagggacacgttttcattgatccatgctcagtcgtattcacagaagaaccagaatttgtgatctatcaagaattggttcaagtaaatgagaagaagctgatgacgtcagtgtgtgcagttgataaagaatggctcagtagattggctgaatcatattgcaattatggagaacaggacaagaatcaggaaccgatttacgatccagtcaaagatatggttgtgaaaacagtgaaagtgacatttggaccgttgaattgggaattgccgaacgaaaatcgaagtgtaccacatgatatcatgatgtatagatattttgcactattcctcctcgatggattggtttttgaaaaactcaaagaatatactccgaagctactagcaccgccatcaacaatggtcaagtcttgggcaaaattgcagaaacgaacggagatgttgttgaataagttaatcgagaaggaggtaagcagtacagaatttcagatcaaatatttcagctttttctttcaaaaaactgaaatttaaaaaatatatagaaaaatgtacaaaatgtctacagttttcaaatttttcttttactcgactgctcgattttctgcaaaaataatttcaaaattttcaagccatttttctattttttaaaaaataatttatttatcgtctgggttatatttaattttcaatttcaaaatgtttgtcttctatgaaaaaaaaacgattaaaaacctttttgtagattcctaaatctttctaaaattgaaaaataaaaataaattcattttttctgaaaaaaaaaacaccagaaaatcgaaaacaattttttttttcgaaaacattgtttttgttttttagatttccttttccaggtaacaacgcgatcatcactgaaagagcaatggttgaaaaatgagaattggttgctggaagaatatttggaatgggttccagaatccgtgcatcaacaaatttcccttatgtggccaccgcttgaagatcatgaaaagactattaaaatgggtagaaacaagaaatactaa

SEQ ID NO: 29490 - DNA, 1089 bp, Caenorhabditis elegans
gatccaaaagatcagctcctgctctctccagcctacgtcattccaaagcttctggacaaggcaggactcactcttaaggatgttgatgtatttgagattcacgaagcttttgccggacaagtccttgccaatttgaacgcgatggacagtgattacttctgcaaagagcagatgaaacgatctggtaaattcggaagagttccaatggacaagctcaacctgtggggaggatctttgtcaatcggacatccattcggagccactggtgtgagacttgcaactcattcagctcacagactgaaggaagagaagggacagtacgctgtaattgcagcctgtgctgctggaggtcacggagttggatgctcattgaggcttatggaaagtaaactcgaggttactttaaacccacttttctgtatgataaattagtgattgtcccaactatttattcttcccatttctgccattttcccgtatttctctttttaaatgtttatgtgtatagattgtagcggttgtcgtgccttttcgtctcctcgtaattctactggtcatttctgaacactttctttttccttttcgatattctgtcaaatatcaccatcattgccatcaccaaaaaggaagtggtactaactttactgaatagttaaaagtttataaaatatttttaaaaaaacacaacaaattaaaaaatatttaactaaagtttcttcttcgatacaagtaagaaaatgtcgtcatgtgtaatgaatttatatccttgttcggcagttgtcgccataccatttgcctgaaatcatatggttgggagaataatttggaacattttgaaattttttgctcttgttggtggatcttttttttcaaagaataatattttaaaacacttttttcaaaaatacaatttaccttgagactttcaattatatgtgcttgtttcagccgatgacatcgaaatgtttttcctccaaaattgtaggtcgttgcatcgagaacaccaccttgaatcagaataccaccttcatcaataagggaacacgcacttcgtaccgcccggaaatatgcttcaagagtttcacatga

SEQ ID NO: 29491 - DNA, 716 bp, Caenorhabditis elegans
ctagagaagaacaaattgttatgttgagtcgtgctgttgaagatgaaaaatttgcgaaggaacgactcattcaagaagtaagagttgattattaaaatatagtttttttttaaaactatcataaaaataaacaaaatacaacattttttactattttccaggcgcgcagccgcatcgaacaatatgagaaccgtttattgcaaatgcaaggagaatttgatcacgcaaaacgagaagctgatgagaatcgagaggaggcacagagactgaagagttcgtttttttttttggagaatgatatttttctcaaaattagttggaagtcagattattattaattagatatattttcagacgagcttgcacttcgtgatgcatcaagaactcagacagacgatgcacgtgtaaaagaagcagaattgaaagcaacggcagctgaggaaagatttaataaaatgaaaggagtttacgaaaagttccgaagtgaacacgttttagcgctcacaaaattaggagatattcaaaaacaactagaagctagtgaaaaatcgaaattcgataaggacgaagagattactgctttgaatcgaaaagtagaagaagctcaacgagaagctggaagagctttgacaaaggcggagggtgatgctggagcagttgatgagatgagaactcaattggttaaggctgatattgaagttgaggagctgaaaagg

SEQ ID NO: 29492 - DNA, 638 bp, Caenorhabditis elegans
atttgtgatcgtggaggaggtgtatccagaactattctcgaacgtctctacaactacatgtactcaacagctccaccaccgccacgtgatggaacacaagctcctttggtaagtattttgaaagtaaaaataaacaaaaacaatggaccaaaaatttatatttgtgaaaaaccaaaaaacaacaataaaaccattataaatcacattttgtttcaaaaaaaatttcaaagccaatttttgatcaagttatagaagttttaagagttttttttttgaaaaaaaccagtatttaaaagttttctaatttttcgaaaataagttgaatttttaataactagagtccagattcatactgtatggtttatatttttaaaaatcgagatttttaggctggttacggatacggactgccactatctcgactatacgctcggtatttccttggtgacctctttttggtttccatggaaggacatggaacggatgcatgtatctacttgaaagctgtaccagttgaggctagtgaagtactcccaatttatagtacttcttcgcgtcgaaatttgacaatgggaccacaagtagctgattggtcgcatcatgttcctggtcaaggaaatcgtccagctcaatcatga

SEQ ID NO: 29493 - DNA, 272 bp, Caenorhabditis elegans
ctgtcaacattccaaaagttcgcgttgatgacgcggacgcctcgctgaaatcatcgttgaacagcagtatctacatggctgatattgaggtttgttatagaaaaatattcgttcttggttcttttttataagcattaaaatttcagaactcaatggaaagtcttgatgaagtttcaactcaatcttcggaacccgaagctccaattcgttctcagacgatggaattctttgcaacttgccacatcatcatgcaggctttgttagctgaataa

SEQ ID NO: 29494 - DNA, 628 bp, Caenorhabditis elegans
atgcgagagggtagttttccgcgaaggatcggcttgcttctaggcttactgggccttttagccggagttgccaccttcaacatcgacacaaaaaatgtagtggttcatcacatggctggtaactactttggatactcactcgatttttaccatgagcagaagggaatgcctgtgtaagttattgaattaactgaacagattttacattcaaaaatttcagcctcgttgtcggtgcccctgaagctgaaagcaataacccaaacctggctggaatccgaagacctggagcagtttatgcttgctccgtgaaccgggcaacatgccgagaagtccacgtggataaaatgaagggaaacttgaagaaactcaatggatcacatcttgttccaattgaagaaaaatcacatcaattctttggtgcaactgttcgatcaaatgataagcatgataaaattgtggtaggtttattctgcggagtttgaaaattaaaaattaaatttccaggtgtgtgctccaaaatacacatatttctactcaaaattcgaagttattgagccagttggaacctgtttctatgctgaaaatggatttgataatgcggaggagttttcatcgtgcaaacaagaac

SEQ ID NO: 29495 - DNA, 475 bp, Caenorhabditis elegans
tttcactgtcactgtgctcatttttgtggcacgtgccttcatttctggtgccttccaatgtgcatacgtctacacaccggaagtttatcctacaacattgagagccgttggactgggaacgtgctctgcgatggcaagaattggagcaattgtgactccatttatcgctcaggcgagttcaatgtggaaatgaataacctagcgtatcttgaaatatacacatatagaaaacagaagtttacctaacaaaatgattagaaatattttctcaatgagtattttcctatacgttgagttccaggttgcgtcggagaaatctctatccttacctataggaatttatggaactgcggcaatacttggattgatagcttctctaagtttaccaattgagacaaaaggacgtcaaatgatggtgagattgacatctgaaaagtcatctatattttcaaactttttccaggactcccattaa

SEQ ID NO: 29496 - DNA, 373 bp, Caenorhabditis elegans
ggactaacattttcaacactagttgcttgtatcatgggtgtcatttctggaatgtcacctcatttttacgttcttctatttttccgtggacttactggatttggtatcggaggtgtaccccagtcgttagttttttaatcagaatattccaaatccctatttttaaaaaacttcatctttcagtgtcactttatacgctgagtttcttccaactgctcaacgtgccaaatgtgtagttttgatagaatcattttgggctatcggagcagttttcgaagctcttcttgcttattttgtgatggaatcatttggttggagagctcttatgttcctttcttcactacctcttggaatttttgcagtggcttctttt

SEQ ID NO: 29497 - DNA, 647 bp, Caenorhabditis elegans
atgggtgattacgtgactcccggcgaggagccaccacaaccgggcatctatcgaagtgagcagatgtgcctggctcaactctaccttcaatctgatgcttcctatcaatgcgttgctgaactgggagagctcggacttgttcagtttcgtgatgtgagtttgtgatatgtaaaaaactattttcaattaataattttaaaaaaaagtaaaacttcaatttattttaattttcagcttaatcccgatgtgagctccttccaacgaaaatatgtaaatgaagtcagacggtgtgatgaaatggaacgaaaattgagatatcttgaacgagaaattaaaaaagatcagatcccgatgctggatactggtgagaatccagatgctccacttccacgagaaatgattgatttggaggtttgttgaaaaaaaaatataggtatataaatatgtgttgcaatttcacggtctattttttttgaatgtttaatttttaaaaagtttttaaaaattctttcttacaggcaacattcgaaaaactcgagaacgaacttcgcgaggtcaataagaacgaggaaacgctgaagaaaaacttttcagagctcacagagctgaaacatattttacgaaagactcaaactttcttcgaagag

SEQ ID NO: 29498 - DNA, 647 bp, Caenorhabditis elegans; identical to SEQ ID NO: 29497

SEQ ID NO: 29499 - DNA, 577 bp, Caenorhabditis elegans
atgcttctatccactttcaaacgacatctaccaatcaggcgtctcttctcatcaaataaatttgatctgattgtaattggagcaggatctggaggactttcttgttctaaaagagcagctgatcttggagcaaacgtggcattaattgatgcagttgagccaactccacatggacattcatggggaatcggaggaacttgtgcaaatgtcggatgcattcctaaaaagttaatgcaccaagcagcaatcgtcgggaaagaggcaggaataatattataaatatttagagcactaaattcaaaattccagctaaaacacgcagacaaatatggctggaatggcatagatcaagagaaaatcaaacatgattggaatgtgttgtcaaagaatgtgaatgatcgagtaaaagcaaacaattggatttatagagttcaattaaatcagaagtattttttttaattttgtggaaatttttatttttatgaaatttagaaaaatcaattacttcaatgcctatgccgagtttgtggataaagacaagattgtgataactggtacagacaaaaataaaaccaag

SEQ ID NO: 29500 - DNA, 4893 bp, Caenorhabditis elegans
atgaatccatcgatatccacggcgggagcagtcgtcgacgattttcagatgtcatgcagattttcaaattttggagatcatgcacctgaatcatttgactcactttcctgtggagcatgcttctattttatttttatgctcgtagagcactataaagataggtgagcagaatggaggcgcctttttttgttccttattgaaacaaggactctattatttatgaagcttcacctcttttctctatttcaaatgacaattaacactccgcggacctttttgtggtctcttatggttgaagctattattagtttgaaactattatttggaaagttccaaagtttaatttttaaattaaaaatatttcatgagtcattcaattatttttaaatatgaaatgtttgttgtactaaatcgggatttgcttctgaaaaatttacagtactccattttagcaacttttaaaatttttaattgatatataccttaaaattgaaaatgttcaatttactagtttgtattgaaaaaatatttttaaaaatttaatctaaagttttgcaactttttcaaatgtttgaattatttttccaaatttttcaacagaaacattcaaaaccggactgtgcggaaatatttttgcaaaagtagaaaactgcaatttcaatatgataatccaacgtttttaatcaagttttgatatagcaaagtagtagacttgttccatctgaaaataatatttattttagtaaaaaagtttgcaaaagacctcaaatgttgtatgaaactgtttgaagtctctttgaaaaaagataattactggacaaaaatgtagagattttctcactctcctcaaagcctgtctggaaagcaaaatagataggtaggcgggctttcccgcctgaataaaaaatgtgcctgtctatcacagatttaaactagttcttttattatcgcagattcttcattatatccaaaaatgtgtttcagatacgttgcaagtctttgtgaagacactttcggagtactagtatgcccagttgatgtcagtgacaaaatttgcaattgctataatcgagaatatgtctacaatattccggagttcgcacttaattcgtaagttttataacttaaatagttcaccttggacattaatatattgttgttaatatttgtaactttggaaactttaaaagttattcttgaaattaatagaaagtgtattttgctgtcaagaaacatccttgcgtgcaggttttctgatgtagtttaaaaaaaatggaaacccaatttttgatctctgatacttttgatttgaataatttttgaaactgtaatattcatttaaaaaattgaatctagtcttattcatttctttttctcttgcatccgaatgtcaacgaattgtctcaaatttcaaccggacgttgctcgaaaccttgtgctcattgatcaaaatgttgagcagattttggtcctaaaaaacgaaagcagaacgtatccatttctatgaatgcaaagaaacataccagaaaaaaacgcgtaatacgattacctctttctcgctagtttccatctatgtttagtctatgaaaaaaaggacaaaacgagcactgagtgaaattgtctcagcggcggcggtggctctttccatcatttccactccttttccgcaacatttcgcacaaatttaaagggtccccgaatgcttgaaagaaatagtatgtgagacgaagagacgcacagattcactgacctcttttgcttatttctgaccatgcacacgcaataggaagaaaggttcaattgaaacaagaaaagtcctagtttcaccaacaaaaaaagtttggagattggtgagggacaggggattttaacgcttccaatcggttgaaagccaaaatattttacacttgcggaagtttggatattctatggaaattaggtgtgaaaatttaacaaaaaccttaaattggcattaaaatatataacttaaatatttcatactacaacaaaaactgaagacggagccgcagaataacggaaagttccgtgtaagaaacgggtgactatcggacaaatctaccgtaacatatagtttttcgttacgagacccttgaaaaattactaaaatttcaactgttttttcaaaacctttccttgcacaagtattccctaacaagaatggttttttccagagctcaaaaattcaaccaaaaaagttttgaaactaacaaaaaaagtatattctctccgggggatctgaaacgtttttttgcccatcatacttttttctttaagaaaaaactcctggattgacaggagggtctttttggaactcttgggaactcttggaacattgatatgtcaaacattttggaaaatttggtgcagagtgaatgacgagctttttttttcgttttttaggcctcttttttgaacaatttttgaaattttccaaaaagaccggaaatctacggtgacaggagggactagggatgtgtgagtcagacgggaagttcagatgaatagatttggaaagtttgaaacttttttttagaaattgtgatatgtatgacctttgtgtacttgagaaccaaggagcgaaataaaatatgaagattttttcaacttcttttggctgtttgtgattcgtgccgaatgttatgcaatttacgcaacagtaatgttcttattagttcagaaagttacattaggataattcaatttgttggaattctaatggggaaggattactgtagtttgaaggattagcactacaaggaaatttttcccttttgtgacttcaaatagtaaactgcaaaattttaagtggcaaagtttcattctcaacccctaaaattttttattttaattttaatactaacattaacaaaaaagttctgatttttttgcaagatttttttccaactttttccttgcagaaattgaccccttacttttcaaaaagtaacatttcaatctttagcagccatttttccatcagaagccctgaccacctgacacgtgattttcctatttcggttgcacctccatgtcccatttccgcccaccgcctcttgtgtccaaattcttgctcaattgagcgttttattatttttttttcaaaaaacgaaatccctgcgtctcttctccatgggctcttaagctttctcgttgatttttttgttcaatttttctgttcgaaacgcttctttcccatcataaccgctaatcggcgtatctgatttttgaatgatctctagttttcgccgtttcaatggttcaaatcgcaacaacacatgatacgagaaaacggaaagagaaacacaagaagaggggcgtttgaaatttaagaagactccttctttatcttgggatcaaaaaatcgaacttcttagatgttttttctggaggagagatttctaatcgagtagaatataatgtttcaatagatacgatagtaagtctgtaaatctagatatttatataagttttttcttttcttcttaatttcagaactcttatcgcccgttatttcagcaagcgaataccatgtattatgtcgcatcatcttttagttttggcgctccctagtaaaaaccacttcagtagtgaaatatcagaaacacagtaacccgttcatcatgatcaatctttgcgccaacccagtcggagacatacagagcaaaaaatgacggattcattgaagagaaaaaagaaggagaaatgatgagtaaagaggggttaactgacagtttgtgtaaaggtttgcaacatttcaaccgacaattcgtgtgtcaattgatggctgggaaaagagaacattgcagcaaaacacatctagtttgaccctcacggattgtggggaaagttcatcgataaatcattagataatccaaaatttaatatattttccatggaattatttgaaacgagtagtcgagcatattgctagagtgcataagtgtttattcgctcttggttagtttgcgaaaaaaaaaacaaagacaaataaggactttaatcctttggcatgacaagatcagtttccatttggagagaacaaagagtaatgattgacaacttttgatggcgaaattgttttttttgcagaacaaagattccttgtctttgaagatcactttaggaacatgaaaggactttcttaaaaatacgaatatactttcactattttattcaagtttttcatagtaaatcaaatcctaaaataatgaatttactcagagaaaaaaaagttactgaataaatatctaaacctgcaattttaagctcaaaagggtattgtaacttctgcgatggtttccatgaactcttgattgtccctttttgttgcatccactaaaattattgatgtacataattaaatcacaatcaaaatgtgcacttcttcaaaaattcgaatcaaatcgaacagcattcccttttccccatcatctctttcaatttccctacaatacaaaaaaagtttccgagacttttgtaaatttccgggttcaaaagaaaagctgtcagggcgaagaaaaaatatgtgcgaaaagaggaaatcgaatgggaaacgaaaaaaaaaggaaaagttcgaagcatttactgagaccgctccggctccaactcaatcagacatatgccctttttttctgaaaaatgggtcttcttttgagaaagaaaaagaaattgaagggaaaaaaattggtggttaatgtattgaaaacgacttgaaactcaaaaaagcacaaaaactttagaaaattttcagatctcgaataaaacctctgaatcatctgcgacttgatccaccgttaccttttcaattcgatttaattgtcaaagattgctgctcggccgcacgatattgctgtagaaatacacttgtgaaat

SEQ ID NO: 29501 - DNA, 741 bp, Caenorhabditis elegans
atgtgcaccgaacaaaagccaaatttgctcaagctttcacaattgaaaatggtgctccgtgctcttggatatgatccaagaaactcaaaagtacaagagatgactaggaaaatcaaagatggaagaagcatggtaatgggatggcatggaggtaattctggattaacttttaaataaaagtttaaatatttagagaaggattacatggacgttgacgaactgtggaatgcattacaatcaaaagacgatgaaggagactcaacagaagataaagttacaacggaaatgagatctgcattcaaattatttgatccagaaagtaaaggaacgattactgtcgccaatttaaaaatggtttgtaatcatgtggagttaaaatcaaaatttcgaacgaaagttttgaaaaaagggccaaattttttgaagtcggtagtattctattcagtatttatttatttaaatatctcgagtaactatgatacatccttaatattatagctttatgaaataattgaataaaccgaattatttgaaatttcaatgattttaaaaggaaaatgtcccagtttttaaaatcgaattccaaatttaaattgtattttgcaggtcgccaaggaactcggagaaacgttggcagatgcagatttcgatgaaatgattcgcgaagctggtggtgataataacactggaatcaatgagcaacagttttttgaaatcatgaagaagacttgcttgtactaa

SEQ ID NO: 29502 - DNA, 451 bp, Caenorhabditis elegans
atgaaagatggatttctaggcattgatctgagcacacaacaggtttgttacaactgctacttttacagtaaaccttcaaaatttcagataaaagcagtaataattgatcaaaatggaaaagtagttcatactacagcaatcaatttttcaactcacgagaaactgaaaaaatttgggtttgaagaatctgatggagattaagactaaatactagaatttcagaacagaaaatggtgtacataaaaacgggtctgttatcacttcacctgtaatcatgtggattgaagccattgatattttattcaatgatcttagagaaaatggatggacagataaactgagaggaatatcaggatgtgcacaacaacatggtactgtatattggaagaatggagcagagaacagcctgaagggtctggatgagagcaggagtttagctgaacaattggag

SEQ ID NO: 29503 - DNA, 488 bp, Caenorhabditis elegans
acaaaccactttttgattttatatcgtcagatcttgaatctaaacttggaacacttgtacatccaatgacttctactgtaagtgaaatgtttattgaaaaattcaaaaacaaatattttgtagggacatgttcattcttattggactcgtagatttgggattccatcggattgtacagttctaccgtttctcggggataatccttgtgagttgaattttcagtagatcagtgctttatgcctactgtccgttaagcctagaccgatatctatagacgtttcaggccgatatctatagatataatgaaaaaagcaattatccataatttcagcttccctggcagggttatctctacttccaacggatataggaatttctcttggtacaagtgacaccgtcttctttttcacaccaacttttgagccaaatattgatgctcacgtcttctcacattttgctccaaacagtggttatatggcaatggtttg

SEQ ID NO: 29504 - DNA, 778 bp, Caenorhabditis elegans
acagccaaatcagtgggacaaactacccgccgctacgaacttcaccgggacaattactatgattggaatgagcatgtacgcatttgaaggtcaaactatgattctaccgattgagaataaacttgataacccggccgctttcctcgccccattcggagttctgtcgacaactatgatcatttgtactgcattcatgacagctctcggatttttcggatacactggatttggagattctattgctccaacaatcacaacgaatgtaccaaaagaaggtctttattcaacagtaaatgtattccttatgcttcaatctcttcttggtaattccattgcaatgtacgtcgtctacgatatgttcttcaatggattccgtcggaaattcggtgcccgattcccaaatgttccaaagtggctgtcagataaaggattccgtgtcttctgggtgcttgtcacgtatcttatggcagttttgattccaaaacttgaaatcatgattccattagtcggagttacaagtggtgccctgtgtgctttaattttcccaccattcttcgaaatgatcaccttctggaccgattggaaggtaaatatgaatacaatttaaaaatcttactaaattaaaaaaaaattccagggacttctgacatatcgtcaacgtatgacaaagatcttcatcaacctcgtcgtcatggctattggagtatttgccattatcgccggagtctacacaaatattcatgcaattatccaatcattctctcaaccggatccttaa

SEQ ID NO: 29505 - DNA, 176 bp, Caenorhabditis elegans
ctcttccgcaaaatcgctacggcacttccaggaattgtccaagaggagacgcctgagcagcgtaagattcttatcaaacattttagtgatttattttaattttttcagccaacatcgttatcatgaatcctcctaaagacgcggaagagagccaaggccgtcaatgtccgtgttaa

SEQ ID NO: 29506 - DNA, 858 bp, Caenorhabditis elegans
gatcatacggctcgtcaactcgctcaagcaaataaccatcacaatattgttgatatttttgatagatgtcgtccagaacgagaatattcaatggatcttcacatccaacatacccatcaaccacaaccttcaagaaaagtaactcgagctccgaagaaacagacaagtcgaagcaaaaaagagtcagcttccaattctcgagactcaactcatctgacacctccaccatcggatggatcaacgtcaacaccgtcaccacagcattttatgaataccactcatactacaccgacgagtttgaactatttgagcccagaatatcaaactgaagctggaagctcagaagcggttagttttaagcttcaactgaacagacgggaaacaatgtaattttgcaattaaaaatacggtacccggtctcgacacgacaaagttttgttaaatagaacgtgcgccttttaagaatactgtagttcgaatcttgtgtttttgcggatttttaagtctttccaatctaaataagtgttatggtttaaaagtctggacaacaataaaatcacataaatgtaacaaggaaattccgcagcaacaaatgtttgaaattacagtaatctttaaaggcgcacaccttttcgcattcaatagaaatttgtcgtgccaagaccgttttacgcgtatgtgtaatatacaaagttcaaatataacgtacataaattaaaataacgttactttcagttccaaccacaatgtggagcatttggaaatggcgaaatgtggtatacaagagcttcaacatcgtacacccaaatgcagaatgaaccaatgacgcgatactccgaaccagctcattatttttga

SEQ ID NO: 29507 - DNA, 1819 bp, Caenorhabditis elegans
atgcgagttcttctaattttactcgcgttttttgcgccaatcgccagtcaacttatgggtggagaatgcggaagggaaggtgcttgctccgtcaatggaaaatgctataatggaaaactgattgagacatactggtgccggtaagcatatatttcattctcccatgtcaatgttattcatccgctttctcatgaaccgtgacgaaaagaacaaaaaaaagaaagtttgggcaggtggtggtggtgggaaacaggcgatagataaacaaaagcttggtgtagagaacattttgaataatatccgaaagttgaattatcactgtccatatttccctctaagacatcattaaacgccacccggcttgcagaatgggaacacaatgaacagcaggaggctgtcacaatgtaaaatctcgtaaatcgttcgggaaatctaaaaaattgttatttagttttcccttttctctacaaacaattcatttttcttatcaataactttgagttccaaaggcaaaatttacagccgtttacagccatcttcccagggttgtcggcgaatttatatggacgttcataaaacaattggattagcgtgtcggttctttaatcttgtcttttcttattactatctagctcgtttgattagttatacagagagtatcaacgtatttatcgataggaaaattgcgccatgatgctctaaaatacataaaatcgctcgatttatctgaaaataacacttatttcagcttaaaaatgtgagaaaatggtccaaaattgtctgaaagttgttgagtgaattatcgagatttgttttctgatcactttcacgaatatatcagctgaaaaattgttattttcaagtaaatcgatatattttgccacgatttttgattaaaaatactgtaatttattgattgtcacccaccactggcccacagtcataaattgtctcaattgaattacttttcagtttaaaaataatttaatcaaatttacagttgcaaaaaaggattcggaggtgctttctgtgaacgtgaatgcgatttggattgtaaacgaggcgagaagtgcatctacgatgtttatggtgaaaatccgacgtgtatctgtcaaggtaattttgtgaatcctaaaatctgttaaatatcataatattttgcccgaaacgacctattttcataatgggacttctcaaatctttaaatcaaattatcgcctttttgcatagtttgataaatactttatctcgattcaagtgtattctaatcaatcattttaagattttaaacgtttcaaattcaaaattttgttccatgttttacttccacctttttcttcatctgccctttttcatagcggcaatctttttcaccacatcatccatcatcacactgcgagtgtatttttctttgattgtgcccgacttgtacgcaattttttgtttcaggatatatcaaaatttcgaaaacttattagggaaaacacgcgaccatacgtataataattctcccgggagatcccaacattgacaaattgtaccgcattcgtggtatcctatttttcatttctacgctctcaaaatgaccgctagtgatagatagcttctactaggtcatattcgcacatcttcatcgcctttgtcatgcgatttattgcaaatgttcggtttcattgcgcgggggcagtagtataaatcaagcagatgttgttacacagacagccatgagaaaatatttataagttttattattcagattgcgaagacgagactcctccaacagaacgtactcaaaaaggctgtgaagaaggctatggag

SEQ ID NO: 29508 - DNA, 344 bp, Caenorhabditis elegans
ctcgaaaaacgccaacaagtgcagcatcgtctcgcgaaacaaatcatctgacaccaccaccgtctgatggatcgttctcatctccgtctccacattattatccgacgactacatcgacaccgaatcgaatggaaacaagtccggagtacatgtttaaccatgaaatggtgggtagatgattattaaaatgtttaagaaaattaaataatttgttttaggcaccaccggtcaatgcgatgtggtatactacaccacctccttatcaagatccaaactatcgtcatgtgcctccaaatactgcatttcaaaatgcagagcaaatgaatggctccttctactgttaa

SEQ ID NO: 29509 - DNA, 643 bp, Caenorhabditis elegans
gaaatacgaggaaatctttccgccagagattgaagactttgctctcatcactgacaacacctaccgagttcccgacattcttttaatggagcgattcttgctcggaaagtttgacttcgttgttgcaatgcccacatcatcttggttcggaacatgttttgccaagagaatgaactttacaaagtgagttttaatatcatcatttttagctcctgtgaaaaaaattagcgatctttctcaattttaaacgttattttattacagaaagatgcggaatactgttcattatctcctcgagttgtcgctgatagatgtccattttctacgttaccgcccatccgatattgcagctgcggcttgctgctttgcaaatctccaggctgacgttgaatcctggccacaaaaaatggttgacgacacgggaatcagtacggaagattttgtggacgtgctgagggatcttcacaggatgtacctgaatgcatcaacggcagatttcaagtcaatattctacaattactcggagactgcacaaatggaagtggccctgttaccggcacctactgacaagcttcgatcgatgttcccatcgatctttgtcaccgctccaaaatcttccaacgatagtagtagtccccagtaa

SEQ ID NO: 29510 - DNA, 629 bp, Caenorhabditis elegans
atgtcgtcatggaacgaggcttgggatcgtggcaaacaaatggttggagagccactcgccaagtgagtttcttttgagattttttgtccaccatttccggagcccaacacaacaaaaaggcacacggccgtgaaattggtggggctgaatgagcgcacatacctctcaagcattaacatttttttcgattccatatctcaactaatttcagaatgactgcagcagctgcatctgcaactggtgcagcacccccacagcaaatgtaagtgtataaagagcaggtggatttttaaatctatagatatcagatcgaatttgttcttgattgatagtgaacatctagtaaacttttgccacaactatttttcaaaattaaaatttttccaaacctttttcaagaaaaaaacaatttcaggcaagaagaaggaaacgaaaacccgatgcaaatgcattcaaacaaagtgcttcaagttatggagcaaacttggatcggaaaatgccgaaaacgttggcttctagctattcttgcaaatatgggattcatgatttcatttggaattcgatgcaatttcggtgcagccaaaactcatatgtataaaaattatacagatccatacggaaaagttcat

SEQ ID NO: 29511 - DNA, 961 bp, Caenorhabditis elegans
atttttgaaagatgtcttggtaaacgcccattgttcgcagttcatggaaaatgctcaaacccacaccgtgcatctcaaatcaaagcattctcggatagcaccaatggagttatgatttcaactgatgtgatggcacgaggaattgatatctcggatattgactgggtcattcagttcgatcttccaaaacattccagttggtttgtccatcgagccggccgaacagccagatgtggtcgtgaaggaaatgctcttattctcatcgcttcggaacagttggcctatgtgaatttccttgataaccacgagaaagtaaagcttgatgagatcaaagttccaactaacaattcgagaaaatcggaagagctgagacagaaaatgatcaaaattcaagtttctgatcgtgcaattctagaagctggaactcgtgcatttgtgagtcacgtggagtcatatgccaaacacgattgtcatctcatttgctcacttgatggtaggttatgcaaaatatataatacaacgctgaaataataagtttacagatctcaacgtggtcggtcttgccaattcgtacgctcttctcagattgccgaaaatgcgtgaactgtcacaaagaaaagatttggatatgttcgacagaagtgccatcgagacatctgaaatcaaatacgccgatgttaaactagaagccaatcgggaaactgtgatgaaagaaaagcacgagaagaaggtcgagacgttggctgcaaaggataagaagcgccgtgagaaggaggctagaaaactgaagaagatgggtggaaggttcagaaatggtggtggaactggtagaaaagcagaggagaagaaggctttgaagagaaaggccgaagaagaagatgatgctcaaaatgatatccgattgttgaagagaatcaagagaggaaagttgagcaagaaggaaatcaaggatgttctttaa

SEQ ID NO: 29512 - DNA, 921 bp, Caenorhabditis elegans
atgttgttatcaccggagcaattctcgcggcttagcgaatatgcggcatgtaagttaacgaaaagaatgaagaatgaacacctgaacaaaatctaatttccgaaaatttgctgtgaaagaacttcgaaaaagatatataaaaccacagggaaaattgaattttcagattctcggcgaaagttgaaagatatgttgagcgattttcagcaagacgggaagttctactcatatctttcagttgatgggcaggtatattttaacgttttaggatttcaaacctgcagtaatcttcaaatttattttttaaaaagttccggaaagtttggcaatttagcataactttgactgaatttttaaaaataatcaacacatttatggagtaactgataatgcgatcgtgttcatttgtgtcatcttgaactattaatacaaacctagatatacgaatcacattaaaaaaagagcaccaagataatttccatgttttcatagaaacttgatagcgctatataaaaaattaaaattaaatgatttgatatacaaaacaaaacatgatttttctgttagctgataagattataacataattcaaaaatcaaacacaacacgagttttgagaacattcatttgtgtttgttttgtgttttgatcttacaaatttgctgggttaataagataaaagttttcctgaaagtcacttaattttcaacatgattgaattttccaaaacctgaaaaattccattgcgtgggtgattactaggctcataaagaaaacgaatatttacgagtttttgaaatattcttttagagcagtacgattatgggaaaatttagaataataatgttggaagtttcaataataattcttttccagcattcgagattcccgttttgtaggcagtgcatcaaacattttaaa

SEQ ID NO: 29513 - DNA, 595 bp, Caenorhabditis elegans
agctgccaagacaacactgccaattgtttcaccgtcatttgccacttcgatttcatcgatgccaattctgcagtagtcattgatttacgtgcaagactctggaatgcaacgttcattgaggattattcagatgttgaaagtgtgaagatccgatcgttcggaaaacttcaattagacgaatcacaaggaattgatgacgatccgaataacaatgcagctttcgttgaaacatctgctgatcctgataggcctacaattggtgggttttttgaaatgagaccaactttaatatctaatcattttaaagtgatatactagtacgaatgtattcataaaaaatcattgttgaggatattctagctttaaaagacatgctcaaacccccaactttaccttaattttttcaggagactctcgacctatcccgtggtggatatacgtcattgcagctgttattggtgttctcattttgtcactaattataatttgtctttcaaaatgtggtttcttcaaacgaaatcgtttggatcagccatcattatacactgctcaactcaaacatgaacgagaagaatgggctgatacgggactttag

SEQ ID NO: 29514 - DNA, 456 bp, Caenorhabditis elegans
caactccatctcctgaccaagaaaagtgcccacgtggaaatccattgatctatccatctacaagttctcctgtactttgtcaaccaggaaaaagaggatgtccagttggctttggatgtgtgcagagctcgacatccaataatcatatttgctgtccatctcgccattccgatcgacctggatatcaaagtgaatcgttcggacttggagcatattacagtagagggccaccagcagccatcaatccatgtgaagggtacttagttcttgtaacaagaggtgttaatggaagaattgagaagagatgtggtatgttatcgaatatcagtcaaggagaaattattcaggtgatttgtttataaacacaatatttttgaaatttcagaaagaagctgcccgttccctcaaatcccaatcggaggagtttgttacgagctcaagaacaaagcaacataa

SEQ ID NO: 29515 - DNA, 1279 bp, Caenorhabditis elegans
atacgaagccgagggacgagtccgcaaaacggtgaaggcccgcaagctctgggagcacatcgtttccaaccaaatcgagaccgggcttccatacatcacctacaaagatgccgccaatcgcaagtctaaccagcaaaatcttggaactatcaagtgttccaacttgtgcactgaaatcatagagtactctgctccagatgagattgcagtttgcaaccttgcttccattgctctcaatcgctacgtgacccccgagaaaaagttcgacttcgtcaaactggctgaggtgactaaagttataaccagaaatttgaataagattattgacgtcaactactatccagtcgaggaggctcgcaactctaatatgcgccatcgcccaatcgggcttggtgtccaaggactcgctgattgcttcatgttgatgcgttacccattcacttcggcagaagccagagatctcaacaaacgaatcttcgaaaccatctactacgctgcattggaagccagttgtgaattggctgagttgaatggaccatactcgacatacgaaggatctccagtatcgaaaggacagcttcaatttgatatgtggggagtcactccaaccgatcaatgcgattgggccactcttcgcaagaaaattgcaaagtaagattaaaatactctttcgaatctgattaaactacttatttacaggcatggtatccgcaacagtcttctgatggctccaatgccaactgcttccactgctcaaattctcggaaacaatgaatccatcgagccatacacttcgaacatctactctcgccgtgttctttctggagatttccagattgtgaatcctcacatgctcaaggatttggtggaaagaggattgtggactgatgagatgaagaatcgtctgattgccaacaatggatccattcaaaacattgatggaattccatccgacatcaaggaactttatcgcacagtgtgggagatctctcaaaaagacattattgagatggctgctgatcgtggagcatacattgatcaatcccaatctcttaacattcacatggccaagccaagctacgccggtatcacatcaatgcatttctacggatggaagaagggactcaagactggaatgtactatttgcgtaccaagccagctgtcaatgcagttcaattcactgtggataagaatgcgctgaaaactaaccaacaagctgagacgccagccaccgtggccgagtcgcaagatgaaggatgcctcatgtgctccggataa

SEQ ID NO: 29516 - DNA, 914 bp, Caenorhabditis elegans
atgcaaaatgcaactcttcctattgatggaccagttaatacagaacccaaagatccagcaagagaacagtggtctggaaaggtaagatccatcttgcctgtaattctacatatgaacccatcttttcagctggacttccttctctcagttgtcgggtttgctgtagatttgggaaatatatggcgatttccatatctttgcttcaaaaatggaggaggagtatttctgattccttattctataatggtcctgttgacaggagttccactattctacatggagttgtgcctcggccagtattatagaaaaggagcaatcacaacttggggaagaatatgtccgttgttcaaaggaatcggatattgtgttattttaaccgcattctatgtggatttcttttataatgtgatccttgcctgggggcttcattatttatatacttcattcaggtgaggacaaaatatgcttattttaggtattataaagacatagtaaaaccaaataatttttaaatcttataaatttttaccgccataatttggaaaactattgcaattaatgtcaaaaatcttgtctaagtctaccaaaaatgactaaagttctacaaagcctctggtaaaatttcaagaaaaaaattacagtttttttaaaacttgatactaattatttttagatatctattcggatatcttgccaatgctataccagaaaaattttaaaaaccaccattccttttaattttgccatattcactttattttcagttttaacctgccatgggcatcctgtaacaacagttataactctcctgcttgttacgaaccacactggtcagaagacggaacagcaatgtgtcgaagtgcaaatcaatctgtctcagctgaaaagatttcagctgctgaagaatactttta

SEQ ID NO: 29517 - DNA, 48 bp, Caenorhabditis elegans
cgtactgacaaagctgtctaccaaatttctgcaacgttttgcaactaa

SEQ ID NO: 29518 - DNA, 1286 bp, Caenorhabditis elegans
gatcctctacgatcactatatgctgaaggattctacaaaactctgtgctattcgtgtaatccaactgatgtggctgcattttggagctttgcattcgctctttccaagattgttgaacttggagacactatgttcattattttgagaaaacggccattgatctttttacactactatcatcatgcagcagtgttaatctacactgtccattctggtatgcaaatgtgatttcattacgagtttttgcgaattttccattcaaaatactctcatcacgaacgaactatttttctattgcccaggcgtgatatattgcgattttgagccgaaaatacggtactcggtctcgacacgaccaagttttgttgaatgtaaaaatgtgcgcgcctttaacaattactgtaatttcaaacttccatttcggcagaatgtaaatcgatttttccaactttttatttctaattgttaaaattaaacgattgttattgttaaattagaatttaaaaataaaaaaaattaatttttatcgaaaaacggaaaaatcaatgaaaactccgcaataacagaagtttaagattacagtactcattaacatattttgcttatcgatttgaaaagtagttttccgataaaaaaccattcattcattaaaaaaaacaattcgaacaataaaacctgatttattttaccaaatcgaaagataattctgaaaaatcgataaaaattccgcaataacggaagtttaagactacagtactttttaaaaacttgcacctgttttattttaaaaaaattgtcgcgtcgagacccggtggcacaaaaacaaaacaaaatttagcatatacgcacaatgttgtccgtcgagaatattttaacgtggaaaatcgcaaatttcgcaaatgaatataatgtgattctcaggaaaaattgaatttctaggtgccgagcatactgcagctggtcgtttctacatcctaatgaactacttcgcacattctctcatgtatacttactacacagtttctgccatgggatacagattaccgaaatgggtatcaatgactgtcacaactgttcaaacaactcaaatgttagctggagtcggaataacttggatggtgtacaaagtgaaaactgaatacaagcttccttgtcaacaatccgtagccaatttgtatctcgcattcgtcatctatgtcacatttgccattcttttcattcaattcttcgtcaaggcatacattatcaagtcgtcgaagaagtcgaaatcggtgaagaacgaataa

SEQ ID NO: 29519 - DNA, 1295 bp, Caenorhabditis elegans
gactttccggaccaccaggaaaagccggatacccaggagctccaggaacagacggctatccaggaccaccaggtctttcaggaatgcctggacacggtggagatcaaggattccaaggagctgctggacgtactggtaatccaggacttccaggtactccaggatacccaggatcaccaggaggatgggcaccaagtcgaggattcacttttgccaagcactctcagactaccgcagtaccacagtgcccaccaggagcttctcaactttgggaaggatattctcttctttacgttcaaggaaacggtcgtgccagtggacaagatcttggtcaaccaggatcttgcctctccaaattcaacacaatgccattcatgttctgtaatatgaacagcgtctgccacgtttccagccgtaacgattactcgttctggttgtcaactgacgagccaatgacaccaatgatgaatccagtcaccggaacagcaattcgtccatacatttctcgttgtgccgtctgtgaagttccaactcaaatcatcgcagttcactctcaagacacatcagttccacaatgtccacaaggatggtcgggtatgtggaccggatattcctttgtcatgcacactgccgctggagccgaaggaactggacaaagtcttcaatcgcctggttcctgtctcgaagagttccgtgccgttccattcattgagtgccacggaagaggaacatgcaattattatgccaccaatcacggattctggctttccatcgttgatcaggtaaattttgaattattttggaatggggttggctgcaattctacaaaatgaccataacctcgaaatatagaaaaatagttataacttgatttatctgaaaataatatttatttaagctgaaacattctagaaaattttcaaaaatggtctgaaagttgtcaatggtcgaattatagaactatcgaggtataaagctttgttgtttgaaaatcggcaatttccagacttttgtaatacttaaaaaaaaaatttttcggattttcagctgaaatagatgctatttacatataaatcaatctattttctttatttggaacgaacggcatggtgccatatgttgttttatagaaagtagaattgcccaaaattgcggcaaaaaataaaatattacttcacaaaataattgaataattccaggacaagcaattccgtaaaccaatgtcacagacactcaaagctggaggacttaaagatcgtgtatccagatgccaagtgtgtctcaagaaccgataa

SEQ ID NO: 29520 - DNA, 635 bp, Caenorhabditis elegans
atgattattttttatctttacgtgtaggttcaaataaaatattttttaattgagtacatattacgtatttattgatttatttaacaacaatatgttttaattaaataaataattgaaatttagaaatccaataaaaataatttcagagcaactcaagtatttgtggcaattgcatttgtccttctgatggcaactgcaataattggaaactctgtcgtgatgtggataatttatcaacacaaagtaatgcactacggcttcaactattttcttttcaatatggcattcgctgatcttttgattgctctcttcaatgttggtacttcatggacctataatttatactatgactggtggtatggtgatctatgtacacttacttccttcttcggtattgcaccaactaccgtatccgtgtgctcaatgatggctctcagctgggataggtaggttcttttgaaatttttgagtttatttccctttgcacaaagatcattagtcaaaatttcagatgtcaagcagtcgtgaatcctctacaaaaacgtccactatctcgaaaaagatccgtcattgctattctcatcatttgggttgtttcaacggttactgcacttccgtttgcaattgctgcatct

SEQ ID NO: 29521 - DNA, 417 bp, Caenorhabditis elegans
gtcctcgtcataatcttcattacctgcggtatggctatttctggccttcagtatgctggatttgtcgtgaactacctcgaaatcgccccaccattctctggaacagtgatgggaactggaaatactatctccgcacttgctggtatcatttcaccagctgtcagcagctacttgacacctaatgtaagataagaaaattagaacaaacattcaagtttcaaatgccaattttagggtactcaagaagaatggcaaatggttctatggttgactgctggaattttgacaattggagctctgttgttctcaatctttgcatctggagaagtacaaccatgggctaagctgaccgccgaagaaggccatgagatggctccacttagagaaggagaaaagattgaattggcaaccgcctaa

SEQ ID NO: 29522 - DNA, 973 bp, Caenorhabditis elegans
gaaaaacgtctcggatcactgaacaaattcaaaagcaaagctcgtgagatccttgtgtgcaccgatgtggcagctcgtggattggatattccacacgtcgacatggtcatcaattatgatatgccatctcaatcgaaagattacgttcatcgtgttggaagaactgctcgtgctggaagaagtggtattgcaattacagttgttacacaatatgacgtcgaagcctatcagaagattgaagcaaatttaggttagattttgaattttccgacttgttaaaatcgcgctacgaagtcatcattttattttcgaattatttcacatattttagctagatttcttgttttcggacaattttgcgaaatttttccagttaacatccaaaatgaccaatttaattatacttattatagagaatttgtttccttttgtaaatgttacatgcaaaaagaattagaaagaatagtccaaaaacaagaattattgtcaaaatcaataagatcatgcaaacaataaattcacacttctccgtgtgtagtacaatttcttcgtaaatcgacataaatcaagccgcaccgaaagcttgcaaaatttcttctaaaacttcgctcagcctctactttaaataaataattcaataattctcgaagttaaatcagcgaaaatttccctaaaattgcaataagccctgcaatttaaattatttacaggaaaaaagctggatgagtacaaatgcgtcgaaaatgaggttatggttttagtagaacgaacacaggaagcaacagaaaacgcgagaattgaaatgaaagaaatggacgaaaagaagaaatctggaaagaagcgacgacaaaatgatgatttcggagacactgaggagagtggtggaagatttaagatgggaatcaaaagtatgggaggtcgaggtggcagtggtggtggacgaggtggaaaaaagaagaaaatgagtaaatga

SEQ ID NO: 29523 - DNA, 988 bp, Caenorhabditis elegans
atgttcacagcaaagtgtgccatgcaaaacatcagaaacgtggcgatcgttggatcagggcagatgggatcgggaatagctcaagttacggcgagtagtggattcaatgtgatgctggccgatgttaataaaaaagcacttgatagagcgatgaaggcaattagtcaaagtgtgacgcatctttcaaaaaagcaaaaaggaactgataaggtatatatcgtaattgtttgaagattctcattcttgttttttccaggaaaagtcggatttcgtgactctcacaatgtcacgtatcaaaacgtgtaacaatgtgtcaaccgccgttgctgatgccgatctgatcatcgaagccgccattgagaacatcgatttgaagcggggaatctttgcccaaatcgagcagtcttgcaagaaggattcgattttgaccacgaacacttcatcgttccttcttgaggatgtcgccaaaggattgcaagataaaactcgcttcggaggactccacttcttcaatccggtgccagttatgaagcttctcgaggtaattcgatctgatgacacttcggatgaaacatatgcaacgctgatcaagtttggaacagctgttggaaaaacaacagtcgcttgtaaggatagtcctggattcattgtcaatcgtctgcttattccatactttttcgaagcagcgagaatgtatgaacgaggagatgcatcaatgaccgtatgttgattttcagctttctaaaaactccaaatatcgtttcaggacatcgatgaagccatgaagttgggagcaggacatccaatgggaccattcgagctggccgactacattggtctcgacacggtcaaattcgtcatggatggatgggcagcaaagtatccagaagtacaactattcgaagcaagtccattggtagataagctggttgccgagggaaaacttggaagaaaaactggtgacggattctactcgtacaagaaataa

SEQ ID NO: 29524 - DNA, 669 bp, Caenorhabditis elegans
cattccaattgtaattgttggaaacaagacggatctcagcacgcaaagggtcgttcgagcagaagaaggtgaagaacttgctagacaatgggatgcgaagtttgtcgagatcacggccagagaatcggtgagttgaattttttttagaaaaaagagtactacatacttttaaattgtgaaaatttaaatgtaaactacgaatacatataaaactttttagaaattttaaacttatttatgaaataaaaagtttagattaaatgagatctatgaaaaaatcatccaataaacattctacggatcggtaataagatttctgccggaaaatggaaaactgcgaacatagtgtgttcatttttgcgtctaatatgtgtccctcccatatttatttcgcaatttttcttttttctgcaacctctcttctctcttctatctccgaataaaaaaagggaaagcgtctgcacctctcttagtcaacgtgttcctacaggtttcgacacgttgcttcatccttccaattttcagaatcgagtgcatgaggtgttcgaattgcttctccgtgagatagaaatctcgcgtggaaatctatcaccaacggagcgtccaaacggtaattcaccaaaaaggaatccgtttaaggatgatggaaagccgtgtagtatcagttga

SEQ ID NO: 29525 - DNA, 2313 bp, Caenorhabditis elegans
cccacagcaccaaacacgcctacatctcctcaagcgggtgagaaaaacgcaaatttgaaaaatggaacagttacaacaaacggatcaaatcacgtggaaaggtgagattttgagtttttttttttaatatgctttaattacatcgctgaaaccgggaccaaaatgattataagttgtttggtgtaatcgttgcatcgtccttttctcatgacagcaactggttgtcttttcacttcgtctcaaatgatcccaccttcgtgtgtccgtcatccatccacccatccatccattcgtcccttcttttctatcttctctattccttcaccttggccttttctctctgtcagctgtctcctcttcgcgacctggccgacaagttgaagattgaaacaaggaagagagacccaggatttcctctatctcttgttgggcgccgcaatcattacatcactatcacttgaacactcttccttctcacaccgatcgcgttttcttcaagtcgctcctcgcgcctcgttggccgccgccaatattctcgagacacttctcgcgccgctgatcttccttatcccccttcccactctcaaagcgtcgcaactcgcttctacgtggtcgctatttcaaaaaaaatcgcctgcttttgaatccagttttcttctgtcaggctggccggtcgagcagtacattcgctctcagctatcgattactcgggtataacaaatgatgtcgaagcaggcggctccttcagcttaactgacgttttccccactgtcatattcatgtttgtggttctattctgtagatggctcaatggcttcagccagcatcgagaacgactttataaattcgaagatgaagccgttcagagacgccgccgttttcgtgttcattcagaggaatcggaagaactgaatgaccacgaatcgtattctgaaactgatatttgtacacagcttttggcatcatctgcagacgtaacctgtcatataaatgttgatttggtcaaccagaatcgattttatttctttgtaaagcaaagaaataaaaaagaaaattcgaccaatgaagaagaagaaatctcttcccaagaaataaatacgagtacacaaaatgaagagacagaagttaatttagtgttcgctagtgcggaagataatggaggcgtcgcgtcgaatttcgatatatcagacgctctaatggttacctctaacatttccgaagtcagtaaactaccggaaacgttgtgcgaagagggtgaaactgtacaacaaaaaagtgttgtaaatgagaatgatcattcgaatgaggacgatgaacagtcgctacaatcacaagatggttcaagatgctctgatgaagacatgaactcttgcgtatctgcctcagatgaagaggacgttgaatctcaagatgattcttttcatgtgaatgatgctaccgaagaatcaattgattcggtaagctctattgaatcacaagaagcagaagagtcagcaactgaagatttggcgtcgtgtcattcgaacgacgataaaaatgaaaaagatgttcttgtcgatgaggacacatccaaatacgataaccttccggtggaaatgcggtcagcaaaagagggtgaagagagtgaagggacgatcgattcttcagtctcctcgtcgacatcgtcttcctcaacgggcgacgacggggacgacagtgctacctcttacgactcagaagatatcgaaattcagatgttcgagtatgatctgggaaccgcatgcgcttcagcttctatttctattcctcgtccatctataattccaagaaataacaaaaagtaacatttattttccattaactaaattagtattactaatatcaatcagaaactgtcttttaatttacatttttcaggaccgaagtcaatgctaatgaagagcgtttggacgatttaagtgtgagccccggacgaagtgattctcctggaggcggcggtggtggacattcagattcattccaagatccaatggtgagttgatttttgcatttcatttttttgtatttatacatatttattttcaggatcctggagaacaacttggatctgacgatgaagaacaagaagatccacgtgattacaaacgaggtggatatcatccagtcaacattggtgatgtattcaatgcgagatatcatgtgattcgtaaacttggatggggtcacttttctacggtttggctggcgtgggacactcaagacaaacgatttgttgccatgaaaatagtgaagtcagcggagcattacacggaagcggctcttgatgaaattaag

SEQ ID NO: 29526 - DNA, 2313 bp, Caenorhabditis elegans; identical to SEQ ID NO: 29525

SEQ ID NO: 29527 - DNA, 3130 bp, Caenorhabditis elegans
atggacgaaagtattgatgatgtgcaagagaccagaacaatcgctattccattgaaagacagtcacgaagatgtaagtttttgtttcaaaagtgttcataatttcaaaaatcgatcgttgttgtttcttagtgaggaaatttgggaatattgattcatcatgtcggtaggactttcaaatttcgaatttatttcagccaaccgacttgatttatcgatatttttgaatttcagggtacgcacttaaaacgtctccgccgtttctcaatcgaagtctggaatttaatgcaaaactgggcgacagcttctgaaaaatcagtccaatatttggaatcattagttaattcacgtctgaaactgctatattcgcgagaagttgatgtagaggagtctgcaaaactaacaaaagatcaatctgatcgtgttctcaatgagattgttgttatgaattcaaaactgaatcaaactatgagtgattttgagaaagttattggaaaattcgaagttgcacaaggacgaatgtcagcttggaagcaattgaccgaaaaaagtcaaaatattgaagaaaagtacattgtggagacccttgacgagaatttgccgttaataattacaatgcttaagaaagaattgaaagtgaagcaagacgtgctcttcgatttcgctcaaaatgacagccgggacgtatttactcttgtccttctcacatttaaacatgaaccatttgttgatgtcgcccttctttccaaattattcgcattagtggcctccgaagcacaatgatcgatttttattaaatattatattgtttaaaaaaaacgttttttatgtttgttcgtgaaataaaatcttgaaaaattaattttctgaatcaaataatgaaaaacttattcaggaagtaattgaaatcaactgctccgagctccccgatggcgaagaagtccttcaaattttggaagcagaagaagcaaagttatcgtattggattgaagttgctctcgaatattacagacaagatcgtgttgatctattcatgatgattctagaatctgctggatctcgtgctggattggagtatgaaggagtaaaacaggatcaaatgagagcattggatatacttgctgcctactggatgactcaaggttacagagagaaggccaaggacaagaaaagtgatttcttctcgaaagctacagttcttttcaacacagccgataaaattgcgatgtatgaatggtctcacttgacagttcgtgcttggttttatctttttgaacgagataaaagtacaaacaagtatgaacttgctgatcaacaattcaattatgtcgttaaaaccaatccgaagaatgtgctcccgttgattggaaaagctgtaatcgcattcaataaaaaggattataaaactgcaatctattactttcgaaaagcaattcgacaatgtcgtcacacaatcgcagatcttcgagtcggaatcggtcactgcttcgctaaaatgggaatgatggacaaagcgaaaacggcattcgaaagagccatggaaattgaaccatataatgtatcggccatgtgtggtttgggaattattctgttgaacacgtacgaccatgacagcctcaaacacgcagtcagtttgtttggaagatcttataatttacaaactgatcatccagttgctcttattcatcttgctaatcatttctttttcaaaaaagaaattgagcgtgcatggacacttgcctggcatgcagcaacgtataatgattgtgattcgataaaagctgaagctttctatcaaatgggaagatgcaggcatgcacaagggcaatttgacggtgcttataaggtttgtttttgagttttcaaatcataaactaaaaatataaaattaaaaactcgaaagaaaccccggaattttgtcattgaatcctgaaagcaatcgaaaaatcaaatgatttttatgttaaaaaaagcttcagaaaaaatgcacggaaatattctagaattttgaaattttcttatttcgtgtctcgaaagacattgctctaaattctcaaaaagtcctttttttttaagtttcatatttttccaatttacgaaagcttcgactgaaaatattcaaaaatctacctaaaatttttgtgttttggccattttggaatattatacgtgtaaaatcctactttcagtactactaccaagctcgacaagcaaacaatggagagcacacccttgctcactatggacttggtcaaatgtacattcatcgaaatgaaattgaagaagcaatcaaatgcttcgatactgttcataaacgattgccaaacaatacagacacgatgaaaattcttggaagtctatatgctcatgttcagctaaacgatccggcacaaacagcagaagcacggcaaaagggacgggatgttcttggaaaatatctggcagttgaaaatgatgactatgaagcatgcatcgacttggctcaacttctcgaagcaacagatccaaaacgatctctggaattgtatgaaaatgcaatcgacttgcttgtaacaaatgagagtattcaaccacaacccgaaatgctcaacaacgtcggtgctttgtatatgtcaatgaagcaatatgaaaaagctgaacatcacttcaaaagagctaaagaacgtcttgaagaacaattgaatactgatgaagggtctctacttttagaacgtagaagtgctcctgaaaaatcgcaccttctcacaattcgttacaatttggctctgtgcttggagcatctttgtcgtactgttgaagccgaacaaatgtacaaggatattgtgaaagaatgtcctggatatattgatggatatcttcgtcttggatgtatcactcgtgatcgtcatcaagtctatgaatcgtctttgtggttgaaacaaggcgttcaatttgatcaagcatcaccaattgtttggactcttattggaaatcttcattttgcaaagaatgaatggatgcctgcccagaagaagtttgaattcattttgtcgaagattttcaacaacaaaattcctgatccatactcgctggtagctcttggtaatgtgtggttcgagcagcttctcaatccatcaaggaaaaaggaagat

SEQ ID NO: 29528 - DNA, 414 bp, Caenorhabditis elegans
atgtccgggggaggaaaagacagaatcgcggttttcccgtctagaatgtgagttttatagaagaaaaacttgatggaaatctaaaaaataactattcagggcgcaaaccctgatgaaaacccgtctgaagggtgctcaaaagggtcattctctgctgaagaagaaggccgatgcgttgaatcttcgtttccgtgacattttgagaaagattgttgaggtttgtttgaaaattctgaggtgaaacgctaaaaatcaaatgttttcagaacaaagtcctcatgggagaggttatgaaagaggctgcattctctttggctgaagccaagttcactgctggagatttctctcacactgtcattcaaaacgtttctcaagctcaatatcgtgttcgcatgaagaaagagaacgttgtcg

SEQ ID NO: 29529 - DNA, 1596 bp, Caenorhabditis elegans
ggtgatcttcctgtttgtgaaagtgtatcagaagaaagagaacgagttcatcgagttaattctcaaaattccgcgcttgttattaaggatttgacgaaaacttttggaagatttacagctgttaatgaattatgtctcgcagttgatcaaaaagaatgttttggacttctcggggttaatggagctggaaaaactacaacattcaatattttaaccggtcaatcgttcgcatcaagtggagaggcaatgattggaggacgtgatgttactgaactcatttcaattggatactgtcctcaattcgatgctcttatgctggatttaactggaagagaatcactagagattctagctcaaatgcatggatttgaaaattacaaggcaaaagcggaacttattttggaatgtgttggaatgattgcacatgctgataagctcgttagattctacagtggtggacagaagagaaaaatatcagttggagttgcacttctcgccccgacacagatgattattctagatgaaccaactgctggaattgatccaaaagctagaagagaagtatgggaattgcttttatggtgtagagagcattcaaatagtgcattgatgttaacatctcattcaatggatgaatgtgaagcattgtgctcacgaattgccgtgcttaatcgaggatcattgattgcaattggatccagtcaagagcttaaatcattatacggaaataattatacaatgacattgagtctttatgaaccaaatcaacgagatatggttgttcaattggttcaaacaagattaccgaattctgttcttaaaactacatcaacgaacaaaacattaaatttgaagtggcaggtgagtacctatttttatttatttaatttttctatattttccccgaaaaaaaatcaaaaactatatcatttcgaatttgtttttttggaaaagattaaattttaaattttaattgggggattggggggaggaaaataaattagttgattgggaaaaatggattaggatttctccagaaaagtcgttccggaaattcagagatgccgccaagaagaacagaggcaaatcgaaaataaagaaaaaaaatccaactttcgaaaacttctcaatttttactattttccaaatttgaatatcccccaaaatgagaactgcaagatcaatcagcgtgtccgaactccgcccactccgcctgattggttgaagagtgggtggaccggatcgctgattggtcttgcagttctcattttggtggatattcaaatagggaaactggtcgaaattgaaaaatagcttcttttggagttgatttatttattctatgtatttcagaataacttacttttttgctaacgctcagaatgaaatcgaaatttccagattccgaaagaaaaggaagattgttggtcggccaaattcgaaatggtacaggcactggctaaagatttaggagtcaaagacttcatattagctcagtcctcccttgaagaaacattccttcgacttgccggtctcgacgaagatcaacttgacacacattcaactgtagagatttcccattccacacatgtctga

SEQ ID NO: 29530 - DNA, 1596 bp, Caenorhabditis elegans; identical to SEQ ID NO: 29529

SEQ ID NO: 29531 - DNA, 459 bp, Caenorhabditis elegans
gctgctcgtgctcatacaaagttgtttatcgcccgtggtttcgtgaaaagtgtgcaggaagttagtgatgaagcagttcatgatgtacttacaacacttgctgaactctatctctcttatgaacttattgaaatgtcggctgatttgacagctaatggatatctttccgaatcggatgtccaacaaattcgacatcaaatctacgattcaatgagaaaaactcgccgcaatgctgtttcaattgtcgactcatttgatatttgtgatcgagagcttcgttcagtgagttttgccgaattccgaattctaatgggacaaaaatattattttcaggtactcggtcgccgtgatggacatgtatatgagaatctgtacaaatgggctcaaatgagcccactcaatgagagaaatcttcctcatgttgaaaagtatttgaagccaatgacaagcaaactttaa

SEQ ID NO: 29532 - DNA, 1041 bp, Caenorhabditis elegans
gtgtcaatgtatggtcatcttggaggccttgtcgccggaattctgttcacattcattttattccgtggatccaaaccatcacgattttatactgtttctttttgggtgtcccttgtactttctggattctttatcgccatttgtattactcttattgctgcacccagtatgcttcattaatttgaataaatctttactaactgaaattgattaagaaatagaaatattaatgaggaagcagaaaataaaaatatatagtaagaaaaacatatatatcaatttttttcaatatagtacacttgtcgatggaaattttaaattaatcctgctcaatgcgggttagagtacaacacaaattacaaagtacggacaaaattgagcattttcggtaaattctagttttgaaatattttggaaatttcaaaatttttaaaattttaatcttcaaactacaaatgcaacgcctcatatttctagaaattaccggtcctaggagaaccgaaaaaaagtaaggaaatttgataaaatatatttataaaaatagagttgtaagtgttttttgttatgaaaattctttttcaatattttcggaaattggaaatttttggcaatttgaatttgtcgaaaataattaagccgagcggcagttgtcacccataaaatttcaaagaaagaaaattagagtagatatataatactatctaccatagtttaacaggttggaatttttcagagctccaattgttttattttataaaaatttcagggactacagttcaagaaattattaaaaatcagtcattcaaaaataacgcaacacgatgtagtgtgcaaataggaataaactgtatttcatggacgtctaattttttaatctttgaccacatttttcatgtttcctattcccatgttcttctcatctctaatgctgtttccaactctctatacccaactacgtcacctccttccattctcattgtgctctgttcatctccgggttttccaattctctcgatgggttttccgctctataaatactga

SEQ ID NO: 29533 - DNA, 319 bp, Caenorhabditis elegans
gaacaaatcacttgctcaaatccccattctgcattcatccaaagaccggaaacgttgcagttcctctgaatgtcggtaaaattgaagagttcgatgtaagcaaatgtcctcgaattgagtaagtaaaaagtcgtctctctaatagtattatccaaaaactttcagtcatgtcgtggaagagttgagcagtcttttggctgaacgaggaaacgacgagaacgaggattcgaagaatcgaaaattcctggcgtacaagcatggagctctcgcaccttacgttgaaaactttgaaaagtttgtatcggcttgcatttcataa

SEQ ID NO: 29534 - DNA, 1076 bp, Caenorhabditis elegans
ctatctctcctgttgtcgatccaaatgagaactttacccgaaaaacttcagtcgctgacgtcactcgcttcttgttaaaaccaacttcaatgatggtttcaactgcttctcgggttcggccaaatgactgcatgctatcagcttacatgttccttcaaggacaaattgaggcacatacaattatgactgctgagcaaaacgttgatgtaagctcaatactttaaagaatttccgggaaaattgaaaaataaatttactaaatcaaccataaaattcaatttttatcaaattttgtttatgttcatgaaaactataagaaagcatataaatattttctaaaaataaaaataagcaactttaaaaaatatttttcgagatatcggaaaaacgaaaaattttcgtaagctaattttggagatgtagattttattctcaaaacacgaaggcggtcacaaataccgagatactgcaaacgaaaaaaatcttcaaattacattgcaaaaatgagcgcttattttgacgaatcagcaattgtgaagcaaacttttttaaaaagtatttttgacatgaagtaaaaaatttttagaaacttggaaatttgacaaaagcgtggcaattcaaataacacattagtcagaaaatcaaaaatgcaccaataaaatcactattttaaagacaaaattagtgattaataatgactttttttcgttatttttctataatccaccttaaagcatcaaatcaataaaatcaaatttcagttcgcaatcagaaggcctccattctacatgcttaaaccacttcgaatgatgcatgctccactctctccatatgttcggccacaatacaaagtatctggactcttgctcaataacagcacaagcgtggctccgttattcgaatcgcttctctccaaatacgacaaactacgatcaaagagagccttcatcgacaagtttgaaaagattgacaatttctcgctggatatgatggacgatgcaatgcacattgtgcaagacttgctggacgagtacaaggcggtcgtacaaaaggactatctgacaagagggctttag

SEQ ID NO: 29535 - DNA, 301 bp, Caenorhabditis elegans
ttgacaaggaaggtaacgtgtgcatctcgattcttcacgatcccggagatgataagtggggttacgaacgtccggaagagcgttggctgcctgtgcatactgtcgagacgatccttctttctgtcatctcaatgctcacggatcctaactttgaatctcctgcaaacgttgatgcagcggttcgtctaaacaatgaaaaataaccgaaatattttaattttttcagaaaatgcaacgtgaaaactacgccgagttcaaaaagaaagttgctcaatgtgttcgcagaagtcaagaagaatga

SEQ ID NO: 29536 - DNA, 641 bp, Caenorhabditis elegans
atggatcctattcgcgaaggagaagtggcccacgagggagattcggtttacacactcaacgatttcacgaagctcgaaaaaatcggcgaaggaacatacggagtcgtctacaaaggcaaaaacagaagaaccaatgccatggttgctatgaagaaaatcagattggaaagtgaagatgaggtatttgaattttgtagcagtttcgttttttcaaacaataattcttatagggtgttccatcaacggctgtgcgagagatcagcttgctcaaagagctccagcatccgaatgttgttggattggaagcggtcattatgcaggagaaccggcttttcctgatcttcgaattcctgtctttcgacttgaaacgatacatggatcagttgggaaaagatgaataccttccgctcgaaactcttaaaagttacacattccaagtgaggaaatatttaaaatcgatgtctttacaagaataattgttccagattcttcaagctatgtgtttttgtcatcagcgtcgtgttattcatcgcgatcttaagccacagaacttgctggtcgacaacaatggagcaatcaagcttgccgatttcggacttgccagagctattggtatcccgattcgcgtttacacgcatgaa

SEQ ID NO: 29537 - DNA, 425 bp, Caenorhabditis elegans
atgggagctactggatcatcacaactggaaaaggagatcagtaccactgagtcagttaataatgccaatgaacactattacgggctagtaaatgtcagtggaatttatcgagtttatcgagtttaattcttttttattcagtttggaaatacatgttactgcaactcagtgattcaggcgttgttcttctgccggccgtttcgagaaaaagttctcaattacaagcaaactttgaagaaatcgggttagtatttaaaaattctatttagaaaaatcattaaagtaaaatttaattttgtcaggcgcttcaaaggacaacttggttacgtgtctagctgatctatttcatagtattgccagtcaaaaacgaagagtaggaacaattgctccaaaacgatttattactaaattaaagaaagaaaatg

SEQ ID NO: 29538 - DNA, 510 bp, Caenorhabditis elegans
atgtcgaccgacactaaacaaatcattgctgatgcgctcttgaagaacgagcaggctatgtatggcccattcttcggcagtcttggagtaacatccgccatggcatttgctgctgctggatctgcatatggaacagcaaaagccggcaccggaatcgcttcaatggctgttgcacgacccgatctcgttatgaaggccattattccagtcgtcatggctggaatcgtcgccatctacggacttgtagttgctgtcattgtgtcgggaaaagttgagccagctggtgctaactatacaatcaataatgcattctcacaattcgctggaggtttggtttgcggactttgcggactcggagcaggatatgctattggtatcgctggagatgcgggagtgagagccctctcacaacaaccgcgcatgttcgttggaatgatcttgattcttattttcgccgaagtcttgggtctctacggtatgatcgtcgcccttattcttggagctacataa

SEQ ID NO: 29539 - DNA, 583 bp, Caenorhabditis elegans
atgtcgtacgatttggaaaccgccgaaagagctgcctacgctccattcttcggatacatgggagccgcttctgcccagatcttcaccgttttgggagcagcttatggaactgccaagtccgccgtcggtatttgctcaatgggtgtgatgagacctgagctcatcatgaaatcggtcattccagttattatggctggtgagttcagcattttcctcatgacattactcatatttaattctgtttcaggtatcatcggtatctacggattggtcgtggctatggttctcaagggaaaggtcacatctgcttcagctggttatgacctcaacaagggattcgctcacttggcagctggacttacctgcggactttgcggacttggagctggatacgctatcggaattgtcggagacgccggagtccgtggaactgcccaacagccaagactcttcgtcggaatgatccttatcctcattttctctgaggtgagtcgtcaatttcaaatattttttaattattctgaattttcaggtcttgggactctacggtatgattgtcgctcttatccttggaacatcctaa

SEQ ID NO: 29540 - DNA, 907 bp, Caenorhabditis elegans
atggacaacattatcggcggtcaagcccagcaagtggaggacaccgacggaactcgtgtgcagaacgagttttccaagtttttgaagagcttcaaagaccagaaaaatgagtttatctacaaatctgcgatgaaggagctcgtgcaaccagaaaagaataccattttcattaacatgcaacatctctacaagttcagtaacaatctcgcaacaactatcgagctgcaatactacaggtaaattaaattcgattagtattttcgaatacttataaatatacttcagggtctatccattcatgtgcgaagctctacacttggccactttagatgcttgtgatgaaagtgagagacagcaaatgttcaagaagcaattgtacgtttcgctgttcaatctcgatgcgaaaacgaaagttcgtgagctttctgcggacaaagtcggaggcctcgtgcgcattgccggtcagattgtccgaactcacccagtgcatccagaactttcacgggcttgtttcgtgtgtgaggattgcggtgttaccacacgtgatgttcaacagcagttcagatacactcaggtatgcggagataataattagcttataacgaattcaaatgttttcagccaactaaatgtgctaatcctcaatgcatgaatcgtaccagattcagtctcgatgtcaactcatctactttcgtcgacttccagaagattagaattcaggagactcaagcagagttgcctcgtggatcaattccacgtactgtcgatgtgattgttcgaggagaaatggttgaaactgtccaaccaggagataaatgtgacattgttggaactcttatcgtcattccagatattgctcaattgagcactcctggacttcgtgctgagacttcaaatcagaacagag

SEQ ID NO: 29541 - DNA, 1409 bp, Caenorhabditis elegans
atttatggaaaccacgaagttaagcttggagttcttctgatgcttcttggaggtgtcgcgaagaagagcagggacgaaggaacttcactgagaggtgatatcaacgtttgtcttgttggagatccatcaactgccaagtcgcaagttctgaaagctgtggaagagttcagtccaagagctatttacacttctggaaaagcatcttcagctgctggtctgactgctgctgttgtaaaagacgaggaatcgttcgagtttgtcattgaagctggagctctcatgcttgccgacaatggagtttgttgtattgatgagttcgacaaaatggacctcaaggatcaggttgccattcacgaggcaatggaacaacaaaccatttccatcaccaaagctggagtcaaagcaacattgaatgcccgtgcatcaattcttgccgctgcaaatccagttaatggacgttatgatagaagtcgtccgttgaagtataatgtccagatgtcagctccgattatgtcacgtttcgatcttttctttgtgttggtcgatgagtgcaatgaagttactgattacgctattgcccgtcggatccttgataatcatcgtgcgatcagtgagcatactgaacgtgacagtgtttacaaaattgatgatatcaagaagtatatcgcgtttgctcgttgcttcaagccgaagatttcggataaagctgctgaaactcttgttcgagagtacaagaaacttcgtatgtctgacagcaacaatgcagccacgtcatcatggagaatcactgttcgtcaattggagtctctcgttcgtctgtctgaggctcttgctcgtcttcactgtggaaaggaagtactggtggaacatgtcgaaaaggctgccgaacttctcaacaagtctatcgtcagagttgagcaaccagacattgctttggatgatgacgactttgacaacaatatcatggttgttgaagcagacaaagagaatcaaagaggagatgatagtatggatcatgatggagagaaggaaaatgctccgaagattgatatagcaaagctcaaaatctcattcaaggaatacaagcaattgtctgatgttctcgttttacatatgcgatccgatgaagacaatcaaggagaagacgagtatgatggtgtcaagcagagtgcacttgttgaatggtttgtttaaatattcaaatatttaaatttaaatttctggtttttaggtacttgtcgacaatcgaagcagatttggagacggaggaagacttcaacgtacaaaagactatttgcgagcgtgtaattcatcgtctcattcaccaggatcacgttcttcttgaagttgagcaaggagaagatccaactctctgtgttcatccgaactatgttattgccgacgaataa

SEQ ID NO: 29542 - DNA, 796 bp, Caenorhabditis elegans
ggaaaatggattcgaccaaaaatttcaaatccggcgttcaagggaaaatggacagctcgacttatcgataatccaaactacttcgagcccaagccatttgccggacttgctccaattactgctgtcggaatcgaaatgtggacaatgagcgaaaatatcttatttggtaggaaatttaacatcatcgtgagtttgaaatatgaaaattaaattttcagataatatcctcatcacatcatcagaagaagactcgtctgatgtagctaaacaaacattttacgttaagcaaaaagaagaatatcgtctcgctgcagccactggaaatggaaatggtttcttccagcaaattatcgacgcaacaaatgaaaaaccatggttgtgggcagtttatattctttgcgttcttcttcctcttgttgctatcggagtattttgcttcggaaaacaatcgaaaccaactccaaactttgcgaaaaagtctgatgcttactcagccgatgatgacagagttccgaacttggtcgatgatgacgaagaagaaattattggagatgaggaagacgatgtgaatcagcctggaccatccggttcccagagcaatccagaaccgcaagacgaggaagaaaatgccgaacaacaatctgcgaattcctcgcaatccagtgcagctgaagaagaggatgacgagcatgttgttccagaaaatgagccagtgaagccaactgaagaatttgccaaaaagagcccgaaaaataccggaggggcgaagcgtcgcacagctcgccgaggggattga

SEQ ID NO: 29543 - DNA, 408 bp, Caenorhabditis elegans
atgggtctcattatggcaaaactgttccaaagttggtggattggtaaaagtaagaaatattttattaatttcaagtttgaaaaaaaaaggaattttcagagtacaagattattgtagtcggtctcgataatgcagggaaaacgacgattttatataattagtgagttaatttcagaaaaaaaacacattaaataacttttaaaaatttagaaataatttctaatccaaaaaaaaaattataattcagtgtgacaaaagatcaagttgaaacgaagccaacaattggaagcaacgtcgaagaagtttcgtatcgaaatttagattttgtgatctgggatattggcgggcaggagagtctacgaaagtcttggagtacttattatgttcaaacagatgttgttatagttg

SEQ ID NO: 29544 - DNA, 1210 bp, Caenorhabditis elegans
atgagcggaattcagccagtgcccggagccaagtgagccaatttccatacactttcacattaattttttccttttccaggcctctgtcaatgtggcagcaatacggaccttcagagaagacggttcgtggaattgtgattggaggaatcactggtggtattgagatttgtattacattcccaacggaatatgtcaagacacaacttcaacttgatgaacggtctgctactccaaaattcagaggaccaattgattgtgtaaaacaaacagtgaatggacatggattctttggtctttacagaggattatctgttcttctctacggatctattccaaaatcttcattcaggtatggaaaatacgctttcgtactgtcaaaacagaactgatcggtcaaaaaaaatttttttaatttttcgaatttttttgcaatcgagaaacggagaagtgacatccttgtttataactaggaattatcagaaattctgaataatataattttcagattcggaacatttgattttccgggaaatcgaaatttttcaacaattttaaaattttgtatcaatttttgtagtttaaaaaaatacgaaagcgtgcaatttacttctaaaactagagaaaaattgtcaaaattgaaatctagttttcgaattttccgaaaaaacgctctaaataatacattttctagattcggaacattcgaatatctcaaatctcaagcagcagatgaacgaggaaatctatctccagtaatgcgacttctttgtggattgggagctggtctctctgaagccgtatttgcagtaacacctatggaaactgtaaaagtgaaatttattcatgatcaaggacttgctcaaccaaaatacaaaggatttgtgcatggagttggatgtattgtaaaagcagaaggacttggtggtatatataaaggagttactgcaacaatggccaaacaaggatccaatcaagcgattcgattctttgtaatggaaactctcaaagattggtatcgtggtggtgacaatactcaaccgatctcaaaaccaatcgtcggacttatgggagcagttgctggagctgcttctgtttatggaaatactccgattgatgtagtgaaaactcgtatgcaaggtctcgaagcgaaaaagtacaagaatactttggattgtgcaatgcaaatttggaagaaagaaggattcttcgc

SEQ ID NO: 29545 - DNA, 765 bp, Caenorhabditis elegans
gtgtgcgaggcgttcgtcaaaactggtaaatcgatggctgaagttgagaaagaactgttgaatgggcaaagtgctcaaggaccattgacagctgaggaggtttatttgatgatgcacaagactggattggatgctaagtgagtactagaaattattatttgcctcaaggatacggtacctgatgtcgttgaaaaatttacaataattgaaaaataaaatttcggtttaaaaagaatcttatttcgcaagcctcgcatgttttattcctcgatattgctctcaattttgggtgaggctcacgattagaaaaaacgtgcgaggcttgcgaaataagcgtgcggtggttgcaaaaaaaatcctgtcttgagctgcattctgttttggtggggcctcgaaatttacttttattttaaatagtttttccgtttataaaacctcttctttttgaaaaattgtctaattattgcaacaaaaaatattattatgcagcaacatgcaaaatagaaagaccggaagatgttgtactctttaaaggcgcatgcacttttgcgcagccgccacttaagaatactttcgattgtgtcgagaccaggtaccgtatccagtatactgtgagctggcgaattattttgtatttttaaattctatattaataaattgattttcagattcccattgttcacagccgttcacaaaatctgcgccggtgagatgaagcctgccgaactcgtcgattgtctcagaaaccatccagaacacatgtaa

SEQ ID NO: 29546 - DNA, 809 bp, Caenorhabditis elegans
caaccagccatcgtcaagcctgcgccgagatcatgcatgagatccgtgacacccgcccgtggttcggaatggagcaggaatatctgatcgtcgacagagatgagcacccactcggatggccgaaacacggattcccggatccacagggaaagtactactgtagcgtaggagctgatcgtgcgttcgggagagaagtcgtcgagacacattaccgggcttgtcttcacgccggactcaacatttttggaacaaatgccgaagtgactccaggacaatgggaattccaaattggaacctgcgaaggaatcgatatgggagatcagttgtggatgtcgagatacattctgcacaggtacataaatcaaccccgatagttgtaaaataaaaatgatttcagagttgctgaacaattcggtgtctgcgtatcccttgatcccaaaccaaaggtcaccatgggagactggaacggagccggatgccacaccaacttctcgactgccgaaatgcgtgctccaggtggaattgctgcgattgaagccgccatgacaggactcaagcggacacatttggaggcgatgaaggtgtacgatccacatggtggagaagacaatcttcgtcgtttgacaggacgtcatgagacaagttcggctgacaaattctcatggggagtcgccaatcgtggatgctcaatccgtattccgagacaggtggctgcggagagaaaaggatatctggaggatcgtcgtccgtcatcaaactgcgatccttatcaagtgactgcgatgattgcacagagcattctcttctag

SEQ ID NO: 29547 - DNA, 715 bp, Caenorhabditis elegans
ctcaaacggaagtgaatgggatattgtgagaaaatgcatttgctctgcgtatttccacaatgcagctcgtcttaaaggaattggtgaatatgtcaatgttcgtaccggaattccatgcttccttcatccaacttcagctctttttggaatgggtttcatgcctgattacgtggtaagcagggctgaatctgaagaaaaaaaaatgctgaatcggtatttcaaatatttcggccaaattgcactctattttaaattttgaatatgatttttggaaaaaaagtaacacttaaaaatttatgaatgtttcagtatatcctctttttcgaaaaaaagaagcggaaaataaattattcgccaaaaacacattcctttaaactttaaattaatattctaaattaaggtgtaccacgaattgattatgacagccaaagaatatatgcaatgtgtaactgctgtcgatgcaatctggcttgctgaacttggacccatgttctattcgatcaaagaatcgaaacaatcacgcaaagaactgaaaatggagagtgtccgaacggttgaaacgatggaagcagagatgcgagaggcgcagaaagaaatggaacggcggaaggaagaaagtgacaaggcgttcaaacgaccagaatcttccaggcgtgttgttgaagtcggatcgaaatcggccagatcggagagaagaaagctgtggggtctttga

SEQ ID NO: 29548 - DNA, 347 bp, Caenorhabditis elegans
gaggagacgaagagaaggaacgagagcaaagagcggaacgtgcacgtttgaatgttccagctacagctgcagaaggaagttcaaaggatattagtatggtgagtttataaaattgtttaaaactgctaaaatgcccaaaaaccataataaaacttttcaaaaatttttttttcaatttacagccaaaagttgtgaaaacacggtctgttgtcataattttagaattcgaccgaaaaaagttatttcctacgaatttgatacgtatattaattttgttacaattatttgcagttaagtcgaagctgcagcagtgctctaaattacttgaaaaactgacacatttttga

SEQ ID NO: 29549 - DNA, 134 bp, Caenorhabditis elegans
gacaatgcggctgcgatgatgaatgttgacaagaacttgacttgctccttccaggtaaattttagaaagaatgaaaagagtattaaattatttcatttcagatcatgagaccctccatcgatgcaaaaaagtga

SEQ ID NO: 29550 - DNA, 761 bp, Caenorhabditis elegans
ggatgtattcatgaaacaaggtgcaatgctcgaacttgaagctcctgtgaagatctgtggtgacgtacatggtcaatattcggatgttcttcgccttttcgatcgtggaggattcccaccattggtcaactacttgtttctgggggattacgtcgatcgcggacaacaaagtctagaagttgcctgtctgttcctggcctacaaagtcaaatttcccgggaacttcttcatgttacgcgggaatcacgagtgcggatccattaaccgtgtctatggatttttggatgaagttcaacggaaatatggagcaaagggtggaacaacaatgtggaattgctttcaagttagtgttttgatttttaaaattaaatttaaaatgtttgttccagatttgttttgcgtatatgccgtacactgctctggtctccggaagaattctttgtatgcacggtggaatcagtaaacggatgaacaatttgaatcaacttcgcaatcttcaaagaccggttttagaagtcgctaatccgagcgtcgaaatagatatcctctggtcagatcctgactcaacagttgatgattttgtggacagtacccgtggagttggtcaagtttttggagcaaaagcattgacagctataatgaataaactggacgttgatttggttgcacgtgcacatcaagtagttcaagatggatatgaattcttcaacaacaaacgtcttgtcacaattttctcagctcctcattactgtggagaattt

SEQ ID NO: 29551 - DNA, 851 bp, Caenorhabditis elegans
aattcatccaaatcttcgacaacccacttattgttatggccttcgtcaaagtaataatatcgatgattttacaacagtgaacaacctatactcgtggtttgtacaaaatgctggctacttgcaaacagatggatctaatcttttgaatgctctgggatgcgtacaaaatcttgatttgcaaaagacgttagtttaaggtttaattgtcaagttactaattcaaaacaatagtaagacaaaacttcctataacaaagctttgttggaagattgacaacgatttccatttttcaaataattgtgccaattttcccgaaaaattcaacattttgcaacatgaaaaatgttgaattttttgggaaaattaaagattgcttggcttttttttgatcaggaaaaaattgtcaacgtctcaaaatcttactaaaaattggaatatttttgtcggagatgttgtacagattttactgcaattttggaaaaatttaatttcatagtatatttttatcacgttataacaaaaattgcaaaattgcagtaaaatctgtacaacatctccgacaaatatattccaatttttagtaagattttgagacgttgacaattttttcctgatcaaaaaaagccaagcaatctttaatttttaaaaaaaataaaaacatacataaggggatcctttgactcaagaaaaaaataattcatgcaattttcagaatgcttcgatcaattctgagtggagattatccaccatcacttctcaattcaattgcagttcatgatgattcatcagatgttctttacaatttcttgctggataatactcaagattcagattctcaatgctccgtttga

SEQ ID NO: 29552 - DNA, 515 bp, Caenorhabditis elegans
tacattctcggaggtttttcttccatttgctgttcgttatgatattggtgatgtacaaaaccgcactttgaatatgttcgcaaatgtgaaatcagcgtgtatcaacagtctgaatggaactgcatggtgtaatccgtattcaacaaatctccgcaaagcgatttactgtggagctgccaaatatgctccagcaacttcagattatttcttccaaatgcttcactcgtacaataaggaagtcatcaccaatccttacttctatcaagaatacatggcattgttagaaggcatgagttgtacacagagccctgctactcttaaagtgttagtttaaagtagcacaatatattttcattagatagttttatttcagattgattcgtttgttcacaacatccaccctgaatccttccactatttttggatttttgaaatacaaccccgcagcttcagatgttttgtacaactatttcatggcaaatcctcaagtattgacaaaaaccaaattttcgtaa

SEQ ID NO: 29553 - DNA, 707 bp, Caenorhabditis elegans
atgtgttcgaacattgactgtgcggctgaagctgagtgccgagagacaccaattggacccatgtgccaatgtgtcagtggatacgtggatgtttccagacaacacggaagaccagctggaagagtctgtcgagctgtagtgaatgagtgtgctgaaggaagacatgattgttcatcccatgcaacttgtattgatactgctgatgggttcacttgtcgttgcaaggatagctatagagatgagagttcggacactttgaagcatcccggaaagaattgcgttagaagtgagttttcatagaagtctatgcatttgaataataagaacaacatgctttttcagctgtgcaacctgatccgccagagtgtgatgttagtgatccaatgagctgtgatccagcaaaacgggaagtgtgcatatttgtggagaacacttacaaatgtagatgtgcaaatggatattctcgacttccggatggaagatgtgttgtaatcaatgaatgtgctgaaccaagattgaatacttgtggaaagaatgcagaatgtattgacttggtatgtccccttctttgtctcccaaaattcacaaaatatcatttttcaggccgaaggttacacctgtcaatgtagaagtggatacgcagacatctcaccagtttctcaaccgggaagaatttgccgtgctcgagtgaacgaatgtagcaacaa

SEQ ID NO: 29554 - DNA, 233 bp, Caenorhabditis elegans
gaacaatgttatcatttatctggccggcactattccacctttatatcaaagaaaaaactctcaataattttgaaaaacggtaagatataatattcggaataatacaatactttaaaaatactgattacagatttgatcaaggaattataataatgggatgtagtgtgtgcatttctggtgtctacttctcatcaatggaacttctcagagcaatcaactctgctgattcttaa

SEQ ID NO: 29555 - DNA, 850 bp, Caenorhabditis elegans
gactcaatggatcttctcgctaaattgccaactgttgccgctatcatctatcgcaacctgtaccgtgatggatctgcagtcagtgtcatcgatccaaagaaagattggtccgccaacttctcttctatgcttggatatgatgatccacttttcgctgagcttatgagactctaccttgttattcactctgatcacgaaggaggaaatgtatccgctcacacttcccatcttgtaggatctgctctttctgatccatacctttccttctccgccgccatggctggacttgctggaccactccacggattggctaaccaagaggtactaaactttaatttattcttattttattaaaaacaattttttccaggttctcgttttcttgaacaagattgttggagaaatcggttttaactacaccgaggaacaacttaaggaatgggtatggaagcacttgaagagcggccaagttgtaccaggatatggacatgccgtacttagaaaaaccgatccaagatacgagtgccaacgtgaattcgcccttaaacatttgccaaacgatgatcttttcaagctggtctcgactctttacaagatcactccaggaattcttctcgaacaaggaaaagccaagaacccatggccaaacgtggactcccactccggtgtccttcttcaatactttggaatgaccgagatgtccttctacactgttcttttcggagtttctagagctctcggatgtctctcgcaattgatctgggccagaggtatgggacttccactcgaacgtccaaagtcacactccaccgatggacttatcaagcttgctctcgccgccaagaaataa

SEQ ID NO: 29556 - DNA, 445 bp, Caenorhabditis elegans
gctgatcttcgtcgccgatccatgcattttccgaatcagcggtgtcgaggtggcaatgactagcagtgagcctattcaagcgttgagcaatacggaattccatcgatccgcaaatcaggagaacattgatcgtgtcgcccgtctcagcagtcatcttctcactcagcagtgcatgtatccattggagccaacggaagttccagcgtccatgggagatttgctcgatgtctgctgtatcggctcgactcctcatatcgtttttgcaccgacaaagcttgcgccatcagcaaaatgtgtgaatggaagtgtgttcattaactcatctacactcgccaaagggccaacaggaaactatgcaaaaatgtcgattaacctgaatgccggagaactcatgcccggggagacggtcgccgattatgctcagattcaaattttgaaaatttaa

SEQ ID NO: 29557 - DNA, 404 bp, Caenorhabditis elegans
aagaaatctggtttgcgtgtggtccgtacactgcgacggacaattgtgggtatgagcatctctgtgagcttttggacaaagtcgttgccgagaagcccgatattttgatgctggctgggccatttgtggataagaagaacacgtttttgaataagcccacttttaatattacctatgacaatttgttggaggatttgctcttgaaagttaaggagacgcttgtcgggttggtttttgaacaattgaatttccttgaaaattgcaaaaaaatgataattttcaaatttcagcacaaaaacgcaagtgatcattcaaccgaacgcatcccgtgatctttgtgttcctccggtcttcccaagtgctccgttccaacagaaccgaaaactcgataaaatcaagaaaga

SEQ ID NO: 29558 - DNA, 875 bp, Caenorhabditis elegans
atggcgggcagaaccctcaagaagtcggcgacggcgatctcggatacgttgcgccgcacgttctcctcgaagacttgggagcatcgtgagcagctgcattctcttcaggaagatgtaagtccaaaaaaggaatactatatattttaagaaaaatttcagaataaattctttttgcgaaaagtgcgatggcaaattgcacttctagctcattttggatttgcgatttcgtttggaattcggtcgaattttggagttgccaagaatcggatgatcaataattttacagatgcatatggagaagttcatgtaagtaaaacaagttttaattgtagtggtcctcttctttctgtagtttggtcctcttctttctgtagttttttagttctgtagtttaaaatgattgtgaagtgtcggctgcttctgagccgcacaggtgcggccttaatctcaactttccgaatttcaggaaaaggaattcttctggacaggaaccgaagtcggaatgatggagagttctttcttctatggctacgctgcctctcaaattccggccggtgtgatcgccgccaaattcgcgcccaacaaactcttcatgctcggaatcctcttcgcctccctgctcaacatagtcaccgcaatctgcctgaactttcacccgttcaccgatatcttcgtgatggtcatacaggttatgcagggactcgcccttggagtatgctatccagcaatgcacggagtctggaagtactgggctccaccactcgagagatccaaactcgccacgactacattcaccggagcctcagtcggtgtgatggttggactgcccgcgtctgcgtaccttgtctctcatttcagttggagcacaccgttct

SEQ ID NO: 29559 - DNA, 840 bp, Caenorhabditis elegans
atgtatttggagcactgggaattgtgtggtcgattttatggatttacgtgtcgggtacaagtccggaaactcatgggtatataagtgcagatgagaaaaagtatatcacggagaaagttggatcggtagctgtgaagaatatgacggtgagtgtctagttccagagagatgtctgctgcaaagatgtgagcgaccgacccgggagatgtcagctgttctttcttaattccgaagcgcccctgaaaaatcatattttcagcttaccactcttccatggcgtgacatgatgacatccaccgctgtatgggcaatcattatctgctccttctgtcgctcgtggagcttcttcttgctcctcggaaaccagctgacctacatgaaagacgtcttgcatattgacatcaaaaacgtgagttattatttagcatggcggccgacatattaggggtctttacataaatctaaaattttcagagtggtctcatcgcgatcttcccgcaacttggaatgtgcattgtcacacttaccagtggtcaactatccgattacctaagatcttctggaaaaatgagcacagaagccgtcagaaaatccgtgaacacttttggattcacagttgaagcagtgatgctaggatgtctggcgtttgttcgggatcctgtgattgcagtgactttcttgatcattgcttgctcgggagccggagccgttctttctggattcaatgtgaaccactttgatattgctccaagacatgctccaatccttatgggaattgcaaatggactcggagccatcgcaggcgttggtggaatcgtcacaaattcgttgacatatcag

SEQ ID NO: 29560 - DNA, 1425 bp, Caenorhabditis elegans
atgccgaacggatccattagaaactgcgcaaatgcggtagcagataccgttcgccaaacgttctccagaaagacttgggagcataaggaacagcttcaaactattactgaacaggttagttcaagaatttgatttttttttaaattttagtgagaaatttggatttcagaaaaaattcttcctgcgaaaagtgcgatggcaaattgctattctagctcatttcggattcgcgatttcatttggaatacggtcgaatttcggtgtcgccaagaatcggatggtcaataattttacagatgcatatggagaagttcatgtgagttgaatatacacccgtgaagtgtcggatgcttcagttaacgctagcagtcttgtaagccctgttagcgtgaaacgtcgactgttgtcataaataaaaagatcttttattgaaccggttttttaattttcaggaatcgggaatttcggcaattgctggttttttctattttcagtaaatcagcactttcgtaaatcagcaaacccgcgaattgtcggacgctggccgtttaatttcaaacaattttcaagctataacaatcattagaacagtattacatttccagtaggatacaatagaaaatgttccccaaacttggtcagagaactggttttccggtaataaaaactgatatttaatgttttctttcttcttcaaaagttagattcggggggttattcgatgaaaggttatcttatcttcttttttttgaacagagggatctttggaatcagaaactaaaggatgattacctgggaaacgtcggtcactttgttggccagcaagctccccgcgaaatgtcggctgctgaatttttatattgtttccaggaacgtgaattcttgtggacaggagctgaagttggaatgatggagagttcttttttctatggctacgctgcctcccaaattcccgccggtgtcctagccgccaaatttgcaccgaacaaaatcttcatgctaggaattctcgtcgcatctttcatgaacatactctccgcgatttccttcaactttcatccgtacactgacatttttgtgatggttgttcaagctgtccagggattagcgttaggggtactgtaccctgcgatgcacggagtttggaaattctgggctccgccactggaaaggtccaagctcgcaaccactgccttcacagggtcctcagttggtgtaatgactgggttacctgcctcggcgtacctggtctctcattttagttggagcacacctttttatgtgtttggagttgtgggaattatatggtctcttatatggatgtacgtgtcatctcatagtccggagactcatggatacatcagcgatgatgagaagaagcaggttaccgagaaaattggagatgttgcagtgaagaatatgtcg

SEQ ID NO: 29561 - DNA, 2036 bp, Caenorhabditis elegans
atgagccagaaaaccgagcaagatgatattcctctcgctgatgatggtaagtgttctgaaattgaatttcctgaaaataaactttttttaaaatattgtttaattttccagacgacactgtaactataattagcggtgggaaaactccgagagctgcccagccacttccgaaggaggaaccaccagaggatccagaagagaaagcccggatgatcacacaagtgctggaacttcagaatactttggatggtaattcacagaaatttcactttttctatattgattttttaaattttagatctctcacaacgcgtcgaatctgtcaaggaagagagtttgaagttgagatcggaaaatcaagtgctcggccagtacattcagaacctaatgtcctcctcgtcagtattccagtcttctcagccgtcacggcccaagcagtaggtgttgtgttgtcctttaagaatctttttttctaattcgattccccgtccattgattgttccattctcgccgcccacattgggaccctgtgcatgatttcctgaaaccataattgccccttccactaaccccgctttaattgctcctccgatcttgtcagcctttcagttgccgaaatgttaccaaaaagttatatattttattaaataaataaataatttttccaagatcctattacagttaatatttacagagatgattcagttcacgacgacgattttggagagtacgaatattagaaattaggccgattgtaaatagaagatgtccataccacagtctttcgttcgtttcaagagctcagtttgcacaacaaaaattctcttatcgtgttcaacccgcttattttattttctttacattttctgtacgattttttatcacatttttgtgtttgtgtgaatatatttagtgtagtaaaactgttacgagtgctcatctcttctgttgtgttgttctatgccttcattgggtgacaaactggtttccggcgccgtggacattgattttatcacataatttcacgtctaacaatgctatttagttatttttcagttaaagtaaataaaaaacaaagaaaatgaaactggtaaaagtaaatttaagcaattttcgaaaaaaaaatttaatcgaattaatttcaaaatgtaccaactacagtagtatctgcaattgtgcgtcgcggtgtttgcggagcatgattttttagttcaaaatttcgagacccgaaggaactcggaggatgtccaactgggtggattcccaactcgggggattggccacgcccacagaaccgtgccttacaatacgcccatttctgcaacctccgcacggttttaaaattattttttcttgttatttctcgctctattgagaaaaatacagttttaaaatcgtgcggcagttgcagaaatgggcgtattgcaagccacggttctgtgggcggggccaatcccccgagttggtaatccccccaattggacatcccccgagttcttcgggtctccccaattggacattccccgagttcttcgggtctcgggtctcgtaccaactacagtagtatctgcaattgtgcgtcgcggtgtttgcggagcatgattttttagttcaaaatttcaaattaaattaaattaatttttcattctcaaagttttaaagcggaatttacatacggggcgctcgttcttgcggtttttcttcaaaagaacaatattttttgtcggaaattgcatctttgcagaccgaaccagaagagaagacgcacaaaaagggaatattgagtgtccctttttgttcgtcttccctcttggcccggtctttatcctcttttgttattataattaccgtttaccatttaactgttgcacacttacgcagtgtacgcagttgcgcgtcacggtgttcacacgttttggctcgagctttgaatattataaatttctcccgcgatctatcagactttgcagataatgggagaaattccaccgacagacagtgggtatccgacgcctcgagatgaaattccatccacg

SEQ ID NO: 29562 - DNA, 1118 bp, Caenorhabditis elegans
gacgtggctgactctaaagacgaaggcgctggtggagcagcaagatgagcagatgaagaaggtacagaaggccggcgagatgctgttgagccagttgcgagagaaagagtcggacaacgaggtgcttacgaagaagtcgttggagatggaggcggcagcggaagagtttcgcacttattataacgtgagatttggtcactatatattcggtggatatcggcgaaaatctaaattattattaaagaaaaaaaaagaatttcaaaaaaattaaagttttttccaggatatgttgaccgaaaacgatgagctccgccaccggattgtgcagttggacgaaattcgagaggtggaatcctccaacagcacgaagatcgagaagggactccgcgagcagctggagcaagctcagcacgaactggaaaagtaggtttttattttaaaaaattccaaagagtgtttggcttaaattcttggtttttgatggttacaattttttttctggaaaaaaaccttacactttttgaaaaattagcaaaaatttagaaataagcacaaattagcgaatttcatacagaaatcactcaaaatttcaaaaaaaaaacccctcctaattttggctaaaatattgaattttggctattttccgtgaccggaaattggctgtgacacggaaaatcggcaaaattggagattttagctgaaatttgtccgttctaaatttttgaagaatctcttgacgaaattctgtttttattgctattttgagactaataaatagaaaaaaaattatttcaattttattaattttcaggaaaaagcgtgaatacatgtggaagcttcagcagaaggacgagttctacgagattatggatcgcaacgtgaaggagacggagaaggagaacaagcgtctgctgcggaagcgaacggaggataaggaaaggatggatgatttcatgctgaacatccgcaaagcgcaggagcaatggaaatatcttcgtatgcgaaattgccaacgacacacttcaatgatgaatatgctggaatctgtgaagaagaagaagcatgaatcacgggatatgaactggcttctacagcgtttcgaggatagcattagaaag

SEQ ID NO: 29563 - DNA, 713 bp, Caenorhabditis elegans
atgattaacattccaactgcgattctgtgccgcttgggcgccagatcgtcgatttcccgctcctttggaacatcgatcgtcaccaaggtggggattttttgaatttttccgtgaaaattgttgattttttgtgtacgcatgaaggagaaatgtataacagacacattcttttcaattaattatttataatattcacagtccgaggcaaagacgccaatccagaagttcggatgggaatacctgttgaagcagcgctccaagaatcgcccaatcgctccacatctcaccgtctaccagccacaattgacctggatgctctccggattccatagaatcagcggttgtgtaatggccggaacccttctcgtcggaggaatcggattcgcagttttgccgttcgatttcaccgcttttgtggatttcatccgtagctggaacttaccatgcgcggtgaccgctgtcttcaagtacatcattgctttccccatcattttccatactcttaacggaattcgcttcttaggattcgatttggctaagggagtcaataatgttggacaggtaggagttgaaattattaatttaattgttttaaaataaaaattaattttcagatctacaaatcgggatatctcgtatctggactttcggctattcttgctctcgccattgtcttcaactcttgccagaacaagagcaacaagactgcctag

SEQ ID NO: 29564 - DNA, 285 bp, Caenorhabditis elegans
aaaaccatcgccagtgttcattccttgtaaagagggtctcaactgtgatccgatgtatgagttggaagaacgtattcttgtctcaacaccaattcatcggcggagaaccaatcataataatagctcagggagaagctcgagtgagccgcaaaatgccgcgttggtcgaggtttcaaaggtaggcttttttttctggcaaaaattatggaaatatttcaggcgttcattgatttttcccgccataacgtcaaaatcgagcccaatggatttgttaaattgaattaa

SEQ ID NO: 29565 - DNA, 956 bp, Caenorhabditis elegans
gaaaagaaggccgtattcacagaaagccggcaaccaacatcagacgtctgggaccgattcagccgagctgcaaaaacatcgaaaggagccattctatttgctgtcgtcggcggtaaaatgagcgagggaataaatttttgtgatgagctcggacgggcggtcattgttatcggattaccgtatccgaataagaccagcgtcgagttgagggaacggatgaaggtaatagtgatggactctaaaaatatggaaaagcagatttagcgtaatttttctaaaatggaaatcctagaccaatttacaggaatccttggtcagcgaattttagaccaccagttgatttttaaattctaggccaccatatcactataattttaggccacccattactatatatcgaggccacccactagattaagaaattctagaccaccccattacagaatttctaggccaccatatcactataactctaggccactacttcactcaaatcataggccatcaaatgactacagttctagaccacgaaatcagaatctaggccatcacgtgaatcaaattctaggccacctattgagctaaatccttggaaattgtaggccacactttactcggatcctaggccaccacgcaagaacacaaaagggccaccctccccccaataactcaaaatttcaaaatgtttttttcagttcctcgacactcaaatgccgaacggtggaaacctgctctacgaatctctatgcatgcacgccgtgaatcaagccatcggtcgagcaatccgtcaccgccgagactacgcggccgtctatctcttcgacgaccgctacgcaaaggagtccactcggagaaagttgtccacgtggattggagatcgcactcaagtcaagttgggatttggcgagattattcgaaagacgaggagcttttttgaagcgaattctaagaaataa

SEQ ID NO: 29566 - DNA, 2123 bp, Caenorhabditis elegans
atgcagtcggcgatcaatttgaacattggcggtttgctccagaatacgggactgctcagaaatagtcgaaatggtttgtttttaaagtttttaaaaatagaggagaagatcgatttttaggtgatctggaattctttttaatccggctgaaaatatttcattttttgaaatttatgattttcaaaatttggtaaaaaattaggcaaaaatgtagtttaaatttaaaaaaattgttaacaattctgtttcaataattatgtcgtacttattttattttaagaaaaatgtcgatttttacatgacattgtactttttgaaaaaaaaatttcaacgggattttgagctaaaaatgaaaaaaaaaactatttcttggtctgaaaatgcttagattttgatgttttagctggcaacatttaggtattcagttttcaacaatttgtttgaatcagaaattattatttagccgggcgaaaaacaatcaatttaaaatgaaattaaaattgttctttataaattaaaaagcttgcagaaagcaatatacgcttttttttaatattaagacatttagtatggtaattagaaaataaagtttaaaaaattagcacaatatattcaaaaactacatattacgggagcacaatattctgagaatgcgtatcacacaacatattcgacgcgcaaataatatcgtgcgaaaactacagtaattctttaaatgactactgtagcgtttgtgtcgatttacgggctcgattcttaaaatcattttttttatcgatagaatattaaaattaagcaaaaaaatcgacacaagcactacagttttcacttgaagaattactgtagttttcgcttcgagattttttacgttgcccaatactcattctcagaattttgtgttcctgtaataattttcaaaaaatccaaatttccaggaatcaataggaaaccgttggatattgaagcaacagcagcatcactttcaagagtatatcatcaagtttggagacaattcagttctgatacttcttcacctgttacaatcaatcaaatgaataatattctcagagatagtacgctttcaaggcggatcgctagaaaatctgaaatttcgctgaattatgatgatgctgtcgttcggataattccggcgagctcttcgttttgtaagtttaagctgcgtggaaattttgctcctttttgtaaaataagaaaaaattcagaaaaaagtttgaaactttaaaaaaattgcaaaaaaacttattttttgatctaaaataggttttttttaaaattttcacaatttttacaaaaaaggaaaattttatcgaaaacttgaatattttaaaacaattttttattagttagatttttcattattttaggaaattttcatagaataatataaaaataattgaaaaacaaaacaaaaattttcattttaaaaaaccaacttcaaatcaatatttatgttaatttttttgaaataaaattttttatttattttaatttcaaaaatatataaaatattgtttggaagtaggtttttttccaatttttttttattttatgaaaatttattacaagcattttctaaatatttcctaaaattatttttaaaaaatctactttttttcgttaaaaattgtttttaaaaatttcctttttctgaattttttccactaattttaattaaaatttataggaaattttacaaaaaaaacctctagatactggtattttattggtatttttaaaataaaaaatacgataattttttttacatttttcaaaaaattccaattgtctcagatatccaacgccgcggatttcgtactcgaaaacagacattcggagtcggaaatgccggaaaaccgacacaagatgaagtgaaatctccgttaacctatttctcagagcttctcgctggaaaaaagcaaaaaacgtcagaaggaggagttgaaaaatggaatcaatatgagtcggatctcaagaaattaccagaaaatcaacagagaacatatactgatggatttgttaagggattattgtcaaatggtgtttcgggagctggaaaagatgggaaaaaatcgaatacgctcacgcggttctacatttttctt

SEQ ID NO: 29567 - DNA, 1310 bp, Caenorhabditis elegans
ataatcgcaaagcgttggaaaatcgttgaaaaactcggcgaaggcggtatgggtgcggtgttcaaagtacgagatctgacccgctttcagacatacgccgcaatgaaagtcgagggagacgtgagtgacggcggggttctgaagctggaggctcacgtgctcaaatcactggctccactgccgttttgtgcaagattgatggatgctggcgatcgaaaatcgtattgtttcatggtgatgactcttcttggcaaggatctgatggctcataaacgggatgctaatactccgagattctgtgagcagacgactcttcgtctcgcgatggcaacgttgtttgctatcaaacagattcatgaagtgggattcactcatcgggatattaagccgggaaattgtgtgaccggggttcatgggagtgacgccaaaaacgtctatcttattgattatggtaaatttttacgaattttgacgatcccgttactcgacacgacaatattttgtttgatgcgagaaggtgtgcgcctttaaatgagtactgtaattttttttaactgttttccttatgttgcgttttttctcgaaaaaaaaacactttccagatccatcctctgaatcatgaaaaactgaaatgtacagtaatctttaaaggtgcacgtcgcattcaacacacatgtttgtcgtgtcgagacccggcaccgtatttttgattcaaaaatcacaccaaacttcgttcaggaatggtccgtcaattcaccgccaaacgagagaacggagagaccgcactccgcagagctcgatccggcgagcaactattccgtggaactcctcgctattgcagcatgaacgttcacaatcggaaagagcagggacgcgtcgatgatctctggtcgtggctctacatgctcatcgagcttcattgtgggctcccgtggcgccgactgaccgatgagaaggagattatggacgcgaagattgcatgctccatggaaactttgttgaaagggtgtcccaaggaatttgcgaatattcacaagtacctggagacactggaatacaagagccgcccggattatttcggcctgtggagcgagtgctttgccggtttcaagagagtccgtggatcgttctttggccgattcgagtgggagcttgggaagggcggtggtgaggagatgttcacggctctgtcgatcagtgagaagagagctcctaacgattataaggtggcgacgaagatgcaaatggcgaagaagatctggccgtatgcggattctgctcattttaagaagaagatcctcaatctttga

SEQ ID NO: 29568 - DNA, 2373 bp, Caenorhabditis elegans
atgacgtgtgattccgaggtggtttggaagaaattacaagatggacttgatgtagcgtatcgcagagaaaatatggcgccaaaagactatatgactctttacacgtaagatttccccccgaaattccacagaaactcaataaaatctttaattttcagaagcgtctatgactactgcacatcgataacattgtccacaagccgccgagacggcgaagacggtcgagcagaatcttcaactccagcacgaaccgctggcgcggattttgtcggtcacgagatgtaccagcgtgttgaggaatatgtaaaagcgtacgtaatcgctgtttgtgaaaagggcgccgagttgtcgggcgaggatcttctgaaatactacacaactgaatgggagaacttccgaatctcgtcgaaggtgatggatggtatttttgcctacctcaatcgtcattggatcagacgtgagctcgacgagggccatgagaacatttacatggtttatacacttgcgttggtcgtctggaagcgtaacttgttcaatgatcttaaggataaggtgattgatgcgatgctcgagctgattcgttccgagagaaccggatccatgatcaacagccgatacatttctggagttgtcgagtgtcttgtggagttgggtgttgacgattcggagaccgatgcgaagaaggacgcggagaccaagaagctggccgtttacaaggaattcttcgaagtcaagtttttggaggcgacccgcggattttatacccaagaggcggcaaatttcctgagcaacggaggaaatgtgacagattacatgattaaagtggagacaagacttaatcaagaggatgatcgctgtcaactctacctgaattcttccacaaaaactccacttgcaacttgctgtgaatctgtgctcatctctaatcagcttgacttcctccagagacacttcggtggtcttcttgtcgataaacgagacgatgacctttccagaatgttcaagctttgcgatagagtgccgaatggactcgacgagctcagaaaatccctggagaatcacatcgcaaaggagggtcaccaggcgttggaaagagttgctatggaggcggcaaccgacgcgaaactctacgtgaagacgcttctggaggttcatgaacgttatcaaagccttgtcaatcgatcattcaaaaatgagccaggattcatgcaatcactcgataaggcggcgacttcttttatcaataataatgccgtcactaaacgtgccccgccacaggctcagttgacaaagtccgcggagcttcttgccagatattgtgatcaactgctcagaaaaagctcgaagatgcccgatgaggcggagctcgaggagttgcagacgaagattgtaggtttttctcgcttttttttttctcaaaatggcgtaatttccagctaaaatttgaaatttaaccaactttttgcatattttggttgtttatttcgttgattgaggaacattttcgatcgatgagtgcacactgcgaaactgataagttggctaaatttgagattttcgctgaaaaaaaaaaacagattcctctcctttttttcatatcgtttttcataccgattttttcatatcgattcatatcgaggcttctcaaaatttcgaaaaatacggcaattttcccaacttttcaattatttacctttttctgacgtttaaatgtggctataaatcgacctaaatcaacgaaaaacgccagtaatcaattaaaaatcaatttccgacatacgggaaaatttgaggttttatctaaaattgccatattaaaggattaaaagatttaaaatatttcaaacctccatagaaatgaaaacccaatttctaaaaagttagctcaaaattctaaaatttctattccagatggttgtgttcaagtacattgacgataaggatgtattctccaaattctacacgaaaatgttcagcaaacgacttatcagtgaactctcagcaagtgatgaagccgaggctaactttatcacgaagctcaagagtatgtgcgggtacgagtataccgcccgtctctcgaaaatggtcaacgatactcaagtcagcaaggatttaaccgcggatttcaaggaaaagaaagcggatatgctcggccagaaatccgttgaattcaatgttctcgtgctcagttcgggctcatggccgactttcccaacgacaccaataactcttccacagcagctgtcgaagactattgagatctttggacaattctacaatgagaagttcaatggacgtcggctcacgtgggtttactcgcagagtcgtggagagatcacttctacagcttttcccaagaaatatgtgtttact

SEQ ID NO: 29569 - DNA, 951 bp, Caenorhabditis elegans
ccgtgagtcattcaacgatttggcactttggataaaagaatgtgaaaagcatggtctcgttggggatagtgaagttccgaggatcctgatcggcaacaagtgtgacgtggaatgcacaaatcgagtgtccactgatgaagctcaggtgcttataaaaatttggaagaaaattatttttcgaaatttcgctaaaaaaaccaatattttcattaatttttctgggaattttttaacaaaaagggaaaaattgagattgagaaaaaattaattaaaaaacattatttctacaaaaattacaatttttattgaaaaatttggaaaaaatttgaaaatattgattggacttttttatattaaaaaaatcactcaataaaatttttttaaacttcttccccttttttctactgaaaaattcaatttttaaaatttttaaaattgaagaaaataggctaaattaaaaatatactagaaaaaaataaaataattttttttcttgaaatataaatttgaaaatttcgaaaaactggaaaaaaatttatattaaaattcaattcttggaaattcaaaaaatcaattcaaaaaatcgacaaaactgagaaaacttgaaaaacaggaaaacaaaaataatattaaaatcgaaaaaaaaccatcggaaaaaatcttccaaaatctcccaaaattttcgattttccccactttttcaaataaaaaaatcgcaattttcagatgttcgccgaccgtaacaacatggcattattcgaaacatcagccaaattagcatcagaagcagatcatgtcgaatcaattttcctcacactgttacacaaactacaacaaagtaaaccaatgcacgtacaatcacaagatgaacgacatcaaaaagagcaagaacggttgattttgaaggcaaatgagacggaaaatgtggaagaagagggattctgctgctga

SEQ ID NO: 29570 - DNA, 1830 bp, Caenorhabditis elegans
atggctcgtccattcacacttatcgtactcctctccgcacatctgtgtctacatgtggttgtgacacaggatgagtaagttttaatttttgttgagtgaaagtttaatgtgctgcgaaaactaaaatatcgatgttctgagaagttcctgtagagcgaggcctgcctgcctaccggccgcctatatagttctatttggtctgagcaagtaatggtagccacgcgggtaggtataattcagacgattctgtgcctacataaaagtctaaatcttttaatccgcaaactttaagaaggtagttattttgctgctaattgttaagcctaagtctaggtctaagcctaaaactaagccgaagcctatgcctaagattaagcctaagccaaagtctaagcttaggtctagtcctaggtctaagcctaagcctaagcttaagcctaactctaagtctaactctaagtctaacataagcttaagcttaagtctaagccaaatccaaagcctaaacctaagccgaagcttaagcctaagcctaagcctaagcctaagcataagcctaaaattgagccccgctaaatattcgctcggggatttgggtctccgatgctcaaaattccaagttaagctccgcccaattcttggcgttttctaagcttttggtaccgaatttaactttcatgcctgtaggctccaagcaaaaaaaaaacttataaaaaataaatagagtttcaaaactttcccccaatttcgaattccgacgtcgtctaaaaattgagtttgccctttttcccggtggccgcttttagcactagcatggaaaaaaagaacatgtatttttctatctctcaatccattacccaatgatcgtcatcaaatccaatttccatccggcatctgccaactgacgacgacgacgacgcaaaaattgccaatttctcaatttcatgttccattttgtaacaccttccactttggtggttgcaattgaatttgtgcagaaaaaaaaatgaagaatgagaaaaacactgatccagttgattgctcaagcttgcaaaaatgatgttcttcttttcttgcagggactcacatatcaacactcaactcctctcatcagttctcgatagactcacgaatcgcactacttatgataaaagattacggcccaggtaggaccaacatattgttacctgacagatataccataataagtatacagtgtttttggtgatttatcacatttaaaaatgaaaaataactgcaaaaaagaagaaatgctttatacatttttggtaatataaaactagcaaccctactctgataaaatataacggaaaattaaatgtatattattttattactagcacttactaatcaataaaaatgctctgtttttgagctatagaagttcaatagaaatagtcataaatggacccgcgagatgtaactgcatttttttggaacaaaacagttataatcaaaaaatattaaaaaacactatcataaggtattatactgatattttaaatattaaacataaacaattttgatgatttatttaattggcgacaaaaacaggcaaaaacagacaaaaacaggcaaaacaggcaaaaaacaggcaaaaacttatgtcaaaatttatcatttattatgaaagagcacctgaatttgtcttagatagtacaaatagtacatatctagttcaaaagtagatagtacaaaaacacggacaaaaatacttataacaaacattgcaggtatggtgaaaagccagtcgacgttggaattacgatacacgtttcttcaatctctgcagtttcagaagttgatatg

SEQ ID NO: 29571 - DNA, 1956 bp, Caenorhabditis elegans
atgactacattcgacaaaggagcaaaaccagatatcggcacttttgttgcattcgaccatgttagatttgtagtcggaaatgctaaacaagctgcctactggtattgtgcaaactttggctttgagccatttgcctataaggggctcgagacaggatctagaattactgctcaacacgctattcgacaagacaaaatcgtgttcattttcgagtcagcattgttgcctgataattcagaactcggaaatcaccttgttcaacatggagatggagttaaggatgtgtgctttgaggttgaggatcttgattcgattattgcacacgcaaaagctgcaggagcaactattgtgcatgatattactgaagagtcagatgctgatggatccattcgatatgctacgcttagaacggtaagagacttaaaaataaaaatatcttcaaaaattccgaagttgttaaattgcactgaagattgaccaggaaaatttggtggaattaaaaaatttttgagaaaaaattttgacgagaaatgcaaatttctaataatccaaacaatgaaatattatttttagtatggagaaaccgaccacaccttgctggaacgtaaaaattatcgtggagcattcctgcccggcttcaaggctcatccaatgccagccacattcttcaagactcttccacgcgttggattgaacttcctcgatcattgtgtcggtaatcagccagacttgcaaatggactcagctgttcagtggtacgagaaggtgctgaaattccatcgattctggtctgttgatgattccatgattcataccgagtactcggctcttcgttccattgttgtaacgaatttcgaggagactattaaggttagttaatataaagagatcgatggagtgcggctgtcctgtgagatgtcggctgctagtttttattgtaaagaaacagcagccgacaaatcgcgggttttaaaaagacgcacgaccttttttaattcaaaaaattatagcaagatttcttgtggaaaatacatattagtaattttcaacaaaaaaaaatcaagatatcgatttggtaaatacggtgtcctatgagatgtcggttgctagttagtctttataatcaatagaaaaataacagcagccgacatatcgcgggttttaatttttttttcttgtggaacaattgtgtactctacgtgggaaatgaataattgtaattttcgtgtagtcctccagggcattttgaatatggaatactgagtatctaaacattttcaacatctatttcagaaaccattttttaatttgaatacgacgaatgttttaaatattcgatttttgggaaaataattgaattttcaaataattgtgtttttttttctggctctccagaaaattgacaaaataatttaaattattttctgaaaaacactgaataacatagaaaatgcttaaacttttaatacaaaaattttgcagatgccaatcaacgagccagccacatcggacaaaaaggcaatctcccaaatccaggaatacgtggattattacggaggatccggtgttcaacacatcgcactcaacacatccgacatcattactgcaattgaagctcttcgagcccgtggctgtgaattcctttccattccatcaagctactacgataacctcaaggaacgtctcgcggcttcttcaatggtagttaaggaggatatggatcgtcttcagaagttgcacattttggtggatttcgatgagaatgggtatttgctccaaatcttcagtaagccatgccaggaccgtccgacactattcttggagattattcagcgacagaatcatgaaggattcggagccggtaactttaaggctcttttcgagtctattgaattggaacagacaaagagaggcaacttgttctatgataatgttaaggatggaaatactaagtaa

SEQ ID NO: 29572 - DNA, 427 bp, Caenorhabditis elegans
atggaggattacaagtatctattcaaagtggtacttgtgggaaatgcgggcgttgggaaaacatgtctagtcagaaagttcacacaggtttggatttttaaaaaaataaaaattgatgaaaaatgaggttagaaagtaaaaaaatgcgaaaaaaaaccaattctgcattaaaatttgcacaaaacctcatatttaaacaatttcctcgaaaaattgcaaaaataatcaatttttcagggtatatttcctcctggtcaaagtgcaacaatcggcgtcgattttatgataaaaactgttaaagtagggaacgataaaattaaggtgggagatttcaaagtttttattgaaaaatttaaaattttcagcttcaaatttgggatacggcaggtcaggagaggtttcgatcgattacgcagagttattacag

SEQ ID NO: 29573 - DNA, 1345 bp, Caenorhabditis elegans
gacgctaccctgttgaaaatgagccagaatcagtggcaggatgtgatgaatgtcaatttgaatagtgtttttctgatgtctcagatgattgctcgtgaatctgtggccgccggatctccgctctccattgtaaacgtgtcgtcgatcgtcggaaaaatcggaaatttcggccaaactaactacgctgccactaaatctggagtgattggttttacgaaatcggcagccagggagcttgccacaaaggtaaaatcaattaaaaattgattttcagattgttctaaccacccattttttaattgtttttctcaatttgcaaaaaaaaatctggggcacaagacgacatgtttgacgagcaaaatatctcgtagcggaaactacagcaactcttctaatgactactgtagcgctgatgtcgatttacgggctcagcgatgttccatgatcctaaattattttaattattcatttcaaatatcgagctcgtaaatcgacacaagcgctacagtagtcatttgaagaatttctgtagttttcgctacgagatattttgcgcgtcaaatatgttgcgcaatacgcattctcagagtattgttttcccgtaataagactgtcattgtcgattttcgcagcgcgtgtacttgttgaggtcccttttgtagatggttcttaagcttttggctatagggtccaaaaaatcggacggttctacaaacatgaatttgaaaaaaaaacacgactcgtcaccgaggcttgccgaggtagttgcaagcattcccatgatgaaggtattgagctgaaaatatcattgcgagtaatataaaagatgtcttaatccttaccaacagggggttgacgaagttcattgcggatgatacagtatgaactttatgaaggacattaacgttttaaatagaagaattttaattgaattatcatactggacataacattttgatgttcaattcactattcctcatgggaaactttttgaaaaataaactgggaaacaaaacaatgatcggtttctggtgtttaaatcggttcggcaccaacgaagatccaatcggacagttgcccagtaaaatattataaaattctaaataatctaaaattcaacattttccagaacatccgcgtgaatgctgtgctccccggcttcatcagaacaccaatgacagaggctatgcctccgaaggtccttgatgcaatggtctcgatggttccacaacggagactcggtgagactgaggagatcgcgaacgccgtgttgttcctggcatcggatatgtcttcatatgtcactggaaccacgttggaagttactggaggacttggaatgtag

SEQ ID NO: 29574 - DNA, 2284 bp, Caenorhabditis elegans
atgaatactcgcaaatctgaaacgtcaaagactgtatccgccactccagtcaagcggagatcgacaagaatcactaatctcccgaaatcagctcctaaaatcgtaaagcgaagctccgttcgcctcagaggagctccacaatgcacatataaatcggattcttcttcgtcctcatcatcttcagattctgatggagaagatgagtacgccgcgacaaaagacgagctgaaagccgtagatcacgataatcaaatggaaatcgatttttccgatgaaatcggcgagaatttctcagaagaagatagctgcagtgataaagaaaatagaagagttacaagaagcaggactccgacaaggcttgaagagactccatcgaagaggcttgctcgggaattaagtaaagcttcagtgtcgaaagtttccacttcaaaaactctattcaaagagagtaaatcacctcgaaaagttgagatttcaaggaaaacaaataaagctcgagtatttcaagaagaagatgatgacgatgaagatgatttcagcgatgaaattgacgagaaattctattcgaaaactaacaaaagaacaccaatcacaataaagatcccttcaaaaatgataacccagaaagtaactccactagtgatcagcaaaacgccaggtggaacactgagaacccgtagaagggcacgccagaacagtgaagaactcgaagatcttgtggatccactggattcccgatcggcttcaactctgaaagagctggcgagcaggcttcatctctcaaaggtgcccgagaagctcccatgccgagatattgagtctcgagaaattgagaaattcattcgagaagttattgatccaaaacgtggcgagagctctgcaatgtatattagtggagttccaggcacagggaagacagccactgttcgagcggtaaaacttaatttttaaattatttttccaaatttctggttttcaaattctatttttcaggtcgtcaactcgatgaaaaagagcaaaaagtgtcagaaattcgtgtacgtcgaggtcaatgcgatgatcttcaaaaaaactgtattcgtagagatttacaacgggtaaggacgtctcggaaaagttgaaaatcgaacaatttccatctaacaactgcagaactcattggaaaatgctcaaaattttgcgcggaatcctccgaaattcgaatttttcgaaaattgttggctaatttctgagttttttcataagttaacggggaattttttgttttaaagcttggaaatggatcaatttgagcatttttagacagttttcagcttaatcgcaagtttttaaagaaaatattatgctgaaaactgtcaaaaaactgcttaaaaagacgtattttccttgctttaaaaaaatttcgacttaaaattataaaaaaacgcaaaaaagtaactttaaaatgtcgataaaaaaacgaatttcagtgggttctgctagtttttactttatgaaaatgatctaaagtagtgaatttcgtgaaaccttgaacattttcccgataggatgttagaaaaacctcaaaaatctgaaaattttggggtttttctcttcaaaaccctaaaaaatcggtttttttgtaaaataatcgtttttgtacgcaaaaatactgaaattttcaatatttttcagcatccaagaagagtacaacatctcgaaaaagcctcaaagagcaaaaatcacagctaccgctgctcgccaagagctcaactcaattttcaagcgagaagatccgaaaagaccgccaattgttgtgctaatcgatgaactggatagtctgtgcaatagaaaacaagatgttctctatgatatctttgaatggacagcacttccacaatctaaagtcactattatcggtattgccaacactttggacttcccggaacgaatgctttgccaacggaatgctagtcgacttgacaaacgtcgcctcgtattccagccttatcaacacgagcaaatcgaggaaattgtgcgtgcgaggctccaaggatccaatttaattgatccgaaagctgttgaacttgtcgccaagaaggtcgctatgaacactggagacttacggcaggctctcgattttctgtgtcgagcgattcgtgttgcagtagagagaaaatcggaaaagctcgagttgtcgcatgtgattgctgctcagaatgcggtgctggaacctcttaaatatcgtcttgtaaagggattaaggcttcatcaattcacattgttccggacaattgaatctatg

SEQ ID NO: 29575 - DNA, 1234 bp, Caenorhabditis elegans
atggcaaatacgttccacgtgcagtcctcgttgatctcgagccaggaacgatggattctgtgcggtccggtcctttcggacaactcttcagaccagacaactttgttttcggacaatctggagctggaaacaattgggccaagggacattacaccgagggagcagaacttgttgacaacgtgctcgatgtgatccgcaaagaggctgaaggatgcgattgtcttcaaggattccagctcacacactctcttggaggtggaaccggatccggaatgggaacccttctcatctccaagattcgcgaggaattcccagatcgaattatgtcttccttctcggttgttccatcaccaaaggtttcggataccgtcgtcgagccgtacaatgccaccctctctgtccaccagcttgttgagaacaccgacgagacttactgtatcgataacgaggctctctacgatatctgctacagaactctaaagctcaccaacccaacatacggagacctgaaccatctcgtgtctctcacaatgtctggagtgactacctgcctccgcttccctggacagctgaacgctgatcttcgcaagttggctgtcaacatggttccattcccacgtcttcatttcttcatgcctggattcgctccactctccgccaagggagctcaggcttaccgtgcattgactgtcgccgagcttactcaacaaatgttcgacgccaagaacatgatggctgcttgcgatccaagacacggaagatacctcaccgttgctgctatgttccgtggacgcatgtccatgagagtaagttcatcgattgcttgtaacttttcactatatgctttgtttttcaggaggttgacgagcagatgctcagtgtccagaacaagaactcctcgtacttcgttgaatggattccaaacaacgtcaagactgctgtgtgcgacatcccaccacgtggactcaagatggctgccaccttcgtcggaaactccactgctatccaggagctcttcaagcgtatctcggagcaattcaccgccatgttccgcagaaaggccttccttcattggtacactggtgagggtatggacgagatggagttcaccgaggctgaaagcaacatgaacgacttgatctcggagtaccaacaataccaggaagctaccgccgaagacgagccactcgacgagttcgccggagaaggggagacatacgagtctgagcaataa

SEQ ID NO: 29576 - DNA, 329 bp, Caenorhabditis elegans
gtcgacgtcaaggaccgtaaagtgaaggccaagaccatcaccttccaccgaaagaagaacctccaatactacgacatctccgcaaagtcgaactataacttcgaaaagccattcctctggctcgccagaaagctgctcggagatccaaacctcgagtttgtcgcaatgccagctttggctcctccagaggtatttttaaatccatgttctttcataagcaatattttaatttccaggttcaaatggacccagccatgattgccgaatacgaaaaggatctggacaacgccgccaaggctgatcttccagatgacgacgatgatctttaa

SEQ ID NO: 29577 - DNA, 332 bp, Caenorhabditis elegans
gctctgataatctctgtcgtcctgtgcctaacacctcgatatgtgctcacaacagtcgttaacacagtcagcccgtcgacaactcttcgaacacgacttggagctgaagatggctttaaaaagaagaccgaatcaagtgggtgatgctcgaagagcacataattctatttttgttttgttgctcaatctaaaatatctcaatttcaggatttactgcatgcgctgtcggatgcctttcagctcctttcaaatgtgccagaatgtgctgtcaaaagacgaaacccgcagatgttcatgtgagttcaaaaattgttttcaacattttattttaa

SEQ ID NO: 29578 - DNA, 2887 bp, Caenorhabditis elegans
atgaaaagttgcagaagttgtaaggaaaatcctgaagtgcagagaaaacgagccgagaagccgtggcgacgggctccgaaggccaaatcagaagtcgaaaagcatggaatcggtccaccggacagtgattcaggggaggaaatatcatttccttggtataatgtgaccggtaagtgagtcatctcgactttttcggaaataagctgagaggcttatatttctttttgtcgcatttcatgaactttcagccagtttcagttattactcagatgtcaaactttttcgtttttttgaactcgaaaatacgatcccgacgcgacaatttttgtaatatgcaaaaaggcgtgcgcctttgaagagtactgtaacttcctaacttccaccacgattttcatcgattattcatggattgtctcccgtttccgcaatttttaaatgtgttttattttgtttaaaaaaaatagcgtcttgtgcaacatatttgacgcacaaaatatctcttaagttagcgaaaactacagtaattctaattcttttttttccattttcattcgtttcttcgcataattttctcatttttatttttattttaatattttagcgatagtaaagtaaaattttaatccatccgagcccgtaaatcgactacagtagtcatttataaagttactgtagctttcgttacaagatattttgcgcgtcaaatatgttgtgtgagacgcattatcataattctgtgttgtagtaatagttttagtaatagtttttcgtcaaaaaatgttcttgaaaagtaaatgaaaactgaaaattccgctttgcagttagagttactatttaaaggcgcatacacaattttgcattcaaccaaaatttttcgtgtcgagacctggtatcgtacgtttcccaagtgtttatgtgcaaaggttacccatcataatccttttttgctccgtctttttgcaccacacccaaaaaaagcaagaaagagctcataaccatagagcaatgtctctctgtctgtctttctttgtgagcttttcatgtgtatgtgtcctatttagaagcactgcattttctttccctcctccacgtcttccggctctctcggtccccccccccccccccccaactattcccgattgcgaaacacgagctcttcgggaaccgagcccccacttccaattcttcgtgtccctcattttattgccgcattccggcgagtcttctttagtttcagtcgtttgaacatttgttctcgagaaattcgataatttttattagggaaaagtaggtttcaaatcgaaaactcggcttaaatcgttgaatttgaaggaaaaatttaataaatagtgtctaaaattatagaaaattatgcaaagctttgacaaagctttgcaaaggcgagaaatcaaaaattgaatttttctagacttgtctaattgcctctgatatgttttgacctacaattgacctacgatctcaggcgggcgcgcacgaattcatatttttgtttcgcgaagtttctctcattttgtttttccttcgctatcattttaggtggttttcgggttgactcagccggtttttggccagttttttttgttttaagttaatttttcttattttgtcacaatttctttttgattaatggcaaataattattataatctgaacattttgctttgaaactcgaaaaaatctagaaaaagaataattgtatcgtagtcgttttctgatttttacatggaattcaagtcaatattcatgttttttaatgaaaaaacatgaattttctccaagaaacgattattcatttaaaggaacatacgtgcctgctgagctcgtgtctcgtagcgaaatttgtatcgtagtcgtttccgcattttttagtttttagaccttttcaagaaattttctctgtttttcgcttcagaaaagatccattttcgcgaacatttctaccattttttttacaaaattatcctgttacatcgattttgatcgatatcatcaaaatacactagttttctcctccaaaaccgtctgttttacatttctggagcccacgtttctgaccgtttcgctccgtaatccgttggaagaagcactcctttgtgtgtccagacccacccgtccatgctgtgtccatcgagcggtcgcctgtctgcgtttcttcactcccctcgcctatttcatccgttttcctccctctactcccccttcgaacgcaattttcgcgccaatttcccagcagcagcagcggcagtactcgccatttcataacatctcccccgccactgactaatgttttccgatagtttatcattttctttcatgggatatgaacaattgtttcctttattcttacgctctaattaactcgaatccaattaatttgttattattttcaggtaaaatgcttgtcgtcgggatgcatgtggaaatcaagcggagcgacggccgcatccacggtgccgtaatcgccgaagttaagtcgaacggccggtttatggtggaatggtatgagaaggtgagtcgcatccttcgagaagaccatcactcgtcacagaatcatgcatttcggatgtgatgccgaaccaaaaatcatgcatttggcattgtgtactttctttcttctcttttttctcttgcaatctttcacattttcagggcgagacaaaaggaaaggaatcctcgttggaagaacttctcacgctgaacccatcactccaagcaccgaagcctacgccgccgccacagcctcctcaaaaaacgcttcaagcgtcaactgctgtcaacagacaaaacgggatccatgcgcagagcatgatactcgatgacgaggatacattcctcttggatcatatcaacatgattccggctaaag

SEQ ID NO: 29579 - DNA, 931 bp, Caenorhabditis elegans
atcacccctctcaactgggtcgaatggatcgccgtgttgaagatctcactgccagtgctccttctcgatgaaattctcaagttcatcgccagaaactacatcgacggtaagccggagacggtcggcgcgaaggcacgtagtgccatctcgctgctcgcctgggtgtctgtgacgctcgcctactttgcgtggatgttgggcccgtacgccgagctcattaaccatgcgctcgtcggtccatctgtcgatccgtcgaaattcgacgcggttgtcacgcccgacaagttacataacgaattgtgattgaagttcttctaacccccaaaccaaccgcctctcaaacaacttgtgatgatttctctttattttctctctctttcttgttctaatcattttgggcctttttccctttttctctctgcagtgtgttaactgatccataatccttcgtgtaaacccccctctccctacttttaggatttcttcctcgttgctcattgtattttgtccaaatcgccacaatttccctacaaatatatatgttttttttgctaattttttgtgtttcccttccttcttgtccactgaaagttctacgtctctcgctctccacatccccattgttctccccttttttcataataatttattattatcctttttttaaattaatttttgttgcgtgtgaatctattaggagctcacaaataaaagtgatcctttaaaaaaccttacttccttctgttttttctctaacctaaccaatgtgtctgttcagggagtgcctcttttctttaccgaatggtgtgcaattttgtcgactgtcgatctcgtccatggcaatgcaggatttgaaactaaatttccctggaaaaagaaataattttggtgattttcagttgaagctccaatcaaggataaacgcgactaa

SEQ ID NO: 29580 - DNA, 703 bp, Caenorhabditis elegans
cctacgtcggagttgccaccgtcggagcctcaatgtggtggttcttgttgtacgaggagggaccacagatcacctactaccagctcactcactggatgagatgtgaaatcgagccagacaactttgccgatcttgactgcgccgtattcgaggacaatcacccgaacgccatggctctgtccgtgcttgtcaccattgagatgctcaacgccatcaactcactttccgagaatcaatcgcttttagtgatgccaccatggaagaacatctggctgatggccgccatttccctttcgatgtctcttcactttgtcattctctacgttgacatcatggccaccatcttccaggtatcacaattaatcatatattaatcgaaacatctaattcaaatcttcagatcacccctctcaactgggtcgaatggatcgccgtgttgaagatctcactgccagtgctccttctcgatgaaattctcaagttcatcgccagaaactacatcgacggtaagccggagacggtcggcgcgaaggcacgtagtgccatctcgctgctcgcctgggtgtctgtgacgctcgcctactttgcgtggatgttgggcccgtacgccgagctcattaaccatgcgctcgtcggtccatctgtcgatccgtcgaaattcgacgcggttgtcacgcccgacaagttacataacgaattgtga

SEQ ID NO: 29581 - DNA, 163 bp, Caenorhabditis elegans
atggctgacactacgattctcgacacaacgtgctcttccacgttagctgccaacgtggaattctcacacgccaccgattcggctatcggaatttcgctgaaaaatgcgacgattacagaagccgaaggggtgccaaatttgaaagagactggatacgattgtg

SEQ ID NO: 29582 - DNA, 1748 bp, Caenorhabditis elegans
tacgatatatgggtacggtggtagagggagaaattgagctatttggagctctaatttaactttgtaaaaatcagaaagatgtaaaaaaaactatctttaaacaaaaattttctaaaattttggaaagagtatttgagaaaaaaaacatctaatcttttttcccttctcaaaaaaattcaaataacttttctttttctaatttcccagaaatttaaactgagccaagtcgtctgaaagtgaaatttcgaattttccatcaaatctgtgaaaatcgaaaatttttgagtccaaaattgaacaaattgaggtaaaaacaacgattttcttcagctgaacaaaaagctcctaaaaatctggaatttttgtgaaattttttttgaagctacagtaattagacagttatttccagcttttttcggaaatttttttttttaatttggaaattcgcctgaaatattagctttcaggaacttgcaacggaggtcaaatatatcttggcagagaacgaaaaaagctgaaagattatgtggcaatcaagaaatttgccatcgatgatgtggatgattatgcagcgattgcggtgagggataaggattctcgaaaaatttttttaaaaatcgaaaatttttgattttttgaaaaatgccacttttccaataattgcattttttcctattaaaatttacgtatttttgataatttttttgggatatttgtttcaaatttaaaaaagaataaaaacaaattttcaaaaaccaacaatttctaaacttctgaaaatataaattaccaaaaaacaatccaaaaaaggaaatttccaaaaataaataagtttccaaacaaaggaaatttccagaaaaaggatatttcaaaaaaattccataaaaaatatatattttcaacaaaaaaattccaaaaaaaaatccgaaaaaatgaaaaatttccaaaaaaagggaatttccagttccaaaaaaataaattctccataaaaaaaggaaatttccaaaaaataaattctacaaaaaataaatatttctaaaaaaaaaatccaaaaaacaattaattttcaaaaaaaaaatccaaaaagggaatttccaattccaaaaaattaattctccatgaaatttccaaaacaaaatttcatttccaaaaaaaaagaaaatttccaaaaaaagggaatttccagttccaaaaaaataaattctccataaaaaaaggaaatttccaaaaaataaattctacaaaaaataaatatttctaaaaaaaaaatccaaaaaacaattaattttcaaaaaaaaatccaaaaagggaatttccaattccaaaaaattaattctccatgaaatttccaaaacaaaatttcatttccaaaaaaaaagaaaatttccaaaaaacgtccagtgtgttcgcctaaccctagagactcttgtacgaactcaaaaaattgtgcaaaaaaaaaattataatctagttcaattcaaaaaaatccaccaatttttcactaaaacattccagaaagaatcatcaaatctccgtctaatgcaccatccgaatatcattgaactatgtgaatgctttgtctacgaacgatcaatatatcaaataacacctgcaatgaacctcggatcattatttgatattgtatttgaatatatgaaatggggtatcaatgagaaatcggctgctgcaattacacgacaactactcgatgcactttcatatttacatcagagacgttatattcatag

SEQ ID NO: 29583 - DNA, 1516 bp, Caenorhabditis elegans
atgggatcgcccgtctcaacaggcacaacgcccagcgtaatcatttccatattccgacggccaatcgattgttctatcagctgcagactccatgcacgtcagtgcgttttttccggtttagcggccgacggttcacgggcccccggctgggataaattgttgtagcatcagacatatcgcgggtggttcctaacatgattgttgaaaataattttccagaagcacggaggaggagcgacgcacagtgcagacagatgacgtggcagagattggaatgcaacggcccgattatcagatgtactgcggcgaggaggagattagcgagcaatttgtgaagttaaatgttggaggacagaggtttatgcttagaaaggatacgatcaggagaaggggtgttggtgagttatttggatttaggatgaaaataacgataaatgtaatataaaaataggtttttttttaacatttaaaggtgctgtagtgccagtgggaaattaatttatagcatgcctatggcaccacaaaggccaattatcatagtaaaaaattcaaaaaaattttctaaattttataagattttttgaaaattgaaaaaatctcagttctagccactttttggatgtcgtagatcaaaaaaattatttcgaattttacggattgtctatgtaggaggaggaggacaacagaacaagcgggaaaaatgtaggtcacactgtgccggcatagagcaaactatagataagacatcttgcgtccacaggaccacacaacatttatgcttcaaatataaacactgtagggatttgaacatgtgacagtgctagtttttttttcaaaaagtggcaaaaactcagtaattgccacttttaaatgccactcagtcaataaaaattcatcaaaatcaaaaacttttgaaaagctttactttgttttatacaaaaattttaacttttttcttttcttaaatgatttttcaaattgtgtcaaaaaaaggccgaaaaaacagccaaaatttgaattcccgcaaaaatgagtgacgtcacttgtggcattttttgagttttccggctatattaataggtttattttgtttttttttttttcaaataacaactgtgtcggttctataatacaattaaaaattttttatgaacgaaaaattgttgttttccgatattttggtaacaattcaaattttaatttaatccagtaatttcaaatgaaaatcaacattttttggatataatttttgaatttttcgtttgaaaaaaaaaaatcaacggcctatgtatatctctgcagagaagcaagcttttgaaaagtaatcaagtaacaaaatattgcaaatcatcaatttttcaatttcataaattattttttgcaggccgcctcctagaccttatcaacaagccggttgccgactctaacgcggatgcgtttttcagttcaacgtccgaattctactttgaacggcctccatcactttttcacattgtttatcaattttacctcaatg

SEQ ID NO: 29584 - DNA, 283 bp, Caenorhabditis elegans
atgcaaaaaactattcgatcccaagctctgatctaccgaaaattcggagatcctctcaaagttctgcagttggaaactgtcgaagttcccgccgagccgggcagtggagagtgtctggtagagtggttggcttctcctattaacccattggatattaatcggtaattgatatatttttgtgaatataaggatttgaaaatattgaaggatccaaggaaactacgcggtcagagccgagctaccggtgatcggaggcagtgaaggtgtcggcagggttgtcaag

SEQ ID NO: 29585 - DNA, 1466 bp, Caenorhabditis elegans
gtcggctcatcgggatccggaaaaagcacactaattcgactactattccgactttttgaatctacggaaggaagtattgaattcgatggaattgatgttcgaaactatacaatgcactcactgcggcaacaaattggaattgtaccacaagatactgtactcttcaacgacacaattatgtataatatcagattcggacgaccggatgcttcagatgaagaggttattgaggcggcgaaggcagcaatgattcatgaaaagattacctcactgcctgaaggatacgcgacaatggttggagaacgtgggctgaagcttagtggaggggagaagcaacgtgtcgcaattgccagaactattctcaagaagccgcagttcattttcttggatgaagccacgtcggcgttggatacaccgacagaacgggcgattcaaaagtgtttggagaagctttgcaaatcacgtaccggagttgtggtggctcatcgattgagcacggttgtcaatgctgaccttattcttgttcttgataagggcatcattttggagaggggaaagtgagtttattgcccgtagatctggttctactgattttgggattccccagtgtctttggagaaccattttcttccgtggttttgtttctatcggttttatgatcccaggaacctgtttctaacagatttagtattccccctaacttgcgagatctttttccaccgttcttgtagttcactccaaatcgtgagatctcatttccgtcgggaatctgtttctaccgatttcagggtgcgcacttatgtactttttagatcctattttctccgggaatctgtttctaccaattttaacactcccagtgacttacgaaatcccctttttccttgtgaatttgtttctaccggtttaatcgtttttgtgaggcctccaaatcaatatcaatcaataatagacaccatccgtttccaccagcttcaagattcccttaaattgcgaagcgaaattctccggaattttagttctacagaattttaaattccgagaggcctcacacggaaaatttagtaaaaaccctaaacttttcgggaatccgtttccaccggattttggattccctatatttgcaggctccgcccacaattccacaaagttttttccggtggacacagattctcgaaaactgaaaacaatggctccgcccaaaaaaatggaccggtttatgacacctcacgatttgagggaatatagggaatttaagtttgttagaaacaaattcatagagacctcaccatttccgggaaatgtgatatcggtggatccagattcgcggaaaaataccctaatttttgtcatttttcagtcacaaggagcttcttgcacaacaaggcacgtatgcctcaatgtgggaagcacaaatcgccgagcaacgtgccaaatcgattgaactcggcgaggagcttccgtag

SEQ ID NO: 29586 - DNA, 1431 bp, Caenorhabditis elegans
gtagtctcctccatcacggcatctctacgctttgacggtgctctcaacgtggatttaaacgaatttcaaaccaatctggtcccctacccgagaatccacttcccccttgtcgcctacaatccactgatctcttcagcccaccacgagttcctatcagttgatgagataacgaaaagctgctttgaagcctcaaatcaaatggtaaaatgtgacccgaagcacgggaagtatatggctgtatgtttactgtatcgtggagacgttgtgccgaaggatgtgtcggctgcgataaaatcgatcaaaactcagagatccgtgcagtttgtggactggtgtccgactgggtttaaagttggattgaactatcagccgcctacagtaatcccgggtggggatatggcaaaggttccacgggcggtatgtatgttgtcgaatactacggcaattgcggaggcgtggcagagattggactataagtttgatttgatgtatgccaagagagcttttgtgcattggtgagttcaaacgttcatagttcagctaagaatagaattagcaaaatgttgtcaactagcaaaatatagaaaatttaattttaaatattttgttagttgacaattttttgatagcgttcttcaccgctgagttaaccaagtttgaagttagacaaaactgcggaagtgttgcctcaacttcaaactatcataacacagctgagaatagaattagcaaaatgttgtcaactagcaaattatagaaaatttaattttaaatattttcttaattgaaatttttttgataactttcttcaccgcggagttaaccaagtttgaagttagacaaaactgcggaagtgttgccgtaacttcaaacgtttataactcagctgagaataaagttatcaaaaagttgttaactagcaaaatagagaaaatttaattttaaacattttgttagttgaccattttttgataacgtttttcactgtcgagttaagcaagtttgaagttagagaaagcatgagggagctgtgggagtgatgcctcaacttcaaaccgcaattaacagctcagaatagagttagcaaaaagttgtcaactagcaaaatgaagaaaattaaattctaaatatttctcaagtttgcaactttttgatagctctgctcatcgtggagttacatagggttttacaagaccaaagctgagatacgcgcttctatttaatgtcggctgcccagcagcccagtgcatgacccgtaaaatgtcgaaacacctctttgtcaaaacacctctttgttccaggtacgttggcgagggaatggaggaaggcgagttctccgaggcacgtgaagatctggctgctttggagaaggattatgaggaggttggcgcggattccgatgctaatgataatggggatgatgagtattga

SEQ ID NO: 29587 - DNA, 1335 bp, Caenorhabditis elegans
attcctcatcacaatgaccaacccagttgaccgtcacaatactgaatcaatggtaattctcggcttaaacttgctcattgttgctctggaagccatcgccgacttccttccaaactacgatattctcatgccacttatcaaaaatgagctctgtcgaaatttgctccaactgctcgacacgaatcgcctaccagtgctcgccgccacaaatcgctgctgttttttgctgtttgaatcgatgagaatgcacatgaaattccagttggaaagctatttgaagaagcttcaatcgattgtgctcaccgaggaaaagcagcatgaaaacggtggtggtggaacggagcaaaaagaaatggctttggagtcacttgttcagttgtggagaattcccggattggttaccgagatgtatctcaattttgattgtgatctctattgcgggtaaaattttggcttcgaaatgctaaaattttggttaaaatcgagtaaaattggatttttgtacggaaaattcacttaaaaatgtgaaaattactctgaaattggcgaattttggcttaaaaatgctgaaattttagtccaaatcgagtaaaattggccctaaatatgtcagaaattaccgagatttatctcaattttaattgttaaaacaggaattttggcttaaaaatgctgaaatttcaatttaaatcgagtaaaatttgaaaaatttgatttttgtgctgaaaattcacttaaaaatgtgaaaattactctgaaattagcgaattttggctcgaaaatgctgaaattttagtttaaatccagtaaaattggccatattttagcttaaaaatgttgaaaatttgcttaaaaatcggtgatattagcccggaattagtttttgctcaaaattttctcaaaaaacatgaaaattcgacatagaaattggcctgactagcgtgaagccgattttctcgaaaattggctcaaaaattacacgaaatttcacccaaaaatcaccttttttacacagaaatgtttttaaaaaatctgtaaaatccgttttagggctgaattttcgcaaaaaaaattgatttatgagcctattttcgtaaaatttttgctcgaaaatgcccaaaaatttgcttaaaatgtaaaatttccgttgaaatcttcgaaattttttgaaaatcacacaaaatttcggcataaaaactttattttctgaaattttcttgattttttacacattttctgcatgaaatttcagtcaaaagttgtgaaaaattaatttttcccaccaaaaaccatgaaaatttgcagaaatatcttcgaagatttgacaaagcttct

SEQ ID NO: 29588 - DNA, 233 bp, Caenorhabditis elegans
atgagttcaaattcttcgaattcttcaaatcctgctgcaacagatgctccaaaggtaagtggaaattcagatgattctttaaaatgcctctaccttttcagaaaacttccgttgaaccgggttcggaagccaacaattggcatatcacggaggccgatgagaagggattcaagttgaccgatatgatcaagaaacttctgaagcctgtattctcgaaagccattatgtttgat

SEQ ID NO: 29589 - DNA, 432 bp, Caenorhabditis elegans
cctctcgcttgtgacttgctgtgggcagaccctgaaaaggatgccaaaggctttgagcccaacaagatccgtgcaatctcgaacgtctttggaaagaaggaggttgatgatttgtgcaagagattggatatcgatttgattgtcagagctcatcaggttggtctttttactagttctatttgtgctctattaactataaatattctccaggtggtcgagtacgggtatgcattcttcgctgatcgtcgcctcatcactgtcttctcggcatctcgttatcaaattgagctctgcaattatgcagctgttgtggtggtcaacaagatgctcgaacttagctttgttcagctcaaacccgaagatttcgaagttcgacgtgatgagtgcgaggagaatgccaaggatcagacgacttcaaatgttcctcattga

SEQ ID NO: 29590 - DNA, 952 bp, Caenorhabditis elegans
atggctccacctgcttctactgcttcatcagctgacccttctaagccaacggctcaaaaattgaccgaagaatccgatgagaaaactcttcgcaaatatttcagcacaaaagtcgatgatgcgcaggtttgttgtattttttaaaaagtttagcccaagggtttatcaagtatttcagcaaaaagtggccgacaaatcacaaaatgtgcgtcgtctgcaagctcagcgtaatgagctcaacacaaaagttcgtatgctgaaagaagagcttcagcagctccacgagcaaggaagttacgtcggtgaagtgagcaaagccatggataagaagaaagttcttgtgaaagttcatccagaaggaaaatatgtcgtcgacgtggataaatccattgatatcaactcactgaacacaggagcacgtgttgcactccgagccgacagctatgctcttcataagcttcttccgaataaggtggacccgctggtttcgcttatgatggtcgaaaaggttcctgattcaacatacgagatggttggaggtctcgacaagcagatcaaggagatcaaggaggttatcgagctgccagtcaagcatcccgagctcttcgatgctcttggtattgctcagccaaaaggagtcttgctctttggaccaccaggaactggaaaaacactgttggctcgtgcagttgctcatcacaccgagtgcacgtttattcgagtttccggctccgagttggtgcagaagtttattggagaaggagcacgaatggttcgtgagctcttcgtgatggctcgtgagcatgctccatcgatcattttcatggatgaaatcgattcgatcggatctagcagagttgaaggatccagtggtggagattcggaagttcagagaacaatgctcgagcttctcaatcaactggatggatttgaggcgacgaagaatattaag

SEQ ID NO: 29591 - DNA, 1741 bp, Caenorhabditis elegans
atctgtggcgacatccatgggcaattccacgatttaatggaacttttccgagtcggtggctctccaccaaacaccaattacctattcctcggagattacgtggatcgaggatacaattccgtcgagaccttcattcttctgatgcttctcaaatgtcgttatcccgaccgaatcactcttatccgcggaaatcatgaaagccggcagatcacccaggtctacggtttctacgatgagtgtgtgagaaaatatggaagtggtcaggtctggaagcactgcaccgagattttcgactacctatcgcttgcggcggttatcgatggaaagctgttctgtgtgcacggaggattgtcaccttccatcgcaactctcgaccagatccgagttctcgatcggaagattgaggttccacacgagggcccgatgtgtgatctgctgtggtctgatcctgaagaggggtgctccggatgggggataagcccacgtggagccggttatctgttcggaggagatgctgccgagctgttctgcgagaataatgatttccttcgaatctgtcgagctcatcagctcgttatggaaggatataaacttcattttcgcaagcgggtcgtcacagtttggtcggcgcccaattactgctatcggtagaatttttgtgaatttttgctccaaaaaatgcattaaaattgaattttactgtcgaaacagatagataagagcctgcagatttgtactacacgtggacaactgagaacccgattttttactgttttttgactatttttgtgaaaaaaaagcgttcagaatggtctgaatccgacaaaaaaggattttttcgaaaccgaaaacgcaaaaaaaaatgttttttatcaaaattgtacttttgtcatgatttcgagtaaaattttaaggaaaaaaagtgaaacaggttaattttctaacaaattttgtgttttcggtttttcgattttacagaaaagcggcaaaaaatgtttttttttcaaattttcgattttccttgaaaaacatcgaaaaatgacaccaaaaaaacggtcagaaaattttctttttttttaaattttttattttctgaccggtttttggtgtcatttttcgatgtttttcaaggaaattcgaaaaattgaaaaaaaaagttttttgccgattttctgtaaaatcgaaacaccgaaaacacaaaatttgttagaaaataaccataaaattcgttttttttttaaattctaattttgttcaaattgatgagaaaaaacaaaaaaaaaagccacctaaaaagaagaaaaattttcaaaatttaatctaattttagaaaaatctttttaaaaaaagtcgaaatatcggaaaattaaaaacccaaaatttttagaatttcagaaaaaagctcgtttttcgattttattagtcggaatcaaccctgattaaccattttcaatgttaaagacgaaaataattcgcaaaaatagaccaaaacttgtccacgtgtagtacaaaatcctccgtaaatcgacaccgcgccgcaggcttgcaaacccgaaactgcgccttcctatttacaatttagaataaacatcgaattttcagatgcggaaacgtggcggcaatcatggaggtcaccgaggaaaatatcgacagcgaccccgtttttgaagttttcgaagcggcaacagtggagaatcgaggagagccgaaaaagcaaccgattgctcaatattttctatga

SEQ ID NO: 29592 - DNA, 436 bp, Caenorhabditis elegans
ctcacgccgtcgtgtccatctgtggggacatcactatgtcccttatggttgctccactgatttctgtgcctgttatggtttttggtggattcctgataactgtcgatgcggtcccagtgtactatcttccgttgacctacgtgtcatggtaccattatgcgtttgaagccattatgattgcattctttaaggatcatggagatattaaaggtcggctaagaactttttcagaaatttgaataaatggaacattgcaggctgcgataaacctgtcattacacaatttgaatgttcaaatggcctaaaattcattagtgaccaggattttaaagtggagcatttttggttggatttcatcgcagtcggtgcaattctccttttttggaagttatttgggcttttggcttttgtggtaagaattcggagaactacttga

SEQ ID NO: 29593 - DNA, 339 bp, Caenorhabditis elegans
tgtcaccgaaaacacgacaaacgtcgttgttccagtcctttggatgaacgaaactgcgtatttcgatcaaggaactcgtgatcagctgattaatattttcaacgcaaaacattattcatttattggaggtgttatcagcttgtcacttggtcttatcgcctggcttgccgtttttgttgtaatcattgtttattcggtaattatattattgttggttttctgcaaaattcaatttcctctaatttacagcgacaatccgacgaagaagagtacggacgtcttgtgctggaggatgaggacgaagagcctgcgcaagacgagaacgcagttttggcataa

SEQ ID NO: 29594 - DNA, 411 bp, Caenorhabditis elegans
tttgaaagcacctcaaaacccaagaagcgttcatcttcaccaattccaccactatgccgagctggtaacacgataagtgaagaatcggaatcgcctgactatccgagatattcaacgacttccctgaaaggagcaaggccgcatgcttccttaaatcacaagacacatcatctcaaagggagaagctcggctaggtgggtcttttattgtagtgcagttcaacttttcgtaacttgcagagctaagcgaagaatgactttggctcgaatgaatgtatccatgaaacaatcaatatcaggaattgggcgaagagcacggaaagtgattccgacgattcgtgttcgagatgttaatcttattgataaatactcacgggttgtgtttccagtatgctttattgtttttaagtaa

SEQ ID NO: 29595 - DNA, 235 bp, Caenorhabditis elegans
atggtgaccgtattcataattcccatcattgctctaatccatggacatcattctcaggctgtcatagacatgaagagacaacggtaagatttacggacaaacaaacaaacatacagatatttcaggttaagcagccgaagcacaacttacaatcagacgttgatccgctataccaccaaagttttggatacgattttgttgaatcaagacaagaattttcgacccgtgaatcctg

SEQ ID NO: 29596 - DNA, 2942 bp, Caenorhabditis elegans
gaattttcactggattgctacttccgtcaaaagtggctcgacagacgtctcgcgttcaccccaatcaatccttccaaacccgaaattccactggccagcaagatgctaaaagacatttggataccggatacatacattagaaacggacgaaaatcatatttacatacactaacggtgccaaatattctattcagagtacggtcagatggtcaggttcatgtttcacaaaggtgggttgttcgttgcttgaaaaaagtaccagctttatgcctgcccacctgcctaagcctgcctacatgcctaagtacttgcctgccttcttacgcacctgcagattgtcaacgtgcccacttaatgccaatacttatctaaagaccagtctgcctgagtaagcctacctatctgtacattctgcctacctatgtacctgcctacccatgcacctgcgaacctatgcgcctgcaaacctatgcgccagcatatcaatctgcatgcctattgacctacacctctgcctaattgtttacggctatgtaaataattacgtctacctacaatcctgcctgcctacctatttacttgcctacctactcttacgtagccgcatactgtcccttactagactaacaatcacaagaaaaaaaatcaaaagaagcaatttttatcagtgttctgccagggctcaatccgaaaagtgaatgtccttcccgacaacgatcaagtacaaaatcggctccgaattcatgttgacaatatcgtggaaacgaagattagtgtcagtcagcgagatcggcaggagatcggctcggctcatgggcttctggatgctgtagtagaagcgggacttcttcaacagatctctgcaaagtttgatggaactttggcatcaaagtaaacacgtacttgtaaggaaacaaggctctgacaatagcagaaagccgcgccgaagacgggaactccaattccaattgggctcggagaacattgtgaccttggttcttcagaatgcagacatgaattggaatcgattcgattgctccggcgtactgaaaaaaaaaatcgattttatatcgatttttgtgtgcatttttctgcataccgaaatgttcgaggtaacagattccgattgcccaacgcagaccttatccccgtttgcctttgcaagttgaatacaatactcattacaacatccgggagaaccatcgaacaatggagtgcttgatgcttttttacggcaacccgaacagatcacatgatcacatccaaatatgacggtatctgtccattcgataattcgagcacacggaccatcgcatcgagcttctgaaagtttttcaatatgtattactaggacagtggcgggctatctagcggcgcgctgtgacagcctcagcgccattcgccggcgtcgccggcagacgcaagcggcgggcaacatcgggcgagtagctggcgccaactggcaatagagaaggcaactcacttcctgaaaacttcatcattgacgaaattttcttggccgattgcacgggcgacttagcttccaacgaatcatccgacaaagagctggttacagatctactctgcgattctgtctttttcgaagaacttttgatagatccctctaacttcttgtccgtcttcttctccaaccaagtgattgtgtacgacaacactggctgatttccacggaattcggttgtcaaatcgattttcttaatttccgctgcagtcttcggatcgatgcacggcggaagatacatcttggcgttatcctggactttgctcggccaaaatggcatatccgacagattttggtagggcgagttgttgggttgggtgccggttccggttccgaagagttgctcgaatttcgtgtggcgttggcgtgttttcctataaggattagaatttttcaattttttaaattgagaaaaaaatcgggtttttggtaggtaggcgtgcctacctacaaattcgcatgtcttcctgttaccctgccttcttgcgttcgtgctcacctacttaaaagtatgcctacctgcagaatgccgtacttacttgtctgccttcttacacacctgcacattactcatatctaactgcctacctacgcgcttactcacctaaagatctgccaacctatgcgcctgcctatcaacctgcatgtttactaacctacgtgtctgcctgattaccaggcattgtctacctacctatctgtacatttgctaaatatataattacgcctacctacgcgcctgcctctgcctgtttgagcctgtttgtcaacctatgtgcctaacttcctacgtgtttgcctactgcatcgtgtctacgtgtttctcaagctaaatctgctcttgcctacctactcttactgtcttatgtgcctgcctacctccgcgcttgtgcctacctactcacgaaaactcactcaatatttggttccatgattacttctgttaaatccaaatgttgaccaattgagtgtcttctcttctttgaatgataaaatgggaatgattgaaattctcccccccccccccccccccccactgactcgttttgtcatgctggaaaaaattttaattaatttttttaatttacaagtggaatgtcacgtagtggattttttccagttgctttttttaaatgaaaaatccatatatttttttgaaataattttatggaaaattaaaattgtatttccagactaacaatccgctcccgttgccaaatgtttctgaaaaaattcccgatggatacacaagcatgcccaattgaagttggatcacttggatacttttcaaaggatgtagtgtacaaatggaaggatgttgagctggacgcaaaaatgggcaacacgttgagccagtatcaagtattgtcactatcaaaatcggagaggaatgtttcggattttaggttctccgatcgaa

SEQ ID NO: 29597 - DNA, 1717 bp, Caenorhabditis elegans
gccgccaaatgccaatgcatttcggaacaaaagagcgaaactttgtcacaatctcatctccactgaccactcaacttccacaagccgtcggctcagcgtacgctttcaagcaacaaaaggataataatcgcatcgcagtcgtctatttcggagatggagccgcttctgaaggagatgctcacgcagcgttcaacttcgccgccactctcaaatgcccgattattttcttctgtagaaacaacggatacgccatttctacgccgactagtgaacagtatggaggagatggaattgctggaaagggaccggcttatggtcttcatactattaggtagagagaactggattcgttgaaaagcagtgccaccgcacggaaaaagaggcggagcgcaagaatttgcagtttttggcttgattttgcttgattttgaatcattttttgacaaaaaaaattgtaatttctgaaattttacaattttctcttgtttttccctttttttcctccattttttcgcgattttctcgtgaaattggcaaaaattcgaaaatataaaaaaaatatacgaaaattaaagaaaaaacccacaattaatcggtaaaaaatcaccaaaataagaatttcagcctaaaaaagtgcgccgcaggtttgcgaaaacgaggctccgctcctttttctgtgcgatcacagaattctgaaaatgcgtattgcacaacatatgttatcacgtcaaatatgttgtgaaatacgcattttcagaactctgtggtcgcacagaaaaagaggcggagcttaggttttgcaaacctgcggcgtgccgtttattttacgagaaaatcgcgggaaaaagtggaacaaaattacgaaaaagaagagaaaattgtagattttcagaaaattgactaattttgccaaaaattgaaaaaaaaatcgaatcttaaggcgcgccgcagacttgcaaaactacgccccgcccatttttctgtgcgacgcagcttttttcttttgcaagaaataaatcacggatcgattgttcagtatctgtttgcatacctaaatatattttttaaaaatcatcaaaaataaaggaaaaaccgtgccgcagggttgcaaaattacgccccgcccatttttctgtgcggcacttgcgaatattctatctatataatctaatattatcttctaaaaagaggaaaaatgagctatttttgaaatataaaattggaaatttaaaaaataacaaaaaatttcaaaattttttccagagtcgatggaaacgaccttctcgccgtctacaacgcgacaaaagaagcccgccgagtcgccctcaccaaccgcccagtgctcatcgaggccatgacctaccgcctcggccatcattcaacatccgacgactcgaccgcctaccgatcttccgatgaagttcaaacatggggagacaaggatcatccgatcactcgcttcaagaagtacatcacggaacgtggatggtggaatgaggagaaggagatggaatggcagaaagaggtgaagaagcgtgtgctcaccgagttcgccgcagctgagaagcggaagaaggcgcattatcatgatttgttcgaggatgtttatgatgagcttccactcagacttcgccgtcagagagatgagctggatgctcatgttgcggagtacaaggagcattatccgatgttggagactcttcaatcgaagccttaa

SEQ ID NO: 29598 - DNA, 1461 bp, Caenorhabditis elegans
atggctcagtcaaatgctttaacaacaacaacaaccggatcaagtgcaccatccgtgattcctccaactgctccaacagcgtctgtaaagacaaaggcaccaacgaagggacctgttcaaccacaaaagaagcctactacggtggataacgggagaagagcctacagaaatcaagtggtggtagagaatgtcgatcggcaggcatttcgtggtgtaagtcattggatccttttctccaaaaaaaaagacgtggtttatttaggatatgtggatttgagcacgtttgcatagtaaaaagtttcacggcaattttcaagtttaattcatttttaaaaaaatgttgagtcaccatatggattctaaatgaaacctatgtcatttgaaggaggtctttcaaactagctcgctacaaaaatttagagcactttaaagtcgatctgaaactttttccgttcatttttccatattttagacaaacggctttttttttcggcaaattggcaaattgccggaattgaacatttccgaaaatttccacatttcttttgaaaacttcagaatttccatttcaatcagcagaattataagtgtttccgtcttataaaaacccctctgaaaaattccggcaaatcggcaaattgccggaattgagaatttccggcatgttggcaaaccgacaatttgcgggaatcgaaaatttccactttttttttttggaaacttcagaatttcaatttcagccagcaaaattttaagtgtttccgtcttatcaaaattcctctgaaaatttccggcaaatctgatatccgacaaacggcaaattgcgggaattgaaaattgccggcaaattggcaaactggcaaattgccgtaattgaaaatttccggcaaatcggcatattggcaaattgccggaattgaaaatttccggtaaattggcaaacttccaatttgccgaaaatgaaaatttctggcaaatcggcacacctacaaattgccggaattgagaatttccggcaaattggcaaaccagaaatttgccgaatttatcgacaaaccaatttgccgtccatcccatatttaacaaacctggaggaccaaattaatgtacatttttattacagatcgaatcgtttctgagttctctcggacaagctgtcggactcggaaatatctggagattcccaacaaccgcttataaaaatggaggtttatcatttctcatcgcatacgttgtatgtggaatactgttcgccgttccagcaattcacatggaattcgctctgggacagtatgcagccaagtcgccgcctgcggcctttcgaagaatgatgcctattttggaaggagtcggatggatgacttgtctagtcggagcgatcataggtgtctactatatgattgtcatctcgtggatagttttgtaccttttcaatataatatacgctaccaagatcagcaa

SEQ ID NO: 29599 - DNA, 444 bp, Caenorhabditis elegans
acttggtcgtcttgtgtgacacgctcatgtctcttcttggcggtacggcggtcttctcgactctcggcttcttggccgagcaaaggaacatttcgatttcaaatccaaaaggcttcaatgaagttgtccaggaaggtcatgcgcttgcatttattgtctacactgaagcaatcgcccaaatgccttacccattcctctggtacgcattatttttcgtaatgctttttctactgggaattagtactgaaattggtgagttgttggcaattctagttttcatctacataattgatatctgatatcataaacaaagttacagtaatcattgaaacagtgtgttcttgtcttgcggatcgcttccactaccttcgccaacaccgctggattactgtagtaacagtttcaacgacattctttctattaggacttgtcatgacgtctgat

SEQ ID NO: 29600 - DNA, 682 bp, Caenorhabditis elegans
atgtcagattctgaaatagcatttgagaagctgaaaatctctggggagaaagaaggtgagccattccctttttcattatcgtttgagtactataaattattcacaaaaaaactgtttctcgccgttttgcatcacttttttggttccacgtgcccatttttatttgcattcatttattctctctgtttactgattttactaatcgagttcttccaggtatgactgaaacggagcaaacgacggcacccatttatccgctgaagcgtaactggacgtggtggtatttgaacgatgagcgcaacaagtcttgggaggatcgtctgaagaaggtgtacaccttcaacaccgtctcggagttctgggctctctacgatgctatccgtccaccaagtggcctcaacgcgttgtgcgattacaacgttttccgtgacgatattcagccgatgtgggaggttccggaaaactcgaacggaggacgctggctcatcgtcattgacaagggaaagactcccgaaatggtcgatgctatttggctggagattctcatggctttggtcggcgagcaattcggaaaggacatggagtcgatttgtgggttggtgtgcaacgtcagaggaaaaggatcgaagatcagcgtctggactaaggattgcaacgatgatgaaaccaacatgaggattgg

SEQ ID NO: 29601 - DNA, 236 bp, Caenorhabditis elegans
atggcaggaaaatgtgagtgggggtcaaagtccatggtcgttgtactaataagtgatcagtgatgtttatattatgtctgcaggtgtgttcatcgtcggtgccaagcgtacagcattcggaacttttggtggaaagctgaaaggattgagtgcaactgatttgggagtcgtcgcttctcaagcagcgctgaagcacgctaatgttggagcagatgccgtcgatcatgtcatctttg

SEQ ID NO: 29602 - DNA, 466 bp, Caenorhabditis elegans
atgagtattggtattgatttgggaactactttctcttgtgtagcttattatcaaaatggacaagtgaatatattggaaaatgagaatggtgaggctttttccacatggccgcaaaaacaagaaactcgcccgcaataatcatatcggtggcagagtttttgtaattttctagtcccaaaactaaccatgccgcagtcgactgtatggttgaatacgcagcgaacggctaaaattttatttcaatgcaaattggaattccattttgaacagaaaaaagcttgatatctgaaattaaaatctaagcaaagttctataccaaattctatgttatttgaaatgttagttacaaaaactgttccaggttgcagaacaaccccgtcagtcctagctgttggtgaggatggagatttacttataggtcaacatgcaaaagatgttatcggaaaggctactaactcactctttg

SEQ ID NO: 29603 - DNA, 674 bp, Caenorhabditis elegans
atctaggaggtggcacttttgacgtggcagctgtgaatgtagacgggccaaggattactgtaaaagctaaaggaggagatactcacttgggcggtcaagatattgataatattataatgataaagatgttagaagaatttaagaacagacatggaattgatttgaaaggaaactatcgagcactgaagcggatcagaaaagcagccgaggtggcaaagatcacgttatcggcaagttcggttgctaggattgaggtatgaatttttgtgaaattgctgaacaactttcacaaatttagagctagggccattttgagagtttcagtaatttccccacattcacttcttcactaaatgtctaaaaaatatttttttagctcgaatgcttacacctcggtatagatttcatcatgagaatcagccgaacggatttcgaatcttggatcgaaaatcttttaatggctacagtaatccacgtggaacgggttatccgagaagcgaatctcaaaaaatctcagatcaacgaaattgtgctagttggcggaagcacacgaattcccattttaaagaacattatcaaacaaagttttgaatcaaatacaagaatttgtgaatcaatacatccggatgaagcggtggcgtacggtgcggcgattatggctgcggtgctatcag

SEQ ID NO: 29604 - DNA, 1451 bp, Caenorhabditis elegans
cggaagtggttgctgtaatttcaattgctgatcaagttaaaaaagaagcatcacttgcaatctatactctacgtgaaatgggtcttcgtgtcgtacttctcacaggagataactcgaaaactgcagaatcaactgcgaaacaagtcggaattgatgaagtattcgcagaagttcttccaaatcaaaagcaacaaaagattaagcaattgaaaggatacaaaaacaaagttgcaatggttggagacggtgtcaacgactcgccggctctcgcagaagccaatgttggtatcgcaattgctgcaggaagtgacgtggcaattgagtcagctggaatcgtacttgttagaaatgatcttgtggatgttgttggagcaattaagctatcgaaaatgacgacgagaaggattcgattgaactttttgtttgcaatcatttataatgcgattggaattccgattgctgcaggtgaattttaaaaaagttatttcgaacaaaaaaaccgatttcaaatggtagaataaaaagtgttaaaaatgtcgaaaaattttcaattttccgaaaaacgaaaaaattgaaaaaaaatgtctagaacatttttttaatttgaaattttaaatatcaattttttttgaagagaaaaactttaaaaattatattttctctgaaaaaagaaaattggtcaaaatttgtagctatttttcgaaaacccgggtaattttttttcgaacaaaaaaaatcaaaatttttcgacttttcgaatacccggaaaacgaaaaatcgtctagaaaatttttaaacaattcaaaattttatcaaattcggtttatcttgttgagaagtacttaagaaaaaaaatttctgaaaaaaaagaaaaatagcttaagtttgaagctatttttcgagaaaaaaacggaaattttctacttttgtctggaaaatttgaaaaattcaaaatttaatgaaattttcgttgattttcgttgagaaaaaaaaagaagaaaatattgtttttctagaaaacgctatttttccaataacaaaaaacaatccacttttaataattttccaaatttccaggtgtattccgcccatttggcttcatgcttcaaccatggatggctgcagctgcaatggctctttccagtgtctccgtggtttcttcttcacttttactcaaaaacttccgaaaaccaacgattgcaaatctctatacgacgagcttcaaacgacatcagaagttcctcgaatcgggctctttccaagttcaagtgcatcgaggcctagacgattcggctgtttttcgaggtgctgcttcttcaaaattatcaatattaagctcaaaagttggctcactgctcggctcaacaacaagtatcgtgagctctgggagctcgaaaaagcaacgacttttggataatgttggatcagatttagaggatctcattgtgtag

SEQ ID NO: 29605 - DNA, 846 bp, Caenorhabditis elegans
ccacccggtcttcgattcgaagaagccttgaaaatcgcatttgaagctgcgattactgtacttgcaattgcatgtccttgtagtctgggtctcgcaacgcccaccgctgttatggttggaactggagttggagcagcaaatggtattttgattaaaggaggcgaaccattggagagtgtacataaagtgagttcggatttagaaatttggatgtcactgtcaaaattttaaacattttctcatattaacaacactaaaaaacatatttatttcaaattcaaatagaagagacataaccgaaattttgaaacatcgaaaaacaaaaatttagatgtttttacttcccagaaaaaaaaccttgtttcttagagtaccatttttttattttcactcgtaaatatcagaaaataatttttttaaaatttcacgaagccactaaagatataatatatccaaattagtgtgaaatcagaaattgcacgaaaaaacgaaaaaaaatcgagaaataaagaaagatccatttttcaaaccgcgaatttcgatatttttcagggaaaaataaataaaaaagaaaaatcgaaacattaacaaaattatctttaatatgaacaaaaaaagcaatatttatcaaatctcaaattttttaatcactcttttttccaggtaaccacaattgttttcgacaaaactggcacaatcaccgaaggacgtccacgagtagttcaaattgcgtcgtttgtaaatccatctacaatgtcactaaaacttatcacattcctctccggagccactgaagctttgtcggagcatccgattggaaatgcggtagcggcttttgcgaaacag

SEQ ID NO: 29606 - DNA, 231 bp, Caenorhabditis elegans
atgtccaaagaaaagtccttcgacaccaaaaagttcttgatcgatctcgcctcaggaggtaagctttttcagtttttattgcaaaaatttggaggatttctataattattaattttgggttttcattcgtcaaatttgtgatttaattaattttgttttcttttaggtaccgctgctgccgtctccaagaccgctgttgccccaattgagcgtgtcaagcttctcctccag

SEQ ID NO: 29607 - DNA, 220 bp, Caenorhabditis elegans
ccctacccaatctaccatccaacgcttacatggagccaaatcgtacctaatttgaattcacgtggccgtgatcttttacaggtaacttttttccaataaaaattatacttactcaaactcgaagtatttgcagaaacttcttgtttgcaatccagcaggaagaatcgatgccgatgcagctctacgccatgcgtacttcgcagacacttctgacgtctaa

SEQ ID NO: 29608 - DNA, 428 bp, Caenorhabditis elegans
atgtcggtgctcctggctgtgcatgaactgcaaagactggacggctctgaaaatagatcaggtaggtgtcaagaattgcgccaaggcacggaaaatgcgccaagcaacagcgagctcacatggagtcagaatgtctcgtttcggtttgatctctattaaatgcgggagaagagacgcagacatctcatcagatttcgcatggttaagagcgtgcggacgtcacagttttctggaacgatattcccgcctttttcgtagatcaaaccgcaatgagacactctgacaccacgtgcgaactgttatggtgcatcggagcttatttcgacgcaactcgtgtgcaacattcaaattttcagatgtcctcaatagtatttccggtcagttttctcgcgttcaacatttggtactggttcatatttctcgggtaa

SEQ ID NO: 29609 - DNA, 631 bp, Caenorhabditis elegans
atccgaatcaagggaccatgtgtgacgaaagggtactacaaggatccagagagaaccgccgagttgtttgatgaagagggattcctgcaaaccggagacatcggagagatgcttccaaacggaactattcgaatcattgaccgaaagaagcacattttcaaactggcgcagggagaatacgtggcaccagaaaaaattgagcaggtctacattaggacacccgttgtgcaacaggtctatgtcgatggagatagcttggaaaggtaacttggtttttcgttagatttctcaacattgagataatgacttcagatggctcatcgctgttgtcgtgccagaacccgatgtgcttaaagaatggaatgataaacaaggatccggatcaagaaaaattgaagaaatctgcaatgacgagaaggctaaggagttcgtgctcagtgagctgcatgcaattggaaaagctaacaagttgaattctatcgagcaagttaaaaaagtgatcttaacgtctgacacgtttactgtcgaaaatggacttctaaccccaacgctgaaagcaaaacgaccacaattgaggctgaaatataaggatggcatggcaaaagtgtataagcaatttccaaatctttaa

SEQ ID NO: 29610 - DNA, 1243 bp, Caenorhabditis elegans
ccgccgatgagtccaccggatccatggacaagcgtcttaacagcatcggactcgagaacaccgaggagaaccgccgcaagtatcgtcaacttctgtttaccgccggagccgacctcaacaagtacatctcgggagtcatcatgttccacgagacattctaccaaaagaccgacgacggaaagccattcactgctcttctccaggagcaaggaatcattccaggaatcaaggttgacaagggtgtcgtcccaatggccggaaccatcggagagggaaccactcagggattggatgacttgaatgctcgttgcgctcaatacaagaaagacggagcacagttcgccaagtggagatgcgtgcacaagatctcatctacgactccatcagtgactgctcttaaggaaattgcctccaacttggctcgctatgcttcaatttgccaacaaaatggacttgtaccaattgttgagccagaggtaattaccgagagtcgagagccgagagtcgcacagcactggtacctacccacctaagttccttttggggggatgtagtcgtagatcggcttgaatgtaatacttagaacggttttcacagaaaattttaatattcgatgcaaaacccaagttaatgccacgtccgttacttgggtctcgcagcagttttttttttgtaaaaaaaatataattggcactctaattagttatcatttcagatcctcccagacggtgaacactgcttggctcgcggacagaagatcaccgagaccgtgctctcatatgtgtaccacgctctcaacgagcatcacgtcttcctcgagggaaccctcctcaagccaaacatggtcacctccggacaatcattcaccggcgagaagccatcgaatgccgatatcggactcgccaccgtcaccgccctccaacgcggagtcccatccgccgttccaggagtcgtcttcctctccggtggacaatccgaagaggatgccacattgaacttgaacgccatcaatcaagtgagcggaaagaagccatgggccctcacattctcctatggacgtgctcttcaagcctcctgtctcgccaagtgggccggaaaggacgagaacatcgcagccgcccaagaagtcctgctccatcgtgctcaggtcaactcccttgcctctgtcggaaaatacaccggggatgcttcagctgacgcagccgcttcccaatccctcttcgtcgccaatcattcttattaa

SEQ ID NO: 29611 - DNA, 225 bp, Caenorhabditis elegans
ctgttcaactgttactcggacgtcgattcggattcgcatctgtacgattatgatgactccgaatggtgcgctttttgtaattgatgtgcaagcgcgccctaatgtttatttttatagaattgcagtacagggtgggccaaaagtatggtaacacgtttgcagctctataacttcacgtgtggagagagttattacatcaatgtgtacaagttttgttctccataa

SEQ ID NO: 29612 - DNA, 575 bp, Caenorhabditis elegans
caaccagtcatcgtcaagcatgcgccgaaatcatgaacgaaatccgtgatacccgcccatggtttggtatggagcaggaatatctgatcgtcgacagagatgagcactcactaggatggccaaaacacggattcccggctccacaaggaaagtactactgtagcgtcggagcggatcgtgcgttcgggagagaagtcgttgagacacattatcgtgcttgccttcacgccgggctcaatattttcggaacaaatgctgaagtgacgcctggacaatgggaattccaaatcggaacctgcgaaggaatcgatatgggagatcaattgtggatgtcgagatatattttgcacaggtattttcatcacgatcctgtatataataaaaatgtttccagagttgctgaacaattcggtgtctgcgtatctcttgatcccaaaccaaaggtcaccatgggagattggaacggagccagatgccataccaacttctccacgctgaaatgcgtgctccaggcggtatcgccgcgattgaagctgccatggacgggctcaagcgtactcatttggatgcgatga

SEQ ID NO: 29613 - DNA, 7 bp, Caenorhabditis elegans
atgactc

SEQ ID NO: 29614 - DNA, 677 bp, Caenorhabditis elegans
ggatatgccctcccacatgccatccaacgtctcgatcttgccggacgcgacttgaccgactacatgatgaagatcctcaccgagcgcggttacacttttaccaccaccgccgaacgcgaaatcgtccgggacatcaaagagaagctttgctacgtcgcccacgacttcgagtccgagctcgccgccgccgcctcctcctcctccctcgagaagagctacgagcttcccgacggacaggttatcaccatcggaaacgagagattccgctgcccagaagtcctcttccagcctgccttcatcggaatggaaggtgccggaatccacgagaccacctaccaatccatcatgaagtgcgatgtcgacatcagaaaggatctctacgccaacactgttctctccggaggtacctccatgttcccaggaatcgctgatcgtatgcaaaaggagattcaacatttggctccaaggtaagcttcacatttctcagtacatgagattataattcttgtattttcagcacaatgaagatcaagattattgctccaccagagcgcaagtactccgtctggatcggaggatctattcttgcttccctctcaaccttccagcaaatgtggatctccaagcaggagtacgacgagtccggcccatcgattgttcaccgaaagtgcttctaa

SEQ ID NO: 29615 - DNA, 263 bp, Caenorhabditis elegans
atggacgatttggctgattgtcgtgaggttttcgcctattttgacagcaaaggcgacgagcgaatctctgttcagcaggtttttaattcaatattttacttttttaatccaaaattcatatttcaggtcggtgatgtgctccgcgcgctcggccagaacccaacagaagccgaaattcacaaatgtgtcggctcgttcgatcgggaagctcggctttcattcgaggactttgtcccaattttccagtcggtgtccaagaatcg

SEQ ID NO: 29616 - DNA, 224 bp, Caenorhabditis elegans
atggcaagttccacaaaagtttccttacggtacccgttatttttttttgaaaatttcgcacaaattgtcatcattttcagtcgtccacctcgtccacaggttatgtactcactgaagccaaaagttgtggaatttgacaaagtatgggtgcagttgagaccatctatcattgatatcatcaatttgcggccgatcaccaatgttcagtggcatcacaagtttag

SEQ ID NO: 29617 - DNA, 341 bp, Caenorhabditis elegans
atgaatcaggtattgctttttttgctctcacaaactcttaacttccttcgtttttccagttgcaaggtgttcaaaaaaatgcagaatattatccagcagagcgtggaaaattggcggctccgtttttagaaacaggcacgattatcggactgaagcgtccgttccaagttgaaaagatggtgggcggcggggggtttgggcagatttttcgagcggttgatatggagacaaaacttgttgtggccgtgaaggttgaaccgaaatccgtcgaatctgggaggattgtgctggaacttcatatattggttgagcttgcacattcaccacatattcccaaagtg

SEQ ID NO: 29618 - DNA, 1215 bp, Caenorhabditis elegans
gcgtcaagaagaagaaaaaaccgctcgtgaacaagcacacaagcagttcgaagcggatcgacagcgaatggcctcggaaattcactccaaaacagaaaactatcaaccggataaggtcacatcggtgtacaagccaacaaaaccgcacgtggagatcagttcatcagctcgcgaagagttctggagcaagatgaacgaggaggagcagcggcggcaagcggaggaaaaagaggcacaggcccagaagcagaaggaattcgagacggatcgaaaacggattgcggatgatcttcacgggaaggctcaaattagtgataagcccgtgccatcttcggtgaatccagctccagctcccgcccccactccgagcgcaggtctcgttggaagcagaaaagaattattcagctcaaaaccttccggtccagtgcttccgaagcctcaagtgaatggatcgcctaagaagtggccgccagttggcacgacctctccgccccgtgaacccgttaaccgactcactgagccagatgagccttcgacgtatacgccaaagccaatagcttatgagccagagccaatggtttacaagcccgaggctatgagtcagttttcgtataaagtttattagtcctaatttgaatattttcagaacctgccgtctcttacgatgcatacgaagagccaccagcagagccagctccacctacattccttgctccaaccccggtcattgctccacctccacctgagccaactccagctccatcgcattacgcctcccagtacgatgctccaccggttcacgagtctttcgaaccagctgtacctccagtttcagctccttcccactatgcgtctcagtatgatgctccgccggagccgatcgactctcactcatcgagctctcaactgccagctcacatcgcctcacagtatgacatgcctccagtgatgccagaggagcccgtgtttgcaccgaaatcctcgccaataaaagtcgctgctccaccaattgatcagtacgatttcccgccggcggtcgccgagcagaacgcgatggctctctgggactaccaggctgcagatgacacggagatctcatttgatcctgatgacattatcacagatatcgatcaagtcgatagcggatggtggaaaggacgtgcgcccagcggccgcgtaggcctttttcccgctaattatgtgaagctgatttaa

SEQ ID NO: 29619 - DNA, 1025 bp, Caenorhabditis elegans
gtctccgtgcataccttctcccaatctcaatacccacgtatcaaccgtgagactcttcttccaatcgtcaaatcactcgaagccgacgacaacgaatgctggtacccaccaggtcacggaaacttctacgaggccttccacaactctggactcctggacaagttcctcgccgacggcaaagaatactgtttcctatccaacattgacaatatgggagctaccgtggatctttctattctcaattttgtgctgaacccatctcccgatcaaactgctccggagttcttgatggaggtcaccgataagacccgtgctgacgtgaagggaggaactctcattcagtacgaaggacgtcttatgcttcttgaaattgctcaggtgccgaaggattatgtggacgagttcaagtcgattagcaaattccgaattttcaatactaacaacttgtgggccaagcttgacgccatgagaaaaattgtggtggaaaacaagctcgaaatggaggttatcgtcaatccgaagcatctcgaccgtgggcttgatgttattcaactcgaaaccgccgctggtgcagccatcaagtcattctctggagctgttggagtcaatgtgccacgttcccgtttcttgccagtcaagaagacttctgatcttctgcttttaatgtcaaatctttacgatattgacaatggatccttgacgctgtctcatcaaagatccttcccaacaacaccgctggtgaagctcggatcttcattcgataaggtcaaggactacctgggacggttcaatggaatccctgatcttctcgagctggatcacttgacagtttctggtgatgtctggttcggaaaggatgtatctttgaaggtaacttgaatttttccatataggtcatcagtaattttcaatttcagggcaccgtcatcatcattgccaaccacggagatcgtatcgatatcccgcctggttcgattctggagaacaagattgtttctggaaatttgcgcattttggagcactaa

SEQ ID NO: 29620 - DNA, 1025 bp, Caenorhabditis elegans; identical to SEQ ID NO: 29619

SEQ ID NO: 29621 - DNA, 1025 bp, Caenorhabditis elegans; identical to SEQ ID NO: 29619

SEQ ID NO: 29622 - DNA, 1779 bp, Caenorhabditis elegans
atggcacaggctgagaatgcgtgtcggtgagtaattgaaaattatcacatggataattatgcaaattttgagtttgaaacaaaacaatttcacccaaattttgattctccgctagagatgtttttgaaaaattgaaaaattttgagattcttgccaaagttctcaaaaaattcaaattagaattttcctcgccaaaactttttgaaatagtaaaaattatgatttccagccacataattctgatatatggacgaatataattttgggccattttttttgcaaaaaattaaattaaagaatactcaactttgtaatgtcttataaaaatttctgaaaaagtaaaatttgaattttgtttttttaaatcaaatttgcttttccgccaaaaatttattaacaattttatagtaaaatttaaaatctaaatttaataaattttcaagtttaaaaaattccacaacaaaaattcttaaaattaaagtttaattttccttccggaattccctaaattaaagtcaacatgtgacgtcacaggctataaactacaaactttggacaaaaaaatttcagtgaaaaaacccccacagaatctttgcagcagtaagtgccttccccctttgtctctctgctcagcccagctaaaaccaaaaaaaatcacaaattttctcctctctcggtccttttgtcctctgaaaaagtgcacaccacatcagggaagccttccaaaaaaacatttttccatttttttgcaggctgaagcttcttcgagcggacgttccagttgacttacttccggccggatgttcagcaactgatttgcagccggctgttaatgtgaaggagaagattgaagtgaatggtgagttattagctttttttgaaaaagaaaaaaatttcgaaaaatctaagttcaaggggaacctctacctaaaaaacaatttttataacaattaaaatatttttttaaaaattcgattcgtgtgaattttaaaataattgtagaaaagctactgaaaaaactgaatagtcaagaagtgggaggggcctgtttaatatcaaagttgaaaagttgaaagagactccgcccatttcttggtttttttacagattttttaatgcataaaatttttaatatcaattaataagatttttttaattgacattaattgttctcagttgatataatttttgcaaaaaaagagagaaatcaataaaatcatttactatatataaagtagagttttcttccgtctaatgtaggctatgccaacacgcaaaactcacgttagtttgaaagttttcgtaaaatttaaaatttcatttcaaaaaaaaatcaaattcatttaaattcaaaccaaaaaagtaattccgagggatattcgaactttagtttgagtcagtcggaggaggtcgagccgtaggctcgaacgacaccggctggtactataaataatttaagttcaatattaaaacaaaaaatgatttgcgaaacattttttcaattaaaaaaatcagaagtttttttttaattttaggaaatatagttttaataattttcaaaccccaagtgttttttttttcagaattcaatgtgtacaaataaatttttattcaattatttatcattttccaggtgaatcccgactagtccaaaagaagaagaccctttacccggaatgggaaaaatgttgggataccgcagttgccgagggccgaattctacaaattgtgctcatgtttaatcagacacctgtggtcgaagcaactatgcgattagag

SEQ ID NO: 29623 - DNA, 752 bp, Caenorhabditis elegans
atgccagagtggttttttttaattcctcaactacagtttcacaataaatccaaaaaggtgtgtaggtaggcacataaattagcctgccttcgtgcaacgcaacctacgcctacctacctacgcgttttttgtgcctacgggtcaaactacaataactcgaaaataggtgtttatcacgtctataaacaaagtgatattaatatcccaattcgtaactgggctcgtaacaaaatgtataaaataggtgggtaggcacgtaggcacaataatacctgcctaccaagtgcctacctgcgcctaccttgggcctacacagtatatgataggaagacatgcaggcagaaacaatgctactttcttatacccttttttttacaaaaatttaaaaatactaaataaattcaatttttcagcggatgacgatcaccctgtagaggacataatgacatccagaagcaactccggtcccggaattcaacgtcgtagaggtatgtaggcatatgcaagtaaacacctaatttatcaattcaggagcgataaaacatgcgcgagtacacgagattcgcggccatcagttcgtcgccaccttcttccgacaaccccatttctgttcgttgtgctccgatttcatgtgggggctcaacaaacagggatatcagtgtcagttgtgctcggccgccgtgcacaaaaaatgccacgagaaagtgattatgcagtgcccgggaagtgcaaagaatacaaaggagactatg

SEQ ID NO: 29624 - DNA, 1174 bp, Caenorhabditis elegans
atgacatccagaagcaactccggtcccggaattcaacgtcgtagaggtatgtaggcatatgcaagtaaacacctaatttatcaattcaggagcgataaaacatgcgcgagtacacgagattcgcggccatcagttcgtcgccaccttcttccgacaaccccatttctgttcgttgtgctccgatttcatgtgggggctcaacaaacagggatatcagtgtcagttgtgctcggccgccgtgcacaaaaaatgccacgagaaagtgattatgcagtgcccgggaagtgcaaagaatacaaaggagactatggtgagttgggctctagatctagattttgaacttttttatagtgttacctacgtctaaattatttgtaaaatatattttaaccttaggtgaaattgaaccagggtcatgggattactaggcaaacacgttagccactcggcgagtggggaaagtaagtgcaaactgaaattttgagcacccagtctaaattttgaactttcaatattgcagtctgggtctaacaactttcaagaaattgtaagcctagagtagaaaaagtagaattagaacagggtcgtaagattactaggcatcttcaatacccactgagccaaacgtgaacctattcatatgtctgaaaaaatgacaacagggttattttgagcccagaatatttttgctatgagactcacaattcacaaaattaaaactcagtcatgattgtatttttttgaaagctcaaaaatagtacattctgaaaatttacgatttttttcaaatattcggaaaattaccgaaaattcactatttcgggtaagtaatgttcccttggctactggcactttttcagccaaaagtacctttaaatatttgagaacatatgtatcggtatccaaatatagcctccctcatctatttatacagctgcctttgttcgttggtagacaaaaaattatagtgtatgcgcgtagcacctgacttgtacttttttgctgttatagcttctattttttttgaatttggaatttttacaggctctcaaagaacgatttaaagtggacataccgcatcgattcaagacgtataacttcaaaagtcccacgttttgtgatcactgtggttcaatgctttacggactttttaaacaaggactacggtgtgaag

SEQ ID NO: 29625 - DNA, 502 bp, Caenorhabditis elegans
cctcgccaagaagttcattgagaatattccgaacaacgaaagtgcctggaactacctcgcagggcttctcatcacaaatggagtaacctcgaacagtgatgttgtcagttttgtggaggatttgtatgagacaactcctgaagagaaacggtcaccattccttcttgcatttatcgccgatatgatgctcgaaaatattgaaaaccaaaagtctgcggaagaaagcgctgggcgcgctaaaaaggtttgtaagtctagaaagttcatgagaaatgggataacattggagaatttttaactaaaaatttccttttttttaattaaaagtgcacattttcgctttaaatgaatttgcgctctaaacgcctcaaattcccgaaatttccagctctacaaggatcttcaatcgatcgacccggttcgagtcaactactaccgccatcagagtcttcttgctcaaacgatgctcatcaaggcacagacgaaggtcactgccaagtaa

SEQ ID NO: 29626 - DNA, 1552 bp, Caenorhabditis elegans
atgccccccaagatacaccccagtttgtctactggatactttgtctccttggataatttgcccccaaagaacctttgccaccctaaaagtttgtcatctcggaatgaaggccgaatgtttatcatttcaaataatcatgttttacaggtaaaatcacaatctggacagtgtcggattgttcttcgttctgcagctcaaatgacaccaaaagcctctccaattgctcaaaaactaaaaataattccaaaatttgaaaaatcagagtatcaatttcaagttgtcgaaaatcgggagccaactgtccttggagaagtaaaagtgattagtgatggacccgtaacgtatgagattctcggagaaaatggagagaaatttcaaatttcaaatgatggagaaattcagaatttggaaccgattgatcgggaaacttatgaaaaatttgaattaattgtcaaagcaaccgatttgaatggtaagcttgaaagtaaaaaacaccctgaaagtttttaaagtttttcgtaatttttaattcaagttttggcaatttaccatctttttgaaaattttggaatttttgggaaagttagccatttcacttttttgcgaagtttaaattgtttatctttatatatttaaaaaatacagtttgtctgtccatagtttgtaatctatgtagttttggtagtgtgcaaagttttgtcttttgaagagatatcggtttgggattagtgggaagatatggtcggggtactaaaggatggggtactgtagagtactgtaggatcactgtagtttaggaaaaattgagtttttgtcttttgaagagatatcaggttttagtgggaattttttgagaaaaactttggcgggaaattcacattttctgagaaaaaaataactggaataactggaaactcataaaactgtttttaaatctggaagcttctagaactttctagaaacatttgaaacttttagaattttcttattttgaaggtctccgaaattccatgaaaaagtgtagctgcagagaaggcctaccatttttgaaaataaagtaatgttcgcgagtcggagccgacacttagcgcgtgtgaacggctggtatttgtataaataattatttgcatgttataaattcaaattcttaatttttaaagggtcatctggtaaatcccaattgattatccacgtgaaagatgaaaatgataattcgcctatattcgataaggagcactattttattacagtagacgagggaaaaagtgaaaaactaaaaattacggttggtaacatatcttatgtacactgtaaaaaattaaaactgtaggctacggacgccgattcgggaaaaaatggccaaattgtgtattcaattgatcaaaaaatcgataatttaccaatcgacatatcaccagatggaatgctttttattggagccattgatagagagaatatgggaaactcaaatgaggtcaatttgacagtaacagcatcagattctggggaaccgaagagaagtgccagtgcaacggtaactatcagagtaaag

SEQ ID NO: 29627 - DNA, 1295 bp, Caenorhabditis elegans
atgcactgcggatctgggagtcaggtacactgcctggtggtgatcccactaaaaaagtaattagagtattatagaaaaaatacgatcgcccaaaaataaacaacggcgcaacgacactccgctgtttctgagacccgcccacgatttcatttgcactgcggccgacacatttcagtgcaaatgaaatcttgggcggggtttagaaacggtggagtgtcattgcgtcgttgtttatttttgtacgatcgtattttttctataataaaggtttaaaaaaaagaaacacactattggatgttacattccagtcaacttgatacctaaaatatttaaattttccattgaaattagtgttgacttttgtttcctaaatacgaacatcctttcaaaaccaagcgcaaaaagtgtaagatcattcacaactgaagtcaaatttttgaagtgtgaacattttttgcgtcatgcaaatatgaaatatgagtttatgagtcgattaaaaaacataaaaacccaaacaaaaacgctgaaatttcattaaatgttaaaaaatgacttctttattacaaatccaaagttatgattaaacatttaaagattagctgcaaagattatttattaaactacatatctttctatttttagtctattttttaaacattgtcaggtttagtttgcacttcaaaaaatgaaaactgtatttcactaacaatatgtacatatatcccctccctcattttttttcactccagaaatggaaagtcaatatttggaaagaaaataattttccaaactgttagaatctccgtttttaagatttattgatttctacgtgggttgaaatgactcagttttgatgaaactcaacaattttaaggcatttttatcagttccggttggaaaggaaaatcagaaacatttttgcaagtgataagaattatgaaatttttatagattttttcaaacgtttatttggaaattgaaattatacttttaaaaatttaagaaaagctgaaatttaatgactaacgtttatatttaatttttgaattttaagtatttctccctgaaactaataactttttaggcacaataagatggaagtggatctgccggtacataacgagtatgatgcgtctagatttcatcaagttacaattagggtttgttactagatactttacctccattcaaattcattttcaggacccgatagccggcgcggacagcactttcactattccaactcgttatgtaaaccttagttttctgaatgccggcgcccaaggaactgtcgt

SEQ ID NO: 29628 - DNA, 722 bp, Caenorhabditis elegans
aatgttcgacgtcggaggtcaacgttcggaacgtaagaagtggatacattgctttgatagtgtaactgcagtcatattctgtgttgcactcagcgagtatgacttgagactcgccgaagaccagactatggtatgtttgtagttgattcacgatgtttgcataatgttccacagtgagcataatggacatgtcgcggttcacaaataaactttgcttatgcatattttctagtgcacatcaggggtgtgcggcaaatctcaaaatttgccgagctcggcaaattcggcaaattcggcaaatttgccgcacacccctggtgcacatatatcgttagcatccacgaggagtaaagctatatatgcctagttagcccttatttagtataaactttgttgtatgtagtttgatcacggtcggtattataccacaccacatagccaaaacatatttctattttcagaaccgaatgcacgaatcaatgcaattgtttgactcaatcgtgaacaattgctggtttaccgagacatcgattatcctattccttaacaaaatggacattttcgaggaaagaatccgttacacaccattgaccgtctgtttcccagagtatcaagggggtatgacaattactgaaacatcaaccttcattcaaagtcgttttgagattctcaataaaagacaaacacccgctcaaaaggcaagttgcaaggcattgatttaa

SEQ ID NO: 29629 - DNA, 625 bp, Caenorhabditis elegans
atgaagctaaccggatttttaaagcaaaatgtgagtttttaaaataaatttaaaaaatatatgaatgaataaaaaataaattttaaaggtacgagtacgttttgctccctccccaactggacatttgcacattggtggactgagaaccgcatttttcaattatttgtttgccaagaagtatggcggcgatttcattctgagaatcgaagatactgatagaacacgttttgtggatgatgctcaggatcaggccagtctcaatttccaataatttaaataattattgctaattttaaagatttattcctctctgaatttctacaatttattaccggatgaaggaccacgtgaaggcggaaaatttggaccatatgagcaatcaaagcgactagaaatatatcgaaatgccgcctatagactaatagattctggccacgcatatcgatgtttttgctctgaaaaccgactggatttgttaagaaaaactgcggaaaaacgaggagaaattccaaaatatgatcgaaaatgcgcaaatttatcatctagagatgcggttaaaatggagcaaaatggagaaaagttcgtgattcgattcaagttggacaagcaaaatgttcagttccac

SEQ ID NO: 29630 - DNA, 1332 bp, Caenorhabditis elegans
atcaagttagtatgtggttcgtacatttttctggtcagcagattcaacgtcagctgacatttacttcttcaagacctccacaaactttgattgcaggtaaaaattcttagttttctaatcaaaaattacttgaaaaagagaaaacactaaaatagcccttttaaaaaaatatttgagaattttgttagaaacttccaacttccagaagttgtttgacttttctaacttttcagatttgggtaaattgccaaaattttcaaaaatgttgactttgactaattgcaactattttcaacaggtttcaactattagaatgcttacaaaccgctgaacaaaattaaaatatcatttactatatttaaagcgcttattccgtttgtccatagtttgtagtctatgtagtctttgtagtctgtgacgttttggcttctggagggatagtgagttgggcttagtgtagggatatagtcggggtactgtagtggtacaatagtggtacggtaggagtactgtatgattacggtagcttcagaaaaattagttttcagctccagaagtcgggggccgcgccacggctggtgaaaagtatagaaacattttttgctgattgacttccaaaatataatttcccttttgaactgtctctgaaataaatcgccacggccactttccaatcaaccagcgtcttcgaacgttccaacaggaagggaaatcatttatcattgaaaagtagtagttagtctttctcgattttttcattcgtgttattttgaattttgtggtcatgggttagttttgaaatgagaagttcaagagtatgtcagagagtctcaaatctagtccacaatcgctgaatagaaacgttctattatgggaacacgaaattctgaaaatgcgtattacgcaacatttttgacgcgcaaaatttctcgaagcgaaaactacagttattctgatattttgcgcgtcaaatttattgcacaacacgtattctcagaatgttgtgctcccgtaatacagtacattttattttcttcctcgaaaacttcaaaggagggcgcgtttatacggaatggtcttgccactcattggttttaaaaaaatttaaactaatgagagcgcttgtcgagaccatttcgcataaatgcgccctcctctgaagttgtagtgaaaaaacactgtaatcgatttggaaacaaatattttccaggacgagacgatgctcaaatgtgtactctggcgctacaggagacgcttcttgtcggtaaaagaggagcagaaatatcggaagacgaatttgagagtcattggaaattgggatgcttgaattag

SEQ ID NO: 29631 - DNA, 809 bp, Caenorhabditis elegans
acataccgtgtcttgacatctctcgggttcaactcaagttcaagatgcccaacaagaactccaccgactacattcatgccaactacatcagaagtccattcctgaagcgtggctacatccttacacaaggacccaaaaaggaaacgcgggctgacttttggagaatgatttggcaggagaacacgacggcgattgtgatgctctgtcaattcctcgagacgaatcgtgagaagtgcgccgagtacttcccgagaaatgcacattgttgcctgcaattcgacaagtttagtgtaaactacgaggattcaacggtgaacaagtctctggtgacgactcgcctcaacttgagctatgagggcgagacgcgattgatcactcactggctatggaaggaatggcccgactggcaagtgcctgaatcctcagaggtcatgctgaagatcttgagaaagatcagagcgagaagtacacctccagttattcattgttcggcgggagttggccgttcgggaacgctgatggctgttgagattgcattgcaatcgattcatactcacttcacgctgccggatatcaagcaggtaagaatttttatgtctgcctacctatgcctaccttggatgtttcagattgtgagccacctgcgcgtgactgggcgagcggcgtcggtgcagactctccagcagtacatgctcatttggaaggtgctcctggattttggagttgcctacaagcaaataacggaggagctcgctgagaagttcaactctacgtatcgtcgatcgttaagaagtattaatggaacttga

SEQ ID NO: 29632 - DNA, 7119 bp, Caenorhabditis elegans
ccgatggccgaactccgagaagtcgcataaaaacgaatcgccttccacaacgtgtgttcacctccctggaacggaagaaggagaagctgatcacacttctgacacctcggaaaatgcaacgagactctcctcaagttctgaaggatgtgaagaatatggtgaacgtgtcgatgacagcctcacaggatcctgaagaagtgaggaatctgctgaagaaggtgtttgacgatgaacggatgcgatacgagttgaacggatggaagttccttgcgacacaggagactgttcatggatggatgactgtcgagttggaaattgttcggctgcagatgtttgataaagtgcgtaatctgcgccgttttttttgttgtgtcaatatcaacataccgtcgagaaaaccaacatatattgaactctgattgaattttcaaagttcgattatggaagataatttttgaaacaccaaaaaacaaaacattttcgatttttcggtgtttctcaaaaaaccgaaaaatcgaaaaaaaaattcggtgcaaatttgcttaaaaaaagtgcagcacggttgagtgtcgatttacgcagatcgtgtactcctcgagaagtaaaatcttttggaagaaattattggtttccgtcaattcttttcgtatttactattcaaattgccaattttgtgattaagaacaactgaaatttagaaatgttcatttcaaaagtagttccttaaaatactaaaaattaaaaatgaattcgcgattaaaaactgtaaaaagctcgtcaaaaagagggtcgaatctgaaacgttttttttcccaaagatatacaaaaaaaagattttttttttcaaaaaaaaaacacgagaaggcttctcagatagactggagtcacggcagagcgatagaaaatcactgctaattagcatttatgtcacggcttagtcaaccgcagtaattgtgcttttccgctgattagcggtgatgttttgctacgtagttatgctttcttgctagctagttttgctttcatattggattaaacttttataaaaccataaaaaataacacgatttattatgaaaatgaaacaaaatgaaaaaacaacagaaaaaaaacatttaacgaaaaatggaaaaaaaaacaaaaaaacaagtttcgaaagtatcagaaaacaggagaactagtgaatttatggggagtctgggatatgttcccttccagcagatttcgaagttgatagagagttcgaagatgattgaaagttcgaagttgatggaacttgctcctcatcgatatcctcgctgctcttgtagaattgtgtgcaatcgatgatgggacgctttggcagcacaatttttggtggattctggccgtcgtgttttgttcgatacaaaccacgggcatgatcgctgcaaaaagacatttgtgaaaacatagtttttcaagttaaagaaaaattctattcgctggctttttaaagtaaataacaagaaacctacaatctgactttgatatgatgcttgaacagcatattgaccacacttggaaggcgagtaacgtccacctggtcgttgtccaacttgattgccgcagcgagaagagctgaaaacgatttttatgtggctcgcccatgtaaatcataaactaaccggctggccaatttgtcaagtctcctgggaagaaagtaagaggctccgtctttttgcttgtcgtgaaggatccttgttgctctctcggaatcagctgaaatgttaaatagtcaaaaatagaacgtaatatttgatcgctcacgtagtcaatccagtgatttgacatagcattgacaattgatctaaccgagccatgttgaatgctcagcgccgaaaacacgagattgacgttgataaacactgaaatagaatgttcttgggggcggtttttatttatgttcttggtataccagtttgatccaaactcgaaacttccagcagtttgtggttcagaaaatcgttagggttcaattttgccatttcttcaccctgtaaataacattttcaaatgctcaaaatcgttccattcttataaacatacaagtaaacgattcttctccattggtttacttttcgggtgcattgatcgctcagtaaccagttcctgctgaaattttctccaatattaattgcaaattcaagatagtaactaaaactgaccatgagcataacacctcgaattgcacccattgaagctttagaccaagcatccggagcagtgcggatcaactcgtcaatcgattcataactatagtcaattgatcctccaacgttctctccgagtcttttctaaaagtcaacaattttgatcatgccagatttttggaaaaaaaaacttaccaagaatcctggagtttgttcggtggggagtgtgtgagatgtaagtcctagatctacaatacagatttttccgcctttctgaaattaatttatttccgagcaactcgaaattagcagaagtaaacaccttcgcaattggatgcatatccggtttgaacgattttctaggcaacgatggacttgattgcattggctcatgatttggttgctccggaagagcaatttccagatgagattcttcttgttgctcctcttcaatctcaatcggctcctgtacaggttgctccataaactcttcgtcatctacgatcgtgatttgagctttttgatgtccaatctcctcttcttttacaggtgcctgaaaatgacagaaatattaaaactcataggaataggttagctttgggttcacatttaatgttatgtggctccttccactaaccttagcatttcggcgagtaatacggcgagtcttcacaacgatttccgtagtttccggttgccgttttcttgtcggctttggaactaattttggtttttcttctttaatgggctcgtattttgccactagtttctcgaggaatgacatgactttttctgaaattgatttttagatctgttaataaaataagattaaataagcagggttgaacagaacagattatcacatcaaataaacacaaattaattgaaagcggataagcattcatgaaaatattaaaacaaacaacttttaaaaatctgaaagaattcctcaagaacataatgagaacatttttcgagcaaggggtagagacaaacatttgtcaaagaagggggaggtgcagacattttttcgagcgggggggggggacagacaaaagacaaacaaattcaaagctatatgtggttatcaaagtcaagatagactgatacggcgagaaaatggaagagccacacagttgttatttcgcttcacaaccactgcatgtccaacaatggaatcggcggaaaccacgacaactgtgtttgttaacgtgacacgacctccgaaactcgattttgaaactgaatcaacccagttttgaatatgcatttgcggtacatcctcttcatataacttgttcgatatgtcaatcaaatgatcatttgtgttgcagtatttcttcaaaataaaacgaagatcagtgttgttttccttcaacagcatcccaataatctttgcaaatcgtacgcgagcatattcgataaacgtaacatttgagtcatctgtctttttgttgcaataattcgaatatctgatgccgtcgtggtatacaacattaaggaaaacatccccggtctcgcaaaactgttggtactgcggaggggtcggaacaaccgatattcgtttgagtcgccttaataatccaagttcatagcacattttcaagttcgcttctgttcgaaactggtgatttgtgtgtagacggaatgcagcttcggttttgatctcttgaagagccgacattctgtaaaaacattcttgctccctattgtgctctaattttctcactttctcatgatgctcatgcccagtccattgtaaatttccggaactaaagttctttgaatagtgtgatagaagtactcgaaccattgagttgacaatggaaataagctaccgtacagctcagtcattcttgcaaggtggtacaacacttgctgcaaaatagtaatgggtgttagttgacgacaatttccatacatgtactttgatcccattcaacatttccggtgctcgtttcacaattaaaacttcgatggatttgctgatttgttcaatctgtaaagaatggtctacttttttcaagcaaaaacaataaaaactaactttcaaatgaagagtctcgtcagtgattgattggggttctatgcaaagacgataaagtccatgaatgctgagaatgatagccgatgatacacctccaagttcaccggaaaatgcagctgctacaactatcgactcgaaaatctaaatgtgtgttcactttgcagaaattagctgaacgaatctttttaccagtgctttctcagaaccagtacactgtgaagctttgccggacaacgaacgaaatcgagatggaagcgaaggtgttgatgaaaaatccaccgattttgacgggaacaaattccatttccctttggagaataatgctgaaaaatgaacacgtttcgggagcattcgggcattactagtgacctgtattgatattgcttaaaattccttcttcaaaacaatgaaacaagtcaaccgggcatagatgcatatacaaaacatgcttgtggaaatgagaatgctggtttctttgacgaaggccatcgttcatagtcgaagggcacgatccggtgagattttcgcgtactataaagaggtgattatttttttaataatagttttcatgatgcttacgtgttgtatactcatcattgattttgcactcagtttcctggtttaagcaaaagttgcaagaacctgatgatcggagtccacactgattgtatacgattcgtcgtgcctgaaaccaaacacttgttttcaaaattctgaattttcatctcactggatcgtcatgattggcacacgtgagatccgctttccaggccactccctctgagaagaagacatgttcgtccatttggagcagaatccattgtgtaagtctatcatgaattttcgttgtcggatttttgaacccgatgaataacgctgctaaaatgagggcctggggagaagctcgatgaacgtcttcgagatccaaattgagtaaactatatggccaaatgttctgactgaaaaccaattaaaatttttagagccatcaaactaagatacttactttccatttttatgtactttgattccgtcgaagctactctcgaagtgcatccacatttcattatctgccatttcgctgagtagcttttttttaaagatacccttatttattggactggagctattatatccttccaaaatagttgttttagtcttcatcatgatattcgcaaaactattcaatataacttcgagccatttcttgagatctccgaaaattagttggcatttctcttgcatatcttcacatttgcatctgtaatgatatatttcagaaatttagttttataataaacctacagttcgatattctgcgcacataaattacatacttctacaagtgttagatgagagtcattcagtagcaattttctgagaatgctatcttgtgaaacattgtgaaaatgtagatatctcaaaatggctgctttcgagttggtagtagtgatgaggaaaaaagttgttctcagattttgatcgctcagagaacgacacagttgacttcgctcgtcgcatagagaagaatcgcgttgagtgtccaaataaaatgactcatcggtttcagcttcttgatcgatctcgtaatttcccacttcatcgaccggataacgaatttccccgtcttcatcaatgaatcctgttgtttcttcgtcttcgagttcatcttctacaccatcttccttttgtcgttcttcatctgcagttgtttccgtctcgaagttatcggcctgggtgcttgaatttgatggaccattgcttcccggctggtgagaaccatgattattgtccgtcgggtctgaaagtagttatttagtcccaataaaatcatttaaaaaatttacctagagcaactattgtcacgctttgaatcagaagactccggggtgctgaattcaaaattcttcgaactgttgttcttggatttctggccataatcctccgtttctagccgggaatgatacaaatctttgaaaaacacactggaattaacaattaacacatattgataacatatcacacaaaaaatacaataaaaaaggtcaaaaaaatgaaatatgtgaaatacgacgaagaaaaaacaaaataaaatcaataatcaatgttctgctagttagcagtgggtttctgctaattagcagtgctttttagctaattagcaatgacctgctaattagcagtggttctctgctgataaactatggctttactagcttttgctgattagaagtgattttctgtcgctctgccgtgactccagtttatctgagtttaaaaaaacatttttaaaaattgtctaattttgaaacgttattttgaaaaacttgatattttggtaattaatgatgaattcgcgattttatcagtaaatgcgtaaatatacggcaaaaaaataatctaaaaactgtgaaaagctcggcaaaaagtagggttgattccaaaagaaaacattttttttccgaaagaaattaaaacattttttgccaaaaacacgaaaaagctttgtgtaattttaaaaattgtgtaattttgaaacgttattttgaaaaacttaatattttggaaaattgtacaccttctcataattttttaaaagttgaattttagtgattttcagcaaaaaaaaaacggaaaaattgtattttttgccaaaaaaaccagaaaacacagaatacacaaactaaaaaatgtatgtgcgattttcaaaaactgaaaacatgccagaaaaacaaaaatagccaaaaaatccatttttacccaataaaaattcccattacctgacccaaaaaataatccattaaaatttcaggtcggaatccgcagaaagcgtctgaaaggtgacgcgttcatgtacaagaaggtgtgcgagaagattcttcaaatggcgaaaatcgaataa

SEQ ID NO: 29633 - DNA, 462 bp, Caenorhabditis elegans
caagtaatcgactatgaggaatggttcttcaacttgacatccaacaatgcgaatccaacaaatgtgaaatgggaagtactctatcaaagtgccaacatggaatatggtcttaaaggacaaatcccgacggagtataatcaaatgattgagagaatgaagactgatgatagtcttttcaacaaatattacgagtaagtttttttttagattttcagacataatctcttttatattttcagaaaccacaatcgtcgttcgatctacgatggtcgcgcgccatgcaacgatcaacaatgtcgaaacggttatctttgcgacgcccgtcaattccatcagacccagcagctgtgtaccgatttggagggaggaattcagaagccggagcccaaaaaaaataagtattctgcacgatttgccacatcaaatgaaagacggcgtggaaaggaggagtgcaagatttga

SEQ ID NO: 29634 - DNA, 1322 bp, Caenorhabditis elegans
atgagatattccagaatgaaagaaagccaacttctggttttcacactaatcgcagttggaataggttttgctagtggtattctcctacgacagtttgatttatcggataatgctcggaatttggtcgggtttcccggtgaaatattcatgcaggttctcaaattgatggttttgccattgatcttttcatcgttgatttcttgtgagttttttgagactgtgtatttgcctacatgcctacctatgtacctacgtcatactcaaaaaaatctcaaacctgcttgctttttacctgcatttttattcctggcttaggatcgcgtgccagcctacgcacctgccgcatgctttcatacgcacctagcatatgtttaacaactgtatgcctgcctacgtgcctacccaagactacccatgtgccttgttcttgcctgcctgattcatgcctttctacgtgtatgcctattcctgtcatatggcactcttgcctaaatgcgtgatcaatgcccaggctacctgcctagcttatgcctgcctgtttaagtgcctatcctaaccctgcctacactcctagaccgcgcctagtctaagcctgcctggcaaagtgcctagatcatgcctgcctgattaattttcacctaagagcctactctatgcctgcctacatgcctacttcagccaaccttacacattttccagccctcggtcaaatggacgcatcccgatctggaaaaatgagttttatagcaattgcctactacctgaccacagtaattattgcaagctgtatcggtgttgcaatggtgtttctattccatcccggggaccctgatatgagaagtcatcggcctgaggatgtagtgatacgagaggacaataatatatctgcacttgattctattttggatttgatcaggaacatgttcccacagaatattgtggaagcaacgatgtacaggtctcagacggcttttgtagttgtgcggaagaaaattttgaaaaatggcacgatcacaccggttttgatgcggaaaacgattaaattgactcaaggaactaatattttaggtaggcctgcgtacctacatgcctacaattttctttccaggactgattgtattttgcactggttttggaatagtaatctcaaaacttggaggcaaagtccgagtgatagttgaattctttatcgttctcgataaagttgtcatgaagtttatatcagttctaatgttgttcgccccattcggaatagtcagtttgattgcttcgagcgttttggacatcgatgatctctacaaaatggtcactacaatggcttt

SEQ ID NO: 29635 - DNA, 1015 bp, Caenorhabditis elegans
atgacggagttgtcaacctcaccaatcggtcttgttgaaaccaggtgcttttttaatttttttctcaattttgcaggtgaattttacgttcacctgctcgttttctcgctaaaacaaattagaaattggcaggggatactgtggcgtgaactgatcacatttgaaatttcacatgacatgaaatgtgtttctgtgggcaggaaaaaaatcgtttgaagtttcagggaaagtagcgaataaggaaaaatggaattatccagtaagaaaaataaaaaaaaatgaattatagggtgtatgtattccaaatataattactctataattggttttttatcgttttgttctcaagtcagaagtacatttaaaccgaatgatcgcgcataagggagcctacatgcctacatgcctacatgcctacattcctacatgtctacgcagtgaagatcgagtttctcgcagcaggagtcaattagaacaagttgaaagcaaaaatacttttttaaaaaaggcttctcagactgaaagctaaaaaattcgttttgtttgttttgtgcaatttcagaattgcaattccaaaaagaacccgtgattcaatgcctgtttttcagtaatttcttggaattttttattcaaaacaaaaattgtaataaatcaccaaactttcctggaagttttcgcaaaaatttcgtgaaagtttttataaaaataaaaattttaaatttaaattcaagataactaaatcgtaaataaataaataaatacattttaatcaaaaacgtgaaaacctaacacggggggggggggggctatcggaaaaaaaaatcaaatcgatttgaaaattttcaaatcagttttcaatattcattagccgagaaacgtcttttctagttctcgggaggaaatacaaaaggttagtttatttttccaatttttatctgaatcattttgattttcagaacagttctcgtgtaaacaattatcaagagttcaacatggctcctgcaaacagagaaaa

SEQ ID NO: 29636 - DNA, 681 bp, Caenorhabditis elegans
atgacaccgctcagcaaactttgtgcaggtgcagtcacgcaaaatgtgctgaaaaggtaacttttcggcaatttttagagaaaaataatgaaaaatcttccagctacttcctaacaccatcccaatttcgcagcttctcccgaacgatcacagcacttgaaaaatcacagaaatcaccctcaaaacaggaacatgcgctccagagatcgattttggaggaagttttggtgcatgagaaggcgaaaccgacgacatttggcggaaaagtcgctgaaaaggcgtcgaacacgtttatgtacacggcagttgtcgctggaatcggtctaattggtgcatttatctatgtgctcgccggggaatttttcgctcaagattccccgcagacaattttcaataagttggtttttcacttttttccgggaaaaaccaatttaaatcaaatattttttgcagagctctcgcattggtacgtgatgatggccgttgtcaggaaatattcggcgcctcaatcgccggattcggcgaggaaacgtcacgtggacgccgccgccacgtggcacatcacaagtacgagaaggacggaatgcagcggattcgggtgcttttccacgtgaaaggagaccgagatgagggaattgctcaagctgaaatggagcaacgagacggagattggcagtggcg

SEQ ID NO: 29637 - DNA, 1337 bp, Caenorhabditis elegans
ccaaagacctaatccgaaagcttctccgaactgagcccactgaacgtatcacaattgagcagacaatggagcacaagtggatatctcattaccgtagagttccagatactccattattcacaagttcaaatctgaacgatcaacgggaacaatggacggatatgcaggatgaaatggaggctacattggcctcaatgagagttggtcctgaaaatattcagattaaaagccttggagactcgaataataagcttttggcgaagaggagaaaaggtggagctagtccggtaagggagttaggattttaaaaaagtttttgtagaacaaaaaattcaaaaaaaatttaatgaaaaatttaaataattttttctgacacttttttcattattctagaaaaataatttttagaagaagtgaagcacctgaaattcactaaaaatgcaaatatattttttgaaaaaagttgaaaatttttcttttttttttaaatttagtaagtccctaaaatttgtgtatctatcagtgcaaatttgaaattatactactattttgttcaattaaacgcctcaattttttttttgaaaaaattgttaaattttgtacgtttttaagaaagcaggtaactataataaaacaggaaagtttttgaaatgtatgttgaaaaaaaaacgtttaaaaaaatgaaaagtcaaaaaaaaattcggaaaaaatgtatgatttttttggaaaattagtttattaaagaacacgttttttttcaattttacaaatttttttcaaaattttaactgaacaaaaaagaaatctatctgaaaaatttaagcctcacacactctgctacaggttcctctttatttcaaaaagccgattaatttatagagttttctaaaattaaaagtatatcgaaaactaataaagatattaaaaagttgtaaactgacaaaataatgtacgcaaaatttgctgcagtttgttagttgacaactttttgatatcatagttacccgaggagatacgagagttttaatttgagaggccagagatcaggcttttccttgcttaaaacactcgtaactctgcactgtaaagatatcaaaaagttgtacactgacaaaatgaaattcgtataatttcccattttttatcagctcgccaagatacaagtatttcaaaaaattagggcaaaacaattttttcgagtgtgcgagagataattagaaatatattatttaaaaaaaaattagaattaaatttttctcaattttcagaaagacgatcccatggacgatatcaaggaggaggaaaaggacgatgaagaggaaaaaatgatttcctag

SEQ ID NO: 29638 - DNA, 1498 bp, Caenorhabditis elegans
atgcgttacgctcttgccgcttgtctcctgcttctggcagcctcgtctttcgttgacgccaaggtatgggctttgaggggattttttcagcgaattaatgagaaattttcagaaaaagaagatcgctgatgatgagctcggagagctcctcgacaacatcgatgctgatgaggagaagaagagtggtgagtaaacttgaatacggtatatatcggcaattatcagttctattcaaaatctgccaactaacgaattaatgcaaatttcataagctacagcttgtcaaaatttagctatcgcagctgacacaagcgttagtgctgctcacatattttccaacaacttgttagctgacaacgttttgataacttgcacagtcatgtcccttttcaattttaaaccggtgaatctcaagaatcataggcgttactaaaagaactacaattagtttcttaaacaaattcttgataaaaccaaaagcgatccttcgatgcaccatgcttctaactttagttgacgagttataaaattaataaatatcctatagcaaagtaactaaaactttgtaaaacttcctacaaaattcaaaaagttacggcattttcgaaaacctaatcaattatcatccatcatccatagtcccaatcctcaagaaacccaaagagtttaaaacacattcgaaaccccttccgactgataatgatgatgattcataaactgccaatgtcccaatcaatcttgttgcatctggccagctagccgccagctcacggagccatctcctgggctcctgcagtgtaaagttggagaaccttcgaagatgctcgaagctttgtgcatttcacgtcatgtggtgttgtaatatgaaggctgctgcggcggcggcggctccgtgagcaagagaggaaaacgagcactaatatttatgggggaacttagatggggtagctagagatgaaagtgctgaaaatagatcaggcgtgggcaatttgtaggaaattttgtgagaaatcgtttgttagcggacaatttttcactaactttaatgattgccaaaaaattccggttttaaattaggctgccgaacttttgatataaatacctccgcaaccattagagctatcaaagagttttcaaccaacaattttaggaaattttgtgagcaatattttgttagttggcaatttttgaatagctttactggttggcgagctatacgcttcggcgatttcgccaacttccgacccctgtagctctgccagtttcagtactatcaaatttttgccaactggcaatatattacaaactcttggaaaatcattttacagttctcaaactcttctgaaaattactatattttgcagtagagccagccaagaacccatgcgaggaccaccagtgcggatggggaaaggaatgtgtcgtcggaaagaagggagaaccaacttgtgagtgcatctcaaagtgcccagaactcgacggagacccgatggataag

SEQ ID NO: 29639 - DNA, 3691 bp, Caenorhabditis elegans
atgggtcgcggcgagcacaaagagcacaaacgaaagcgttcccgttcaaaggaacgaaaaagaagccggagccgctcgccacgtggcagtcgtgagcaccgggaacatcgagacagagatcgggatcgggagagacgcagagaacgagacactgatcgggagaagacgagagatcgtgaaaagcagagagatgcagagaaaaagaaggaaaaagagagtaaaacggcgatttttgaaatggaagagtcacggaatggtaaggaattgcaaaaaaaattggcaaaaaaaatcgataaaaagccaaaaaaagcaaatttttgcctggaaaaatcccaattttcgaatttttgagttaaaactgggaaatttgaacgaaattcagcctaaaaataggattttaaggtaaaaaaaaaaaactttttaaactgaaaatcgcaaaaattagccgattttcatgccaaaagcatcaaaattcagctatttttgccgtttttatttttgctattttcatgcaatttctaatttttccggagaaaaaaagcgaaattcggacaatttttggatagaaaaattgaatttttgattcaattttcgccttataccgttgaaattcaaatttgtcaacagaaagagccgaaaattgttcaaatttaaaggtttttggttgaaaaattgaagtttaggcgatttttcaccaagaaaagtgcgaaattttcgaatttttcatgcaaaatccatagaattctcaattttttgcgaaaaaaaaactctaattttcacccagaaaaatgcatttttaagcgatttttccaattttccactgatttgtatggtttttgcaaaaaataatgtgaattttatgaacttttcatgcaaaatccatagagttcttacctttttcccaagaaaacataaaaatttaagcgattttttttcaatttccacctaaaaaactgaatttctagacgattttcacccagaaaagtgtgaattttatgtttttttcgcaagaaataggccaattttcaactttttgttacgaaaaaacctaacattttagtgagttttctcaaatttcacccaaaaaattgaatttccagccggcttttacccataaaagtgtgaaaaagcccaaattctcaattttttgcaaaaaaaccccttaattttatcaatttgcagacaccgaagaagttatgaaaatgaaagaagccgaattactacagggagtcgagcgtaggcgtcgtaatgtggagaagtggagagcccaaaagaagaaggaagagcttgatctacaatctgagcaatctgatgaaaaatctgagaaaaagccctggaatctggaggatgaggatgatgaagacgaatttgatatcaaaaatgagggaatttcagaggaaaacccggtgaaaatggaagaaaaagtcgaaaaaatggatacagacgacgaagaggaccctctggacgcttttatgaaagaaattgccactaaaaacgccaaaaaaaccggaaactccacgcaaaaagcgtctggaattgtgacaattgtgcaggaggagaagccggagcccgaaaagggacaagtgctggaaaatgaggataatatggatatggttattgatgattttgatattgagacggctgcagcatcattatgtcataaaggacgaatgttggcacaaactgaccattctaaggtctattatcggaaattcaagaagaatttctatattgaggtgcggcgggagaagttgaaaatcgggaatttttatattaaaattcggaaaaaatcaagaaaaattgaaaaaaaattatttaaaaaccttccattttgtgggaaatctggaaagtggacattttatacgaaattgccaaaaaatccgataaaccgggtttttttgagtcccttagaggctctaccaatttcttggttatttccaatattatctgtgtaaaaaatatatttctagcctaaaaatcttcaaaaatcggaaaaatttgattttctaagagaaaagtattaaaaatacatgaaaattctggaatttttcagatttgtctataaaattttgaatattttcggttgaaaacgccaaaaatcctgaaaattttctgaaaaaacacgtttttcagctcattttttccgaaaaaattgccaaaactgcaagcaaaatagaaaaaaaaaataccgatttccagtatgattaggtgtaaatttcatgaaaatgtgacttgtgtgtttctctatccgaattgatggtttgaatagtggtattctcggctgaaatatgcaataaataccgtattccaaccaacaattcggtgcaatagagcacatttgtcaccggggatgcggaagctatgcccaaattttcatttagcgcggaaatttggctgttttcgggtgtaaagtagaaaatttggaaatttcgacattaaaatttattataaaatttgaaaaaaaaacccataaaaacccttttttctgacaattttctgttttttttaaatcccagtttccgaggaaagctataaatttgggtacggtaactcggaatttatgatgtttttttttaaagctgtaaaaactgaaaaattctgctcaatttccaattttttgttgaaaacctagtggtttcttggattgttctaattttttaaatcaaaatcctgctgaaaattagaatttttagcttttccgcttgattttcggaattttttgtggcttttttcaggaaaaaaattcgttttttacggaaaaaacggcaaattcttgaatttttcgatgtttttcccatgaaaatcgaaatttgtattttttgtttttttttttagtaggaaattcgaatagttttttttcgtggcgagacccaactttttcagactttgcgcaaagtaggtcaaaattgaacggcaactgaactgaatttccctatatattgtctgtgacttgtgtgtttctctatccgaattgatggtttgaatagtggtattctcggctgaaatatgcaataaataccgtattccaaccaacaatttgtgcaatagagcacatttgtcaccggagatgcggaagctatgcccaaattttccatttttcggtgaaaaacttgaatttacaacgaaaatttgtagttttaacttttagaaaaagaaaaaagttgaattttcagaaaatgattcaattttctcgaaaaaagcttgaaattggacctaaaagttccccgtttttcagccaattttcgctaaaatttccaaataatttatctttttttttcagaccgaggagatccgacgaatgacaaaagccgaagtaaaagcctaccgagaggagcttgacagtataacagtaaaaggaatcgattgcccgaaaccaattaaaacatgggctcaatgtggagttaatctgaaaatgatgaatgtgctcaagaaattcgaatactcaaaaccaacatcaatccaagcacaggctattccatcaattatgagtggacgagatgtaattggaattgcaaaaactggaagtggaaaaacgttggcttttcttctaccaatgttcagacatattttggatcaaccggaacttgaagagggcgacgggcctattgcagtgattttggctccgactagagagttggctatgcaaacttataaggaagctaataagttcgcaaaaccactgggtttgaag

SEQ ID NO: 29640 - DNA, 1352 bp, Caenorhabditis elegans
gcaacagtgaacgcttacgagcttgtgaacaaggaaaatgtgctgaaagtctgtgatgagccacacccggaccttatgatcaaaatgctccattactgtacggatcgcaaattcttcgaggcatccaagattattcacgagtttcatcggcttggcttctcctcagacgatattgtatcaacgttgttccgtgtggtaaagactgtcgagctgtcgaaaaatgtgtccgaacagctgagaatggagtatattcgggtgagaaaatgggtggaaaatgagccaaaatgagcgctaaaagccgcccggggtgttctgaaaattgtcaaaaatccgcgttttttggagctttgttttgccgaaaaacgcgaaatttcgttgttagatcatcggaatatctaaatttcggcctttgtggctgaaaattgccgaaaaccaccggattttagggattggtagcctaaaattggcgaaaatcgtgaatttcgaagactagttgccggaaattgccgaattttagtttttggttaccggaaattgagtccggcaactcggcaactgaactgaatttccaattgaaatttccggccaaccgtaaaattgccggaaatgaaaatttgcggcaactcggcaatttgccggaatcgaaagtttccggcaaatcggcaatttgtcggaattgaaatttccggcaaaacggcaaaatggtggaattgaaaattttcgtccaattggcaaactgccaaaaataaaaaataaaatttccgccacattgccggaattgaattttgaggcaaaatgggaaaatagcggaattcaaaaatttccggcaaatcggcaaattgccggaattgaaatttccagcaaaacggaaaattgccaaaaatcaaaatttccggcaaatcggcaagttgccggtattgaaaatatccggccgatcggcaagttaccggaaataaaaatttccggataatcggtaaattgccgaaattgaaatttccggcaaattggcaactgaattgaatttcccggtatattgtctgtgacttgtgtgtttctctatccgaattgatggtttgaatagtggtattctcggctgaaatatgcaataaataccgtattccaaccaacaatttgtgcaatagagcacatttgtcactggagatgcggaagctatgcccaaattttaattttttagcccaaaaccattaaaaaaaaacaacgaaacaatttttcagcaaatcgccatgtgccatatgcgtatcgtgcagggactcacttcgaaacttcaactctcccgtctgattgccgatctgtgccgagtttcagcagcggcaacggctacgagtgcctaa

SEQ ID NO: 29641 - DNA, 987 bp, Caenorhabditis elegans
atgttcacgaattttggaaatttatttcagaaattttggaccaaaaaaatttggaaatttgcgcaaacttttttttctcaaattcttaaacaattttacagattcatttggcaatacgtattcccactccaattcgcgttaggactccttggaaattctctgaatttgtgggtgctcgccagtgatgaagtacccaatattgctagtgatatggtagtgattttgatttttttttaaatatattttgcaaattttaatttccagctagcagcagtttcattttgtgatttggcatttttactggttatgttacccaattgtctggccgcatttgacacaattgcatacaatgtctcgttcaggttagaaactgatactctatgcgcccgacacgctacgggttaagaaaatcaactcgcaaagtgtcggccgctgaatctagaaactaggaaagcaaaaacagcaaaaaaaactagttatacaaaacatataagtgcaataatgaagactatatttttgttagtttacaatctgttgtattcattttagctagagctaaagcggccgacactatatgggtcggatttttcacaaaactccaactacgaaatgtcggttgcttgaactccgcaagcttaaaaaagtcatatggatgttttttatcaaatctacaatatgaagatagtgacgttgttgcgcccgacacctcacgggtccgaaaagtagcccatgatgtgtcggctgctatatctccctttttaggtagagttttagcggccaacatctatgagtggatttatacaatgcaagaaaaactaacccgcaagatgtcggtcgctattactgtgtctataggaaagattttatctcagcgcccgacacctcatgggtcggtcgctgaaaattctgattcttcaggtatttctacctgaacaccaaacaacacatgtcagcagtggcgaactggatgagtgccgctgcgatttg

SEQ ID NO: 29642 - DNA, 1165 bp, Caenorhabditis elegans
ttagacaaaagttgggtctcaccacgaaaactactgtaccccctttttaatttgagcaaaccatgtgtgactataaacgaattcaaactggaaaaatttgaaattttcaggctccgacacaacaatattgttcaactattcgatacatacgacgagaagcagtttgtgtatcttgtgatggagctggtcaccggtggagagcttttcgatagaattgttgcaaaagggtcctacacggaacaggacgcgtcgaatcttattagacaggtgagattttcagttgaagagatcaaaaagttgtgaattagaaaattgtagaaaaatatatggtgtaaatctggcaaagtttttattttcaggtattggaagcagtcgggtttatgcacgacaacggagtcgtccatcgtgacctgaaacctgaaaaccttttatattacaaccaagacgaggactccaaaataatgatctcagattttggactttcaaaaaccgaagattcaggagtaatggctacagcgtgtggaacaccgggatacgtggcaccagaggtcctacagcagaaaccgtatggaaaagcagtcgatgtttggtcgattggagttatagcgtatattttgctttgcgggtgagttaattttgggggtatacctgggagatgtcggctgctggcacatcaaatgattaggaaaaaccactggcacccgttaggtgttggatgctaataaccctggaggtgtcggctgctcgacttaacgagatatgaagcagacgacaacccggcaggtgtcggctgcagacgcttctagagatcacaaggcgccggacatcatgagagcttatagcagccgacacctgccgggtaaacgtcaaattcacggtatttgcggaggttatagggaaattcaaattttttaagagaacatttctaatttccaacccagaaagtgcgcgccaatgacaaaattgccgaaaatttgaagattttccttaaaattttgaagtttttgaataaattttaatagattttcaaataatgaagcgaaaacttttaattgtttcagatatccaccattctacgacgagagcgatgcaaacctattcgcacagatcatcaaaggagaatacgagttcgacgcgccctactgggatcagatttccgattcgg

SEQ ID NO: 29643 - DNA, 4491 bp, Caenorhabditis elegans
accgcatcagttcaagcattaaccgacgtacaattatgggtgctggatcgatccgtattccaaatgattacacagagattgggaatggaacgtcactcgcagttgatgaatttcttgacaaaggtacgagaaaatgctataaaaaatgtggtgaaaattgcgccgcaatccacacctaaaaacggcctgaaaatgagactgaattggtccttaaaaaagaaaaaaaaagtttttattttaatcaactcaaataataactactctaaatcgtcctagaataacttgaaataagtccaagtcgggctaaattggcccgatttagactaaaactggcccgacgattaggactttaaaaaatatttcaaaaaatgcgtctaaataggcccaaagtatcatcatttgtgttaatctttgcgccggcgacccgtcatttgatgattagcgtcaatcaattttctgttgatttttcgatgatttcggtgattgaaaatgtgaaattcacgtgaattgatccccccaaatgacaaatgaacttttaatcttttttccctgtgaacgccgattttaacgaagaaaaatcacgtaatcgttcgaaattcgagagaaaaaacgcgatgaaggcatattcttgaccaattttgccaaaatttgaactattttgggtcccaccacgaatagctacagtacccccggagagattttcgtggcgggacccaaaaacaaacttttaaaaattgaggaaacctagtcatgattatacttaaacgaaagctctcttgttgagctgaatttgaatttaatacaatacactttgttatatagaaacgtataattttttgggtctcgacgcgaattaggaattttcaaaaaaatttgaattcgtcataaaaaagtctcattatcaatagattacactcctctttgacaaacgatttgacaaaattttggggtcctaccacgaaaatcctacagtacttactccaaagcgattttcgtggcgggacccaacaaactttcaaatttgaagaaacctagaaaccttgtcatgattatacttaaattaaagctcttggtgagcagtttctgaaattcgcgtaaaattggaaaaatttttgggtcccaccacgaaaacctccaggacatttcgtggcgagacccaacttttctccaaatttacggaattcaatcatgtttatactcaaatgaaagctctaaacgtgttgatttcgattttcgcgataattttttttttttttaaattgcctctaaaaacttccataaattatggtttaaactgtagatcacacaagaatcgacttcaaattgagcacacacacacacacacactatgattaatttgagctcattcactgtgctctgttgctcttttttgtgcggcggcggaacccgtttgagataatccaaattatcaacaaaaaatcgggggccgccgagccgtctgttcgggcggctcaattacagtaatacagaggaataggctccgcctattttcggcggggagctcaccgaatcgttttcgggctcattttaggcctattttctgatggcttattgttgtgcaccagttttggcgaaaaatgttcaagttttgaccgaaaatcgggaaaaaacggaaattatatttctctaattaactagctatcggagtaaaaatgaagaaggtttatgtggtgagttttaatcaaaaatctattgaaaaccctaataaaaaatgtcatttttaacctcaaaaggtcaaatttttcataaaaatcccgaccaaaaccttataaaaaccgcctaaaactctcaattttcaggtatcaatcttccaaaatttgtcggaagatcgcatctcaaagatggccgacgtcatggatcaggactattatgatggtggacattatatcattcgacagggtgaaaaggtaatttttcgggcttaaaattaatgaaaatttggaattttttgactttcaattgtcctattttgttggaaatttgagaaaaatcgaacttggaaaatctcgatttttcgcttgaaaaatcgaaagaaaggttaaactttttttttttaaaacaacattcgattttttggcttgaaaatcgttaaaaaaattcgacaaaaaataaaataaaaatgattaactactggaaaattatgcaattttgtcctaaaatttggaatttttgaaaaaaaaattaaacgcgaaaatttccctaatttttgagcaaaaatgcaaacttcaagaaaagttataaatttctgaaaaattttcgaatttagatttttccgaaatttgttagattttttttttgaatttttcagaaaaatactgaaaatttttgggctgaaattttgtaggtagcaataaaaaaaaaggaattttttctaagaatttcaaaattcctccaaaattcgtccaaaaatctttttatttttggcagaaaattcctgaaatgtaatgctgaaattttttgcgtaaaaaactcgaaaaaatgagaattttctaaaatgttcaaatttgaatgcctcgaatttttgtgcagttgttttcttataatcccaaaaaaattactgaaattagaccgaagaatatagtttttttgtttaaaaaatcgaaaacggcggcgttttctaaaaattcccattagaaaaaaaattatctaaaatttcaaattttttaaaatccttcaaatttgaatttttctaaaattttctattaaatttttgaattttgcagaaattcttacaatttaaaggaggactaacggttcggacgattttgaacgtatagacccaaaatgagctcaaatcaacgaatttcgtaatgaaactgctcaaaatattttcaaaaattttttatggcggttcaaaatttcaaaaaaaaattacactgcttttcctaaaatctcgaatttttctcatttttccgtgtcacatatgtccgaagttgaagccgataggtaaccaaaaatcatcgaaattggttacctatcggctttaaatgtaccttaatcaacgaaattaaatgagattaattaccaatatatgtaataaaaggacgataattccaaaaaagccaacttcggacagatgtgacacgaaaaaatgggaaaaattcatgattttagctaaaatcagtgtaattttttccaaattttgaaccgccataaaacattttttaaaaaattttgagcaatttcattacgaaattcatttatttgagctcattttgggtctttgtcacgttcgaaatcgtccgaaccgttagtcctcctttaaattgtaagaatttctggaaaactcaaaaatttaatagaaaattttagaaaaattcaaatttgaaggatttaaaaaaatttgaaattttagataactttttttctaatgggaatttttagaaaacgccgccgttttcgattttttaaacaaaaaaactatattcttcggtctaatttcagtaatttttttgggattataagaaaacaactgctcacaaaaattcgaggcattcaaatttgaacattttagaaaaattatcattttttcgagtttttaacgcaaaaaattacaatttcagcataacatttcaggaattttctgccaaaaataaaaagattttgcacgaattttggaggaattttgaaattcttttcagaaaaaattccaagtttgagcacttatttcaggattttttttaatcaggaaattagaattgctacctacaaaatttcagcccaaaaattttagtatttttctgaaaaatgctttttttttctttttctgaaaaagtctttacgttcgaaatcgtccgaaccgttagtcctcctttaaacgcttccgtttttccgtgcaggaatgcaatgtgacaagtgtttacagggtgacgcattcttcgtaatcaactcaggacaagtgaaagtcacccaacaaatcgaaggagaaaccgagccccgagaaatccgtgtgctcaatcaaggagacttctttggagaacgtgcactgctcggcgaggaggtccgtacagccaatattattgcacaagctccaggagttgaagtacttactttggatcgagaatcattcggaaagcttatcggagatcttgaaagccttaaaaaagactatggagataaggaacgtttggctcaagttgtccgagagccgccgagccctgtgaagattgtcgacgacttccgagaggagtttgcacaggttacactgaaaaatgtgaagaggctagcgacacttggagttggaggatttggaagagttgaacttgtctgtgtaaatggagataaggcaaagacgtttgcgctgaaggctctgaagaagaagcatattgttgatacccggcaacaggagcacatctttgccgagcggaatattatgatggaaacttcaactgattggattgtcaagctttataagacttttaggtacagcctgcagcagcaaaatacatcaaaaaatatttggtttttgct

SEQ ID NO: 29644 - DNA, 906 bp, Caenorhabditis elegans
atgccatcatcagacgattatgattgttccatctccgagctcaaactcctcatggagctccgcggagccgaagcgttggagaaagttagtcccctcctagaaagccgcgcattctaacttttccgaaaaaaacttccaggtaaatagcacatacaatggagtcgaaggactgtgcagaaaactcaaaacagatccgataaacggactgcccaacgacacaaaagagcttgaacaccggcggacggcgttcggcaagaacgagatcccaccggcaccgtcgaaatcctttttccggctggcatgggaagcattgcaggatattacgctggttattttattggtcgccgctttggtatcacttggattgtcattttataagcctccggcagagcatgctagtgagtttttgggtgtctttaaatggatcgttggtagttagtattacattaaaatatctgagcattgtaatggtgataattctacatatgtttgtctcttttgtaggaaaatatatgctatatttttttggaagagtagattacaattctacgcccacgcaaggctcaggtttttaatagcttcaattgcgtttgaactttctaagagataactatttggcccattcggcttggctttacgtaaaaatgacagctccacgcagttctgtcttttttaatggaaatttatgtggacctagtttttagaaatgaatttagaatagaagatagtgttgagtatgtgttatggttcaaaaggtcagcccccttcataaatcaaatttcccaggcaatgactcttcggaatccgaggctggatggattgaaggagtcgctatccttgttgccgtcctcgtcgtcgtcctagtcacagccctcaacgattggactaaggaaaagcagttcagag

SEQ ID NO: 29645 - DNA, 1052 bp, Caenorhabditis elegans
atggctctgagaaagtgtggaaacctgttcgtggctcgtctcgctggcacctcgaccagagcggcttccagtgagtagaaattgcaaaaaatgaatggaaaaaaaacgaaaaaatcgctgattaccggctaaaaatgaagaattgaacggaaaaaacgaattttaacctaaaaaagcataaaaatcgccaattttttcagcaatgaccgtccgtgacgccctaaatcaggctatggacgaggaaatcaaacgtgacgaccgagttttcctgatgggagaagaagttgctcagtacgacggagcttacaagatttccaagggattgtggaagaagcacggtgataagcgagtcgtcgacactccaattactgaaatgggattcgctggtacgggaaatcacgctggaaatcgagaaaaatcgagaaatgttgactcggaacgtcaaaatcactaataaatccccaaaaacagcaccattttttcgaaaagaaagtgtccaaatttactttaattttggatcttttctctcaaaagttcagtttttacactaaaaattggatttttcgaacaaatttcggaaattttcctaaaaacaattaattttcggcattttttattgaaaatttcaatattcactgcaaaaagctcggaaattacggagttttgatatttttcgcagaaaattccggttttatcaaaattttgtcgaaaattaagctgaaaaatcacattttttatataaaaatcagatttttcccaatgttatttgcagaaaagctctaagaccgcgcaaattcaatttttcagcaaaaattgtctaaaaagctcgaattttcgcatttttctcgatttattcaatttttagcaaaattttttcagaaaaaactgaaaattcctccaaaaaaatcacatttttttcaggaatcgccgtcggtgctgccttcgccgggctccgtccaatttgcgagttcatgacattcaatttttccatgcaagccatcgatcagattattaattcagccgcaaaaacatattatatgtccgccggaagg

SEQ ID NO: 29646 - DNA, 920 bp, Caenorhabditis elegans
atgggcattatgaagacgactacattaaaagttggtgtttttcaaattaaacaatttaaatttaaattcagctcgccgagagctttgatttaagaataatcatgacctagtttgatcaaaaaagttgggtttcgccacgaaaactacagtaatccagaaggactttgcggtgagacctttttttcaaagtaagtcatgattatacttaaatcaaagctctcagtaagctggaatcaaattttgtatttagaataaacccaacgcaaagttttcgtggcgagacccaaaaaattaataatttattcagctgaacctacacacctcattgaaacgattcaaagaagatacgataagcgagtgagaccgtttgctgagtcgaatcggccggtaatagtgcacatgacaattgtgctgggtattttgaccgaagttgtaagtttttgtgtcaaaaaatttatctgaaactgattttaacacaaagttaatataaaatttaggttcccacatttcaattagcctactcataaatgcctacccaaaagctctcaatgtcgtaagatatggtgtttgatacgcaatcaaactcggtgttcgcgtacttttggagctacagtaaccaaaaatttttaatttgagctagaggcaactagttttttgtgtcttaacgaaattttgacgacaatttcggtttttgcaataaaaactcaaaattttgattgcaaatcccagtttgagcagaatttcagctaatatccaaattttcagcgagaaaaccaacaagtcgcctcatttgtcatatcgcatgtacaaaagtggagggatccaaaactagcgtggaatcctgcagatcattcaggcctcacacaggtcgtcatgccaagaagcctagtttgggttccaaaattgtttatttacaacag

SEQ ID NO: 29647 - DNA, 295 bp, Caenorhabditis elegans
ctctccctggaaacaatcatgagtagtttgtgcgtccaaggcaaaccgaaaaacaccgtatgccgcaatcatcatccctttgagctttctctcaacaccgctgttcgtcaatatccactattcagctcactttacggatgtcgtgccggtgatcggatgtttgctaagcgggtaaaactgatggatgtattctggatgataagtgatatttcaggaagagttctgtaagccgctgggtggcgaggtaaacttggaagactataagatcaaacatgaaacggaggacgttggttga

SEQ ID NO: 29648 - DNA, 863 bp, Caenorhabditis elegans
actccgaccactgtcatatccacaaacagacgtgtttctcgtatgctttgccctgaacaatccggcgagttttgagaatgttcgtgcgaaatggtatccagaagtgtcacatcattgcccgaatacgccgattattttggttggaacgaaagctgatctgcgtgaggatcgagatactgttgaacggtagatttttggagaatttgagagaaaaattgaggaataaagtgaaaaatttgtagaaaatgatgaaaaattgccaaaaaattcgaaaaagcgcataaaaattcagaaaatcacttaaaaattgaaggaataccgccaaaacattagaaaaatcattagaaacggcaaaaaaatgagaaataaggaaaaaacgcatcaatttcaggaaaaaaaattgcaaaaattgtatgaaaagttgcgtaaaatagcacaacattcacataaaattttggaaaaaaatttgcaagattttgagaaatttgctcaaaatgttgaaaaaaaaattaaaattaagataaatcgctaaagaaatgtaaaaagttgcactaaattcgcataaattgtggacaaaagtttgaaattttgaaaaaaagcacattaaacaaaattggcttaaaatcgagaaaacttgcaaaaattccgaaaaaaaaaattttttttgcaggctccgcgaacgccggctccaaccagtgagccaaacccagggctacgtgatggcaaaggaaatcaaggctgtcaagtatctggagtgctcggcgctcacgcaacgtggtctgaaacaagttttcgatgaggcgatccgagccgtgctcacgccgccacaaagagccaaaaagagcaagtgtacggtgctctaa

SEQ ID NO: 29649 - DNA, 1222 bp, Caenorhabditis elegans
gtattcgacaactactcagcaaatgtgatggtcgacggtcggccgataaatctcgggctctgggatacagctggacaggaagattacgatcggtacgggcagcgggaaaactgaaaatgctcgaaaaaactcaggattatgggttttttcaataaaaaattgctcaggattatgtgatattttcctcaatcaaaatgtggaaaatatcacattttagaaaatttcatccaatttttcataaaatgacagtgattttgaagctattttgtggtgaaaaactcgaaaaacatggaatttttcgcactttgcactaaaaattaccccaattatcaatttttcaacaccaaaaaaatttgcagactccgaccactgtcatatccacaaacagacgtgtttctcgtatgctttgccctgaacaatccggcgagttttgagaatgttcgtgcgaaatggtatccagaagtgtcacatcattgcccgaatacgccgattattttggttggaacgaaagctgatctgcgtgaggatcgagatactgttgaacggtagatttttggagaatttgagagaaaaattgaggaataaagtgaaaaatttgtagaaaatgatgaaaaattgccaaaaaattcgaaaaagcgcataaaaattcagaaaatcacttaaaaattgaaggaataccgccaaaacattagaaaaatcattagaaacggcaaaaaaatgagaaataaggaaaaaacgcatcaatttcaggaaaaaaaattgcaaaaattgtatgaaaagttgcgtaaaatagcacaacattcacataaaattttggaaaaaaatttgcaagattttgagaaatttgctcaaaatgttgaaaaaaaaattaaaattaagataaatcgctaaagaaatgtaaaaagttgcactaaattcgcataaattgtggacaaaagtttgaaattttgaaaaaaagcacattaaacaaaattggcttaaaatcgagaaaacttgcaaaaattccgaaaaaaaaaattttttttgcaggctccgcgaacgccggctccaaccagtgagccaaacccagggctacgtgatggcaaaggaaatcaaggctgtcaagtatctggagtgctcggcgctcacgcaacgtggtctgaaacaagttttcgatgaggcgatccgagccgtgctcacgccgccacaaagagccaaaaagagcaagtgtacggtgctctaa

SEQ ID NO: 29650 - DNA, 1813 bp, Caenorhabditis elegans
cgaaagctttggctcaaaagcggccaccaacatcccacgctccaacaatttcgtcgtcaccgctcaaaacctacagcaatattttgtaatgcaggccctgcctcaggcgatcgctcgcctacgccgacagtcaggcgaatgccacgaagacgttcaacctttccttctcgacctgattaagttcaacgacaactcgacgaatcgctactcggatgatttctaccgtgcggcgctgtacaattcgctggcttccagcgtcttcccgcatgatgctctgccatgccacgtggaattacctgagaatctgagcaacgatgttcgggtgctcatcaaggagttcacgtacgcgttaaatatggatacggtcagcccgagctggggccgagtcgtcggagccgccgcgctcaccggactctatcagcttcagaaatgtggatatctcccgctggactcgcaacttttgtggacattttcccatccgaactgttgtgttcaaatgcgacgatgtgccattactctgatcattgatcggattgttaatgatccgcacgcggcggatactcggatgctcgacttgtcaaggatcctggagctcgccgagctggaacaagatccgtcgattcggagaatgattccgaggctgttggcgcaaactccgccgtttggcacttataataagtttgttagagtggggaaaaaagaaaatttgtaaaaataactgaaaaaattaaaaaatttcgacttttgttttttgaaatgcaattctgagagccaaaacggcaaattatttggaaaaaaagtggtttttgaaaaatgttcggaaattttttcaaaaggtttcgagctccagtggaactaaaatgggaatttatcgaaaaaaaaatttttttaagtcattttctgcactttttccggaagaaaaatacaatttttggaagtttttcaaaacaaaatttgtttaaatttggataaaaaattggaaaaatcggatttttttttaaattagaaaattattgagaaatgccaaaaattgataaataatggtaaaatttcgtttaaacatttaaaaatagacaaattaatttttgaaaaacccaaaaaacctctaaaaatttggaaaaaaattttttagaagaacctacagtaatcctgggccgtggaaaaaactcggtggccaagtttttccatgtactaggccacgaggctgatagtaaaaatgtgaaaaaactgaaaattttcagaaaaaatgtttttttttgcagacattttaaagcctcttttttaaaaattaattctgtcaatttttgaatgttttacgggatttacgggaccattgtttattaacattttctcatttttaaaaaattcgattttttccaatttttacaaaattgctaaaaattacaaaatttgaacagatttttttaagttattcaaaaataaaaaataaaaacaaatccaaaaaaaaacactgtttatttttgaaattttcagcacaattttcggctcggaaaatgccgcgaacaccgctgaaactgcagaaagactatggaaactgtgcacaaattcgtcaattgatagctgtattcggagtggttttctggatgtctactactctttatatgctctcggagcaccaccggctcttggtggacccgaggagtctgttggaattcatcgagcctacgtcacagttccgaacgcggcgagcacatttgccacgtcacagtggcataatagtggatacgaggcggcacgcaggtcaccaccgagacgagattttggagatgaaactatgaatttgatgcaataa

SEQ ID NO: 29651 - DNA, 523 bp, Caenorhabditis elegans
atgaatttaccttccaaatttcatcaagttactattacggtttgtattcatatattatatcataattgaaactcgttttcaggacccgatagccggcgcgggcattactttcactattccaacccgttatgtcaaccttaaatttttgaatgtcggcgctcaggggattgtcgtgtgagtttaagctatgtttatgtttatatcatagaacatcactgagccacggcgcgccacccaacgtaagtggacacggccgtcgacgagcccaaatggccgcaaaatcttacatttcaaaatatgagggaatccagaactccgtgttcgcggttaacagtagaaactagaatggatcaaatttgaagtgagtgtttcattttttttgcttacatttagaatggccgatgacctagtgacaacacaacgcgtagcaatcaagaagatgcaacaaccatttctgttgacaatgagtgcaaggcgagcatatcgagaatttatactgctaacgactctgaaacacccaaat

SEQ ID NO: 29652 - DNA, 296 bp, Caenorhabditis elegans
ctggctccgattgtgcatcaaatccaaatgggaagagtgtatcccgaaggcgctggactttgtcaactctcaaggccgcctcaagttctgcaggccgatttacaggtaaggacaagctcaaaagcatcaaaaattttcacttctataattccagagacctcgctcaatggccgattgccaacaaaaaagcccgtgacgtctacctcaagggacgtagccaaatgcatccgatcaccgccgaaatgatcgccaaggaccttcacattcgtcactcgactcacacagtttgcttctaa

SEQ ID NO: 29653 - DNA, 799 bp, Caenorhabditis elegans
aacacatggtcacctcgtttccacctacgaatcagcttcggttcggcgattcggtgcgggaagagttgataacattcgggcgaacacacaagaggcgctggaatgggttacggcaatggcgagcaagaaggagtctaaagagagaaagctggaattatttaagaaggctgtgctcaagcaggtcaaggtcacgttggaggtaagaaaaacggaacacttagcctaagcctaagcctaatcctaagcataagcctagcattaagtaaggcaatagctcttcccatattttggctctggccctgcccataccttgttctttcttggctctatctccgcttatatcttggccccgcctatgtcttgactctagctccgctcaaatatatatcggctcagactccgcctatgtcttggcatcgccaataaatttaaagtttttcagaacatcagcggctacggtgtcgacaatcatctttgcgccctattctgtctcgcccgggaaagggaagaaacgaccggagaagatataccatcactgtttctggatcctctgtggtctgaagttatgcgattcccattgtcgacaagccaagtcacaacctctctggatatccctgattgctacctgacgtatggtgcagtggtccgcgatggctatggatgcccgtacaatattcaaccggatcgagtgatttttgcgccgactgcgttcagaagtgatccgaggactgatttacaacattttaagaaaagcttggctggagctatgagagatgtcaaggagctgctgagcaactga

SEQ ID NO: 29654 - DNA, 316 bp, Caenorhabditis elegans
ccgcgttaaacgttcataaggatgatcctctgcttcaagtctacagtactactcaagaaaaacttgacgcagttacttctcaactggagaaggaagtcaagaaagtaagtccctccagttttacaaagtgaatagtggaatgtttcagtccaaaggttacgagcgagaaatcgaggatctccacggcgaattcgaactggatcgtctcgattatctagacacaattcggaagcaggaccagcagttgaagctccttatgcagattatggacaaaatccagccgatcatcaagaaagatacgaattatagtaacgtg

SEQ ID NO: 29655 - DNA, 759 bp, Caenorhabditis elegans
atcaacatgggaatgtgtttcgacgaagttgaagtcgaggaaatgatgaatgaagtggattgtgatggtgaggagattttttggactttgaagtttcagaaatctggatatttttcaatgatgtcattatttatgtaattaaatttttaatggtggtgtagtcgaaattcttttattgctttattaaactcgaaactgtatgaaaacaccgagtctcaaaatgaaatttcttcaaaacttttcaaaaaaaatttatgacggctcaaaaaatgacctgaaattaattaaaatttaatttataattttgcaaaatttggtaatttcttgtgatccgtagaccttaaatttgaaatccggtgttttaggacaatatttagtctaataaagcaataaaaattcggcttcatcacctttaaattttttttcattgaaataaaaattgagttttcaaataattctcaaaaaaatgtttttgagtttgggcatttttttcttcttttttttttaaattcaaaaaaaatgatttctaaaacaaatgtgtgatttcaaaaattcccaaattttatttttattacatttttgaaaaattttatttgaaaaattttgcattacaaaaccaagaaaacggcggagcagatttttaaaaaattcgtgcttcgcaacaaacattaatttttattttattttaaatttttcacacttattttttcaggaaacggagaaatcgactacgaggagtttgtcaaaattttcagctaa

SEQ ID NO: 29656 - DNA, 488 bp, Caenorhabditis elegans
accagtcatcgagatgacaattccctcttcagtcgaccgaaccattgtggatagtgctgatggtcacgtcgtcctcctctttacccagtacactcccttctcaccgaaagacggtgaatggacggaagaaaagaagacagaatacgcgaaacacgtcttctcggagatagacgcttatgcaccgaacttttcatcaagtgtcataggctatgacatcttgaccccacccgatattcagaacacttttgggattactggaggggtaggtcccatttttaaggctcaattttcaaaatttgcttcagaacatcttccacggatctatgagccttgaccagctgtacgtgtcccgcccgatcagcaaatggagcaactactcaacgcccatcgagtccctctacctctgcggaagtggtgctcacccgggaggtggtgtgactggagcccccggtcggttgagcgcacttcatgccctcaaacatttctaa

SEQ ID NO: 29657 - DNA, 965 bp, Caenorhabditis elegans
atgggaattaaaaaaatagctcgggagcttggtataaaaggtgtaaaattcttcaaaaagaccgcttgcggtgggaaacgggaaggttctcatgatatcaaattttgcaattttcagttcgacgacttctctttgagggccgaagacagcctgattgtctacaatggagcaacaccatcggcgacagttttggcgtcgtgagtttcatttttttcgttttttattgattttatactaaatccttcattactaaaaagttaaattttcagattctcggggaacctcaccacgaaaaaatacatcacctcttctaccaacatcgtctacatctacatgatgactcgcaccacctccagctcccgtggattctcaatttcctacaaacgaggttgcgatctttctatgacagatccccacggagaaattatctccccggggtacctggcaactgagtacccgaacgatgtcacttgcaccttcaccattgagattgagaatttgaaagctgaccgaagcttgagcatcatcccaaatcgattcgacgtcgctgatgatgactctgtgaggatcttcgagaatttggtaaaagggaaggctcttcacgagagtgatggatttacggcaaagtcgaaaccggagaagcagattgattcagaggcaaatcggctgcagatggtgttcaagtcaagcgcatcgagacaggctatgggattcaacttcagttattctattggttagttttcaaatgctaaactggcttctttttaatggatgactttcagattgcccagctttcccaacagttccgatggttactctgtccaccaagcaaagatctgtgaacaccaaggtcactgtggaatgccctattggatttgagtttgcctctggagaaggtgtctcaaaaacagttgagtgtttgattggaggtacttggtcgcaatctcagatttctacttgtcagc

SEQ ID NO: 29658 - DNA, 3540 bp, Caenorhabditis elegans
atgtatgtgtttatttatgaatgggagtgtgaacaaacaggcggattaaaggattttgaatggaattctagttggaaaatactgggtaaattcaaaataactggaatcaagtaggcttaaaagaactgaattttcgaagtttggaggctctttcaagcaatattggcgggatactcgaattttagtctgttttacagaacttgaaaagtgacgctgagtttgcgagtttaccaacaattttgggaagaaattaactttttcaaaaaatgtgtgctgaaaatttaaattctgggaatatctaggaaattctggaaatatctaataattttcctaacatttgggaagttggcacaaaaatttgtgtatgatattttttagggatctcgaaaatttgtaaagaaaaactctgaaacacctcaaactttttgcttttttcaaaaagagaagaaaaaatcgatggatcgaaaaacaacacaagcagtaacaacacacttcaaactgctgttctctcctttttctccccccgatcacctctctcccagctgtctcccactctaattttccctcattttcactagtagttagaggtcatttggacgggaaaaagtagtatggttaatgaaaaggaaacgagaagactgagctcttatcagttgatcaatttccatttcacaacatgttttttagttttgaagttgtttgttgcattttgttatgaaattgttgagatagactactaactttcaggtaggtttttcccaaaactacagtaatcccacagtacttccacagtacccctacagtaccctatacactactcttgcagtacacctacagtactactacagtactactgcagtacccctacagcactcctacagtacttttacagtacttctgcagtactcctccagtacccctacagcaaccgaccacatccctccactaaccggaacttataatcccatgaaaagacgaaaacaaatttgtccaaaactacagtaatcccacagtactgtagtatccctacattactaccacagtacccctacagtactcctgcagtactgccacagtatcattacagtactcctactatgctcctatagcacccctacaaaactcctacgatgccccgatcatatgtattcatccactaaccctaacccaatattctttcaaaatccgaagtctgccttctcttgtgaagtgtgacgtcacagattacaaactataatttcccaattttcagatgactgtgctgactccccgtgtgctctcaacgcgacttgcgtcgacttgatcaacgactacaagtgtgaatgtccgacagggttcagtggtaagagatgccatattaaaggttagttcccatttgaaatctttaggaatacctaaaccaaacttattttcagaaaacctctgcgcatcttccccgtgtgttcacggactgtgcatcgacaaactctactctcgccaatgcctctgccaaccgggatggactggcgagaactgtgatcagaacattgacgagtgcgcggcttccccatgccagaacgatgccaaatgcatcgacgagatcaatggctacatgtgtgaatgtgcggatggttatgaaggggttcactgtcaacatcttgtggatcattgtgccaagcagccatgtcacaataatgctacgtgtaccaatatgggcgctacctaccattgtgattgtacgttaggctttgatggggtccattgtgagatgaatattgacgaatgcgctgaaaatcaatgtgacaagctcggaacggaatcatgtagagacgctgttaacgactttaagtgtgtctgtaagcccgggtacactgggccacgatgtgatgtcaagcaggatcaatgcgcagactccccatgtctgaacgatgctcaatgcgttgatatgggtggagcttacaagtgtgtctgcaaatcgggatggaccggtccgaagtgtgagcaggataatgggagctgcgccgccaagccgtgcaggaacaatggattctgcgtgagcctcgtcgccgactacttctgcgtgtgccctccaggagtatccggaaagaactgcgagtcggcgccgaaccgatgcatcggccaaccttgccataatggtggagagtgtggagatttcgggtctcatctggaatgcgcctgcccggcgagctttaccgggaagggatgtgaattcaagaacactggatgcaagacttgcgagaatggtggaaagtgtgcggaagcagctggaggtctacagaaatgcgaatgctcacctggatttactggagagcgctgcgagaccaacattgacgagtgctccaccgcgcattgtccttctggagcaacttgtgtcgatcaggtcaacacgcatatatgtgtctgcccattcaacttgacaggagtccactgtgacaaaatgatcaataccaactatgaccttcaattcttggatccattccgaccaacatctgcatcactctacgcaccgttccgcatagagtcatctgccttatcagtagggctatgggtgaaatttgagaaacctcatcaacacgcggcattcttttctttgcatagatttgataactcaagtcaagaatatgtgagagtatcttctaaccttgtacggctaactctgttccctggactagctgccgtggaggttccactatctagcagtcaacacttgaacaatggaaaatggaatcaccttcttatcacctggcagtccaagactggagcttactcggtcatctggaactcgctgagaacctattctaacaatggatatgctactggaaagcaactagatgttatgactggaattaccttaggctccactgcacttccatcctttgtcggatccatcgcaagagttggggtatggaatagagttatcgatttcgaggaggaactccctttgatggttcaacactgtcagagatccgaggaaatctacaaggggttgctagtaagattcgagggattcacaaagatcatcggaagagttgagcgaactcataaatcaacatgtggagtcgaggagaagtctgctatgcagaagagtcaatcgcaaattctcatcgaagactgcccatctgacatggtgatctcctctatggaccgagagacaaatgtaacctggccggaacctaccttcctgagctctaactccaaaatcgagaaaatcgagaaaaatctgaagcaaggacagatgttcacatggggagagtatgatgtgctgtataccgccacggataatgctaccaatcaagctcaatgcaacttcaagatccgagttggaaaggagaactgtgtggacgcagcggatccagtgaacggagtgcagtcgtgtgagagctggggaccacaattgaagtacaaggcctgctcggtagagtgtcgcgatggattcgagtttccgaggtctccggcggtattctacacgtgtgcggctgacgggaagtggaagccgaataagagcccgagcacaatgttcagatatccacaatgtaccaa

SEQ ID NO: 29659 - DNA, 320 bp, Caenorhabditis elegans
atgtttgaggccaagctcgccaacgccggactccttaagaagatcgtcgaatcgatcaaggatctcgtcaccgatgctccattcgattgctccgagacggcgatgagccttcaggctatggactcgtctcacgtcgcgttggtttcgctcaagttggaggtaaaattgggaaaaatgaagaaaattagctaattttccgtgttcaggtcggccttttcgacacatatcgctgcgatcggaccatcaacctcggactttcgttggctaatatgtcgaaggcgctcaagtgcgccaacaacgacgatacctgcatgctgaag

SEQ ID NO: 29660 - DNA, 1354 bp, Caenorhabditis elegans
atgacgacgcccagccgtagacgtttgatgagagattttaagaaacttcaggtgagttttgaaatttttggcccgaaaatttggctttctttgaacattagagaacatttgcaacaaaaattggttttttccagaaaaaattagatatttttgggatttttgataaatttctcgtgaaatttttaaaattaaaattgccaaaaaatcgccgaaaatatccataaaaacggccgaaaatgtccaaaaaatcgccgaaaatttccaaaaaaaaatcgccgagaattttccaaaaaaattgccgaattttccaaaaattcgtcgaaattctccgaaaaatcgcctaaaatttcaaaaatatcgcttaaaattaccaaaaaatcatcgaaagtttccaaaaaacggtcgaaaagcacaaaaaaaatgcccaaaatttccgaaaaatcgtcgaaaatatccaaaagattgctcaaaattaccaaaaaaaaaaaaaaaattaccaaaaaaaatcgtcgaaattactgaaaaatcgctcaaaatttccaaaaaatcatcgaaagttcccaaaaaatcgccaaaattatcaaaaaatcgcctccaaaaaaattgccgaattttccaaaaattcgtcgaaattctccgaaaaatcgcctaaaatttcaaaaatatcgctcaaaattaccaaaaaatcatcgaaagtttccaaaaaacggccgaaaaacacaaaaaaattgcccaaaatttccgaaaaatcgtcgaaaattaccaaaaaatcgtcgaaattaccaaaaaaaaaatcacttaaaattaccaaaaaacggctcaaaatcattaaaagattgctcaaaatttccaaaaaaaatcgctcaaaattcctaaaaaactgaaaattttccaaaagaaaggtttcttttaatttccaaaaaaaatcgctctaaatccccaaaaaaacgaccaaatctttcaggaagatccaccagcaggagtatcaggtgcaccaacagaagataatattctcacatgggaagcaataatttttggaccacaagaaaccccgtttgaagatggaacattcaaattatcactggaatttactgaagaatatccaaataaaccgccaaccgtcaaatttatttccaaaatgttccatccaaatgtgtatgcggacggatcaatttgtctggatattctacagaatcgatggtctccgacgtatgatgttgccgcaattctgacatcgattcagtcgttgctcgacgagcccaatccaaattcaccggccaactcacttgccgcacagctttatcaagaaaatcgacgggaatatgagaaacgtgttcagcagattgttgagcag

SEQ ID NO: 29661 - DNA, 670 bp, Caenorhabditis elegans
atggctctcgtcggtgtcgacttccaagcgccgctgcgcattgtctcacgcgttcagtttggaattctcggcccggaggagattgtaggcggaaacccccgattttaacccgaaatttatgatttcttattcagaaacgcatgtcagtggctcatgtcgagtttccagaagtctacgagaacggaaagccaaagttgggcggtctcatggatccaagacaaggagtcatagatcgtcgtggaaggtgcggtggaaatctgaatttttaggctgaaaattgcagaaaatagtgaaaatttaactgcaaactgctgaaaatgataatttatttgctttttcagatgcatgacatgcgctggaaatttgacagattgcccgggacatttcggtcatttggagctcgccaaacccgtatttcacattggattcctcacaaaaacgctgaaaatactgcgttgcgtatgcttctactgcggacggcttctcatcgacaaatccgctcctcgagtgctggaaattctgaaaaagactggcacaaactcgaaaaagcggctcacaatgatctacgatctgtgcaaagccaagtcggtgtgcgaaggagcagcggagaaggaagaaggaatgccagatgacccggatgatccgatgaatgatggaaagaaggtcgcag

SEQ ID NO: 29662 - DNA, 287 bp, Caenorhabditis elegans
attatgcacgtctcggattcttacgagctatccttcacagttctccgtccacgaatgattgcaacaccagagaattttgaaattgtaaagctcatggagaacaactacaaagggctgatggtcgcgagtccagatccaagtgagttcaagtgccttaccactgaaaaatctgtacattttcagaccgtggtcgtcatttgcaatctgctgatgttccccagccaacaccaccgtctgtgcagctcgttccgcctgtcacaaagccagttgaaattaaaaagcagtga

SEQ ID NO: 29663 - DNA, 409 bp, Caenorhabditis elegans
cacgacgagtctggaaagattacttccctgccgtggacgccgtcgtcttcttgatcgatgtggccgacgccgaaagaatgcaagaaagccgtgttgagctcgaatcgctgctccaggacgagcagatcgcttccgttccagtgcttattctcggaaacaagattgacaagccaggagcattgagtgaggatcagctcaagtggcaactcaacattcaacatatgtgcaccggaaagggttggtttttgattggaaattatcgcttgaatttatttaaaaaacgaaaatctttataggagacgtttcccgcaacgaaatggcttctcggccgatggaagtgttcatgtgctctgttcttcagcgacaaggatacggagaaggaatccgttggcttggacagtacctgtaa

SEQ ID NO: 29664 - DNA, 527 bp, Caenorhabditis elegans
atgtcgggaattgctgcaggacgcctcgcggaagaaaggaaacactggcgaaaggtgagaattttatcattacatggcaagtcggggcgatttgtattacaaaaccgctttaaatcggttaaattctaaaaattatcgaaaaatagtttgttttcatgcccaaaactcaacattttcaggatcatccattcggattcattgccaaaccagtcaagaacgccgacggaacattgaacctcttcaattgggaatgtgcaatcccagggagaaaggatacgatttgggaaggcggattatacagagtatgtgaagctagaattcggaaattatcatttttcgttaatttattgagctataatattcgtgaactgtttctctcaaaaactgctatttggaatacaacgatatttataaatctaattcaattttctttcagattcggatgctcttcaaggacgatttcccgtcaacgccaccaaagtgcaagttcgagccaccactcttccatccaaatgtgtacccatcag

SEQ ID NO: 29665 - DNA, 1472 bp, Caenorhabditis elegans
aaaatcgcgttcgaaggaacatttgaagctcaacaactgcacgataccaattggatcgttgccaactgcacaacaccagccaacatctatcatcttctccgccgtcaagtaacaatgccattccgtaaaccggcagtcgtcttctcaccaaaatctcttctccgtcacccgatggctcgttctccagtcgaagacttccaatctggatccaatttccaaagagttattccagaaactggtgctccatctcagaatccaccagacgtgaagcgagttgtcttctgtactggaaaagtgtactacgatatggtcgccgcccgtaagcacgttggaaaggagaatgatgttgcactagtcagagttgagcagctctcaccgttcccatatgatttggtgcaacaagagtgcagaaagtatcaaggagccgagattttgtgggctcaagaggtatgaaattttagaaaattgaaaacttttgcaaattgtgctgatttaaatttagaaaaatagaaaatttgctttgtaacttagttttctgaaatttcgactcgccaatatttgtgtctcgccacgaaaagttaaatttttttttcctattttcggttctgggagtctctagaagacgatttttcgatttttctccgacgttaaaatttgcaaattttatagattttcacagaaaatttacggatttatagctttgatcccaaaaatatattgttcccggtcccgacacgaccgatttttttaattgcaataaagtgtgtgcgcctttatggagtactgtagttccaaactcgtttgtttctcggaatttgctttgatgatgtctccgtttcctcgaaatcggctgaaatgagacgaaaagaatatcccaatgcgtgaatttgtcgtaatttttgcattaaaaaaatacgatacatggtctcgacacgacaattttttgttaaaagctaaaaaagatgtgcgcttatgaacgggtgctgtagtttataaccgaaacagttgaaaaactaagaaatcgatgaaaattccgcagaagaaacgtttgaaactacggtactctttaaaggcgcatatcatacatatcacattgataaatcggccgtgtcgagacctggaatattatttttggtgcgaaaatcttaacatttcgcatctgtgtaatatttttgctgtaatttttaaaattgtaaaaaattgaaaaatctaaaatatagaccctatcgaaatacaatatttccaacatgaaaattttccaggagcacaagaacatgggagcctggtcattcgtgcaaccacgcatcaactcacttctctcgattgacggtcgcgccacgaaatacgctggacgtcttccatcctcatcaccagctactggaaacaaattcactcacatgcaagaacaaaaggagatgatgagcaaagtgtttggagttccaaaatcgaaattggaaggattcaaggcctaa

SEQ ID NO: 29666 - DNA, 357 bp, Caenorhabditis elegans
aacaaaaacaccgtgtgtgatgattgccacgaaagttgaacgggaagaagttgaccagcgatgggaagtgccgccggaggaattctgtagacaatttgagctcccgaagccgatcaagttctcgacgggcaatgtaagctagcttataagcttataagcttcaactgcggctccaatttcttgatatttcagattggccaatcctcttcaccgatcttcgagcagctcgccatgatggcagtttatccacatctccgtcgtgttttctacctcaacgactcgaatcttctctccaaaatcacattcggcgctgccatagtagctctagctggtttcctagtcttgaaaaatctgtaa

SEQ ID NO: 29667 - DNA, 591 bp, Caenorhabditis elegans
agagctggccaacattctcacttcgcattgaacttaaatatggtgattgctggaattgcacagatcttgattccactgggagttcaagcagcggtacctgaaaatacaagaagccaggtgagaaatacatatcatcatttatcatatactaaattttttggagttatctagcctgggcatgacgctttaaatttagaatgactgaaacagtaatttttttgactttaatgcttctaaactgacaataattgtttgagggttcacaaccagtgatttcgtggcaattgcaaacaacatttttttgaacgatgattaaaaaaaaactaaaactactaactaaacatgtaaaaaactttattgaaacatcaccaaaattgtccccaaataaaacaattccagtggtccttcgtattctacttcctcgtcatcacagtagtcatcacatcaattctctacacactgttctcccgagcgacacctgccgaatggacaatgaagaaaagagcatcagaatacacaatttatcgattgtctgacatatcaccacccgaaccaatcacaatcccgatgccaagagaatgcaagttttaa

SEQ ID NO: 29668 - DNA, 662 bp, Caenorhabditis elegans
tgagcacaacggtagtcgcagtcttctccgtccgcatggtccatctgttggcacatttccatatgctccactagcatctctcggcttctgtgatcaatcaccaatcgatgatattgaaggatggttgtacatgattgttcatttattgaaaggtggactcccgtggcacaactcgaaaagagccctgaatctgccaaaagtcagagaatggaaaatgtattgtcgtcgtccgggtggcaagcattatttattcgcaggcattccgaaaggatgggctgatattttcgacgttattgtcaacaccgcgtgagctatttttgtctcttgtaaaattttgtatttattttgaaatagttaaaaagttttacattaaattagatctaaaataaataaaactcttataaaaattaattttcagcccccacgagacaccagactacaacaaaattgccaacatggttctgtcaattgctagaaatgagcttatcgacttgacggctccatttgactggcaagtcaacccagttcttcgttctttggttcgactcggaccattaagctgtggtgagctcacccgcattccgatgagcagcatggcagcaactccatttaccgatcaaatccttctcaactctattggatctccgctggaatcttattga

SEQ ID NO: 29669 - DNA, 1444 bp, Caenorhabditis elegans
atgtccgctttggcatcgaagctatttgcaaaatgtgccgctggaggacgggctcttcagtcccaagcagttcggcaattttcagcatatcctattgatgattctatgtttgggcttaacgatgaggagattgctgtgagtttttataaaatatttaaattataatttttacttgaaattaaccagggcgagcggtaattccacaattttcctattgtgctccaacatttttcattaaaaattaatgcaagaatataaatagccaataacttgattaatctgaaaatattatacttttcacctggaacattgagaaagtgtggtcaaaaatagcctgaaattcgcttattatcgaattatcgagctttgttttccgacaatcggcaatttttgagcactttacccaatgtttcagccaaaaataacgttattttcagataaatcgagtgagtttttgtgttttttttcactatttttgaatgttggaacaacatggtgcattaggacattttgaaaattgccaattaaatatataatctgatggattattttgttttcaatttctgatccctaattttcagctacgtcaatccatccgtcaattcgccgacaaggagctcgccccgtatgctgacaagattgacaaggacaacggatgggatcagctgagaccattctggaagaagcttggagaccagggactacttggaatcactgcgccagctgagtatggtggatctggaatgaattatttctctcatgtaattgcaatggaagagttatcgcgtgctgctggtggaattgctctttcctacggagctcattcaaatctttgtatcaaccaaattgtgagaaatggatctgaagagcagagaaagaagtatctcccaaaggtaattaccgaaaaaattagtaaactaattagattatagagaaaacgtttcagctcatttccggagagcacatgggagctcttgccatgtcggaggctcaagctggatctgacgtcgttagcatgaagctgcgtgctgagaagaagggagacaagtatgtattgaatggaaccaaattctggattaccaatggaccagacgctgatgttcttgtcgtctacgccaaaactgatccatcgaagcatcaacacggaatcacttgcttcctcgttgagaagaatactccaggattctcgcaatccccgaagctcgataaactcggaatgcgtggatcgaacacgtgtgagttggtattcgataactgcgagattcacgagagccagatcatgggtggaaagggaaaaggagtctacgttctgatgactggattggattacgagagattagttctgtcgggtggtccattgggtctcatgcaagccgcctgtgatattgctttcgattatgctcaccagagaactgcattcggacagaagatcggatcattccag

SEQ ID NO: 29670 - DNA, 457 bp, Caenorhabditis elegans
atgtccgttcgtcatcttcaatggactgagtggccggatcgtggagtcccaccttgtaagctaacaagcttggagctgctttccgcaatccgcggatccaaggttccaatcgtcgtgcactgttctgccgggattgggcgtaccgggaccatcgtcgccatcgaatacattcttggtgagttttgaacaatgttagtttttaataaaaatttctataatttcagagaagatcgccgagaacaagccgtgccctccgatgcctgagcttgtgaaggcactccgtgatcaaagggccttctcaatccagaacgatgtccagtacctcttcattcaccgtgtcatgctcaactacttcctcgagaagtacaaggaaaagtatgcggctttgctgacagcggaaaatgtggccaagtacgacaagtttatcaaggattacaatgcagcggttggacaataa

SEQ ID NO: 29671 - DNA, 2023 bp, Caenorhabditis elegans
atggagacatcgaaggagttcgaattccgtccggccaaggagacgtcacgctccaagagtcccggtggaatcgtcggaagactttcgaattttgcgcgaaacaaggcgaggcattcgttgagtgaaaaaggttcaaattcggttggtggaagtggtggagcaggttttgataaaccgagaaaggtactttttcttggagttcatgggatgtcacttgaaaattctttccaaaaatttttataaagatacacgaggcatttttgtgggcattatgagatttcatttaaaaaatccggttgaaaaataattttaaaaataaatttgaagttttctatgcaagttatatttttgtttaattcttaaatttgggaattttttttgtttaaagaaaccgtattttgttcatttcaattttaaaatttttcaaaataggaacctatcgtcagtgggaagatctccaaaaaagccaaatttgaagataagtttacaacttgcgaaaacatttactgaaatttttgataaaacagtgaaacatttaaaatgttctatgttgatttacaaaatattccacaaaaccaaaaactcaactgcaaaattttgaaatcattgataattttttttactgtttcaagtgttccatatgatttaccgtaatttgtttcaacatttttgggaaatcaaaatgtgcttctaatatctcacaaaaagttctaattttcagaaattatgtcaatttaccaaaaccatgcgtgaaattttctaactgcccaaaacatttagaaaatatttaaccttttccgcacgaaagtctaaaatattttggcaaactccccaataaatttttgcgaaaatttttttttaatctttcgtgatcagttccaacaaatttattagtgggaaaaagaagttcttattaaaaaagcaataatttatttcgatatttctcgccgagatatcaaatttttagttttttccccaataattaacaatttaaaactacactaaaaaacttttttaaataccaagaatatcggaaaatgacgaaatattatagaaaaaccaaaatttcctaaactgataaaaaagatggaccagaaaactgctaaactatgaaatctgttaaaaattttttttactgtttcaagtgtttcataagtttttttcaacgttgtgaaatgtttactaaatttaatatgtaaaaatcaaaacataaacgatatgaatcaaataaatcaaaccggtattaattttaaattgaacagctcaaaatttgactcgagttcttataaaatttgaaaacacttgaaaatttgtactgcttcagcattttgatatatgtgcgtgaatagctaactgtttagtgtttgatcagcattgaaaacgttttgaacgaaactaaacaacagctatttggatatttttaaagtctaaaaactgtgataaagtattcaatttcacaaaatttttcactgtttcaaaatacaattataatttgagccgtttgatacaactgttagtctttctttattttcaggacctcctaaaagaatttcacaaatgcaaagaggcgcaggatcagagattagatttgagctcaatcgagatcacgagcattccgtcgccgatcaaagagctcacacagctgacagaattgttcttgtacaaggttagtactatttttcaagaaacagttatttttcgattaaaagatgattgtttccttttatcttcaattcaaatatcttcttatcactctgattagaatctagcacccacgctttttctctttatctcgaaaccgcaagaaacaagttttctcgagaaccttatcatttccggcattaaaaattttcagaacaagttgacgtgcttgccaacggaaataggtcaactggtgaatctcaagaaacttggtctctctgaaaatgcgcttacatctcttccggattcacttgcttctctggaatcactggaaacattggatttacggcacaacaagttgacagaggtaatttttttgcag

SEQ ID NO: 29672 - DNA, 3350 bp, Caenorhabditis elegans
atgctgtatgcaattatagccttcatggcagttgttggaaatcttctggttctctacataacactgttcagattaaggtgagtctactaactataacatttttttttcaaattttgatacaaaaattatattgtactagtaaggtaacccggtggtatccctgagtaagcattataatttccagtcaaacttctaataaattatatagttctgttaatgcaattttaaagcatcacttaaattttaaatccaaaaatgcatcaagtgtgaccgctttctctcaaaaaattttgcgaatttcgatctttcagacctccgataaactccactttacacaaatctcacatttttccataattcttaaagatctctatgaaatccaacacctcaaattttgtgtgttttatgttatttccggaacccggaaacactaaaaacctactggttagatccagtgtttctcacgcttcttgacagttagcagcttttcgcaagaatattctgtttcagcgaacgaaaacaggatgttttgttgaatctttgttagaataagctatcagttggaatgtcaagagtgctttgttagaataacttttggaggcgaaatacgtgcaagggttgaaaatgttcgttaaaatatataaaaattgaagattatagaaaaaatataggaaaaagttgagtttgatcgctatatgtacaaattaaaaatcaaactgtttcaaatagatttttttatataatgagaatatgaaacagtaaattttgtagttttgaaaaataatttttgtttagtttaatgtttctcactaatgtttatttctcacaaggttttgttttataataaaaactataagctggataaaaattgaagcgtgttttccggataaaaaaacaaatcaatattaccatcactgtttgaaaaaaaaacatatttttggaacaattccaaaatcttgaaagtagttcaaaatttttgagaatttcctttattcgaaaaatattaaattacttgtttattttcatgtcaaagttcatctgaaaataataataatatttttttttttgcaaattgaaattgggaagccaaattgttcactgtttcaactatttcgtatatttttacttgaaacttacacagtgttttaacattgttttgtcagaaactcaagtttccaaagttcacagttgagatgtatttcattacagagtccgttccatcacaacctacttcattctgaacctcggatttgctgacctcttcactggtatttttgcgattcccttcaagtttcaggctgctctttttcaagtttgttttttttacacacttgaaaaatgtttttctaggttcacaaaacttagagttttttgttttgaactgagagaatctgtttccggtccgaaggcagtcttgtttgatttttataaattgttactggtttgaaaaagaagaaaaacaaacgggactactacattttgcaacattgatcaaaaaaggcgctgaaaagtttgaaagaaaaacacccaattgagagcgataaatctttttttagtgtgaaggagaaaaataaaaacaagttgttcgacttttcaagtaaagattttaaaattctggggagctctgttgaactgtaacagataacaaaaacataatttggcaattatttttaatttaaaatcgaaatattctaaattactatagaaagatgttaccctactattacaacattttgaaactgtaaattttttaaggaaaatttttttattaccaagtgttgatatgagtaatgggtgaacattttaaaaatcgcagattattttattattctgttcagagcatctttagtttttgtgaatttctacaacatttttggcatttttctgaaaacacatagctattggctgaaaatcttgttttcgttactattttgttaatttccggaaatgaaatcatgaaatataaaacctgaccaacttttgacaattacaaattttaagaattaataagatacagttaaagtttacacgaattcgttcgaaatgggaaaattaatttataatcattttgtgttgaaatgacttaaagtagtaccgaagtgtgagactttgcttttttagacccaaaatggtccaaaactaccaaatttcgtaatgagacactctgaaaattattcaaaaaaaagttatggccctcaagtgttcaggaaaaaattaaaaaaaaaaacacttttaaaggtggagtaccgaaatttgagaaatatttttgaatgactccaaatttactcctaattccgaatatcgatgtgaaaaaaattgtatgtttcaaacagctgaaatattaatgatgtaattcgattataagttcatcaactccggaataaaatctatggattcttcaaagataaacgaaactgtaaaaatttttacaacttataaaaaactaaaaaggtcatgtggagaaaaatctccataaactaattaaatttttgaaataaattggatttaatcttttgaatatagtcattgaacattaaactcgcgtcagtttattctagtaaaactttgaaaattctgaaaaatgctgaaaaaactatcatttggcaatggaacctaattgcattaaaaaaacaaagtcaaaaacacataattaataattcagctgtttgaaacagaaataactttgaaaaagaaaatcgtatttactgttatgaacaaaaaaacattttataaatgaaacattaacaattcacatgggtgaacttaaaactggataaatttaacggaatttctattggaaaatatctcacattgcttgctataacaattttgcaatttataaactaatatttctaaagaaaaactgaaaaaaagaaatactttaaaaaaagacaaagaagacaatgtttaattaaagaacggaatttttgaaaaaaaaagttgaaagaagcaccgactaatttttgaatacattgtgtttaaaaccacaatgaaacagttcagaattttgattaaaaaaaaaacgaaatgcattataaaacttttaaaaaattcggaattactcttcaaacacacataaattttaggaatggttcctgccgcgatcactctgccggatagttccatacgtggaaacagttgctctgacagtttcagtcttcacacttgtgacgtcagcagttcatgaattccgtacaatgttcttctcgaaatgctcacaaatgagcccaagatctgcaaaacgatgtgtacttttgatatggataatggcggttcttgtgtctctaccacatggattgttccataatacatacgaatttccagatgacaataatacttcaattgtacag

SEQ ID NO: 29673 - DNA, 2492 bp, Caenorhabditis elegans
cgttttggcttgggctcttgctctcgctgcttctagtcttcattgaagcccaacacccactacaacagaatgaggatagatgccaagaccgttcatgctacccaattaccggaaatttgttgatcggaagaaaaagtcagctgaaagccacgtcgacatgcggatcccaaggacgtcaacgtttctgtattgtttcccatttggaagaacaaacgaaatgtttttattgtgactctcgtaccgaatggaagccacaacgggaaccctaccgattgagtcatcggttagtttttttttagaagaaatgagacatttgagagattggtagaagggaggagaataggtgtaatagtgcgatagagggaggataggcggctgagataattgattaatcggaggattgctgcaatgccctctttttcatccgaagagcatcttgattcaagaattaaatgaaaaaattggataagaagcagttggaagctcgaaatttttcagaaaaataaaaactagatatttattatagatgctttagatgcccttcaatcttatttgaaaaaaattaaaaaaattataaacgttcaaattttccttgttaggctcaaaaatttttattttaagcttgattaacacgtatcaaaacaaatacctcaatatttttttaatatgttggcttcgaccgtctgcctgcctacgtgcctacctattgcctatttttggcaggcatttaggcacgtcgcaggcgcaggttgtaaagtaaattttgtttagtagaatatacattgttttgtttcgtgaagttttttgaaaccaataggatataggattgaatcagttgttcaactctgatggttcattaatagatgtaaattcaagcattttttgatttggctaactaggaaataaagttcgcatgtactatgacagtaggcaggcgtgaaggcgtatatcaacatcgtaggtcatgaattaaaattgtatttaaataaattgaaaaaaaaattatattgtaaataaagcattttttttcaacatatacgtttttataataaatagctttgaaacagtatatattttttaatgaatatttcgcgcggtatctcaaattttgtggctttttcaaaattttccagtactccagtactccagtaagttttccagtaaagattagtgtttttattataatgtgaaacaaaagatatttccaaacataaactatttaaataatttcagaatcgaaaacgttgtcaccgaagttatggatgacaagaatcgtaattggtatcaatctgaaaatggtgcccaaaatgtttcaatcagttttgatcttgaagcagaattccatttcactcatcttatcatgacattcaaatcattccgtccagctgcaatgatcatcgaaagatccgcagattttggaaagacttggcaagtctacagatatttcgcctacgactgtgatagcagtttccctggaattcctgaaggaccaccaaagaagcatacagatgttatttgtacttcacaatattctgatgttgcaccatcaactggaggagaaattgtctataaagtcatttcaccacatattgtcacagagaatccatatgctgatgagatttctactttgttgaagatcaccaatttgagatttaatttcaccaaattgcacactcttggagatgatttgttggattataggttagttgggcagatgattttgtgaactttggaatactaaataacaggggaacaagattttttttcgaaaacaaaattacggtttcaataattctttaaaattgcaaagaaaagcacttttttgatgtcttttctttttttgaatacatatacacaaaatctgacatcgaaaatacaaaaacgagttattcaaatttacaatatctgaataattaaaccagtaaaatcaaatgaaaactgaaacccagaactttcgagctaaattttccttgtttccgaaaaaaaattaattacggtttcatgaatttttcaaaactttttcaaagttttcaaaagtattgaacatttggtttttctttcttcttcctcaacttattttcttttttttttttaactacaatcaaaaatcaacttccttacttgaatttcaacaaatatttcctcaaccttttcaattttagaccagaaatcgacgagaaatattactacgccatctacgaaattgtcgttcgtggatcgtgctcctgctatggacacgcttccagatgtattccaattgatccccacgtgagcccgaatactgtaatggaacgtgcagatattgtgcacggacggtgcgaatgtatgcacaatacggaaggattgaattgtgaaaaatgcaaagctttctataatgatcttccatggagaccagcaattggagatgaaaagaatgaatgtagacagtgtaattgtaatcgacatgcgttgagatgccattttgatagagctgtctatgagtctagtggtac

SEQ ID NO: 29674 - DNA, 1239 bp, Caenorhabditis elegans
atgtcatcggatgaaacggatgatgtacttccaaaagaagacgaaatgttcaaaacaaaaaaggacaaatacaaagtgatcgcattactcggtaaaggcggatatggagccgtatactctgtactccgcctcagcgatatggagaagtttgcgataaagtgtgagaaggcgactgctggaaagaaggttcttctgatggattgcaatgtgatgaaaggtgcaactcagatcaaaagtagacacttttgtactgtactggatcgagctaacgtcaaggatcgtttcaatttcattgtgatgaagctcatcgggaagaatctttgggacctgagacaggatcgtggcgatggaaaattcacaatgggcacctcgttgaaagcagcgtcacagtgtcttgtatccattgaacacttgcacagtgtgagtttgaactcaattattctagcattaagtttttttttttcagttcggctaccttcaccgtgacatcaagccggggaactttgccgccggacgaaaggaatccaacgagcatcacgtcatcttcatgcttgactttggtctctgcagggagtacgtgaagcgagctgagggaaaagatcttcgagcagcccgtacaactgcaccattccgtggaactactcgatatgctccattggcttcgatgctccagcaagatcaatcacgaaaagatgacattgaatcctggctctacatggttgtcgaatggacttctggaggtttgccgtggcgcaagttgaaggctcacgatcgagagaaggttctgcaatacaaacaagatctccgtacaaaaccggatattctggacgactttctcttcttgtgcccgaagaaagagtttaccagaattctgaaggtttgcatttacttttctttagccatatttaaacgatatattgttttcagtacttggatactcttggatactacgcagtccctgactacaaattcatttacttctgtgtccagcatgctgccaatgctaataagatcaaggatgctgatccactggattgggatcccgaaactccgtatatgggtcccattgagcagcctggtgatggtaaagtgatcgatctggaagttgagggtggcgcatcgacaaaggatttctcgaaaagaaatgcgaaggagaaggaccaaagtgatgagacgagaaaggggaaaaagaagactagtggttcaccgaataaggagagaacaagttccaaaaattga

SEQ ID NO: 29675 - DNA, 610 bp, Caenorhabditis elegans
atgacagcaccgccaccgccactcgtggaacttcctccgggatctatggtaagaaggtattcagtaactgattactatcttcatcttacaggttgaaagatggtcgattacaaagaagctgggagaaggaggctgtggagccgtctatttgtgcacggatgcaactggaaagtatgcactgaaagtcgagggaatctctgaggcaatgcaggtgctcaaaatggaagtgttggtgctcggagagctgacaaagagaggaagtcgtcacttttgcaagattgaagacaaaggaagatatggcagtttcaactatgttgtaatgacgcttgtcggaaagtctttgcaggtaaatacgagtttttattttcataaacaatagttttcattctaggatcttcgcaagggaaccgctcaacaatgtttgagtctggcctgttctctcagtgtcggaatccaatccttggaagctcttgaggatctccacaacattggatacctgcaccgtgacgtgaagcccggaaactatacgattggccgtgccgagttgaatgaacttcgtaaagtttatatcctcgacttcggaatggctcgcaagttcacggacaacaat

SEQ ID NO: 29676 - DNA, 354 bp, Caenorhabditis elegans
attgaatgtggagatggatatcttccatggtcgcacgagaaaacccatgaaaacataatcaagttgaaacaagcacacattggagacaagctgtgtacgaagcaaccggttatgacaaaagccgcagagtacattgagtctctaaattatcacagtattccggattatgagaagttgctcgcattgatggaagaatgcaatccaccggatcttaaggaaagcgagccttacgactggcagtaccggtaggtcaagctgaataattaaaaaacataattgatacttttcagtcatcttcctaatggaacaccaggtggaacaaaagaaaatgtgaccgagcggatggcaatttga

SEQ ID NO: 29677 - DNA, 1539 bp, Caenorhabditis elegans
atgcccattttgtctcgatttcccaaaataatttattcccagtttgccgaaaagaaattcataaagaaattcaatcaactgtaacaacaagagaatctgacaatgcttcaaggaagtgagtttatataattattaaaatcagaaaagaaaacgagtgtatttagaaaataaacagaaaactaataacgttgataaaacggaaagaacggagttggagaccaaaccggaaattgtaaatgaaactgagaagacgcgtcgtgtgcctcagagcaagagcaagaccgcaatcactccggagacgaagaacatggtttgtaacagtttcacaaagcgtgaatggggatatcgcttcaaaaagctacataaattcagagatttatagacgaaatgtttctttttaacaagatgtttcaattttggctcaattccctgttcgattttcctccaaaaggataactgtgaccaatcagcgattcgctccattcattttcgagacaatcagatggagtgtatagagctgattggtttgaagtcgacgtggttttttattttggagaaatttcaaacagggaataacaaaaataggaacatcacgtttttgactgcttgcttttgacgttttcaaatgctgcaaagcagcattttctaatgatttcaaagctctgaaatatttgtttaattttcagcaacatattcaataagcaaccaatgctcattgaggccaactccccaattaacatttgtggtgacattcatggacaattcagtgatcttcttcgcctctttgacaaaaacggcttcccacatcgtgcgaattatctgtttcttggtgattatgtggatcgtggaaagcattgccttgaaacaatcttgcttctattcgcctacaaagtcatctttccaaaccatttcttcatgttgcgaggcaatcacgaatgttcacttatcaacaagatatatggattctacgatgagtgtcagcgccgttacaacaaaccatccgtatacgtttcgtttgaaggtgtcttttcggatatgccattgacagctcttgttggtcagagaattttgtgtatgcatggcggagtttccaaaatggtatcaaacttttacgattcggtacaaataaacctgaactttttacagcttcaaaacgtcagtcaacttcgtgctatcaaacgtccatttgacaatcctgagccaaatacgcttgcaattgacattctttggagcgatccaacaaacttccaaaaaggatggaacccaaactctcgtggtgtttcatacgtttttggatcagatgcccttcgtaaacttctcgatcgtcttcaaattgatctcgtggttcgtgctcatcaagttgtgcaagacggctacgaattctttgctaatcgtcgtctggttacaatcttttcggcaccgttctactgtggacagtttgataatgcagctgcagtgatgtatgtcaataagaatcttgtctgttcgtttgtggtgagtttttggggaagtttcagaagtatggttgagactgtttga

SEQ ID NO: 29678 - DNA, 356 bp, Caenorhabditis elegans
atggaatttcgtgtgtaatttagttcgaattcaattgaataattgaaaattcatccttttggaatgatccattattttcagacaatcagaagcatgtatgactatactccaacagaaaagaagcatattctatgggcagtttcatttggaactatcgttggtatattccctattaatatgctttacgttcaatgtggggctaggttcgaacaagtttattttagttaatattttaaaattgcattttcagacttgcattcttctccgccggacttttatctgcaatgacgactgcgtttactccgtgggcggcgagccaatcgatgtggtttttggtggctttaaggttcttacag

SEQ ID NO: 29679 - DNA, 2257 bp, Caenorhabditis elegans
atggatcagcctcatattaacgaaaaaggaatgtcaattctagtaacagctctgttcatagtcggtgaaacagctggtggtggtctcattgctcttccaactgcaattgtgagcaccggagcggttactggagcatttcttctccttgttgcagcagtagtttgcacatatactggaattcttctggctgaaaattggacaattctgcaagagttgtatccagaatatagagatcactgccggaaaccgtatcctgcaatgggacttcgagccattgggccaaaatttgcgtgagtgaaagaatgaaaatctagaaaaatgcttttattgcttaagaaagcaagttgaactttttcagagctgaaaaaaagtaaaatttgctgccaaagataactgaacacttgcttttcaaacaccatatttttagaatattctttgaaacagataatttttagttttagaagcttctgaaactttgccaaaattcgtttagaaaaaaacaaaacgttctaaatttggatatatgcatttttcagagacaaggttatgtataattagttttttttagaaattttgaaaatttggctgtttcaataacccattattatctgtgttatattttcaaattgatgttcatattttgatcaaacagtctcaaaattttccaattttaaatttcaaaaaagtttggtgaagttgacttgaaaataaattacggtttcaataagttattatttttttgccatatcactcacaatcagtatcagtaagatgttgaccatatttgtttttttccagtcactttgtatcagcaatgcttcaagtcacccaattcggaactgccgttgtatttgttcttcttgccgcaaaaaatggtgaaaacatgcttcacgcaaatttcggaactcacgtgagcttctgctatatgatactcatcgtcgggcttctcgtcttcccatttacccttccaaaatctccaaaagatttctggtatgcagtggttgctgcaatgatttcaactacaatttcagtagttttaatcatttttggaacagtacaagactatgaagtatgtcataaagaagtattctatccatcatttaatttctcaaaaactctgatgtcatttggaactataatgttctcatatggaggacattgtgcatttccaacaattcaacatgatatgaagaagcctcatcacttttctcgatcaattattattgcattcattattatttttattttctatcttcctgtttcaatgagtggatattttgtatatggaagctctttgaccgactctattattccatcaattcaggtaagcaattttcgttttctaaagttttttgtcttaaattttgactagaattttcagaaaaattgaaacgcgaaagaattactttcaattgtgggtaatctcgaatataaatactcggcgaaactgaaggaaattttttgaaaaaataatgtttcaacgaatcaatgtatatatttttcttccattcgatgtaacaaatacgctcgtaatgtcggaaaaaaaaaccttccagtcttcgaggcaacctacctactgccaaaataggcttgaattttttttgaacattctggttgaaaattagaaaatcctaaatgcaacttgagactaaatttaaaaaaagaggtttctatataaatgtttattttgaaacagtaaaaaagtatagattaaaaaaaataccattattcactaattcatttgattattaagagtaatcatgttttttttctggctagttttacaattagattgctcaaattagtttaaacctatattatggtgacaaaatggtgaatattctgatcagttgtgttagttacttgtcgtagttttttttaattcttagatagaacaatgtcagaaaattagaaatgataaccatttttaaaatataatcattcaattaatagttttttttaactactgatacaataaaaaaataaccacagtttcagtgagttattatgaatagtcatattttgtgtttttgatacggattcagtcaacagttttttctaacaaaaaatgtaaattgaaatcttgaagcagtgaattttttttgaaattgttctcctcgtttcaatagaattttacagaatataaatatccaaacaattgtgaatattttgatcagtcttcatgtttcattggctctcacaatcactttcaatccattgaaccaggaatttgaggaaattttgaatatgtcacatg

SEQ ID NO: 29680 - DNA, 434 bp, Caenorhabditis elegans
gaggaccaaatcttgccaaaaactttgtcgattcaacaataatcgtgaatgcaactgctcaagagtactacaaacaaccaatttggcatgtaatggctcaattcagtaaatttgtgaaaccgggagctattcgtgttggaataaacattattgagaaatcagttgatgttgagggtctttcatttttgaatcaagatggtaccaaaactgtggttttattgaataaaaatgaggtaatttaatcaaaaagagataatccaacatggaattatttatagttctagtttattaaattttagaaacagtaaaacaaatttttatccaaacttcaggtactcagcttcgacgtggcaatcagtgacgtcagtgctccaaatgtgatctatgatttgacaatccaaccgaattcactgattacaattgtttataaataa

SEQ ID NO: 29681 - DNA, 1120 bp, Caenorhabditis elegans
tacgctcaacgtcggcacaaagcgaaacgtgttctgattctcgactgggatgttcatcacggtaacggaactcaggagatcttctatgaggatagtaatgtgatgtatatgtcaattcatcgtcacgataaaggaaatttttatccaattggtgaaccaaaagattattctgatgttggagaaggtgctggagagggaatgtcggtgaatgttccatttagtggagttcaaatgggagataatgaatatcaaatggcatttcaacgagttattatgccaattgcataccaatttaatccggatcttgttctcatttctgctggattcgatgcagctgttgatgatccattgggagagtataaggtactcgcattatcaggaaaaaactgctgaatttaattttttaaaaattatttcaaaaattataaatttgcctcgaatacatttttgagtccgggatcttcacgaaaaaaattttgaaaatttagcgataaaactacggtatccggtctcgccacgacgaatttttgctaaatgcaaaatgatgtgctcctttaaagagtactatagtttccaacttgaaaaaattgaaaaatgtgtcgaaatttgtattgtatcccatttttacagccaattttacatgctaaagtgcgaaaaatacaaactttgaactcatcgaagtttttaacagctcaagaaaacaaccccattagttttcgaaatcaacgaggggtttaaaattacagtactctttaaaggcgcatacactttttgcatttaacaaaagtttgtcgtttcgagaccggaacaccgtagtttcgaggcaaagtttaacattttgataaaataatttttaatcatatttaattttccaggtgactccagaaacatttgccctaatgacttatcaactatcatcacttgccggtggacgtattataactgtcctagaaggtggatataatcttacttccatttcaaatagtgctcaagctgtctgcgaagttctacaaaatcgttcaatgctccgacggttacgagaggaaaaagagcaatttgcgacgaaacctcaaaaaatcgagtcatcatgcatcaaaacgattcgagaagtttgtgcagt

SEQ ID NO: 29682 - DNA, 903 bp, Caenorhabditis elegans
actcacaaaatcattcgaaccaatcatggatcatttgaagacgcttagatatcccgatcgtccaaattatttgatgatctacgagctcttggcgaagatgatgtcggacttgaatgccaagcacactgatccaatggattatgatgtttttcggaagaagaatgaggtgaccgatgctatcaagaaaaagtaccaaacgcgatcaagattgcctgaaaaagcattagaggagagcgctacgattgcagtacttgaagaggcattccgtccaaaaacatccgacgttcccggaggtgaccagtacgtggtgaagcctcttttgaagctgtcatggggatcggtcgttgctgcatctgatgttagtttatatatatgttttgtcaaagataactcttgattatttaattttagtttccaactgcggatgaggtagaaacagttgaagagaaagatctgaaaaagaagcaagacgccaagaatcaagaatctgataaaagaaagaactcggatcgaaaaaagaaaagtgagagaaagaagaaaggatcgaaaggagacatgattctggagaagtcgaaagaaacgaaggatcatagagaaagtggacgtcgcctcactgatcgggaagctaatgctgttggcggaaaatccatcgatgccaagtcaaagggaaataaggatatggagcaaaggactatcatgattgacaaacctggaagcataactccgaagagcaaacggtcgagaacaacaactaaaattccacataaaactccacataaatctcatctcagaaaggagaagcaggagtcgtcagccaactcgaagagattgaatgttgccccattggttcatcccacagtgcttgtagtccctgcatccaagaaaaaaccaaaaggaacttga

SEQ ID NO: 29683 - DNA, 1724 bp, Caenorhabditis elegans
atggaaaatctcattcctgtcgtcaataaactacaggatgttttcgcaacgttaggcaggaaagaagatcaaattcaacttccacagattgtagtcgtcggatcacagtcggccggaaagtcttcagtgctcgaaaatctagtcggtcgggattttctgccgcgtggtactggaattgtcactcgcaggccattgattcttcagttaaatcacgttgctctcgatgatgaatccaaaagaagacggtcaaatggaacacttctcacagatgattgggcaatgttcgaacatactggctctaaggttttcacaggtgagaatttagtaatttgaatattgcgagaaatttaaacaattttccagacttcgatgccgtgcgaaaagaaatcgaagatgaaactgatcgtgtaactggagtgaataaaggaatctctcttcttccaatcagtttgaaaatttattcccacagagttgtctccctctccctggtcgatcttcccggcatcacaaagatcccagttggtgatcaaccagtcaatattgaagagcaaatccgtgaaatgattcttctctacatttcaaatccttcttctatcattctggctgtaactccagcgaaccaggatttcgctacttcggagcctatcaagttagctagagaagtggacgcaggtggacaaagaactctcgcagttctcacgaaattggatttgatggatcaaggaactgatgcgatggacgtattaatggggaaagtgattccagtaaagttgggaattattggagtcgttaatcgatctcaacagaatattctcgacaacaaactgatcgtggatgcagtgaaagatgagcaaagctttatgcaaaagaaatatccaacattagctagcagaaatggaactccttatttggcaaagagattgaatatggtaagaatttcaataaataaaaaattatttagaaattaatttcagcttctcatgcaccatattcgcaactgtcttcctgcactgaaagcccgcgtgtctatcatgaacgcccaatgccaatcggatcttgttgcattcggtgaaccagttgaagataagaacagaacacttcttcaaatcataactcgattcgcaactgcttatacatcaactatcgaaggaactgcccgcaatattgaaacaactgagctatgcggaggtgctcgtatatgctacattttccacgataccttcggaagatctttggaatctgtcaatccattggaaaacctcacacaattggatattttgactgcgattagaaacgcgacaggaccaaggccagctcttttcgtaccagaagtctcatttgaattgcttgtcaagcgacaaattcaacgattggaggagccatcgttgagatgcgttgagctggtacacgaagaaatgcaacgaatggttcagcattgcggattcactactcaacaggagatgattcgtttcccaagattgtacgataaaatcaatgaggtcgttagtggagttctgaaagagaggctgaagcccaccaatgagcttgtcgagaatcttgtagccattgaacttgcttacattaatacaaaacatccagaattcacagaagccaatttggtgacacttttgaaagaggagcttcttctcgacgatcggcatggtcgcagtagaaatcgacatgcatcaaccggagaaagagcggtcagtgctcatggagaacag

SEQ ID NO: 29684 - DNA, 973 bp, Caenorhabditis elegans
atggcccaagagctcattcagcttaatcccggacaacaggtgagtgagagagttcgctgcgagacccgcgaatttcaaagctttcaggtcgagagatggagcatcgagaagaagttgggagaaggaggattcggtgcggtgtaccgtgtattcgacgcaaccggcaaatacgcgatgaaagtggaaggagccaatgagcagatccaggtacatcacagcacaattgttcatttgaattttttctgcatttttgagcaacagtttttgtttctatctttcggaatctttcggtcattcttcttagaatcttagaattgttcggtttcaagtttcactcttacactagagcgcaaatgaaccaacgctcgaataattgtgagttcgacagagcgcatatgatgtgtgtttcgtgtagacctatgtcccatcctaagcctaagccacatttaagcctgtaggagcgcaatttctacatttaagcctgtaggagcgcaatttctcacctgagactttaagaataatttcaggtgttgaaactggaagtttctgtgctcaacgagctctcaaagcgtggaaatcgtcatttctgtaagatcgaggacaagggacgctttggaaacttcaactacgtcgtaatgacacttgtcggaaaatcgcttcaagatttgaataaagctggggtcggtgggcacatgtcgatgggttgctcgattggaatcggcattcaatcgttggaggcactcgaggatcttcataacattggataccttcatcgtgacgtcaaacccggaaattacacgattggacgtcccgagttgaacgagattcgcaaggtctacattttggattttggaatgtgcagaaagtttactgggaatgatggaaccattagaaagccacgccaagctgctggttttcgtggaactgtcaagtacgctccaatcagttgccatcttcagagagaactttgccg

SEQ ID NO: 29685 - DNA, 801 bp, Caenorhabditis elegans
atggaagttgataacgtcaagccatccagctcagttccgcagagaaactgggaaaaagaaaataacgtcagtttttcttaaatatttttagatttttaatattatttgtgtttcaggtccaaaatgtcgattcgattttcgagtacaacaacaagcagcaagtagaaatcagaaatgcaaaaccatgggataaagatccacattatttcaaacaaatcaaaatatctgcaattgctcttctgaaaatgacaatgcacgcgaaaagaggtggaaatctggaaattatgggacttttgcaaggtcgaatcgatgctaattctttcattattcttgatgtattcgctcttccagttgagggtactgagaccaggtgaaatgatttacgctgggagtaatttcgaacattttaaatttccagagtcaatgcccaagctcaagcctacgagtacatgacagtttattctgaaatgtgcgatacggaaggtcgaaaggagaaagtcgtcggatggtatcattctcatcctggatatggatgctggctatccggaatcgacgtctcaacgcagacactcaatcaaaagttccaagagccatgggttgctattgttattgatccattgagaactatgtctgccggaaaggttgacattggcgcattccgtacatatccagaaggataccgtccaccagatgatgttccatcagagtatcagtcgattcctctcgcaaagattgaggatttcggtgtacattgcaaacgatactactcgcttgacgtcagcttcttcaaatcacaacttg

SEQ ID NO: 29686 - DNA, 276 bp, Caenorhabditis elegans
acaaaatgttggccggaaaagtatgaggatcgtcttccaatgaaggacatttgcaagtggatgaagtcgtctgtcaaggctcaaggaggagatactggtccaggcggagtgagtttttgtcaaaatgttttaaattccatgattttcttacagatgatgtcgaagtttggcaagaaaattaaacggtcaaactcgcgtgagagcaagagcaaaagctcgacaatgacggctgcacatgggcatgatcaaggtgcaatgacagccattgagaaatag

SEQ ID NO: 29687 - DNA, 619 bp, Caenorhabditis elegans
gttatcaaagctgtaattcctgccaatctcatcgacgacaagaccatctatcatctcaatccatgtggatcattcattattggaggaccaatgggagatgctggacttactggacgtaagatcatcgttgatacctacggaggatggggagctcacggaggaggtgctttctctggaaaggacccaaccaaagtcgatcgttctgccgcatatgctgctcgttgggttgccaagtcacttgtcaaagctggactttgccgtcgttgccttgttcaagtttcatacgccatcggagttgctaagcctctttctgtgatggtcttttcatttggaacttctgctctcagcgaggaggatttattgaccattgtgaatgataacttcgatctgagaccgggaaagattatcaagtaagcgtttttttttatgtttcactatttttactgttttcaggaatcttgacttgaagagaccaatttacgagccaactgctgaaaacggacactttggacacaataatttcccatgggagcagcctcgaaacctcaaaatcagtgcagatatgctcgccaaatcacaaggaccagctcaacctgacgtaattggaattgcccattaa

SEQ ID NO: 29688 - DNA, 753 bp, Caenorhabditis elegans
atgtcgcaacacaagttccttttcacctccgaatctgtctctgaagggcatcctgacaagatgtgtgaccaggtaagtaaccaacgaaacattaataaggtgccaggttttttttagtttcatggtttcgaaaatgcgtatatatttttgatgtcagccattcttcgcgtcatttctcaaacgaagatttctattttcagatctcggacgctgttcttgatgctcatttggctcaagatcctcacgcaaaggttgcatgtggtaagtggttcaggacttcttgatatccttcagcgaaagttcaacaacaatatggaactgcgatgagcaaaagtcctaattattatcccctaacaacgttcagagattcggcggaagacatggaagtcaggcggtcacattcagtacacacacatcgtgttaacatgatattgatatttgtgttgtgaatttgatttgcagaaggatcaacagtgaactcgtaccgttcactgtagttcttttgcatttatcgcctattcatgtctctgatttcaggctctacgggtgttggatgatgcgggaaacggggctgaagcttatcgcaacaatatgtttctttacctgttacaacggttactttgattacagaaacggtgactaaaacgggtatgatcatgttgtgcggtgagatcacctcgaaagctgtcgtcgactaccaggttctcgtccgaaacgtcattaagaaaattggatacgatgattcctcgaaag

SEQ ID NO: 29689 - DNA, 1137 bp, Caenorhabditis elegans
atgacagagactgattgtccaacatgtcgtgagttttgcttttttaatttctccaacatcagtgcatctttttagaatttccaagtatccaaactcgagatcggctaaatgatgtttgccagtttatcgttccacgtcagcacaatacactgatcgtcccgaacttcggacaagtccccgtgctcaagggcgatcttacttggctttcgccagaagtcttaacgttcctcaacgattgtgtgcagctgatgacaccatgcgctgttcggatctgcaacggaagtgttttcgaggctcaggagctccgtgacgctattgccaacgagtttggtaacgaggagcagcaaatgctagatcgtttccatctgaaaatggcggatattgggtatgatgacgtcagcgttgtgacgaaggaccgactggatgcggatccaggaatcagcttgtcaaacgcctctgcaagccgaacatcaagctcaggatcaggagaaggcatcgaaaacgtccgtctcagctcgcattacatgtcgcagaagatgttcgattttaacaagacaaaactgtttgactgttcgatgagtggacgcaccatgtacgtggtaccattttcgatgggaacaatcggaagtcggcgtgcggtggttggagtccagattactgatgatccggttctggtgctcaatttgagaaccacttttaggtatggtagatcatagattgcacgcaatgtctgcctgcagactgacttactggttatgcgtatgaaaatctccgtttgagctccgtaggcatagttcgccttgatggctacaaagcttttaaacttcaacttatttcatttcagagttctctcaaacatctgggaccacatcgccgccaccaccaactttctgcgatgcgttcacacaatcggcatgccgcgtccgattatccgcaaaatcgtgactccatctcctgttgagacaccagttggtagtttcctcgttctgaagcacgatgatcaagaagtatgggctcatggtcactcttttggacgaactccaagatatggaaagactttctcggttcatgcggcgtcctggttgggtgccaaacaaggatggttggcagagagcgcggcaattttggcgattacca

SEQ ID NO: 29690 - DNA, 1774 bp, Caenorhabditis elegans
atggccatggaaaaaatcaaaaaatttccgattttttcagttttttttttaattgttttgatgtttttcagaaaaactcgaatattgaaaaagggaaaatcgaaaagggattttcggagttttttttcgatgattcgttttgtatgtatttatcaaaaatatgtcgatttattctcctgttattttcttttaaagatttccttagcatggcgaccactaaataaaaagatcctacaatcttcaaagcacaagatgagtctaatctttcgccagcaaatcggaagatgtctatcgacactgaaagatctccatgaagaagcacaagacgacattgaaaatgttgtggaaatccggaaaggaccgatcgatgctctattcggaacaatcttcgatattgtcgacctcgcagagagaacaatcactgaatcaaatcgcattgagcaacactcgacaaaatggaaactccggttcgattccgactcatccgaaaaagaagttatgagaacttacaaaaagcagcacggtgattttgaaattgaattgaacaagacaaaataagtacgttttcaacttcacaagatgtacaaaaaatacgtggagttcaaattcatatcaattctgctactaccaattccaacaccacaattcatatgtcaactcaatctgttattcccttatattcaagtcaatctccaaatcagctgatttttcaaagtaactgtaaaaattacaataaatttaccaactctcaacccaatatctcttcaaaaactaaaaattcgaattttctcaaactacagtaagctaagattgtaaaaaatgtgcaaatcgggcagatttcacgatgttatccgattttttgtgaactcgaaaacacaaatccccttatttttcgatgttttttgtgttctcttctgcagctgccgttcctcgttattcggatgatcttttctagttcaaaacatgattgaaaaactcgattcaagtggttttccagctgctgatatgacaaagaacacattgaattatagaaccgaaaacaatctaagtaggcacaaaaacgcctgtctgccttccaggctacctacgtcttccataattgcatgcacagcacgtgagcatttgtctcatattttctttgattttacaacaagtttatttttttgagacgataatggtgatttaagcgtgtgaaattttttgatttgtcaataattgacagcgtgaaactgtaaacaaaattcaaaaattctttgttttttaacgtgaaaaaaagatccgtgtacttaatttgttccgacattccacgtaactctttaaataaatcaatatttattgatttattgattaccaatgcccggacgactttcgacaattgaagagaaaactgaaacttccactggagcaatttcaacaacttccaacacaacaaacaggtttatcttttttcactgtttcttatttgtttcatattttgaaacagtttttaatgcaattattaatgttgtaatagctactcggaaataatcagaaaataaattatttcctgggtgtgaatcttaaaatctcttctacaaactatatagtttccaacttgcagtggcgcagaaatggattcaaaaatgcatcaagcggtacgtgcctgccaaatcggagaaattcaaaccgttcgatttctgttgaatggacatgtttcggctaatgaattcgatcacgaaggatgtggacttcttcattgggctgcaattaataataaattggatattattcaact

SEQ ID NO: 29691 - DNA, 6172 bp, Caenorhabditis elegans
atgcctctcgcctactcaacacacgataatttctacgaatcgccgaaaacaccgcagccaacctgggatcacgtgcacgcacagtttccgtaagttttttattgaaattattgaaattatcgataaatttaattgaaatatttttaaaattaaggttttctgtcgctttcgaatcgttaaatcggcgaattttgttttgttcttctcgcttttcatgagtttccgtacgaagcgttttcccttattgataaggtgttttcttgtttctcaatgagaataatcacttttttctttctgtttcggtatgcctgcactcgaatcattgcaacaaggcattgaaaatcacgagaaatcttttcgaagttctttctcacaagtaaacttttccaaacagcttaaaaaacattcacagatccccatctccacacattttcgatactaaatcctcttctccgcctcagtcaacgacacttctaattctttgcaaagtttccgtttcgtctccaccaccagcaccggatatttacgtttcttcaaatgccaacctcatcactgattcttggtgatttctgaccgataaggagtacttttaagtgcaaagtgcgtataatttcaactttccatagaagaacgagcaacagttttgtatatattcactcgaaaactttcccatcctagtttttcccacacgcattccctctctttttcatttttttgttttctcttcatctctatttctcgtcatgttcattcagtttctttcgttcctttttttagaaatgggaaggccgtccttcaatcgttcccaggagaagaagaagaagtagaaaaagtagtcgtgttagtacgggaacaaaaaatgagagataattgaagaaaacatagtaatggttgaataccgaccaagaatggtatattcatttcctttctttttccacccagtctaaaatctcttgacaagttatcttcactgttccgtgtgatatttttttccgtttcaatccatttttctactcggaggctgcctatatctgaattcagcggaagtacagctaaaatgtgtgagatctaggttaagtataatccgttgaagattgtggaaaagctcatcctagataaagtgtaaacccacggatgcacacttttatgaaacggtgtttctttttctatgtttgatgccaaaattaaattagatttgaaaataataaatcatgtttcttcaaaagaatggggatttttttttcaatatttatccgaaatctgaagagcaatgaaaatgaaactatcaccaactgcagctgtttaggtcagcacatttgatgctattgaacaagatttccctctttctagattcaaattttttgcgaagtctcaggttttctttttgtatattgtattccaagctgagtctcgaaaaaaaaacacgaaacgtactgatttcaggaaacaaaaagcggaccgaaatatttggaaaattacattccgcactgccaggaatttgcttttccggatcagatctgattttttttttaatttctacaagttctacaatattcaaatcgccaataaaaatctccaaaagcatgataattccaaagttcggagtatcatattggaaccgtcagtttcccatacgacaaaggtcgtgcccgttctatgtttccatcattctctccagtttcattactatttcctacgtccatcctgtccggcgtcctctccgtcatcgtcctctgtcgcagccgccaccgccgacactttcccacgctcgtttttcccaccacacacacacacacacacacacaccagttccctcccctttttctctcttttcaacggccagttcgccatccctttctcacacattgtctgtgtatatgtgagtgaaagagagtgtgagagaatgcccggaggccgtccctctttacttgtcaagaatagtatatgagatgaagatgcgcagacattttgagaagtgtgtcctctctctcctctctcttttttccttcttttcatcgtctgcaaacggccccgcaaccgaccgaccaccgacacagcccacaaggccaacctttttttcccactcgtcgctttttcccacgatattccatctttcacacgttcctctctcaagcattttgtttttccatccaggctttctccgaactttctagctcgtctaggagctagactagaactacagtacctcttgatcagtgataagagactgggggcactcctacggactgtctctctaaaagtttcccaatgactttggttctttatttcactgcgtctctgtgggaatacaacaatcttcggtgtggttggggggttgtctttgtggcaatgaagagacaacacatacgcacacaagatgatgcgtccctgggaaacccccccaactggtgggaagattgaaaagtactaagaaattgcagtaacttttaaagttgactagattctcgtatctcggtgttacagcctaacttacaggcatgcttcttctagattccagatgattatacgacattcaaaaattattttggtacttttccttttctaccccgcattttcagaagaatattccaatcattgaattattcgaatttaattctcacgtgaatgttcattttaatactattttcatttttaggcttagaaaacaacattactaagcctaaaataaaaattaaaagctttccattaattcgtaaagaatcataccttgattgacaaaatatcaacaatcaacggagaactttcctgctcttgctctcttcctgttatcaactttgaattgttatcatagttttcccgtgtatatttctcacacagttcttattttaccgaacccgccgtcctgcccgcccatattctcgttcgttctacgccgcgccgtcttgtgtggacattttcccaccgacgccaccctcggcggttctttttttccagtcacacactgatttccatatttgtttagctggtatacattttcaaaaaatgtcatgactgaggtgtcgctggcgacggcggcggtcagtaccagtcagtttctcaatgttttgatgttgaggttcccatgatgctctgggcaatttcgcacatgacgcggtgacggtcgaattttttgattaaaaaaaatatctgaaagatgctttttcctgatttttgaagagctatttatttggatacaaattggaatttcagtttttgatttcgatattttctctgtagaatttgaaaactagttatatattctatgccagtatttgaattttctacatcgtaatcatattaaagctggaatcgtgaaggcaggtctcgtcacgatctgggtaataataattcctcattagattgtacaaaaaatttgaattattccaatccttcacacctctaagatcatcctctcgtatttcaaacttcgcctatttatcaaccattccaaggaacattaccttttcgtggatacatgttgcatttctcttctttgattctcttttcttttatgtttactttttctgcgtttcttctcacaccttctccagcagctcctcttttaccgattacccaacatgaccccgtcgtcttctttttctattcaatataacaattttatgtgtccgtgtttgtgtgcagcagcagcaacactttcctatctcatcacctattccttgacgaccgttgatgattcttcactggcttctagtactgtaataattagagactcgaatcgtcgttatttcactgtaaattttataaattgttccatactttgcacctgcaccgacacacaatccgaatctctcggtgcattagaggtggtaaaagtgtccgattagattggagattaaaatagttattaggcgtgagagagagagagtgtcggttggttcaaaaaaggagttgtgtgattgactttttgaataaggaggttttttcaagccgagcagttgttgagctgaataagaaaattcttttttttttattggaaagacacaaaattgttaaaagttgcgcagaaatccaaaactctcttttttaatgaacaattaaagttaaaaaacacgagacttcactcaaagtaagaaagttcgttccccctttatcgtatttcaattttcttgtcttctttcataaattccctttttagatctttaaaaattatacatataaaggtaaaggaagtatccgatcagaaaaattcgataatagaccccatttcaatctggggtgtgattttccgtgttccaatcggctttttagtactttttggaaattttcctcctttctctaaaataacggtagtacagaataaggaaatttttttttaatccagaagcggccagccaactgtataggaatttcaattttttttaatgtgctgaacaatttcgaaatcaaaaagaccctactctccagctgattacaatcatctgatcgatgtcatatttcttttcccaaaaataatttgtcttgtttctctaattactcttctcttatcatcacaatctctcacgtttcttctgtctcaccaataaaaacgggggaatccccctgcaggttcaagttgatatcattagaaacctgtttttcacgcagtcaatactcttttttttccctcgataaattgatcattttctcggctttgggcgtggaaatattttctgcaataagatgtgttgaaaagtcagaaaaaagaaagtgttcatcccgcccgttgtcgtagatcatttgttttatggcaattttcatcatcattttgtaaccgtcttcttcctcctcttgcgcatccaatccacatatcacacaaaaatgtacaatacgaaaaataggtcggtctcttcacattttcatcaccaaaaaagtgtttttgcagagaaaaaagtggtgataaatgtggaacttataactgtaaacacatttaaacgagggcggcgaaattagatatcagacatatacgatacaaaaaaaattaaaaaatctgtgtgtattttgtttgtaaaaaaataaaataattgcgagtgcatttttttcagatttgaggataaattttagaattcatggaattggagcattcgataggtcgaaaggaaagtattttgagcattcaattcgttatatcagttatccgactcaaagcaatttgttctactttagaattaacgcactttttcgattctgagaaatttattcaattcgagcttctttctgtaatcagattttaccgcaatttttcaaatcttttttgctcttcttttccatattagcattgttcgtctcaaaattttatttttgatttcgaaggctaatttcttctttcccaaaaattcgtactcatctatgaccttttacagtatcaaagaaacatatatgcatttaaaaattattgaaaaaaactgtttgaaaatctcaaaattttgtcattttcaaacttaaaactcgaagaacatttgaaaaaaatacagtattcgcttcaaatataatcgttttcatgatcggattctctcagaatttcatcttcaatctgaaaatactagatttaagtgattccgtggatcttctattctcgtttcaaagcttcacactcctgcttttttagttgtccgatctcttgtttcttaccatattccgacataaaaatcccgccgaaacccatcaaacttcttcttctcgtatacgaatataatatgtgtgggtgctccgttttgtcgcacaagtaccgtacctctgcttccttaccgatattcttttctccgaatcgacgacaaaatttaatgatcgattcggaggcggaggtcgaagtggtgggaatagaagtgataaaacatacgcacacctcccgattttgtcgattcttcgtgtatgtgtctccccggcagtttcattcttcttccgagagcattatattcggaggtgctccctttttgacacgtccctctaattgtttaaaaacctctttggataatttccatgaagttttattaaagttttaattttcagactgggtgaacccgcacgaaatctggataagtttataggtaagttcgtaatcaatccatcgaaatttcaaacaacgtatcattgagttccagaagcaatgttccagtcggtatcgccgctggccggtgtcgctgcagcgccgagccaaattgccgcacttcaacag

SEQ ID NO: 29692 - DNA, 1086 bp, Caenorhabditis elegans
atgtcgtcgcgtaaacgaggaataactccatcgcgagaccaagtccgccggaagaagttatcgattgaagaaaccgacagtatcgaagtcgtttgtcgtctttgtccatatactggctcgactccaagtcttattgcaattgatgagggatctattcaaactgttcttccaccagcacagttcagacgcgaaaacgctccacaagttgagaaagtgtttagatttggacgagttttttcggaaaatgatggacaagctactgtttttgagcggacatctgttgatttaattttaaacctattgaaaggtcagaattcgttgttattcacttatggagttactggatctggaaaaacgtatacaatgacgggaaaacccactgaaaccggcacaggactactgccgcgtacattggatgtaattttcaatagtattaataatcggtaagcttttgaaacgaaaaaagcaaataatattattttcttccagagttgagaaatgcatcttctatccatcagcactgaatacattcgagatccgtgccacattggatgctcacttgaaacgccatcaaatggctgcagaccgtctttccacatcacgcgaaatcactgatcgttactgtgaagctataaagctgtcaggctacaacgacgatatggtttgctcggttttcgtaacctacgtcgaaatctacaacaattattgctacgatttgttggaagacgccagaaatgggtaagaaaaatcgagcaataattgatagtgaccctccgctagttccagagtattgacgaagcgtgaaattcgtcatgatcgtcagcaacagatgtacgtcgacggagccaaagatgttgaagtctcgtcaagcgaggaagctctcgaagtgttctgccttggagaagaacgtcgtcgtgtatcgtccactcttctcaacaaagattcatcccgttctcattccgtattcactatcaaattggttatggctccgagagcctacgagacgaaaagcgtgtatccaacaatggactcatcgcaaattatcgtttcgcagttatgtttggtagatttggctggatctgagag

SEQ ID NO: 29693 - DNA, 1086 bp, Caenorhabditis elegans; identical to SEQ ID NO: 29692

SEQ ID NO: 29694 - DNA, 864 bp, Caenorhabditis elegans
acacgtaaacttccgaactgcatcagaagcattggtcgttttgtttcgatgtttaactggagaggattggaatgatattatgcatgattgtatggtgagtgaactaccttgaaacttttatcaaaattttttcctcaagattatgtttattttattggagaagttgaaaaatcaaattctaaagtgaacaacttgaaacggtctggaaaaattttgaaaattccataaaatttgaaaaaaaaattcaaaattctgaaaaatttgagaaggttccataaggtttgagagcgacgctcttgaaatttctggaaaattctttaaaaaataggaaaaccagtttggaaactgaacaattttttttctgaaaaattgaagatattagttaaaaaaaatgtcttgaaagaacattgaacatttcttgctcaaacacatatttgctgtcggttacctacttttgttggccaaatttaaaactttgtttttcttcttatatcagaaaaatgctgaactacattttaaagtaaataacgtgaaactgttgtttttttttgtgttttcccattttttgtcatatttcaattgcaaaaacaaattatatgacaactaaagtctactttaacttaaatttcagtaaataaaagtattttatctgtctattttcagagaagcgccccattctgttattggaatgaaggaatgaattattgggagactgattgtggaaatttctatggagcaatcatctacttttgctctttttatctcatcatcacgtatattgtcagaaatcttcttgttggtaagtttgaaaaattaacgataataaattgctatttaattcaaagtatgtattgttataattga

SEQ ID NO: 29695 - DNA, 2026 bp, Caenorhabditis elegans
atggcccttcccttcttccttcttcttccaaatgctcacttttcttcgttttgcatgcatctcgtgagaaaagagcattccacgtgtctcatgggaccagttgtatcaaatcgtctccattcctcaagttttaaatccaaacacacaatccacaagtgtactttcttatttgagaaatgttttacctggtcaactaaaaaaaacctggattctctctcctgtttcagcgttgccattaattggaacaatgcttctgaaaacattgtgcgatcactagaatacataggttcaagtcaaacacctagaattacaaattttcaggtttttaaagaagaaagaaaaaatagggtttaatttttacacatttagacaagtgtcttttagcccaaaatatcgggtataaaaacattccgtccccgatccgtgggtctcgctagtcaaaaccataaatacgtccaatccttttcaattagttttgcctatgattgttgataaggcctccaggttatattataactccaatttctgatttttatcaatagttgatataagttatcacttttatttttatgattaagcagtaaaaagtagtaaagtgaagcagaagcgctgttatcttttgaattttccactcaaaaacactgatgacgatatgacaggccgattgcattgataagattgttttgaataatatggtataaaaggaacagtgattaaattttgatagttgagctgaaatgaaacattggtttttaactgttttgctgataggaacactttctatttttgaaaccaaatatcaagtaagagtacaaagaggaaaactcgtgaaacatgcaactcagaaatatggtctgagaaggtttgatcgacttgttgggttagttaatcattttattttgttctcacaagaaaactgaaatttcatataatcattttaaatatatcttcagaggccaacatcaacatgtagcggatttccgtgatttcgcctattttggaaatataacactgggaactccaatcgagtcaactgctgagcaaactttcctggttgttttggacactggaagttcaaatgtttgggttccagataactcttgtggaattgatgataagtaagtgatagttcatataccgtaaagaagggacaatttattagtacatagaacaaaaatattcaaaaatttgatctgaaactggtttccactgctagaattaaaatattttagcctagctatgtatcagacaacatttactattattcttggaattgaagatttaaaaatacttgataattaaactagaaaattaagtaagctttttccaatgttggtcatttactttttgtattgtttttggaatttcagaatattcaattcagtatttgaaattaaaatccccattgacttcagtatgaccaaaaatgcctacctacctgccttcaaagcaaaatgtgcctgcctcctgctgtcactctccatgtgaacaatttttctgatttttaagtaagcatatcaagtgaaatgaaaaaaaaaactacatataccaacattgaaaaaagtaaaatgcagaaaataggcgataggcagaaaggtaggcagagagaaattaaacatggtaagcctgaagatcagcatttttaccacaaaaggcctaataaaatactctccacaacatttcaattaaaacaaaaaaaatcaccattgatttaaaaaaaaaaaatattcctgtttcaaaaaaaaaatgtaactgttcacaatttttttctcatcgatgttgcatagatttattttctattcgaaaaaatcctctaatctaaatatcacatttcaatataactgtaacaaaaaaaacatttaaaattgatacttcgaactggtcctttttcagaaaatcagcatgcacctacaaaaaaaagtatttcgggactgattcaagttcctacgaaaaagacggaacaccattcagtatcagttatggaactggaagtgcttctggatattttggaaaagatacactatgt

SEQ ID NO: 29696 - DNA, 1470 bp, Caenorhabditis elegans
atgacaacgtgtcccctaccacccagtttagacgaaatggatctgcgattagctgccgataaagtgagttttaagggaaggctgttaatgaaacagcaaagcgagaattagttttacgagaaaatgaaacagtgaaaatttgagaaaaatattcgagtttttaagttaattagaaatttttaaaaaaccatatctcaaatacctctagagtattgtgtggacatgtgacaattttcatgccaatagaggaaccgatattatttttttactagttgggtactagttggtattttaagggaggtaacttaattgtaaaaaaaaaagtttctcaaaaacttttagattttctacctttatatcatacctataagaaatctagacttttcagttttaagaaaataattttgaatccactataataatccattttgttgttccttcacatagatttttgctatcttttgtaattccaaaaaacttcaaatgtactcaatttcccaatttccgtgttcttttgtgcttactcaccacaaattcaaaataaacgttttgtagtaaatttgtgaattatcaggagcacctggaaattatcagggattagattcaggatgatcaatttataattataagtgttttgaaacagaaaatatattttgtcaactgtagtttttatgatggaacagctaataatgagaactaacacattaaattaaaactctgcaacagacgaatataaattgttttaaaattaatattgcctaggacttccaaggtatacctacctaccttatgcctgtctaggtgcatacgttttgctttttatggcgaaatgtggtgtcttgagccctcacagccgcatttcagtaaaactgtaaaaatattaacaattactttagtaagccgccttgaagaatcatgagtaagccgccttgaaggcaggcattttatattgagagcagcttataagcttcattagaaatctgaactaatcaatatttcaggttctaaacggttcactgatcaactgtacattccaatcgttttacgatcaaatgtatcaaacacacggagtatacttcatatttgaaccaactccgttcgttcatccaattgtttcacagattttctatggaatcctgttcacactaacaatatttctggcgttaatgggcaattttacagtgatgtggtaagtgaaataaagtgaaaaatgacaaagtctgtttcaacatgttaataagttccacgattacttgtgatgacactggatacctaaacttaggaaatattcgctttttttgctcaaaaaatttttaaagatttaaaattaattctcaggataatcctgtaccaccgtcaaatgcgaagcgtcacaaattactatctgttcaacttggcagtggcggatgcctcgatttcagtgttcaacacgggattctcatggtcttataattattattatgtttggaa

SEQ ID NO: 29697 - DNA, 705 bp, Caenorhabditis elegans
gctcaatcaattggatccattgagaccccgatgtctactatgtcattcttgaatcaaaaaccttcaaagttctcatcatggtcttcgaatccagttaatgacgtgttgtctgcgtaccgatatctcacttatcacttacttcaaacaacttcggcagaagcttacagactaaaagcatctggaaagaattcattcgaagttcgaaatgaaattcaaattcatagagctgtcaatttgtctgttgcatacacagaacatacaatgatccattgggttcaacagttcttgaaagaaattgaagatcaaagtgtgaagccggttcttcaaaaagttttgaatcttttctcacttttccttttggaaagacatcttgcaactctttatattactggatatgcttctggtggaaagtttggagaagatcttcgagagaagcttagactcgctgtagccgaattaaaacccgaggccattgctttagtggactcgattgctccagatgatttcattttacattcagctctgggagcatctgatggaaagtcagttttaaaatgtaaaggtttctgctgaactttaaatttgattttcagagcgtacgagcatataatggaagaattccggaagtatacaaatgaacaaccaagatgggtttgcgatttggctcagtttttgcaaaagagatcacaaggatccaagctataa

SEQ ID NO: 29698 - DNA, 621 bp, Caenorhabditis elegans
gttatcaaagtggtcattcctggaaatcttatcgacaacgacaccgtctaccatctcaatccatgcggatcatttgtcgttggtggaccaatgggtgatgctggacttactggacgtaagatcatcgtagacacctacggaggatggggagctcacggaggaggtgctttctctggaaaggacccaaccaaagtcgatcgttctgccgcttatgctgctcgctgggttgccaagtcacttgtcaaggctggtctctgccgtcgttgtctcgttcaagtttcctatgctatcggagttgctaagccgctttcggtgatggtcttctcgtttggaacttctgcactcaacgaggctgaactcttgaagattgtcaacgacaactttgacttgagaccaggaatgatcatcaagtaagtgtacttctaaatgcttcttaaccaatcagttaatttcagaaatctggacttgaagagagccatctatgagccaaccgctgaaaatggtcacttcggtcacaacgattttccatgggagcaggctcgtaagctcaagattgataaagatctccgcgccaaatccaaaggaccagctctcgttgatgctattggaattgctcattaa

SEQ ID NO: 29699 - DNA, 399 bp, Caenorhabditis elegans
aatgtcatcttggcatggattatgaaaggaaaatatggtgtcgttgccaagtcggtcactccatcgagagtcgcagaaaattacacggtgaattttgaaaaattgaaagtaaaaaaaaactaggaaaaaatattcagaaaataaaccataaaatgtaatttttatgaaatgttgcttatgttgatgaaaaattcttctgaaaggaggaaaaacgaccaaattttaaagctatttttttaaaaaatcaggtttttttgttgaaatatcggaaaaacgaaaatgaaaaccttcaattttcagtctctttccttggaactgtctgatgatgagttcgaaaagattaacggattgaatctggaaacaccatacgtcgaggaccgtggatggttcgtgctctga

SEQ ID NO: 29700 - DNA, 537 bp, Caenorhabditis elegans
atgccaactcccgaggatgttcccatggatgaaaatgacgcaggaagagtagcagaaggctcccaggatgaatctgtactgaatcctacgtgtttatcaaatttatgtttttttttcttcagaaaacaccttcccgtgaagtgcttaagaaacttcttaacgaggttgagatggctgaaatggaggaaaatgaaatgtggtacttgatcagccaaaagtggtggaattcgttgatcaaagcagttcgtgatggctttgttgatgacgttgggccaattgacaattcacagatatcggaatgtatgggctttgaattttaaaaaaagttatattcatacattttcaggccgaaacggatcattctttctgaaacaacgacttgccgagcaagtagactatactccagttccagagattctgttcaaacgtcttgaaagattctatcacattgatgatgatcgtcgggactatattcagcgtcgagttgtccggaaggatggaaaattatgtattgaagtatatccgagaatcgttcat

SEQ ID NO: 29701 - DNA, 1197 bp, Caenorhabditis elegans
atgcttttacttcctggtcttatgaataatttgttactgtttctgtcatttttcttattattctcaattacaaaatctgcaattgtttctacatcgttggggcaaattgatggtgatcaaattggaagtttccatttatttaaacatattccattagcaaagccaccaattggaaaattaagatttcaaaaaccagaaccgcctgagaaatggaccggagtgagaaatgcaaaaggtatggttgaaaactctgaaattaaattagattaattactctgaaaaacatgaaaaatttacgtttgtttgttaaataaaaaattttctgaaattcaacgaaattttctaaacacaatgaaataggaactgcagttataaaatctgcaaaaaatatagtagatggtcaagattttctctttcactgctagaaatttttcgactgtttcaacgtgtctagaaaatctaaactaaattttcactaataatttatagtctcttatgatatcctaaaatatttcaatatttcaacatgttcataagtctatacaaaaacttcagaaatagttaaacttgataaaacttgcatcagcgcctttgtcaataaactcaaatgttgaaaacatttaatttaataaatttaaattatattttatactttcgttaatatatgtttataccaataaacttcaaatttttcaaaaatagtttcatagctgatcacagtgtctaaaattgttataaatgtcccaacgtatcagacgcgttgttgtagtgtgttgcgtgcaaaactgatcatcgagtagtctacgagtattacagatgtagtttagacacaattacctttgttatagaagtattgatatttttaatcatgcaagtaattgtcacggaaaatgaatccttcaaatttttcaattcaaatttattccattttcagcgtacggaccagcatgtatatcaaattcatctgtatcaacaagcccacagaaatggattgatgaagattgtcttcacataaatatcttcacttctgataaatgtttggtaagcttttgttcctcataatatatccagacataataatgttccagaaatcaaaagactgtgcagttgttacatattttcatggaggaggtctcatgtatgactcggctgtaatgtttaatgatacgtatttgcttgggacttttgttaaccaag

SEQ ID NO: 29702 - DNA, 725 bp, Caenorhabditis elegans
gttttgtggaatgaagagcataattgttggtttgactttgatgttgaagagggaaatcatgccacaagcttccacgacactaacttcttcccaatgtactgtgacagctatcatgaagatctcgactcacaagtggtagttgactatttgacaacatctggagccatcagcttccccggaggtattcctgtatccctagtgaattctggagaacaatgggattttccgaacagttggccaccaactacttgggttcttcttgaaggattacggtaacttattgattgtagtgtacttgagttatttattttcggctttgcagaaaagttggtcaagaagaattagcattgagcttggtggagaaatgggtacagaagaacttcaatatgtggagaacaagtggaggaagaatgttcgaaaagtacaacgtagtctcaccatgcttcaaagtgaaaggaggtggtgaatacgtgatgcaagaaggattcggttggacaaacggcgtcattctagactttctcaagaactacggatccaaaatccggtggcaagttgcagaatcctgtgaatgctgtgatgtcacattatcacgtactcttatcaaaccaacatctcctgctccatcatcatcttcaactgctcgcctctttgctagtgaactcacacagacaccttccgtcgtgtcacttcaatcaatgttgtccgatggatcagttcagaattag

SEQ ID NO: 29703 - DNA, 280 bp, Caenorhabditis elegans
ttgaacgtttctgttcgtgttggtcaagccgttgacgttgttgctcaagccggaaagccaaagacaatcactggattccaaactcatactacgccagtcttgcttgcccatggtgaacgtgccgagttggcgaacgatgaatgtatgccatcctaacatttgataattaatttttaactaaaatatttcagatctctctgtgactccacatcttgaaggattggttattttgaagaagaatccagattatcagccggttgttgtatcaactaagaagtaa

SEQ ID NO: 29704 - DNA, 571 bp, Caenorhabditis elegans
atggttcgaccggaagacttcaattcattggagcttgataactcacttaccgatggagaaaccgtccacgagatgatggctcacaaggctggactgacatacaagtatttattttgcgtggtgtaattttaataaaatatttgactttcagtgacttcaacattcttcctggatttatcaatttcggagtgcacgacgtcagcttggagaccaacatcacgaaagatcttaaaattaaagcaccacttgtttcatctccaatggacactgtaactgaaagtggaatggctatcgttatggcggttagtctgactgaatttatattctgaaaacaatttaaataaatttcagctttacggtggaattggtattattcacggaaatttcccaaagccggaagatcaagccgctgaagttctcaaagtgaaaagattcaagcaaggatacgtgatgcaaccacattgtctcagtcgtgactcgactgcgtttgatatgattcaaattaaaaagaagtatggttatactggagcaccggttactgaagatggacgagttggtagcaaactcattg

SEQ ID NO: 29705 - DNA, 576 bp, Caenorhabditis elegans
acatatttctatgaatattcatatccaaaacatccttctcatactgatgatctttcctatataatgggcgttcatgcatttgaaaaagatgaaaatgagatacatcttgccaaatcgtaccaagaaatgttcatgaactttgtgaaatttggagagccaggcggtggatttgaaatgtcgacttttgaaaattcaagttatttcaatttttactggaatgaaacgaccggagaaaagtcttcaatgaaaactaatttcgagaaagaggtatttcatttcaaaactttgaaaattatttttactttccagatcatcaaatactggttgaaagacatgttcgaatatgatcaaaatattacagctgcaaaacaactaaaagtagccataacccggtcagctaaattcaatgtatctgaagaccaattgccatatttgtatatttctatgttgataattgctttaatatttctaacaggatgtcttgttgggaaaatatgttgtgttcagccacgggatagacatttgtatattcaattagatggacttgatcatgactgttacactgtcaaaaattaa

SEQ ID NO: 29706 - DNA, 253 bp, Caenorhabditis elegans
attcttcaattccgcccgtgttacgtcacaactaccggtacagcagccaccaacgtgtatgcatattctgcgacttcgaaggcggaaaatgtcactttggtgagtttttaattgacaacgcttgtaataaactctttgaacgaaaaaattaaaatttgaaataatgcatattttattgaaaattccataatttcagatgcgtgatcctttctcaacaactcctcgtccaaatgaacgcccagacagtgtttga

SEQ ID NO: 29707 - DNA, 506 bp, Caenorhabditis elegans
atgaacattactggcagaattgacaaaattcaagaaaagtccttgaaacagagaaattttgttcacaaaacacgaactgaggcgaagttgcttacggtttcagaaaacttcgcaactgttttatcaaatgttgatggtcactcaatagtcagaaataacagtttttaaaacaaaatcatcaatatctaactatatctttattccctattttcagtggctggttccatcatcatctggtcgagacgacgacgctgtctctttggatagttgccaatcagtgtacagtcctgttcgtcatcacataaacagtggaacaggaggaggaattctcatggaaccatcctctattcatgttcccgaaaactattattcggtgagtacaattttaacagtttggttgaagatctcgatatgtttcaggtgacaataggggaagcgcagatggttgttctcaaacgatatcaaaatctcaggttgatcgggtctggtgctcagggaattgtttg

SEQ ID NO: 29708 - DNA, 285 bp, Caenorhabditis elegans
atccaatgaacgtctgctgtgaaacccacgacaactgctacaacactcaaattggtaaagatttttgcgataatgaattttgtctatgtctaagtacggccacagaaaagaatctttgcgcagtgagttttttttttaattaaaatttgtttttttttcatattgaaaagtaatcccatgtttcaggtggatgctgccggattctgtgcagctgttcgactttttggagagactgcgtataacaccttgggaggactagaaccagtatctcccactataaattaa

SEQ ID NO: 29709 - DNA, 923 bp, Caenorhabditis elegans
atgtttgacaaagatattccctcggaaccatggtatcatggactgctcccacgtgaggatattaaggtatgtcaagtgttcatggccgaggaaaacctcggccagcatatctgaaaatgtatatcaattaaaaacattttcaggcgatgctccgtaagaatggcgactttctggtgagaagtacggaaccgaaggccggcgagccacgtcaatatgtgctctcggcaatgcagagtgaagagttggaggatgcaggggtacggtagaagatcgtatgcagtctttcagagcctttcaagtattgaaatggaagagttttagaggaacctcggccgcggacatgaccgcgatgcgcgcggagctgctcaaacaaagcaagtattatcatattcgctaatttttcggccaaaataatataatcaacttttttttcttgagccgcttcgcacgcagctgtcatggccgcggccgaggttccgaaccctctggctaaaactgtcatttcaatatataagggacccgggaagcccgtggagcgttcggtacattttcagtgtcaaaattttcaggtgaaacactatgttatgcgtctcaacccgagtaaccaaatatttttggaagcaaaaggcttcgagaccatagcctcacttgtcaattactacatgaactcgaaagagccgatcaagaagatgacagttttgaagaccccgattctgaagcaaccatgggagattgagcattcgcaggtggagctcacgaaaaagctgggagaaggagcatttggagaggtttggaagggaaagctgacactgaagaacggaaccgttgagaattgtgctatcaaaaccgctaaactggagtcactgaacaaggagcagatcaaggaaattatgcgagaagcacggctcatgagaaatctcgat

SEQ ID NO: 29710 - DNA, 782 bp, Caenorhabditis elegans
atgtcaatcagagtttcaattaaaaaatattttttactaaatattggtttaatagttttgataattgtaaaaggctccaaattgcagaaaactcgtctctccccaaatcttcttcaaaacatcacaacgtgcacccatttagtgtatggaagtattccaattgatcgagacactggatatccacagtacagtgtatccgatgttgagtctggatatgatattgacaatattcgaactttcatgagattgagaaaatatcatccaaatgccaaactcttgatgggagttgttagaacaaaaccgtttgaagacgcggctacatcggtgaaggttgcaaacgggctccgatctcatgtgaagagcaagtgagtttgagaattttgggaaattggtcatcacagctttatcaaaactaaaatttattttccagaagattcgatggtttatttgtaactttcaacggcattcaccttgagtatcgagcctcaacgagttttcttgaaacgatttcaaaagacaaaaagatgtcgttaacatttggagtcacaggaagaagagtttttgcatttgatgcattaagacgacttcaagaaatcaatgatctcgttgagtatatctatttggatatgggagaattgccagtaagtattttcagtttaaaaaatggttgactggagttatttttagtcaaacgaggaacttgccagagtcacacacataaatccacttttctataatggatcaattccgtttgaggaaacaattcaaggaactgtcgaaga

SEQ ID NO: 29711 - DNA, 705 bp, Caenorhabditis elegans
tggaggtcttgcagcagcgaaagaagcttctcgattaggcaaaaaagtcgcatgtctggattttgtgaaaccatcaccacaaggaacatcttggggattaggaggaacttgtgtgaatgtcggttgtattccaaagaaattgatgcatcaagcaagtcttttgggtcattctattcgtgagtataaatattatttctaattataacataaagttattaacattttacagatgacgcgaagaaatatggttggaaactaccggaagggaaagttgagcatcaatggaatcatttgcgtgattctgttcaagatcatatcgcttctttgaattggggttaccgtgtgcaattgagagaaaagacggtaagctttaagagattgaaaatattctgaattcatgtttattaatgttatcctagttttcaggttacgtatatcaattcctacggagagttcactggaccatttgaaatttctgcgacaaataaaaagaagaaagttgaaaaactcactgctgatcgcttcttaatctccactggtcttcgtcctaaatatccggaaattcctggagtgaaagagtacactataactagcgatgatttgttccaacttccatattctcctggaaaaaccttgtgtgttggtgcttcgtacgtctcattggaatgtgctggatttttgcacggttttggatttgatgttacg

SEQ ID NO: 29712 - DNA, 1799 bp, Caenorhabditis elegans
atgtcgcagtacatcaagtgctacggcagggtacgcccgtcggcacggcttggggcaccttccgagtctctctttgtgggaggacgcgttgtgacgattgaaactgataatggatccaaaagatatgagctccatcatatctttgatagctcttcatcacaggaggacgtctttggaacagtcgcgaagaagattgtcgaggattgtgtggaaggctataatgggaccgtgttcgcctatggacagacagggtaagtgcttccaatgtagtttgagaaatgaaagttcgattttcagttctggaaaaacccatacaatgcttggtccttgcgattcatggactgaccaagaacttatggggctcatccctcgatcagtggaacacgttttccagcatctggacacgaaggctaaagagtgtcaaaagttgacgttctccgtttctgttgagtttgttgaactctacaacgaagtcatctacgacctcttgaatgcgaagaacaaagtccaactcagagattcgggaaaggacattcagcttgttggagccttgtcgaaaaacgttgataacccgctcgacttgatgcatttggtccaaaaaggttggcaggaaagaagcactggctcgactgcaatgaatgccgaatcgtcaagatcacacgcgctgctcatcatcaggatcaaaacgcaggagcgaacaggagagctagtcaaggaaaggtcatctatcctgaaccttgtggacttggcgggatcggagcgtcagacgcatacaaaatcaagcggagatcgactgaaagaagcgacaaatatcaactcatctctgacagtgctaggccgttgcatccgtcttcttgccgatccttcgaaagctaaaggacacgttccataccgcgattctcatctcactcatattctgaagaactcgcttggtggcaattcaaagacggctgttatcgttaatatgcacccggatcgtgattttgcacaggaaagcaactccaccttgatgttcgctcagtcgtgcacgatgatcatgaacattgccactcgaaatgaagttatgaccggcgaccaggagagcagctacaaaaaagccattcaagaactacgccaagaggttgacgaaacgcgggaaaaggttcggacggaattcgcatcacagttggacgaagccgaagttgaacaacttcgactgaagacagaaaacaactccttgagattggaaaacgtcgatcttcgtgcaaagtatgactttgctcttctgaagtacacgatcggatcagaaaacgaacagattgttaacgagttcaagaagatcatcagtgaattcagtgccgcaaatagcagttctccattcgaatgcatagctctgaagaatcaaacggtatgttaattattctcatcattttgtgtaaatatgagaattttcagctccaattggagatcgaagccagcgagaagcgataccaggagctgcaaaaggagacaagtgctctgcgaaatcgctatcaggaaaatctggacgcgacaatcttgatgcaaacaccgtcggcaaaggagaggaggagcagttcgagacccaaacgccgggagacccaatacagaccttcacctgcacgaatggctttgttcgctgaagtcgaaacctcggaggatgccgtgctcgacctacaatgtcaaaacgagaagctcagttgtgaactgagctcattgaaagacaagcacgaagaggcaacgtcaaagtcaatcgagacggaacgattgcttcagggagaaattgttgcattgcaaaaaga

SEQ ID NO: 29713 - DNA, 589 bp, Caenorhabditis elegans
atggattctcaaaaagatttcaacttgggagactcatcaaaaggagaaaaagaaggaatgcagccttcgacaggcaataatgtaactttgcattgattgttgtccagttcaacttgattatttttgaagcaattcgagccatttgagtttttgaagaaaatgattcaacctggaagagtgatgaaacgatcaaaggtaaactacgctacctgcagaaaatataatgtttagttaaatttgaattttagaacaatttatcttcaaatgaagtctggtcggtctgtcgagcagttattgatgagtttaaaaaagaacaaaatctgatggaagtcagtgctccagttactgtgattggagatgttcatggtaattttcacgatttatatcgagctttgttggcaagaactgaacaggatatcactgatgagcagaagtcaaattttagtacaagacagtttgtcagagacaagtgaatgaaggagcggaaaacaattttaaatatttaatattcagatatgtttttcttggaaattatattgacaaaggtcctcgatcgattgaatgcatttgtcttctttttgctttcaag

SEQ ID NO: 29714 - DNA, 1075 bp, Caenorhabditis elegans
atggcaactcccgatacttcggctgcgaaaatggcgggacaggatcgtcaaaaggtacgtgatttgactttttctaaaatgagttttcgaactttctttgactttcaaaataattgttattttcagttaaaagttgttgcatggttgcaaaatcttgttgagcgactgaaaggatggactccaggacattgccagaagctattcgatgagaaggagctcatccagctttgttatcgtgctcgtgaagtcttctggaagaacaatgtgaagttagaggtgtgtacagactgcaaaattcttttaaaaaattaattttctttagctgaaggctcctgtcaagatatgcggagatcttcatgggcagtacgaggatttattggccctgttggaattgaatggatggcctccagagaccaagtatctctttctgggagactacgttgatcgaggaccgttttcgatcgaggtcatctcattgctcttcgcctatcaagtcctccacccggacaaagttttcttgctccgaggaaatcatgagagtcgcccggttaacatgcaatacggattctttatggaatgccgtaaaagattttcaaatgctctctacgatgcgttccaactggcattctactgcatgccactttgtgcagtagtcagcgacaagatcatctgtatgcatggcggaatttccgaggatttggtggatttgaggtttgaaatttcggcaatcaaggtttatgctcattattttggttacagacaacttgacaaagtcgaacgtccctgcgatgttcccgatattggcgtcattgctgacctgacatgggctgatccggatgccaccattcaaatgtacgccgagtcgcaacgtggagccggtcgtgtctttggagcagaagcagtcaagaaattcctgaacacccatcatctcgaacttgtcgttcgtgcccatcaagtcgtcatggatggctacgaattttttgctgatcggcaactcgtcaccatcttctcggcgccatcatactgtggacaaatggacaacgctgcggcagttatgactgtggatgaagaattg

SEQ ID NO: 29715 - DNA, 950 bp, Caenorhabditis elegans
gagaaatctgcgactatattgaagaagtttaccttccggatgactatttcctacttgttaaactgaactcaaaacgtattcgacttcttcaattggaagtttgtatggaatcaatttcatatgcaattgcaacttcaaaagtgtgtccacagatgagaggatgtaaaattgttgctcatggaaagacaatgatggcaattcgaccaccatctacaagcaaattaagtaaaactatgacaatgcaaattctcaaatattctctcgcaaatgtggtagtcaaaggaattccatcagtgaatcgatgtgtcattcatgcagatgaaaagaagggtgatttctattctcttttggttgaaggaactgatttccgatctgttctctcttctgttggagttgatccaagaaaaacgaattttaataatgcactcgtggtcgctgatgttcttggaattgaagcagctcgttcgtgtattatcaatgaaatcattgcaacaatggatgctcatggaattggattggatagacgtcacgtcatgcttctcgcggatgttatgacttacagaggagaagtacttggaatcactcgtaatggtctcgttaaaatgaaagattccgtacttttacttgcttccttcgaaaaaacgatggatcacttgtttgaagctgcatttttctctcaacgtgacgtggtaagtaaattttatagtttcctattaaagtttataaatcgaaaaaataaaaacccaaatattttcgattttttttaatttgttttaattgtagaaaatttattgaactttttttagattcatggagtttcggagtgtattattatgggaaccccaatgactgtcggaaccggtacattcaaattgatgcagaaatacgacaagaaagccgttcttaaacagaattcgccgattttcgaacgtctgaacgtcactctttaa

SEQ ID NO: 29716 - DNA, 725 bp, Caenorhabditis elegans
atgccatttttctctagctatctgaaagcccatatcacacctggaccacttgaaagagctcagagctcatcacacggtggtcatggagccaaagctgatcttggagtgcttctcggagtctacttgccgacgattcaacatattcttggtgtaaccatgttcattcgtctcttttggcttgttggaatcgctgggctcgggcaaacttttctgctacttttcctttgctgcttctgtgtaagttttgatttgtttgtttgaaaaaaagagattgtttttaaatttttcaagcattaaacccagtttgatacaatttattaatttacagactttccttacctgcatctctatatcagccgtcgcaaccaatggagtcgttgaatctggtggagcctatttcatgatatcacgtaatcttggaccagagttcggatcagcagtgggaatactgttctaccttgctaatactgtagccacatctatgtacttggtcggaggagttgaaatattgttactctacattttccctggattaacgttcggaggagttgaaggacaacatgatacctgtttgttaaaaaatacttttttctgagaataagttccaaattacagccatgttcggaacgatgaccaactctctacgattctactccacaatactacttctcatcgaatttgccattgtcgccatgggagtcaagtttgtacaaatgcttgcaccg

SEQ ID NO: 29717 - DNA, 542 bp, Caenorhabditis elegans
gctgacttcgacaaaaccgccaaagaaataattcatgccatttccgaggaagagactatatatcagaatgctgtacaagagaattacgctaatatgtctgataccacattcaaagcacttcgtcgccaattgccagttactcgcgctaagatggactggaataaggtatcgtaatttcacaatatttcggaatgccttcggaaaagtgcacagatttattcagatgggtctcggtgtttcttatttttctgttaacaaatgcttcgaatcagttttatatcccttgtcatgcagacacaataaaaaataattgtgatttgaaaactaatttaaaaagaattttaacagaaacaagagatgaagccgacaaaattctctaaatgcgaagtaatttctttgaaaaagattaagcaagggctaccataataaatctgtgcgcctctacaaaggcatgtcaaaattttcagaattgataaaataaaaagaataaattaattttaattcaggctcaaacctaccgaattggtcaggaaatgaagtaa

SEQ ID NO: 29718 - DNA, 1031 bp, Caenorhabditis elegans
atggcagaaaacactgcttccgaaaatgacgttgagaacgtcttcatttcgatggatgacaagtaagtcttggcattttgccacagagttcactcgcacttctgcagtctcccctcgcactttgtcagagttcatacagagtttagatctttctggcgaaaagccgaggtgatttggaagtcttgcttccatggtaggcaagcgcggtttcacgacctgcttgaatcctgccggcctcggaagacattgtgggcgcaacaaaacccgtgccagagttgcaaacatgcaaacatgagagtttctccctttttctcggatttcaaataagaatgagtacgtggatcgagatgtattgttcatttgactattttccaagtgaaataaaatgtgaaatcacggattttctatcttattaaaatacaagcccatctttgcaactgccatggtttttgctccgcccacaatcttccagttttgtgtaaccccttttcgaatgtttccccgatcggtggggcctcgaatcgaaggaagttctagaatggattgaggcttagaatatttttaatgaagccaaaactaggatacttatgaaatagaagaaataaatagttgaaaatcaaaaaaatagcattattttccagaataaaaggttaccaagttgtcgaaagtataggagacggagcttatgggcaagtattcaaggtttccaaaaatgcaaagaaatatgcaatgaaagtggaacccaatcggttggatggcggcccagcgtcaatcaccaaggaggtttggcaatatttatgaaacgatttttaataatatgtgaaattttagatagaggttatgatggaattgaataatcgtggtgctaagttcttcccaatattcgaaacaggaggacgagaaccaaaattccacatggttgtgatgactcttttgggcgaaaatctacaagtgttgagaatgaagggatgcaacccgaaggcttgtacacctggaacatggagccgcattgggatacaatgcctttttgt

SEQ ID NO: 29719 - DNA, 635 bp, Caenorhabditis elegans
atcaacaacgccggagctaatattccagattctcaaggacaaactcgcactaaatgcagcatcgaaaatcttaccaagatgtttcagctcaatcttcagagcgtcgtcgaaatggttcagaaagtgcgaccacatttggcaaaaacccgcggagagatcgtcaatatttcaagtattggagcggggccagcggctgtaagtatagtataagtatagtatagtataagtgtaagtatagtattgtttttctattttaatcattaaatcaattatagcaacccgccagtccatactactcaagcgctaaagctgctttggatcaatattctcgatgtgccgcaatcgacttgatttctgaaggaattcgtatcaacgttgttcaacctggttttgtttccactggattctcgacagctgctcgaggacttagcgcggatgaatctgtcaaattctacgacttgatggggtccctaccacattgtattccagctggatactgtggtcaaccagaccatctcgcatctgtaattgcattcctggttgatcgaaaggtctccgagtacatcgtaggacaaacgatcatagccgatggaggttcctcattggttatcggatgtcatgccccgcgccagtaa

SEQ ID NO: 29720 - DNA, 689 bp, Caenorhabditis elegans
atgtctggtcgattttctggtaaagacgcaatcatcaccggttcctcttttgaaattggaagagcaactgctcttctttttgccaaagaaggagaaaaagttactgtgactggaagaagtgaggaacgacttcaaggatctcgataagttctattagatgctggaattttggagagcaatattcttattgttccggctgatactaccatctccaccggacaagatgctctgattagtaagactttggaaaagttcggaaagattgatattctcgtgaacaatgctggagcatctcttcctgatgatcagaataaaactggagttgcacaatcgattgagacttttgaaaaagtaatgaatctgaatgtgcagagtgtaattgaaatgactcagaagattcacccgcatcttgcaaaaactcatggagaaattttcaatgtctccagcattgtagctttgaagtttggcgtaagtgaaattttgaaatcatgattcaacaaaagctaatgtttcagtcgggccgaggcccatactacccattggcaaaagctgctcttgatcaatacataagaagtgctgcaattgatttgatttctgaagggattcgagtaaacaccgtgaatccaggagttgtggcgactggattcatggaagttgccacaggattatcttccgagcaatctcagacg

SEQ ID NO: 29721 - DNA, 1103 bp, Caenorhabditis elegans
atgactggacgcttttctggaaaagttgcaattatcactggttcctcttttggaattggaagagcaactgctctactttttgcaaaagaaggagctaaagttactgtgactggaagaagcgaagaaagacttcaaggatccaagcaagctttgctagatgctggaatttctgatagcaactttttaattgttcctgctgatattaccacgtcctccggacaagatgcactgatcagtaaaactttggaaaagtttggtcaaattaatatccttgtgaacaatgccggagcttccatcgctgattcgcagaacagagctggattagatcaaggaatcgacacatacgagaaagttttgaagctcaatgtgcaaagtgttattgaaatgacacagaaaattcgtcctcatttggcaaaaactcgtggagaaattgttaatgtttcaagtgttgctgctttgaaatttgcagtgagttaaagttgattgagttaaaaattcaaactaacattttcagcatgtacgtaatccatactacccactggcaaaagctgctctagatcaatacacaagaagtgctgcaattgatttgatttctcaaggaattcgtgtaaatactgttaatccaggagttgttgcaactggatttcatgagagttgtactggattgtcaactgaagaatctcagaaagttagtgaaagactaaaacattgtattacatgttacggaatagtatagttctttggtccctttttgtcaagtcttcttctacaaaattttaaagttaagtatataattatgaattcaaaagatgtgctgatacttttcacataaaatattttgattaagaaatttctggaattcctattccattcctcttaatacgccagtagattccaaaaattattttcagttctacgataaagtcggcgcaaacaaatctgcaattccatgtggattttctggaagaccagagcatattgcaaaggcgattgcctttttggcggaccgtgactcatctgagtacattattggacagaatatcattgctgatggtggaaccagtctggttcttggattccatgctcagttgccccaaaaataa

SEQ ID NO: 29722 - DNA, 1757 bp, Caenorhabditis elegans
atgacgaagaaaaattggatttccatcaaaaattatgcaaacggtttccatcaaaaattatgcaaatttgatgagcccgtcacagcgaacaatgtaaaatgtgtcaccatcgttgatttaagattaaaattagaattggaaaaacaaaaaggttccagtttttcgaacggcatagtacgtttttttaagatgaaatcatggtatttctcgttctgagaactaatttttgaaaatacgattattatttttaaagttatgtgcacaattagttgaatcctataaaaatagtggtgtttgaaaaatgtgtcgctatgatgagaaacatttacaaaaattttttaaaaatgaattccgaaaaaaaaacccgggtatttcaaaagtggcatttccgaaataaaacacggccttcaatgtttttctagatatattgtcgcttttaagatacatatatgcttacaattagttcaataaattagttgaaaatatttatctgaaataaaaaaatcgagaacaatgaatacgtctgtaacagaatctatgtcttaatttagggttgagtttcagatcagattaccagtatgagcattcaccgtggttcctgttctgttttcttgttttttgttctagaaattttacttgctccaattctggtccaaaatctatgtatccacgctaccttccgctattctttttattttttccatgctgaaatatccaaagtattcattctcttcttaatgatgttttcgtctttagggtgtgccttcttgatggaggatttttcctcgaatttcacgacaacttcaattcagaatgatagttatgaagaagatcaacaaccacgtgagttttactctatttctgctattttcgaaatcgagaaaaaaaacggaaacatgtaaaaactcctacatttccttccggtttgtggtgtaaagttttgcaattttctgcatcaggtatttttttccgtcgtcgtagaattaatttttcaattttatgttccgaggaaaaaaaccgaactaaatcccccgtgtcttattatattttcattcatttccttagctttgttcattcttctcgatgctcctcccttactcttgaggtctgagaagtaaaaacaaatagaattgaattggaagaacaaaaggagaaaaacatcagaaattatggttgggtaccttcatattactcatagctaactctctgtctgttgtagagtctcacttgggacaatactagacagttgaattcgtacgtttttataatactgaaatctgagtgggatccgacggattttgttctgaaattaaataattttatttttgatcaccacagatttgggttttctcctcctggtgtactttgcacacgttgagaattttttcctctagacatcttttcaatttctttgatttctgatcaaatttgaatactgcgtaaccgaatttccttgttttttccgtatagcatatcttctgtaggatttctcgaaaaatttcagttagaaatattctactcattgatttatcttttccctctgaaagataaaagcttccccgaaatgttcatttttgaaaatggtaggatttagttttaagtgaattatcagtcaagaaaaattaatgttttaatgttattgtttcagatatcgatatgtcatttgcaaaaggttttatgacagttgtctacatagtcgtttgtctcgttggaacacctggaaatctatggatcatctataaacttttccgtgcaaa

SEQ ID NO: 29723 - DNA, 2165 bp, Caenorhabditis elegans
atgatgtcatcgggggaggacgaggagcaggcggcagctgatgagcaggagagaaccgatctgtggcagcagacattacaggttagtattttattttgcaaacacttgaaaaattgtaaagaaatactttggaaatctctgggaaaaaagtgtgcaaaaagagtggaaactgataattcttacgaagcaagaagaatcttcatctgttggatagatccaacagatttcaaaaattattgaaaatatacctgctgtagggcctagtatgtcatccttgaaagtcaacaagcatttttcatttgacctaaaaagcttctttatgctcatatcaagacactggacttccgttattaaatcccataaatcgcatccaaattggtagatcctgagggtcagcgaccccatcaatcccagcagcacaatgttaccacttttaatatccggtagcttttaatggtataaaatggctagggaccacatttatggtatcatttatagtcagatgcccactatacgttaccatgcccgtgagctttatgccgatatttatggatattttgacgggttaggtcctttactttggatgcgatttaatgtaagtgacatattcttttggaagtgttagaaacacaaaatgttgttaagagactctcttattgtctcgtactctctctatgatccaggaactcttctgattgaacacaggcaaatccgcagtacgtgtctgtgtgtatcatctctagtgtaatatgcgggagctctcgagagacgcagatacttgcagaaaataaattgagggtggaaaatggtgatcttgttgtgaagtcaaaatatctgtttggtacaaaatgagggagtgccgagtgacacagatctttaaaattgacccttgttagtcatgcaaaagatatgtgacacctccctgtgcatttttggaatctgagaatagacaaagatcacagatgaattttaaaaatcaattagcttactgtactatgagaactgaaaatgcgaagatttttctggttccattggcttgaaattttattttagtcaaccaattttcatatgaaacatttcgaaacatgcttgtttttatctattgattttctgaaacagagataaaatttgagaagttgataataaatcactttttttcggaaaacatgccatccaatttctgatattttcaatttctagttttctttgaacgagtgactttgcattcttcaacataaaaagaaaaaaagacatttcatgcacaatgtggatatgattatcaagttgaatggtgccttctcttgctctttttgttctttttctccacttttctttcccctttttctctttttctctctcaataagatccaaagggatccactttttgaatccatccaccaaagtaagtatgaaagaaaaaaaagccgagagatgctaacaaaacaataaaaaagaagaaggcgggatctttttgtgtattatgatggagcctattggtagaatgagtgagaaaaagagaaagatcttatgcaaattgacaaatgatcgtattcatgggttttgcgaaaaaggaaagaagctctttcctctatgccagctcagtcgcgcgacttcttgagagaaggagaagaaactgaaatttgaaaccgaccattgaccgatttcacatctttttccaattatccacataaaaacaagaaatggaaagacaataaaatgatgagggaacccagttgaaaaaaatacaccaaaatttaaaaataccgagtatcaacaacaagttattaatcaagcgtgaaatctagagaagtttatttgaatgagcaaaaaataaatttcaggccgccgtggcagcttcatcatcacaagatgccacaaagaaacgacccgcacaacggaaacctcttcgacaaacgaacgtcgtcgaaagatccgaacgatcacttctttgcctctccttgaataatcccatccgaaaattgtgcatcagtattgttgaatggaagtaagtttattgtttttctaaattcaattttactaaaatcaaaaccattttcagaccattcgagtttttaatattgtttatgatatgtgccaactgtatcgctctagccatctatcaaccctatcctgctcaagattcagactataaaaatacattactt

SEQ ID NO: 29724 - DNA, 657 bp, Caenorhabditis elegans
tctggcatgctcttcaatgataacacacaaatgaaagtgaattcagccggaaatcaactaactttcgttgacgagaataataccgaacaattttacaccatgaacgatcaagtaccgatgaacttgcagacgaagattaatatattttcaaatgtacaatcttacatgaacacccatttggaagctgacacccatttggaagctgaggatcaatgtgtcaataaagtgccaccattacgcaactttgctcgacttccaacaatacaaaattggtttgaaacaaagtcggccgttatattccatctttcaaacgggacagttcagattaactttcttgtgagttgaagtgtatcctttatagtttctgaatcattcaatttttaggatcatgtcaagatggtgctgtgtccgctgttgaagtctgtcacattcattgaggaaaacaaacgtgtttcaactttcacgttcgcaaacatattgacaaacagctgcccaaagaagtatctcagtcgtatcgaatatgcccaagccaaaattaaattgcttcgtcctacaaacaaccaggagcatgtcgtctatgtggactctccatgccgtcctacgacttcgaacacagctcacggtgctccacttgcttcctccagatatctcgcataa

SEQ ID NO: 29725 - DNA, 1031 bp, Caenorhabditis elegans
atggatattgacgaattggaattgctacaagaagaacgagaagaacaaccaatccgatatcttccaaaagttttgaatggaggaatttcgggaattgttggagtttcgtgtgtctttccaatggatttagtcaagacacggcttcagaatcaaaaagggacttcgaagtatacgggtattgccgattgtttcaaaaaatcgtggcaagctggggccccaggacggctgaatcagataaagggaatgtaccaggtactgtattgtattgagtcaatactcttttttgatttaaaaaactttcagggcgcctctgtgaacattttcttgatcactccagagaaggccatcaagcttgttgcaaacgatttttttcgtcacgcattgatgaaggatcacgatgaaagattgtcgacgccacgtgggatgatcgctggagcatcagctggattttgtcaagtcgtaatcaccacaccaatggagctattgaaaattcgaatgcagcagtcttctgataaagtaaaagctaccaagctgatctggaatctgttgacaaaggatggtggtgttcgtgcattgtataaaggccttggaccgacaatggcacgagatgtttcgttttcagcaatgtatttcccgcttttcgcctatttggatggcctcggtccacgaaagaaagacgattcaggtttgtcgaattgtttactgaaactttaaattttcaagttcatatttaaggcgacgcagtattctgggcaagctttgtatcaggattaactgctggagcaactgcatcattatcagtgactccattggacgttgtgaaaacaagaattcaaactggaggatccaactacaacggaattttccacgcgttttatcgtattctcgctgatgaaggtgtaaaagctctttttaaaggagcaatttgcagaatgatggtaatggcaccacttttcggaatcgctcagactgtctactatgttggatcggccgaaaagattctcggcttggaaaaaggatcaagagtataa

SEQ ID NO: 29726 - DNA, 859 bp, Caenorhabditis elegans
gctttacaccgaaaagcaatattgtaattggcgttcaaacggaaaaatcggctgagaaatggaggcaactaggatataaaaacgttttcacaaacacactggaaatgctggaaagatattcgacggcaatctatgtgatttgtgtgaaacctcaagttttcgaagaagttgtgtcaagctggcctgtaaactcaagaccagaatttattatttctgtaatggctggagttccattaaaagttctcaacgcgaaggtgattactataagcagttataaaataattttagaaatcataatttgctgtacataacatttttccagttgccattcgtttcgggaaacactaccattgttcgtttgatgccaaatgtagcaagttctattggagccggcgcctcgacgatgtgctatgaaaagaatgaaaaaattatgaatcaagattctcacatcgaattggcacgcgagttcgccgagtgtgttggaactgtcgaacttatcccagaaagatgctttaacccggcaatggctattggagggagtagtcctgcatggacatttatgtacatcgaatcactggcagatggagccgtcgcacaagggctcggacgagcagaggctaaaagattagctgctcaagcagtactcggagcagctcaaatggtgctcaattcgaactctggatttgatattgaaactcagcactttggatccctcaaagatatggtttgctcccctggcggtacaacgattgaaggtgttcgggcacttgagaagaacggattccgttacgctgttatggaagctgtggtagctgcctcgaccaaggccgatgaaatggcaaaatctctggccaagtga

SEQ ID NO: 29727 - DNA, 313 bp, Caenorhabditis elegans
ttcagataaaatcatttatcaaattttaaatgcaacttatggtgatcttggaccagataaactagatgaggttaaacataattttaagtgatataatttgatgaaattatttcagatggctcaagagctgacaaatgatcctactctagtaagagatattgttccatttctgattggtggttacagtctggaagttagaactagtctttcctggactgcagcagatatgttcttgtgggttgcctatgagcaacagttgattgatttgaagttagttgttgtatttttgaatatgaaagaccggaaagtttag

SEQ ID NO: 29728 - DNA, 1351 bp, Caenorhabditis elegans
atgaagtcaaaacgtcgggatgatattgttcagttctgtcgagagaacacgttgcttgtcatgacaatgttttcagtgtttcttggtgttgttctcggatttggtcttcgtccattgaatctgtcacaggaaaccttgcaacttattaattttcctggtgaaatattcatgcaggttctcaaaatgatgattctccctctcattttctcatcgctgatctctggtgagttgaagcttaaacaattgcaagcctttgaagttcaaaaatctgttagtacaaataggatattttatttgttttaattatctgtatataaatattatctgttggtgttcaaacatgcgacgttactctaaatttcccacaaaaaatacacaaacttttctaaattttgcaattcaccaaaactttgactgaaaatttaatagaaatccaaaaatttttatattgttttcttacgatattccgcatattcgagtcattaaaagtgtgtttaggcaaaaaggttgaaaatagcaagttcaagtttttccatttttagctctagcccaaatggacgcgaaggaatcgggacaaatgggtgcatcaacagtactttattatctttcaacggcagttcttgcaacaatcgtaagagttttactattccttctaaatattctaaattctagaacaaatcgatcattttttaaccaagattttctgtttccagctcggtatcttcctggttacagtaatccatccgggtgatccgtcaataaaaggaactgatatttctgaagctccatctgatggaaatgtatctccacttgacactttcctggatcttgttagaaatatgttcccagagaatataattcaagcaacatttgaaagaatgcaaacaacgtatgtagctatccgtccaaaaattgcctcaaaaaatggaacatctggaaatataatagtaaaacgatcaattggaatgacaaaaggaatgaatattctcggaataattgttttttgtactggtttcggaattgtgatctctcaattgggagagcgtgccagaatagttgtcgatttctttgtaattttggatgctgttattatgagatgggtggttacattaatgtggtttgcaccacttggtattacttgtctcatttgtggaaatttattggaattggatgatatatctgatattgcatcggttcttgcattatacgtgttcactgtttgtgctggtttgatacttcatacaatcattactgtacctctaatgtatttcttcattacaagagaaaatccacttccaattttcaaaggaatgattcaagcggctgttactgcattcggaactgcttctgg

SEQ ID NO: 29729 - DNA, 759 bp, Caenorhabditis elegans
atccatttgatggaagtccttcgctctcggaaaataaagtatatacaatgtttgaagctgcagttcccatcttcacttacactgcagaaaggcttgtgaagagttatccaaaaggattacgtcaagattcatcaaatatgcatccaatggtttcttggctttgtggaattcaaagtgttgctatgaacttccaaaccgctggtgaagagcttgatttgaatgcaggattattcagaattaatggaaattgcggttacgttctgaaaccaagttgccttctcgatggagtcgatccaagaagtatggccaaaccaaaattgaagcttggtattggacttttctctgctcagtatcttccaaagtcagaacccggaaaagagatcattgatccatacgtcagtgttcagattttcggaattccacgagatgaaacaaaagcaaaaacaagaatcatcaaggacaatggattcaacccagaatggagggataatttctatttcacactctcgtgcccagagctagcaattattcgattctgtgtaaaagtaggttttgaaacattatggatctaaattttatattccactttcgcaggattttgactctacatcttcgaacgactttgttggagaattctcaattcctgttatgagtcttcgtacaggtttctcgcaaattcaactaaataccggatatcaacatactctggacccatctgcatctctttttgtacgaattgcaatggaggaagagtactaa

SEQ ID NO: 29730 - DNA, 433 bp, Caenorhabditis elegans
tcaccggaactatgtgcgaagcttctgactgtaattctaatggaatctgtattggaacaaagaacttgaaatcctgtatctgcgctcctggatattatggatcacggtgtgaatcgagattcggtaagttctaattataaaacataaatccacaattcttagactttcagctcttctccctggcaccgaaggaatgttctgtgaagctaaagactgtaatggaaatgggatctgtataggaaacaagcttcttcccatgtgcatttgtgctcctggattcactggtcttcgttgcgaacttgagccattatgtactggtgcacttcaatgttctggtaatggtttatgcattggatcattgaaatcttatagttgtacttgtaatcttgggtggactggtccaacttgtgcccaaagcactctaatcggataa

SEQ ID NO: 29731 - DNA, 794 bp, Caenorhabditis elegans
tgctaaacaactcgtcgttaagatgttcgagcagactggggcagagctcggattcgcagaacaagctggagaagactcgcagaaaatgatgttgagatcgcttgttcaagcacgactcgcccgtgcaggtcatcaaccaacaattgacaagttcactcagatgttcaatgatttcctggagaaaggaacgccaattcatccagacattcggctagccactttcggtgttgttgctcggtatggaggaaaggaaggattcgataagctaatgaatctccgtgaaactaccacattccaagagatcgaaagacaaaccatggtagcaatgtctcaaactccggaggagtcacttcttgcccaacttttcgaatatggatttgagaagaacaaggtccgtccacaagatcagctgtatctcttcctcggaactggagcgactcatatgggacagcaatacgcgtggaaatatttctgcgagcacattaaagagttcctcgacaaatacggaggtgccaactcgagtctcttccagcgatgcctcaagtttgctggagaaagttttggaaacgaaaaacgagctgtcgagtttcaagatttcttctgcaattgcaatgttctcagcgatacggatcgccagactttggccagacccatcggacaggtatttattttttcaagtttaattgttcaaaaagcataaatttcagaccgtcgaagctatccgtttgaacgctcgcctgctcgaatccaaccgccaaatcattgaaaatcttcttaaacagagcaacgtttaa

SEQ ID NO: 29732 - DNA, 758 bp, Caenorhabditis elegans
gccaggagatgacattcatccaaaacgctaatgctggagctcttgctggagtcttcacaacaattgtgatggttcctggtgaacgaatcaagtgtcttcttcaagttcagcaagctggatctgctggttctggagttcattacgatggtccacttgatgttgtcaaaaaactatataaacaaggaggaatttcatcaatctacagaggaactggtgccactctgctcagagacatcccagcttcagccgcttatctttcagtatatgaatatctaaaaaagaaattctctggagaaggagctcaaagaacattgtcaccaggagcaacattgatggctggaggacttgctggtattgccaattggggagtgtgtattccagctgatgttctcaaatctcgattacaaacagcccctgaaggaaagtatccagatggaatccgtggagttttgagagaggttcttcgcgaagagggtcctagagctctgttcaaggtgattttttttaaacgattgggacgatgcaagtgaatttttcgtcatttctcgacacatttacatacatatatactttacctgatttctagctacaatttgtataaatttcagggattctggccagtaatgctccgtgctttccctgcaaacgctgcctgtttcttcggacttgaactcacgttggctgccttccgttactttggcattggtggacacccaacaccatctacagaagttgttccactcccacacgacgagtaa

SEQ ID NO: 29733 - DNA, 772 bp, Caenorhabditis elegans
ttccgatgatgagactggcaacgtggaaggagctcaaagttctgcttttggaggcgacgttccaccagttcctgatgctccaaacggaggatggaactttggaaagtagatctccatgattcctttaatcacaaaatacgttttgtcttatttctcgtaaacaatttcgcatgccgttcccatacaaatgttcatgtagttttcgtcttactatttttcacacctcactttttgttaggttctcgtgtattttcatctgacacgcgagttcctaagccagcttctcggaaatgcaagctctctttcatgtgagattttgcactttttgaccaattgagtttgcacgttcttctacaatcgattgtcaattatctcatcctttctttatctcttcgttgtttctgtaccatcagtgatttgattaacatttcactttttcatccaccatcttttttccattgtgattaattagttacaatgtccccgccctcttcttcgtgtgtgcgagagtgactgttttatgataatatatttcgatttctttttaaagtgagtgtgtgagttgtgcatttttgttgagttttgttttcatttttgtttcccattcgcgcccgttcattgcccgcgtcccccaccctcatccttttatcattgttaccgcgtcgttttcaaatctctcatcatttttcccagtccctccaatccccacggtccccagattttctctctaaaagcgagtattttcattttcttcacatgttacttttattaa

SEQ ID NO: 29734 - DNA, 548 bp, Caenorhabditis elegans
atgggcttattcttctctaaaatttcttccttcatgtttccaaatatcgaatgtcgtacattgatgctcggtttagatggagccgggaaaacgactattctctataagctgaagcttaatgagacagtcaatacaattccaaccattggtttgttcactttttaaatgtggtcatacttgagtatttgtttgaaggattcaacgtggagactgttaccttccaaaaaatcactctcactgtttgggatgttggaggtcagaagaaaattcgtgctctctggaaatactactttccaaataccacagtaattatcaagaggaattatacaacgaaaattgtttaatttcagacattagtgtttgtggtggacagttcggatattgagcggattcccgaggcaaaggaggaattgttcagtttgctggccgagccagagcttgcggattctcatttgcttgtctttgcaaacaagcaggatatgccgaatgcaagatcaccagccgagctgactcagctgcttgatttgggttcactcaagaatagagag

SEQ ID NO: 29735 - DNA, 486 bp, Caenorhabditis elegans
aacaaataatccaatggctatgtattctgatggtccaaacggagttactaatggtaaaactgaatgaattaccaaacatcatgaacctactttttcagagtcaacagacacaacacagcaaaatattccaagcgtttgggttctagggccgacaaaatcagaattcccagaagaagatgctaatttgttattccaattggatccgtccacattcatgaaagtagacgcaccaaactgcattatttaattgaattcaaaagttttcagtcaaacaaagaagttccaagacgttcatacgttcgtcttctccatcagagctctgataaatgggttcatgcaactaatgcaactgagaaacagaatcttcactacagtagtaaaaatgagaaaggatgggttaaagtgatatgtgaaaagaatcgagttgacaaggaaacgtttgctttgttacctgtgaaccccgatgaggcaagtcaaagcttaaac

SEQ ID NO: 29736 - DNA, 486 bp, Caenorhabditis elegans; identical to SEQ ID NO: 29735

SEQ ID NO: 29737 - DNA, 486 bp, Caenorhabditis elegans; identical to SEQ ID NO: 29735

SEQ ID NO: 29738 - DNA, 1647 bp, Caenorhabditis elegans
atggctcaaaaaccacatcatattggcgtgcgaaaatcgtggctcacatggcattcacagaatctcgaaggtttgttccaaaactgaattacgatttaacaatttttaaaatttgtttttagaattccgtcaatctcaaccactggttgttgcacaagatgaagttgttcgtcggttcattcgaggatttttcccacaaaatttagtcgttagtggaaatgaggtaataacttatcaaaaaaattttaaaattcagtatagtatctatttctcttatccaagtttgcaaaacttcacatttttccagattgtaatcaaacgacgaggaaacgtactgatcgttgccggattccttcaatattcgcgtcgactcgatattcgaagaatctactggatgttcgggtttgcagaagaatttctttccattcttctgaaacaaccagtgaagctagaaatggcatttgtggaatccgaagaagatgtagcatacaactatatctaaaactttcatctttgttatagaaccgaaataccgtagttttattttacttctttaattgtttctgttgtgttccaaaaaacaaaataaatctgaattttggcatttggattctggattttggtccctgaaaaatatacgagagtcaacgataagacttcataaaattatcaatcagcgcattggtttgacaaaaatcaataaatatttgtgctcacttcgcacactgataagcaaaccccatagtctttcatacaaactattgcgccctttcaatcgtcctttttaactatacgtgaatcacagttaactatgcgtcgctcatataatcactgattattattcgtatcttattccacttgtggtgtgacttatctgcaaaacctaacaacattttaatcactaaaacaaaaatttcgtcattccatgccttcgtcttctccatcgatggacgagtctcgaaggtctgctgttccaccaaaagagcctgctggcagaatttgcacagttagttttgatattatttagaatataatcactttattgaagagcctcttgacgctggtttaaaagttgaaaaaaccatcagaaagttgtaattttattttggaaacggcgtgagatttttcgatttttgcttaaaaaatacggtatccggtctcgccaagacaagtctttaaggagtactgtaatttcaaactttagaagaacatgcatatttaacgtgaaaaactaaaataaaacacataaatgtttttaaaaaagtattaatagctatgaattatcaatgaaaattccacagcttgaaattacagtaatcttcaaatgcacacagctttttgtactgaacaaagattgtcgtgccgagacctggtaccgtatttttgacctaaaaatcaaaaagaaaattccgtttggatacatatcgtcttttccaaaacgtaagatgagttccatagtggattactacaaatctggtggtatttttgtaaaaatataatagaaaaacgttttttcatttatacttctaaaccaacaattgtaattaattttaggtttgctccgaccgtgcaaatggatacaattttggtgtactcacttgcgaatcttgtaaggcgtttttcaggcgaaatgcttcaaagcataag

SEQ ID NO: 29739 - DNA, 673 bp, Caenorhabditis elegans
atgcttcgtgctgctggtaacctatccaagtcaatgatgaaatcacagcgtagatttctgaatctacaggagtttcaaagcaaagaaattcttgaaaaacatggatgcagcgttcagaatttcgtcgttgcatcgaacaggaaggaagcagaagagaaatggatgtcatttggttagtttttagaaattcatgaaaaataaaagcgattaaatttcaggagatcatgagtacgttgtgaaggcacaaattcttgctggaggtcgaggcaaaggcaaattcatcaatggaacaaagggaatcggaggtgtattcattactaaagagtaagcttttttgaaaaagtagtaaaactaaaaatttgaataaattatatatattttcgaacgatttctttttaaatccgacgaattttatatttaatttttcagaaaagatgcggccctcgaagcgatcgacgaaatgattggaaagaggcttgtcacaaaacaaactacatcggaaggtgttcgtgtcgacaaagtaatgattgccgagggagtcgatattaaaagagaaacctatcttgctgttcttatggatcgtgagtcaaatggtccagtggtggttgcatctccagacggtggaatggatattgaagccgttgctgaaaagactccagaacgaattttcaag

SEQ ID NO: 29740 - DNA, 1007 bp, Caenorhabditis elegans
atgaatacgtcatttgtagagccattatatgcagatgttgaacaacttgaaccagtccctctacttagacattcatatcaactaactgttctttatacagttgcatatggagctgtattcttcactggtgtacttggaaacacgtttgttgtcttagcggtttgggctcataagaatttaaatataaccacggattatctaattttgtctcttgcacttgctgatctgtttattttatggatttgtctgccaactacgttgattaatagcattttcacaggtaaggttattttttaaattatttttccagaataactttttactcagttttcggtgtgaatcaaaaattttgaaattgagcaaaaatcgtatcctttgtatgaattctgcagcagtgctcaaaatttctcaaaaaatcaaatatttttaaaatttttggcaatttgacagagaattttgacattttttgaaagtggttctcaaaagactattatagggatattttggcaaaatttccgtttttaatgaaaacagctttatattttcagaatggctttggggtcaatttttctgccgattgtccacatgggctaacgcatctacgtcatttgcatcagtttacaccttggttgcagtgacggctgatcgttatctagctatttgccatacgttgaaatacaacactagctgggatcgagaatatacaaaatatgttatatttgctgtttggctagtagctgcaatattcggaatacctaattggtataactatgatttggtataaatttaaaatcgttgtttttttttcaaaaaatgcatttcagatagtatggcaagaaggcagttatggttaccgattatgtacgtcacaaacggatcaaaaattatattttttatttgttaacttattgctggctttcatagttccatttggtttgatttcgggtctatacacgagaatatttatcactgtatcaacacatagaagtctggcagttgatgcaaga

SEQ ID NO: 29741 - DNA, 869 bp, Caenorhabditis elegans
ttatgtgacaaagaagagctgccaagacacgtggaaaatatcgtagacgttctattaaaatatctttacggagaacatttggattatgctgtggagacaggcttggctggaatttctcttgcagaatcaaaaactgaaccacctgcctactttttctcggttgttgcaaaatgtaccagtgtcattttacttatgattaaacaatttgaagatcccattttccctattatcaagtgagcttaatttttattagaaaacaaataaatatattttatttcagagaaacaattgtcgaaccatctgttgccaagaaatggcaacaatctctgcgttctttggaatcaaaaatgagtttaggattggaacggcaattgaattcaatcgtaggatacgtgaaattcttgttcagcgaacaaaagaaaactgatttccgtccggattctcagcaaattgatattcgagtatccccacaatgtcaattggcatctcgttttcttgcaaaccaagttgctgcaatggagttgggatgtgatggcgaaaatttggaagcacttcaatctgatcttgcaactcggctattcaaattcatgcttacacatattcaacagttcacatataattctactggtgctgtacttcttctttgtgatgttggagaacttcgaactcttgtatcaaaatggagagttcaaaatgcactgacacaatgggaaagtcttcaagctcttaccaatttgctcgccgttcttcccgatcaagttaatgaaacagctcactcctcgttgctcgaaaatgttgatagacaattgattcatgattttgttcgacttcgaaccgatttccgatctattaaaaatttccaaatttag

SEQ ID NO: 29742 - DNA, 699 bp, Caenorhabditis elegans
ggtaccggagaatgggacgtttgtcttgcacaagtatcatctttaatcggtgataaagctcaaccttcttgtccaaacccaacatgtttcctacgtaacgtgattgctccatcagttaacctatcaactgttcaattgtatggcttctcagaatactggtatacgacaagcaatttcggatctggtggcgaatatcattatcaaaaatttacggacgaagttcgaaaatactgccaaaaagattggaatgatattcaagatggattcaaaagaaatgaatttcccaacgctgacattgaacgacttggaacaaactgtttcaaagctgcttgggtgaccagtgtacttcatgacggttttaatgtggataaaaccaagcatttgtttcaggtatgaatttttaaagacacatcttacattcaagataaatattttcagagtgttctgaaaatagccggtgaagaaatgcaatgggctctaggagcaatgctttatcactcaaaggatctcaaattcaacctactagaacaacttgaagttgcgcaatctacccaacaaatatcaaatttcttctcattttttgtcattcttatcattgtactggcagttgctttatatcgccaacttcaatctgaatctacgtacaaaaaatataattttctgcgaaccgattctaaaccggattttctaaatgtgtag

SEQ ID NO: 29743 - DNA, 1371 bp, Caenorhabditis elegans
atgtcgcagtacatcaagtgctacggcagggtacgcccgtcggcacggcttggagcatcttccgaatctctcgttgtgggaggacgcgttgttacgattgatactgataatggatccaaaagatatgagcttcatcatatctttgatagctcttcatcacaagaggacgtctttggaacagtcgcgaagaagattgtcgaggattgtgtggaaggctataatgggaccgtgttcgcctacggacagacagggtaagtgcttccagtttagtttgagaaatgaaagttcgattttcagatctggaaaaacccatacaatgcttggtccctgcgattcatggactgacccagaacttatggggctcattcctcgatcagtggaacacgttttccagcatctggacacgaaggctaaaaagtgtcaaaagttgacgttctccgtttctgttgagtttgttgaactctacaacgaagtcatctacgaccttctcaatgcgaagaacaaagttcaactcagagattcgggaaaagacattcagcttgttggagcgttgccgaaaaacgttgataacccgctcgacttgatgcatttggtccaaaaaggttggcaggaaagaagcactggctcgactgcaatgaatgccgaatcacacgcgctgctgatcatcaggatcaaaacgcaggagcgaacaggagagctagtcaaggaaaggtcatctatcctgaaccttgttgacttggcgggatcggagcgtcagacgcatacaaaatcaagcggagatcgactgaaagaagcgacaaatatcaactcatctctgacagtgctcggccgttgcatccgtcttctcgccgatccttcgaaagctaaaggacacgttccataccgcgattctcatctcactcatattctgaagaactcgcttggtggcaattcgaagacggctgttatcgttaatatgcacccggatcgtgattttgcacaggaaagcaactccaccttgatgttcgctcagtcgtgcacgatgatcatgaacattgccacccgaaatgaagttatgaccggcgaccaggagagcagctacaaaaaagctatccaacaactgcgccaagagaaacgcgggaaaaggttcggacggaattcgcatcacagttggacgaagccgaagttgaacaacttcgactgaagacagaaaacaactcattgagattagaaaacgtcgatcttcgtgcaaagtatgactttgctcttctgaagtacacgatcggatcagaaaacgaacagattgtgaacgagttcaagaagatcatcagtgaattcagtaccgcaaatagcagttctacattcgaatgcatagctctgaagaatcaaacg

SEQ ID NO: 29744 - DNA, 552 bp, Caenorhabditis elegans
ctctccctggctctttacaatcgtccattcttcgtgtgtccagtacaacactatcagactgatagctcaaattgcacaattccattggcattccaacttcaagattatccagttccacgtccattctcatttgtctataaaattttacgaaaagagccaattatccaactgtgtccattcgtttttcacagtattgcattgagtttgttcgcttcgattctgggaccattcggtggtttctttgctagtggattcaaaagagctttcaagattaaagtgagtttttatttcattttttggattttaacattaaaattttaatcaaagtcttttcaggactttggagatgtcattcccggacatggaggactgatggatcgattcgattgccaacttttaatgggaacatttgtaatggtttatattcatagtttcattcgtgttcctgatgcttcaaaacttcttaaacaaatcatgacactcgaaccacaagatcaacttaacatctttaatcttcttcaatcagaactatcgaaaactggattaatctag

SEQ ID NO: 29745 - DNA, 259 bp, Caenorhabditis elegans
agatgcaatgctgaaaatccgaatgatcgtccatcaatggctgaaattgctgaaatcctacaacgtgtcactgaaactcctcgccccaattttacagccatagcgaagaaagaggcagaggaggttgtttcgaaaatcttattaattctaatatatacttttatttcagcttctcctaatgaactctgtaactacgaaaacaactgctcgtcgcaagaagtctaatgtgaagcttccaaagggaatgtcgaagaactaa

SEQ ID NO: 29746 - DNA, 450 bp, Caenorhabditis elegans
atgggtttaacaatctcctccctcttcaatcgcctttttggcaagagacaggtatgtttttgtaatgcttaatctcacagttttaatgtgttaattttaaggttcgtatattgatggtcggactcgatgctgccggaaaaactacgatcctctacaaactcaagcttggagagatcgtcaccacgatcccaactatcggtaagtatttcaggaaaatatttgcatttttcgaatcaatggttattgcaaaagagtcgcaagttctataatatgtgtgtttttcagtatttcataattcgtaaaaattaataatctgatattacaggattcaatgttgaaactgttgaatacaagaacatttccttcactgtgtgggatgtcggaggtcaggacaagatccgtccactctggaggcactatttccaaaacacacaaggacttatcttcgtc

SEQ ID NO: 29747 - DNA, 243 bp, Caenorhabditis elegans
cgatgatgatgaaaagcgatcattgacgggctccaaagccgaatcagaaactgacagtatggcacaatacggagacacagatccaggagtcttcactgaagatggatcatttattggtaagtttcatataaaattaagagcttattacgaacctcaaaagctgtttcaggtcaatacgttccacaaaagagcttgatgccggccgaacggcccgagaaaggatcaacgtcgacgtttgtctag

SEQ ID NO: 29748 - DNA, 3901 bp, Caenorhabditis elegans
atggaacaacttgatgtcgaagattgggagtattggggtgatgaatatcttgaagaagaaccaacttatgcaataagacctggtacaagagttgtgaaagttgaaaggttagtaaatcgattattataacttttctgtgcatttgaacttgcatcataaccctaacttttttgagaattaatatcaaattattaagatttatttgctcaattgatcagttggagatcatttcatagttttttctttaattttttgaacttgtgagataaataattttcaaaaaattttgtttaccgaagccgccaaaaaattttatctcaaatatatagctctagtggctctttgataaaaacattgaaaattgaaaagaaaagatttacttgaaaccccatttaatgctaaatctaaatttattcaaagtcaatgtgatacaaaatcccttcaggccttaaacttttacatctattctgatatcaaagcatttgatagtttcaaagaaattacgacattttggcaatcaatcgctgatcttctgacgttttcagatcaattgacaatgatttaaatgaacttttgagcaattatctcaactcattagagccattagatagttttcaagaagctgcaagtacgtgttctatttgcattttaattctaattcccttttgtataggacagagtctcccctttgttatcttattcttgccccgccacgacgcaacaaccatttttgtgataataatttgcaattttatcaatggcactactacctctgatcaccaccatctcacacatactttgtaaaagcgcgtcgatcgtaaatactactgtcttgccactttagtagtaaccctgccacgtggaaactttgaaatttggcgtggaaatgagtgaagaggcacgtgacaagatgcgcgcgaagaatgatcaaattgcgataaaaagggataggtgaatgatctttgtgatttgaatgctacttgaggaatggtttacatggaaattgagaaaaagtaaaataaaagggttcaaggacggtaatcgatcaatttgaatgaatgaagaaagatatgattgtgattgataaaaggaatttgctacaagaaaccgagacgaactgcatcggttcatatgagtcagatgtgttcttcggttgaagaagatcacttaatttagtgagaagtttcttttgagattcaattttgattatattcttagaagttttcagaaagacagtttagtattcactccacaaggttaatagctaaaagtattctctactcgattcgaaaaataatttttgcgggtttttacttttagtataaaatatttgaatttgaaaaaatctctagttagtagtttgttcgtgtgcaaagcttaaacaggataattaaagtattttaaaatataatccagctttgattctagatcacaattcagcatctacttatagataaactagtatatgttaacttcccctatcctatccaataaccttttccttattcagctgtaaacaacaattgatacaagttatcttatctccaaatgcctcctccaattttatgagacccgtaaaaaaattcgatagacaaaaagcattacgattttatttattttggtgacattttggatccttgtagtcagaggctctatcatttgatcttctaatatatctttacaaaaaggcaatacatccaattagcccaattagtctgcacgtcttgatataaatatgacatcatacatttactgattcgaatcgttgatttttaatttagaattaaggataaacagaaagaagatttaagtgtttgattggagaatataggcatcctatgctaaaagctatctctaatttattactgacatcatccgtttctcgtctgtgtttcatgtatctttatcacctttccctcctctagtagaatgacctagaaagtgattggcaagtctggcaagcctacagggggacaagggttataagattgataggtaataaattcttgtaaaatgaagaaaaaaaattctgtgcggataaacgaagcggaaatcatcattgtgtgcgtgctttgaggaaaggttcgcgcctgtttacttgccttgttcggaggtcgagatttcggacacgaaccacctcatatttttctctcgtttcttttcttcgattctcttttttccattactatctctcttcctttggttcttattttctcgacagtctcttttggtcagtatagttcctaactaggaactgttcgaaatctggcatgataattcttcaaaaacgcttatgaaacttcaaaaactcggactattttactgtgaaagtatatacctccgttcgtttcaacaaaaaaaaagttaagctttgaaactatagaaaaattaataatacatctgctgccagttgattttaaattgattcaatcgaaaatagccaagatatcaggtgccaaagttgagcaagattaattgagaaaataatgtttttgggagtgcattttttcaaatatacaagtagtttatcaacaaaaaattattttgtactggtgtaattgatttaaaaaacaagtaattgatgtgaaaaacaagcttaaatactgttctaaaataaagttacaggtgttaaaatgttttaaacaaattatttactatttgttcaaaaccttagtgacatctaatctttatgttttcattttctcttcatcctctcaagcgtcttctgttttgtattcttcttcttctttatttcaaatcagtgtctctttcgccttgttatcagtaaatcgtcgtcgtcttctcctccttcatctccttttatttcaatgtcactcccacttaatttcccccattttgtaatattatcatagagagacaccgccccataggtattcccccaaatacgtcagtttttccacgtggaactttttggtctttttgatgtgtgaactttgatagtttgcaacaaattgaaattatgaattttttttatcatcaatggaattggtcactgttccaatgattttttaattggattcttaaatgccttttggctagaaaactttgcacatttagctccgattaagcaatgaatttttacaataacaaaaaagtgcctatcgactttcaattccgcttccacacacaaaattttgcaattttgaaactgaaaaaaccgtatcaaatataatactcttttgaaagtttaatcacttgaaaaatgtaattccgtcttcaccaaaaaacgttgtattttccaagacacaaattattgtgggaagatcaagaaatcaaaatttcaaggacacactctagtttttaaattttattatttttgtgtttgaaactaattttcccgatcttttaactttaaaatttccagagttccaatgatgcgaggagatttaaggacaagcggtgccacgtcatcaagtggtcccgccacgtcatatatcatcaggcccagtgacaagcaacccacagtttctagtggtggatcacagaatggagattcagtttgtgctgtttgtggtgacggaattgcaaaattacattatggagtacttgcatgttatggatgtaaaggattctttagaagaacactgactggaaaatatcgatatgcatgcagattctcaaataattgtattgttgataaatgtaagttttttaaagaataaattcgaatatacttgactgagtatctttataatcaagaaaatacctgaagtttcggttttcagtccagcgaaatagttgccgatactgcagatttcaacgttgtattcaagcaggaatggatccaaaagcagtcaggccggatagggatcagacaggaaaacagaaagttccaagaattaagaagaagcaaattgatgaggagcttttaaatcatatg

SEQ ID NO: 29749 - DNA, 610 bp, Caenorhabditis elegans
atggcagacgacaaatcatttgatgtgaacatgtttctcaaacgacatttgatcgtgaagagttgggccaattataggcaggtccgtatgtattcttagtcgcaggcaggcttgcggtaggcgtgtagtaggcacgcaagaaggcacaaagtaggcattgaaatagaatgcgttaagcaagtaaataggcatgaggtttcaggtttgtggctatcagtcgtgattccagcttcaatttgtttcatcaaaaactcccaaaattaagcaatttccagctagagtatacaaaaagtgaattgattcaactcattgatcttgtgacaccagcattgaaggaagataattcattggcccaaatttcgcctccagtcacaattgtgggtgatattcacggacaattccatgatcttatacgcattctaaactacaatgttccaaaggatgatgcaaaaaagaaatcgggctatggattctgtaacaataggtatatattttccaacttcacagtctgaagtactataatgacattttcagatttgtatttctcggagattatgttgatagaggaagtcattccatcgaatgtataagtttgatgtttgctttgaag

SEQ ID NO: 29750 - DNA, 1016 bp, Caenorhabditis elegans
atggcgtcagtcccatcgtcatctagtctcccagtgtcgcatgtccgtcgtcatgaagacgtgtcaacaccaagtgcaccaccaaccaaacgaagtaataatcaatctcaacctccagaaagctacgaacccaacacctggttgcaacaacaacgagagcaggaacaacagaaaaagttagctgcagagaatattaagaagcagagtatcgaagcaacgggaaacaacgagatggttggggaggaggaagaggtgagggagaaagattttagatttcgtaagttgacgaaagtcaatccgcgcgttttgttgatatgcggagaatcataaaaatgataaaggtaaagcttcagtatgactttaatctaagaaatcgaccttaatactctaaaaaggatggaaataaaacattccataattaatttttttataattgtcaaagtttcaaaactagcttaatatttgtagaattgactagaattgacattttcagaagaatctaaccccgcgcacgcatagctcattttttgagaagttttttctacaaaaattgcaacacaaaattattgcgccgtcttatttccaaatgataaaattggcacgtgtactagagaccaaaccaaataggaaactggctatgtaatgcctcagaaatttagctttacagaaataaacattgttgacaatattgcaaccataggtattccaaaatcttaatcatcattatattttcaggatattctctcaaaaccatgtggtccacacaaacgacgattccaatttgtgatgatccgtaacattacatttgcaattccggaaggctatgacgtcgagccaaacagcattgagtatttgggtggaggctcgtttggaaatgttatgtatgtttttcagtatttgtgtgctttatttgaatgattatattttccagaaaaacaagtgcagtgtgccgtgacgggcttcgtcgttatgttgcaataaagaagatgcgagaaccgttctttgatccacatcat

SEQ ID NO: 29751 - DNA, 1026 bp, Caenorhabditis elegans
atggggatgtcggcgaccatgggcgattcagccagcattcccggtgtcttttttgccgattttggtcctgccccgcctgagattactccagaaggatatcatgaggtatagttacagaagaagattttttatagtgtagtgaatattgtctaaatatactagaatgagctaaaagaaattttgcaaattacaaaaacccaatgagttaattttagattattcatcatttttagtcaaagttttggaaaatttccaaatttgcggactatttgaaaaaaaaattaagatttttttaatcacttgaacaaaaatgattttataacgaaagtcaggagagattttttttggtcggcttccaaaattttttttttgaattccttttttttttttgaattctttaaaaaaatccaatgttttcttaaaagtaaaacacaattactcattttttgcactatggaagtattttttaatcatcttctccctgttgcgctactccatttttacagttgccaaaataaaaataactacaaaattcacgaagatcataggatatgagacataatgtgatggtgatatcattggaaataaatataaattgtcaaaaactataaatctataaattcataataaaaaaaaactataaattcaactacatattttccttttttatttcattgcaatttttagttagattatttgtaggtcgaactaaacaaaacgaaatgggtcttacctcaatggtacaacagtttgaagcctctaggagaaggagcgtatggagttgtatggtaagttacaaaaattgagatatatctaaaatctgacatttttttgtagcacagcagaatatgagccaactggagatcgagttgcaattaaaaagttctttcgcccatttcaaagtacaattcacgcaaaacgaacctatcgggaactgaaacttctaagaactctacaacatgataatgtattggaaatgattgatgtattcacaccagatccagatgcatcttctttgaataatgt

SEQ ID NO: 29752 - DNA, 728 bp, Caenorhabditis elegans
ttcggatttttgcaccgagacatcaagccaggcaacttcgcagtcggtcgtaaagagtctaatgagcatcacacaatcttcatgctcgacttcggtctctgccgtgaatttgtgaaacgaggcgaaggcaggcttcggactcaacgtgcaaagtctcaattccgaggaacaactcgttatgctccaatcaattcaatgcttgaaattgataccggacgcaaagatgacattgaatcatggctttacatggtcgcggaatggacatctggtggattgccatggagaaagttcaaggccacagaacgggaaaaagttctgaagtacaagaaagacgtgagaacggacaaggaaatcatggcggatttgttttataattgcccgttgaaggagtttgaacgaattttgaaggtatacaaagcaacttttatcaatcctgaaccctttttttgcagtacgtagacgaacttgacttctactcggagcccgattataagttcgtgtactgctgtcttcaacacgctgccgctgccagcaagatcaaggatacagatccattggattgggatccaaatgttccgtacatgggcccgattgaaacaattggtgatggaaaagtgatcgagttggatgtagaccaaggcatgtcaacagaagtatcgtttaacaagactggaagagatagagagactgccgatgcgacaaagagagtcgagattaagaagaagtaa

SEQ ID NO: 29753 - DNA, 674 bp, Caenorhabditis elegans
gttttcattggattagtctatcaaaattcaaaatggcaatggactgatggatctgcagtcaatttcctcaactggggagatggagagccaaataatatggacaaggaatggtggacttcggtgagtttcaatttgttttttttttcacagttcagttttgcttttaggcagtggccgatttttgtctaacaatataaaacatttgcaaagagtggccacgctttagccaaaagggcgatcttggattgggctcgaattatgtcttcgggaaggtgcatcgggcaaagtcagctaaccctttgtcaagaacaagggattctagatcgttttttatgtttcaaccgcgcgacacttatccgatggcatgatcaaagcccgatccaatttctgcacagagtcggacaaaggtatgactaaaaaaagcggaactttgatcaaagagtgggcggccgaggtgatgtggtttagcattaatttctttgaaatttctttcaattttaaattcaaaataaatcctgattgagctacccagatacctatgcttccaaaaaacaatacattttcagttggttgctgatccacacgaggataagaacactgaaaatactcgatggaataatgttgcacaaattgacatgagagcatttatctgtaaaaaggcaccgctccattaa

SEQ ID NO: 29754 - DNA, 1573 bp, Caenorhabditis elegans
atgaagaagcttaaacggcgtttgtcagcagcattccgtcctggaagtaacaataatgtgagcattaccagttctggaggatcttattatgattcggattgtggtatgttttaatttgaaaatgattattttttggtgatgaagtaattataactataaaccaaatggcttatcagttatcattgaaatgattgatttccacgtcgtccttgttcgtctcagcatgtgaaaaagttatggagaaagcatcaaaaactggaaattcgacttgaaaatttgtggaaatggaaaaatagcaaaaatagttctactaaaacatgatctttgaccgatactttttgaccaaaaaatatctgagaaactagtgaaattatatttacaagggactctttttttgcactatttttattgagtgggtctatacttttaagttcaaattttcttccgaaaaacttatgtgacgcccgaagaaaatctgtcaatttttttttaaatcataagaactaagatttttcttacaaaaattcaaatgccacagcttttctaacattttcgatcacaacgaatcaaaagattttcgcagattaaccctaatcctactgcttcgtgtctattactttttttcacatttttcaattgtatacaattttcagaaggacgtaataatattgtaatcggttacggtatgatgtcagcaccacttcatggaagaacttggacactttccgaatcaatgagccatttatcagacaaaaatggtgcaattttagaagaatgtgcagttgttgatccaacagcattgcttagagtttcacgaggaggtactgctggtagacgatatgatacaaatgtgtaagttttttttgaactgaaaattgtttaaaagttaaaaatgtgtttttgctccaaatggcataaattaaatgacataaaaataactgttaaaaatgtatataatcaaaaaaaatttacttttttttaaattttgaataaaaattagaaataggtcttttttctaatttcccgcgcaaatgatccatcatttttttgttttataatttaaaacatcgtttgccagcattttttctgtgaaaaaaattcttttcgtgttattgattcttttgggcaatttgagaattttttaatatcaaattttcttgatgtaaaatgtctgaaaatgtgtaaaacgatgtttctttttatacaaattaaaaaaaaccaattaaaatagcagaaaaacgcaaaaattttgaaatttagtcactcatttgcgcggtagttcaaaaataaatgcatttttaatttttcaaaattgcttaaaatttcaagaggttattaatttttaaaacagttatattcggcatattaacaatgatttctgtagttttgggcaaaaataaattacctattcaaagaatttcattaccttcttttacaaaaacagaaaattaaatttaaaaattttgcagtaattatatcaacggaatgcatgtcccaccaccacgaacacacagtctctactatccacgtggctacaattctcgtcgaaactcatattacggatccaatgctt

SEQ ID NO: 29755 - DNA, 305 bp, Caenorhabditis elegans
atgtcttcaggtacaacgatttgagttgaagctctttaaattatttttatttaagcttctcaatgtggacttcgttacgttgaagttaatgctcgtgatgctgcaaaatctcgaattgccagagttgtcggaggctttgaaacagttcctggtgcatttccctggacagctgctttgcggaataaagctgtaagtagatcgtttggttcagatggaaatgtttgatcatttcagaccaaagctcatcattgtggagcatcgattctagacaagacacatttgatcacagcagcccattgtttcga

SEQ ID NO: 29756 - DNA, 1024 bp, Caenorhabditis elegans
atgaacattcgttgtgctcgcgtggacgatttgatgagcatgcaaaatgcgaatcttatgtgccttccagagaattatcaaatgaaatactacttctatcacgctctttcttggccgcagctctcttatattgctgaagatcacaaggtattttttattctcatgcaaatcttgacttgaaacatttattgttgttcagggaaatgttgttggatatgttctcgccaaaatggaagaagacccaggagaggagccacatggtcatatcacctctttggccgtcaaaagatcttacagacgtctgggattggctaataaaatgatggatcagaccgcaagagccatggtcgaaacctacaacgctaaatacgtatcgcttcatgttcgtgtatcaaaccgagccgcattgaatctatacaagaacacactgaaattcgaaattgtggatacagagccaaagtaagtattaatttgaataaatcctcatttctcggcgcggattagttcgtccctcgatgaacaactgaaaaaattctaatcgacgtttcccaatcacccgttcgatttccaacgttatactttttacagaagtgatggaattaaataattttgtattcttttttggttcacctatttttaatttttgttccaagtcaagttcaaattgaaaaaggttattgtgattatcagtgaaaggacaaaatgtttcgaaaaataattacgtttaataacgtggcgcttttttaaaacaataaacaaaaatatgcgagcgaggtgattaaactttggcatcaatcagaagaaacatacttcaatttgcaaattatgataacttttagaaccttattaaccctaattattaacaaaaatgacaaattccagatattacgcggatggagaagatgcatacgctatgcgtcgcgatctcgcaaaatgggcagaagaacggaacatcgagccagcagatcgagaggcctataccactgcaaaaaccactgacgataaaaagaaaaatcgcagttaa

SEQ ID NO: 29757 - DNA, 2690 bp, Caenorhabditis elegans
atggggtcgttgtcgcgctcggaggagatgcgcttctgccagctcatcgtggagaaggatgctgcgttcaacattgttgctgaaattggaaaacaaccatatgttcaatttaaggatgtaagttgaggctctgatggattgtatgcaatcgacaaataaaacgaatattatctagaagaaaacaacaatatgtgaaaatgagtttgcaacgttttccgcaatggttaactcttcttggtaaaagtatcaaattttaattttaagtgttctgatacttttcccaagattatttgacattgcaactttttgcagtgcacaactcgaggactcatgtcaagaaaaaaagtagaactatctaagctcattttaaaaactcacatgcttaatccataacgtaatttatttcagttgaacccaaatgtgaatagcttccaaagaacctttgtcaaagacatccgtcgttacgatgagatggaacgaaaattgagattcttggagagtcaaattgtcaaggatgagattgtgatccctggaagagttgatactggagactacacaattctcccaacatctgagctcaatactttggagggaactcttaccgaattggagaaagatgtaaagagtatgaatgattctgattctcaactcaaggcaaatttcatggatttgaaagaatgggacgctgttcttgataagactgatgagtttttccaaggaggagttgatgatcaggcacaagaagaacttgagaatcttgatgaagaaggagcagttccacgtgttgagaaaggaccagtcaactatttggttggaattatccgtcgtgaaagactgaatggatttgaacgtgttctttggcgtgcatgccatcacactgcatacatccgttccagtgatattgaggaagaactcgaagatccaggaactggagagaaggttcacaaatctgtcttcatcattttcttgaaaggagatcgcatgcgttcaatcgttgagaaagtttgcgatggattcaaagccaagctgttcaagaactgcccaaagactttcaaggaacgtcaatctgctagaaatgatgttcgtgctcgtatccaagatcttcaaacagttcttggacagaccagagaacatcgtttccgtgttcttcaagcagctgccaacaatcatcatcaatggctgaagcaagttcgcatgatcaaaacagttttccacatgctcaacttgttcaccttcgatggaatcggaagattttttgttggagaatgctggattccattgaagcatgttgaagatgttcgtaaggcaattgaagttggagcagagcgaagtggatcttctgtcaagcctgttttaaacatcctcgagacatcggttacaccaccaacttataatgagactaacaagttcacagctgtcttccaaggaatagttgattcttatggtattgctacttaccgtgagttgaatccagctccatacacaatcattaccttcccattccttttctcctgcatgttcggagatcttggtcatggatgtatcatgttgatggcaggactttggtttgtgcttcgtgagaagaatcttcaagccagaaacatcaaggatgagatcttcaatatgttctttggaggtcgttacattattcttctaatgggtctcttctcgatccatgctggaatcatttacaacgatatgtttgccaagtcattcaacattttcggtagtggatggaaaaatccatacaatgcgtctgaaattgaaggatggataaacagaacagaacatggaaaggagatgcttgtggagctggctccagaagacgcatatgatcatgctggaggtccatactctttcggagttgatccaatttggaacattgctgagaataagctcaactttttgaattccatgaaaatgaaactttctgttatcctcggaatcagtcagatgacatttggagtcattctttcattcttcaatcacacatacaacaaatctaaaatcgatattttcacagtcttcattccacagatgctcttcatgggatgtattttcatgtacctgtgccttcaaattatcctcaaatggctcttcttctggaccaaggaagccactgtctttggccaaatctacccaggttcccattgtgctccatctcttcttattggacttatcaatatgttcatgatgaaggatcgtaatgccggatttgtcgtagacggtggaaaagttaatggagaatatagagaagttgaaacttgttatctttctcaatggtatccaggccaatctgttattgaaatgattttggtagttattgctgtcatttgtgttccagtaatgttgtttggaaaaccaatccatcatgttatgcaacaaaagaaaaaggcaaaggaacttcatggaaacgcggtatgtttattcgcaatttaaattttagaaccttcaaacttttcagactgtccgtgcaaatgttgtctctgatagcagtgaaatagttttgaacggaggatcaaagaaagaaggagcagctcatgaagaacacgggcacggaggacacgaagatgaatccttcggagatattatggttcatcaagctattcacactattgagtatgtactcggatgtgtatctcacactgcctcttatcttcgtctttgggctctttctcttgctcacgctc

SEQ ID NO: 29758 - DNA, 445 bp, Caenorhabditis elegans
tacgggggaaacccagtggcgtgtgcagcagttatctcggtgatgaaagtggtaaaggacgagaatcttttagagcacagtcaacaaatgggagagaagcttgaagttgctctcagagatttgcaaaagaaacatgaatgtatcggagatatcaggtgagtagcttttttaaaaatttttattattcactaatattttcttattcagaggagttggtcttttctggggaatcgatttggtcaaggatagaaatactcgtgaacccgatcaaaaactcgcaatcgccacaattttggctctccgaaaaagttacggaattcttttgaacgctgatggtccacacacaaatattctcaaaatcaagccaccactgtgtttcaacgagaataatattctggaaactgtgacagcactcgatcaagtgctcactttgatgaaccgatga

SEQ ID NO: 29759 - DNA, 977 bp, Caenorhabditis elegans
gtggagattcaaagcctatcgataagaagaaggaggacaagaaaggtttcgatactcgaaaattcttgattgatctggcctcgggaggaactgctgccgctgtttccaagactgctgttgctccgattgaacgtgtcaagcttctgttgcaagtacaggatgcttccctcaccattgctgccgataaacgttacaaaggaatcgtcgatgtcctcgttcgtgtcccaaaggagcaaggatatgctgctctctggagaggaaacttggctaacgtcatccgatacttcccgacccaggcgctgaacttcgctttcaaggatacttacaaaaacattttccaaaagggattggataagaagaaggatttctggaagttcttcgccggaaatctagcttctggtggagcagctggagccacttcgctctgttttgtctacccattggattttgctcgtacccgtttggctgctgatgtcggaaaagctaatgaacgtgaattcaaaggcctggccgattgtctcgtcaagatcgcaaagtcggatggaccaatcggactctacaggtattttttctatttagaaaatttaaaaaattattattttttcagaggtttctttgtctcggtacaaggtatcatcatctaccgcgccgcttacttcggaatgttcgacactgccaagatggtgttcactgctgatggcaagaaactcaacttcttcgctgcctgggctattgctcaagtggttactgttggatctggaatcctctcctatccatgggatactgttcgtcgtcgcatgatgatgcagtctggtcgcaaagatgttctctacaagaatactttggattgtgccgtcaagatcatcaaaaacgaaggaatgtccgccatgttcaagggagccctgtcaaatgtattccgtggaactggtggagcactcgttcttgccatctacgatgaaatccaaaagttcatttaa

SEQ ID NO: 29760 - DNA, 525 bp, Caenorhabditis elegans
gcttctcgctggattataaacattgctgtgagcatagctgactacaaacttccatggtttggaagaaaaatgatcaaccaaattgcaatgatatgtacacttttcgcgcttctcatgattgccgtttatctctattttggatataatggacaattaattgcaatcggaactgtggctgctgtttccatgtgctcacaacttttcattgccaaatatatgatggttaatgagctttatccaactgccgtcagaaacttagcagtttccgctgtttcaaccatgagcagaattggaagcatgttctcaccacaattgttttatttggtaagcattttgtatactcatctaaaaataagcctcgaaattcagagtgactatgccgaatggattccctacgcagtactattctcctgccaactttatgatttcattgttttatctttattcctaccagaaacaaaaggagttatcttggaaaaccatttacctccaaaacataaaagaatctttggaaaacgttcatga

SEQ ID NO: 29761 - DNA, 399 bp, Caenorhabditis elegans
atgacaactggaaacaatgatttctactattcaaacaaatacgaagatgatgagttcgagtaccgtcacgttcatgtcaccaaggatgtttccaagcttatcccaaaaaatcgattgatgtccgaaacagagtggagaagtcttggaattcaacaggtaaatatttaaaataggttttttccttaagaaaaaaagaaaaagcgaacataatttcaactgacatcagaataagttatctcatcgtttcatagcttcaagtttttgtttcagtccccaggatggatgcactacatgattcacggacccgagcgtcacgtgcttcttttccgcagaccattggcagctacacaaaaaaccggaggaaatgttcgttctggaaatgctgttggagttcgctaa

SEQ ID NO: 29762 - DNA, 476 bp, Caenorhabditis elegans
atgtccgtctttaagtgcctgcctaccatctactttttgcctcttgtgagagaatgtaggattaggttagtttaaaagattatttacgaaatgaacaaaaaattccgcatcgtttcaataatttctagttttcagagctttcgaaacaatcggaaatgcattgcgtctcaactcgttccttcgtaatttggatgcaactcaaattgagaaaatctcatctgcgatgtaccccgtagaagttccagctggtgcaataattattcgtcaaggagatcttggatcaattatgtatgttattcaaggtgagttcttgtcatttcaaagctattattcaaaaatgaattaaatgaaatcaattaaagaaggaaaagttcaagttgtgaaggataatcgatttgtacgaacaatggaagatggagcactatttggagagcttgctattcttcatcactgtgaaagaactgcaacagttagag

SEQ ID NO: 29763 - DNA, 729 bp, Caenorhabditis elegans
atggtggtgacgcgtggattggacaatgatgtcgacgacgaacgagaagcgtggaaacagtcgattctgcgtgcgaaagatgtcatgccggaaaaggttataaatactgtgatatttttaaaggaaattatccagacgcataataattacaaattttacgccaaaattcggcacccgctcttgacacgataaatttttgttgaacgcgaaaaggcgtgcgtctttaaaatttgtaactttttgataaataatgaatttttaaaaaaactaaatcgataaaaattccacagcaccaatagtttgaagctacagtactctttaaaggcgtacaaccagaattttcatcgattttcatagttttcgattaaaaaatatttatttttttatcagacaatttaaatattataataaagcacaccaaaaattgccatgtcgagaccgggtaccgaattttcggaagcaaaattttgtgtctaggtaatatcgtcaaaaagcttaaaattttgaaacgttgttataatctcatctaataatataattataggcgtctggaccactcgttgcattacttgaaggcacctcgggtcatcatcactggacagaggtaacaatatgaatgaactttatatttaatttcaaattttcagacaaatcatcctcggccaacgttttgcaattattgccgcgaaaagttgaacggagtcccatggcacggctatacgtgtgata

SEQ ID NO: 29764 - DNA, 729 bp, Caenorhabditis elegans; identical to SEQ ID NO: 29763

SEQ ID NO: 29765 - DNA, 641 bp, Caenorhabditis elegans
atggggacaacagtcagagtttccccaaatagtcagtctgaatcattacaaattttggtcaatgatgaagatttggtgagtctgatgttactgtgcgcatttttagatagatcatactataataactttaaaaactacagttgaactgaagtcatgttctagtttttcaatcaataattattgattttctagcaacccggaatgcctccagccacttaccaatacatcctaacagggcttggagcaacaatttttgccgttgaccaaaggggtttcgtttatttgaatgttccaaagattgatgctgacccaccaaatccaagtacttatcaattgaatgtgagttaattgacctttttattttaattttatttttatttatttgtattttattatcaaaaaaattatttttgaactttcaggttgaagcccgagaagtgaatacagttccaacccgtcgaagtgagcccgtcacaatcacaattcacattttggacatcaacgataactctccacaattcgaacaaccgatttatatggccaatacgacagccagtggtgatgaacgagatgttgtaaaagtggtggctacagacgtagattctggagcttttggacaagttacttacactattgctcaa

SEQ ID NO: 29766 - DNA, 344 bp, Caenorhabditis elegans
gcgcatttgtgtccacttcctcaacatattacaccagttttaccggatttctctcattccttgtcacttcatccacttcccgatcttctgatcactgctgatcgtttcgagactttcaccgaaaaagtcgttggagctgacacaattgtctcaaatcctggttcattctctcgaagcaactacactttccacgtctattatccctgtcagaatcgcgtggaagcttcacaaatcccagtttccgaacttgatgatcagtagaatatgatgattaagaattcatacccaattatatttccagctctaacatcaaaaatgtaatcatattcttcttccttttctga

SEQ ID NO: 29767 - DNA, 2956 bp, Caenorhabditis elegans
atgagtgaagaaatagacgaaaatacgatgaaagaagagcaagaagaagaagaaagagatgaaatcgaagaaaaagaagagaaaccaggtaaaattagaaatttcccagtgttttatcatgaaaagtatatattttcagatgcacaacaacaagagctccttaatattcgaattccaacgcaaaccaaaaaatcgcttaagcgcaagcacatcaagtaagttgtattttaaacaattattttttagatatctagtatagaaacaaaataatattggagagtgagtaagaaatagtgatatatatgcaggattactatctttcaacataattcgtcataactaatacgtttccaaacgtttccatagaaacacgccgaatagtaattaaattttcttcgactagcgggccccatggggcccgctagtagaggtggggttggggcgggtccgctagctggcgcgggttctcggcttcgcctcgaacgtgcgattggcaatgttttgggtctcgcaccgcaggcctatggcctgcgttgcttcctctaccagattaggtagctggcgcaggttctcggcttcgcctcgtgtgtttgtttttactgttttaaaaatatttattgtctccctgaagtacacaattttgcctacggcctgctctgcctgtaatttagattcagagcgcctgcggcgctctgacccggcagtaaaagcaggctggcatagcaggcctacggcctgctctgcctgtaatttagattcagagcgcctgcggcgctctgacccggcagtgaaagcctactggcatagcaggccttcggcctgttctgcctataatttagattaagagcgcctacggcgctctgtccccgcgaagaaagcagacctcaaaattaaaaaatgttttattttaaaattaaaaaggattttttattttaaaattaaaaaaaatttttaatgtatttttatttcaaaattaaaataataattttcaacccctcaattacaataaatgaacagtctcaaatacattacctcctttcttgcaggaagaaaggtggatagactgttttacagcccattggggacctcttacaaaaacaaatgtggcgatgtctattgttcttctattaagagatatgtcgtaaaatatacatatctgatcctgtaacagtaattagagaccatattacagccaccctatgcatgagagggaggaggcaagagaaaggggaggaaagaggggggcgggcgggcattgctgaaacttgaaagcgccgcaactcagctcataataggaattggaaaaagaaaagtatatatttggaatcagcgtttaaagtaaaatattatagcatttgaatatttaaaaattggtaaagaatgaacttttgagcttcctgagcaaggcttgaagctcacaacttcaggaacggggctcgaggaactcaagactaaaattttttggtttgtctcgcttctcatagcaaaaataataagatttaggacataacattcacatttcagtgaaaaactggtccaggaaaagagggaaattgaaatttcgaggtcaaaaattaaataaactaaaatcgttgaaaatgatcgtagagagctgtgctttcagcttgcattcggtatttatgtacttattacgaatttaacataaaatcccatttggtagtggaaaattttttatttttccagcaaaaacgtcattattttgagaaaatcatgaaatttgcgatttctgaagttatttttgacttttttgtaaaaaaaattatatttttgaagagtaaatttcctgaaaaatacgtttttcgaaaaatttaccccaaaaagtgccgaactgaccgacttacagccgaaagaatctcaaaaatcactaatttgcacaccaaaaacacgaggggaaatgcgcacaatttcattgaaaaatcgtcaatttatgcttttttcgtaactttccggttggataatgagaaaactatttagaaaaacggaatctacgttaaaatgtacatttgatagtgtaaaataaaacaaaaatacgaacgttaaacatgttttcaacgcaattttcgaaattccgggatttttcgagtccgattttcaaatcatcataactcagttcgaaattgatgaaattgcaaaaactaaaaaattttaacaatcccagatatacagttaccttctgaaaaacattttatactatgacctctaaacgtgtgcaaaaaaagcgacactactcgcgaaaaaagtgattttttcgtgtttcatcgcgaatttctcttgaaagatagaatcaaatcaaataaccatttagatgggaagatagaaaaaacgattctctattccctacaaaaaagaaaattaaaaaatgtgcaggtacagcaaagttagacacgaaagtgtgcgcccaacttttttaattttttgttacactttgtgcgcaaaaagtgacgacccttgcactttccggatttaatataggaagaaggcagaattacctgaaactagttacaagtctcaaacaaatgtgaatctaaacattctttgattttcagaacagacttcggcgcagaagatctcgatgaaaatgtgttggaagcccagcgactcgagaagcaacgtctagaacgtttggagaaaatcaagcctgaaaatgatcatattcaacaaatggaatcattgtttcttgctggagccagtgaagggcaacttccacaacttgatctccaagacgatgattttgaagagatgtttggatttagtgtggaaaatgataataaaaaatatcgttatggagatgaagagaagcctgagccaatgtttcatctacaggaaccttctacatcgcgtggtcatgttgatgttgtggatttgacgttggatgattcagatgatgactgcttgataactgatgttaagtcggttatgcctcaagtcgtacctg

SEQ ID NO: 29768 - DNA, 535 bp, Caenorhabditis elegans
ctcaaaccaagatgaagatcattctgtattggacatgattcgcaagacacagaaaggatatggagtagaagttagtttgaagtaagtatcatttactatatataaagcgcttattctgtgtgtccatagtttgtagtctatgtagcctttgtagtctgtgaagttttggcttctggagggatagtgagttagggttagtgtagggatatagttggggtactgtagtggtacaatagtggtacggtaggaatactgtagggttacggtagtttcataaaaaattaattttcagccccagaagtcgggggccgcgccgaaggtgcggtccacggctggttttttatatgcgaagaagttttttcatgtttacaatatttccagagataaagtcatgtctcttgaatcaatccgcaaaaaattgggaatgactactagtacgacgccgcctccgccaagaactccatctccggacgctccactcgcccaatctccgccaattccacgatcgcctccgagttctactgaaaatgcgtag

SEQ ID NO: 29769 - DNA, 757 bp, Caenorhabditis elegans
atgcgaaggaaaaatttcatacgtaggtttcagatgcaacaaagttcaaatatattgaagcatctcgagaaccatgaggtgttttgtaaaactgagctcaagacttgtacataatcttaatcagaatagacataaacagtggcagactttcaaaaattaatctttcaggtcaaataaacgacgactcaccattattcattagcacatcaattgataattcaatgaatttaaaaatcttggtggaaaagaaaccatattttacgggctctgttacgggttacaagctctattatacaaatgattcaagtcaaaccaatgaagaatatgagaaatggatgcatcaagaagcactttcaaatcagaattcatataattttgtaattgatgcaaataaacatgaaatcgtgtcaggagatgtatatcgagtcagagcaactgttttcttcaataatgtggaaagtgttccaactggagttatttcaatcaatacaagacaatctattccaaaagctccattgattgttaacactaaaatactgtacaattcatctgtactcatttcatttgtacctgctgatgatgtcaacgctatcgaggttagtatggatttgtaatactgttcttttgaattaaacttgaaattgataattgatagctattaaaatacttttgattccagaactatactttgatgtataaacaaatggaagcggaagaatggaaatcattgaatttcaaatctgattttgatggaaag

SEQ ID NO: 29770 - DNA, 1018 bp, Caenorhabditis elegans
gttccaatgattttggtaggaaataagtgtgatttggaagacgaacgagttgttggaaaagatcagggacagaatctcgccaggcagtttggatcagcattccttgaaacctctgcaaaagcaaagattaacgtcagcgaggtgagtatcaaaaccttttgaaatttctatatttttctcaatgaaaaggaggctaacaatttaaaaaaaatccgaatatcacagttaaacacttaaaaaaatattttcacacagttttttgaaactcacagtgaaatttttgataacaatttaaaaattggcaaaattaattttttttagtaaaatggattgtaatgctgccacaaattttttaaccccgaaactcaaaatcgacaaaaaatgttgtttgaattttgtacaaaaaacattgaatttctccgaaagtacaaaaattccacctttttctttctggcgactaaaaattatagtttttgaaagactgttttttttgttttctggtacgtaaaaaaaataaaagtaaaagaaaaccaaaatacacaattttgcaaaaagagagccttgaaacaattttgtcatgctcgaacccgtgcaatattcaaaaacaattaattcaaatataaaaaaagggaatatttttttagccgactataatataacgatataacgacgaataaggtggaaatgagcaattaacacttttcggttgaaaaaataattataatgggttatccaactgggtgaaaaattaattgtttatgctctggataaccccataacatttggctattttagcacaatagcatttattttaaaacaataatccccagcgatactgaaaatttaatgcaaaaattttttaaatgtgtagttaatggaatttcaagtaaaaatagcaaaataatttatatttcaggtgttctacgacctcgttcgtcaaataaaccgacgttatcccgaatctggtcgacgccagggacaatcaaataagcagtgctgctcgtgtgtcatcatgtga

SEQ ID NO: 29771 - DNA, 1185 bp, Caenorhabditis elegans
atgccatcagaagaaggatcggtggtacgatggctcgtgtgtggggcgacagctggtttagcagttgatattggattatatccattggatacaattaaatcaagaatgcaatctaaacaaggattcattgcagctggaggttttaaagatatttataggtgaatacttggaaaaaatggatataattagttggttttcggacatttgagagcttaacccaaaattaaattcaaaaattcagataaatgaggacgcagaaaataaactttcgaaatggaaacaaaacgctccgcccccgaacctagggtctcgttaggtatttggcggcaaatctgtaaatccaaacgttttaaagtagttttgccaatttcaccaattttcaagtaattttctttttttaatcaattttggcataaacctcattaaacatatctggaaacataaccaaaaagcttttaaaagtcaaaaatcggtgaaactcatcgaaaacgtttgattcacggttttgccgccgaatacctaacgagacccatagctcgtggccggagcgccgatttcaaaagcggcatttttctgagttttctgcataatagctgtagattagattctctatttcaggggaatgatctcagtattagttggctcagcacccggagctgccattttcttcctcacttacaaatacattaatggacaaatgaaacaagtaattgaagaaagaaatgctcttgtggatgctgtttctgcaagtttggctgaaattgcagcatgtgctgtaagagtaccaacagagctttgtaagcaaagaggacaagttaataaaaatgaacgactgacgttaatatgcaaagaaataatggaaactaaaggaatacgtggattctatcgaggatacggtagcactgtggctcgagaaattcctttttcaattatccagtttcctatttgggaagctttgaagagggcagtggcaaataaaaaagttagttttttttaaatatcttaatctacaatcacaaaatatttcaggaatcaggtcgttgtagtccattggaaggagctgcttgtggaagtgtagctggatttattgcagctggtttaacgacaccattagacgtggcaaagacacgtatcatgctcacaaaaaacggtccagctcctggtattttgagcacattaaaagag

SEQ ID NO: 29772 - DNA, 1054 bp, Caenorhabditis elegans
atgattacggcggataatcttaaaacgtgagttttcagaagaaagttataaaatagaaaaccaacgatgaacacttttgaattcagatttttaagtcattaaatcttcagagtttctgagtttctaagaattttttgcaaccgcagcgaagtcttgaaaatttgaaaccaacacttatcaattttttagcttaagttttcatgtatcgtttcaaatttatgtaaaaactttgacatccattgtaacaggagcgaaagggtggcaatatcgtagttggaaatctttagcaagaaaaaaccttcagcaagatttcgacactgcaaaagctttttggtcgagacgaagggaaaagtatatatcgaaattgttttcctagaataattatttcaatcattgcaaaatatttgtaaaccctcataattctgctttactggtcagctggtttttttttaactagatgtgaatcacgattgtttcagaaccaacgaaagttcaataaaatacgttgggctcttttttattgaacaagcattatcatataaaagtatgctttatattatacatacttcaagaaataaatttttaaactttaattttaataaattttcagcccaatcttctctgcaactcgttgcaccaatgatcatcttcccgcctataaatcatttcttcatcgtactcgtttccttctacttctccttgttattcttctaaatgctactgtctacagtaacacaattctaatcaatttctcagtgatttgtatgtcagaagagaagattagcacgatgttcaatggatctcataatgattgtaagttgagacatgaatctaaattgttttggaaagtagtgtcacttggcattataaaataaaaataaagtttaaaaactattcaactttagatgaagttctccgtgaagcaattgcaacaagtatgaacgatttccgatcaatatggttcacatttagttcaattaaacagagtattatgtttatgatgtcaccattgggatctttacttgcaatgtatcctacttggatgttaattatg

SEQ ID NO: 29773 - DNA, 827 bp, Caenorhabditis elegans
atgagccacgaagtgtccactactccagctgctgagttggctgctttcagagcacgcaaggttgctctgattactggaatttctggacaagtatgttaatcatttttcttgcttcgtatttacgccagcacttttttcaggacggttcatatcttgctgagcttcttctttcaaaaggatacaaagttcacggaatcatccgtcgttcatcttcattcaataccgcaagaatcgaacatctgtacagtaatccaattactcatcacggtgattcttcattctctcttcactatggagatatgactgattcatcttgtctcatcaagctcatttcaactatcgagccaaccgaagtgagtattgttattcatacagaattacaaatattccaagcttcacgcagacagacaaaaatgtctgtctgcgtgttaagatttttctgtacctccgttttatatgttctcaaaatataaccagttaattatgttctttctaggtgtatcatttggctgctcaatctcacgtcaaagtgtcttttgatttgccagaatacactgctgaagtagacgctgttggaactcttcgccttctcgatgcaatccatgcttgtcgtttgactgaaaaagttcgattctatcaagcatccacatccgaattgtatggaaaagttcaagagattccacaaagtgagaagactccattctatccaagatctccatatgctgttgccaagatgtacgggtactggattgttgttaactatcgtgaagcctacaatatgtttgcttgcaatggaattttgttcaaccatgagagtccaagaagag

SEQ ID NO: 29774 - DNA, 706 bp, Caenorhabditis elegans
atgatatttactcttttatcaacactgcctgtacttatcatcacaacagaacttgactattcggaacttgttcattcagcagaactgggtaagagttgggatagaagattggaaaatttataggattttcagatttgcagagagaaattgaatagttgaaacggtaaaaattgttttataaaaaaattctctttttaatttgacaatcaacaattaccgttcgatattgaataatttacactcgctttctatagttttttatagagaaactttttttactttctttgtggaagaagtctaatagaggaaactgtatgtaaaacacaattaaattgtgacttttaaacctctgaacaagatccctcccgtttgtacttagaccagttcatttgcagtatcatcctcatcatatattcatcacaaaacgaataaaaaacctgacaattgcacaagagacactgatatcatagatcgacttctcaatggaactggatataacaagtttcgtattccacgtatgttaattattatctgccaaaataatcagattttttagaagaagaagggatgactgtagttgtcgaaatttggattcaagctatcacttcaattgatgaacttacaaatgattttgatatggacatttatatcactgaaacgtggctggatccagcgttaaattttcagacaatgactccctgtaaag

SEQ ID NO: 29775 - DNA, 663 bp, Caenorhabditis elegans
atgaaataccgcgtgcaattgttcaaaatcttttattcaaacttccgcctttttgcccgcggcggccgcgtttgtgaaagttcttccattcgctacgtacacctcgtggacaaagttaatttcacttttttagaagcattttctgcaattctgttcaatttttgtttaattcgttactctaatcgttttgttgtatcaatgtcagcaaaaagatttttattccagtattacgtagatttgtttgtgtttagccgacaaattgagcttcactattgcgtaaccattgtttccttgaaaatagagcatataaatttttttcagataaatgtacagaagactagcctccggcttatatcaggtaatttaaacaattttgtttacagtgaaagtaatttatttttcagacttcccaaagaagaatcgcacaagttcagccgaaatcagtatttgtcccagaaacaattgtaacgacacttccgaatgggttcagagttgcaacagaaaacacaggtggatctactgctactgtaattatttttcctaaattatttgtttgttcaaagctatttttattagatcggagtatttattgatgccggcagtcgctacgagaatgagaaaaacaatggaacagctcattttctagagcatatggcgttcaaa

SEQ ID NO: 29776 - DNA, 782 bp, Caenorhabditis elegans
gtattactcttggagctcgtgctgacagctactacgaatatcttatcaagcaatggcttcaaaccaaaaaatcaattgattggctgcgtgacgacttcattcaatccattgccgccatgaaaaagcatctctatagacaatctcagccgaatagcatctggtttctcggtgaaataaccgaattggcacagttctatccaaaaatggatcaccttgtctgtttcctttccggatctcttgtactttcccatttaaatggtcttgatcatgacaatgaacatttggaaatggctaaaaatattggaaatgtttgtcataaaatgtatgaaaatccaacaggacttggaccagaaataatacatttcaatatggaggatagttctgatatgacacaagcggatacttatgtgaagaatcttgatgctcattcacttctccgtccagaagcaattgaagcgtggttctatttgtatcgtgttactaaagataagaaatatcaagagtggggatggaaagcttttgagtcgattgaaaagtatgcaaaagtggaaactggtggatacagctcaattgacaatgtgctcagaaagaagatcaaaaggtttgtcagcattttgtttaatttttaatcattcaaattcagacgtgacaaaatggaatcattcttccttgctgagaccctcaaatacctttaccttctaatggctgatgatcaagaaatccttccactcgatcgatgggttctcaacactgaagcccacccacttccaatttacaattga

SEQ ID NO: 29777 - DNA, 1093 bp, Caenorhabditis elegans
atgcacatcattccacccggtatctaccgggtagatgtgctcattttgatctcataccaaatgtgccatttcttctcaattcagcaactgtttcccattttcctgaactacactccaaagacaaactgcatccagactgcccaaggtaaaaaaactgaagagaacagcgaaaaaaactgaagtaaaccagcgccttggaccgctcggccatctctccgcacgagaactagctttgaaaatgacaattttgaataaatgagaagagtgactgcagctgcagcacttgagagatagatcgctcgtcaacacctgtggttttctcgctgaagtctccatagaaagtatcttgcaattattttttcaggaaaagtatgctacgatgttccaaaatccaagtgcctcgagtacaatgaaaatttccctaacctttgcgccaatttgactggaacagctctttcggattgccacacagagaaatcacattcttattattcatccgccgctatggaattcgaaatttactgtcgtcccggatggaaggatttccgtccagcttttgttcaatacgttggcgtactcatcggaaatattattctcggatatgtagctgatcaaattggccgaaagaagacttttattctgtcaatgctcattggaattccatcactttcactctcagccacattcaattccattgccgcattctacattttccgcgctttaactggaatcggaatcgctggaacaatgattgtcggatgggcttatttttccgagttggtatcgccacatcagagatttaagctccgaacattcagtaactgggtaaatagtttcattctagaatgtctgcaatttacctaatcaatttttcaggcaaatgcacgtataatgctaactttggtagccttattcactggagaatggcgtctatcatctcatgtatctgctgttatttctcttatcactcttgcgatcgtctattttattcttcctgaatctcacatttggctccgtaaaaaaggacgttatgaggaggcagaagtgagccgaaaaaggattgctgatctcgctggaatcgaatttgttccaa

SEQ ID NO: 29778 - DNA, 239 bp, Caenorhabditis elegans
acaagccgttgctgaagtactcaatgtgggtctttcgagagctgaagttgaagctgacatcgaaattgttcaaggatctgttattgaacagcctaaggtcagttcatcgattgttttagaaaactatgtttattaatctatgatttttgaatttgaattaaagttttcagcaatcagacgcctcatatgctcgccgttcggatcaaagtcgcagtacatctgtatgctccattacttaa

SEQ ID NO: 29779 - DNA, 1084 bp, Caenorhabditis elegans
atgaccggaggcaaaggagagataggtcatttgcacattatgtcgcagcttgtatgtttcaaaaaaattgtaattgatattttttcaatgcaaatgtgtttttgaaatcaggttaagatgcggagaactttattctgaacaaatttttaaaaagaagggataaaaagagatgaatgggaaatgtttctggctggcacgaatccaatgatcaacagctgacttggaatcatggaatgggacgtttcatgtttttgagagaaaaatagattccaagtggaattaatttgagaggaaacaataaacagtaactttaacttggaaaaagctattttaaaagagaattccgttaatgcctatacaaaactatttaaaaacgaataaagtttattttttcccgcaaaaaaaaatagaagaagcaataatagtttaatttttccaaaatatttgcgaacttttttatagaaaaaaagtggtaaaataaaatctatgaaatttatcagtttcgcttgaaaaactgttcgttttccgctttttcggtcgtttccttttctcgtaaaagcaaacattcagttttagcaaaaacgcatacattcaatttttaaatttttaatttaaactttaaactagaaattgaaagatacaattctgaaaaaatacaattacagaaacgaattgaaaaaacgaaatgcgaagtaccgagtttaaataactattcagaagatttatgcacactgacacagccgaatgcagctacagtacttaatgcacttaaaataagatatacttcaaatgttattcatgtaagttaacaaattactcgatattgtgtttttaatttatcataatttttcatttggtgataaagattgagcgatcttttatttaatccaaagaggttttttcagacgttttgtggtttattttgtgtagtaattaatccgtggagaaatattccaatatattcggatgaagtgaaacaattgtatcaattacaaaatgatctacctccacatgtatattctgttgcacagaatgcatttcatggaatattgaaaggaggaagaaatcagtcaattctcattac

SEQ ID NO: 29780 - DNA, 1231 bp, Caenorhabditis elegans
tcactatcgatgccgccaacgcgaccctcaagtacaatgttgctgttaagtgtgccaccatcactccagatgaggctcgtgtcgaggagttcaagctcaagaaaatgtggaagtcaccaaacggaactatccgtaacattcttggaggaacagtcttccgtgagccaattattgtcaagaacgtaccacgccttgtcaacacctggtcgaagccaatcatcattggacgtcacgctcatgctgatcaatacaaggccaccgactttgttgttccaggagctggaaagctcgaaatcaagttcgtttctgctgatggtacccagaccattcaggagaccgtcttcgacttcaaaggtccaggagtctccctctcaatgtacaataccgatgattctatccgggatttcgctcatgcatccttcaagtatgctcttcaacgtaaattcccactttacctatccaccaagaacactatcctgaagaagtacgatggacgtttcaaggatatctttgctgagatctacccagaatatgaggctgaattcaaggccgccggaatctggtacgaacatcgtcttatcgatgacatggttgctcaagccatgaagagcgatggaggattcgtgtgggcctgcaagaactatgacggagatgttcaatcagactctgttgctcaaggatatggatccctcggattgatgacatctgtgcttgtgtgcccagatggaaagaccgtcgaagctgaagctgctcacggaactgtcactcgtcattacagaatgcaccaaaagggacaagaaacctccacgaatccaattggtaagtgataagaaagtaatagaaaagtgaaagggaaaaagataacacatttttttgttttctcgctcccgttaattaattttattggtgacctgtaaatcaatgttttttcattttcaaaaaaattaaacatggaaacgtcggaaacgttaatttttcagcctccatcttcgcttggtctcgtggattggctcaccgtgccactctcgacaagaactctgcccttgagacattcgccaataatttggaagctgtgtgcattgagacaatggaggctggattcctcaccaaggatcttgccatttgcgtgaagggaggaaatgcttcagctgtcactcgtaccgactacctcaacacctttgaattcctcgacaaattggctgagaacctcgccaagaagcaagcccattaa

SEQ ID NO: 29781 - DNA, 1398 bp, Caenorhabditis elegans
atggctcagcatccgctcgttcaacggcttctcgatgtcaaattcgacacgaaacgatttgtggctattgctactcatgggccaaagaatttccctgacgcagaaggtcgcaagttctttgctgatcactttgatgttactattcaggtaaaatttgtttagaattaaaattttgattatagttgtttggtttattggaaatccgaagaatccgaaattgaaatatttgtataatttattaaatttttcccaacactaaacgaattacaacctatattacaacaattattcaaaaaaaattctcaaccaagaatgcaacttcaaattaattttgaatattttgaaagtattttatttcataggttctctttggataatctttcaagaaatttattgcacttgaaaaccaatgagtttcttgaaaaatggtccgaacctataaaattgaatatttttaaaaatatccagcatgtattcgaagcgtctctgaaacatgtttgtattctttacaatttatttttgagaattcattttgagatattgaaaactgggtgttttcaatttggtgcattttcatccctcattcaaccatatttcattttccaggcttcaatcctgtacatggtcgttgtgttcggaacaaaatggttcatgcgtaatcgtcaaccattccaattgactattccactcaacatctggaatttcatcctcgccgcattttccatcgcaggagctgtcaaaatgaccccagagttctttggaaccattgccaacaaaggaattgtcggtgagtacaatcaaagagagtgtaccaaagtactaacgttctctgatcaacctgattttgatagtgtcagaacaattagtagtcagcattatcgtgttatcaaaagttgacgggaatattatgttatctgtgaaaaattaaaaataccaaaaaataaaaaatatgttccaaagtgacaaaatagaatacattccactttcctgcaaaaattaaatataatttcagcatcctactgcaaagtgtttgatttcacgaaaggagagaatggatactgggtgtggctcttcatggcttccaaacttttcgaacttgttgacaccatcttcttggttctccgtaaacgtccactcatgttccttcactggtatcaccatattctcaccatgatctacgcctggtactctcatccattgaccccaggattcaacagatacggaatttatcttaactttgtcgtccacgccttcatgtactcttactacttccttcgctcgatgaagattcgcgtgccaggattcatcgcccaagctatcacatctcttcaaatcgttcaattcatcatctcttgcgccgttcttgctcatcttggttatctcatgcacttcaccaat

SEQ ID NO: 29782 - DNA, 630 bp, Caenorhabditis elegans
atgcgaatttgtttcttattattggcatttttggtggcaggtaagctttttaaattttttcaaatatttatttaaattttatgaataattaataaagagggccctcaaaaacactttgaaaataggccattttctaacattatccataaaaagaaaactatcacaaacaacgggaaactttcaaaattttcagagacctttgccaacgaacttacaagatgttgtgctggaggaactcgtcatttcaagaattcaaatacttgttcaagtatcaaaagcgaaggaacaagtatgacgtgccaaagagctgcatccatatgttgtctcagaagtttattggataatgcatgtgactctggtacagatattgcaaaagaagaggagagctgcccaagtaatataaatattttgggaggtggattgaaaaaagtaattttaaaaaatcgaataaaaatataaattgagatggatttcaggagtgttgtgattgctgtcttctagccaaagatttgctcaatcgaaatgaaccgtgtgttgctccagttggattttcagctggatgtttgagaagtttcaataaatgttgtaatggtgacattgaaatcacacatgcttccgagatcataactg

SEQ ID NO: 29783 - DNA, 893 bp, Caenorhabditis elegans
atgttgacgagtgtgccatgggagaatgcgctggatcggataaagtatgtgttaatacacttggatcgttcaaatgtcattccatcgattgcccaactaactatattcacgactcgttgaacaaaaagttagtttttaaagctatataatttttgcataagcttaccctaatttttcttgaaatttcccaattcatgaatagtcttaatagaaaattggatgtctgcaaagtatctgaactaatacgtttgaatgttccactaacaatattttcagtcgttgtaatcgtcaaccatcagcatgtggtttgcctgaagaatgttcaaaagtaccattattcttaacctatcagtttatttctttggcacgtgctgtacctatttcatctcatcgtcctgcaatcactttgtttaaagtttctgctccaaatcatgcagacactgaagtcaactttgaattacaattgaagactactatagttggtatgaattttctactgactgtatctatagagactgctatttcaaaaatgctctgaaatacacatacttcagcatttctaaaaaattaggaagtcatattagaagagtgttttttagcagtttttcttgattacctttacgctaaccctagcccacctaatttcaggtgctccaaacgttcttccagctattcgagctaattttttacttcaaaaaggtgaaaaacgaaatagtgcagttgtaacacttcgggatagtttggatggaccacagacagtgaaattgcaacttttactcagaatgagcaaaaaaggcaaaaacttcaacacatacgctgccaacctgattgtcgatgtggcagctcacaagcgacataatacggttcatccaccgctcatgaagattcgatag

SEQ ID NO: 29784 - DNA, 359 bp, Caenorhabditis elegans
aggtggaagtaaatccccgaaaccagctgacatcaagcaaacttcattcattcgagtaagttcctcacattgtttttttctttttctgtaattttctttttaaaaaagtttgcaatttccatccagtttcccataaatctttcaattgaagtcatataattacagtaactagtggaaatttaatacctatcatttataatgttttttcatctttcagatgccgaatagtggtgcgccaagtcaatcttcctacctgtgattttgtttcaaattataccgtttttcattgcatttttcaaaagaattgctttcaacatcacgtgttttatttgatttatacttattttgtttgccaatga

SEQ ID NO: 29785 - DNA, 220 bp, Caenorhabditis elegans
gaattggtctacttatcatgctttccgctgtccccgtctacggaattttcatcggatggaaaaacaagccaaaatggttcaatgaattcattggtaagtaattttcaacaaatgttttttttcttcattttcaacttgtcaattgtaccgtatttcagacagctcaactgttttcattcaaaagctattcatggttgtcgacgaggataaggaggattag

SEQ ID NO: 29786 - DNA, 239 bp, Caenorhabditis elegans
aagccaccgcggaaactgctgaatctgtgaaatctgccgactgggccaaggaacagaaggaaaagaagaagacgttcaaacagatcaaacaggttgcacgtggaaagagtcttgacaaggattctaagaaggtttgtagtacagaattagaactgccgaatttaaaaataaattttcagcatcacaagaagaggaaggatcagacaaatgtcgatatggaagacattgaactcaattag

SEQ ID NO: 29787 - DNA, 774 bp, Caenorhabditis elegans
atgcactactcaaagatagctacaataaagttcgtttttcgcacgttgacagagctaaaactgtttttttttcagcattatatcccttctcatcctacacatgttcgagtggatatgtgggttcaggaagtaacatcagtttcagaattaacgcaggattttgaaataggtaagtgtaagaaatttcaaaaataaacataatttcaaaactcgatcgtttaaaatatgagaaatgttcttttttaagtcaaatgactggcaaacaattaaattgttctagaatcatccaatttttgcgtaaagctaaaatttttagatttgtatatcaacgaattttgggaagatcctgcattagtatacgaagatatgaatccatgtaagcgaaatatatcatttgatgataaggtcttacaacgattatggttgccgaacacttgcttcatcaattcaaaaagtgcagcaattcacgaatctccattcaagtaattttcatttttatttgcaattttgttcgttattcttgaaagagaagtgaaacagttaatactcaaaaattttctgtttcacgttatcaataagatactttacgaaaatactaatagtaaatgtaatttagttagtctatgtaaaccaaaattacaggaacgtcttcctgatggttttctcaaatggtactctctggacaaactatcgaatgaaattaacaggaccttgtgatatgaaactaaaaagatttccgttcgataagcagaaatgctatctcacttttgaatc

SEQ ID NO: 29788 - DNA, 360 bp, Caenorhabditis elegans
accgtcgcctctcagaagaaggtcgtgcacacattaaaagagttcgtgacaaatacattgaagctttgtatcaacatgttcaacaccaacatcgtcatttctcgtctgtacagacatcaatgagaatcagcaaaattttattgttacttcctagcatagaggttaaaaatttcaagaatttatctaacgaactgttgatttttccagcatctctcccaacaagaagatgacaacgttcaatttctggcactttttaatttggcaaatctcaatggattaccctatgagttacattcctctatcaagcaacatatcccaaacggtgatgatagtgatgacacacaggtttgttttttttag

SEQ ID NO: 29789 - DNA, 810 bp, Caenorhabditis elegans
atgctctacgcaataatcataattggctcatggctcatgacaacttgcggaatttttgtgtttttgactttgtcaaacacggaaaaaccattaggatatggtcgatacagtgattcattggccacaactcgaacacttccaccgactatttcatggatgattcaaggatttccatcatttattattccattctatttatactggacaaatcaacatttgacagagtatggatcatttctgacatgtcttatgacttttcactatgcctatcgttcatttgtctatccattcattatcaactcggataatcagagtcccgtcaaaatagtgataatggcttttggattctctgtgttaaatggatttattcaaggaacgtggaatgcattttatcaacccgaattcgatacactacatcctaaatttttcgtatttcttggggcttggctgttcgtggtaagttgtatcctataatatacaagattttaaatcaatattttgaagattggattcataactcattgcgtttctgatcttcatctcatcactcttcgcaatgattacctgaatagttacagtattccacggggacactatttcgaatacatttcttgtccaaattattttggtgaatgcttgcaatggatcggttatgcactggctgctcgtagttttccggcaattgccttcgcattcttcattgtttgcaatctggctccacgagcaatgtcacatcataaatggtatcagaagatgtttggagaacaatatccacgtgatcgtcatgctttggttcccggagtttggtag

SEQ ID NO: 29790 - DNA, 976 bp, Caenorhabditis elegans
gaggagattcaaagcctattgaaaagaagaaggaggataagaaaggtttcgatacccgaaaattcttgattgatctcgcctcgggaggaactgctgccgctgtctccaagactgctgtggctccgattgaacgtgtcaagcttcttttgcaagtacaggatgcttccctaactatcgccgccgataaacgttacaaaggaatcgtcgatgtcctcgttcgtgtcccgaaagagcaaggatatgctgctctctggagaggaaacttggccaatgtcatccgatacttcccaacccaggcgctgaacttcgcattcaaggatacatacaaaaacattttccaaaagggattggacaagaagaaggatttttggaagttcttcgccgggaatctcgcttctggtggagctgccggagcaacttctctctgcttcgtctacccattggatttcgctcgtacccgcttggctgctgacgtcggaaaagctaatgaacgtgaattcaaaggtctggctgattgtctcgtcaagattgcaaaatcggatggtccaatcggactctacaggtattttttccatttttataatataagcaaacattaattttcagaggattctttgtttctgtacaaggtatcatcatctaccgtgccgcttacttcggaatgttcgacactgccaagatggtattcactgctgatggcaagaaactcaacttcttcgccgcctgggctattgctcaagtcgtcaccgtcggatctggaatcatttcctatccatgggatactgttcgccgtcgcatgatgatgcagtctggtcgcaaagatgttctctacaagaataccttggattgtgctgtcaagatcatcaaaaacgaaggaatgtctgccatgttcaagggagctctgtcgaatgtgttccgtggaactggtggagcactcgttctggccatctacgatgaaatccagaagttcatttaa

SEQ ID NO: 29791 - DNA, 456 bp, Caenorhabditis elegans
aggattcgatctaggaaatcatttctgtgaatatggttatgactataatgaggctgaagctccatactataaaattcatcaacactatttcgaagtggaaaaagagagaaaagtattctgtgaggcatatctggatgaggtttacaaggtaattgctaatttttttaaatgaaaatcacaaaatttgaaaccaaatatttccagatgcgagcttgcggtgacaacccacatttcccctcggatctggttactggcgatcgggagaaagatcttaataagatcattgaagaatcgattctcttcatgccagtctctaatattttctgggtttgctggtctttaatcaatgctgaagaatcctcgattgcattcgattacggtgcttatggacgtgatcgtcttgctctatacttccaccagaagaagaatctcgaaaaatacctttccaatttgtga

SEQ ID NO: 29792 - DNA, 460 bp, Caenorhabditis elegans
agttgccgaacagttcggagtttgcgtctctcttgaccccaaaccacgcgttacaatgggcgattggaacggcgctggctgtcatacaaacttctcaacgattgatatgcgtcgaccagatggattggaaactattatcgcagctatggagggacttaaaaagactcattcagaagccatgaaagtatacgatccaaatggaggacatgataatttgcgccgactcactgggcggcatgagaccagtcaagccgaccaattctcctggggaattgctaatcgtgcttgctcagttcgtatcccacgtcaagttgctgatgaaggaagagttagtttcagtaaacccttaataaaacaataatatattttacagggatatctcgaagaccgccgtccatcgtcgaattgtgatccatacctggtgactgcaatgatcgtgaaaagcgtgctgatcaattga

SEQ ID NO: 29793 - DNA, 696 bp, Caenorhabditis elegans
atgctcgtggtttttttgtttatcagattttatgttataagtccttcttggagcaaaattcaaaaagtaagcgttctttattgatttattataactcctgagaatgtggtttccccaaaattccgcccttttgcatcgtttgttgcaaaagggcagatacacccccatacactcacacgcacggagatctttcaaacgtccacatcttgttctacagtatctgtttcattgtctttttccaacaaatcacgatttttttggcaattgaccgcccgtattaaatctacacaaaaaattattttaatttatgatataaccttaatataagtaatttcagatttcaatgatgtgtgtgcagaaagttgaaaaaataagtaacaactcgaaaatcaaaaagacaacaaaaagagacgcaaaaccaaagaaaccgaaaatgtggagagttattgctcaaaagttagttgaaactattgcacacgaaatgaaaatatcagaaattatggatttatcagttagttttcatgaatttcttttattggaacaccttttatagattatggcagaaactatcagcaatggatgtaatgagagaataaagaaacactttaaaaatctccagtttcgatatttgaatacattggaaattgaggtgaacggcgagaaaatgacagttttcaacattatatcgtttattga

SEQ ID NO: 29794 - DNA, 1163 bp, Caenorhabditis elegans
atggtattacgagagcaagagcatgagccattcttcattaaaattgatggaaaatggtgtcaaattgacgatgctgtcctgagatcacatccaggtggtagtgcaattactacctataaaaatatggatgtaagctttctatttaattaaaaaaataaaaagcggtcggttatatcgttatatcttattcttattagttattcttatatattattcttatatttcttattatatatattattatatatattatatatatatcttattagattgttatatcgttatttacgtgtaactcaaataagtgtgtacgtgcccgtaaatttgttccttgtgaacaaaaatgtgcaaattcagtgaacaatgtacagagaacaccccttatcacgtgcatcacatgtgaagtttaataaaaaaaaacgccaaaaagagataatccgagaaaatgattagtctctcaaaaaggaggaagacataaataaaaattaataatatcatgccaacattcaatttatcggaatatttcattaaaataattttgcaggccactaccgtattccacacattccatactggttctaaagaagcgtatcaatggctgacagaattgaaaaaagagtgccctacacaagaaccagagatcccagatattaaggtaacaataatttcaaaaaatttactgtttatcctaaaacgggatttttgaaatctgatttcgagtaattcaattcaaaattctagcgcagtataccgttaaataataatccaaaacatatgaaaaatatctacaggatgacccaatcaaaggaattgatgatgtgaacatgggaactttcaatatttctgagaaacgatctgcccaaataaataaaagtttcactgatctacgtatgcgagttcgtgcagaaggacttatggatggatctcctttgttctacattagaaaaattcttgaaacaatcttcacaattctttttgcattctaccttcaataccacacatattatcttccatcagctattctaatgggagttgcgtggcaacaattgggatggttaatccatgaattcgcacatcatcagttgttcaaaaacagatactacaatgatttggccagctatttcgttggaaactttttacaagtaagtcacattttcaataat

SEQ ID NO: 29795 - DNA, 1318 bp, Caenorhabditis elegans
gtcgatggcaaatggctctaccttagcgaggaattggtgaagaaacatccaggaggagctgttattgaacaatataggttagtttttaacaatactttttttttcttaaaagatacaaaagtctagaatcttccacaattcaaccaattttctgaaatagaaaaattcgcaatcacatgaaaaggaaggcagcttacaaaatattagacttcccagagtattttggatctagttttagttttttcgcaaacagaagttacaaaataatattaaaaaccaattaatattgcagtattccgccattaaacaaaaatattgaaacacgaggcatcatcacaactcgtggaagttctaacgcccttgatatactgtatttttatagaaattcggatgctactcatattttccacgctttccacgaaggatcttctcaggcttataagcaacttgaccttctgaaaaagcacggagagcacgatgaattccttgagaaacaattggaaaagagacttgacaaagttgatatcaatgtatcagcatatgatgtcagtgttgcacaagaaaagaaaatggttgaatcattcgaaaaactacgacagaagcttcatgatgatggattaatgaaagcaaatgaaacatatttcctgtttaaagcaatttcaacactttcaattatggcatttgcattttatcttcagtatcttggatggtatattacttctgcatgtttattagcacttgcatggcaacaattcggatggttaacacatgagttctgccatcaacagccaacaaagaacagacctttgaatgatactatttctttgttctttggtaatttcttacaaggattttcaagagattggtggaaggacaaggtgagaattatgagagacttgcataccgtatccgttttcaaagcttttcttgctgtctcgtgacttctcttgaaaaataggtgataaaggtatcacttgtgggattattttctaaaactgtttttttccgttagcacacaagcacaaaaaatatattaattgatcatagtggtctcaaagaccgtaaccctctattgacataagaaatcatttcaatttcaatttctgatgattatttaaaaaaattgttttcttaaaatattggaataaattaaaaaatgtttatccagttctttaatatcaatttacagcataacactcatcacgctgccacaaatgtaattgatcatgacggtgatatcgacttggcaccacttttcgcatttattccaggagatttgtgcaagtataaggccagctttgaaaaagcaattctcaag

SEQ ID NO: 29796 - DNA, 497 bp, Caenorhabditis elegans
atggccgatcttttcgacgaattcatcgaacccggtgtaaaaaatgagatcatggacgtaagtcaaaaatacttctcttaaactatgcagacaacaatctgaaagtttatatttttaggtagaggaagcaccggaaaatcctatggaaaaggtaacgtttagaaaattcatgcgaagtttattttaaaactttccagctcgattctgcaaaaaaacgtcaagcacgagaggatatgacaaacttactggcaaacatgcacaatgatgtcggagttggaaattttgatgaagcaacatcaaaacgcgctcgtgtcgaagaggaagaggaggtcgaagaagcaagaatggaaaatataattgtccatacaatccgaacagataatgagaattgtactcatgaagtggcaataccacctaatgctgaatttgctgaacttcgagaaaatagtggaacagagcctgcaaaatattatccattccaacttgatgcttttcag

SEQ ID NO: 29797 - DNA, 627 bp, Caenorhabditis elegans
atggcttgctccggaatgcattcagcgtgagtctgaattctcaactaaaactgacgtttgggcgtttggagttgtcattttcgaggtctacaacaacgcggaaaaactgtttgccggagaggaagacatagcgattcttcggaagatcaagaaagccaacatgccaactatcgagaatcggacaaaggttccagcaatgcaggctgttctcagttcaatttggactaggaagccggacgatcgaccagaaatgcagaaagttcttgaaaaactcgtggcagctttggtgccgattcaaccagatgatctgaaacggctccaaatcaacagcctcaaaggtgtcagcagaactcagatgccagtgagtttttggtttcccaactattcgaatgcttgctttttcagaacacagacctggagatggatgtgtcggtggtgaacgaagaggtagatcaggatggatcggagaaaaaccgcaaggtgaagggaggatccaaaaagaaaaccggaaatcgccataaccgaagtggcaagagaactccaaaacaagaagaatccccaaaaagcaaaaagccagttccactacgcaataccgttcgaaaaggacccggagccacctctgaatga

SEQ ID NO: 29798 - DNA, 599 bp, Caenorhabditis elegans
atgctagtggatccgagatttgacgcattctttaaattggaacaaatagacgactacaaatatgatggaggtaagcgctgaacaccttaccaacttttgatagttcacatctcaactgactttggttttattaaaaaatcaccaactgaaaaattattgttgcttatttttgtatattgaactgagatgttgacagacttctttcaaaataaaaaaaattggctacagtaatcgtcacaaatttaaatcaagtttaaaaatttcaaaccttgaacattttcagctgacacttctccatcaacgtccaacggtctgccagaaacctcaaacgggggtcgcttgatttgtgatgtttgtggtgacgtggcgttcggaaaacattatgggattaatgcttgtaatgggtgtaaaggttttttcagacgaaggtattaatgaatcgaacaaatttaattttaaaatttactgtttcagtgtgtggtcaaggaggcaatattcttgtcgttttggaggagattgcccggttgtaaaggaacatcgaaatgtctgtagatcttgtcgattgaagaaatgttttgaagttggaatgaatccggatt

SEQ ID NO: 29799 - DNA, 888 bp, Caenorhabditis elegans
atgcttggtgtattccaaaaacgatgtgcctcaactgcccctctaattcgtcccattcaacgggttttagttgcaaatcgtggagaaatcgccattcgcgtccaaaataccgctcgtaaaatgggaattgagacagttgctgttttttctgacgcagaccgtaattccctctttgttaaaaaagctgacaaggtaagaatccatagtattcgtgaagtgttaaactgaatttaatgtcaggcataccacatcggccctcctcttgcagcggaaagttatctgaatatggacaaaattatcaacagtgcattgcgatctggagcacaagctattcacccaggatacggtttcctatctgaaaatgctggattcgctgaaaaatgtgctcaggccggccttgtttttattggaccaccagcccaagctatcagggatatgggagccaagaatgtatcgaagcaaatcatggaagatgctaaagttcctgtagtaaaaggattccacggagaagatcaatcagatgctaatttgaaaaagaaatcagcagaaatcggtaattttttaaagtatagccccacataaatttatttaaaatttcaggctacccggttatgctgaaggctgtctatggtggaggtggaaaaggaatgagaattgcgtggaacgaggctgaattcgaagaaaaactggcttcagctcgtaacgaagctaagaagtcgtttggaaacgatgaaatgctcgtggaaaagtttgtcgagaagccgagacacgttgaagtacaagttttcggagatcaccatggaaactatgttcatttatgggaaagagattgctccgttcaaagacgtcatcagaaaattattgaagaagcaccagcgccaaatatgg

SEQ ID NO: 29800 - DNA, 305 bp, Caenorhabditis elegans
aaagaagaatcggcgtccagttcgaactcgcatacgcaatggtaactctccaagtcccggtttcaaaagtcagagcagatcagcggcggaaaatcagaataaatcaaacctgaaagctgttcaggttagtgaatatgtttcatattttcggtgtttaatttgattttattcagaaaaagaagaacaataagcagtcatcctctatttccggtgatgctccttcaaccttttcagttcttggtgtctttggaaaaaagaagaatactgctgatagaagtgatctgaaaaagcttgaagagttctga

SEQ ID NO: 29801 - DNA, 23 bp, Caenorhabditis elegans
atgagtcaaacacgtactcatga

SEQ ID NO: 29802 - DNA, 798 bp, Caenorhabditis elegans
ggtcacatatttccaatatccccgctgttcaatctgcctcctactccgccatctcaatatgatccacctctcaaaccattgccacgtaccaactcatcattttgcgaaactgccacagacttcacttttggaaccccaccacttcgtcattctcaaatgcgtgaattgttcaaagttattggagttgattcggttcttcacgattggttataatttatttgtactattgcatatctgatttcttgttgccttatattttatgtggttttagttctgtgatagcaatattttttttccggttagcattaaaatatatgaatttcaatgatctagaaataaatcaaaagaagatagaataatgaaatcatatgtttacattctactaaaatcaataagagtttaagttttaccaacaattatgacacatcgtttgtgatttgtaatcagtgtaatacaatggcgaatggagaaaccgagaggtattgataagagaagactgctcacagagcaaaaacaagtccaagcggttttcaatattagattctcctcccagaagtgttctttgattgatctttcagtgatggtcgtttcttgatgggcctcgtgttgatcgccaaacgaaacaagccgctgatcgcgatgatggctgctatacttttcacagtcgctgtatttttggctacgaggtttgttgcattcgactgttcctatttggtggttttcaaatgcaaattaatatttagcatattttctcaactgtctgggatttttattttatttttatgcgttcagacttaa

SEQ ID NO: 29803 - DNA, 275 bp, Caenorhabditis elegans
ggtgtaaccgtactatcgtcatatttaacctacccttgggacactgtgcggcggcgaatgatggtaaaaggacagctgagcacatcaaaggctttttcagctgcacgaaaaattgtccatgaggaaggtgttcgcggattgtacaaaggagcgttagctaacatttttaggtttgtatgaggattacatataatgttctttaaatttatggtttcagaagcgctggtggagcacttgtcatggcactttacgaagagattcacaagcatatgtga

SEQ ID NO: 29804 - DNA, 333 bp, Caenorhabditis elegans
aaacgaagactcctcggcagtccgtcttgctctattggtcaaggctgacaacagggatcaggggattccaaactgtgagaagagcaactcttatgagaatgtttttccgagaagatcaacacttatcccggttagatctccatataaacaactagataaatgaaccattacagaaggaacagaagatggctcgtgatgtcaaatcgaatgaggacaactctgacgatcgacgtggtggggcatcaagtgaagatcgtagatcatcggaggctgcgtcggctgctgctaagcgttccgaatcgaacagaaacgcggcaaagaaatcgacaatga

SEQ ID NO: 29805 - DNA, 428 bp, Caenorhabditis elegans
gaagcttatgaaatgccggctgacaataaaaaagtcatgctgaaaatagaggaagtgcatcttcattcatgtggtgtctttagtaacgtctacaaagggatcctccgtgagccacacgagaaaaatattgccatcaagaagagctggccggaaaagggcgaacgcaatttcgagttcatattcttgacgggccgtgaacgaacaaagcacaaaaatgtgattcatatgatcttcgcgttcagccacagctatggtacaaaggtttgctagaagcacgtttccagagccctagttcctgattttccaggtctgcgaatcctatgtctttgactacatgccgaacactttggccgaggtgattcgtcagaagctcaccgacctcgacattcgcctctacacatggcaaattttttctggtctaaaatacc

SEQ ID NO: 29806 - DNA, 269 bp, Caenorhabditis elegans
catgatcttcaaatgtttctggcaagtgatggagaacgagaagataacaccgagttcaaagtacgattgggagaaggatgagcctgatgtaagaattcccttcaaattctcataatagttcatttctttagaaatctgttccacctgcatcttgggagaatccagccggacccttcttccaatccgatcctcttggaatcaatgccccaccaacaccagctgaagcggctcttactgaaaaaagtggaaagaagcatggaaagaagtaa

SEQ ID NO: 29807 - DNA, 1146 bp, Caenorhabditis elegans
atgtgcactcaagacgaggaatgttcagcaccaggaggagataaggggaaagagaaggaggaacatacagttgttccaagaggaaaagaagaaaaagaaaagaaacctggcactaaaccatcaccaatcagtcccgcattcaaaggaacaccgaaggaaagaccaaattgtggaaagactaagaatgagacaagtggaaagaagctcagggtaagaaagctgtttcctgcgataaatgcataaggaggagttacgtaaataggaatttcaccttaaaatactcgaaatcttccagaatactgaattaagaattttataaggcgacgactattcagcgacagcgggcgatatcggaaaaaaataagatgaagaaacaaactcgccctctgtcgccctatagtcggcagcagtcatagcagcatttcagtaccgtcgttttaaaaatacaattttcagtcgaatgacgtgtctccggatgtcaaagacagactccaactgtcagaacacggaccttcaaaaacctgcataaaggatttccaatggcttgaagacttcatcacaaaaatgccgtgcttccacggattcattggtcgagaagacctgatgtcagtgctgaaaaatgtcggtgactttctcattcgaacatctgtgcaaccaaacaagcatgaagtggagaaaatgaaaaagaatcaggcagatgtgaaggttctgggaaatttgagtcgagagaagtgtgcaaagaaggagaaggagaaagaggaaaagttggcaggaatgggagatgttggaagacgcgaattcgtcatatcagtttattgcagtgagtttggcagaaaccctgaaagatttgaaaattttattttgaaataaggcaacagttcgttgcaaaagccctaatcagccaagacataggcggaacctactttgggaattcatgaaaaacctcaatgtcttggtttaaagttctacgtactcatttcagaagacaaagagaaaccagcaactgataaacctcaatacacgccaattcgaaatcttgtgatcaaaagagacaatggaatggttcatgttgaaccactacgtaaattcaaaactcttacggaattttttggatattatcagaaaaattccgggatttgcaaagag

SEQ ID NO: 29808 - DNA, 890 bp, Caenorhabditis elegans
atggctgtcgataagaaagaagaggaaaaggatccaatggacaatgttcgttttaaaattggcaaacggttagttttttatcggaaaatcacacattttcctacgagggttttgctcactgcatcatttggaaacttgcccaaagtggagttttagagacagtccagtgaaaatgctcttacctatttaatgagcgcggctgagtttttccttttggcgaacacgtagcaaaatccaaaatcttgttgctctgcccatctacattcaaacaaattggtttatacttgagcagtatgccaatttgatttatagtggcctgattcctacgtgtctcctacaatctctaatttacagtttcggttcgtatacaatagaaaaatctttggacgaaggaggatttggtcaagtttacctcgtgagagataatagtggcaagcgattcgcattgaaagcagaatcgaacgatatggaaggaggatctgcaatcaagttggaagcgttgattctcagaaaattgaacgatggagaatcggtgattcatgtgccgaaacttcttctttcaggaaaacggaagaagtattgttagtttaaaaatatataataaattttcagaaaaacatttgtattcttcaggttacatggtaatgacacttctcggcaagaacttgaagtgtctgaagaacaaacgacccaaggagagattcacacgtggcacatggtcccggattggaattcaatgtctgtacgggcttaaatacatgcacgactgtggatttgtccacagagacattaagccgcagaatttcatgatgggtaatgaggatgacaaggaaagagctagaattgttcacattttggactttgggctagcaagatcttttgccaagttt

SEQ ID NO: 29809 - DNA, 530 bp, Caenorhabditis elegans
atgggcatgaagaaggatcttcttcttgtgcttaccatcgaatctgtcgtgctcggtgttgtcttgggcttcgttattcgacctttcaatcccaggtgagaagatctttaaaatctttcgggtctaaattgtaaattttaaattaatttttttaaatcgatttgtgaattccagtaatgatacaatcagtcttatcggatttcctggtgaaattttcatgcaaatcgttgagatgatgattttgccattgataatgtcttctgtgatatctgccttggcacaagtcagagctcgtgatgctcgtcgtattggaattgtcacaattatttactatatgataactacattcctggcaacatttgtaggaaactagaatagtttcaaatagactactgtatataatttcagacaggaataattttggtatcttctattcaccctggagaccctgaactgattcatgagcttggagagggaactttagagaacacagctctatcaacgcttgacacatttttagatcaaataag

SEQ ID NO: 29810 - DNA, 416 bp, Caenorhabditis elegans
aggaggaacttcaagctgatgaggtagtcgatactttcaaagatttcattgagagcttcagaaaatttgtgattgccgtactttccggcgaatccgaggaaatattggtgagtagcattttgatcttgaattaaaaaaaatttcagaaaaacatccgagaagaagttattaaaccagcagtcaaaacttacactgcctacttgaaagcgattctcgagaaaagttcatcaggatatcttgttggaaatgaattaacatgggcagatttagtgattgctgataatttgacaacgttgattaatgccgagttgttggatattgaaaacgataaacttttaaaagaatttcgtgaaaaaataatcgagactccgaaattgaaggaatggttggcaaaacgtcctgagacaagattttga

SEQ ID NO: 29811 - DNA, 642 bp, Caenorhabditis elegans
atgctcactccacgggatgaaaacaacgaaggcgacgccatgccaatgttaaagaagccaagatactcggttagttcttttctatttttaaattaaatttaatattctcacagttatcgttttttaatattcagagcctctctggtcaatcgactaacatcacctatcaagagcataccattagtcgggaagaacgagctgcggcagttggaagacatgaaggtttccgtggatgtacgatctggttcacgggactttcgggtgctggaaaaactaccatttcttttgcgttggagcgtactttaaacaaggtaagatcaatcatcacacaatcatcatttctcgaaatatcgagttttcagctcggaattccttgttatgggttggatggagacaacattcgtcatggattatgtaagaatctcggattttccaaagaagatcgtcaagagaacatccgtcgagttgctgaagttgctaaactttttgctgattctggaatgatatgtcttgctgcattcatttctcctttccaagaggatcgtctcgacgctcgaaagatccatgaatctgaaaatgtgaaattcattgaagttcatgtaagcactactctggaagtgtgtgaacaaagagatcctaagc

SEQ ID NO: 29812 - DNA, 538 bp, Caenorhabditis elegans
atggtccaagagcaaatgaagcttaccggaaccctcgagggtcacaccggatgggttacccaaatcgccacctacacccgcaacgacaagaccactgtcctgtcatcttcccgcggtaagtcaattaatataacgttttcaaatttatactcacatttttcagacaagactatccttgtttgggatgtcgacagcgttgctccagtcgatgagggaccaatcggtcgcccagttcgttcgctcactggacataaccacttcgtctctgacgttgtcatctcctccgacggacaattcgctctttctggatcctgggacaagaccctccgcctctgggacctcaaccagtaagtaattcaataaaaaaacattgtgcaaacaattttataggggagtgagcacccgtcaattcatctcccacaccaaggatgttctctctgttgccttctctgctgacaacagacaaatcgtctctggatcccgcgacaagtccatcaagctgtggaacactcttgcccagtgcaagtacaccatcact

SEQ ID NO: 29813 - DNA, 1015 bp, Caenorhabditis elegans
atgacggatcgtaatgagttgatcggtgttgcaattcgagtagtggcggcggctgcagtttcatttctatcagtgcgctatctagtcaagtacttggatccaaattatagtgtgaatgaagaaagcaaaaagaaggtttgtagatttacaacactaattttgtttttttaatatacaggtggcacagctgtttcatgaacttggtatcgatcgtcaaatagaactctcagagcacgaaattagaatcgccacgcagtttgttggcggagaagacgttggagcagattgggatgagatcggtagaacagaaaattgtttcgcaaaaaaaaagaaaaattttacaggtggctgcgaagaacttgttgctgaactaaaggatcgcattattttacccttgagattcgcatcgcaaagtggaagtcatttattgtctcctccacgtggaattcttctttatggaccacccggatgtggaaaaactcttttagcgaaagcagttgcaagggcagctggatgccggttagttattcataaatgcagaattgacctgttttaaatattgctacctttcagatttatcaatcttcaagtgtcaaacctaactgataaatggtacggagagtctcaaaaacttgcggccgctgttttctctgttgctcaaaagtttcaaccaacaattattttcattgatgaaattgattcgttcctccgagacagacaatctcatgatcacgaatcaacagcaatgatgaaggcacaattcatgacattatgggatggattttctagttctggagatcaaatcattgttatgggagctacaaatcgtccacgagacgttgatgctgctattctacgcagaatgactgcaagattccaagttccagtaccaaatgccaagcaaagaagtcagattcttaatgtgattctcaggaatgaaaagatcaataatactgtaaatctcggagaaatcgcacaggcagcagaaggtcttagtggaagtgatttgaaagag

SEQ ID NO: 29814 - DNA, 1360 bp, Caenorhabditis elegans
atgcttcccagactggcaaagtcatctttaatccaacagggtaaaccaattaatatattttggattcaactgggatttatttaggaaataatttaacatataatttttgattttgaaaaacctaacctgcagctttttagttcttctagatacattcattttcaaccctttttacttgcatctttgacctaaaacacattgaaaaagaaacaaacaacacttttttgattctcttatcagtttatcagtatcacaaacattaacgaaggcaattgatttttctcgagtaaaaccgaatagggaaaagatcagaaaaactgaacgataaaatcgaagttttggtaaattggcaggtattttgatattcaccacatgtttcaatttggaagattaaaaaaacaaaattttctgaaattttaaaaaaatactaaaacacttcaacaccatgagaatgtttccaaaaaatgctctgactcaattgaaacgtttattttagtgcgtggagtttcggcgattgcaaatgccgagccatctggacctagtatttcaacgagcattcctggaccaaagtcaaaggcgttgaaacaggaaatggataaagttcatgtaagaattgagatatcgaaagttaaatggtttttttaaacatcatggaccttaaaataccttcaaattgtgataacttattttttatatctattctaaatcttatacgctcattatgtattggttttagtttttgacaattattcagtggcgaaatcgcttgaaattacttttcaaacaaaaactttggctgaactttctgacaacttgctcaacagaagctcaacattgtcaatttgattctaaattattaagaattataagatagataaattataattttagattacaaaacattattagctatttaatggtcacacaattgcgaagaatttcgagccattcagttcaattttcaaatcaaaaaccaacatctcaactccgtaattacatgaacatcacattcttacccttatcacagaacgaatgaaattcgtctcagaaatattacactttctctggtcaactgacaactgacattcaggagttttgattatttgattttagtttttttaatttcaaatcttcaatttcattgataatacaaaaaataaaataatatttcaaggaaatttaaattttatacatattgtcaaaaatactgtagttatgaaacatatgaatcattccaaatgcaatatgagatttcaaaattttataaaaattaaaaaaattttttttcagcaaactacatccgttcgtttccatgtcgactacgagaaatcattcggaaattacgttgtagatgctgatg

SEQ ID NO: 29815 - DNA, 244 bp, Caenorhabditis elegans
atgatacagcacttgcattcagtatttgtgcagccacaactttagcgtgtcaactggagacaacgggttgtgttgacgtggtacaggttctttcatcgtataccgaaattcagtgtggtatttttgcctcgaaggtgaaaatcgaattatctcattttccaataccaaattattttgttttcagcaagaaatcgagataatctatgaaaagatgtcacagctagtcggaggaacacgtgtctaa

SEQ ID NO: 29816 - DNA, 332 bp, Caenorhabditis elegans
gatgtgattaattttatgttgtatcctactgtaaatgaaggttaccggtgtattgaagaaggtgttatcagtaatgaaagtttaattgatatcatgttgtaagtgatatcatgtaatattataagttgaccgatagatattatttcagtattctcggttttggttggcctattcatagtggtggaccgatgagatttggtaaaactgaaggacttgataaaattgcaaatatgcttgttcactggagttccttggagcccaaggaaagtgcttatattgttgctgacgctcttaaaactgcgaacaacaaactgatgtcatcaaaactatga

SEQ ID NO: 29817 - DNA, 337 bp, Caenorhabditis elegans
gatgccgtcaatttcctcttgtatcccatggtcaacgaaggtcttttgtgcattgaggaaggaatcatccatcatgaaagtttgatcgatatcatgttgtaagtaaaacttaatttcaaaaaaaaattaaaattatgagcacaattgtttcagcattctcgggtttggatggcctgttgctactggtggtccgatgagatttggatggcttcaaggaattgaaaaagttgcgagcacaattattctctggaattctttagaaccaaatgatagaacatacaaagttgcggccacgttgcaaaatgtggacaggaagaattttgcagcgaaattataa

SEQ ID NO: 29818 - DNA, 1667 bp, Caenorhabditis elegans
atgaccgtttcggagcaacttcgcaatgatttggaagacgctgccaaccgcatgcgtatttcctcgatcgagatgacttgcgcaagcaaaagtggacatcccacgtcttctacgtctgctggtaagaattattcaacatttactcgaatccgataaatttcaacattttcagccgagattatgtcaactctgttcttctcggagatgaagtacgatgtcgcagagccaaaatcagcatctgccgatcgttttgttctctccaagggacacgcttgcccaattctctacgctgcgtgggaagaggccggtcttctgagccatgagcaagtgctctctctccgcaaaatcgactcggacatcgaaggacaccccactcctcgcttgaacttcatcgatgttgctacaggatctctcggacaaggacttggagttgccactggcatggcttacgtcggaaagtacattgacaaagccagctaccgcgtcttctgccttctcggagatggtgaatctgctgaaggatctgtctgggaagctgctgcttttgcttcaatctacaagctcgacaatctcgttgctattgtcgatgtcaacagactgggacaaagtcaagccacttctcttggacatgacgtagagacctacaaagctcgctttgccgctttcggattcaatgccattattgtcaacggacacaatgttgatgagctcttggccgcatatgagactgctcgttccaccaagggaaagccaaccgccatcatcgccaagactttgaagggaaaaggaatcgaaggaattgaaaacgaggacaattggcatggaaagccagtcccagagggaacagtaagtttgacgtgagaatgaaatagtctcatattaaaaatttcaggtcaatgccatcaaggctagattccacggaagccaaaagggaaagctcgttgctcaaaagccaatcaatgacgcccctgctattgatctccatgttggatccatcaaaatggctgccccagaatacaagaagggagacaaggtcgccacaagagccgcttacggaactgcacttgctaagcttggagatgctagtccacgtgtcattggtcttgatggagataccaagaactctactttctctgacaaacttcttaagaagcacccagatcaattcattgagtgcttcattgccgaacagaatcttgtcggtgtagctgtgggagcgcaatgccgtgaccgcacaattccattcaccagcacattcgctgcattcttcacccgagccactgatcagatccgtatggccgctgtttcatttgctaatctcaaatgcgttggatctcacgtcggagtctcaattggagaagatggaccaagtcaaatggctctcgaagatcttgcaattttccgtactatcccaggagcaactgttttctacccaaccgacgccgtgtctgctgaaagagcaacagagttggctgccaacacaaaaggagttgttttcattcgtaccggccgccccgcacttccagttctctacgacaatgaagagccattccacattggacaagccaaggttgtgaagcagtcagcccaagataaaattgttcttgtcggatcgggagtcactttgtacgagtcattgaaggccgctgaggagttggagaaagaag

SEQ ID NO: 29819 - DNA, 535 bp, Caenorhabditis elegans
gagcaatgatgtccgagagtcgttatgctgttgtgattgttgactgtgcaactgctcatttccgtaacgaatacactggaagaggagatctagcggaacgtcagatgaagctctctgcttttctgaaatgccttgccaagcttgccgatgaatatggtgtcgctgtaattattaccaatcaagttgtagcacaagtcgacggaggagcctcgatgttccaggctgatgctaaaaagcccattggaggtcacatcatcgctcacatgtctactaccaggtaaacatagttggaggttttctgaagattttgaacaaatagagaacatatttaatttttttattaaacattacatgtggtctttttgaggattttttaaagaagaaaaattaagttattcatattttcagattgtaccttcgaaaaggaaaaggagagaatcgcgtcgcaaaaatggttcaatcacccaatttaccagaagccgaagcgacctactcaatcacgaatcatggtattgaggacgcacgcgaggactag

SEQ ID NO: 29820 - DNA, 461 bp, Caenorhabditis elegans
gaaaattgggttttctcgaggtgatccagatcttttagtggaagacattcaggcactgggtccacgtacatttgctaccgttccccgcgttttagacaagatttataagtctgtaatgaagcaaatacaaaataaacctgtgaaaaagatgattctaaactctgccattgcatacaaattgtatcattacaaaataacgttagttagcggcaacatagagtaattttgaaaaatctgaactacaaattttcagcggaaaagctactcgggatactttggtggacaagtatattctgcacaagattcaaatgatgctcggtcctaacatcaagcaatttctgatagcggctgcaaaaacagataaatcattgttgaaatttgctcgtggagcttttgggattgaagttcttgagttatatggacaaactgaaaccgctttcaactattctaactttcactaa

SEQ ID NO: 29821 - DNA, 391 bp, Caenorhabditis elegans
tatcttgcttcatatgcgctaaccaaacacaacatcaatgggaaaacctatgaacaattgtgcaacattccgattctcgcagatgatgtgctgcgacaatttgtagaactcacagaagaagataaaaggccaagatatgaaggggtactgtttaggaatttaggaatttcatgtttatcactgtttaggaatttcatgtcaataaatatttagtttttaactttaggtgtacggcgttcacttgacgccagttgctttttcggctgaaaatgggttgacaacacctacattgaagaataagagaaatgctatcgcacagtttttcaaagcggaaattgatggaatgtataagaagattgagactagtgaactttcgaatttggcaaaatga

SEQ ID NO: 29822 - DNA, 1083 bp, Caenorhabditis elegans
gaaatcggaaaaaccaagtgcacacaacaatgctcaatccgaatgtgcatatcattggagaagatgccgcgtgtgttgcttacgtgaaattgacacagttcttggataggtaagtgttgaaaaaatgaattttgttttaaaaagttgtatgccttgcatcagttttagtttaaatgaaacaaacacatttgtaacttgatatttgttaattgttaaattcctagttgtttctatgtcaaagtttaaaactcctagtacttaatgacgttagctgaaaaaaaaccagagataaaaaaaaaaaaaagttgaaattcttcctagaattttgaacgaggttgagattctagaatttataacagaattgattagattgtttaaatgaaagtggaagttttgtttcagtgagaaaaccgcgtaaagatgaacttattttattgtcacttggattgctggatagttgtgagaatctagaaaatatttccaaattacccaaatgaacaataaagaaattacaaagaagcctaattaaagaaaaaaatagcgtttgtaataattgcacaatgaccccaaattactaaattttataaagagtttctattttctgaatgaaagcgtgtttttaaaactctggcaagtcatgaaacttgcgaaaaagtgatctaatgtaagaatcggtgcagcatatccgtattctgccaagaaaattcagagttcggtttcacaattttctaaaatttatctaaagtaacaaatcacaggttagtgtcacttggaataaacttttaaaaaaattcccttatattctttattttgtactgcataatcaacataatttgaaacagtttttttttctggaacttatttttctagtttttggtcaaaaatctgtggaaaacaacatatcattgtctcgtattacatacaatttttacctttcactctttatttttcagaaacggagaagctcatacccgtcagtcacaagaatcacgtgtgtggtcaaagaaacaaggccgttgggtgtgtgttcatgtacatcgatcaacacaaccatcaacaaatacaacagtatctgaattctag

SEQ ID NO: 29823 - DNA, 1083 bp, Caenorhabditis elegans; identical to SEQ ID NO: 29822

SEQ ID NO: 29824 - DNA, 867 bp, Caenorhabditis elegans
atgtcgttcagtcttgaaatgccacaaatgctaccagcacccagagattgttatgcagtgcctggaaaacctggacactcggagccattgactgttgtaggatgggagcatatggatctgaaactcttctatccatctgcacttttcaggtattgtttcgcctttttatgtggtttatgaaacttgagtgattcgtgttttatgtgtgactgaattgtttggaaatcttgttttcttataattttacaattgggactaattcgacatttggcgctagtttctcggtgaaacccatcactgtcatccaagttaagatttttggactgaatttgggcaaaacctatagcattaaattccaagatacctgtatcattcttaaataaatattttccatcgttttaacactaaacatttttcagttcctggagcatccgtactgctctctatccgcttgcagttcttcggagccaattgcaacttcagaagcagaatacagtttatcgaagcacttttcacgcatattctgatatttctaaacgtgaaggatttcgtggattgtacagagtccgtaaattaatttgcaaaaaccccattcacggagtaaagtttacagggattctggattacagtaccacaaattggatgttcattcatttattcgaccatctttgaaaagtgccgtgctgttcttcatgaacaaggtatacagtctgttggtggtgtagcagcggttgccggtggtttggccagttttgcgactcaatccatttttgttccaactgatattattgcacaatatatgatgatttataagaatactgacaagctgactgctggacatgataaatctgtaattgatggcgttcg

SEQ ID NO: 29825 - DNA, 722 bp, Caenorhabditis elegans
ccgtaccgcaccgtactcaaatccctgtttggaaattgtgcccgcaatagtatttatttttatgttatgaataagaggcaaaattctgcgatttctgcttacggtgccaggtctcgacacgacaatttttggttaaacacaaacgggtgtgcgcctagattactgtaatttcaaacttttgcttttgtgaagttttcatcgattttttcaagtttttcgcagtttttttttaaatgtatgtgtttgttttgtttcagtcttttaatattttttttaatgaaaaactttcaaaaatcaatgaaaacattttagggtacagtaatctttaaaggcacacacgtttgtatttaacaaaaaaaatgtcgcgtcgagaccgcatattttggcgtctatagtattcatcagattgttttcagcttcatcccgccacaaatcgcagtcttctttttgatcaagcagttgcagcaacactgggaggagtcatctcaactgtagcaaccaatccaatggaattgtttcgtgtcagacttcaagttcatcgtggcagttactcgaaaaccttagagactatgcttcgtgacgaaaagacggctgttttcacgaaaggacttacaccgcgcatcattgccaattcaatgtatagtggacttgtagttgttggatacgaaattgtcaagagattatgtgcaaaagaagagtacaagcatagagtaaaatggtag

SEQ ID NO: 29826 - DNA, 2407 bp, Caenorhabditis elegans
atgggtcactgcacgagtaaagatcagaaagaaggcaaacgtctgaatcgtcggatcgatgagcaaatcaagaaggatcaatcgatgagtcttcggatcatcaagttattactattaggtacgtacatctttcggtttttttccctgaagaaatttgagctcgtttcattcgaaatgctatgggaaaaaagagaaaacacgatccacacggtgtccagttggagcacaccgaaggggtcaggtgaaatatatttatttatagaaagtctgcgtttctggttttaaatttagaagataattaagtttcccataaaatagtctagttgagagctaattctgttgttctatgatcttttactaaaatagaatattttcgcatcacataattcattcattcccccgaagagtaatcctttccattgaaggacattctatttgatatttattcttgcaatatttaaatgtgaaataattcacgaactcaaacttcaaacatcataatgtatacatttgatttgaaatttttctgaagtgaaatggcaagtcttgtaaaaacttcactaccttgataaaaccccagagcaagcagatcacttttttctagtttcatgtcaactaaaattttttgcaaagattttcttcctcatgtctgttctgacatcaaaattacgtattgcaagtaataaagtatgtctgaagcatagaaaatggacaagaactttgctccgattccaagttgttaagattgaatttgaaaaataatgagactttgtagacagtgcaaaatcaagcgaataaagtttcaaggaattccaaacaaataatttatctacagtaggtcccaaaacacattatgataacgccaaacctcatttataaattgatcgaaacaatgtgttctctctgaagttttctttttttttggcttctgatcgaatttcagatttttcttttgagaaagacaaggacgcatatttaatttaaaactaaaaaaatatatatatttagtattttctcagtataattttctggggtagtttcctgaaatttccccagttttctacattctctataaaatatattattaatacttttactttaaaactttccaattcgatgtgaccactgagctaaaaaaaacaaaaagtgtcctcctgacccaattatttcgctttttgacgtcacggagcaaatttttattgactctgcaccagcaacgacccatccaattagtatgtgtagaagtgaaggaaaaaaaaaagagaaagttgtaaaatgatacatggacatggagagaaacatgggaatcctggaagaaatgtttaagaattttttttgtgttttggtatttgttggaatgagatgaatcatcatcacatgctggattattgaaataatctttttcactcaatcttaaaaaaaagaaaaggacattattaaagaattgttggggaaaacccagaaaactcgataattccaaagataggggtctattattgacatttttttttggtaatttgaagattaattttgaagttctagaaacaatatcaaaaatgttcatgcaagatatgggaaatcgaatgaaacttcactttttttttaaagaaaatagtccgacacaaaatgatataaatattgtgaatattctttgcaaactcgtttttttgtggtttctgaataaatgacgataattcaacaagtggtgggtaacttttaaatccttatagttcaaataatacaaatttggaccagaaaaactaattaactagaatatatttttccaactaaatgtttaccagttttgttgttcacatgagctcacggagctttggctctgtttttgttgtcataacaaaaattcaaattttgatcacaaatctttgtttaaaattatgaacacatgatgtagaactaagaatatcagataccataaacaacaaaacaaccaatttcaggagccggagaaagtggaaagagtacaatattaaaacaaatgaggatattacacaaggatggattctcacaacaagatcttgaaatgattcggcctgttgtatattcgaattgtattcacagtatgctttcaattctccgagccatgttccatttgcaaatcgaatacggcgaacctgatcgagtggtgagatttttggatagctctcgaaataatttacaaacattttaatatttgaaattcaagccaattctatcagatgtttcttgtactttttaagaaaactacatttcagcgtgactcccagttagtgtttgcaactgtgcatgcaaataaagaagaattaacagaagaactagcagcagcaatgcagaggttatggcatgatccaggtgtccgagaatgctatcgacgcagcaatgaataccaaattgatgactctgcaaaata

SEQ ID NO: 29827 - DNA, 201 bp, Caenorhabditis elegans
gtctattttctcaatgattttatggaggttacttccagaaactaaatttcattataaggtttttctccagaagctttttgaaattttaaattttaacatattcagattgatccattggaaatacgacttctgacagatctcggaccatcaattgctccgaattatggtacattagaccttgacgaaccaactttgttttga

SEQ ID NO: 29828 - DNA, 550 bp, Caenorhabditis elegans
tgacattgctgctcgtaattgtctgctcagtgaaaaagaggtcaaaatcacggactttggcctctctcgaaatggcccatcctacaaaatcaaggcagcctgtaaacttccagtcaagtggctcgcaccagaaacattgtcatcgctttgcttcacttttgcaacagatgtgtacaggtatattgactgttgataccccagaattactattctacgcgaatcatctttcagctggggtattacttgttacgaagtgtttgccgatggtgccgagccttacgaaggcattccgaacgcaacagtcaaagcagacgttctcaacaacaagtttattcagatgcctccacactgcccggattctatcaaaaagtacatgagcacattcatttttgttgatgcatcttgtcgagccagcatgaccatggcaatcggggactttgaacgtatgactgtgatgagtgaaaccggagcaagtgatccaggaactaagaataagtttatgaagattttgaaaaagaagaagaaagagaaagaatcgaaaaatgattga

SEQ ID NO: 29829 - DNA, 487 bp, Caenorhabditis elegans
atgccagaaggatctcaacttcctcgattctgggaggacaaccagaaatccattttcgagtatgtttggaaatctcacagcggagttaagggaatggttgtcgatgcaatgaccggcgagccaatcaagcgggccgttgtctggattcgtaatggaactgagactgttccagttaagcatccagttaccacatggtccgagggagacttctacagagtgctcccagctggaaagtacgaaattatcgttgccgctgaaggatacgatattgccgccaagaatgtgacagtcgagaacaaggtccgcgacagcgctcttgttgtcaactttgcactttcaccagctgccgatgagccatccgaggtaagattttaattgcttaaatagagtcccgtatttaaaataaaaacaaaagtcaatgttcaactttcagaatgagcaagagcaaatcgccgagctcgtcaacgagattgcccgtcgtcgttaa

SEQ ID NO: 29830 - DNA, 1067 bp, Caenorhabditis elegans
cgaggagagcgaaagtgttctcgcactgaaaggacttacaccaaccggtgcacttccaatgggaacacttcaaggtggatcacgtggtgtccgagaaggtaatgtttgtcctgatgtctcttcgatcctgatccgtccaaaatcgtttaaagtccgtcaaaaagtgtgtgtacttttctctaatcgaaatgcaactatacttaccgagttaactttcgaatcaaatgatattttctacgaaaaaacaataattcaatagaaaaaaggaaagagaaaaacgtagtaccacgctttttaacagacatgaaagcgagtcagtgctgcagttgaagggcctgaatgcaggtggcaagctgccacaaggggctctttcggaaggacggacaggattgaatgcggcttatagaattgaacagtcaggtctgaataataaaaattatctaaattatctatggtctgcaaatgtttaaaacatctgattctacaaaagtatggtttttttaactgaaagaacattgcttttggggcaacaccgacgttttcgttttcgaaaatgtttttaattatttttcttttcaaaattacaactttaaagttgctaaaaaaaaacaaatttgattagacaaccaggaatgaagaaaaatctaagcatctgcattcgattttttttcttttttgtgacgagacccattcaaatagccacgtgcgactttaaagtattaatttcgaaagttgcgagattatagtaaacttaaataccatcatgtatacccaacagtttatgctaataaatgcaatatttttcgaaactaaaccttggatcccatataaaatgattggaaataaaaatacctaattataatatttgaatttcagtggcagcagaatccggatgcgattcgggacatcttattcaatcattcgaagaagctcgccgtctcgataagattaatgaaagaatgccaccaacaatggcaacaccaccagcacaatcaccaagtcaatcaccaattccgtcacgacaaacgacacctcaaccaccacaaaatggtccatcaaatagctaa

SEQ ID NO: 29831 - DNA, 813 bp, Caenorhabditis elegans
atgtatcgccagggaaccaatcaatcggtgtgctccgatgccgatgagttcacaccagaagaacttcaagaatttgctcaagccttcaaattgtttgacaaggatggaaacaacacaatgaatatcaaagaattgggtgaagcaatgcgtatgcttggtctgaatccaactgaagaagagcttcttaacatggttaacgagtatgatgtggatggtaatggaaaaattgattttggagaattttgtaaaatgatgaaggaaatgaacaaagaaactgatcaagagttgattcggcttgctttcaagtgagtttttctcttatttttctgtaatttttagtggtttccataaaatcaaacaacacacagaaactgatgaaatgcaaatattttgacactttttaatgtcctgaatataaatttcaaatcctctttcaagtgaacaaaaatcaacgttgacccgttttcagagtgtttgataaagatggaaacgggtacattactgcacaagagttcaagcatttcatgactacaatgggtgaaagattcagtgaggaagaggttgatgagattattcgagaagttgataaggatggcgatgaacaggtaagacatgattctggatgaattaaaaaacatgattgattagtttgatgaaaaacaacaatacagattccctatatgtatgaatctctttaattttcagatcgacttagacgagttcgtcaacatggttgctccgattgtatcggatggtaccaaaactgatccattcctcgaaccaactgcctccactaatccacctaccaaataa

SEQ ID NO: 29832 - DNA, 459 bp, Caenorhabditis elegans
catactgctataatggacaacgcacgcaagttcgttgcacaacttctgtagattgcgcagccggtcaaacatgcatgaatgggatttgctgtaccacaacaggaaatgaatatacaggatcttgtggaggacttccagctatttcagcatgtggtacaggtcagacgtgcggatctttcagatgtacatcttcaaactattgctgtgaatgccaatatggaagaactgcgggtctgtgttccaatgtgagttgacttttcctgaattttctcaagcagcattttacagcgtaatgttttatattttcagggctgcccaactggatattcatgcaattcaaacactggcaatggttactgctgtgccacttgtgcttctgggcgtccaccatttggttcttgtttcaatggactttgcgccagtggttatacttgtcaagcaggaaatatctgttgctaa

SEQ ID NO: 29833 - DNA, 1876 bp, Caenorhabditis elegans
atgagtccgtacgattcgtcgccttgggcgacgaaggctctatttttaatagtaacattattggcacaattcacttattctcaagttttgactccatctcaaatcacaatttcccaccgaaaaccaattaccgctacatctacctgtggagaaattcaaggacaaccggtgactgaaatctattgctctctgacaggtaagtcaacttcatgaatttatcttgttgagttcttctttttggagttgtagtgatttatattgtatgaattattttttaggatcgacacagtatacaccgctgaactcttattcgtaccaagacgatgaacaacaaaaatcgtggtctcaatacgaaaatccaatggtacgtggaggacacggttgtggtcattgtaatgctggaaatgagaactcccatccagcagctaacatggtcgacggaaacaatagttggtggatgtctcctccactttcacgtggactccagcacaatgaggtcaacattactattgatttggaacaggaattccacgtggcttatgtttggattcaaatggctaacagtcctcgtccaggaagttgggttcttgaaagatcaactgatcatggaaagacctatcaaccatggtttaactttgccgagaacgctgctgaatgtatgagaagattcggaatggagtctctgtcaccaatttcagaggatgactctgtcacctgtcgtactgatatggccagtcttcaaccattggagaatgctgagatggttatcagaattcttgagcatagaccaagttcccgtcaatttgcaacttccgaggcgcttcaaaatttcacaagagcaaccaatgtcagacttcgtcttcttggaacaagaactcttcaaggacatttgatggatatgaatgagtggagagacccaactgtcactagaagagtaagtgagatctcacttttgtaaaatcagaaaatatattcctgaaaataattttgactaatttcctcttcacaatttagatattgtattttatctatgtttttcagtacttctacgccatcaaggaaattatgattggaggaagatgtgtgtgcaacggtcacgccgtcacctgtgacatcctcgagccacaaagaccaaaatctcttctgtgccgttgtgaacataatacatgcggagatatgtgtgagagatgttgtcctggatttgtgcaaaagcaatggcaagccgccacagcccacaataacttcacctgtgaagcttgtaactgtttcggacgttccaacgagtgtgaatacgacgccgaagttgatttgaataagcaatccattgattcacaaggaaattatgaaggaggaggagtttgtaagaattgtcgtgaaaatactgaaggagtcaactgtaacaagtgttcttttggatacttccgtccagagggagttacatggaatgagccacagccatgtaaagtctgtgactgcgaccctgacaaacacacaggtgcatgtgctgaagaaactggaaagtgcgaatgtcttcctcgcttcgttggagaggactgtgatcagtgcgcatctggttattatgatgcaccaaaatgcaaaccatgtgaatgtaacgtaaatggaacaattggagatgtatgtcttccagaagatggtcagtgcccatgtaaagcaggattcggaggaaccttctgcgagacttgcgccgatggatacactaatgtgactgctggttgtgttgaatgtgtctgtgacgctactggatcagaacatggaaattgttctgcatctactggacagtgcgagtgtaaacctgcctatgctggtttgtcatgtgacaagtgtcaagtaggatattttggagatgattgtaaat

SEQ ID NO: 29834 - DNA, 950 bp, Caenorhabditis elegans
ataattcctctcttgtgaacgtggcggacgttgaatcaacagaaatcgctttgagaacatcacttcttcttgtgagcgagctgaaatctcaacttcaagctgcaaaaatgtctgaatccactcttctgaaatcaaattcaaaccatgaaattgaagaaaacaagaaactatctgagaaaatggaagttatgaagaacgagttcgaattgaagatgcaagaatcagctgctagcgtagagaaagttatccaggagaaagactcggctatcgagcagctcaaagtgcaattggctcagagccaacaggtggccgagctgtggaagcagggagccgagaaaaacagcaacgctcagtacagtgactcgaagactactattgatagacttttggaggagaactcgaaattgagaaatctggttgatgaagaggttgctcgccggctcgaagaatctgagcgtcgcaagctggcggaggatcagttgaaacatgcaagaggaggctctgtctttgatccaccagcctcttttgttgcatcgcagttggcggaaagaaccacatattcattgaatctggaacatgagcttatcactctgagaaaagaattggaggaaactaaagaagcactgaagaaatctgtagaagagtcgagcaacaaggatgagatagttagtgctctgcatgaggtgcggttttgataacttttttttaaattagttaaccatagaaaccgttcaagcggtcattgctatcttaaatttttaatttagtgctaaaacaacgttgtttttcaacgacaaacataagatttcatttaacaattttttgcaaaaaataccagcttgcaggaccaacaggagagcacccgcatgctcgcttcgaacgagcaggtgatcaacagtctgaagcagaaatgtcgtcaacttggagtgctggaagacttctcgagctaa

SEQ ID NO: 29835 - DNA, 1792 bp, Caenorhabditis elegans
atgagttcttcagccaacctaacctgtaaaaatggtattttaataccagctctcgaaacaaccccaaggaatgcaatactctacttggctggattgttttattgtttcttgggtaagtttacaattttatattgaaaaatgggcaattttttttaaagttcagttaattttaactcttatctattcattgtttagtcttgatgaactaaacgattttctatttatgataacatccgcttatcagaacttgaaaatatcaggcatttctatatgaacttttttcattttcaaggtttccatgtgacttttttaggtatcgcaattgcggctgacattttcatgtgctcaattgagcaaatcacgagtgcaacaaagaaagtaaagaaacaaaagaaagccggacaacttgtagcaaaagaagaagacgaagaaattgatgaacaatatgattatgttcggatttggaatccaacagttgccaatttaacattaatggcactcggatcttcggcacccgaaatcttgctctccatcattgaaattgttggaaacgggtttaaagccggcgacctgggacctggtacaattgttggctcagctgcattcaatttgttctgtatctctgcaatttgtgtgtttgctgttggaactcaaaccaagagaatcgagttatacagagtatttgttgtcaccgcattttttggaacttttgcatacatttgggtgtttttggtaattattttataattgaaatatgggaaaaaactacgacaaaatattttggcagtgaccactcacaattcggccaacgtttggccgattagcaaaaagtgacaatatcttagccaaactttggttagatgttaggcagatattgatcaatcttcgatcatgtcttctgaaagtttcttgaggatgaagattctagggatatagctttcttgaaccgaacgatacctctccagaggcatggtcaaagtctgatacaaggtctgaccagaccgatgtccgcccaagatctggcacaagtttaccaaaaaaggtactcaaaagctgactgaaaattgccaaatgtaatttgagtttttacaattattcagtattttctaatatttcaacaaaaatgaaagccatttccagattgactaatcactagttaaaaaaaaatatttccctcacgaactgtttaaataaattcaaacaaaattccacaatgtgacgtttaacacattatcaaaacgtattttttcttacacataaattgaatataaaaactcattttttcaggttctcattgtcataacgccgaatgtcgtcgatgtttgggaagcaatccttactttattattctttattatacttgttgtggtttcttatgctgtagatgctcaaatttggaagaaaaagaagtcaagtgatctccaggaagagcttgagatggctcaacacgatggaaaagttgatgatcaaccagaaaaattgagtgatgaaatcaaaaaatgggcaagtaatctgagtttgaacaaagaggagaatgacgtaattgttgatgcgactccatctgtagataccgttagaagatggacaagatcaatttctcacacgtatccgtctctttccgatgaggatcaagcgaagattttggcttatcgtgtatcgagaaccatgtcacatgaccgtctctactaccgtattcgagcaatccgtcagttgtcgtcttcatggaggaagagtgaagaggaagaagttttgaaaatggaaaaccaagagagtacagattctgctagtagaa

SEQ ID NO: 29836 - DNA, 586 bp, Caenorhabditis elegans
ccgtgtccctaaaggttagttccctttttccgatgcacatattatcctctagacattggttgcatcacatacaaaagcagaggcgtacgtttgttcaaatgaaatcataatctgtttttgaagtacagattagcacagggtatcagatatttcgaagaaaaaacgtggtgtcaaacatggtaaattataagattaacgagattaacatgactaaaaagaagaaatggattagattagtgaatgatgataactgatcgagagctttttttgttgcagattgagagaaaaggaaatatggaatccaagttcacagtcagttatgcaactgtcaatggtcttgcaaagaaggatttgaactttttgttcaagtcagaaactctacagttcaatccaggagaacttcataaaacggtactttactattatagaaccagaaagtcagtgagcaacaactacgtttcagatttctattcaactgataaatgcagctaactggaggccaaatgatgttttctatgttcatttgaagattcaagatgtagacgaagactccaagatttgcctcggagcatgtaatgttgctcat

SEQ ID NO: 29837 - DNA, 987 bp, Caenorhabditis elegans
atgctaagagccaccaacaacagacgaacatcgaataatgtggaaaaggatagcctccaggtacaaggtgtttacaaactaaaaactataattatcattcagatggctaagcacggaaacggaccattgaagcccgtcaatgcgcaaggtcttcagacgaaaagagaagctcgagagattcttgcactcaagccatccaatccagctccagtcgaaactgcgcaaaagtcacagagaatcaacctccaggatgctgagactaaatgtcttgctatggccgacgacatatacaagtatctcgttcatcacgagaaaaagtatcttcttgaggagtgcttcatggagggaggagagcccactcccaagatgcgtcgcattctcgtcgattggcttgtccaagttcatgttcgattccatctcacacctgagacacttcacttgactgtcttcattctggatcgcatgcttcagaagaaggtcacctccaaggcggatcttcagcttcttggaatttcagctatgtgagagtttttattcaattttaaaacgtaacatatagggattactaattgtgtatcctttaaaaatgttttgtttcaggttcgttgcctccaagttcgaagaggtttacctcccagacatccacgactacgagttcatcactgagaacacatacagcaagaagcagatcttggcaatggagcaaacaatccttaactcgttgaactttgacttgtcctgcccatcttcgcttgtcttcctccgctgtctctcaagaattctctccgaaaacgatgccagcccaatcgataatcaagctttctgttatacttacaatatctccaagtgtctcggagagctcgcactgctcgattcggttatggcctcgaccccaaggtcccacattgcttctgcttcgatgatcatcgctcttgaagttcatcctgttgacggaatcgaggcggagaatgctgtatcggtcatttg

SEQ ID NO: 29838 - DNA, 636 bp, Caenorhabditis elegans
atataatgctctcctgtttattgacgagtgccatgctaccgggttctttggtaaaactggtcgaggtactgctgaagctgttggaggtcgtcctgatgttatcaactctacccttggaaaggctcttggtggttcaatgggtggatatacaaccggcccaaaacccctcatcgatcttttgagacaacgctcccgtccttacttgttctccaattcacttgctccaagcattgtgggaagtagcatcaaggtatctcatttccgtttagtgcaaacaaaactacgagaatttaataggtattcgatctactcatgaacgattcttcattcattggctcgctccaaacaaatgtttctcacttccgtaaaagtatggctgccaatggatttactattctcggaaatgatccaactcatcctatctgtccagttcttcttggagatgcaaagttggccgcaacaatggctgatgaacttttgaaaatgggaatctatgtgattggtttctctttcccagttgttccaaaaggaaaagcaagaattcgagttcaaatttcagctgctcattcgaaacaacacattgatcagttaatcgaagcatttgcaactgtaggaaagaaacttaatgttatctga

SEQ ID NO: 29839 - DNA, 618 bp, Caenorhabditis elegans
actgaaaaaggctataaaccatccgcacgtggtgcatcttttgtcttcggaccaccagctctccgtgcatttctgaaaaagctggatcttcaaatggttatccgcggtcatcaagttgttgaagatggctatgaattcttcgatggtcgacgtctggtcacaattttttcggctccaaactactgtggacagaatgacaatacagcggctgtgtttagtattgataagaagctgaagatttcgatcaatgtcttcagaccggagagcagagacaagaaacgtggatttgaaaaggagagaaaggccaagaaatgatcctgaactcgtttagactttttattcgtagaaataaaaattgaaatttctacaacttataatacaaataacattattcacagtactcacaggaaaaaaaaacaaactcctgccgaaagtgagaattttggcacaatcttgacaaaagtagactgaaaaaaataactgaaaaaaaacatcaatttttctctgtttccagcaactctccttacaattaatcacgaattatttttttttcaatttttcgtaattaagttcacaaccaagcaacgtgattttgtgatttccgtcttgccattttga

SEQ ID NO: 29840 - DNA, 523 bp, Caenorhabditis elegans
atggccgaagctgatattgccgtcatcggattggccgttatgggtcaaaatcttattctgaacatgaatgatcacggattcactgtttgcgccttcaacagaactgtcaaattggtcgacgattttcttgccaatgaagctaaaggaactaagattattggagctcattcaattgaggaaatgtgcaagaaattgaaaagaccacgtcgtgtcatgatgctcattaaagccggaactcctgtcgatatgatgatcgatgcaattgttccgcatcttgaggaaggtgatattatcattgatggaggaaattctgaatacactgattcaaacgtaagtttttgtttttttctaaatatttatttattttattcattagacttttctctctaaaaataaaataaatatgtaatatagtgaatcgattgtgaactgacaaacaacaattattttcagagacgctccgagcaactcgccgcaaaggggatcatgttcgtcggctgtggagtttccggaggagaagaag

SEQ ID NO: 29841 - DNA, 1527 bp, Caenorhabditis elegans
gagctcgttttggaccatctcttatgccaggaggtaatccaaaagcctggccacatctgaaagacatcttccaaaagatcgctgccaagtcaaacggagaaccatgctgtgattgggtaggaaacgctggatccggtcacttcgtgaaaatggttcataatggaattgaatatggagacatgcaactgatagctgaagcatatcatcttctgagcaaggccgtcgagctgaatcacgatcaaatggctgaagttcttgatgattggaataaaggagaattggaatctttccttattgaaatcaccgctaatattttgaaataccgtgacgagcaaggagagccaattgttccaaagattcgtgattctgctggacaaaagggaactggaaaatggacttgtttcgctgctcttgagtatggacttcctgttactcttatcggtatgttgaaaatacaatgaatatcaatattctttcaaagtttcaaaacattctagatattttgaaggtagagtatcatctgcgggtattttcctaaatcacaaaaaacagtcataatataccgaatataactaaaaacaattatagaattgttgtaaattttaaaggaattttcgttcgatttcgcaaaaaacgttatttcggacttccaatgcttattggtgtttattcatttttttctttgtttttgtaattttgaattttaaaagaaaacaatttttacgaaaaaaattctgaaaattgacaaattatgtttcaaattatataattaagaaaaagctgtaagtattaacggagaacgcaaaaatgccaaaaactacgccacatttgcgcgggaattcgaaaataattcacatttattttgcaaaatttaaaatataatttagaaaagttctataaatattttaaaagttataatcggcaaattgagactgttttctgccattcaggcatatttgatttaaaaaaccgttacttctaggacttttctaattttttcttgaaacttagttccgcagctttattttaaggccatatttctctcaaaattcaaagtcactctagttttctttttcttctgaataatttggttttatttcaggagaagccgttttcgccagatgtctatctgctctgaaggatgaacgtgttcgtgcttcgaaacaacttcctcgtccacaagtctcaccagataccgtcgttcaggacaaaagagtcttcatcaagcaaatcagcaaggctctttacgcctcaaaaatcgtcagttatgctcaaggatttatgcttcttgccgaagcatctaaacaattcaactggaatttgaactttggagctattgctttgatgtggagaggaggatgcattattcgttcaaggtaaataaaaatttgtataaaaataattatattgaagtatattaatattttcagattcctcggagacattgaacacgctttccaaaagaacaagcaactttccaatcttcttctcgatgatttcttcaccaaggccatcaccgaagcgcag

SEQ ID NO: 29842 - DNA, 645 bp, Caenorhabditis elegans
gatctccgcaaaactgctccattcaacaaattctcaatgggaaccgccatttctgtagccagacaatcattggaagctgttgaggatttgcacaacattggattcttgcaccgagacattaaaccaggaaattataccatcggacggaaggagatgcacgaattgagaaaggttgttaaataattttacgtatttcaaaaacgtttcgtacttcaggtctacatgctcgatttcggaatggcacgcaagtttgcccgtgaagacggaactcttcgcaatccacgtgctcgtgctggattccgtggaacggtgaagtatgctccattggcttgccatattcaacgtgagcagtgtcgcaaggatgacattgaaagttggctctacatggtcgttgaaatgacatgtggacgtcttccctggcgtaatctgactgaaagtgatgatgtgggagtgttcaagaaggaatgtaaaacgactcgtcttaggtgtctgtttggaggttgtccgcgtgaattcactgaagttttcccgattcttgacaaaggaaagttcttcgatgctccggagtacacgaccatctacgagctccttgaaaaggcaatggttaacaccaaatcgaacgagtttccttatgattgggagtag

SEQ ID NO: 29843 - DNA, 1735 bp, Caenorhabditis elegans
atgtcgttgcattccagttcagagcattcatctgctactactaatatttctcatttatgcggacttcggatctcggagagacctcaaaaaacaagaaaaactggtgttatttgcactatcggaccagcgtgtagtgatgtagagacactgagaaaaatgataaacactggaatgaatattgccagattgaatttctcacatggaactcacgaggtgatttattttaacatttttattaacttaagttggattatataaatttcaaaaacatatttatgtttgtagtataacaaatatcaaagtaaaacacaaacgtttcacaaggaattttgaaattttttaaatttaaattcaaaaagtggcaatcgcgtagtttttgccactcataattcggaaagtcgatcttttttttcagattttgcaaactctttttctttttttttcaaattttgcaaccaaattttgcattttgcatttcaaattttggcaaccgaaattttaaagtttctctacataggactttgtgaatctgcatattttgcatctggatatttagtcctggcgtcagtgaatatcgccttttcacatgtaaaaataataataagctaaccaattgaagacagaataaaaaacattgaaaactgaaatatagattaaacttttttgaagatgaaactgttcatggtcgcaatattttgtttgaaaaacaaataattgatttatttgtttctcgttaatttaagacattatttgtaaaaaataatgtatcaggcacagaaaaagaaacaaataatttcaggcacatgctgcaacaatcaagacaatccgtgaagctgctgaaaatgctccattcccggtcgcaattgctcttgacaccaaaggacctgaaattcgtaccggaatgtttgccaataatatgaaagaagttcaattggaaaatgggaaaagtgttcgagtttccacagatccatctatggaatttgctgcaacatcttctcatatttatgctgactacagaaatcttccaaaagttgttcaacctggttcaagaatctatattgatgacggattgatttctttaatcgtcgaaagttgtgaagaaacagcagttatatgtacaattgaaaatggaggagctcttggaacacggaaaggtgttaatcttcctggaactattgttgatcttcctgcagtcacatcaaaagatatcgaagatttattatttggagttgagcaaggtgttgatattatttttgcatcattcatcagaaatgccgacggaattcataaaattcgacaagttcttggagaaaagtgagtgaaaaacataaactttcttgattgctgactgccattccttaaaacttaatttttcagaggaaagcatatttacataattgcaaaaatcgaatcagaagatggagtcactaattgcgatgaaatcatcgaagcatccgatggagtaatggttgcaagaggagatcttggaattgaaattcctgcggagaaagtattcctcgcccagaaaatgctcattgccaaatgtaatctggcgggaaaacctgtgatatgtgcaacccagatgctcgagagcatgatcaccaaacctcgtccgactagagcagaatgcagtgacgtggcaaacgctgtcttggatggagttgactgtgtgatgttgagtggagaaactgcaaaaggagattatccagttgaagcattggcgattatgcataat

SEQ ID NO: 29844 - DNA, 1128 bp, Caenorhabditis elegans
atgttgcgagttactacaagcattagaaaaaccacgaaaaatgccgttgggccaagaacaaacctggaggaagtgttgaattgtatcgctatggctgaagacatttacaactaccttgttcatcacgagaagaaatatgttcttgacgacagcttcataaatggaggaaatgttaattctaagatgcgccgcatccttgttgactggcttatccaagttcatcttcgcttccacctcacccctgagacgcttcacctgacgattttcgttctggatcgaattatcgtgaagaacattgtctccaaggcggaattccagcttctcggtgttgcagctttgtaagatcgttttttttgtaaaattatagataatcttttgtagatcagaaaattaacaatagtttttatgcaatattaatgatttcaggttcgttgcctccaaattcgaagatatttacttgccagacatcctcgaatacgagatgatcactgataacacattcagcaagaagcagataatggctatggaacagaccatcctcaacgccttgaactttgacttgtcctgcccatcttcgcttgtcttcctccgctgtatttcaaaaactctcacagagaatgacgtcaatccaatcgataaggaagcgttctattatgtgcacaatatctccaagtgtctcggagaactcgcattgctcgattcggtcatgtctacggttccaaggtcgcacgttgccagtgcttcgatgatcatcactctcaatgttatcaccgttgatggaattaatccgaagactgctgcatcgatgattcggtagattcaatttttttcgaaaattttacaagaatttgtttcagcaaacaattaggagcctccaagcaagatatttatgatgctatcgctctgctcgctcaagtcgcatataaaaacttcagacatcagaagctttgcgccattagagtaatatatttttacaaaatgtttactcagttttgttttcaggaaaagtaccagtcgagcaagtttggacgagtatcctacttgatgaccgacgaaatcttggagaaaattcaccggatggggcgcaacgttgaggcttcagaagctgaaacatcagaaatggaatga

SEQ ID NO: 29845 - DNA, 713 bp, Caenorhabditis elegans
atgaaaattgcaatcattggtcagtcggcatttggtgtcgatgtttacaaggagttacgcaagaatggacacgagattgttgtagtcttcactatcccagataaaaatggaagagaagatctattgggtacgtttaaaaatagttttatcacactactttcatttttgctgtggtctgatttttgaacccaattctctacgaaccacaactcgtgatcacttttaaaaaacattataatttttgcaattcgtttacagccgtcgaggctgccaaagatggtgtcccagttcaaaaaccatctcgttggcgtaagaagaaccctgaaactggaaaattcgaaactcttccggaaatgcttgaactttacaaatcgtttggagctgaactcaacgttttgccattctgcactcaattcatcccactagaaatcactgaagcgccggctaagaagagcattatctatcatccaagtattctaccaaagcacaggttttcagctgaaaatgttaatttactataaatttcaatttttcaggggagcttctgccatcaattggactcttattgaaggtgatgaggaagctggattatcgatcttctgggctgatgatggtcttgatactggaccaattttgttgcaaaagaaatgcaaagttgaagagaatgatacattgaacactttatataaaagattcctgtatccagctggagt

SEQ ID NO: 29846 - DNA, 1348 bp, Caenorhabditis elegans
agctgctgttgtaagtctaggagttgtacaattcggagtataattaaatctaaatttttaggcagaatcagtagaactcattgctactggaaaagctccaagaattgtacagccagaagagggagcatcttatgaaccatatattaccacaaaaccagaattggctcaaatagattggtcgaagactcagcgtcaacttcataattttattcgtggaaatgacaaagttcctggagcatgggctgttttgaacggagaaaaagtttcatttttcggttcaaagttgtggaagccaaagaagcttccagatgatgctgtagaagttttcgtttcagaagttccaggaggaaaagttttagttgaagatcgtggattgctccttccaggatcagacggtagatgggttattgtagatacagtgaagattggtacaaaaactgtcccagcttctaaatatggacagggagctgatcaagttcaagaacttgtattaaccgacgaagaaaagagtactgtagctaagctgaagaaaatttggaccggaattctgaagactcaagtttcaagtgacactgatttcttcgaaagtggtgcaagttctgctgatgttactcgtcttgtggaggagatcaagttcaatactggagctgagcttgaatcaggacaagtgagcttttatgaaagtattctaaaaattcaaatgtgttacagatctatgccgggccaactcttggtgaaaacatcgacattgtgatccgtaatcttcgtggtgaaggtggaatctctgtaacttacgatccaattgtattgaatgttaacaatatggaattgaaattcccacatgaccaattcattgatggaaaatttgttggttcatcagatggacgcacttttaaaacaattaacccagcaactgaaaagccaatttgtgaacttcctttggctactgtagctgatgtcgatcgtgctgttcgtgcagcaaagaaagcttttgaacgtggagaatggcgtcaaatgtctgcccgtgaacgtggaaagagactttacaaactcgctgaactcatggaagaacacaaagaagagctcgcaacactagagtccctagatgctggagcagtatatacgttggctctaaagactcacgttggaatgtctattgatgtgtggagatactttgctggatggtgtgataagattcaaggaaaaactattccaatttctaatgctcgtccaaataagaatctatgtttgacacttcgtgaaccaattggagttgttggactcattactccatggaattatccattaatgatgttatcgtggaagatggctgcttgccttgctgcgg

SEQ ID NO: 29847 - DNA, 516 bp, Caenorhabditis elegans
atgaaaaccgctgttatcgttggacttttgtgcctattggcgatcgcatatgctgccgatgagcagaaaatcgataaattgcaaattggagtcaagaagcgtgccgagaactgcgttcagaaatccaggtaagcttactctttttaattaaaataaaaatgttaaatttacagaaagggtgatcaattgcacatgcactacaccggaacccttctcgatggaactgaatttgattccagccgcactcgcaatgaagaattcactttcactcttggacaaggaaatgttagtttttaaagaaaaaaccaatatcaataattaaaattgaaattataggtgatcaagggatgggatcaaggacttcttaacatgtgcgtcggagagcgtcgtattctcacaattccaccacaccttggatacggagaacgtggagccccaccaaagattccaggcaactctgtcctcaagttcgacgttgagctcatgaagattgacagagacggagaagaattgtaa

SEQ ID NO: 29848 - DNA, 186 bp, Caenorhabditis elegans
ttctgctttcgatctgctcgctgctctgtgatccaaatccggatgatccacttgtgccagagattgcacgcatctacaagacggatcgtgaaaggtgaatttagattttcttttaactactaaaaataatcgattttcaggtacaatcaattggcgagagaatggacgcaaaagtacgctatgtga

SEQ ID NO: 29849 - DNA, 1116 bp, Caenorhabditis elegans
atggaacatgaagtaggtgctaagccaatgctcccaccaggtaccacatgtgatcaatttgttcttcaaaaaatgctgagtggtggcggttttgggcagatttttgaggcttctatttatggaagttcgaatgagaaaagtgtggtgaaagttgaaggccaaaatgctatggtacttttaatatatttctgctttcgtggtggtttttccagttttgctgaggagtgagactcaaaagctagaagaattatagagaaaatctcaattgaagaagttttgcgtaacttttcccttgaatgcttaaaacactcagcgtttagcgtttaatcgttggcaacagctctcccacatcgtttccagcaacttgccaactataactaactattgccactattgccaactgtcacaataagttgccaggaagtttttttgtcaagaaggtgctccggaatgtgttctcaagcagatatggctacgaccaattgcccgttaaacgcttttgttttccgaaataattcagcttctgagttagtctcatttgaactgggaaaaatcataacgaaaaccgaaagcaaatagaatctgcaataagtttctaaataattttcagtttcaacttttatacaatgaatgttcttgtcttaaaagtttgaatacggcattcaatccaaacaatttgcctggagcatccccatttcttcgtttccatggctatgggggcattgatggatttcgttggttggcaatggaaaggtgtggagagaatctcagtgatttgagaaaggacactccattgggtcgcttcaggtacctattcgatcttggattttcttggatcttcttggatcaaggattttcagtgttacaacatctctgttcattttctacaaattcattgaagcccttcaaatgatgcacagcattggttggcttcatcgtgacgtgaaaccggcaaatgtttgcgttgatcttaaatcgagacgtcatctctacttgttagatttcggaatgagcaaaatttatgtggaaaaggatgggacattgaaagcaagaagaacatctgctccattcagaggaactcttagatatgtctctgtcaatattcatcgtagacag

SEQ ID NO: 29850 - DNA, 2199 bp, Caenorhabditis elegans
atgagattccttttggtgggcttcgtcgcccttctggctgtttcaggtatgtctttttattgattttcagagcttagtgagctttaaatagaaaaccgtagttttgaaattgtaaaaaaaatttttaagcttaaatgtacgctgaaaatattaaaactgtgttcacagaataaaaacattaggctttattttttcattctgtgcatacacgccacgcagtttttgaattcacgtttttattcccaacaatcatcacttttcagccttcattccaaatgtctacgccgaagatgaaatcgaagacgcaccaaaggaaaccaaagaagaaacaaggtaatttttgataatttgattattatgaaaaattgcaatttgaaaaagtctagagaattttgaattgtgtttcgtacattttttgaacaatttcgtgaatatgtcgaaatcagaatcaataaccttgttaatttttaattagatctaatatatcagaaatatctttcgaattcgtttttcgctcttaatattgaatagttacagttttagctggattaagtgttccaaaaagataaatcacattttcttccactttccaaataaattgacctgtcactacgtgtctgttccttttcctggttactctgaactatctcaatatttgtctacccccggcctcagccaaaacttttgaacggtaccaggtcgcgtcagtccacttggtgactctcatccgttttgcacactattttgtactcccgcggagcactatttgattgagtcttgccctttgtcggaatgcaaacagactcgatctactgctaggttatcttatcttgtttgtgtttcctttttctcaaataagaaaaatcggctgaagggtcaagagagactaaaagggttatctccgacctagataatttaacgtatgctttcctagattcacgtaatagcctgtcaaggacggagatacgaatcacaagatttaatcttctgctaatggaaggtgtagtattagggatgccatacacggattagaagtgaacgcattattttctagggtttctgataaaattttggaaaattaaagatcaaaactgtacaattaaaacacaatacagtttaaaacaatttaaaaatataactagttaacaaaaaaaattgaaattgataaataatattttcagagaggaagattcgatcaagctcgatggactatctgtctcccagatcaaggagctccgctcaaaagccgagaaacacgaattccaagccgaagtaaaccgaatgatgaaacttattatcaactctctctacagaaataaggagattttcctccgtgagcttatttctaatgcttccgatgctctcgacaaaattcgtcttctttccctcaccgatccagagcaactccgtgagactgaagagatgtctgttaaaatcaaggctgatcgtgaaaaccgccttcttcacattaccgacacaggagttggtatgactcgtcaagatttgatcaacaatttgggaactattgcacgctctggaacttcagaattcttatccaaacttatggacactgccacttcttctgaccagcaacaagatcttattggacaattcggagtcggattctacgctgccttccttgttgccgaccgtgttgtcgtaaccaccaagaacaacgatgatgatcagtacatttgggaatctgattcagctagcttcaccatcagcaaagacccacgtggaaacacattgaagcgcggaactcagattacattgtacctcaaggaggaggcagcagatttcttggagccagataccctcaagaacttggtgcacaagtattcccaattcatcaactttgacattttcctctggcaatccaaaactgaaatggtggaagaagcagttgaagaggaaccagccaccactgaagacggagctgttgaagaagagaaggaagaaaagaaaaccaagaaggttgagaagaccacctgggattgggagaaggtcaacaacgttaaacctatttggatgcgcaaaccaaatcaggtcgaagaagacgaatacaagcaattctacaagagtatcaccaaggattcggaagagccactgagtcacgtgcatttcagtgctgaaggagaagtttccttcagatctatcctctacgttccaaagaagtctccaaatgacatgttccag

SEQ ID NO: 29851 - DNA, 1002 bp, Caenorhabditis elegans
atgagcggaaggccggcgtttgagcagtttactgctcaaccaccgcaaccagccggtgaagttgttgctcagcaagctggtgatggagctcaaggccaagagctgacaatttccaaactggaaaatgcgataacttcaatggaggaacaaggtcttcagaatgaccatcgacacgccaaagcagttcttttgaagcaaaaactccaatctggtctcccagacgccgttccaggacaggaaaatggcgggaatcaacaaattaccccagcacaactcaatcaactgagggctcaagtgtcagcctatcgtcttttggctcgaaatgaacaagtaccggccaacttgattgcggatgctgtcatgctccgaccaaaagttacaactttgttgcctgaaccttatgaatatccaggagaggcagagaatggagaaaagttgccgtatgatttgatgaaggtaggtaaaatggatcgaatgaaactatacagtctacttttttacagattttcaatctccatcaaatacgctgtaatcgtccaacaacaatttctgttccatcaggaattgatcctgttggcatgctcaagcaaagagaaaatatgattcaaaacagaatcgggctacgcatgaagctactcaataacttacccgccgacattccagatcacatgaaattgaaagcagaaatcgaattgcgtgctttacgtcttgtcaatctccaaactcaggtaatttctggattcgaagagtattttaaccaataagctgtttttaggtgcgcagtgaagtgatggcttgtctcaaaagagacacaactctcgaaactgcactcaatccatatgcgtatcgacgcacaaagcggcaatctttacgcgaagctcgtgttaccgaaaagcttgagaagcaacaaaagatggagcaagaaagaaagagaaggcagaagcatactgatttgatgcaagctatcattcagcatggaaaggaattcaaggagtatcatag

SEQ ID NO: 29852 - DNA, 2258 bp, Caenorhabditis elegans
actattcaggtaggaatttgggaaatgaggaaatattaatcaatttttaattttcagacaatctcgttggtgacgtatttgatggaagtcaaacaaaacaatggaccatatcttgtcatcgtaccgctctccacgttgtccaattggcagaacgaatttgctaaatgggctccatctgtaaccactatcatctataaaggaactaaagatgctcgtcgtcgtgttgaaggacaaatcagaaaaggagcgttcaacgttttgatgacaacatatgaatatgtgatcaaagagaaagcactgcttggtaaaatccgttggaagtatatgataatcgacgaaggacatcgtttgaagaatcacaattgtaaattgacattgatgttgaacggattcttccatgctcagcatcgtttacttcttactggtactccacttcagaacaaacttcctgagctatgggctctgctgaacttcttacttccatcgatcttctcatcttgtggaactttcgaacaatggttcaatgctccatttgcgactacaggagagaaagtagaactgaatcaagaagagacgatgctcatcatcagaagactgcacaaggttcttcgtccattcttgctgagacgtctcaaaaaggaagtagaatcacagcttcctgacaagaccgagtatgtcatcaagtgtgaccagtctgctttgcaaaaggttatttatcgtcatatgcagaaaggattgcttctcgacgctaaaatgtcatctggagcacgttcgttgatgaacactgtcgtgcatcttcgcaagctttgcaatcacccgttccttttccctaatattgaagattcctgccgtgcatactggaaggtcaacgaagtcaatggaaccgatctaatgcgtgttgctggaaagttggaacttctcgatcgtattctaccgaaactaaaggcaacaggtcatcgaattctgatgttcttccagatgacgtctatgatgaacattttcgaagactttttgaatttccgaagatacacgtacctccgtttagacggttcaactaaaccagacgagcgtggagatctgctgacacagtttaatgctcctaacagtgatttgttccttttcatgctttctacaagagctggaggtcttggactcaatttgcaaactgctgatactgttattatctttgattcggattggaatcctcatcaggatatgcaggctcaagatcgtgcacatcgtatcggacaaaagaaagaagttcgagttcttcgtctcatcacagctaactctgttgaagagaaaattcttgccgctgctcgctacaagttgaatgtcgacgagaaagttattcaagcaggaaagttcgatcaacgttcaactggagctgaaagaaagcaaatgctcgaacaaattattcaagcagacggagaagaggaagaagaagaggaagttccagatgatgaaactgtgaatcagatggttgctcgctcagaggaagaatttaatatcttccaatcgatggatattgatcgtcgtcgtgaagaagctaatcaacttcaccgtaaaccccgtcttctagaagaacatgaaattccagacgatattctcaaattgtcattcgattatgaggaaatggaacgagccagagaggaaggtcgtgaagttgttgatcaaactcctaatcagagaagacgcagaagagaggtaaggaatatataagagaatttacaatattaattcattttcaggtcgactactcttccgatcttttgtccgatgaacagttcatgaaacaagttgaggaagttgaggatgaaaataatcaagctgtggctgaacgtaaaaagcaaagaaaacgtaaaatggctggattggacgagaatgatgattctatggatgacgttgttctacaacacaagaagaagaagacggatccagaattggcagaaaaaatcaatgaaatgcttgatgttattctagaatataaaaatgaggatggagaactcatcgcggatgtattccagacacttccaactcgtaaagaactgccggactattatcaagtgatttccaaaccaatggatttcgatcgaatcaacaaaaagatcgaaacaggacgttatacggttatggaagaattgaatgatgatatgaatttgcttgtgaacaatgctcaaacatacaacgaagaaggcagtgagatttatgttagctctgaaacaatcggaaaattgtggaaggaacaatacgataag

SEQ ID NO: 29853 - DNA, 1213 bp, Caenorhabditis elegans
atgtcggcactcagaagcactaaggtgagtttaagagcttgaaaaggttgaatacttgctccaaaattgaaagtgttatctgaaaaccctacgttctatcttctcagggtctcgttgctctcgtcactggcggagcgtctggactgggaaagggtgctgccgaagttttggcaaaggctggtgcacaggtcgctattcttgatcttccacagtcaaaaggagccgatgttgcgaaggagatcggaggaatctttacaccagcttcggtaacaatgatttcatgctacatttgtaaagagaaacttcaagtaaaatattacccagacgccaattttgcgatctctgtctcgacacgcccttttttgtaaaatagaaacgagtgtgtgcctttaaagagtactgttatttcaaaatttcgttagtactgaattttcatgaaattctcatcgttttttaaattaagaattaaaaattgaaagcacatcaattttattcaacaaatcatgataaaaaactacgaaaagtcgataaaaattccacagcattttcaattttaagagtactgtaaaattacagtactttttaaaggcgcacatacattagtattttacaaagttttacgcttcaaatattacgataacacaaaattctgagaatgcgtattttgcaacatatttgacgcgcaaaatatcttgtagcgaaaactacagtaattgtttaaatgactactgtagctcttgtgccgatttacgggatcgattttcgaaatgaatttattctcgaatagtgacagtgatattagattttccttcattttttcttaaattaaataattaaattgattttaactaatttggaaaaaaaccaaccctgaaattgatacaagagctacagtagtcatttaaagaactactgtagttttcgctacaagatattttgcgcgtcaaatatgtggttctatacgcattctccgaatttagtgctcccgtaataacataatttattattgtattttctcattaaaaaacaaacgtttcataaatttcaggtaacatccgaagaagaagtgagagcagcttttgccaaagttcaagctgaatatggtcgcctcgatgctcttgtgaattgtgccggaattgcgtatgctttcaagctctactctgttcaaaagaagaaacacgttgattttgagaagatccgtcagaccattgat

SEQ ID NO: 29854 - DNA, 390 bp, Caenorhabditis elegans
attagtgaaagtgtgaaatcagttctcacaagattagaatctgtggcatctaaacataaatctcaaatttctgatttgggatgtgaaattcgatttgatctgatggaagttgtgtatgaatgggcgaatggaacagtaatatcgagaaaataatatgatttagtcaatcaacttactaaatttcagccgttctatcaaatcatggaaatgactgattgtcaagaaggccttatcgttaagtgtattcaacgattggatgaagtttgcaaagatgttagaaacgctggcagaattgttggagatcctgctctggttgaaaaaatggaagaagttagtgcatcaattcgacgggatattgtttttgcagcctccctttatactaccgtctga

SEQ ID NO: 29855 - DNA, 855 bp, Caenorhabditis elegans
gtgaatccagagaagtacaccggtattgctactggtttccggaccaccatcgccgaggaaggagctcgtgctcttgtaaagggatgggccccaaccctccttggatactccgcacaaggacttggaaaattcggattctacgagatcttcaagaacgtctacgctgacatgctcggagaagagaacgcatatctctacagaacctctctttacctcgctgcttccgcctcagctgagttcttcgctgatatccttctcgccccaatggaagccaccaaggtccgtatccaaacctcaccaggagctccaccaactcttcgtggatgtgcaccaatgatctacaaggccgaaggactcaccggattttacaagggacttccaccactctggatgagacagattccatacaccatgatgaagttcgcttgcttcgagaagaccgttgaggccctttaccaatacgttgttccaaagccaagagcagagtgctccaaggctgaacaacttgtcgtcacgtttgttgctggatatatcgccggagttttctgcgccatcgtatctcacccagccgacactgttgtttccaagcttaaccaagactctcaagccaccgccggaggaatcctcaagaaacttggtttcgccggagtctggaagggacttgtgccacgtattatcatgatcggaaccctcacagctcttcaatggttcatctatgattctgttaaagtgagtttatatcggtattatttttcttaattaataaaaaaaattcaggtcgccctcaaccttccacgcccaccaccaccagagatgccagcttccctcaaggccaagcttgccgctcaacaataa

SEQ ID NO: 29856 - DNA, 94 bp, Caenorhabditis elegans
atgagcgtgttcagccagcttgccgaatcatcgaagcagaacccattcagcttgccggtcaggtcgggtaactgcgccagtgctgtttcagctc

SEQ ID NO: 29857 - DNA, 593 bp, Caenorhabditis elegans
gttgagctcactaaagggtccctgccatggcgtaatatgacagaaatccaggatgttggaaatgagaagcgtgctattcgccgtgatcccatcgtcaagaagaagatgttcggagggtaagagacagattttctaaaaaactatttttgaagtgttgaaaaaactttcatcacccgtctctgtttcaaaacctatcttatttcagctgtccacgtgagtaccttgacattctcgaagcgatcgataagggacaattctttgatgagccgaactatgaacggatctactatcttttgagagaggcaatgaagaatacgggatccactgaatatccgtatgattgggagcaatctcttatgaagaaaacgaaggaagaacaggaaaagaagaagaaaggagttgtagatcaaacagaaaaggttatcaagaaaaaagaagttgagttggcagagggaaaatctcataaggagactaaggaggttaccaaagtcagtaaggaaattgttgaggaaaagaaggaagagaagaaagaggagaaaaaggaagagaaaaaggaaaagtatgaagacgataagaaggaggagttgtattga

SEQ ID NO: 29858 - DNA, 2141 bp, Caenorhabditis elegans
atgatgactgcggtttcacagatgtcggttccaagcagtaagtcaattttaaaaagttaatcgtcaacatctagaatcagaagatgaaaacttctacttcgaactttcttggaaaaatgagctttcttaaacttccaggctttagctgtagaaagcttttttccaattcccaacttcaaaagaaactcagattttaaaattgggatcttgagcaattaataaacgtaggatgagttgcccggtgggcatacttcacattcttagccacataaaattgttattttctcattttaatttcaatttcagagtagattattattaatttgaaatatttagggaagaatttcctaaaaatgggtttggaagtgcataatatcgaaaaaaaaagtgggagcttttttggcaagatacatacgtataggattttgataccttcacaaaattttgaaaaccctatgaaatactcctgtttttttttaaatatttttttactacccattgtcttcaaatttaacaaaatctgaaccttgacttcttccatgggataaatccattaatatacaaactacagtaaatccatgtatctttatatatgagttctagaagccttagtgcagatgggttactgtagttgtacctaaactagtttgtgtgaatgaagaaagaaaatgaagaaatgtctaatgtgaatatcataatttgaatgcatatcaatttcagtgtgagaaaaaatttctaactgaaaaattaagacattatttcagaaccctgatttcagaactaaaaagtcacataaaactttcataaaaattcctttttttttcctaatctccccggcacgagaactccaataagtaaaataggaagtcattaaacatagtgactcaatattatggtagaaatgattaggtgtgaattatgagttaggtgatggaattagtacaagaatggaagagtttctgtgggagatgcaggtgtttcgggtcaattgtgacacgtggcacctgtggatttagcaccatttagctagaactagaattgatttgaaaggtcatgatgttaaataaaattaattttttaaagtcatacgaacaacatcaaaactaatactcaatatccaagaagtagaaactcaatttgaaatattgttcacttcttgcctttttctttcaacaaatccatttccattctgccttcattctcttttcatattctattaattaggcaggcaagagacacaggaagtgctgaataattggagtctctccttcttggctttcttgatttcctcattctatttcacacctaaaaatgattatttcttcaggtcgaattctattggatgttgattgtagagtctgtgaagatcattcgtcggggaagcattacagtattttttcctgcgacgggtgtgctggattctttaaagtaagttttaatgtttattgagctctcattttttagatagcttaaaatattcgaatttgagagtaaattttagtggaaaatttttaaaaaagtattatctagacgcgaaagtttcccatttttgctctaaaaatacggtaaccggtctcgatgtgaattttttttattaaacgggaaaaggtatgtgcctttaaactgtactgtaattatgtactctcgtttctgccgaatttttctcctgatttattaaaaatgtatgtgttacatctgaattttattaaaaaacatatatttttatcgaaaaaccatccaaaattcgacagaaacaaatttattgaactacagtacgttttaaaagcgcacaccttggttagacaaggtactaatttttgctgaaactaattgttatattattgaatttccggatagataaaaatgtgttaatcttcaacaaaaaatgtctacaatcattttgcaacattaactttgttctgctccgattataatgtatgtctaggatttgagacctcatgaaatattttttcaatgtgaattgactttcaaatttccttagcataattatcattgaaattgaacaacaattccaaatttcagcgttcaatccgtcgtcatcgtcaatacgtgtgcaaaaacaaaggcagtccatccgaaggacaatgcaaagtggacaaaacacaccgcaaccagtgcag

SEQ ID NO: 29859 - DNA, 611 bp, Caenorhabditis elegans
atgaaagagtacaaaattgttgttttgggaaatggaggagttgggaaaagcgcattggtaactaatctcaaatagattttaaatttgatttccaaatttcagactttgcaatacgtgcaaggaatatttgttcacacttatgacgccacaattgaagattcctatagaaaattatcaaaagttgatgctgaaaatgcgaggctggaaattttagatactgctggaacggtaaaactttcaattcaggaaattcaacatatgttaattcaggagcaattcactggaatgcgagaaacatattaccgtactgctcagggatttgtactcgtcttttctcttgccgaaacttctacttttgaaaatttgaaacaaacgtttacagatattatcgcaattcgtggaaaggaggttttgttgctattttctgtgaatttcctagttttttgtttcaggttccaatgatattagtcggaaataaatctgatttggcagaaacaaggcaagttgatgaatcagaagctcacaattttgctgaaaaactcaaaatcccatattttgagactagtgcaaggctcaaccagaacgtatcagaggttggaatatatctttaa

SEQ ID NO: 29860 - DNA, 887 bp, Caenorhabditis elegans
atgcttcgttcctcaaacttgtgtcgatcaattacagcttctcgtggaaagcatgctttgaccggagacgactatcaatatctggaaaaatcagaaattccatcgtatcacttccagaagtcgctgagaagactgcctatcccaaagcttccagatacggtaaatcggtgagcattctgtaactaaactgaacattgataattattcatcatatttttacagctaccttgcttcttctaaagcagtgctctctccggatgtttttgcaaaaactgaagccaccattcgcagttttgaagccaatgaaggtccaaaacttcaagaagcgcttctagaatacgacaaggctcatagggacaccagttacatttctgagccatggtttgatatgtatctaagagccagagttccagttgctgtgaattacaacccatttatgatgtatgctccagatccaaatccgaaattcaatgatcaggtaaaatacgtttcagagaaataatgtttttgagtagttttttttctgaatttgaattgatttatttttgtactttgtatactcgttctatttatgacttaccttctctgtagtctcttctccgtagtccacaaattgttcgagtacactacgagatgaaagatacgagggagaaaaggggaagggtacagtgtagctttgatgaaacctctttcttttcttaatgaacaaatttaaagttctaccgattgttcttaagaccattattatttcagctaactcgcgccacgaatctcgccatttcctatgctagaatcaagcgatccctcgatgagaacctcttggggccagaggttttccatatgaacccgaaaaagagcgatacaaaattattcagaaccatttgcaa

SEQ ID NO: 29861 - DNA, 1533 bp, Caenorhabditis elegans
ccaacggtcaagccacaatcaactttgaacactcgtggggagatggagttgccgtgcttcgtttaatggaagaatcattcaaggataccaacaaaaatcattttgtatctccagacgacactccaaaatctcataatccagcacatgtgcaggcactcgaattcaagctcacggattctctcaaatctaaaatcagtgatgctcagaagaaacacgtctctgcaaattctgatcttgattttgcgacaatggaattcgaaggactcaacagagatttgatcaagaaaactaaattgtcaccggattctgtgatgcagcttgctattcaaatggcattctattctttgtacaaagagtttgttccaacgtatgagtcatgttccactgctgctttcttgaagggaagaactgaatgcatgaggtaagcttattcctcagaattaaaatatcaagtttcaaaactcaattttcatatcggcaacatcagctacgcgtgccgccaccttggctattcttgaagaaaatcgtaaagatgttcgacaactattgactgattgctccacacaacatttccaacttgtaaaagaagcatcaatgggacaaggatatgatcgacatttgctcggcctcaaaatcacagctcaacgattgagccaaccaactccagatttcttccaagatccaggatacacgagaatgggtcattttgtactttcaacgagcactttgtcaacggatacgattgtcttcggaggattcggaccagttgtgcaagatggattcggtattggatacaacgttgttcccaacaaactcggagccgttatttcgagcaataaggttcgtgatttctctattacccagacgctaaattttatactttttgcgtcaaaattacggtagtggtctcgacgcgaccttttttttgttgctaaatccaaactttcgttgcttcggaattttttaatcattttttcgataagaaatatatgtatatttaaaaaaaataaagcaaaaaaactgaaaaaaaaaaccaataaaaacaacaatatgttgcaacattgaacacatcgtaagaaacaaagaaaaagtcaattaaaattccaaagcctaagagctttaaaggcgcacagcttttcgcatttaataaaaaaaactatcttgttgatacccgaaaaattgtctaatttttttttgaaaaaaaaattagtcaaaaaatagaaatatttagaagttttttaaaagtatatggaaaaaaaagaaacttttttaagaatataaatattatcagatattatataaaaatcgaaataaaactaaacatcaataaattgagattagaaaaatcttgttcaggtaccgtatttttgacaaaaaaaactcgaaaatttcaggttattatcttatctcttagaatttgaaaacatcttatctttataaaattttcagtcgaaacgtgacgctgccgccttctcgaatgctctttacaagagtttggacattcttcgtggtcaccttctcgatccgaaataa

SEQ ID NO: 29862 - DNA, 583 bp, Caenorhabditis elegans
ggattcttcatcactgtctgcccaccagctattctccaactcgcaagccactctgccgaattcaacaagactttcacccttaacctctccgccccgttcatctcccaatttttcttcgataagctctcggaaatcattccattggtcgatgttcttttcggaaacgaagacgaagctgctgcctttgctaaagccaatggatgggagaccacctgtgtcaaggagatcgctttgaaggctgctgcacttccaaagaaatctactaagccaagactcgttgttttcactcaaggaccagagccagtcatcgtcgtggaaggagataaggtgagagtttttgataatttttgaatttattgttttcaattttaatctacaggtcaccgaattcccagtaactcgtcttccaaaggaagaaatcgtcgataccaacggtgccggagacgcttttgtcggaggtttcctttctcaattcatccaaggaaagggagtcgaagcttcagtcacctgtggatcttatgctgctcaagaaatcatcaagaagcacggatgcacagtgccatctgtttgcaagtaccattaa

SEQ ID NO: 29863 - DNA, 707 bp, Caenorhabditis elegans
atggcagaaaacacagcttccgagaatgatgttgagaaagtatacattgcgattgatgataagtaagtgatttgggagtttggcttccatgaaaaatattcgaaaattgtatacacaaaaagggtgggcggaacaaaaacggtgccagagttgcaaatccacttttgtgtagccccttttcaaatgtttccccaatctgtggagcctgaagttctagaatggattgagacttagtggaaagtacagagaaaacgaggatacttactgaatagaagaaataaataattgaaaattaaaaaagtagcattcttttccagaataaaaggttaccaagttgtcgagagtataggagaaggagcttatggacaagtattcaaagtttcaaagaatgcaaagaaatacgcaatgaaagtggaacccaatcggttggatggtggcccagcgtcaatcaccaaggaggtttggcaatatttatggaacgatttttaatactatgtgaaattttagatagaggttatgatggaattgaataatcgtggtgctaagttcttcccaatattcgagacaggaggacgagaaccaaaattccacatggttgtgatgactcttttgggcgaaaatctacaagtgttgagaatgaagggatgcaacccgaaggcttgtacacctggaacatggagccgcattgggatacaatgcctttttgt

SEQ ID NO: 29864 - DNA, 878 bp, Caenorhabditis elegans
atggcatgcaaacgtcattcagtgtccgatcccatttcgaaggatctcgtcgagtgtcttcgtgaatcaatgcaaagagatctcaaatttgagactccgtacgttttcgtgatatttggagcatcggtatgacatctattccatatatatcgattattaattatttaacattttttcagggagatctcgcaaaaaagaaaatatacccaacactgtggtggttgttccgtgacaaccttttgccagtcaacatcaaatttattggatatgcccgttccgatctgacagttttcaagcttcgtgaatcttttgagaaaaactgtaaagttcgagaaaatgagaaatgtgcttttgatgacttcatcaagaagtgctcatacgttcaggtaaatctacatctgctaataaataggcgtgaaactttgttccaaaaatacagtgctcggtctcgacaccacaaatttgtgttaaatgcgaaaacgtatcacctttaaacagtactgtagcttcaagcttttgtcgatttcagattttaaaaaaattgttttaaaactgaaaaaaaataattgcaacacatacattttttttacaaatcaggtaggaaaactacgaaaaccaacaaaaacttgaaactacagtactctttaaaggcgcgcacttttttgcattcaacaaaaattgtggggtcgagaccggttaccgtatttttcgcacaaaatcttgttactgggtaataaaaatttgaatcgaagcttttttctagaaactttgaacataaaaagcaccattgacattttttcagggccaatacgacacttctgaaggattccaacgccttcaatcttcaattgatgatttccaaaaagaaagcaataatc

SEQ ID NO: 29865 - DNA, 524 bp, Caenorhabditis elegans
tgtcattgtttctcaatggacatcggttctcaatttgatcgaaattcacataaaatcaagtggtttcaaatatacatcaattaccggacaagttctggtcaaggatcgtcaagagagagtggacagctttaatcgggagaaaggtggtgctcgagttatgcttctctctctggccgcgggaggtgttgggctcaatctgacaggtggaaatcatttagtgatggtggatttgcattggaatccggctctcgaacagcaagctttcgatagaatttatcgaatggggcagaagaaggatgttttcattcataggttcgttgattgcggcaagaaaattaaattcataatatgtgtgttaatcttgcagattggttacgaaaggaacgatcgaacaacgagttgtaatgctgcaaaaggacaaagtcgcgctagcttcgtctgttctcgacggaaatgctactcgcaagatgaacaaattgacgacggcagatatcaagatgctgttcggattgaatgaaaaataa

SEQ ID NO: 29866 - DNA, 504 bp, Caenorhabditis elegans
aaaattcgtcaaaaaacttctgcaagattccaatgatatgaaaaatcatggatttattcctcgtcgcaatagaagagcaggaaaggaaggagaagttcagaatcctttcaattgtaagaatctgtgatgtttaaaaaattaatattgaatattttcagttggtccacgtgatttggcagccggctcgaacttcgaaaagatgtcatgtgttttgatgcttcttcttcgtcttcgacaagcttgtgttcatttcaatatcacaaaaacaggagtcgacatggacgctttcagcttaatcggtggagacaatgcggaggaagcgaatgtggacgatttgaatgagttactggagaaaactatgaacatgacgttgggaaatggtgacaatgaagaaagagacaaaccgagggctacaacacgaattttcgatccggactacctgagctgtaaaattaaaaatacacttgaaattgttgagaacattatggagaagaaagagaaagt

SEQ ID NO: 29867 - DNA, 1168 bp, Caenorhabditis elegans
atgttcacatcaacactggcaccaatggtgctggctctacttgaaaacgatacatcaattatagcaactacccaatcttcaatgagccccgaaattctagaatatataaaatttgcaaagggaatctaccagtggctggttcctttaacaatcgtaattctactcgtgagtttttgttttcacagtttttagctcaaagatgagtgtgttcatataatccgagatgaatccagatgtgcctgattttaaaattccctcaaaatatttaaaatcttgctaaagagctaagtaagaggttcaaaaaaactaattcctaagatattggaggtgggataagaggggttgaaagattgaatttttgataagttgagtcaaacttcagaaacacataaatatttttcactttttcaaagaagtgaatcacgtgttttgatgtcagtcgattggcgttttgagatgatacagaaattaataattgcttgagaaaaacacggaatcacaggaaatttgactttattctgacattctggcaaaccttatgattcagaacttttttccatttattttgatttttgaactactccacgcgtggaaagcttttttcaaacgttgggacgtcactaccattcgacaaagaaccttctgtatggaaacatacgtgacgtcatagtacccgaaaaactttaccacgagttctataggtcaatttaaagggaagactataaataaaaattttaaatccgataaaaaatcatccaggagaacattttgaaaacgattcaaaacgaattatatttcaaaatccactgaatttcaggttgcaattctgggaaatggcctaatcgttctttcatctccatggctctcttccccggtttccccatatttaaagttatgtatatcccttgctgcagctgatatgtgggccgcaacattacttataagcggtaggttttgattttatatcgatctactgttaacattaagtattttaggattaatagtgaattcgtatctacctgtagttactggatacaagaaaacgtcattatgctttgatgctcttttggaaatgtttaggatatccggaatgttgacttctgatatgcatttatttgctctcgcaattaatcaatttcttggaactatgtatccattaaaatataag

SEQ ID NO: 29868 - DNA, 1983 bp, Caenorhabditis elegans
atgtgcggaatctttgcctacctcaatttcctggctccgaagaagcggtcggaaattgtggacattttggttcaaggattgcagagaatggaatacagaggttacgactctgccggtatcgccattgacggatcaaacgacatcgaaaatcctcattcgaagattgctctgctccgaaagagaggaaaggtgtccgttctcaacgactacattaaggagaacaatgaaaagctcaacatggatatggaatacaatattcattgcgggattgcacacactcgttgggctacgcacggatcaccacgtgatgttaattcccatccacatcgcagcaacgacaacaacgagttccttgtggttcataatggtatcattaccaattatcgcgaaatcaaggagtatctcgagaagaagggacacaagttcgagtctgagacggatacggaagtcatcgcaaagctcacacagcatgtccatgatcgttatcccgacttttcattccgtcagttagttgagacggttatccagcagttggaaggagctttcgctttggcattcaagtcatcgcgtttcccaggacaacttgtggcttctagacgcggatctccactgttggttggtatcaagagcaactcaactcttcacactagccatttcccagtctcttactcgaaaggacgctgttttatgtcgaacaacgccacgcattgtaagttatttaatggttctattttcaattgaacgaaaatgttctcagtgcgcgaagagacatcgttcgtcgagactccaaacaacattctggatctttcaatcgctgtcagaaatcccagtggatctgcaaagctgcccgacaacaattccacaacacgtccgttcgactcaaccgattttgaagttgaatacttcatcgcctcggatgcggctgcaatcattgaacacaccaagcaagttctgttccttgaggatgatgatgtggccttcgttgaagatggatcactcacaattcatcgcatctctcgccacgctgacagcggcgaacaaaagagagaagttcagcttctcgagttggaaatccaagagattatgaaggtttgtggaatatccaaattagaatattgtattaaattgttttatttccagggatcttacaagaccttcatgcaaaaggagatcttcgagcaaccggaatcagttgtcaacacaatgcgcggacgtgttctcccatcgggacaagttgttcttggtggacttaaggaataccttccagctatcaaacgatgccgtcgcctcatcatggttgcgtgtggaacatcatatcactctgcaattgcttgccgtcaggttctcgaagaattgtcggaactgcctgttgtcgtcgaacttgcttcagatttcttggatcgtgagactccaatcttccgtaatgatgtgtgcttgttcatctcgcagagtggagagacggctgatactctgatggctttgagatactgcaaacctcgtggagctctcacaattggagttaccaacacagtcggatcgtcgattggtcgcgaatcccactgtggaattcatatcaacgctggtccggaaataggagttgcttcaaccaaggcctacacctcgcagattgtatcacttctgttgttcgcactcaccatctcggaagatcgcatctcgaagatgaagagacgtgcagagattattgatgctctcaataatcttccaattctgatccgcgatgttctcgatctggacgatcaggtactgaagatcgctgagcaaatctacaaagataagtcacttctcattatgggacgaggattgaactttgccacgtgtctcgaaggagctctcaagatcaaagagctctcgtacatgcattgtgaaggaatcatgtctggtgaactgaagcatgggcctcttgcaatggtcgatgaattcctcagcatctgcatggtagtatgcaacgatcatgtctacaag

SEQ ID NO: 29869 - DNA, 575 bp, Caenorhabditis elegans
ccaaagattgccgatttcggtttggcaaagcacgcgagctcctacaaaatgcgaaaagccacgaagatccctgtcaggtaccttgctccagagacgttgagctcattcgtctattccaccaaaaccgatgtctacacgtttggtcttgtcatctgggaaatatttgcaaacggacaggagccatatatgaaagctcaaccacaccaagaatgtgttgctccaaaaaatacgcaactcagaggacgtcatattaaggagctggttagttctttatcttgatatttgttgtaattgcttgaaaagttcagatcaggaaggagctgttcgtgaaattcaaccaagaggcaccagttgctcttcaacaatatgtggctgcaaagctgttcgtagttgatgataagaaaagacccgatatgcccgaggtaggtgtaacttctaatagtagtgcaccatatgatgtttcaggtatcaacgttcctgggcgacatgttgaaggtggacttgacaaagatgagatactcgtacaagatgtagttacaaaaattgatctacttggtgttttaagttttaaataa

SEQ ID NO: 29870 - DNA, 988 bp, Caenorhabditis elegans
atggagggtggtcgaaactgtgtaatgacagtacaacagtggcaacctgaatacaatgatatgaaccagataagagcaatattctcgttactgtaccttcttgtttgggttggagctattgttggcaacactctagtactttatgtactcacttttaatcaggtattttttgttgagaaaaatcgactttgttctcgagtttatatgagaaaaagtgttattttgttgaaaaaccttggttataatttctaaaaaaaaattttaaattaaaatttgtaccattccggaattttttttttgaaacaatcagaatactacatagaattttttttttcaaaaaatacgagcggttcccccttttaagaggatttttgaggacttcaactttcagttttgaaagttcttaggcttcattaaaatcttccgtatctctcttctcgcattcaattcaaaaaaattgtttttgatactaccatcatctcaaatttccggtattttattcatcgaatttcctagtgaatcaagaatctttcatacatgattgaaagtacaattaccgaaccacctccagaattcgtcattgagctcaaagtgcccgaaaagagttcattaagctaatttgccaacttcaggtatcactgtcagttaggacggtatttgttggatgtctagctggttcagaccttctaatgtgccttttctcgttgccaattaccgcgatttctatattttcaagagtttgggtatttcctgctatattttgcaagttgatcggagttttccaggtgagatttgtataagattttcaggatttataaataaatgtctagactctgaaatactgtgtattaatcagaataacaggagcgaacagaaatttgaattaaaatcagaaacttttcagggcggtacgatttttgtctcatcattcacattaacagttattgctctggacagatgtgtactaattctacgtccaaatcaggag

SEQ ID NO: 29871 - DNA, 398 bp, Caenorhabditis elegans
atggcgacagagacatgcagtctcttgtccgttggacaatcagaatacggcgcagcggcttcaatgatttcagcattagaagcagttgatccagttacactcacatggcataatatttcgtgagttttatctctgaaaatcgttctttatttatagcatttttagaattcacgcggaaaaatcaggaaaacaaattctggaaaatgtatctggaatcgcaaaacctggacaattattggcgttgatgggagccaggtatcctcagttttcataattgaatttcagtattatttttaaatttcagtggcgccggaaaaacaactctactcaacatgctgctctcacgtaatttgagaggcctcgaaacaagtggaagtgtcaaagtgaacggtcacgaa

SEQ ID NO: 29872 - DNA, 1282 bp, Caenorhabditis elegans
cgactcacaatctctggtcttgaatttatggctgattggatgaatgttcaagttggaaatgagaatcaatgtccaccgattgatcgtcttgtagttattggtccactggttgaaacaaaatcaaatggttgtgatgttcagtcagtcgttcgaacacttactctttcacgtgcagagaaacattcttcaacagcatcactaattactgtagacaaaattattaattcaattgctgaaaaacctcttgttaacactgtcgacgtgactcctggtgttggtgatccatgctcatcgatgtggccactgccacctattcacagagtttgtcttccacgttgtggaatgagtgataaaaaagtgaatcttgtgacaaatccatatgaatttgaagtcaatggactacgtgtgatgacaatgtctggcgaaaacgtgagcgagcttcttcgtacttccctgaaatggacgggagctgatgctattgagaatatcattaaatggcaacatgtggcaccaaattgtccagatactcttgatgcattcccagtggctgaaaggtttgtttggtgcattttttggagcacagaataatttcgaaaaatatttcgaaccaaaaaaactaaaaaatatgttgatattggatttatttcgaaatataatttttttggagcctaagacctaaatactttttgaaaaattaatcaaaaaccactaaaaataaggtttgctgtaagtatataaatttttttcgggtattttggtgtcaaaaaagaagccaaataaaatcaatttttcctttaaataacattaaaaaaccagaaaaatgtccaactctagtcaagggtgacattttttcgatttttcgatgtttttcagtgaaaatcaaaaatcgataaaagaaatttttcgactttccaaaaatcgaaaaatttttgtttttcgattttctaaaaaaaaaatcgaaaaacgaacaccctaaggtccctagttttaagttttaaaaaattgatttagtacagtacttttctattgatagagaacatttattacctatacagagaatgtttcaaaacaattatttttcagagatcctctgatcatggacatcacaccgcatgtgatcatttgtggaaatcaacctcacgccgagttccgtcatattccaattgatggatcaaattgccttgttgtttgcctgcccaaattctccaaaactcgtgtcgcctgctttctcaacttatctgatctttccctgaagtggcaaaactttgatcatcagttctaa

SEQ ID NO: 29873 - DNA, 956 bp, Caenorhabditis elegans
gttcctatggtcttggtagggaataaatgtgatttgtcatctcgatcagtcgacttccgaacagtcagtgagacagcaaagggttacggtattccgaatgtcgacacatctgccaaaacgcgtatgggagttgatgaagcattttacacacttgttagagaaattcgcaaggtaattttttagttaaaaatttaaattaaaaataatgtttttaatgtacaattaaggtacaaattcagtcattattatatgaaaattgaaagacgcgagattttgatattttcgcgccaaaaatacgacacccggtctgttcgatttgctccttcaaatattatggtaactttatactgtcgttacagcggaattttcatcaatttttttaagttttcgatattataaaaatatttaaaaacacagcagttttaataaatcggtgaaaattaccccagaaacgaaatattaaagttactgtattctttaaaggcgcacatacgtttgcatttaacacaaattcatcgtgtcgagaccgggcaccgcatctttaatttgaaaatcgccaaatgttgcatttgagtaatacaaaaacgttgtttttaaaaattttctgttttgtaaagctctaaaatgttattattgttatcaacagtttcaagtttccatttttcactaaaaacgaaaaatgtaagtttttccgatatttcgaaacaaaagctcaaagttttggtcattttcttaatttttaaagaaaattatatgttttcttttgttttttttctcaccagcatgcacaaaatctgataaaaaattgagttttattgttaattttctaaaaaaaattttgatgacaccctagattgatatccgaaagatttaataatgttttctttttatttcagcatcgtgagcgtcacgacaataataagccacaaaagaagaagaagtgtcaaataatgtga

SEQ ID NO: 29874 - DNA, 409 bp, Caenorhabditis elegans
ggaagaagtgagttggagcagatttccataattttcggagttctcggaactccaaacgaagacaactggccaaactggagaacaatgcctgatgcaaataaattgctatttgagccgaaagagccgaggaataattggacggaaattcgtatgttgttcttaacaattgatcaaaaaaaaaacgcaataaatcgattttccagtactgtgcaaagaaatatccaacaatttcaccgagtttttgggctcacatcttcaatttttcaaacgattaaaagccagtgaactgttgaaagagccatggatcaagcaaggattgcccctcgttgagccaaattatcgaatatcaaaaaagagtacaagaaggaatcaaagggatgcactacctccattacatgtttttttataa

SEQ ID NO: 29875 - DNA, 533 bp, Caenorhabditis elegans
gttgagcaagaactcaacgacatctgccaagatgtgctcaagctcctcgacgagttcctcattgtcaaggctggagctgctgagtcgaaggtcttctatctcaagatgaaaggagattactacagatacctcgccgaggtcgcttcagaggatcgcgctgccgttgttgagaagtcccagaaggcttaccaggtatttgaaaataactaaattcttgatgtaaatggcatgactttcaggaggctcttgatatcgctaaggacaagatgcagccaacccacccaattcgccttggacttgccctcaacttctctgtcttctactacgagatcttgaacactccagagcacgcttgccaactcgcgaaacaggctttcgatgatgctattgctgagctcgacacgttgaacgaggattcgtacaaggactcgaccttgatcatgcaacttctacgtgacaatctcactctctggacatctgacgttggagctgaagatcaagagcaggagggaaaccaggaagctggaaactaa

SEQ ID NO: 29876 - DNA, 385 bp, Caenorhabditis elegans
atggctgctgccccaccatctgcggatccgcttgataaagcactaatcgtcgatgtagatcagtggattgagcagttatacgaatgtaaaccactatcggagaatcaagtcaaaacgttatgcgaaaaggtttgttgatacagttttgtgattgtcaaaaattaatttttttaaggcgaaagagatcttggaaaaagagccgaatgtgcaagaagtccggtgccctgtgacagtgtgtggtgacgttcacggtcaattccacgatctgatggagctgttcaaaatgggtggaaagagtcctgacacgaattaccttttcatgggagactacgtcgaccgggggtattattccgtcgaaacagttagtctgcttgtctgtttgaag

SEQ ID NO: 29877 - DNA, 550 bp, Caenorhabditis elegans
acattacttcccacttgtcatcttgtgctgcttcattcttccaacaattatcccagtttacttctggaaggagactgcattcattgccttctacacagctggaacattccgttattgcttcacacttcatgctacatggtgcatcaacagcgctgctcactagtgagttttttatttatttacaaaattcgaacctgcctggaagcaaatcctaaagcattcacgattgaagaaatcaaacataaaaaatctaaaaattattatttccagtttcggatggaagccatacgattcctcaattaccccagtcgaaaacgtcttcaccacaattgctgccgtcggagagggaggtcacaacttccatcacacattcccacaagactacagaacatctgaatactcattgaaatacaattggacacgtgtccttattgatactgcagctgctcttggacttgtctacgaccggaaaactgcttgtgatgagattatcggccggcaggtatccaatcatggatgtgatattcaacgaggaaaatcaatcatgtaa

SEQ ID NO: 29878 - DNA, 774 bp, Caenorhabditis elegans
tccgggtcttgtgagcacttctttcttcgccagactacccggagtcggagatgataatgcgagaaaaatggagaattatgtgcagagcaagaccgagtatattcctctgggaagggtatgccaggcgtccgatgttgcggagactatattatttttggccgacaggtgagattctttaaaggaagaaaattgcttcaaaatgcatttaaaacttattttcaatgtttgctgactacggtagatcagtcacttgtggcgtcatgtaagcgcctctaacccacgttaactcgcgctccttgtgctcaacagtgtatattgtatcctctgtgtgcaatttgttgccacaatgccactttattggatccctgtatttcaattttttggatttcattttttttggaggtccgggaaagtgaaagcgggcaggagctagtcacatgtactgtagataatctaaaaacaaatcacaaagttgatcgggatttcaaaaaatctagaatgagtaaaataatctcctataaaatcaaacaacacgaaacataattggaacactaacaaaaaaatctgccatctgactggacaataaataacgggaaaatgcgctcccgagacgcctccactagagaaaacgttatttatgataataaaaataaaatcttttccagaaaagtgtctgaatgtatagtcggacaaagtattataatcgatggaggttctcgtttatgttgcaatattgacatgtcggatttcaaggaacaaatggcaaaagcttga

SEQ ID NO: 29879 - DNA, 276 bp, Caenorhabditis elegans
atgcctggaacaagattctctggaaaagttgtccttatttctggatcttccaaaggtattggacaagcaactgcagttaaatttgctgctgaaggtgcaaaaattgtattgaatggaagatctgctgatgacgttgagaagactagaaaattgtgcatggaagttggcgcaaagccgtgggatcttctaccaactgtcggtgatattaccaatgaagattttgtaaaaatgatggttaatacagtcattcataactttggaaaattagatattttg

SEQ ID NO: 29880 - DNA, 344 bp, Caenorhabditis elegans
cgtttcaatatcgaattgaagtaatgaatcaagcagagctcgaaacctttattcgcgatccagcaaaaatccactcgtctgccgaagtttctcgtcgcttcccagttgtaaatccattagagccgtgtcgaagtcttgctcaaatttcctcgcaaatgcacactgctgaatatgcaggtagcctgttttttccaaattctttgaactctaacaagattatttcagatccgccaggaaaaagcaacaaatcgcctcaagtagctgcaaaaggcgagctaccatctgcggctcctccatcatctcgtactccaaattcagatatttctgaaaaatctgatagatga

SEQ ID NO: 29881 - DNA, 728 bp, Caenorhabditis elegans
atgttgagcactctttccagaggcgcccgctcggtcgctgtccgaagctattcggccgctactctcgatgcccactcccaggtgctcgacgagcagaagccaatggaggagcaggtcaacccatctttctacaagatggtcgacttttacttcaacaagggagccgaggtcatcgctccaaaactcgccgaggagctcaagtccaactctttgagccaaaaggataagaagaatctcgtgtccggaattcttggagctatcaagccagttaacaaggtaagaattttgagtctcattaatttatcatattttattttcttcaggtcctttacatcaccttcccaatccgtcgtgacaatggagagttcgaggttattgaggcctggcgcgcacagcattctgagcacagaactccaaccaagggaggtatccgttattccctcgatgtgtgcgaagatgaggtcaaagctttgtctgctcttatgacttacaagtgcgctgttgtcgatgttccattcggaggagctaagggaggagtcaagattgatccaaagcaatacactgattatgaaattgagaagatcacccgccgtatcgctatcgaattcgcaaagaagggattcctcggccccggagttgatgtcccagccccagatatgggaaccggagagcgtgaaatgggatggatcgctgatacctacgcccaaaccattggacatttggacaga

SEQ ID NO: 29882 - DNA, 716 bp, Caenorhabditis elegans
gccagaccgatagtcgaagcgttttcacaatcaaagggattctgcaatattcttatcgtgggagcaggaggacttggactttggcttcttaaactcgccaagcatttcctagcgatcaacaatgataaaaagatccgtttgatggttgctgatgccaaagaagaacgtttgtctctggccgaaagaaacggagctgactttgtagtacactgggatgattccgaatttgaagaatatctgattatgagaactaaggatgtggctcgtaccggtgtcaatgttgttttcgattttgtgacatctccaagaactgtcactcgatcattgaagtgtctcgctgaaggtggtgtcttatttgttggaggtctttccggtcttgatgttcaacttccaatcaagcacgttgctaaaaacagactggccattatgggagttacgaggtactatttgaagtttttttctttctttatttcatttacaaaatttccagaggaagtatcgaacaactgaaaaaccttgtaaatttgattgccggaggccaaatcgatgctccagactacagagtttatccagtcgatcaagcgtctgcagtgttgaagcaattgtcgatgtcggaggttgaaggtcgtgccattctcgaagtttgcgatccctcttcagcattagatgcagatcagagcggcggtgttccaattcctgccgccacttccgaataa

SEQ ID NO: 29883 - DNA, 407 bp, Caenorhabditis elegans
aaacaattcaattcaagtatcctctggcatcgccaacttcatctacgttcgtggaatcgaattgaaaaggaaatgagtgaagaacaaaggaattttgcacatgtaagtttcttcaaattttttttattcgaataatgagataaattcagcaacatctacctgaaaaagagtctgaagatttggaagagttctggaagttggtgtaccgcccattctttgaaaccccgtctcacgaaactgtgatgatgccaataatcccaaaatctaaggaaattgtaaagccacgtcaagcatcaaagaagaggtcaaagaagagaagtaagaaggatgaattcttgacatttgaggtaatttatttatacaatggctcctggatttataaaactattttttcagacgtattataa

SEQ ID NO: 29884 - DNA, 503 bp, Caenorhabditis elegans
atgtcttccgatccatctctactttcatggaatggcatccgcctccttctcatctgctccttactcactgccatgactaacttcccatcaggttcgtaaacgcgttttttaaaatttataaaccttaactattcatttcaataattacaggattctctcacacatctgtcaataccgctgtccacaaactcaacgagtacctcaacaactcgttcaccgaaagatatcgtcctctggatcatgaagaagtatcccttttgaaatctggaatcaactcggcatggtatctcttccaagttgttggagcaatgtcaagtccgtttctctgtgataattatggtcgcaaggtagcatttgctctctcaatcgctttcatgacgttggccggagctatgcaaatgctcgccagtttcacgccgtactcggaagtcctgattgctggtcgattgattgccgccgttttctccccgttgagtgatgctgcgttgattctgtatctacag

SEQ ID NO: 29885 - DNA, 1489 bp, Caenorhabditis elegans
gctccttatctattctctcaatgccaagcaattaatgctcgttcaatcgtcccctgcatggatactccatcggttaaaagtacctacgaagctgaagtatgcgttccaattggattaacctgccttatgtcagctattggacaaggatcaacaccatctgaatgtggaaaaagaacaattttctctttcaaacagccagtttcaattccatcgtatcttcttgcgattgttgttggacatttggaacggaaggaaatcagcgaaagatgcgccgtctgggccgagccatctcaagcagaagcttcgttttacgaattcgctgaaactgaaaaaattctgaaagttgctgaggatgttgccggtccgtatgtctggggaagatatgatttggttgttcttccagcaacttttccatttggaggaatggagaatccttgtctcactttcattactccaactcttcttgctggtgatcgcagtctcgtcaacgttattgctcatgaaatttcacacagttggactggaaatctcgtcactaatttctcctgggaacatttctggctaaacgaaggatttacagttttcttggagagaaagattcatggtaaaatgtacggagaactggagagacaatttgaaagtgaaagtggatacgaagaagctctcgttcgcactgtcaatgatgtttttggaccagatcatgaatatacaaaacttgttcaaaatcttggaaatgctgacccagatgacgctttttcatcagttccatacgaaaaaggatcggcactgttgttcacaattgagcaggcactgggtgataattctcgttttgaacagttcctgagagattacattcaaaaatatgcctataaaactgtctctactgaagagtggaaagagtatctctatgattcattcactgataagaaggttattctggacaatattgactggaatttgtggcttcacaaagccggacttccaccaaagccaaaatatgactcaactccgatgcaagcttgcaaggatcttgccgctaaatggactacagaaggatccgaggcaccaactgacggagaagtcttcgcaaagatgtctaattctcaaaagcttgctgttctcgatgcagttcgtgtgaacaagactatgtttggagatcgaatgcctgcgttgacagccacctataaactggatcaggctaaaaatgcagagctaaaattctcatggctgatgcttggtctcgaaacgaagtggtctccgattgttgatgcaagtctagcgttcgcgttggctgttggtagaatgaagtattgcaaaccaatttacaggtgaaaataagatgatattgaaaatcttaaatttaaatttataattcagatctttgttcggatggagtgcaacacgtgatcgagccatctcacaattcaaggcaaacatcccaaatatgcatccaatcactgtgaaagcaatccaaagtcttctcaaataa

SEQ ID NO: 29886 - DNA, 203 bp, Caenorhabditis elegans
atggatagcaaaagcgaagaagctggtaagattttcaagttttcttaactctacgatatgaaacgaacctttcagaacctttgctaaaacctaaaaatgtggaagacgagggtctaattacctcgctggatgtggaccccactcaaaagtcacgatctccaactccgaagccaactccgatcccggttcttatcaatgatacg

SEQ ID NO: 29887 - DNA, 1664 bp, Caenorhabditis elegans
tgaacattgacggacatgtcggagcttgcggattcttgccaatatccccattaacaaagaaaatgcatccggttcgattaattaaggttgatgatgtcactggagaagcaatccgaacttccgatggactttgcattgcatgtaatccaggagagtctggagcaatggtgtcgacgatcagaaaaaataatccattattgcaattcgagggatatctgaataagaaggaaacgaataaaaagattatcagagatgtcttcgcaaagggagatagttgctttttgactggagatcttcttcattgggatcgtcttggttatgtatatttcaaggatcgtactggagatactttccgttggaagggagagaatgtgtcgactactgaagtcgaggcaattcttcatccaattactggattgtctgatgcaactgtttatggtgtagaggttcctcaaagagagggaagagttggaatggcgtcagttgttcgagttgtatcgcatgaggaagatgaaactcaatttgttcatagagttggagcaagacttgcctcttcgcttaccagctacgcgattcctcagtttatgcgaatttgtcaggatgttgagaaaacaggttcgtaatttacaaaactcttattattcagatgcgaaactttgcgccaaagatacggtatgcggtctcgacacgacatattttgttaagttattatgtgaacacaaaattctgagaatgcgtatgtgcacaatatttaacgcgtaaaatatctcgtagcgaaaactaaagtaattctttaaatgattactgtagccgcttgtttcgatttacgggctcgatttgcgaaatgtattgaagtcattgatttttcaatagaatattaaaattgaacaaacaaatgagaaaatatggaatgttcctggcattttcgaaaatcaattcatttcaataatcgagcccgtaaatcgacacaagcgctacagtagtaatttaaatcattactgtggttttcagtacgagatactttgcgcgtcaaatatgttgcgcaatacgcattctcagaacttcgtgtacccgtaatataaaataagcgcgtctttaaagagtactgtaacttcaaacttttatttctgcgcaattttcatagattttgtgtaatttttcactaacaattaattattttatctaaacacttaatataaaattatgaacttttcaacaaatcatgagaaaaactatgccatatcgatgaaaattccaaatttgcaattacagtaatctttaaaggcgcacacattttctcatttaatgaaaaaactttccgtgtcgagaccaggtaccgtattattggcgcaaaattttgcgtttgggtatagattaataaatatgaatcatagtgtgtcatttttgattcacaaaaatagattaaaaccaaaaatttcagtcaaaaactgagaaattatgaaaaaaatcttttcgtacaataccaatatttatactgttttattgcaggtacattcaaacttgtgaagacgaatctacaacgattaggtatcatggatgctccttcagattcaatttacatctacaattctgaaaatcgcaattttgtgccgttcgacaatgatttgaggtgcaaggtctcactgggaagttatccattttaa

SEQ ID NO: 29888 - DNA, 375 bp, Caenorhabditis elegans
gcatgcatcgtaagaatcatgaagacacggaaaagtctcacccacacattgctcattaatgaggtaagaggctaacaatataagtaattttgtttttcaatagtttaaaataatccaaatagttgctcttttgtatagttttatcactgaacttttattaaaaattttccgcaactgaattagtggcaaaacacaatttaaaaacacgggtttcaagagcttggtaactttaatttttttcagataattagtcaattgaaaagccggtttacgccaaatgtgcaaatgatcaagatatgcattgaaatcctgattgagcagttgtacatacgtcgatcagaaaacgaacacaatgtctatgagtatttggcataa

SEQ ID NO: 29889 - DNA, 483 bp, Caenorhabditis elegans
cttcctcagttaccatggctcaagttgaagaagcagccaggcttgcgaacatccacaatttcatcgcagagcttccagaaggttttgagactcgtgtaggagaccgtggaacccagctctccggaggtcaaaaacaacgtatcgctattgcacgcgccctggtaaggaatcccaagatcttactcttggacgaagctacgtcagcactggacacagaatccgagaaggttgtccaagaagcgctggatcgtgcgagagagggaagaacctgtattgtgattgctcatcgtttgaacacagtgatgaatgcagattgtattgctgtcgtgagcaatggtactattattgaaaaaggtaagcagactttcaaagagccttcctatccctaatcttgttatttttacaggaacccacacacagttgatgtctgagaagggtgcctactacaaactgacccaaaagcagatgaccgagaagaaataa

SEQ ID NO: 29890 - DNA, 654 bp, Caenorhabditis elegans
ggctattttagtgcttcagctattttttttttctgcttaacaagtcttctttatggaaaaacgtatgaaaaagagaaagtgtatgtttcaaatttataaccgaaaaaatgaagaaaaaccggttaatatagccggaatacgcaaatatatcgaaactagatcactgatttgaacgggaattctaaaataattcaaaattgaaaaaaaaaacatatcataaaaaaattttacagttaaattgggtatattgagactgttttctgtcatttagggaaaaaccacagatgatactccaacgctggataattttttttcttttgaatatatttgtcgctcagaaaatatttattttaagtacagaaaattgaaaaaaaaaaactgcaatttttttcataaaaatcaatccataattttcaggcattcttcatattcgcatcgctttccctctcaattctgataatgatggaaggtctatctgcattcttgcatgctctacgtcttcattgggtcgaattccaatcaaaattctatctgggaacaggacacccattccatgcattttatttgaaagaaagtctcgaaaatgctcaactaattactgaagaaaccgatcgacttgctgacatttccagtggtcaacacctacatatttag

SEQ ID NO: 29891 - DNA, 663 bp, Caenorhabditis elegans
atgtctgatgaagaagaagaagacgttaacttcaagccggtgagttcaaagaatgcaacgcctacctgcccaccttcaagacaggccggcattttgactgcttcttaaccgtgcctatttcagggaacggaaatcagtagcaccaaagccaactacacagtagttcgtcttttgggtgagggaggatttggtgcggtgtatctagtgcaggacaacaaatcgaagaaacaaagtgcaatgaaagtcgagcggaaaatcgagaaaagaaagcattcaaaactgaaaatggagattgctatactgaaattggttggaagcggcaagcactttacgcagattgtggatcgtggaaagaaagacaaagagggcttcttctttctagtgatggaactggtaggaaagtctctggctgacttgaaggctgatcgaccggataaggtgttctcgtttgctactggccttggcgtgtcatgccagtgcttggaggctgtcgaggaacttcataagactgggttcattcatcgtgacttaaagcctcagaactatgcatgtgggttggatgagaaacggcataacatctacattctggactttggtatagctcggaagtacctgaacacgaagaatgagctgaagacgccgagagaaacagttggatttaag

SEQ ID NO: 29892 - DNA, 89 bp, Caenorhabditis elegans
gtaatcttgacattgattcaccgtacgattgggagcttcagaagccggagaagacgagcaaggaacctacttccagcaagatgccctag

SEQ ID NO: 29893 - DNA, 751 bp, Caenorhabditis elegans
atgctcctattttctgcttttttgatattcgggttttctattgggttttcagaagaagcgagttgcagacatccacatgagaggtttattggaactaggtaaagattttttaattttttccgagtaggcgaaaattcctgcctacctggtgcctactgtcaatttaaaactgattttcttgaaatttagttttttgtcggttgttatttcaacaaattatccaggctggcagagaaggctagcagacaggaatgaggtaggcaagtaggcatgaaggcgtgtctacatcgggagttttagtgtctagttttgtttcagtgtgcttgttttgagatttaagataattttcacgtactagctgataattcgaaatttttaaagaaaaaaaaaacaaaaaatttgtccgaataaattttaaaaaatggtttttttttctaaatatctgctgaaaattttgatagctagaaaaagacacgatattgctagattaatctagaatttttgttgaaaaattggaagaccggagctccacccaaatctgggcaccaaatttggttgaccagattttaaagtgagcgaaaaatcgacaaaaaaaaattagttataactttaaaaattctgaattttattttaaggtgctacgcatttgtgtccaaaaagcatacatacaacactgccaaggaatattgtgatagccacggatacagccttgctaccgtcgataatgctatcacctctaatttcttagcct

SEQ ID NO: 29894 - DNA, 403 bp, Caenorhabditis elegans
gtgttactccttcatcccgaccctacttccgtacgcggctgctaaacaaaaatgcgaatcaatcggaaaaacattggcaatttttgacgatcaaatgcaaatcaattttgtgacatgtaagtgtgtgactacttcattaattataaccttctaatcggttttagctgtctccgtctcaaaattctccatgaactacggctctttctgggtcggtctcacgaagaataccgctgataacacgttccactgggctgatggaaatgtgaattcacttaaaaattggactcccggctacccattccaacatcaaacggttgtctcccagcaagtgtcaaatggaaaatggaagacatcagaaacagatacacttcttccgtctgtttgcagtggatatttacagtga

SEQ ID NO: 29895 - DNA, 776 bp, Caenorhabditis elegans
tggtggtcaaaagcgcaaaatctccgttggcatcgctttgatgtctcgtgccacgtgtatcattcttgacgaaccgactgctggaatcgatccacgtgctcgtcgtgaaatttgggatattattcatgagatgagagaacaagcgaaatgctcaattgtgctcacgtctcactcgatggaagaatgtgaagccttgtgcactcgaatcggaattcttagaaatggagagatgatcgcgttgggaaccagtcagtcattgaagtcacagtacgggaacacttatatgatgacacttattctgaacaagttggaggataggaagtctgtctgtcaaattgtcaaagcagatatgccgtatgcaacgctgaaaactcccgaatccagtttgactactagcattgtttgggaggtttgttatttgtcacaaatttgcacgggcgggaatacggcatattgaaaatatggaaaatatggcaagaatgtggtcaaacggtcgaatatgaccgaaataagttgggctcggtggaaatggggcgattacggaaaaataaggcgaggatagggtaggtagctgttgtatacacaattgagaataacacggaatttccaagtcacataaaaatttgcaatcaaaccggatttttttttagattcccaagaaaaagtcggataaatggtcggtaaagtatgatcaagtggaggcgctcgccagaaaagttagagcaagagattacacgttgacgctacaacggaagcagaaaaattctgaaatttag

SEQ ID NO: 29896 - DNA, 435 bp, Caenorhabditis elegans
atgacactttttgagccgtcaacatcgggcaatcgaatggggtatagaggtaagagagtttcaataaaacgtcactttccccgggtgcagattaatttttgaatatccttttcataaatactaaagtgtaaaaaaatgtatccgaatgtttgaattcaaaaaaaatgacgtagggtggcgggcagaactggatgaactggacgttgatctcttgtttttgcgttgttcaatctcactcactcacccactgtatattacaggctcgtccaactcgtcatctggtgttggatcgggaggatctggaagtctgatgacgcaatcgatcggtggacccaataaacatttgtcagcgtcacactcaacactaaatactgcatcaactcacgatatgatgcattcgaagattccaaagagcccgagcaatgagagtttaag

SEQ ID NO: 29897 - DNA, 339 bp, Caenorhabditis elegans
atgaccgatgacaaaaaaatgttcgatattaacgagtttctcaaaagacatttattcgtgaagaactgggtaaactataggcaggtgagtatttcaatgtgtttcttcagctaattgtaatcattttcagcaatcctacacaaaatacgaattaatgcaacttattgaatccgttgaagccgctctttccgtagatgacacattggcaaaaatctctcctccagttacaattgtgggtgatattcacgggcaatatccggatcttgtacgagttctttgcaatcaaaattcgaaggaggatgctaagaagaaagctgcatatggattctgtaacagcag

SEQ ID NO: 29898 - DNA, 932 bp, Caenorhabditis elegans
atggcgttgtgggtggacaaatatcgaccaaaggacttgttgggaaaggatggcgttgattatcacatcgagcaggccaatcatttgaagtttctctccgcagactgtatgccgcatctcttgttctgtggtcccagtggagctggaaaaaagacacggatcaagtgtctgttgaggtttaattattggtaaattcagtaaataaaataatatttttcagagagctttacggtgttggagtcgagaaaacgcagctcatcatgaagtcgttcactagtccgtcgaataaaaaacttgaaatacagactgtctcgagcaattatcacatcgaaatgacgccgtctgatgttggaatctatgatcgagttgttgtgcaggatctcgttaaagaaatggcacaaacgtctcaaatcgaatcaacttctcaaagatcgttcaaagttgtcgttctttgtgaagcggactcactgactcgtgatgctcaacacggacttcgtcgaactatggagaagtacgcgaataactgtaaaatcgttttgagctgtgaatccctgtcccgtatcattgagccacttcaatctcgttgcatcatcatcaatgtgccagctccaaccgatgaagatgtgaccaaagtcttgcggaaagtgattgaacgggagagctttctacttccggagaacgttttgcaaaagattgtggagaagtctgaaggaaatctgagaagagctattctgatgactgaggctttaagaatggagaacgagagtggtgtggctgaaagtgtagtaattccggttccggaatgggagatttatatccaagagactgctcgtctgatcctccagaaacagagctccgatatgcttctgaaagttcgcgaacgattgtacgaattgctctccagatgtattccaccaactgtcatttttaag

SEQ ID NO: 29899 - DNA, 364 bp, Caenorhabditis elegans
atgtccactcgatggagatattacaattcaaaacgcgggaatggattccgcggtcgaggcagaggccgaggtcgcggtacaagcttgaccgccgtcgccttaccccgtgatgataattttcacaagggagctcaggatggcgcttatttcaaaggttaactctagattattcctattttctttaaataatttattaaaattgcagacatgccgatggatccggagcaatttcgggatgaaacggtgctcagtctttcttttgctcaaggaatgctcggagctgcctactacgagcaatcaagccagttgttgaagatcatgaacgatatttcagaagatcttgaatttagattcttgaagagat

SEQ ID NO: 29900 - DNA, 1609 bp, Caenorhabditis elegans
atgatgttaggaggtggtggaggatgtggtgcaggaggaacatggctcggttttcttgtgtttttggcaggttagttgttttgtgacgaacatagttttgatagactgatcagatattgaattgggtgttcaaattataagcattgctccttaattatggcatctcggttttttgattttattttaaaaaaaacacacggccttttcgaagtgagatagttttggcacaatgtctagggctcactatttatttcttgggtggcatagacactctcgtcgaccacccaattcaattagtcaagaccacccaaattgatgaggtgtgttgctcctgaaatccctgtttccataatggacgtacatttccacttcgcttggcataggagccttctattgtttggcggggaaggattttctgagagcatgggatgaataatacttttgataactattaccaacaaaacagcaatactttattttgcgcgtcaaatctggtgtattgggtacgtaccattacatttacattacatttggcgcgcaaaactgaaaaaaaaaccgcagaaataagtgaggtcagtgcattcatactattttcagtacgtacctgagacaccatattttacgcgcaaagtgaaaaaatttgcagaaataatatttctgggtttacaagggtgtttaaaatcgattttataattactaaagtttccacattgttttttgagaatttttgcattttgcagaattgcaaattataataataataaattttgtaagctgtaaactttttcacgacataaatcggtccatcatgtccccttttccccttttcagttctttttcaattcccttgatacataatcggcggggcagttcgtatgacaatttgtgacaagaacactgctttcttcttcccattttctcttccgctcaaaaatgaatgtgtgtgtgtgtgcgtaacctgaaaaagaatgacaaacacactaaaagttaacgaggagtctctctggtccattttgcaccacaaacgcggatttattttgatggctggtgggggattaggtagacggcgagtggacgaggcggtgtgtgcatgatgggccacaaaaagtagtatgtcagaaaaatggaaaaggaaaaagtggaaagaacatgccgaaaacgagtcatgaaatttttggaggaaagggaacacacggggatgctctttttggagtcttcaccctgtgggcacaaaaataggcacaaaaatacctaccgccttgcgccacacacgggcctgcaaaaatatacatataagcaaaaggatgatactgtaagatttcaaaatctttcccttatacccaaaacacacgttaatattcgaacaatttcagtatccctccggaaccattccacgtgtgaagacatcgatgccgaggatcgcctgatggtcgacctattccgtggatacaactctctcgttcaaccagtcagaaatcgatcggaacttccgatgattgtcaaaatcggaatgcaacttgttttactgatcaacgtcgatgaaaaagagcaagtaatgcacacaaatgtgtggttgactatgaaatgggacgattttcaattgaaatgg

SEQ ID NO: 29901 - DNA, 1445 bp, Caenorhabditis elegans
atgacaatcgctacaaaagtgaacacaaataaaaaggaccttgatacaatcaaggtaccggagcttccatcagtggcagctgtcaaagcagcaatccctgagcactgctttgtcaaggatccattgacttcaatttcatatcttatcaaggattacgtacttctcgctggtctctattttgcagttccatacattgagcattatctcggatggatcgggcttcttggatggtattgggcaatgggaattgttggatccgcattgttctgtgtgggtcatgactgtggacatggatcattctccgattatgaatggctcaatgatctttgtggacatttggctcatgctccaattcttgctccattctggccatggcaaaagtctcatagacaacatcatcaatacacatcccacgtggaaaaggataagggacatccatgggttactgaggaagactacaataatagaactgctattgagaagtatttcgctgtgattccaatttccggatggcttcgatggaatccaatctacaccatcgtcggtcttccagatggatctcatttctggccatggtcccggctcttcgagactactgaggatcgtgtcaagtgtgcagtttctggagttgcatgcgctatctgtgcttacgtgagtttgtgtgttgtagcctgtagtctagcagtctaaatggtgtgatgtctaaacggaatgggaacatatgttgattataattttgaaaaactaaaaaacatcagttgggctaatttggcaaatttgccgtgattgacaaactcggaaaaatgtgatattttttaaatgtttttcggagcaccaaaactatttttatcaatatttttgggcaaaattgtattgtcaaatttttggtgtgtccggcaattttcaataaatgccgtgctcggcaaattcggcgaatttggtaaaattgccgagctcggcaaattcagcaagttcggcgaatttgccgcacaaaaattaagttttaatacatcactgtagttcaacatgtagtccataaaaaactacaaaaatttttatattcttcagaaattttagtcaaaattttgaggttctgacttgaaaaaaaatattcaaaaaaatatttgaaaagttttattatgtgaattagttattctaggtttataggaacatttttaattttttaatcactctacttttgaattatataaagagctcccaaaaactacagtagtctttcaaattcgcaaagctgtcaaactcctgatatttctaccgcaatgaaattcttatcaattaatataatttgatattttcagattgcctttgtcctctgcgactattctgtctacacatttgtcaagtactactacattccacttctcttccaaggacttattctcgtcattatcacatatcttcaacatcagaatgaggatattgag

SEQ ID NO: 29902 - DNA, 1182 bp, Caenorhabditis elegans
atggatgattctcttggagtatcagaagttgtaatgattccattcatgaaacgagaagttctccagcaaatatgtgcgattttagatacggataacacttgggagacgattggttcggacttttttataacaaatcattgaaatttcgcggtttttgctccaaaaatagggtctcgaaacgacaaatttttgttatatgcgaaacggtgtgcgcctttaattcttaaagcactttaaagaatagttatttcaaacattcgaatctgcggatttttcatcgaatttttttatagttttcctttaaaggtggtgtagtcgaatttttgttattgctttattagactcaaaattgtctgaaaacaccgaatttcttaataaaacttctaaaaaaagttatgacagcttaaaaaatggcctaaaataagttaaaatttgaaatttgaccgacttgtaaagcggctggaaacgaacttttttgaaatcaccgtctaattgtaggtataccagttaattatcttgcgttttcaacttgatttaagtattttaaagtctatggacgacgagatttttaacaatttttttaaaccaaatctcgccgtccatcgactttaaaatacctaattgtaaagtagtagtcgaaaacgcaagttaattgacatgtatactcaaaatttgacggtgatttcaaaaaaattgtttccagccgctttacaagtcggtcaaatttcaaattttaacaaattttaggtcattttttgagctgtcataactattttttgagaagttttcaaaaagtttcattatgaaattcggtgttttcagatagttttgagtctaataaagcaataacaaaaattcgactacaccacttttaaaggcgcacacattttcgcatttaacaaaacaattgtcgcgtcgagacctagacagagaaatcacaaaatttcacgtctggggaatataaatagcaaagtgttcaaatatccataatttcagcaccttacatgcccggaattgagttgagagatgttgaaggttgcaagagatattcaagttataaccaaagtccatcggagttacttttaagaatatggagctcgaaaggatactcgacaactcatctttatcaactttttgcgaaaacaaaattgattcgattgatgagaatgatgaggtcacaag

SEQ ID NO: 29903 - DNA, 599 bp, Caenorhabditis elegans
catctccaatcatataacattgtgcaccgtgacctcaagtgcgagaacatctttcttgacaagtacgagaacgtcaaactcggagattttggcttctcgcgtatcctgaaacctggagagaagtctggaacattctgcggatctcgtgcgtatgttgctccggagattctgcgcggaagagaatattcgggaaatgcggttgatgtctggagtaccggagtgattttgtacattatgttggttggaaccatgccgtttgatgatcgcgatccgacgagaatgattgagagacaactggctcataaaattaagtaagtaaaatgtactagaaaccgtttttttttaaatttgaatttcgttcaagattcggaaaaacctgtacagcctccattcattccaaggctctgattttggagattcttcagcctcatgctccaaatcgaccaacttacaaggcaatttgtgaatcggaatggctgaagaatcagccgtactacatgaaaccgaatgagccaccgaagcttccgagtccttccacagccaccaccacaccaacaggaccacagaagccaaaggatagcaagagacatcatggataa

SEQ ID NO: 29904 - DNA, 209 bp, Caenorhabditis elegans
atggccgcagagcttgttcagcttaatcccggacaacaggtgagtgagacagagttcgttgcgagacccgctgaattcgaagctttcaggttgagagatggagtatcgagaagaagttgggagaaggaggattcggtgctgtctaccgtgtattcgatgcaaccggaaaatatgcgatgaaagtggaaggagccaatgagcaaattcag

SEQ ID NO: 29905 - DNA, 2115 bp, Caenorhabditis elegans
atgtttagtattaatagtagtggtgagttaatttttttcaaattttttttttgaaacaatagtttttttaaagaaatgttttttgaaaaaaacatcccagatgcaaaatgtttccatttatacccagaaatacggtatcaactgacgattaatttctgttaagtgcaaagaagtctgcgcctttaaggagtactgtaatttcctatactcgttgctgagggttttcaatggtcatttttattttatcaaaactgttcattcatagaaaaaatgaagagcaaaggggtgaacacaattcaatgagacaaacccgatgaactatgcgcagacttgttcaaagcttaccacaggagtttgaaacggtgaaattttttaaagatttttttttcaaaaattgcagacattcacaatactccttaaagatacgaagtgattttgcatttcaccaaatattgtcgtgtcgagaccgtattttgggaacaattgcaaacttaacattcaatttaatttaaattattcacctatctaacatctgaactatggagaacataattattttatattatcgcattattgaaacagaaaaaacgtattaaattcaaatttaatttccaaaacttctaggcttcaacattcaaaacgcacccttcctttcaaaaagcctccaccacatttccatttgccctcatatcgttttttggacgaagataatcgtccgatacgatgttcaatgaaacattttaataacacaattactaacaaatttggaactccgtgcatgatgtgtgatttgccgaaaaaagatgtcgagttcaaggaaatcgatgcaatttacgagaatatgaagatcaagaactcacaacgacagaggtctcagaatagtttgggtagggatttgtgggaggcaaatgtgctccaatgataaattttgcaaaagctgaaaatgaaatgttaaacaattttgagtgctgaaaatagctttgagaaagaaaatttaactttcaaaaacttttttcaaatgttactctaaaccaatcagcatttccaagctccgcccatgtttcctgattggttaaaagagggcggggcattttgctgattggtctatctgtgtatgtatttgagcacattcaagcagagatagagaaaattgaaattttgggtttttctactttttcgattttttttttggtatttcgggaattcaaaatttggatacttagttgccagttgttcccaaggataataactacatttggaagctaggattaataaagaaatttcaaaaaattattttaatctgaaatactgtttcactgaatacatataattaactcaaaataaataatcctgatgaggtttttctttgttgttcctcaaattattttcaaaatgttcctccaaaatcagaaaccactctcacttttaaaccaatcagcgtcttcgagctccgcccactccatatgattggttcaaagtgggagggcacttcgctgattggtcatagctctgtagttttggagcaaattcaaacagagatattaccgctaaaattagaactttgcgttgttttcgattttttttggtttttttttgaaattcaaaattcagaaactgttgccagttgttccttaggattctgactacatttggaagcaaaaaaattaaaaaaaacacaattacctactgtttcactgaatctataaatatagctcaaaatttaatatttattattcagtcccatcttttattagtcaactaactttactaacctttttcattacacaaaatgtgtgtttcagacttaatccgtatcacgaataaccttgatgaaacaacaaaaagcctaaatctgtaccttcaacaaatcgatgcaacatggaaacggtcaaagtctcaaccaattatgaaaggcatgcatttgcagtgactaacaattttcttttgtatttttagtttttaaaacaattaatttaaaataattgcaggaccaaatgatcaatataataatcaagaacgagtaaaacagtcgaatgaagaagagctgttacgattaaaagcagagaaattagcagaagagttgagaaaagaaaaagaacggaaacatagttttat

SEQ ID NO: 29906 - DNA, 1438 bp, Caenorhabditis elegans
gccacctcaaaaatgtacgagtcatgtctgacacgtatcgccgatgaagtacatcgtcgtggtaagaccaatgtgtccgtaatggtggcaagtcacaatgaggatacagtaagattcgcattgaatttgatgaaggaaaagtgtatttcaccatcggaacgtgttatgtgcatggcacagttgtacggaatgtgtgatcaggtttgtgtgtatgggaaaaaagaggaactatttatggaaacatttggaaaatttataagaaatatgtgaaacagaaatttttaattttgaaagttcacaaaatgcatgacatcgtaaattaatggcctaggtagttttttgttttgtttttaacttaaaaacaatttttttctgtttcaaaggtttgatattatcaaatccatatcaaattcaaatatttcttccacgaactaagtataatgaaccaaataaactaaataaaattcatagaaattttccaaaaaatacaaattctattgatttcttaaaattttgcaaaagaaacatttcaatggctttttaaattttttcaattcctgcgcaacctaattttggcacttttccgttttccggctaaatatattggatttcttcatttatgtttgattttcgatttgaaaacttgtcaaacttgaaaaacttttttctgcaaaaaagctaatatatcaattttaagcccatatcagcttctttttcgtctgaaaaaaaaaacaattttcaacttgaatatacagaagaaatatagaaacctataaatttagacagaaaacgtatgctaggtcactcctttgcgcgcgagccaattcaaaaagtattcaacagttttgaaacttattttacaaattaaaaaaaaaacatattttcaagttttgaaaagttctaaacattttttgtaattacagtacattttctaccatgttgccaagttgttcaaataaatttttactgtttcgagggttctatattattgtatgtggaaatcaagtgtgcttattgcgctcttaaaaaaagcttagttttaatatgaaaccctttttgtaaggcagaaaataaaattattcaagaaacttgggaaagttccatatattttgtaaaacatttttatgcgatttttatgcattttcaacttaaaaaaaactgtttcaaggttctgatattttcctgtctgaaattttaattttcaaattatttcaaataatatcaggtatcattctccctgggtcaagccggtttctcagtctacaaatatcttccatatggaccagttgaagaagttctaccatatctaagtcgacgtgcacttgaaaatggaagtgtattgaaaaaagcgaataaggaacgtgatctcttgtggaaagagcttaaacgacgaatctcaagtggtgaatttaaagccagaagtagcagttcttcttaa

SEQ ID NO: 29907 - DNA, 231 bp, Caenorhabditis elegans
ccgattcctgattctaacattctatcttcctgtcaaaaatatgacgtctgagtttatggcctacgcgattttcttcgttgttccaatggtttgtacctctatttttctttaaaatatttataagatttacagattgtcgcagtattggtgatatttttcttattaccggaaacaaagggaagaaatgtggaagaaattcgagaggaatatgaaagaaaatcattgttgtga

SEQ ID NO: 29908 - DNA, 416 bp, Caenorhabditis elegans
agacgttttcgactggaatatggcaatgtgtgttctacgaaatggccaagtcggtctcgacttttctgaagcaatgagaaatttgaatcttattgaaccgaatcgattaaatgttccaccgattgaggagaaggagaaagaaaaagagaaaacgaatgaaaactcgccggaaacggttcatttaatcgaaaaagacgagacagcgagaactgacaagtcaggagacgatggttcttgtaagtttttgagcagttgcgtgctctaaacgtttcagaacacgcatagaaaaccaaaaaaaaaatcaataaaatttcaattcagcagctcgtctatcatatcggggtagttgccgaagtgttgaaatgttccagcggattaatgctttttatattaatggttcggacaaattgtcgtaa

SEQ ID NO: 29909 - DNA, 556 bp, Caenorhabditis elegans
gtcagtaaaactgacgaggacgagaaaaccagcgacgacaatttacgaaaattaaaaagtggcagtgagccgcctcctccgactcaaaatcatgaagcagtgacgcttgtgacgagaaaaatgagtgccactggaagatttatggtaggttctaagcaaaatttggtggattttgaggcaaatttttttttattttccgtattttcaggtaacctctgacacaaatccgggtcaactcgtcgctgaagtcgctgatgaacttggtattgatgttccgatagatccgccggcggaaaaatcgccggcttcacgtgctaaaggagtacatttctctgttggagacaaggattccggtagcatgtcggaggatggcgacgagaaacgaaatataacacacgagaatcagacaacgttcaatatgaaaagttggagaaatatgaagacgatagagcatccgccgattatcgatttttatcggaattcgattgatacagatggggtgttcaacaggccttcgatggctcaacttattcatggaaaagagcacaaagagcaa

SEQ ID NO: 29910 - DNA, 599 bp, Caenorhabditis elegans
cacgctccaaaactcggtctcctgaaatgcaaatctgcacaaagtgtaactcgtctgacaattcacggagtcgacttcaactcagcctcaacgggaactcacaatgtctacgcaattctcaaagattccagaaaatcgttcagaacgaaaactttgagtggagtgaagtcgattcaatgggatgagcaatttttatttcataagtgagttttcatcggaaacatactaatgaaaaagcaaagtagacatttggtttcatggatctcgtgaaacggaaaaaaaaacttttttttttttcattttttttccaataaccttgcttaatattttacgcatcgaatgaatagagacatcctgtttcaagaaatgtttgtttccaattataatattacagatcaaaaaatcgtcagcaatacaaaatcgaagtgtgggaagatcgtaaaatggctcgagaccaccttcttgctcaatccgttatcattgctctaatcgataacgagaatcgtgatacgacccttcagttgacagatccacgtggtactgtcattggtaccgtatcggttactgtatctgcatttgatgatcctatgtacctttaa

SEQ ID NO: 29911 - DNA, 369 bp, Caenorhabditis elegans
atgtcgctgtccagaacgactcagcttccattcgccaagcggcagtttttccaagtgttggccagaaattacagcaacactcaaggtaggagaaagctttgaaaatcgagaaaaattgaataaaaagtttttaaaaaccatttaaacccgaatttttttttccagatgccgatctcgtcgttatcggaggaggaccaggaggctacgttgccgctattaaggccgctcaactcggaatgaagacagtttgtgttgaaaagaacgccacattgggaggaacctgcttgaatgttggatgtattccatcaaaagctcttctcaacaattcccactatttgcacatggctcagcacgattttgcagcaagag

SEQ ID NO: 29912 - DNA, 3613 bp, Caenorhabditis elegans
tgaaccttatcgaaccagccttgtatggtcaaatgatgacaaatgcgattcaaatgaaatcttttgatattatcaaacgagcctgcctactgctggcactcatccaattctcagaagctacatgcaaatcggcttgttactttttcatgcaatacgctgaaaagttaactgcaaggaatattcgtatccaacttttccgttcaattctccatcaggaaatctcattttttgatgagaataaaacaggacaattggtgtcaagaatcacacatgactcggaatccatttcaaatactcttccagttcacattgaaacacttgtcaacaatctattcatgttttttggatccattccaatcatgttttgttattcatggcagttgacattaacttcattcattgaatttccaattactctgttaatgacaagatattatggattggcagtggagaagctatcagaaaaggaaaatgatgcaactgcagcttcaaatgaaactgttgaagaagtactttcagctatccgaacagttagatcattcgctgctgagaatttcgaacaaaaacgatacactaagaatacggaagactggttcaagattagcacaaagactgtgacacttggaactatctacaactatttttgggctcttatgttacgttcgcaagatgttattcgatatttatatggaggatatttggcattaaatgggagaatggctccggaggcattgctaacttttatcttttatcactggagacttcatactgcgatcaatgtaagtttatttgaaacttgaatgaaaaaaacctttaaaaatgcattcacatactctaaactactgttaatgaaacaaaataataatcaatcagaacaagaaagtctgagcaaaaaccattgaattttacgtaaatttattactttcgtgaaacagtaatttatttataattatattctctcattaagataaaatattaaaacgttcttgaaatttgaacaacaattttttactgtttctcgtagttttcaaattcaatgagaaattgcaaaaataattccatgagaggaaattagaaaaaaaaacctaaaaaccactgaattgtattttttaaaataacaactcaaacttttgaaccttgaacaattattacctatttcaaaaaagttcacaatttgttcatcaaaattttggctttattgaagttgtttaacagttttgtaaaacatactttttttgaataaaaattaattttaaagggagctccttgaaaaattcaaaaaatttggaaacaaaatgttcactgtttcttccagtattcaatgagatttttaaaaatttaattcattttaatggtgaaaaatcaggcacaagtaatacatgaatatttacgatcacaaattatttttttaactgacaattttgaaatattaaaaaaaaatgtgtgaaattacaaaactgatttttttgcccaattggttgttaatgttttgacaaatttattttaattgttttattcaattatcaaagttagtgtgaaaatgaaaaatagatgaattatgcagctcaaaatataaatttgcgatgaattttctcaagatttttactgcttctttcaatatatcaagaagcttttgaatttgaaaatattaaaatatcggaactatgctataaaaactctcagttttagagccccattcgaaacagtcacacccttaatttcaagattttttaaaaagtttttgatactggcaaagaaaaggtgaaaaattgttttaaaatcacatttaattaacagatttgaaccaattcgtttacttttaaaagttgcaatgcaaataaaattttaactgtttcagtaattttacaaattcagtgagcaatcaaaaaaattacttttgctttgcgattttaaatctctaaaactataaaattaaaaaggtgtttgattctagtgataaagtaatttcctcaaagatgatatagaaatcggaaattttttgttagctttcgagtatcgtctaagtagcagtggtagcagttatttgtttcaagctttttatgtatctctatcgagcagaaaccattgaattttacgtaaatttattaacttcgtgaaacacaaatttttataattatgttttctcgaaaatatttaaacgttcttgaaaattgaaaacaaaaattttgactgtttctcttagtttttaaattaactgagaaatttagcttcttaattatttcatccataaatcagaaatctttcgaaattgaaaatagtggaactacgttgcaaaaactctcagttttagagccccatttgaaacaggcttaatatcaagatttaaaaaaaaagtttttgaaactggtaaggaaaaggcttttatgttgtttaaaatcatattaaattagcaaatttaaatgtatccaattcttttttttcaaagttgcaaggcaaataaagttttaactgtttcagtagttttacaaattcaataaaaatgcaaaaaattactctcgatccaattccaattttttttcggatttaaaactaaaactataacattaaaaagtagttttattctagtgaaaaagttattttctcaaagatgatatagatagagatcggaaattttttgatagcttttgagtatcaacagtggtagcagtaacaatgtttcaaactttcaatgtttcaggcgttcagttccctattctctggcgtcatgaaaaccattggtctatcccgaaaagtgatacatctgatcaatagaaaaccacaacttgactatgattttgggactgaaactccagaaattcaaggaaaaattgagtttgaagtagttgaatttgcatatccgactcggaaaacagtaaatgtaataaatggaatcaacttatcaattgaatcaggaaaaactgttgccttggttggaccgagtggaaatgggaaatctactttggtttctttaattcaacaattttatactccacaatctggaagaatattgactgatggaattccaattcagaatattaatcatcaacattatcactcaaatattgcccttgttgctcaagaaccaacattattctcaggaactatcagagaaaatattctttttggaattgaaaatggaacagaagaagctatgttgaaagccgctgaaatggcaaatgttcatgaatttgtgtcaaaaatggatgatggatatgatacaaagtgtggagagaagggtgttcaaatgtctggaggtcagaagcaacgaattgcaatcgcaagagctcttatcagaaatccacgtgttttaatccttgatgaagccacgtcagcattagattcagaatctgaaggaatggttcaagaagcattgaataaatgtgcaaaagaacgtactgttatagtgattgcacatcgcctttcaactgtacgaaaagcccagaaaattgctgtaattgaaaatggaagtgtgaaggagatgggatgtcatgatgaattgatggagaatcaggatgggctttactacaaattagttagcaagcaacttggttcaattgttgatacaaatatttttaactgcttcgatatgctaatattttttgtccttttttag

SEQ ID NO: 29913 - DNA, 1497 bp, Caenorhabditis elegans
atgaatttttatgactttaaatttgtattttatttggctatatcttggtgtaacttgttggaagttgatgggattacggtagcagagcagttgaaggatgtccttatggaaggtaagatatattttgcttacatttttggaaaaatttaatcctttaatactgtcgtacggcaaattgttaaaataatttagcgtcctccaattaaacggagtgtgaaacagaaattttttaaaaatctcaatgttttatcattttggtttcttttttattttgaactttcaaaagcatatgaatcatagaatttaatgttttagaatgttttagaatgtttttaacgttctgaatctagcatttcccttaaaattaatgtttgaaattactatttttcactttcttatttaatagatgttgaacatagcggcacaacactttctctaaattcatattaataaaaacactatgtgaaacatgatatcgttcttattattttttgtctgtcgaattgacagtgaaacttttaacttaaacttttgaaaattcatgaatttttatttttataagtttttaagaattgaaaaaaacttttctttcgtcttttttagctcttatagttaggaaaacattgctcagcaaaaagaggagttggtcctaaacatttttgatgaacttgaaacagcaaatttaattgtttagatattagaagaaaaatgtttcaccttttccataaaggttcgaaacaaaatcttaagaatcactacgagttgtgcactttggaaaatttttagtgctttgaaacaaggagctaagtcccacacgatttagcaatagaaattaaaatttttctcgccaaaagactcaacacagtaagctaacaaagttatcaaaaaaaaatataaatctgctgaaacggtaaattatttccggtagtccgaaaattatgttattgttattcattttggtttttaatgatcgtaatcaataagaaatcatatatcaacaacataggaattaaaattccaggttatgacagctcaatccgcccagttaacaatgagagagacattcttattatcaatatttcaatgaataccatgtctgttctaacactagatcctgctgaagaaaccatcaatttctcatcagaatttatacttcaatggaaagatgaattccttttttggaacaaatcagactataacatcacttggctgaaactcaaagaatcatttttatggactccagacactactgtatctacaagtattgatactaattatctgatagatgcttcggaaagatatgtatctgtgaaacacgatggaacagttcgacagagtatttatgctgtttttacgaatctctgtgatatgaacgttgataaattcccatatgatcaacagacatgtatgattaaaatgggtccatggagttatacgacgcaggaggttacttgtattgttggaagggatattgcgccaaatgacactgatttcgga

SEQ ID NO: 29914 - DNA, 559 bp, Caenorhabditis elegans
atgttggctatggtgaataaggttctcgactggattcgcagtcttttttggaaagaggagatggagttgacacttgttgggctccaaaactctggaaaaacgacatttgtcaatgttattgctgttagtttttctggaaaataaatttaaattcaatgttcttcactttagagcggccaattcacagaagatatgatcccaacagtcggattcaatatgcggaagatcaccaaaggcaacgtgacgatcaaattatgggatatcgggggccagccacggttccgctcgatgtgggaacgatattgccgcggtgtcaacgccatcgtcttcatggtggacgctgccgacgaggagaagctcgaagcatccagaaatgagcttatgcagctgttggacaagccacagctcgacgctattccagttttggtgctcggaaacaagaaggatttgcctggagcacttgatgagcggcaattgatcgaaagaatgaatctgtcatcaatccagaatcgcgagatttgctgctattctatttcatgcaaagagaaggagaatattg

SEQ ID NO: 29915 - DNA, 702 bp, Caenorhabditis elegans
aacaatggccgtgctcgagggattgaagctgacaatcgaaaacttttccgaactcaatctcccatcatccgtcgacgttccagacttcccatctgatccgactgatccacgaaagcactcggtatccgtcgatcgggagattttcattgaaaagtccgactataagccggatgattcggacaaatccttcagaaggctgacgccgaaacaagccgtcggcctgaaacacattggattggtgctccgattcgtgaaagaagtcaaagatgccgagggtcacgtcacagaagttgtggtgaaggctgagaagttgtcggagaaggataagccgaaagcatttattcattgggttgcaaagcctgtctcgtgtgaagttcggctctatgatagactattcaagagtaagaatccagaggatgctcaactagttccaggtggattcctgtcggatatcaatccagattcattgacagttgtctacaatgctctaattgatcagtctattgcaaaatcaaaggtttatgataggtaagagccggaaattatttttaaaaaaataaaaataaaatcataattcaaatctccagattccaattcgaacgcatcggattcttctgtgtcgatcgtgattcgacgtcttcaacgttggtcttcaaccgaactgtcatgctgaaagacggaggagcttctggaaagaattga

SEQ ID NO: 29916 - DNA, 299 bp, Caenorhabditis elegans
atgcaagcaatcaaatgtgtcgtcgttggtgacggagccgtcggtaagacgtgtctcctgctatcgtacactacaaacgcttttcccggagaatatattctaacggtgagccactttttgtcggggcacttgagaaaaattcgggttggcacttgaaaatttttttttcaaaaaatcttattttttagcgcaaaaatttgaaaaaaaatttgaaaaaaaatctatctatacttttttatttaaaaaaccatgaaaagttgaattcgtttttcaaaaaaaggcaacttctgtccgtaaac

SEQ ID NO: 29917 - DNA, 1064 bp, Caenorhabditis elegans
atgagagttaaaaccttttactataatccagcaagttttgagaatgttcgtgcaaaatggtatccagaagtatcacatcattgcccaaatacaccgattattttggttggaacgaaagctgatttgcgcgaggatcgagatactgttgaacggtaatttttggaaaatttgaaaaaaaaaagctcaaaatttccaaaatctgcacaaaactaggaaaaaactgagaggaagcgtaggttgcgaaaaattgagaaaaaaattattagaaaaactgaaaaaaatgcttataaaatttggaaattttgcataaacttcaaaaatcacacaagattgaggaaaccctcagaaatatgtatttacaaatttacttaaatttgagtatgcaataatttttaataatcactgtagtattcaaattcgcctgtaaaaacctgaaaatttggttaaacgtttttttgaaaatttttcacatttcccggaaaacctgaaagattaaccgagaactaaaaaaatgtaaaaaaacaaaaacttggtgaattttttcagcgtttttacattggaaaatttccacttaagctttaaagctgctgagaaatttgcttaaatttcagcatgatcgcctatttcagtacgtatttatgagctaaagctaaatttcggcaaaattgttatgatttagtagtaacactacaaattttaaagtttccaatgttccgagcaaaaaagccaaaacacacagaaatttgctgtaattccgaaatttttgcaaatttttccattgtataaccttttcgggcgcaaaaaaagacataatttctactgtccttcccaaaaactcctagaaattcgaattttgcaggctccgcgaaagccggctccaaccagtgagccacacccagggttacgtgatggcaaaggaaatcaaggcggtcaagtacctggaatgctcggcgcttacccaaattggattgaaacaagttttcgatgaggcaattcgtactgggctcaccccgccacaaacaccacaaacgagagccaaaaagagcaattgcacggtgctttaa

SEQ ID NO: 29918 - DNA, 229 bp, Caenorhabditis elegans
atggccaccaaggacgccctcatcgccgaggaaggcacaaattttgggggatcgagtagcggtgatattgccgtctttgacaaggtagaccataaaactcaaaacgttattccaataaagtattccagaccgccgaagttgtaaacttcgagctcgagccgaagccaatcggtttgaccaaggagcagctcgaaaagtacagaaatgatccgttctggaagccggttcg

SEQ ID NO: 29919 - DNA, 468 bp, Caenorhabditis elegans
agtcgctgaacaatttggagtgtgcgtttcattggatcccaagccaaaggttaccatgggagactggaacggtgccggttgtcataccaacttctcgacaattgaaatgcgaagaccaaacggtctgaacgccattttcgaagctatgaaaggcctcgaaagaactcattcggaagccatgtcggtttacgatccaaatggaggacgggacaatcttcgacgcctcaccggtcgccacgagactagtcaagctgacaagttctcctggggaatcgccaatcgtgcgtgctcaattcggattccacgtcaagtcgctgacgagacgaaggtcagtttaaatttaatcaatgttccaaaacaagattttcaaatttttagggctatctcgaagaccgtcgtccatcatccaactgcgatccttacctggtgacagcaatgattgtgaagagctgcctgctcagcgactga

SEQ ID NO: 29920 - DNA, 1044 bp, Caenorhabditis elegans
atgagtaagcataacgctgttggaatcgatttgggaactacctactcctgcgtgggagttttcatgcacggaaaggtagaaatcattgccaacgatcaaggaaaccgtacaactccatcatatgtggctttcaccgacaccgagcgtctcatcggagatgctgccaagaatcaagttgccatgaacccacataacactgttttcggtaagtgcaattaattatattttcaacaatctcaacggtcgtgtttttcagatgccaaacgtcttattggacgcaagttcgacgatccagcagttcagtctgacatgaagcattggccattcaaggtcatctctgccgaaggagctaagccaaaggtccaagttgagtacaaaggagagaacaagatcttcactccagaagagatctcctcaatggttttgctgaagatgaaggagactgccgaggctttccttggaaccaccgtcaaggatgccgttgtcactgtcccagcttacttcaacgactcgcagcgtcaagccaccaaggatgccggagccatcgctggactcaacgttctccgtatcatcaacgagccaaccgctgcagctatcgcttacggacttgacaagaagggacacggagaacgcaacgttcttatcttcgatcttggaggtggtaccttcgatgtctccattcttaccattgaggacggaatcttcgaagtcaagtctaccgctggagacactcatcttggaggagaggacttcgataaccgcatggtgaaccacttctgtgccgagttcaagcgcaagcacaagaaggatcttgcttccaacccacgtgctcttcgtcgtcttcgtaccgcctgcgagcgcgcaaagagaactctttcgtcgtcttcccaggcttcaattgagatcgattctctcttcgagggaattgacttctacaccaacatcactcgtgctcgtttcgaggagctctgcgctgatctcttcagatccaccatggacccagtcgagaagtctctccgtgacgccaagatggacaagagccaa

SEQ ID NO: 29921 - DNA, 516 bp, Caenorhabditis elegans
cttgagatttgttaatgaatttggagtttttcggactgaagttttgcataattctgatgaatcaagtgaattctcaccaccagacaaacgtgatttcaaacgaagtttggccaggtaatatcaattaacttgtgaattgttaccactttctcaacttccagacaaaaccgcacaacatacatttacgacttcccgagaatgtttgcctgggtggcatctggctcttctaaagaacctttggatacatggagttccacagttcaagtccaagaactcgtaatcgacgacgaaagcagtgaacttcggtttatctccgacctaaaagaacttgaggcgcgtgctactgaaggtgccaattcatgctcggttgttgcctggcttttgaacattcatatcgatcaaaagaacatggaattcgttttgattgggaatgacgtaactcatcaagtcgggtcgtttgctcaaccagagcacagactatttgagatggctagtaagcttgccagagagaaacag

SEQ ID NO: 29922 - DNA, 289 bp, Caenorhabditis elegans
atgacgtcgccaacgcaacggagatcaccttccgactcgtcggctgcagaagatcagcgaattgcgacaactattgtcagggactcgggaagttcgaaagagattgaggagagccaagcggatccgtgcagaggagcatggggaaatcaggtaaacttttgaaaacaattatgggaaagatctaatgaaagctttttacagattgagtttctactttccacattaggaatggctgttggccttggaaatatctggagatttccgacgagagcttataataatggaggat

SEQ ID NO: 29923 - DNA, 460 bp, Caenorhabditis elegans
atgaagcaaaacaatgagatcaacgatactttggtgccattggtaagtgagaaacacatctatgcagacacgtaggtagaataacatggttttgtgggaaataaaacttgaataatgactcagatactagcttttcttgcaataaatttagctatttgtagtaaccatggaatattatcagtgaaacaatgtttgatgatcatatttatcttgcagtttaaggcgtgaattataggcataataataggcttaagtagtttaatccaaataaagtcaccaccatcatgatagtccaatttttcagacaggaaagcgcctccgcttgggagatcatgaatacaaactgagcgcaccaattgctactggcccattttcatcagttttcctggtagaggaggacggagttccatatgcaatgaaggtcgaagctgaaaaaagttgtgttcggcctgttttgaag

SEQ ID NO: 29924 - DNA, 464 bp, Caenorhabditis elegans
gtaccaggctccaatcaatttttactctcgctttcccgacacggtattccaaggagttttgcaattcgagccaaaggaatgtgatatgtcacgtgatcttcttttccgaatgttggttattaatccggacgatcgacttaatatacaaatggttttgtcgcatccgtatttgagagagatttggggcgaaattgtggttagttagattagatgtttaacaactaaagttaggaaaatgattcttgctgaaatctaattttttttaaacagaataaataaaaacttaggaaatagtaattttccaggccgaagatgtgattcctgagcctcagcctccaaatgagcttctcagatttttcgattttcaaccttattcgagtccattggatatgagagaggagattttccagaagattaaaaactttggaaatcagtataatattatgaacgaatcgaaaaattga

SEQ ID NO: 29925 - DNA, 604 bp, Caenorhabditis elegans
atggtagtgtcaagtggaatttttctgattattcctcgaattttgggaaagctcattgatcaatttgatagtaatacgggagttcagaaagccgaggaggtgttcacaatgaagattgcaaaatatttcaaggagcagcccatgtcgcttgttggattgttagcaatcggtgcattggctacagctgcgaaagtttactgcttgcaaattgcaggcaagttgtgatatccaaaatttgtgaagtaattttggaacttaacttttaggagtgaacatagttggaagtttgcggaaaatggtgtacagttctattatcagacaggatatgacatttttcgacaaaaacatggttggcgaaatcgggtctcgccacgctgcagatactgtaatcgtcggatattcggtctcatcgtcccttcgagcaggagttcgagctgttctcgtcggtgttggctctattggaatgatgcttatgacgtcattggagttgtctacagtctcctttttgactgctccaattgtgatggggatatttaaaatgtttgggagagtacagcaacaatgcacttggcaattgcaagaggtggcggcagatgttaatcag

SEQ ID NO: 29926 - DNA, 299 bp, Caenorhabditis elegans
atgctagccggtagtcaggctcttcgccacctttctactgctgcacaaaaccaagggtaagtgtgtaaaatagatttttctatttaatagtattttccagagcttgcggtcctgcagtcaagcttcttctgattcaatatggtctggaaaatcgaaaaattgatggaacaggcccaaaaaacaaaaatattctgaaaggcgatgttatgaaaatagttgaagctgaaaagctgaagccggtggctcatcatgcacatgctccaaaagaaacacatattgaaaataaatctattgaaaag

SEQ ID NO: 29927 - DNA, 662 bp, Caenorhabditis elegans
atgtcaagatggaaggtcgttattttgtgcctattaagttttatgtttgaaatcggtatgtttatatttggttgatttacaatcagcgttttttttctgtttgaatgaaaaatgtgagaaattcatgaaagaaaatctctagtttattaaaaaaactagatcataaaaaaatttaaaaacaggtttcacttggactattctttaaaaaaaacgttctaaggctaaattgctttggattaaatttaaaaaaaaacccacactgactaaaaattgcattccctaatgagacttcataataagttttcggttttaatggctccaaaaaatcatagataaatttttgagaagtcttttaatgatattcggttttaggtgtggggaggtagttttgagtttcccaaacaatgaataaagtgagaatgatttaccgttcagtattaatattcttttaggtcatgcttcttttcaatgcaacccaaaaacctatgacggcgcgtttctcaacattgtttgtgtttgcaacgcaacgttttgcgatgaaattgagccaataggagagatagctgaagggaaggcaattgtttatagatcaagtttggacggcgatagattgaaacgcatgagtatgaaaatgaaagagaaattgagaaaaaatgaatcag

SEQ ID NO: 29928 - DNA, 431 bp, Caenorhabditis elegans
ttaatcatcacgttacgggatggactgactggaatctttgccttgatgaaactggtgggccaaattgggcctacaatgttgtagattccccaatcattgtcaaccgaactgctcaagagttttacaaacaaccaatgttctatgcattgggccactttaggtttattaaccttatgattctgaaaacatactttttttttagtaaattccttccacgtggatctactcgtgtgttcacaaagatcgagggaaacctggctgtctcagctacaagtgttgtgattgaaggtggaagacgagctacagttattttatcaaaagcgtccaactcattattgacacgtatagttgacagttcaacaggattctctattgtgctgaatttgcccccaagatccattcatacagtgatttggaagaaaagaaaataa

SEQ ID NO: 29929 - DNA, 674 bp, Caenorhabditis elegans
atggtttcacttttcgacactgtcgaggacttctggtcgctgtacaatcacattcagtctgccggaggattgaactggggatccgattattacttgttcaaggaaggaatcaagccaatgtgggaggacgtcaacaacgttcaaggtggacgttggttggttgttgtcgataagcaagtacgttttgagaaatatattttattcaatgaatcatagaagcttcagagaagaacgcaattgctcgatcactactggttggagctgttgatggctattgttggagagcaattcgacgagtacggagactacatctgcggagctgtcgtgaatgttcgtcaaaagggtgacaaggtttccttgtggactcgtgatgctactcgcgatgatgtcaatcttcgcatcggacaggttttgaagcagaaattgagcattccggatactgagattttgaggtaattttacaattttagtatttgctatctaagtaaaatatttccagatacgaagttcacaaggactcgtcggctcgcacctcatcgactgtcaagccacgcatatgtcttccagccaaggatccagcaccagtgaaggaaaagggaccagccgcaacgacttctccatcgaatcccggcacggaggctacaggaacttctccagccaccccaactccttaa

SEQ ID NO: 29930 - DNA, 2265 bp, Caenorhabditis elegans
atgagcaaaacgacgaggccgatctcgctgaatcggatagttcaacggaatgtcagatattgtgcaaaacagctagaatactttcttttcccggttctcactcgggaggtcgtgttctttttgacgttatggacagtcttggacgccctggaaatgaattttatgaatttggcgccgaaaagcttggaagttatggcttttggaattattgggtaggtcaaatattgcttctgagattggcatttttttcggcgtacctgcctgcctacgcgcctgtttttgcattatttgcaacagtgccgattatttggctttattaatttgtgtaaaatattcgattataggcgtaggcaggcagaatttttagcgcctgcctacatcttatagtttgtacatttcgacattgaatctaaattcgcattgtgcgtatttaagggctagcctgaaaagtaggtgcgtgtgtaaacaggcttgtagaaggcaggcgcgtaggcatgtttttactgataacttctacgccttttagatattgaaaaaaattctaacgttattaggaacttgctagtcccaaaaattttagtcgaatttttaaaaatgtgggcttaaaatttgctatcagctagattcaaaattttgaaaacccagaaattttccaataaaaaaattagaaatttttaaaatgttgaaaattctaaaatgtctaaatttttgagaaattaaaacatttttaaatttttaaaaaacttaaaaatttccacattttcaaatgtttcagcacatcccttcttgctcaaactcttgtgtctctgctcatcggtaccgtcactgcacttaccgtaattaccgtaatccgatgctccttaatcatgatgctctattacaatggatggctttttgaggaaattggcaagaagccaagctatgcaacgacagcgttctttgtaatcctgggttttatttcaaaaagagcaacatttttctcatatcaaggaattcttccatggcttttaccaccaaaagttgaggatacagttgccaagtatttgcagacaatgaagcctattttgggagagaaagagtttttggagctctcggagcaagctgaagagttcaagagcacaattgccggtggcctacagaataagctttggatgaaatgggcagtgtctaagaattatgtaagtttgaacgcagtcgaaaaattgcaaatttttagaataataaaattcaatttttttcaaaactttttatggaaaagctaaactctaatacggactgaattttgaacttggcgccaaattttgtatgaaactggataaatattttttgtgaaaataaaattttaaaatagcaaaattcgaatgttccccgaaattctattgaaattgtttctaagaaaaattgaaatatgcttgcaattttttccagagaaaaccttgtctgaaaatcaaacaatatttcaaaaaaaaaattaaaacttttctgaaaaaaaagtttccaagttttctgaaattccaacaaaaataattgatgtttaaaaaatataatttcccaaatttccagctctccgactggtggaaagaagttgtctacatgcgttaccgtgactccctcatccgaaccaatgtcggatgtgctgacgtcatctaccaaaagaccacctccaaccaggccgcccgtgccgcctacgtcaccctcaaccgccaacacttttgcaatgatatcttcaagtcggagaagatgaagccagtaagcctaggaggaattccattgtgtgctcagcagtatgccgagtactatagaacattaagaattccacatgagacgagcgacaaaatgattcgacttccggatgctaagcatatcgccgtgtaccataaaggttgctggtacaagattgatattttccatggaaaacgtatggtgaagccgtcggagttggagaagagtttccaagaaatcttagactcaaacgatcacatttctcaacaaggtgagaaatatctgtcagcacttacaattggaccaagagatctttgggctagaattcgcactgaaaagttctcaaaaggaggtgtaaatcaggaatcattgagttttatcgaaaactcactggaaatagttttcctcgacgaagaagaacgattctttgatgaagacgactcgacaaagtatggaagagaatatgccagagccctacatggagatggatatatgttatggtgtgataaaccgagtgtctacatttttagcaagaatggaaga

SEQ ID NO: 29931 - DNA, 797 bp, Caenorhabditis elegans
atcaataacgcaggagccctgatcgtcgatccggagggaaaaaccaatacgtctaccggagtcgagacgtgcttgaagaccttccagctgaatttccagtccgtcgttgagatgactcaaaagatccgaccacatttggcaaatacacatggggagattgtcaatgtgtctagtgttggtgccggaccagctgccgtaagtctcatggggatacggtatctaggttacaatttctagggcagctaggggatgctgaaggagagtacggtagcttttacagttacgtgttacggcagttacagagataggcaaattggcacttaagtacctaaactcctagacggctaggcacctaggcacctaggcacgtaggcattcaggcaggatcaatgtagttggaattattccggcaatattttcaggaaaaccgattcccatactactcagctgccaaagcagctctggatcaatattcacgtaatacagcgatcgatctgattcctgatgggatccgtgttaacatcgttcaacccggcttcgtagccaccggtttcaccactgcggcaagtggaatgagcccagatgcttctgctaaaatgtacgaaggaatcggagccaacacgagctgcattccggctggttactgtggacgtccggagcatctggcgtccgttatcgcgttccttgccgatcggaaagcgtcggagtatattgtgggacagactattattgcggacggtggaactacgttggttagaggacgcaatgttgctcttgcgacacgcagagcagaataa

SEQ ID NO: 29932 - DNA, 693 bp, Caenorhabditis elegans
gcctctccatggactaattttgaacgccggcgttcttggacgaaaagaaaaaacgactgctgatagatttgaagctcattttggaataaatcatcttgctcattttttggtacatttttttcatttaattaggtatttaactgaataatttttcagctgataaaggagcttcttccagttcttcgatcgtcagctccatcaagaattgtcatcctttcttcgacgcttagcaagttcacttcgatcaatcctgattccaaaattgaggagaagcttggcactctttgcccaaaaaacgcaactgagtggtattaccgattgtatgcaaaatcaaaaatgtgcaacatgctaattgcgtttaaattgcatcgagatgaatttgaaaacggaataagtgtatattcggttcatccgggatccgcagttcgcacgaatcttcatagagatgttccgttttggagtatttttaattttttgtcaattccttttacaaagaatgcgagccagggagcagcaacaagtctttattgtgcagtacatccagaagttcaagaactgtctggaaggtattgggaatcttgttgggatgatgagctgaacttggacgagaaagtggcaagagatgaagaattacaagaagcgttgtgggaatattctgaagaacttgttggaaaatgtttgaattcgtgttaa

SEQ ID NO: 29933 - DNA, 1630 bp, Caenorhabditis elegans
cacttccgcttcatcaaccagttgcaactccgaagccaaatccagcagaaaacggaaaattgagcagactattgaatcccgtaatgtcttcgattacagctcaaaaagcaaaaaaatgaaaaggagaaccctttctgcatagtgatgggtcaagtttaatggggaaatcaaaaaattaaaaaaaaaaaagcattttaaaaagttgtcagaatttagaaattttcgtattttaaggacatatagaaattgataaaatcaatgaaatttctattaaaaaatgtttaaaaaacattattcaaattttcaaaaattgtatctgctttttcagaattgaaacattttttattttgaaaaaaaaactatttaattttctgattaaacaacagaaaaaaaatatggcgcaaaaaccataatttttaatttattccggttgtgtcaataatttctctaaaattttattttatgccttctagtacataattttaaccaaccaaataatatcaattttttcaattttccaaaattgttccagttttgcaatttggagttttttttagcatttaatgttttgctaaaagagttatttctgaaaaaaaattaaagttccgaaaaaaaccgaattttttaaagttataattttttaccttcaagaagcctaatatattacgataagaaattttgaaacaccattgaaggcatgaaatttaaaaaaaagctcgattactacaaaatttcaaaattttgcaaaaaaattactggtttacaggggtttacaaaggaaattccttctttttttaatttcagattttttttgaggcctaacgaacaccgatgagcccaccgaaaaaaatttggagtaagaaaatgtttatttcattttgtcatagccgcttatttgaaatgtgttttttttaaattaaaattgaaaataaataatatactattgaaatttgcaaaatttttgaattgcacaaaaaagagaataaattttcaaaacataaatttatatgctcatttgcccaagcttgattcctacctgatacctgatattcctgagtttttaagaatttcgatccacaatttagcaatttacaaaaaaatttatttcaaacattttcccagtttttgaaatctcagcaccactacagtaacccaaaagtatcctacagtacctcgacctcgtctataacaaataactctattttctaaaactactgtaaccctactgtaattctatagcttcttgcattacctctcctgaatcatacagtaattctacagtatcctatagtgatttatgatactgtagaattaatttcttcatatggtcaaaacttaaacttaccgaagcaaaaaaaaaatgattttattctgaactttgagcccttatattgttcgacaaacaacacaaatgttttttcccttattttatcccctttcacctgtatgtttagaatttttataaatatttaattcagtaagatcactcaattttgtgagtttttgcatgagaattttttttcttaattttttattttcaggtcagatcttgatggacacggacttttgttggattttgggaaaattaggtgttgatttttttttcaatttgcgaggagttttaggttaa

SEQ ID NO: 29934 - DNA, 1271 bp, Caenorhabditis elegans
atggcttatttgcaagttgtcccaccaccaatctcaccattatcagtactagccaatcatccagaccgcccgtacgaagtgctgaaacctctgggccagggatccttcgggcaggtggctctagtatcgaatcggcgatatcctgaaatgctggccgcactgaagcggattgtaatcactggacaggatcgggagtacatagacgccatcagaaaggagatcacgattcaggaatctctcacggggcatgaaaatgtgattcaggtgcttgggaaggagtccgatgcccaattctgctacatgtttttggagtacgcggatggaggcgatctttatgagaagatcacctcaggctgttcattttcactagaagaagcacatagttatttcaagcaacttgtgaatgggctcaagtttcttcattgtagagatgtggcgcatcgggacatcaagccagaaaacctaatgctcacccactcgggtaagtcggaaatgcgtaggctgaggtttagtttttttagcttaagtttaagcttagtctaaggcggggctgacggtggcatacataagtacatatgcgatacctcaaaaaattgcaaattccatttcattatccaacattttcaggacacctaaaaatcgccgatttcgggctcgccacatggtatcgctacaaaggagcggagctgattttcgagcaacgttgcggttcagtggagtacgttgctccagaaatttacactggagcccagtatcgagggccacaaatcgatatttggtcggctggagttgtgcttctggcgatgttgactcgacaactgccatgggagtttccgtgcatgtaagttgggattatgaacttgtctagaaacacataaacgcctgccttctgcctacacgactgcctaggtatcgctagaatatagagcaggaaataggcattcatttaggcaggtatgtgggcaggtcccatacaggtatgtaggcaggtcccatgcaggtatgtgggcaggtcccatacaggtatgtaggcaggtcccatgcaggtatgtaggcaagttaaaacccattcaaataaaaattcagagcccaaaaaaatgcatatttaattttaggacaaacaagcgctacttcttctggatgaaaaaccgggtcgcccatatcgacgcgtggaatgagctcagctgccgagccaagaaactgctctggaaaatgctttctccaggttcagagaatcgagcaacaatcgaggaaattcaatcaagtgcgtg

SEQ ID NO: 29935 - DNA, 1256 bp, Caenorhabditis elegans
atgacttccaacatgtccacctgcaaacaatttttatctaccaagaagaaatcaaaagattcctacgaattcattgagaaccttggagaaggatcctttgcggaggttgtcctcgtcgcaaaggtcggcacacctaataagatgtttgcaatgaaggaaatttccatagttgggaaagatgagtgcttcatggagagcatcaaaagagagtgctccatacagaagcgtctctctaaaagtcggcatttaaatatgatccatctcttcgaaattcgtacaaatccagaaaactatcagttgattttgagctatgctgatgggggagacctttttgaaaaaattaaccaacacggaggactgggctcagatgaagctcatcgatatttcaaacagctaattgatgggctcagatttattcatgaggaaggtgtgactcatcgggacatcaagccagagaacttgctccttaccaagtcaggttagtcttttttaaccaatcatcaatcagccttgcctaccaagcaatcaaagaacgtgctcgctgattggtcagcagataagatgcatttgctacgtcaaaatgcaggcagtaggcaggcacataggcatgtaggcaatgagactgcctactgctgagacctttgaaaattttcaggcattctaaaaatcgcggattttggcttcgcaactatgcaccgtttcaatggagcagaacagatgctgaacgcgtattgtggatccccaccgtacattgcacctgaagtattaactggaatagactatcgcggtccagcagtggatatttggtcggctggagtggtgctcatcgccatgatagctggagctgtgccatgggagcaggctgaccagtaagttggtgggcttaggcttaggctcagtcttaggcgtaggcttaggctcaggcttaggcagggctgggggagagaaaattgaaaattgcaaaaatttaaagaaaatccagaaatatttgcaaaaattcgagctgccctaaatttttttccagaaatttttcgagcttttaaaaatttcagcttcgacattttccaatcccggtactgcagtttccgtagaaatggcagaaaaggagcatggagccggatgagccaacaagtgatatcccttcttcgaaaaatccttctccaggctgagttaagagcgactattagtatgattgaagaagatccgtggttcatatatggtgaggaggtggacgctgagaataaggagaacggaag

SEQ ID NO: 29936 - DNA, 773 bp, Caenorhabditis elegans
gtcaacgctgttatccacgctatcggaatcggaatgtatgccagtcgccaaatcaagacctactctggcggaaacaagcgccgtctctccctgggtattgccattgttggtctgcccgacgtcctcctcctcgacgagccgacctcaggtgtggatccaaaggctagacgtattatctggaatattttgaatcgtttgagagacttgggtactgctcttgtcctcacttctcatagtatggatgaatgtgaagcgttgtgcacggaactggcgattatggtttatggtgaggatacattatcaatgggcctttaaaattcaagttttcaggaaaattccgatgctatggaagttgtcagcatatcaagagtagatatggaagtggatacactctgctaatccgtctcaagaaccgaaatgacgctgaaaagaccaagtcaacgatcaagcaaacattccgcggaagcgtcatcaaggaggaacacgtcctccagctcaactttgacattccacgtgatggagattcgtggtctcgcctcttcgagaagcttgaaacagtctccacgtcgctcaactgggatgattactcgctgtcgcaaaccacactggagcaggtgttcatcgaattcagcagggacgccggggtatcttcggattcggagtttgatggagccagcagcacagggtccgccaactcgcgaggcaaacagaatggttacacgaatcgggcactaaccattgaaagcgacgcggaaagtgccatgtatttctaa

SEQ ID NO: 29937 - DNA, 675 bp, Caenorhabditis elegans
ctggtattgtgttcgacgactccatcgcaaaagatctcaagaaccccgacaaacgagatttcacctacacaatccgactctcaaatactcaccgaagatccagaaacgttggttttatcacctcctactttttcaacttgaacttgaaattttgcaggccttcggtgacaactcctacccatgggatacctctgtctcatttgctgttcagtatgtcagcggtcccatcaacccggatgacaatgacggaggttcccccggatactggcaggagggtttcatgactgtccaaagagctgtcgacgtggcgatcaccgagattatcactggggaggatgctcagctcaccccgcttctcgattcctaccaagtatcgagattcccgtttcccgggtattccacgaagattattgagatcggagcgttcttcatgcctgtcattgtgattttctccttcatgaccagcgtcatttacatcgtaagggcggttgttgtggagaaggaggatcggctgaaagagtacatgagagtcatgggactatcccagtttatcaactgggttgctcattttatcatcaactacgccaagctcacttttgcagttattgtgttaacgattctcatgcacttcgtcgctttgaaatccgacatgacactaatgttcgtcttcctgat

SEQ ID NO: 29938 - DNA, 848 bp, Caenorhabditis elegans
atgacccgttttgctggaaaatctgtgattattactggatcttcaagtggaatcgggcgagctaccgctgtactttttgcaaaaaatggagcccaggtaacaattactggcaggaatgctgagaagctggaggctaccaagaaaaaactactaaaagttgttaaaactccggacagtgtaaatgtggtggtggcgaacttgaccgatgcccaaggacaagatcagataattcagtcggcggtgaagaaatttggaaaaattgatatattggtaaaaaacatagttttgaaatttttgtcttaaaacatagtttccagattaacaacgccggtgcaaatgtggtcgacggtactgtgaatacagatcagtcaattgatttgtaccataaaacatttcaaatcaactttcaagctgtcgtggagatggtcaagaagaccaaaaaatatttgatagaatcgaaaggagaaatcgtgaatgtttcgagtatcgctgcgggaccacaagcggtgagaaaaaatttcataaaaaattggaaggactatcacttctggcaaaaatagctttgaaggtggagtaccaaaatttgaaactttcccttttagaccaatagaccaaaaaaccagtggaaaaactgtttttcggcccaatttcgtttgaaaaaaacattatttctacaggtgtcaatgtctccttattatgcagctgcaaaagctgcacttaaccaatacacacgatgtgttgcactggatcttataaaacaaggagttcgcgtcaactctgtcagtcctggcatcatcgcaacaaattttatgggggctatgggagtgcctgagcaggcacagaaaaag

SEQ ID NO: 29939 - DNA, 417 bp, Caenorhabditis elegans
cttgctccatccccctattacgcagcctccaaagccgccctagaccaatacacacgttgcgtggcacttgatctcatcttgcaaggggttcgtgttaattcagtgagcccgggtgtcgtcacgtccgggtttctgggggcaatgggaatgtcggagcaggtccagaaacaggtaaacgaaattgttccatgattgctgtaaatttgatagaaattttagatcgaagagaacttcacttctaacagagcctgcattcctgcaggagtttgcggaaagcctgaggacatcgccgagcttattatttttttggcggatcgcaagagatcttcttacataataggacagtcgattgtggccgatggaggaacttctttggtttcagggctcaccgctcaaaacattcagcgaaacaattga

SEQ ID NO: 29940 - DNA, 1058 bp, Caenorhabditis elegans
atgagcttttcgctcataaattctacatttaccgaggctcaatttggtattaaactgctatcagatctaacttccgaccagctcacaccatgcgtcttctccccggtgtctattctattatcgttggctctggtgcatcttggagctaagggacataccagacatgacatccgaaactctgtggtgaatgggagcaccgatgagcagtttatcgagcatttcagttttattaataaacttttgaatagttctgtgaacgatgtggagactttgattgccaacagactatttgtttcgtgagttttttttctgtagtggaaatatttgttgtagtacgtttaagatttaaaaaagtatttgagcatattcctggtctatcaatcatttcgggttttcgaaaaaaaaaatcaaaacttaaaaatagagttttctgacggaaaaattaactttttctcaaatcttttttggtagttgtgttgcaaattttcagattatccaatttttaggccagaacaagcaattcgaaaagcttttaccgatgagctccgcgagcattacaacgctgaaacggcaacaatcgacttcaaaaagtctcaggaagccgcaaaaataatgaaccagtttatatcggagagtaccaaaggaaagatacctgatatgattaagccggacaatttgaaaggtgagatttgagtgtaggaacttgaatgcctgctggggcatccaggtgcctaggcttaggctcaagctcaggttcaggttcaggatcaggctcaggctcaggctcaggctcaggctcaaaaaaattttttttgaactatcagataatcgaaaaatctaaaaacgataattttagatttttttttccgaaacaacttttaacagttttagacgtcgacgcaattctcatcaatgcaattttcttccaaggcgattggcgtcgaaaattcggggaacccgcggaatccaacttctctatttctgctactgaaaatcgccttgtcccaatgctccgcgagaccagagactacttttataacaaggatgatgagtggcag

SEQ ID NO: 29941 - DNA, 834 bp, Caenorhabditis elegans
atgtccgataacgcaacgtaagttttattcgtggaccaaattataaaaaactttatagattttttgatgtgggcaaatttcgcaattcttttttgaaacttatccgctgccttttttctagtccaaagtttgttcgaaatcctctaaatttcctaggatttttggagcagagtctagccgtagaagcctctacatttaaaataatcatcacattggtattatgaaccacaatttctgagaaaaagtatttttggatttacattaacatttgcaaacgagcattgatttaccaaaaaaaaagttatggcggcccaaaaatatttttttgaaaaaataccatttttccgctaaaattttaaaattggccaactttacataatcagaacttgaatctcaaatttcgccatcccaccatcagaatcatcttccagctcccaaaccgactttgctctgaagctccttgccacccttcctcactcaggctccgtagtcctatctccactttccatctctcttggtctggctctgatccatgcgggggcttgtggttccacccaaaaagagcttgaagatgtgctcggtggctctaggatttttgaggaattttctggattgatggaagctgttggtgacacagataacggcgtggaaacgaaaattgtgaatcgggtttttgtgaagttagttttaaaagttattgtaccaatttaaagttttcaaacatgtttcagccaagcctataccattcaccaggattaccttgaaaccgttgaaaaattatacaaagcttcgggtgaaagcctcgatttttctcagaccgaacaagcggcaaag

SEQ ID NO: 29942 - DNA, 730 bp, Caenorhabditis elegans
atgacggacgccgtaagtttttcaacaattaatcaataaaattcaactaaaattccctattttcaggcgattgctgaaaaagatctcggaaatgctgcctacaagcaaaaggactttgaaaaagctcatgttcactacgacaaagcgatcgagcttgatcctagtaatattaccttctacaacaacaaagccggtaggtttttatttaaaaaaaactgtagattttccctaattttccgaatttcagccgtctatttcgaggagaaaaaattcgcggaatgtgtgcaattctgcgagaaagccgtcgaagttggacgcgagacccgtgccgattacaagcttatcgccaaggccatgtctcgtgccggaaacgctttccagaagcagaatgacttgagtttagccgtccaatggttccaccgctcgctctccgagttcagagaccccgagcttgtcaagaaagtcaaggagctcgagaagcagttgaaggcggccgagcgtcttgcctatatcaatccagagcttgcccaggaggagaagaacaagggaaacgagtatttcaagaagggcgactatccgacagcgatgaggcactacaacgaagcggtgaagcgtgatccggagaacgcgattttgtactcaaaccgggccgcgtgtctgacgaaattgatggaattccagagagctcttgatgattgtgacacttgtattcggctggactcgaaattta

SEQ ID NO: 29943 - DNA, 318 bp, Caenorhabditis elegans
acatgtatctcaacaattcgcggatgtcgtaattgctgctattcaattctgcaagtgcctggccctattctttgtgccagcaatagtggcggctaccgtaaccgacgagtctgaccggggccagtggtcccacgcgtttctcgtcatgtccgggctgcttttggtggtgaatttaagtttttttgttttctgaaaattgagttttttcaggcaaatttttctgcctatttcttctttaccgaccagccagccgattttacgaaatgtgaagagccacatgagtttccgttgaaaaaatcgattgaagcacatgactaa

SEQ ID NO: 29944 - DNA, 625 bp, Caenorhabditis elegans
atgtgagggtggttatccaatccaagcatggcgatattgggtcaagaacggactagtcaccggaggatcctttgagtcgcaatatggatgcaagccatattcaattgctccatgcggcgaaactatcgacggagttacatggcctgagtgccctatgaaaatctctgatactccaaagtgtgagcatcactgcactggaaacaactcctacccgattccatatgaccaggataagcattttggttggttgacctaacctaaaatttactataagggttgacatttttcaggcgcaagtgcatatgcaattggtcggagcgcgaagcaaattcaaaccgaaattctggctcacggaccagtagaagtcggattcattgtctacgaggacttctacctatacaaaaccgggatctacacacatgtcgctggaggagaacttggtgggcatgcagtgaagatgcttggctggggagtcgacaatggtacaccgtattggctcgcggccaactcctggaatacagtgtggggcgagaaaggctacttcaggattttgagaggggtcgatgaatgtggtatcgagagtgctgcggtcgccgggatgccggacttgaatcgacgtaactag

SEQ ID NO: 29945 - DNA, 625 bp, Caenorhabditis elegans
ttgcgaaggaggttacccaatccaggcatggaagtggtgggtcaagcacggtctcgtcaccggaggatcctacgagacccagttcggatgcaagccatactcgatcgctccatgcggcgagactgtgaacggcgtcaagtggccagcatgcccagaagacaccgagccaactccaaagtgtgtcgactcctgcacttccaagaacaactacgccaccccatatcttcaggataagcactttggtgagtttacacgtgtaagcggcgctggttaacactatgaagttctaggatctaccgcctacgccgtcggaaagaaggtcgagcaaatccagaccgagattcttacgaacggaccaatcgaggttgccttcaccgtctacgaggacttctaccaatacaccactggagtgtacgtacacaccgccggagcctccctcggaggacacgccgtcaagatcctcggatggggagtcgacaacggaaccccatactggcttgtcgccaactcgtggaacgtcgcctggggagagaagggatacttccgtatcattcgtggactcaacgagtgtggaatcgagcactcggctgttgccggaattccagacttggctcgtcacaactaa

SEQ ID NO: 29946 - DNA, 539 bp, Caenorhabditis elegans
atgcggaaaatattgatttgcctgatcggagtcctatttcaagccgatggagtaccaccttcaggtttttttacaaattgtatttctagattgaaagcaatattttcagaaattgaccggataattcattatgtgaattcgcaaaaaactacttggactgctgggattcctgctctgagccggaattctatgctgaaaactcttgtcacagacgctgcaactataggattcaaaatccagaatttcggggtgtcacaagcaaattccgatctatctccttcatttgatgcgagagaacgttggccggagtgcatgtcaattccacagatcaacgatatttcagaatgtagtgagttttgctttaaattccagaatatgaacggtaatggcctaaatttttcagagacaagttgggcgttcgcagcagccgaatcaatgtctgacaggctttgcattaattccggaggatttaaaaataccattttatccgctgaagaacttttgagttgttgcacgggaatgttttcctgtggggaagg

SEQ ID NO: 29947 - DNA, 799 bp, Caenorhabditis elegans
atggccgatcaactgaccgaggagcaaattgccggtacttttttaaattctgattgatggacggaggaccgggagattgaagaaatctaatcctctctcatttcgaagcgaattgagcagaaaccaagcggcgcggcgtagaaatttaaatttaatggatgaaacattagccgtagcagcagatgtatagcgccactatttttgtgtgttttattccagatgttggctggttctcgcggcgaaaaatctatcaacaattgtataaaaaactacaaaattcgagaaaaaaccaaatcaattttgccaaattttcagagttcaaggaggcattcagtttgttcgacaaggacggcgatggcacaatcaccaccaaggaattgggaactgttatgcggtctttgggacaaaatccgactgaagccgagcttcaggacatgatcaacgaagtggacgctgacggaaacggaaccatcgatttcccagagttcttgacgatgatggcccgcaagatgaaggacacggacagtgaggaggagattcgtgaggcgttccgagtaagagatttgtggaaatttataaattcatttttgattcactatagagaagcctcatgtagtatagaaaatctcattcaaatcttcctatttgcaggttttcgacaaggacggaaatggcttcatctcggccgctgaactgcgccacgtcatgaccaacttgggagagaagctaacggacgaagaggtcgacgagatgatccgtgaagccgatatcgacggagatggacaagtcaattatgagg

SEQ ID NO: 29948 - DNA, 378 bp, Caenorhabditis elegans
gagacattcaacaacgtgaagcagtggcttcaggaaatcgataggtacgcatgtgagaacgtcaacaagctgttggtcggaaacaaatgcgatttgacagcgaagagagctgtggagactcaagctgcccaggattatgctggacaactcggaatcccgttcctcgagacatccgccaagtcatcgacgaatgttgaacaggtttgttgggctaaaaatgatttttaaaaaaataaaatcacatttcaggccttccttaccatggcttcggaaatcaaatcacgtatgggaccagttcaaggagccggaggtgctccaggtgtgcgtatcacgggaagtcaaccggttcaagacaagaagagcggtggatgttgttaa

SEQ ID NO: 29949 - DNA, 578 bp, Caenorhabditis elegans
aaactgcatgcttatcacgaacacctcgtctctaaaactgtctcaaatgctcccagttattcagaacccggcactattcgctgggcttcatttcttcaaccctgttccagtgatgaagcttgtagaagttgtatcaactgatgaaacttctccagagaccacaaatttcttgttcaacttctgcaaagaaatcaaaaagctgccggtcgccgcgaaggatactcctggattcattgtcaaccggctattgatcccatatcttatggactccattcgcatgctggaacgtggagatgcaactaaagaagatatcgatacagccatgcgatttggaacttcttacccaatgggaccaattgaattgtgtgactatgttggacttgatgttctgcagagcactttgaaaagtgagatttaccaactccttttctaggttttattgaaccctttctaatctttcagtcttccgcgaaaccatccctggtgacgcccgttttgcaccaatcccacttatggacaaattggtcgctgaaggaaagcttggcagaaaaacgaagcagggattctacacgtattga

SEQ ID NO: 29950 - DNA, 265 bp, Caenorhabditis elegans
tcttcaaaatgcttcgtttgattattcttctcctagtcgcccttctcgcactttcttcagcccaatatggtgagttttgccttttaaagtcttttttctatataaaattatacattataggatatgggtacaactatggctacggagcaccaatgtatcctggatatggtggatatggtggaggacttctcgggcttcttattggaaagaagtaggacggagagaggaattatttgctgactttctttatttgattgtgatataa

SEQ ID NO: 29951 - DNA, 649 bp, Caenorhabditis elegans
atggtgagtttgagattttaattcgcttcaatatttttaaattgaaagaaatttggaatgttatgtttggcgtgtttttttttcattgaatttccaaaatttcacactaaaatggaatggttttctcttctttttgcctaacctaacctaacctatgtgtgcctgttttctagagttccggtgtcatggtcgacccagatgtgcagacatctttccaaaagctctccgagggacgcaaggagtaccgctacatcattttcaagatcgacgtgagtttttaaaaaataaaatctgaatcagatcaatttaaaaaaatttcgtgccactttttgttttttttgttgaaaaatttgaaaaatcctcaaattaattgttttagatgaacattattgatttccctattaaattgcaacattttccaggagaacaaggtgatcgtggaagccgcggtgactcaggatcagctcggcatcactggagacgactatgatgactcttccaaggccgctttcgacaaattcgtcgaggacgtgaagtctcgaaccgataatctgaccgattgccgctacgccgttttcgacttcaagttcacgtgcagtcgtgttggagccggcacgagcaagatggacaagatcatcttcctccagat

SEQ ID NO: 29952 - DNA, 2313 bp, Caenorhabditis elegans
atggtgagtttgagattttaattcgcttcaatatttttaaattgaaagaaatttggaatgttatgtttggcgtgtttttttttcattgaatttccaaaatttcacactaaaatggaatggttttctcttctttttgcctaacctaacctaacctatgtgtgcctgttttctagagttccggtgtcatggtcgacccagatgtgcagacatctttccaaaagctctccgagggacgcaaggagtaccgctacatcattttcaagatcgacgtgagtttttaaaaaataaaatctgaatcagatcaatttaaaaaaatttcgtgccactttttgttttttttgttgaaaaatttgaaaaatcctcaaattaattgttttagatgaacattattgatttccctattaaattgcaacattttccaggagaacaaggtgatcgtggaagccgcggtgactcaggatcagctcggcatcactggagacgactatgatgactcttccaaggccgctttcgacaaattcgtcgaggacgtgaagtctcgaaccgataatctgaccgattgccgctacgccgttttcgacttcaagttcacgtgcagtcgtgttggagccggcacgagcaagatggacaagatcatcttcctccagatgtaagcgcttgatcctattggtgaattattgtaccatctaattttttttccagctgcccagatggtgcttctatcaagaaaaagatggtgtacgcttcgtccgccgccgccatcaagacttctctcggaaccggcaaaatccttcagttccaggtgagaaatctcgataatttttacaattagaaaaaaaaaatcaaattattaaaatttcaggtgtctgacgagagcgagatgagccacaaggaactcctcaacaagttgggcgagaaatacggagatcactagatacacgggtctcttccgaagtcgtcgtcgccgtcacatcctcgattattctcgtctctgtctgtcgcattttctccattgcttgatgatttctgatcgttttcacgtgtgctctttgaatgtgctagtgcgttgttgtggtgcttttttcttaccaacctcactacttgttcattttttttggtgtcctcaaagaatcatccgttgaaaacatgactgcggcgatgtgtttcgatgatgtttcttaagcgtcttcttcacattttcacctcttaacattgctaatttatcctctatttttatctgtttttttcctgattgacgattgtttttttcctgggggcaagtgattgtgtgtgcccactaatttaatacaatgtgccgggtaaccttccgtactatgaagaagttgagacatcccctcagattctcagtatctttattgtttagtgaaatgcgtggtaaatcccttctcatttacgattatattctctctctcttgtaaagctttctatatttatatagtgtactttcccccactggaactctcaatctccatctcctcaccattctttttttttcaaatcttctattgcgtattcatttcccttcttacttttttcccaccctgcccgatccccttgaagaatcacccaccaaaccgttcatgtgctgtgctttttaagattatcacaatgaaatcaagtttggagtttctaacaattgttttaacacgcgtggaaaattttgaaaggaaacaaaaattgacataaaaaccagaaaaatattacaaacacctttgagtacaggcttccggagtcaaagttgatccatcctgcaagaacgcctacgatcttctccacaacaagcatcagcacagctacatcatcttcaaggtgagttattctgcgaaaaaaaaaatgcgtactgcacaacacatttgacgcgcaaaatatctcgtagcgaaaactacagtaattctttaaatgagtactgtagctcttgtgtcgatttacgggctcaattattgcaattttctttataaatggtttccgtgaatcgacactagcgctacagtagtcatttaaaggattactgcagttttcgctacgagatatttgatgtattttgcgcgtcaaatatgttgtgcagtacgcattttcagagttttctgttcccgtaataattaaataattttctaaatttgattttttaaaaatttaaaaaataaataaatcgaaaaaaaataaatcaaaaaataatcagattgacaaaaatgacaccgccatcgtcgtcgagaaggtcggagagaagaatgctccgtacgccgagttcgttgaggagatgaagaagcttgttgaggacggaaaggagtgcag

SEQ ID NO: 29953 - DNA, 649 bp, Caenorhabditis elegans; identical to SEQ ID NO: 29951

SEQ ID NO: 29954 - DNA, 679 bp, Caenorhabditis elegans
atgtccttcgaccttgaaagttgcgaaaactccgaatcgtctgggtgctccatcgaagacaaactgccctcaaaaaattgtcttattcgaggcaaagacagcgtctacgcagttggcaaaaaagttgcccagggcaggtatggagccgtttatgaggtgctccgaaggtcagacggtaagccgtttgcatgtaaattggaaatttgtgaagcccactcacacggcctggatcaggattatagtgtgatgacgaaagctgcaaaacggggtatgaaacagttttccacgtttttttcgaacattgcattttttcaggcgcggaaaaccttgtcagaatgattgatcgtggcaaaatcgaagagcatttcaagttcataattatgcctctggtaagtgtgcctgcctgccttcatgtcttacctgtgcctaccaccaagcaagttgttctaaaattcttaatgatagcaaataaaatgaaacaatgtctagaataggcggtaggcgtaagtaggcagacataggcaggcgctaaattcagctcggtgagaacctgatgaacctacgcttcctcttcgaagatggccgcttttccctatccactggtcttcgtcttgcacttttcgcaattcaaccgattcaatcgctgcatcaattgggatatgtgcacagagatattaaa

SEQ ID NO: 29955 - DNA, 883 bp, Caenorhabditis elegans
ggcgtggaactgatgctggtgaagctattgcatcgcatatggacgtcgataaagtcgcgttcactggatccacggaagttggaaaaaccataatgaaagcagcagcggagtccaatgtgaagaaagtaacgctcgagcttggaggaaagtcaccgaatatcgtttttgcggacgcggatctagaggaggcggttcgtcaatcccatcacgcgctgtttttcaatcagggacagtgttgctctgcaggatcgagaacttttgtggagggaaaaatctacgatgagtttgtggcaaaggcaaaggaactggtagagaaaactgtcatcggagacccattcgacgagaacactacacaaggtccgcaaattgatgaatcacaagttgagactattatgaagtatattgagtctggaaagaaggagggggctcagctagtgactggcggagttaaacacggagaccagggatattttgtgaagcctaccatctttgcaaatgtgaatgatcaaatgaaaatcgcacaggaagagattttcgggccagtcatgattgtcatcagatttgattcgatggaggagttgattgaaaaagccaataatacaatttatggactggctgctggagtggtgaccaatgatttgaataaagctcttcaagtcgcaaatactatccgcgcgggatcagtttgggtcaactgttatgatgtttttgatcctgctgctccgtttggaggattcaaacaatctggtaacaaaaataattattccaacctattctttaaaagttttttttaggtatcggtcgtgaacttggggagtacggtcttgcggcgtatactgaagtgaaaacggtcactattaaagttccacaaaagaattcgtag

SEQ ID NO: 29956 - DNA, 3395 bp, Caenorhabditis elegans
gaagccgtcgccgcacttcgcctcgaaaacattgacgctcacggcacaacagcacacgtcggcaacaagtcggaccgcacaaaactgatcgacttcacacttgacagattcacgaaactcgacatcctcgtgtcgaacgctgccgtcaacccgcactacggtgatctgatgaaagtcaccgactcacaatgggataagcttctcgatttgaacgtaaaatccgcattcgaacttacaaaagaggctgtgccgcacttggaggcttctggtcggggcaatgtcgtctttgtgtcgtctgtcgccggatactcaccgatgaacgagattggagcgtattcggtgatgaagacgacgctcacgggattgagcaaatcgttggctttgaatttggccaggcggaatattcgagtcaatagtattgctccgggtaagcggaaaaatatttgttttttggatatttcgtgaaaaaattaaattttgaatcattgaaaatcaaaaaattcaaaaaaataagttgctaattttggtagcctaggttttctaggaaaattgatttttttttcaaaaattttacaaaaatgcagttgatctacaaaagtttgaggggtgcgcggcaaacgattttttttccggaaactcggcaaattgccggaatttaaattttcggcaaatgggcaaacctgcaaattgccggaattgaaagcttctgacaaatcgacaaatcagcaaattgccggaatcaaaatttcccgctcattggaaaattgcctacctgccgatttgcctgaaaaatggcaactgccgaaaaaattaattttcggcaaatttgcactttttttttttggaaattccagaatttcaattttaatcggcaaaattgtacgcatcctggaaaacgacgattccggcaaattggcaaatcagcaaattgccggaattgaaagcttccggcaaattgccagtattgaaaacttccagcaaattgccgaatgtgccggaaattaaaaattgccggaattgaaaatttccggcaaatcggcaaatttccggaattgaaaacttcggcaaaccggcaaattgccgaaattataaactttcggaattgaaaatttccagcaaatcggcgaattgccgaaattgaaattttccggcaaattgctaatttgccggaaaaacggcgaaattttcggcaaattgtgattttgcaccttttttttttgaaatttcaaaattttaattttaatcggcaaatgattttccggcaaatctacaaatcggcaaattgccggaattgaaaatttccggcaaatccgcaaattgcccatatgccggaaaacggcaaatgtcaataatatattttgaggaaattctatgaaaatttcgaaaaggcacagtttttcgttgtttccgtttccgtcttttaaaaaatccctctaaaaatttccggcaaattactgcaaatttgccgaaaatcaaaattttcggcaaaccggcaatttgccggatttgccgctattccttcaaattcccagaggggtcagtgggtgcaaaaacacaaactttaatgtccttgactgatcacattctgtatcttttatcatttaatcttttctctctttctgttatcttgattcgattcgacaaagaacagattttaattggttttcgatttttgcctgcttctgtcatagtgtgtagggatttcccaagctagctggagctcctgaaaaatcgattttttttttccaaaatcattccgaaaagtgcgttgcccactacttattttcggatcgattgaccccatttttacccctcgtgcgagctatttgctctgcgaaagagcagtagcaggagcaacaaaaaaacagaagccacgaggctaacgtctgagttttagcaaacatttgacatattttctcaatatttacctctcgctgcttctctcccacattgacttcgaaaaaccaaacgccaactcacgggatcccggtgcatcgggtacccagaggagggttattttcaaaaaatttgaaaaaaacgcatgtttttcgtttgtttttcaactttgaaacggaagatttggcgcgatcgaaaatcaaaatgttgaaatttggcgatctttgggaaaaaacgccatgtgacttgaaacatgttgacttgccaaaaaaccatctgataaataacatacttaatgacccagaaatcataaggcgtaaatcctgagatctaggtaaatataaatatttatccgaatttttgcggaattttcgtgaaaactgttgtttttccaacgcacgtggactcagaaagttccattttgctttgatcttcgaaaaatgcgggagaagagagcgcgtgctgacgtcgcaatttttctgggaaaaattcccgcatttttcgtagatcaaagtgaaacaggctgacaccacgtgttgtcgttgatgggtgacgtagatattacggaaatacaagactattagcatgcgtattgcacaaaatatttgacgtgcaaataatctcgtagcgaaaactacagtaatcctttaaatgactactactgtagcgcttgtgtcgatttacgggctcgatttacgatggaatattacatttaagcaaaataaagagaaaataatacaaagaaacgaaggaaactggaatatagctgtaactattcgaaaataaatttatttcaaaaatcgagcccgtaaatcgacacaagcgctacagtatttatttaaagagttactgtaattttcgctgcgagatattttgcgcgtaaaatatgttgcacagtacgtattctcagaattttgtgttcccgtaatattgaaatatttttgtgaaatgcaaaacggcgtgcgcctttaaagtgtactacggaattttcatagatttgtctagttttctcacgattagttgaaaacttgagattcttttatttttggtctagcaaaaaattacagaaaaattttctacaaaaaatatttatttatttattaaagagaaaatttcaatcttaaatttttaacgaatcgtgagaaaactagtgaaaatcgatgacaagcccgcgaaaacaggattttttgaaattacagtactcttcaaagatcgtgtcgagaccgggctaccgtgatttcgactcaaaaatcgcaaaattttcgcgtctgaataatatcacaatgattttttcgaaccacactaaaacataaatttctttacaggaatcattcaaaccgacttctcgcaagtcctcttctccgacgaatccgaaaagcagaagtggctctcacaaattgcacaacgccgattcggtgatccggatgagtgtgccgaggcggtggcgttcctggtttccgacgaggctagctacatatctggagagacgatcggtatca

SEQ ID NO: 29957 - DNA, 413 bp, Caenorhabditis elegans
gttttcgtcgtttttctcccgttttttaggttagttaaggcagatttcaagctgtaagtaataaaccaactaaaacataacattttttaaagaaaaaattctttgtatttttgagtcgaagaaaccaaaaaatccatttttttcaccaaaaacacccaaaaaaaaagctaatttccgaaatttttcagatcatcccacgccagctttgccaaaacgccggactcgatgctctcgacgtgctgaacaagctgagacatcgtcatgctcaaggcgagaaatgggccggaatcgacatccatcgtgaagccgtcggagataatcttgtcgcatgtgtctgggagccgagcatcgtgaagaggaacgccatcacagctgccaccgaagccgcgtgcctcgttctttcgatcgatcaa

SEQ ID NO: 29958 - DNA, 944 bp, Caenorhabditis elegans
atgtcactgcatcgaatcgtcgaagcccaacgcgcctattttaacaccggagccacaaaaccagcagagtttagaaaggagcagctccttcaattgaaaaagctgatcgaagagaatagagcggctttgactgaggttgtctggaaggatttgagaagagtaagtcacttttatctaataaaaactgttccaaatttttttgcgaaattgtaacggtagcgtaggtatatacgaaactggcaaaatctgatctaaaaatgaatttcagcgccatgaagtcactgagcccatggagcttggcggaagcctcgaggaaattgcctactacctaaaaaaccttgacgattggatgaagccaacatatgttgagccaactgttgcaactctccctactgataaaccctacattgtcaaggatccaaaaggagtcgtacttgtaatttcgccatggaactacccagtatccatggttctattgcccatgattccatcaattgccgctggaaataccattgtgatcaagccatctgagttgtctgaaaatactgcgattctgttcgaaaagcttattccaaaatatttcgatccaaagtatgttacaattgtcaatggaggaattccggaaaccactgaacttctgaaagaacgatttgatcatattatctacacaggatgtccaccggttgctaaaattattatggctgctgcagcaaaacatttgaccccggttactttggagctcggaggaaaatggtaagctgaaattttagtcaaagtttggaaaattttattcaaaaattttctgtttcagccctgtcgtggtcgaagatgacgcggacattgagatctccgcgcagagaatcgccagaggcaagtggttgaattgtgggcagacctgtctcgcgccggattacattttggttagcagtgccacaaaaccaaag

SEQ ID NO: 29959 - DNA, 576 bp, Caenorhabditis elegans
gttggctccacactggagatatcggaaaatggcttccaaccggcggcctccaaatcatagatcgcaaaaacgagatgttcaagctcagccaaggagattttgtatcgccaattcaaatcgaagcaatctacgcaaattccccgcttatcactcaaatatatgtcaccggaaaaactgaacgatcgtttttagttggaattgtggttctagacttgccacgattcaagcaacttccgctggtgaaggcgttggacggaaaagagagcatcgagatgataatggagaataaggaagtgaaaaatgcagttattgcagagttgaataaatatgcaaagcagaatggacttcaaacaattgagcttatcagaaatgtgcatttgacattgcaggtactgttaaataccttattttgcctacgcgcctaccagcaattcaacacaaaaattgtccaattttcaggaatttaccgaagaaaatggcttgataacttcaacccttaaaaatcgcagaaagattttggaagactactttgcaccccaaattgcaaagatgtacaaggaagttgaagcgctgtaa

SEQ ID NO: 29960 - DNA, 606 bp, Caenorhabditis elegans
tgtcattgtctcccaatggacttctgttctgcgtctcgtgcaaagacattcaagaaggaggccacgggtacacatctatcaccggagaggtagccataaaagatcggcaagaacgagtagacagcttcaaccaagaaaagggcggagcccaggatatgctcctctcattgacggccggaggtgtggggctcaatttgattggcgggaatcatctgattatggtcgatttgcactggaatcctgcactagagcagcaggcgtgtgatcgcatttatcgaatgggacagaagaaggaagtccatattcatcggtaatatcttttgaagttcaaagtttcgctcatacaatctattttatttcttgaattgctagaaatttctaaaaacatttttactgtttatttttattttgaaatttcacaaaaaaatttgcagactcatcgtgaaggaaaccattgagcaacgcgtcatgagcctccaggagaagaagctcgcgttggcagcttcagtgttggaaggatcggcaactcgtggaatgaacaagctcaccaactcagacattcgcactctctttggactcgacgaagaatttgaactcgacacctaa

SEQ ID NO: 29961 - DNA, 297 bp, Caenorhabditis elegans
atgaaaaccgctaacccgaagcaaaaattcccactgactgaagggcgtgccgctgaagtggagtctctcatgttggagtgcaaatttttcattccactggtcaatatgttctgggcagtatggtcacttaggcaacatttggtatacatttctagttgagattgtgttctgaattttaaattacaggcaaaatacgaaatcgggatggatttggatgttatcgccagtgaccgcttttccatgtacttccacttgaaagagcagtcgagagctatttatgagcagttcaagaaataa

SEQ ID NO: 29962 - DNA, 1315 bp, Caenorhabditis elegans
atgataatcattctgttattgacttttctaactatctactttgtgtacgagttatattggaagcggaggaactttccacccgggccatgtccgctgccagtttttgggaatttgttgtctattgcaaatccaccaccgggatataaagccttcgagagatggactaagaaatatggtgatgtctacacgttttggattggttagtttagaaaggaagtgagagaaaagtagggtaggttgtaggcggaagtgtaagcggagacctatccaaaaaatacatgcctgatatattgaacatacttttgaccatcgtttgacttaaaacattcacgagcgaaaaaaatcaattatcaggacttcaaagtgggatttaagccacacgtggtgtcagcgtgccccatttcggattgatctatgtcgattaacgagaatcgcagaaatttagatgcagaattctcaactgattttgcatgtttaagaacgtgttgacaccacattttttgggaatcattcccgcattttttgtagatcaaaccgtaatgggacagcctgacactacgtgtggccactttttttttgtttttttgtttgtcgatcagccttattaaaattccgacgactcaggtaacactcctcacataatgatcaacacatgggacaagatcaaagagaccttcattcgtgacgccgacacatacacaaacaaggtcgtactccctatggtgacgttgtcccgcggcggcgagtacggaattatcgattcgaatggagccatgtggcgagagcacagacggtttgcactttctacaatgagagattttggtcttgggaagaacttaatgcaggaaaatattctgatggaggtgcaggatgtttttgcgaggctagatgcaaaactgggatccgagacggatgttccggaagttttcgatcatgcagttgcgaatgtggttaatcaacttctttttggatacagatttatgggggtttcatagaaatttttagcattgcctaaccgatgagtttcagcccaaagaaaatgaatatcaggaattaaaacatattattgattctccagcggaaattttcggaaaacttcacatatttctagccatgaatattccaatatttgcaaagctgttgcccgaatctttatacgaaggaccaatcaaaactttccgggatactacattagcattttttaataaacaaattgaggcacatcggcaccgaatagattttgaagatttgaactcagagagcacagattttgtagagacctttttgaaagagcagaaaagacgtgaaagcgagg

SEQ ID NO: 29963 - DNA, 1395 bp, Caenorhabditis elegans
atgatcattttactggttttcacagcttttctagcgtttctgttccatgagttgtactggaagcgaagaaatttgccgcccggaccgattccgctcccgtttatgggaaatatcctaacaatgctgttgaacaagccgggatatgagtgcttcaggaactgcaccaaaaagtatggagatgtgtacactttctggatgggtgagtaggagtgaactgcggccgacacttcacgggtttgaattttgtgagtttggaagcgagtttcgccaaaccccctaattgtcggctgctactgaatcgcaattttttttaaactactaacctatttccattccaggaaagaccccattcgtgatgatcagctcctacgacttgttaaaagacacctttgtccgggatggtgacacttacaaggacaagtacccccagcctctcaatcaaaaaattcgtggtggaaattatggaatcgtcgagtcaaatggacatttatggagcacccatcgcagattcgccctcaccactttacgagactttgggctcgggaaagatctgatgcaggaaaagattcttatagaagttgaagacattttcaagaagtttgatgctcagctaggcctggagcaagatgtctcagtagttatgaataatgccattgcaaatgtaatcaatcagaacattttcggttatcgatttgaaggtgataaggaggaagattttaagaagctaagagagctcatggagtaccaagagactgcgtttgccacttttaaggtctatgttgaagcttttataccaaaagttggagcactgcttccaggaagatcattgaacgagctgtaagttccttataaattagcagaataatttaatagcagagtttcagattagaagaatggagggataatttctacacatttttcgatactcaaatcgaaaaccaccgcaaaaaaatcgacttcgactcccaggaatccctggattacgcagaagcctatctgaaagagcagagaaaacaagaagctttaggagaattcgagctgttctccaacaagcaactctcaaatacttgcctggacctttggcttgcaggactttccacaactaatactacagttaactggacaatatgctatgttttgaatcatcctgatgttcttcaaaagatgaatgaagagtttgaccaggtggttggtagtgataggctggtgacaatgggtgataagaataatctaccttatttcaatgccgtgctcaatgagtctcaaagatgtgccaatatcgtgccaattaatttgttccatgcaactacaaaggatactgtaattaatggatatccagttaaaaagggaactggagtcatcgcccagattagtacagttatgctagatgagaaa

SEQ ID NO: 29964 - DNA, 1399 bp, Caenorhabditis elegans
atgatccttttattggttttcaccgctttcctagcgtttttgttccatgaattgtactggaagcgaagaaatttgccgcccggaccgattccgctcccgtacatgggaaatatcctaacaatgctaatgaacaagccgggatatgagtgcttcagaaattggactaaaaagtatggagatgtctatactttctggatgggtgagtggggtgaactgcggccgacacttcacgggtttgaattttgtgaattttgaaactttcccttaaaaccgctaattgtcggctgccactaaataaaaataggggttttgctactaacccatgcccattccaggaaagaccccatacgtgatgatcagctcctacgacttgttgaaagacacctttgtccgggatggtgacacttacaaggacaagtacccccagccatttaatcaaaaaattcgtggtggaaattatggaatcgtcgagtcaaatggacatttatggaacactcatcgcagattcgccctcaccactttacgagactttgggctcgggaaagatctgatgcatgaaaagattcttatagaagttgaaaacattttcaagaagtttgatgctcagctaggcctggagcaagatgtctcagtagttatgaataatgccattgcaaatgtaatcaatcagaacattttcggttatcgatttgaaggtgataaggaggaagattttaagaagctaagggagctcatggagtaccaagagactgcgtttgccacgttcaaggtctatgttgaagcttttataccaaaagttggagcactgcttccaggaagatcattggacgtgctgtaaattcgaattgcctgaaaaccttttttagatgaagattttgaatctttcagattagaagaatggagggataatttctactcttttttcgacactcaaatcgaaaaccaccgcaaaaaaatcgacttcgactcccaggaatccctggattacgcagaagcctatctgaaagagcagagaaaacaagaagctttaggagaattcgagctcttctccaacaagcaactctcgaatacctgcctggatttatggtcggcaggactgtcgacaacctacacaacagttacctgggctcttgcctatgtcttgaattcgccggaagtattggagaagatgagatccgagttagatgaagttgttggaaaagatagattcgtgacaaccgctgataagaatgatctaccttatatgaacgcggctatcaatgaggttcagagatgtgcgaaccttttgccggtcaatgttgctcacgcaacaaccagggataccgttatcaatgggtatgcaattaaaaaggggactggagttattgcacagatcagtacagtgatgcttgatgagaag

SEQ ID NO: 29965 - DNA, 1574 bp, Caenorhabditis elegans
atgatcctacttctactatcagctgcggtttgtttgttcctgttccatgaactttactggaagcggagaagcctaccacctggcccaacaccgcttccatttatggggaatactttggcgatgctcctggagaagccgggatacgagtgcttcagacggtggactaagcagttcggaggtgtatacactttttggatgggtaagtcttgggagtttgaaatgatgattgaaaggtgtttattcaagctttagagaaggttcgagcgtcagtaaagtatagtaatttgaaaaattaacttgtttcaaagatggcaatagttagtgaaacgtcaaaagaacatttgaaacgtagtcagcattttgccatagtttttgagccaaacttagacaaaaatctagatccaaatacccagcaagcctgggaatgagttgttgagttgatgagactatgtcggtcgcgtctttgtattttcaatgcttacagactacatcctcaaaacaagttacaatttcaggcaacattccatatgtgatcatcggatcctacgacttgctgaaagaaacttttgttcgtgatggcgacacctacaaagacaaatatcctcaacctttcaatgaaaaacttcgtggtggaatgtacggaatcgtagagtccaacggacacatgtggagcacacatcgtagatttgccctctctacgttacgtgacttcggtcttggtaaggatctgatgcaggaaaaaatcctaattgaagtggaagatatattccgaaagtatgatgcacaacttggaaaagagcaagacatccaagtagttctgaacaatgccatagccaatgtgatcaatcagactattttcggttaccggtttgatgagactaatcaagaagagtttgagagaatgagacacttggtggagtatcaggaaaagcaatttgcaactgttaaagtctatgttgaagcttttgttcctacaattggaaaatttcttcctggaaaatcattagatcagttgtaagtaaccaatttaattaattttataactgaaaactttattttataggctcgacgactggaggaatagtttctacacatttttcgatactcaaattgaaaatcatcgaaagaaaatcgattttgattccgaggaaagccaggattacgctgaagcctatctgaaggagcagaaaaaacaagaagctttaggagaattcgagctgttctccaacactcaattctcaaatacttgcttggacctttggctggcaggagtttccacaactaacactacagttaactggacaatatgctatgttttgaatcatcctgatgttcttcaaaagatgaatgaagagtttgaccaggtggttggaagtgataggctggtgacaatgggtgataagaataatctaccttatttcaatgccgtgctcaatgagtctcaaagatgtgccaatatcgtgccaataaatttgttccatgcaactacaaaggatactgtaattaatggatatccagttaaaaagggaactggagtcatcgcccagattagtacagttatgctagatgagaaa

SEQ ID NO: 29966 - DNA, 1634 bp, Caenorhabditis elegans
atgcagatgaacacgttaacattgaattttactgtaatttgtatggacgatattgtagaggatttccatatgttccataattccacaggtttgcaaatttccgatcttcaatttttttgtaatgtaagaaatttcagaaacccattggttcgagcgaagtactgaaaaatcgctactcttctcgggagtagctatcggtggacttataggccttgtaccatcagtacctcaaataagctccatcggtcttcgcaacactcaaacaatatccggcttcatctccgggctcggatcatttctattcccactggctgtctccgtcggcttctacacatcattcctgtgtagagttctgcaaggcatcggagccgccgtcctgttcaccgcagttggcgttgtgccaggcgtctgggctccgaaaagtgaagcgaacacatttatgtcaatacttgcgtgtgcttttcaactgagtaatgtaatatgtatgccggtttccggattgctttgtgaatcggcggttggttggcgatcgatttattatatatccggagcaatcacttttgttttgtatacggttttttggttcacctataccgatgacccgaagttgcacaggttggttggctcgtcgctgtgagaccatggagggaaattcaaattttcaataaaaaacattttggcgggaattcaaactcaattttttttcggaattatttttgcggaacatttaaattttttgtgaaaaattgtggcgggaatttaaaaatttttgagaatagttttagcggtaattcgaatttttcacggaattttttttgcggaaaattcgaatttaccgacagtgagaaaaatttggcgaaaattcaaactttctgatagtgaggaaaatttggcggaaattcaaaaaattaaaaagaaatctggaaattaaaaaaaaagtgccggagaaacttcgtgaaaattctcgtggtgtctgagtgtctcatttcggcttgatctacagagatcttcaaaaaatgcgggagaagagacgcagactgattgcgcatagttaagaacgtgctgacgtcacactttttgggagaaaaattcccgcatttttttgtagatcaaaccgtaatgggacatctgccaggtgaaaacgtgaaaattcgacaagcctgaaaattttcagaaatctcttgatgtgcctgtgaattttttgactattttgaaaacttttagaaaaatctgggaacatgtggaatttttttgtgaatatttattttttgtaaaaatttacaaacccgatttccaaggacatttttctgacataaattttaacaaattccagaaacgtctcgcaaaaagaactgcgaaaaatttccaccggaaaagtcgaaaaaatcaaggaaccagttccatactttgcagtttccacagacccgacagtcatcatttcttggatttcactttttggtggaaacatgggcttctacgttttgtgtatctatggacccacatacctccgagaagttttgaaattcgatgtgaaggagaccggttttctcacagcacttccgttcatcctatcagcgatcgccaagttttcagctggccggatctctgacaagcttactggattgtctgaaaga

SEQ ID NO: 29967 - DNA, 1726 bp, Caenorhabditis elegans
tggaccggaaagccgccgaatctgctgaagctcatgtcgtccacgccaccgaacaccacaccgtccatcatgtcgtcaagaagagcaaattcaccaaattcaaggaatcactgtgctctgtgctcgacaaggatcttctcttctctccatcattcatgactcttgccgtctcaggaactttcaccgtcctctcgttccttgttccattcgtctacttggctcttgccatgaagcagaagaatccggattttactgatgctgaattgtcacttccagtcactctaatcggtgctttcaacattatgttccgtatcggatgtggaatggtcgctgatcatccgaaaatgtcggctcttcaagtttccaacgtcgccaccatcatcgccggaacctcgatgctctttgtgccattttgcactgagctctggcattacgtcgttttctgcatcccgttcagtgccggagttggtgagttttggagaaaaatcccgttgcttttaacgatttttacgtcgaaattgaaaaaaaagatgtttaaaatatcaatttcggacttaaaatatcaataaccacaaaaaatttgcgaaattaaggtggaaacgcgctccacggacaatcggtaatactccgcccacaaaatttgggtctcgttaggtatttgacagaaaagtcgtattttcgagcatttttcatttttattgttaaatttttcgttgtttttattgatttttatgtcgaaattgataaaataatatttataattttatttcattaatttcagcttaaaatcgataagaaaaacaatggaaaaatgacgaaaaaagcgaaaattggttgattctggcctcaatttgccggttttaatttttttttttgccgatttcccctgttttctatcatttttcgttgttttaataattttcacgtcgaaattgaattaaaaaatttaatttcggcttaaaaatcacaaaaactacctaaaaaacggcgaaaaatgcttgaaaattggcaaactattttaaaaatttcaaatttgcgtttttatcgccaaatacccgatgagacccaaatttttggaggtggagtgttgtcgattgtccgtggagcgcgttttttcacgaaaaaaaaaaccaaaaattaaaaaaaaacttaaatatttaaaaaaatcagttaaaaaaatttcgagcgtgtttttgaaaaaaaaaaagtaatcagtttttctttttaaaaatccaaaaaaaagcgaatgtccccatcaaaggagccaccgaaaatttttttaaatacttttttgaacgaatttggccccaatttttttctgaaaaaaaacgataaatcttcggttttgtcgaaaaaaaaaatcgaaaaaccgacacccttggtccccatattaaattaataaatcttgaactatttctccatttcagcttgcttcgccgctcttcgttcggtcatctgcgtcgagctgatcggagtcgaaaagctgtcgaacgcgttcggcatcctgatggttttcatgggaatcggcgctgtcgtcggcgggccgattgccgctcaaatcaaggatatcactggcaactacgacattagcttctacgtgatgggcatcattttcgccttctccggcgtcatgactatccgtttgccagagctgaaggcgtgggaagagtcgaaaaaactcgcacgcgccggaaccgagatgcgtgtgatctctgaagcatcctaa

SEQ ID NO: 29968 - DNA, 2190 bp, Caenorhabditis elegans
atgcgacgagtcggcgatgctgaggaaaaaattgaaaaatcagatgaaatgtcggagaattccaggaagacttcaaaaatattgtgttgcaatctgacgcgatatttgattttgattctgacgtaagttttgagaatgttcgatcactttatattacaggaacaaaaaattctgagattgcgtattgcgcaacacaattgacgcgcaaaatgtctcgtagcgaaaactacagtaactctttaaatgactactgtagcacttgtgtcgatttatggggatctcgattttttttttggcgaattgtgacagaacagcgttattccattttcgggttgtgtcaaagtgtctcattccggcttgatctacgtagatctacaaaaaatgcgggaaacgagacgcagagttctcaactgatttcgcatggttaagaacgtgctgacgacacaattttttggaaaaaaaatcccgcatttttgtagatcaaaccgtgatgggtcagcctagcacctttatttcttcgtattattttagctttttttttggctcaattttactattctatcgataaatcgataattaagcaaaaagtgagaaaatataacgaagaaacgaagggaaattcatttcaaaaatcgagatcccgtaaatcgacaccagcgctacagtagtcacttaaagaattactgtagttttcgctacgagatattttgcgcgtcaaatatgttgcccaatacgcattctcagaattcaacgttcccataataccaaaacttcttcagattaacatgtctgacactgctccaaatgaactcattggcgttcaatttcacagtaatctgtatgtcagatgtctcagacgattaccatatcactcatccaaacgaaactcattggtttgaagatagtaacatgaaatctctggtattttcatcgatggcagtcggcggcctattaggattattaattgctatgccattaatgcatcgagtcggtgttcgtctagtattgagcatttgtggtgtattctcaatactcggaaccatactattcccgctagctgtcgagtggaactttttcagcgttcttgtagtgcgatttctacaaggattggggattagtatggtctttacagttctgggctccgtgccgacagcatgggctccaaataatgaatctggcacttttttggcagttctatcgtgtgcattccagtggagtaacgtgatctgcatgccaatttctggattcctatgtgaatcatcctgggggtggagatcgatctactacctcttcggaattgtcaccatagtatttttcctggcgttctactttttctacacagattctccgacagatcataggaatgtttcgaacaaagagttaagccttatcttgcaagataagactgtaactcataaggaaccagttccatatttggctatttgcaaggatccttgtgtgcttgtcacttggatgtccaacatcggtggaaacctcggatttttaaccttggtactctacggtccaacctatttgcgtgaagttttgaatttcgaagttcgcggaactggcttcgctagtgctcttccattcttgctctcagcagctgtcaaatctatagccggacagctatcagatcgctgtgattttgtatcagaacgggttagatttacaatttgcggaatcgttgcaagactcggcttggcaatcggttatatcggaatggcaacgacgtcgagcaggctagtggctcaaattgcgttcactttttcgattgctgtatccggactgaacattatgggaacagtgaaatgtctacagctggtcagttgttcgaaattccattctttttctgatcctgcttaatgtctccaactcttttcaatattgactcagcctattaacctctgcacttttcagcgctgcaaacaacatgtgcactttgccgtctccgtcatcgcactcatggcctatgtgattcaattcggcgcgccaatcctcgtcggaatcatttgtccagataacaccgcagaacagtggggatggttcttcttgatcgtcggaattattgtgttcgtcacaagtgcaccctttccatggtttacaactgccgagccagccgactacacgctatccagggaaaaacagttggaaattgcgaaacacaaagaattgcaggaatgttgctga

SEQ ID NO: 29969 - DNA, 1079 bp, Caenorhabditis elegans
atgataagctttcaacttttattaaggatagtggtgctgcattttttaatggtaagttttcggttaatttttaatactaattattatcaaaaaaatgtttcagggacttgcaatggctcaacaaaaacaactgataaaatacttgttcagggactatcataaagaattaaggtttgaaggaaaaatttaaagtaaatgaaaatttgagaactaaaaactagttttgaacttttctcgaaaaaattgtttgagaaaatttaaatttctcgccagaatttttttgagcaattttgaaattcccgccaaaatgttgtctgggaaaatttgaatttccagtgaatattttgcgaaaatttgaatttcgcactaaagtgttttctgagaaaagttgaatttccagtaaatattttcacaaagaaaatttttatttcccggcaaaattttttctcagaaaatttgaatttaccggcaaaaagttgtctcaaaaaattttaatttcccgccaaaattttttctcagaaaacttgaatttccagtcaatattttttcaaagaatatttgaatttcgcgctgaaatgttttctgagaaattttgaatttctagtcaatttttgtgagaaaatttagatttgattttcctggcagcattttcaagtaattttgaaactggcaccaaataaatttaatgtgagaaaattaaaacttctcggtagcattttttgaatacttctgaaattcgcgaaaaattctgcaaaatattttaagtcataaaaaattcgatacggttaatgaatttaatacggtatattatggtcaatttgacaaaataaaatatttcaaacaatttccaggccagtaaaagacgagtcaagtggtccaacaaatgtcacagtccaattatatttcaagcaaattcaaaaagttcacgaaaatgatcaaataatcaccctttactgctggatcgaagaatattggcaggatgagtttttgacatggaatccatcagatttcgggaacattaagtcacttcatgttccgtcggagatgatttggaagccagatttgctagtctataataa

SEQ ID NO: 29970 - DNA, 567 bp, Caenorhabditis elegans
gtcacaaactacacccaaactttatggggtacacttccggagtctgcgaatcgttataatggtatcaccgaagccctcgtcccacttcttggcatcccagctgacctgatcacccgccagctcaacgtgaattggaaccgatggggagaccttctccttgctgttggctccatcggacaagccggcctacttttttggatgtcacaatctcatcatatcgtggtgttatacctgagttacatattctatagagtcatataccagttgaccactacgattgctcagtctacactggccttttccctggactctagactatttggcctactcttcgggattaacacatttgttgctctccttcttcaatctattctgaccgctgttgtcatagattggcagaagctggatattaggccacaggtttgttttgagtatctgaaaaatttaagaaacagtttttttcagtttgtggtctattcatgttatcatcttgtcgttgcatttggatttgctattatttttggaatttgggcgagcaggcggtttttcaaaacgagtactaattga

SEQ ID NO: 29971 - DNA, 266 bp, Caenorhabditis elegans
aaatattctaagctattgcggatatatgtttccagtgttcatcaccggcaacagttgcactcatctcgtagtttgttttttgatgtcctccgattatcggagcactgctatttctgttttctcgtgtgtgtatttcaatcaggtatgttgaaagtgattgccgtgaactcatgccatagaagctagtgtttcaggaaagaaggcatgcgcaaagggttcaggtcaatacatcattgcacccaacagcattacctccagtgaattaa

SEQ ID NO: 29972 - DNA, 718 bp, Caenorhabditis elegans
atgaaacaaggttttttgatctattacagcaggctactattagattttcgcgcctttttttgtagggcacttgccttggcaattttcttcgtgcaattttcaatttgcatcactcaattagttcaaaaactttttatttgcgtcaacactacatttttatgcgctgaacgaggagaaagtgtattcacaatcagttcgcaaacaaagatcatgaccatttttaagatcattgacaaaaactgcatcatctttttgtagtgataacggggggtactaaaatattgagaaatactttccagtctataaaattggaagataaccggaaaattttcattttccacaaaatgtttggaaaactaatttctctgctgggactagttgccctctgctctgcaggacaattctcaatttcagtagaaaaatctggatctcttcgtgagcagctaatccgagaaggacgctacggacaggagcttgctagaatccagcaattgagcactggaaatgtgtcgttctttgaccatttcgatgagtactataccgccggtgttagaattggaactccaggtgagttctcggatgttcggggtgcttcaaaaagaaaacaaaaaatttcagctcaacactttcaagtagcctttgacactacatcctcaaatctatgggtttttggagtcgagtgcagaagtcaaaactgccatggaggacgaggtcgtag

SEQ ID NO: 29973 - DNA, 877 bp, Caenorhabditis elegans
atgactgaaaaactaactattctgttggcactattagtcttctgctcggcaggacaattctcgatatcattagaaaaatctgtacctcttcgtgagcagttaatccgagaaggacgcgagcttgctagacttcagcagttgagcactggaaacgagtcaatctatgatcattttgatgagtattatacggttagtgttagaattggaactccaggtaagctctctagatttcaaagtttttcagggttttaacaaaaaaattcagctcaacactttgaagtagcacttgacactacatcctcaaatctctgggtgtttggagtcgagtgtaagagtcaaagctgtcaaggtcacaggcgagtttcctgatcagttacatgttaaccaagttctcaaatatattagaattcgtgaatacaatcgcacggcttcttcaacatttattgccggaacttcgaattttgtcttgccgtttaatgatggagatgtatctggcgatctaggaaaagataacattcaatttgctggttccaaaatccaaaatcaggattttggaattgggacggatgctaccagactttccggagtaacattcgatggagttctcgggttgggatggcctgctactgctcttaatggaacaagcaccacaatgcaaaacctattgccacaacttgaccaaccactcttcactacttacttcacaaaatctagcgtgcataatggaacggtaggtggtgaaattacttttggagcaattgacaccacacactgccaatcgcaaataaactacgtccgacttgcctatgattcattatggagttattctatcgatggattttcctttggaaattattcaagaaatcagactgatacg

SEQ ID NO: 29974 - DNA, 636 bp, Caenorhabditis elegans
gtcaaggatatttgtcacgtgacgacttcttgaatgtcccagaactagctgtcaatccgcttggagatcgaattatcgacgcatttttcacattaggcgactctgatggggatagcaaatccgggcaattgactttccgacaatttgtgagaattctggcacattttcaaccaatctctaaagtgaaggataatgcgctgaattcgaggaaggacaagcttcgatgtaagattttcggagtagttgtgggagatcagcgggcagtaggggggggggggggggggggttccatgcaggcgccgcgagccacgtctttttatagtgcggcgcaaaacccgaaaagtgtcggccgcggcgaaacaacgaaatatgaatcgaaaaacaaaatttcttccagttgccttcaaaatgtatgacctgaacaagaacaactacatcacacgcgaggagttcaaagtgatcctaaacagtatggtaggagctaacataacttctgatcaactcgacaaaatcgccgacaaaactctcgaggaagccgaccaagatcgtgatggaaaaatttcgtttgaagacttttgtagagccatggagaaaacggatattgaggagaaaatgtcgatgcgatttttgaattaa

SEQ ID NO: 29975 - DNA, 293 bp, Caenorhabditis elegans
attttattgcaatccttcctattctgctttttccattccgtcagtgcacttttgtatgcgtacatgcaacttttcgtcggcacaagcacacttattctaattggacatctgacttggatatgtgatagtggtaatcaagcggtacttttggaagatcttcattaatttttttttcaggctccgtgtgcattgtctatttgacactcaacagaacaatcaggcagtccgtaaaaagattgatatgcccgggaagtcagaaagtgattcaagtcagcagtttgtccaatcgttga

SEQ ID NO: 29976 - DNA, 465 bp, Caenorhabditis elegans
atgcttacccaccacctcaaatcttcaattcacacaaccgctggtcttcgagctgctacgtcagcagcaaataatataataagtcaggcaaatcttcagtcagacatttctaaggtaatttttctagatttatgattatttgtaaattagaaatattctagttttaggtattgttcatcgatgatggccggaagataacttatggtgattttgtgcaacgtgcaggacagtatgctactgcccttactgagaaatacaaaattaaggtactagctctttaaaaatcgccaaaaatatatttttcaagtggcacataaaattttacagaaaggcgaccgagtaatggctcgagtttcaaaaaccactgacacagctgctctgtacgctgcttgtcttcaaattggagcactttacgtaccagttaaccctgcactaactcaatcggaagcagcacattatgttaag

SEQ ID NO: 29977 - DNA, 327 bp, Caenorhabditis elegans
gtcttccctgagccgtatattttcaagccggagagattccttgatgacgatggaaaactgaaaaaggtcgagcaactggtcccattttcagttggaaaacggcagtgcctcggagaagggcttgctcgtatggagctcttcctttttattgccaactttttcaatagatacagggtaaatttttgattgtaataacattgaagttgatattatttgaaggttgttccggatgcaaacgggcctccaattattgataaagctgtgctaggtggcatgcacacgaaggagttcaaggcaattttgcagagacgacatgtgtcggaatga

SEQ ID NO: 29978 - DNA, 370 bp, Caenorhabditis elegans
ctgaaaaatgcgcttgaaacaattttgagcggattatgcatccaaggcaaaccaaaaaactcaattctaccaaatcatcatccctttgaaatatccatcaacacagccgttcgccaatatccattgttcagttcactctatggatgtcgccttggtgatcgaatgtttgctgaaccggtacggaatttaagatgaaaaaaggaaaatacggtataggtatctatttttttaggaaaagttttgcaatccactgggaggcgacgtgaacttggaggactataaaatcaagaatgatactgaagatgtcggtggattcttcaattatataatggatactgcaaatgcgtttaatttttcttttacgaattga

SEQ ID NO: 29979 - DNA, 365 bp, Caenorhabditis elegans
ctgaaagaagccctggaaactgtaatcggaggtctttgcaagcacactggtaggaaaaacgagttgatccccgaccatcatccgttggaaatttctcgaaatgcggcagtacgtcaatatccgttattcaactcattgtatggatgtaaggcgggagatcgtatgtttgcaaaaccagtgcgttgtaccatttattaaaagtgcaacttttataatctttacagaatgagtattgcaaaccactaggggatcccatcaacgttgaggattttctgatcaaaaacgaaacacggaaagatgccggtggattctttaaggacgttctaaacacggcagagcgttttaattttacctatggcctgtaa

SEQ ID NO: 29980 - DNA, 439 bp, Caenorhabditis elegans
ttgaaaaatgcgcttgaaacaattttgagcggattatgcatccaaggcaaaccaaaaaactcaattctaccacatcatcatccctttgaaatatccatcaacacagccgttcgccaatatccattgttcagttcactctatggatgtcgccttggtgatcgaatgtttgctgaaccggtacggaatttaagatgaaaaaaggaaaatacggtataggtatctatttttttaggaaaagttttgcaatccactgggaggcgacgtgaacttggaggactataaaatcaagaatgatactgaagatgtcggtggattcttcaattatataatggatactgcaaatgcgttagaacagaaaatagcaagtgcaaaagaacagaagatagcaagtgctttcttttgctttatttcttttttccagcaattgccatccgactga

SEQ ID NO: 29981 - DNA, 365 bp, Caenorhabditis elegans
ctgaaagaagccctggaaactgtaatcggaggtctttgcaagcatactggtaggaaaaacgagttgatccccgaccatcatccgttggaaatttctcgaaatgcggcagtacgtcaatatccgttattcaactcattgtatggatgtaaggctggagatcgaatgtttgcaaaaccagtgagttgtatcatttattaatagttcaactcttggattttttacagaatgagtattgcaaaccgttaggtgatcccatcaacgttgaggattttctgatcaaaaacgaaacacggaaagatgtcggtggattccttaaggacgtgctaaacacggcagaacgttttaattttacctatgagctgtaa

SEQ ID NO: 29982 - DNA, 787 bp, Caenorhabditis elegans
atgctagtctggatccttgcaacgacttctatgattatgtgtgctcaaatgacaccagaagcatcactaagcttaacttcacaagtttattcgaggatcgtgagatactggtagtaggctcccagccattcatataatagtacccaacaattttccagaatccgaacatctcattttcgaataacggttcctacaccacattaaatcaaattcttgagccggatcgcttaatgaaatggtatatgacagtcaaatcattggatacggccattgtggatatggaatattttttcgaaacgcattacgaatatattaaaaagaagaacaattctgagaaattcagttttatggtggagaccctgaaaaacgttaatctgacggtaagaaaatcccgtaaattttaagaatatgtcaaatttcacgataaaatatttttgctagccctagtttcaaaaaaagcgagtgaattggattttcttctaactctaaagagaaaatgtaatattttttggaaagaatttagttttctaataacaatttgagagcgaatttcacatactacattttcaatattttttatattccagttgacaaatattttctacaattctctctacgccaatattgaggtcctcaaccagcttaatctcccagcctccgaagaaaacaaatttcttcatcatatcttcaatatgttaaaaaataatactatcgaggagatttggagcagttctttctctgatgaaagtaaaaaagagtttgacaaaaaaaactggaaaattcaaaa

SEQ ID NO: 29983 - DNA, 570 bp, Caenorhabditis elegans
atgaacttcctgctggtactgacactaattgtgactataagcgtgcagagtagacaagatgtgagttttttacattaaattactgaaaatgtttatttttttgtttcaaatttcatagatttaacatataatttgttgctattctgacaaactttgctaaacaaactacaaactacaaaatgtattcagaatgttagtttggatccttgcaacgacttctatgattatgtgtgcacaaatgacactagaattatcactaagctaaacttcacaagtttattcgaggatcgagagatattggtagtaggcttcctgccattcatcctatagcacccaacagtttttcagaatccgaacatctcatttccgaataacgggacctacatcacattagatcagattcttgatccggatagcttgatgatatggtatttgaagatcgaattattgaatacgaccactgcggattttgactatttttttaagatgcatagcgaatatgttaaaaaggagaacaaatcggagaagttcagttttgtgatggagaccctggaaaacgttaatgtaacg

SEQ ID NO: 29984 - DNA, 314 bp, Caenorhabditis elegans
gcgactcctcactgatcatctcccttatcaaaacttgctgtatgtgcattttgggatggacgtccggattttgggtgtgcagcaccaaaactctatcgtcgtggaaaaatgctatttgctgtttgggtaagttgaatctagcttgagtttaaacaagttttattaatttaataattttaggttcctcccgatctttacccaaataccaaccggcagacatactttacgctaaatctgacatgtcatcctcacaattctacaacacaagtctccgacacaaccatctttacggaggcattcctgacaagctgtag

SEQ ID NO: 29985 - DNA, 619 bp, Caenorhabditis elegans
atgcgatttaaactggttggaatgacgtcgatgatgatcaaagtgtatgttcataataaaatatttcaatgtaatataaattttaaaaattttagaaaatacgagaaaatcttcccaacaacccaacagtacccgacattcttttgatggagcgattcttgattggaaagttcgaatttgtcgtcgctaagcccacaccatcttggctcggatcatgctttgcaaagagaattaaccttacaaagtaagttttaaaatcataattttttagctcctttggaaaaaaatagcggttcctctcaactttaacgttaattttttacagaaagatgcggaatgatgtcaaactcctcgagctgtcgccgatagatgctcattttctacgttaccgcccatctgatgctgcttagaatcaccgaatcaacaattcgaccaagtggctgctaatgatggatccaaggaatcgggaatcgagacgaggctcacactaagccgaaatattaaataatatttatgtttttttcccttttttcagatttattttttcatttttcatgttcaataaacacaatttttctctttttgtattaacatttaataacaaaaagcagtattcccg

SEQ ID NO: 29986 - DNA, 291 bp, Caenorhabditis elegans
acaattctcgcacgttgttattaccgcgattcaatggatgaagtgtttggctctatttgtagcgccggctcttgtttccatttttgtccacgaggagtccaacaggctgcaatggatttgggtatttctgatagttggtggcctaatgattattgtacgtttttttttcgaaaagtgaactttaatttctttttttttcagacaaatattgtggcattcttcattttaaccgataagccggcgagctggacgggaagtcttgaaagtgaagaatcactagaaaaattataa

SEQ ID NO: 29987 - DNA, 278 bp, Caenorhabditis elegans
gcaattcgctcacgtggtgctcaccgcaatccaatggataaaatgtttggctctgtttgttgctccggcacttgtatcgatttttgtcactaatgaatctattagacagcagtggatttgggtatttctgatagttggtggtggtatggtgattgtaagttcttaaattcttaaaactttttaaattttattttcagacaaatatcctgggcttcttctttttaacggataaaccagctgagtggactgacacagacgaacctttagaaaaactttaa

SEQ ID NO: 29988 - DNA, 1550 bp, Caenorhabditis elegans
atgtttttcatacttgttctagtgctaactggaatttccatctaccttttccatcttttgtactggaaaagaagaaatttaccaccgggacctactcctctcccactgttcggcaatactctcccaactttgttcgatattccgggatataagacattcggaaaattgaaggagcaatatggagatgcatacacgttttggatgggtatgtagtctatgttttccttgaagtcggagtatagtcagtgagaattttgtctaactgtgcaaatagtagtacaaaattatcaatgtcataatagaacacttcaaaattttatagattctttcaattttcagacaaaatttttgaaaattctgttttgctctgacaacttttagaaagatttaaaatattccaaaagtttctcttggaacattagagtacttgctgataaactcgagaaactttgagattcgttttgtaaacttgagaattttttgcaatttttataggcaaagacccatatgtcatgatttgctcctatgatttattgaaagaaactttcattcgagacgcagacacctacaaggacaaagactacaacccgattgatgagaaaattcgtggaggtatctatggcatcctacagactaacgggcatgtttggaacacccatcgtagatttgctctcaccacttttcgggatttcggacttggaaaggatttgatgcagcaaaaaattttgatagaagttgaagacatgttcagaaaattagatgaaaatattggcgaggagcaggatgttccaacggttctgtataatgctgtggcaaatgtcattaaccaaattatttttggatatcggtttgaaggagttaaacaggaagaattcacaaaactcaaggagttaatggagtacctagaaactgcatttgccacattgaagatctacgtggaaatttttgtgccctggattggaaaattgctccctggaaaatcgctggatgatgtgttagcataaaaaaataattgaaagttattttcttatgatttcaggctcaactactggaaggacacctcctatgaatttttcaattcgcaaattgaaaatcaccgtctgaaaatcgactttgacaccgaggaaagcttagactatgccgaagcctacctgaaagagcagaagaagcaaaaggctcaaggagaattcgagttgttttgtgataagcaactttcgaataattgcctagatttatggacggcaggcttatctaccactattatcacaattaactggaccatctgctacattatgaatactccgggagttcaagaaaaaatgcaggaggaaatggataaggtggtgggaggtggtagattggtgacaacagctgataagaatgacctaccatatatgaatgcggtgatcaatgaggctcagagatgtgggaatattgtgccgctgaacctgttgcattgtacaacaaaggacactgttatcaatggttattcagtgaaaaaggggactggagtcgttgcgcagatcagcacagttatgtatgatgagaag

SEQ ID NO: 29989 - DNA, 1053 bp, Caenorhabditis elegans
cctcgagactcttgccgtagacctgtatgatctatggctggcaggacaggaaacaacttcaacgacattgacatgggcatgtgcctgtcttttaaattacccggaagttgttaaagaaattagaaaagaattgacagaggttaccggtggaacgcgaagtctatcactaaccgataggccaaagacgccatacttgggcgcaactatcaatgtaggtgttagccattattttgaaatttctgtgatttttttcaaatcaaaattttctaaaattatatttcctgggaaccctttgaaatatttttatgaaaacctacataggtcaactaggtaatttcaaattgtttgaaccataaattaattgtgtagtttttaatacagactgtaaaaattgtaagcgtgaagcttatagactccaatctatttatatttttgcaaaaaccgaaagttctcaaattgctgttattaaatcagttgccattagaacttcaagttgtgtgtaaaatttgtttaaatggaaattgtattttgacaatctaggtactttgcaaactgtattttttgagttcagtaggtttttttttgtttttccaggaaatccaaagaatcgcttcaattctaaacgtcaacattttccgcctaatggaggaggactcgatcattgaggggcagccaatatctgctggagccgttttgactactcaacttgccatgcttcataccgatgagaagacgttcaaaaatcacacagagttccgacctgaaagatttttggaaaataataatctggaaaaacggctgattccatttggcatcgggaagagatcttgtcttggcgaatcactggctagagctgagctgtatttggctagtgaaatgtgtgtttttgatactttaaatgagtttttttcttttcagataacaggaaatatgattttggatttcgattttgaatcggttggtgctgccccaagaattcaaacaccaactccgtttgcactaatgaaaagaccgccatcatatgatatcagatttattcctcgttccaaatga

SEQ ID NO: 29990 - DNA, 1650 bp, Caenorhabditis elegans
atggtttcatctgatgttccaaagactcaacgcgctcttatttttgaatcatacggaggtccacttgaaatcaagcaacttccgattcctcaacccaatgaggatgaacttttggtgaaaatggaatattctggaatatgccattcggatgttcatacgtggctaggtgactttcattatgtttccaaatgtccaatgattggtgggcatgaaggcgccggcagtgtgatcagcgttggatcgaaagtaaaaaattggcaaatcggagataaagttgggattaaggtaagccaaactcttaactcctcaagcttgaactttaatatttttcagttggtccaaggaaactgccttaactgtgagtattgccaaactggacatgaaccactttgccctcatgtctggaacattggagttcaaaaatatggaaccttccaagagtacgctactattcgtgacgttgatgctatcaaaatcccaaagagtatgaatatggccgccgctgctcccgtgctttgtggtggtgtaactgcgtataaagccctaaaggagtctgaagtgaagtctggacaaattgttgcagtcactggagctggtggtgggctgggatcttttgcaattcaatacgcaagagctatgggaatgcgagttgttgcgatagatcatccaagtaaagaggctcactgtaagagtcttggagcagaatggtttgttgatgcatttggaactgaggatattgtggcacacattcgagaaattactgatggtggagcacatggtgttgtcaattttgcagctgctaaggtgcccatggagaaggctctagagtacgttagaaaacgaggaactgtggtgtttgtaggacttgcgaaagactcaaaggtaagcattatctgattgtgagatagttgttttttaaactgaatagttttttctgtagtttaatattcgacttctagatcacaaaagaggaatctaatgctagtcgaaatctatttagattaaataataagtttttggtcttaatccatcagtacctcgtatacgtcacatcttttaagttctaagtcaagaagtttctttaaagttgattcatagaacgatgtgtaaaactcatgaaactcaatatttttcaataactccaagtaaatgcaaattttccctacaagatgtaccagccgcacaaatatcattttttaacaaaaaaaacacctagttatttttacatttttgtaatgcatttccgacgtcaaactaccaaaaacacgtgtagcaaacactttataccttcaataatatatcagtaatgtctgtaaaaatacggtagaattatttcagctaattgtgcacataaaacttttactatttttagattctcgtcgacacaatccccctgattttcaacgctgtaaaaatcaaaggatcaattgttggatcccgattggatgtcaatgaggctatggattttgtggctcgtggagccgtcaatgtcccattagagttggtgaagctggaagacgtcgccgaagtctacacaaaaatgcacgatggaaagataaattctcgggttgttgtggatttctctttgtaaatatgtatatttttcagcaattattgtcggtttttttaaaccccataatttttttatcg

SEQ ID NO: 29991 - DNA, 1315 bp, Caenorhabditis elegans
tacatcaacaatcttgacgacaacccaactttcaatggagttcaatccgccgaactggaagttctccgtcgcaaaggagacaactacgaaactcttgccgcctccatcgctccggaaattttcggccacgttgatgttaaaaagtgccttttgatggctctcgttggaggaaatgacaacagctcgaacggaatgaaaattcgtggatgcatcaacgttctgatgatgggagatccaggagttgctaaatctcaacttctcggctacgtgaaccggttggctccacgatctcagtacactactggtcgtggttcttctggagttggtctcacggccgctgtgatgaaggatcccgtcactggagagatgtctctcgagggtggtgccttggtgttggccgacggaggaatttgctgcattgacgagttcgataagatgatggatcacgatagaactgcgatccatgaagttatggagcagcagaccatctcgattgccaaagctggaatcatgacgacactcaacgctcgtacggctatcatcgccgctgccaatccagcctacggaagatataacccaaatcgttccattgagcagaacgttgatcttccagctgcacttctctcccgtttcgatttgattcttctcatgcaggacaaggctgatcgtgagaacgacaagattctcgctgagcacatcacatatgttcatcagcacggttgccatccaaatcgtgagaagaaggatctcatctcgcttgagacacttcgcgagtacatttctctttgcaagacgtatactccaactgtcgatccagctcttcgagaacgtattgtcgaggcatacgttgagatgcgcagagatgctagatattcgtccgatccaacatttgtgtcgccaagaatgattctaggaatcgtcagaatggcgacagctcgtgctaagcttcgtctatccacgattgtcgacgaaagtgacgttgaagaagctctccgtttgatgcaattcgctaaggactcgctcagaccagaacagaacaaaattgagaagtaagttttcagaaaattatttatagcgaatattttaatcataaaattattttcttttcaggcgcatggctccagtcgatgctgcattcgccgttcttcgtgagctctaccatgccgacaacgccccgatcgccatctcaaacgccattcaaagatgcgctcgcaagggaatcagcgaggttgctctcaagaaatgcctggatcaatacactgctaacggtctcttggtcatggatcgccagaacattgtgttcgctatgaattaa

SEQ ID NO: 29992 - DNA, 949 bp, Caenorhabditis elegans
atgaccgtagactctattccattgaataccggagctcagcttccacttttcggattgggaacgtggcaggtgaaggatgaagctgagctgactgtggctcttcgtgcagctcttgatgctggatacagacttattggtgagtgctgtcctagatggaaaccataatttttttttagtcatgttttcttttcttcttccatttgagatgtcacaaaaaaataattggaaaataaaaaccgatttaaaaaatgttatttttggccaaaaacggaaaactcaaaaaaaaagtggtggcttgctcaaaccagttaattaaattttttgcacaattgaaaaaaaacattaaaaattttgaaatttttttccaacattttttacattcggtaactacgacccattttcaaaaaaccgacaaactttactcacacctttaacttcagattttcccattcaaattctaggtatttttctactttttgacacaaatgttgagattttttacggtgtccagtttttcgagttttcgaataaaaccattggcaaagttgatccttggagggcagttttgacaacgttttgacaactgaaaatcccattttttcaatattcagacactgctcacctctaccaaaacgagcacattattggaaaagtgctccatgagtacatctcatctggaaaactgaaacgcgaggacatcttcgtcacctctaaacttccatttaccgctcacgccccggaagatgttccaaaatgtgtggaaagccaattgaaggcgcttcaacttgagtatattgacctgtatttgatccattgcccattcccattcaaacatcaggagggaagctttgctccattgatggagaatggagagcttgctgttacagaaatcgctcatattgatacatggagagcgttggagaagttgtacaaggagggaaagcttaag

SEQ ID NO: 29993 - DNA, 2690 bp, Caenorhabditis elegans
atgtcatctctatccattccacgtcaatctttgtattatgtgaataaggtgaccgagggacgatcggtgtccaatgttcaagttgtgtcaccgtgtcagaagcaggggtaagatgtgttgattggcgcgcgtttgcaacattgagctgatttttcgcacgtggtgccaggttgtcccattacggtttgatctacaaaaaatgcgggaatgtttcgccaaaaaaaaaaagtgacgtcgacacgttcttaaccatgtgaaatcagttgagaactctgccgcattttttgtagatctacttagatcaagccgaaatgagacaccacgtgttttcggtcggtagagcacatattatgccgacgttttttttcgaatttttcatgggtcttgccgcgaaatcgtttttttacagagaaataccgccaaaaatacggtacccggtctcgacgcgaaagttttttttttgccaaatgcagtgcgcctttaaaaagtactgtaattccaaactctcgttgttgcacaatttttatagattttgcatagttttactggcgatttgttaaaaggttttaaaaatagtttttcaataaataaatacacttttttttgaaaaaaaatcgataaaagtttcataaaaaccgcattaaaaatactatttatgatctcgaattttttttctgtggatttttttgataaaattatatttatttattaaatagctgaaaaaaacaacaaaaacacataaattttcgaaaaatcgtgagaaaaaccatgaaaaatcaaagaatgtattcttaattaaggttatttaattaacgaaagttcgaatctacagtactctctttaaaggcccacaccttttcacatatagccaaaaattgtcgtgtcgagaccgcgtaccgtattttttgcgcaaaaatctcaaaatttcgcgtctagataatatataaagaaaaaaaactaatcaagtccagttcgaaaaaaaaacatggaaaacatagaaagtttaatgccaaattatttaaaattttataaatttctagaaaaatagagttagaattcctaggtaacgtaaatgcgccccaccgcactgcatgaactctttgtagattatataataacaagcctttcagaaatttttcgaattaaaaaaagtattttcaaaaagtggtagttacacagtttttgccacttttttggaagttgtagatcaaaaacgaattttgtttgttgaacttgaattttattgcctgctaatatttattcataggttcgaacattctacagtaatatagttttcttaaaaagtggcaaaaactcagtaattgccactttttgaaacaaaataaatacttttgataattcacattcaccttcaatatttaaattttcccattccagacaaacctacgtgaccgccttcacaccgctcacctccaacgtccaagtccacacttcgctcgagcaattgagcactattcgcaacgccgatgtgctcattttcaacaatgctctttcacaggtagcatcttttgatctcttatcatatcttattcgtaaatcacgccatttggggcttaaagatatgaatagatgtatccaaaatctacagaaaaagatagatacaaagttcatttcttcacttgcttttttcattttttttttcacctcaaatcaccccatctctactatcatatcatcaacacaaggtagttaaaacagatacaattggttaatgtttttttttcctcttgttatcgctatcataaagtgtttgataagccgtgaaaggggcaagtggtcaaaacttggaaattaacaagaaaatgatgggaggaaaaataaggcgagtcaggggcgcctatcggaggcgattttcgggctaaaaatcatattatgggaacgcagaaaaattccctttggtaacgttgtgaaaacgagctccacggtcaatttaaatcaatttaagctggtcccgaataatgggtctcgttaggttttatgtttccatagtttttatcaattttcattttgaaacgatgcttcccagctccatctgagcctacgcctatgcttaagcctaagcctcagcattagcctaagcctaagcctatgccttagcctaatcctaagcctaaacctgatcctatgcctaagccttcgcttaagcctacacctaagcctatcctaagcctaaccttagcctaagtgtccgcccaagcctaaacctaagcccaatcccaagtctaggacttagactaggcctaagcctacgcctaagactaaacgtaagcttaagcctaaacctacgcctatgccaagcctaatcctgagcttaagcctaaacctaagcctaagcctaaagtgcatttaatgttgaaaagtgaatgtcgtttttattggaaaatgttcccatcaatttcggctcaaaaacgaccagaaacatttcaacaagatgaaattttctttgatttttaaaaaacctaacgagaccctcggtttgggggcggaccgtattaaattagccgtggagcgcgtttccatgtcgatattacaagagattgataaaccatatacaactgatataacacatttccagattattaccaacgccgatctcttgaccgatttcttgaagaacgccacaaacgccaccgccatcggtggaaccgttatcatccgtgaggatctaa

SEQ ID NO: 29994 - DNA, 854 bp, Caenorhabditis elegans
attccaaatgtacgatgggaagatgttggaggtctcgaagagacgaaacagaccgtcctggaaagtatccgcacaaatttatttggctcaagagctcttaaaagatctggaattatactttatggctcccctggttgcggaaaaactctcattgctaaggcagtggcaacggagtttaaaattgcattcttatcagttaaaggtccagaacttctcaataaatacgtgggacaaagtgaagagaacctgcggaaagtcttcgaaagagctaaacaagcttctccgtgcgtaattttctttgacgaaatcgacagtttggctccgaatcgcggaaggaatggagattctggaggggtcattgacagaattgtatctcaactgctcgcggagctagacaaacttcataactccccactaactaaagtttttgtaatgggagctacgaatcgtccagatttgctggataattctctaatgactcctggaagatttgataagctggttgaggtgaagcctggtgaagatgtagagtcgaagactaagattttggaagcagtctcaagaaaaatgagattcgaagaggatgttgatttgagagaaattgtgagttcttttttttgaagcgttagaaaatttttttcaactaaaaataaactttgcattttcaggcaagtaaagttgacgaaaaaatgtccggtgcacaactattctccataatttctaacgctggaatggctgcaattgtggaaacgattcaaagtattgaggacgggaagactgaaaatcaatcaatacgggttgctcagagacatcttttggaaagtgtgaagaggtttcatgaaactaaatattag

SEQ ID NO: 29995 - DNA, 2329 bp, Caenorhabditis elegans
atgggatccgtcacttctaagaccaacgatgagctcgaatcgtttctaaacaagagacttggtggcagtgtatgtttacagtgtgggaaatataggcggcacatagagaggaaagatcagcgagaaaatggagaaaaaaagaggcttttgtgtttgtttaaagcgttcgtctagaatataacagaatagtttgtaacttttggaaccattcttcctagaaatcaaaaattaatgtagaaatgtaagaaaatgtgcgaaagatctaaaaaaataatatttattttgttgaaaaattcgaaaaatacctgaaatagggcttaaaactcgactttcaggcatttttcgaacttttccgtaaaataaaaattatttttagatcgagcaaacatttttccacatttctacattaatttttgattcaaaaagttaggttattatcgtttttcacttgattttggcatggattcttaaaggcgcacggatttaatcaaatgggtctcgacgcgaaaaagtttatggtagtttgcgggtgctttctcgtttattttttattgcatttttcaatggaattacttcgtttttaccgtagttttttaattttccttacattttacttttaaaaattgtttaaaaatcagttttaaaaggtacacatacactctttttccattaaaaatttatagtttttgcccgaaaaaaagatagaaaactgatttaaaacgatttttaccagtaaaattttttttgaaagaaaatgaaaaaatcactaaaaacgaattaaaatgcaaggcaattgaactaccataaactttttgcgcgccgagacccatcttaataaatctgtgtgcctttaaacaggcatgttcaaaattccgaaatttttttttaaaagcgagctatttaaatagtttcgctaaaatctccaattttggctatttttccgtgtcgctgcacgtaaaacgagccgaaattgaagatttcagctgaaagtatctttttttccgaaattttgagtttttcgtccccaaattcggcaattttggcgaatttagaggatttacaagcatgaatcttgtgaaattaatatttaattttctatgtttgtcgcttcgattcatttctctcgtcctgcaaatcgttttttatcaaattgaacacaatttgtttgttttcccgttctgttgatttgtttttctgtcgaaaaaaaaacataaaaatcagcctgaccgctttcagtttttcttccttttttcctttttcatttttataatattattattttttgcagatgacgtcttccaacaagactgtgtccgtcttactgggtgctcaatggggtgacgaaggaaagggaaagatcatcgactatctgatcgagaatcacaagatcaatgtgaccgcccgatgccagggaggcaacaacgccggacacaccgtcgtcgccaacggacggaagtatgatttccacattttgccgagtggaattatcagtccaacatgcttcaacgtcatcggaaatggagtcgtcgtcaatttggacgctttcttctcggaacttgctcataacgggattctcgaggagtcgggatgggagaagagaattatgatctccagcgaagctcatcttgttttcggtgttcactctcaagttgacggccgtcaagaggattcgttggccgccaagaacaagatcggaaccaccaaccgtggaatcggaccaacctacagctcgaaatgcttcagaaatggaatccgtgtcgccgatcttatggctgacttcgaagagttctcggagaagtatcgccgtctcgtcgagcactacaaaaagcaattcccatcgattgaggtcaacgttgatgaggagctcgccaagttcaagcagcatcgtgagaagctcgccgagttgaagctcgtcggcgacaccgtcggattcatccacgagcaacgcaacgccgggaagcaggttctcgtcgaaggagccaacggagcccttctcgacattgattttggaacctatccatacgtgacatcttccaactccaccgtcggaggtgcttgcacaggaatcggagttccaccaaccgccgtcggaaacgttatcggtgttgtgaaggcttatcagacccgcgtcggaaccggtccattcccaacagaattgttcgattctgatggtgagaagcttcagacgatcggaaaagaagttggagtaacgactggacgtaaacgtcgttgtggatggattgatcttttcttgctccgtcgctcggcgatgatcaatgggtacacagcgatcgctctgacgaagctcgatattcttgatactttccca

SEQ ID NO: 29996 - DNA, 1383 bp, Caenorhabditis elegans
catcgctgtctacgatcttggaggtggtactttcgatgtgtcaattcttgaaatccaaaagggcgtcttcgaggtcaagtccaccaacggagatacattcctcggaggagaagacttcgatcacgctctcgtccatcacctcgttggagagttcaagaaggagcaaggagttgatcttaccaaggatccacaggccatgcagagacttcgtgaagccgccgagaaggccaagtgcgaactttcatccaccacccagaccgacattaatcttccatacatcaccatggatcaatctggaccaaaacatcttaacttgaagctcaccagagccaagttcgagcagattgtcggagatctcatcaagagaaccattgagccatgccgtaaggctcttcacgacgctgaagtcaagtcctcccaaatcgccgatgttcttctcgtaggaggaatgagcagaatgccaaaggtgcaagccactgttcaagaaatcttcggaaaagttccatcaaaggctgtcaacccagacgaggccgtcgccatgggagctgctattcaaggagccgtcttggccggagacgtcaccgatgttcttctccttgatgtcactccactttcccttggtatcgagactctcggaggaattatgaccaaactcatcaccagaaacactaccatcccaactaagaagtcccaagtcttctctaccgccgccgatggacagactcaagtgcagatcaaggtgttccaaggagaacgtgaaatggccaccagcaacaaacttctcggtcaattctcgcttgtcggaattccaccagcaccacgtggtgttccacaagtcgaggtcacctttgacattgacgctaatggtatcgtgaacgtttcagccagagatcgtggaaccggaaaggaacaacagagtaagattttcttctaattgatgtagtttttgtacttaagattttaagatttttgttttcagtcgttatccaatcttctggaggactttccaaggaccaaatcgagaatatgatcaaggaagccgaaaagaatgccgctgaggacgcaaagagaaaggagctcgtcgaggttatcaatcaagctgaaggaatcatccacgacaccgaagccaagatgaccgagtttgccgatcaattgccaaaggacgaatgtgaggctctccgaaccaagattgctgatactaagaagattctcgacaacaaggacaatgagactccagaagctatcaaggaggcttgcaacactcttcaacaacaatcgctcaagcttttcgaggctgcttataagaacatggctgccaagaactctggaggtgacgcccaggaggccaagaccgccgaggagccaaagaaggagcaaaactaa

SEQ ID NO: 29997 - DNA, 525 bp, Caenorhabditis elegans
atgattttccaaatgtacgaatctcaatacgaggatctccgcggcaccatctatggtccaagctctccggattttcatccagttcaggcttctgagacattgcgctcttcgcttcacggacttggtagcgtcatcatcatcatgcgcaaatttaatataattcaaaacatttcatttcagaaaccaaggatcaaacgattatcaacaccgtcttatatcacaacaatttccagcgtcagaagatcttgggtgcctatgaagacatgtatagcagggtgagtgaagactttgcagaagctagctacacgatttctattatttgcggcaatataagattaaccttgctatttccagaagctccttgaagacttggaagaagaatgcggtggatttttcttcgaaatgtgtcaagctcttttcaaaccggcgccaaactacgatgctcaatgcgtctacaaatccctgtcaaatcgccatggagatcgctctgtcgccattgaaatcgcatgcacacgatcgccacga

SEQ ID NO: 29998 - DNA, 1122 bp, Caenorhabditis elegans
atgagtgagttttatttttaaattattttcacattgaaaaatatttattttcattttttcagcattacttttcggggtgaaacgatggcttcgtcgcggcgatgaagcttctgattcaaaagctgatgccagcaaagaagtgaatcagcagaatttatctctgtaagtttttaaaaaaatttactcgaaaattggatttagtcgtaaagaattttgttttaacccccaaaatttgctcaaaaatttttacaagcactcaatttttaaaattcttttaattatgtatattcaaattttgatttttatagttaagtactcgtacatattcaatcacatacttttttaaaaatcgctcgaaattgaacaaattaatttaaaatatagatacagctgagttaacgaatatagcagatgtatttattttcacaacatttatttcgtctttaaaattttttgggaaagccctacgtgttgctctctaaaacttatcctcttgatgttgtcatacctgacactaaccttatcagttggtgagcttcaagcattactgataagcagcaaataaacacggaatgcaaaaaaaataaaactgaaaccgaattgatactgtaggagtagtgtataagaaactttgaagcggaagaaaattatgattcaaactttaaaaattcaacatactttgttattgtttttaataaagcactgactatgcgtaacaaaatttcggtttaaaagttttattttttttacttttgaatcagtttttctgattattatgcttttgaaattgttctctaactgttttcaaaatgggaaaaattctgattccgatagttatactagtcttcaaagagatttgtcagggtgagtttccaaacttttctagaaataatggataacattccttattaaccttaattccagatcgttcaatgaacatcatttggacatgaggcaactatctgaaaagttctcaatgtcgaaattggatattgttgaccccaaggtttctcgaggattgagcaagcaagtagctgcggagaggcttgaaagtgatggaagaaatgctctatcaccaccaaaagttatcagtaattggaaattgtttttgcgacaattcaa

SEQ ID NO: 29999 - DNA, 506 bp, Caenorhabditis elegans
caaaaagagcgaagagacctgttgaaaaaggcttgtgaagcacatgtggagaattgcaaagaggttatgactggaaaaggagtcgataggcatttgtttgttctttgtgttttggcaaagggactaggatattcgagcccgttcctggaagagtatgctaatcagaaatggcttctcagcactagtaacgtatgtttatggtgcatcgattcaatgattaaatcataaaagttcagatcccaaacatgacaaactcagttgacgaggatatttccgaagacaacattatgctcggagcatccttcggcgcagttgcccaagatggatatggaatttgctatcggtttgcaggaaatcgagcgataatggttcacatcacttcctaccactcatctccagcaactgattctgataggtttggtcaacatttgcgtgaagcaattcatacacttgccgatttgttcgacgatgagccaagcaataataatgtgtcgaaaaatgtttaa

SEQ ID NO: 30000 - DNA, 254 bp, Caenorhabditis elegans
tccataagccaaactctatttgttcttgcaatcgtttgtagttttacttggggtccgcgttttattccagacattgattacacctttattttctcttctattctctggtcttcagtgcatatgtttgatgggtaattgtaaatattctaaatactcaaaaagttctaatttaggtttttcacattgattttcaatccagaaatccgaaggagctgttccagaagcggccagccactggcattcaacgttgttag

SEQ ID NO: 30001 - DNA, 644 bp, Caenorhabditis elegans
ctcaaattctgccagtaggtggacaagttggtggtgggcaaagattgccatgccgtggacgaaatgaagaatataagacttgtggaaccgcctgtgagccatcatgcaccaatccgaacccggtaagctatctgccgactcttcgggtatttctgtgcaaacaccgtcacgcgaaaattctgcacgcctaagtttgatctacaaaaaatgcgggtttttttcctagaaaattgtgacgtcagtacgctcttaaccatgcgaaatcatatgagatgtatgcgtctcacctcccgcatttttcgaagatcaaagcgtgtttttagatgtgcaccaagcaatgcatcaacaacgtctgccaatgcagaagcggatacgttcgtaacgagatcaccagacaatgtgtgcgtcaagctcaatgctccagacctggaactggtttcggaagctccactccgttcccatctcaatctcctcagagatgcggacgtaacgaaacattcagaacctgcggatcttcgtgtgagccgagctgtactactccacgtccacaagcgtgcactatgcagtgtattgtgaacgtgtgtcaatgctctgagggatttgtccgaggaccttccggatgtgtcagacaacgagattgttaa

SEQ ID NO: 30002 - DNA, 492 bp, Caenorhabditis elegans
atgtctctttcattttactggggaattggttgtctactactttcgattgttgaaggaggatttttggttaatttgacgccggagaaaaactctcaaattttgaatgcaccttgtggaccaattagaggaaatatttataaacataaaaatgtaagtaacaatttgttaactccataatccataattgaaaacttagggaacaaaaatagttgatggctatcttggaattccatttgcaaaagcaccagtgggagctttaaaattcaaaaaaccagtggcagcggagaagtggacagagccaagagattgttacgaatatgggccgggatgtcctcagactggaagatttgcagctgtaattttatatatggaaatattccggctaaaaaaatttcaaaattccagctaactgcaaaaagtactgcagcatttgccgaggaaaattgtctcactttgaatgtttttgcaccgagatggaagttggcggaattt

SEQ ID NO: 30003 - DNA, 763 bp, Caenorhabditis elegans
atgggaggatttctgtcacatttgaaaccggaacaaaactcgaaaattttgaattcgacctgcggtcctattcgaagaaatatctatgaacatgtaagttactcttttttagaaatggttttgaatttttttcagggtgagaaaattgtggatggatatctaggaattccatttgccaaagccccaattggagaacttcgattcaaaaaaccagttgaagctgaaaaatggacggagccactggattgctataaatatggacccggatgtccacaatctggatatctcggtgctacgttagttccaaaaggttatgttgagctgaatgaggacaactgtttaactctcaacgtttttgctccaagatggaaggttactgaattggtaaggtggcttcaaatctttctaggaaataattttcaatttcagccaaaaggtctccctgtgatggtttatttttacggtggaggttttgaaattggattctcatctctttataacgactactcgctaactggatctctcccactcaaagatgtaattctagtcacatccaattaccgtgttggaccacttggtttcttcactaccggggacgacgtggcacgtggaaactatggttcatgggatcagactatgactcttcaatgggtgcaaaaacatatcaaatcatttggaggtgatccagataatgtaacaattttcggaacaagtgcaggtggagctagcgtggatttgttatcactgagcccacactctaaca

SEQ ID NO: 30004 - DNA, 676 bp, Caenorhabditis elegans
atggtgagttgtaaattttaatagaagaaataaactttttagatggtttcacaagctactaatcatgatttcgctgaagataattgcttgaacctcaacgtgtttgcaccaaaatggaaatctgccgaattcgtgagctcacttctaccgttttcaatgtatttattctgatttcagccaaacggttttcctgtaatggtttacttctatggtggaggtttcgaggttggattctcatcgatgtttgatgattattctttaactggaactcttccacttaaagatgtaattctagtcactcccaactaccgaattggacctctcggatttttcgctactggagatgacgtgtcacggggaaactggggattatgggatcaagctttggctctacagtgggtacaaaagcatatcaaatcatttggaggagatccgagcaacgtgacgatttctgggacaagtgccggtggagcaagtgttgatttcctgtctctgagtccacatgctaatagtaagatttattgggaataatggaataaagccaatcatttagaatacttccataagttcattcctatgtctggtgcggcgacctgtccatttggtatccgttcgaaagatgttgagggattaattttccgagagtttgccaagcaccatggctacgccggaaatg

SEQ ID NO: 30005 - DNA, 452 bp, Caenorhabditis elegans
atgggtggattcctttcacatttgaaacctgaacacaataccgaagttcttaatgcttcatgtggcccgattcgtggaaatatttacgaacatgtaagtgataattttttgcagtttaaaagccatcctttcaaatatttttgacatttttaggacgacaaaattgtggatggatatctaggaattccatttgccaaggctccaatcggagaacttcgattcaaaaaatcagtcgaagctgagaaatggacggaaccactggattgctataaatatggaccgggatgtccacagtctggagctcttggagccatggtgagttgtaaaatacagtaaaacatcaaattcatgcgtttcagatagttccacaagcttcagctattcgtgaattcgctgaggacaattgtttgacgctcaacgtttttgcaccaaagtggaaatctgctgaattt

SEQ ID NO: 30006 - DNA, 1132 bp, Caenorhabditis elegans
ctccaatttgacacttatggctctcggatcgtctgctcctgaaattttgctttcgattattgaggtgagtatatttgaagtcagcttaaaaatgaaaatctatgtatcaaagcagacctttaaaaaataagcaattttggttaggtttccatggcagacaggcgcggcttcagacctggtgcctgcctgatacctactgatataaattttcctaatttcctcatttcaatcgatctgatgaaaatctaacaagattaaaaaaaaacaatttgaagtgtatttaagcagaacgtacaaaaccgctttaaggttgccttaaggctaggcaggcaggcgttttggtgcctacatggaagccctttttttttgcattaaaaaaaagtaaatttttcaatttcgtcatcaatgtccagtgagagaaatgtgaaatttaaaactcgagacttttaaatctttaataaacaatttaaaaaattgcaaaaaaaaattgccgcccaatttaaattcatttcctacaaaaaataacctatgtccatctttttaaaggttatcgccagaggattcgaagctggagacctcggaccgaacaccattgtcggatcagccgctttcaacttgttcatgatcatcgccatctgcgtcgtcgtcattccaaaaggagaaatccgtcgtcagaagcatttggatgtgttctgtgtcacagccacatggtccgtctttgcctacgtgtggctctacttgatcctcgccttcttctcaccaggagagatcgagatctgggagggtgcgctcactttcatcttcttcccacttaccgtcttcacagcttacatggctgatatcaagcttatccagaacaagttcttgccccacagataccgtagaggttctcacggacagatgatcgccactgaggctgaagaaatgaaaatgttggagaacggaacacaggtaaaattactttcctttcttattttctaattttgacttattttcagggagatccagctcttaaagcttttgaagaacatcgtcaagaattcattgagttgatgagggagatcagaaaacaaaatccacatattaccccaacagagcttcagaagcaagccgaatacgagatgatcagcag

SEQ ID NO: 30007 - DNA, 355 bp, Caenorhabditis elegans
tcgattcgtcattgtcaccgcatttctgccaatgaaaaatcaacttggagaagcatggtcttatcttattcttttcgtcgcccccgtcgccgcatcacttgtttatttgtacttctcgcttccagaaactaaaaacaaaaatccatttgaggttcgtcaacattttctattttccaaccttctaaacatgtactattttcaggtggaggaagcgattgaagatcttccaaagttcccgttatgtggaaaaaatcgtgtatatgataggaaacaatctcaagaaatggttttgtcgaggcaaatgcaattagttgtagattatggctcgatagaatccttatcttatcgactctag

SEQ ID NO: 30008 - DNA, 418 bp, Caenorhabditis elegans
acacagaagatgtccttgtcaaagaacacaacataccaactggaactctcttatttgctcaaatttggtcggttttgaaaaatgacccagttttcgaagagaactctaaattcaacccggacagatatttgatgcctgacggaaaaacgttgaacaaggtaaaatatcaaattccaggtctgcatttctaactttaagcctatttcagactgtacttgaacgaacaataccgttcagtgtcggaaagcgaaattgcgtgggcgaaggactggcccgaatggagttgtttttgattttcagtgcgctcatccaaaagtacgagttcattccaaaaaccaatgtcgatttgaaaccagtgtatggaggtgtgattactgtgaaaccatatctatgcgagttggttccacagaatgcttag

SEQ ID NO: 30009 - DNA, 563 bp, Caenorhabditis elegans
atggagctcgacgtggaatcaaccagcataacacagttgagaagtcactgtgaaacatgtttcccgttgatggaagaagtggttccgcgacgtgaaagatatgtcgatttgctggagttttcgaatgtgagcctaggctaacccagatttaaaaaatcattaatttcagttcaatggaattccttatccagttgtcgatccttccagaaagccgagaagatttctagccgattttaggtatgaatgctcttatatttgtatttaaaatattattttattgtttattcaggtactcatggtcaattccgctaattcatcattaccctaatgtcgagaaagatgtattgtcttctaaacgagttcatcgagtgatttccaagttaaaagagcaaaatgatgagcaaaagaatcgtgctgtccagtttttcactgaaataagtgctcgtttgtcaaagttcatatgcaaatgttgttcctatgtgttgtacaaagtttttcgacggttaatggataaactgctagtttgtaaagaagaaatggaggttttatatgaagcagaacag

SEQ ID NO: 30010 - DNA, 563 bp, Caenorhabditis elegans
gaaataaaaactgctcaagtcgaaattcactattgatcgaaacaaaacaggcactgattattccgaacacagtggtagctcagtttccagagcatcccgaggtaatttccctttcattttttgtgaaatgttcaattgagcttaggaagtggaaatggggttggctcaggctccagatgtttggattcgacagtctggaaatggaaaaactgtaagtagagtaaatgggcatatcaatcacaacaatgatgaggccgcggagctcatcatttttgacgccaagcacaaaaatcgccgatttgtttggtggactaactttcgaaatattcgactaattagatggattcgaaatcgattaaatgttgatgataacgcgaaaagggcggatttaatatcaagtgagcgttttttctggaggtttctagaacgaaagttaatttttttttcaggagtcctatttcctactctcttcgtatgtttcaactttgtctactggaccaagtattcacaatatcacgcaccggaagccaaatgaaattgtacaattaatttcaaaattttaa

SEQ ID NO: 30011 - DNA, 961 bp, Caenorhabditis elegans
atgctatttttcatatgtcttatccctggagtaacaaaaacggtgaagcggcgagttcaacagatgtcaattcaagtgattcgagaaggacgaggacttgttgtcgaggcaccaacgggtattggtaaaacatacgcatttttgatcccggcgattgaagccgcattggaaaatcgtcaatcaaattgcttcgagtccacgaaaccgtcaccttcgattttgattatggcaagcacatcggctttggtggatcagcttttcaatcgctgtgaactcattcttggattacagtgcatggacaatgttgagccaatccgtgatatcaagattgataaacttgtcgctaaccatcctttcactaaaggtaattattttgcaggagtttaccggcccccatgtgccgtacaaggatttcagtttgctaatgaaatgcttaattttaataattttcaggccaatgcgacattgcattctgcacaatcggcaaactgaaagcgacgattgaatgtggcgacgtatgccttgataatttgaaaacgattattctggacgaagctgataaaatgatcgacaattgtgctttcgttcccgacatcaattggatcctggatcaactgaaggaagaaaacctggaaaatctacagtcgtgcttcttctcggcaacctataataaaaatgcgaatggcacaattgcattgactgtacttcaaatgagaatgttgggagaagacgatccgtggtcagtcattatttgcccaagaatgtcaggatacatcacacagcgagttgtaagagtgggaagaggaaggccaaatgatattcgttcacatccctgggttatcaaaatgggatcattcgcaaattgatcgacgatgatctgaaggagactggttgcagtaaagatggaccttataatgagacgattgccattttttgtgagactgtccaaagagttactcag

SEQ ID NO: 30012 - DNA, 609 bp, Caenorhabditis elegans
gaaactatcactgaatgaggcactttgcggctataatttccttatcaaacatcttgatggccatcctttggttctttctagtaaacaaggagatgttatcaagccaggagtcatcagaggagttcttggaaaaggaatgccaaataagaaatacccagaactcaaaggaaacttgttcgttgaatttgaagtcgaatttccaaaggagcatttcctcgatgatgaaaaagcttatgccgtaagtatttttattaaagatttattgttcttaatgtattgttcgaactgttttttaaggttttgtttcatttactgactttatttccgttttaaaaaagcaacaaaaatttatgtttataaattgattagaataggatttgtatgttacgttttatttatctaaaattttctttattccaggttctgaaaagctgcttccctacctcaaaagttgtcaatgtcaccccagctgccgcagaagtttctcttatggaatatgacgagaagaagtacagccgaggacgtggcggagacgcttacaatgaagattcggacgaagaacaacacggaggacatcacggacaaggcgtcagatgccaacaccaatag

SEQ ID NO: 30013 - DNA, 909 bp, Caenorhabditis elegans
gtaatatgtttggaggtggaagtagtggtcccgtggacaccactttatacacaacactcaatgtgagaccagacgcttcgcaggccgacattaagaaatcttacttcaaacttgctaaagaataccatccagataaaaacccggaccatggagataaattcaaagagatcagttttgcctatgaagttctttcgagccctgaaaaacgacgcttgtatgacgccagaggtttggaaggagttcaaggaggaggagctggtggtggtggaggaggctttcctggaggtctgttctctcacttcttcggcggtgctggcggtgatgacgatgacgacgatgatgatatgggtggtcatccatttggtggcttgttcggtggaatgggtggaatgggacgaggtggcccacgtcggcggaaattccaagatactgttcatcccctcaatgttacactcgaagagctttacgtcggaaaaacatcaaagctgaagctttccaaaaaggcactctgtaaaacttgcgaagggtcaggtggaaagaagggagaaaaatataagtgtgatgcatgccgtggtcgtggagtgaagacgatcgttcagcaaattggccccggaatgctccaacaaatgcaggttcactgtgatgcttgtaagggttctggaggcaaagttccagcaggtgataagtgcaaaggatgccatggagaaaagtacgaaaacgtttcgaaaatattggaggttcacgttcttcctggcatgaaacataacgataaaattacattcaaaggagatggagaccaatctgacgtaagtgcatgtgaagataattgatttaaaaaaatttctaaataaaaatatcttttagccagatggtgagccaggagatgttgtcattgttattcaacagaaa

SEQ ID NO: 30014 - DNA, 1009 bp, Caenorhabditis elegans
ctgagtgttcacgttctaaaagagtggaatgactatggaccggaatgtgaatcatttgccactaacaaaattggattcaaagcgattttggacgatattgccgcaccgattccaagaaaggcattcaatttcaatagtcgagttgaaaatatcaatctggattcaaacactggaaaaatcaaattgacagtttccgatcgtgcagttccaacggaatatgactatattattgtgacttcttcgttaggagttctcaagaaatatcatcataaaatgttcacaccacccttgccacgacagaaaattgaagccatcgagaaaatcggattcggaggatcttgcaaggtgttcttcgaatgggaaactccattttggtcgaacaacacctactccatcgctcctctccctgttaagggaatgattagagataaactggatgcatttgaagatgagactacgatccttcaagttgtcgactgggctccgaacgttctgagtgcatggtatgctggtagaggtcatcagttggtggataacatgtcggaggaagagttgaagcaaagaattacaaaactgatgcgagacatgtacaacgacaaaagtattcccgagcctagcaagattatcagaactcagctgaccaagaacgagttgcttctaggatcctattcctacatgactcaagtgcaagcgctctcccatatttctcactctcaacttgcgattccagtgaaactggaaggaagaccaaaggttctgtttgccggtgaagcaactcatcacaggtatactatttcagagataagagaaaaaagtctaaacaatcaatttcagactattccaaacaaccatcggaggttatttgagtggtcgcagagaagctgatcgagctgtcaatgactggtttggaagatggaatcagaccacaaaattggaagtagtggatgaaacattgatcaatgatcagagaaacatcccaatcatttcacaaccaataacttctatttaa

SEQ ID NO: 30015 - DNA, 182 bp, Caenorhabditis elegans
agattttttttttcattataattattgtgattcttttcgggttgttcttttctattttctgtgattttttttcttattcctagtgcttcttttatattacttatcaattcctttaccattcacaaagtgccttaccaaaaattcacatcaatgctcattttgttgttccaatggttctctga

SEQ ID NO: 30016 - DNA, 419 bp, Caenorhabditis elegans
aaagatggagcacacatcattcaaactgacccatctgctgaagtcgtcagcatgcatggaacttcaatcggagcaagatctcagtctgcgcgcacttacctcgagagaaatgttgataacttcgagaaatgtatttatttcggaatataattgataaaattgagcaatttcttttttcagcaactccggaacaattgattgtccatgctctccttgctcttcgcgacacacttccagccgaagaaaacctcaacgctcagaatacgtctattggaattgtcgggaaagattctccattcagtcttctcgaagatgctcaagtcgccgttcatctcaaccaagtttccacacatccacgcacaactggcggagcagcagcagcagcagctccaggtggcgccgaaccaatgcaaatgtag

SEQ ID NO: 30017 - DNA, 374 bp, Caenorhabditis elegans
ataagtcaggaattgttcatggtgaaaaagcgcgtcgacgaaaactcgcccgtccggagtttaataagcaacgattcaaaaaatcgttcaatgcacatgtaatcgagcagagcaaggcaattttagactcagcagagccggattatcgacgagtgaatgcttatcaactaagctcagcacctccttctgaaaaacctgcaagaaagttctgtgcagtttgcggcattatttccaagtactgttgtacgcgatgtggtgccaagtaagttttttttttaatctgtgatatacattatacagtttctttcagatattgctcacttccatgtcgagacgtgcataatgatactcgttgcatgaaatggttggcttaa

SEQ ID NO: 30018 - DNA, 462 bp, Caenorhabditis elegans
gtaaccatggctctccgtcaattgggatacaatttcaagcccgtatgcagcatgatcacgaaaaatcagcagctcgtcactgttaatgatttggaattccgaaaaattcacggagttgtctgcaccaacatcttggcaagaggaattgacgtgtcatctgtgaagcatgtgagttgaatataacaagatttaattttttatataatttgttttcagacaatcatcatggaaatgtcggcagactttgacacctacaagcacaggattggtagagttggacgagacggatgtggcggaaaatcgacggttctagttgaacatcaccaactgcaaggaggaccagcttcaaatgtaatcgaacaactttacaatttcatgaaggaaagtaaggaagatattccacaatggatgcaggagtggatcgtcgctcgtcgaaacaacaatatcgactcatgggcttaa

SEQ ID NO: 30019 - DNA, 401 bp, Caenorhabditis elegans
cgtcaccggggagaaaagcattttattcttcgcctatggaagtggtctagcgtcagcaattttcccaggaagagttaggcagacatctaatcttgataaaattcgtcaagtcgcaataagggcgattaaaaggctcgatgaccgaattcagtttactccagaagagtttacagaaacattacaaaaaagagaagttttcctacgatcaaaaggtgagtaattctaatagtgattggtttttaatgtcattttgtttttcagagattccaaaatctccatccgaaacttcattgtttcccaacacttatttccttgataacatggacaagctttatcgccgatcatatactttacacgaggaaccaaacggtgttcaaaacgggaacggaattcatcattaa

SEQ ID NO: 30020 - DNA, 414 bp, Caenorhabditis elegans
aggtctgattccatcgcttcaatacatgattatctatcgaggagcatattatggtctgttcgatacaacggctccatatatgaatagtgacggaaagatgacatttactgaagcatttcttgttggacaagtcgtcactctgatcgctgcaatgacatcttatccactggatactgtaagaagacgactgatgatgggtgctggaaagaagacgttaccgttcaataacacaatatcctgcatcaaagtaagatcatttaattgcttctcggacaaagatttatttattttcagtacatttacacgaaggaaggacccaaggcatttttccatggagccctggtgaacgcgattcgtggaactggtgcagcattggttctggcgatttacaatgaacttcagaagtacatgtga

SEQ ID NO: 30021 - DNA, 637 bp, Caenorhabditis elegans
gctacattgtttggactggatctcgcctgaactgtggaactgtagcactcaatgttatcgtacaaggaccaaagagtgttgatcatgttcttgaacgcatcgaagtgttcttggagtcggttcgtaaagaaattgctgaaatgccacaagaggaattcgataatcaagtttctggaatgattgctcggcttgaagagaagccgaaaacgttgagtagcagattcagaagattctggaatgagattgaatgccgacagtacaattttgcacgtagagaagaagaagttgcacttctgaaaactatcaagaaagatgacgtccttgaactctttgacaagtaagatcttttccaagttttaattacctcatattctcttcttaaaggaaaatccgcaaagatgcagcggaacggcgcaagcttgctgtcttcgtccacggaaagaatgaggaccaggaggctgtcaacactattatcaagaagaatgccgaatctggaaagaaagaaaaggaagttctctattcggatcaacttcgacaattccttccactgtatggacgaccaatcgcagctatagacttgaagccaattggtgtcgatccacttgagcaccaggagactacgaagtctaagtattag

SEQ ID NO: 30022 - DNA, 370 bp, Caenorhabditis elegans
acatcttccagaacaattgcccaaatttcatatacttttgcagttactctgtcaggcattacaatcatgggtacagttaaatgtttgcaactggtaaaaattttctttctcccagattttatttaatctacaaatccaaaattttcagcgatgccaacaacatgttcactttgcaactgttgttgttgcattcatggcatgcatttggcagtttttggtacctcttggagtagggtacctttgtccgaataatactcctgaagaatggtctttcttgttttttattgtatccggaattgttttaattgtcaatattcctttcccgtttttgactaccgctgaagctgcggattatgccaaacgattttaa

SEQ ID NO: 30023 - DNA, 633 bp, Caenorhabditis elegans
gatatattgtttggacgggatgtcgttttaattgcggagctgttgcactcaacatttttgtacaaggaccaaaaagcgttgactacgttcttgagcgcattgaagtatttttggagtctgtccgcaaagaaataattgagatgccacaagatgaatttgagaaaaaagtggccggaatgattgctcgactcgaagaaaaaccgaaaactttaagcaatagatttaaaagattttggtatcagattgagtgccggcagtacgattttgcccgcagagagaaagaagttaaagttctgaaatcaattggaaaagatgacgtcattgcactctttgataagtgggagcaatatgaattttcgaatgcatcattttcttttttgcagaaaaattcgtaaaaatgctgtcgaacggcgcaagcttgttgtccttgtccacggaaaaattgatgaccaagaaactttgaatcgtattataaagaaaaacgtagaatctggaaagaaagaaaaagaaattctcaatctggatcaactccgacaatctctaccagtttatgatctaccaaacgcagctatcgacttgaagccaattggtgtcgatccactggaacaaaaggaaagtgcgacagtgcagtaa

SEQ ID NO: 30024 - DNA, 912 bp, Caenorhabditis elegans
gatactctcactgaggaaacctacaatgctgccattgctggcctcaaattccagcttgagtcgggtcacaatggcgtacatgagcaagccggaaattggctagatcctgaaagacatgcatcgataaccttacatgttagttttttttcatccttcttgtgaaatagttgtagttccagaggtttttgcattgatagaatgaactttcaggtatatggatacgatgagaaacaaccactgtttgtgaagcacttgacaaaatgcatgactaatttcaagattgatagaactcgattcgacgttgtatttgaatcccttaagagatctttaacaaatcacgcattctctcaaccttatatgctctctaaatatttcaatgagcttctcgtcgtcgaaaaggtttggagcaaagagcaactgcttgcagtctgtgatagtgccaccttggaggatgttcaaggattttcgaaagaattgtttcaagcattccatctggaactctttgtccatggcaattctactgaaaaaaaagcaattcaattgtcaaacgaattgatggatattctcaaatcagctgcaccgaattctcgcttactgtatcgtaatgagcacaatccacgtcgcgagttccaactgaacaatggggatgaatacatctacagacatcttcaaaagactcatgatgccggatgcgttgaagtgacttttaaatttggtgtccagaatacttacgacaatgctctcgctggtctgatcagtcaactcatccggcaaccagctttcagtaccctaagaacaaaagaaagcctaggtaagaacagttatccccatctaatcaaatattctaaatacttggaaaggaaattattgagatgccacaagatgaatttgagaagaaagtttccggaatga

SEQ ID NO: 30025 - DNA, 918 bp, Caenorhabditis elegans
gttggccgaaatggcacggttgttggaattgaacatatgccacagctggtcgaattaagcgagaaaaatatcagaaagcatcacagtgaacaattggaacgtggaaatgttatcattattgaggtaaattttaaaaaaatcgaagaattcgaacattttgcactaccatatggattgatttttaatagctgtactcacctaggactgttttgggaagataaaaaatgaaactgaaactatctagcatggtcacatagacgtggattttttttttaaatacagctggaaaaactagtacacgtattagtagtggaatgccttttctgtttctctctcttgtctacaactgtctgcgcaggcgcacaatgttttttgattgattttcaaaattaaatattaaaaggcaatatacgtggctatcagacttttaaaaaacttttttttattgccagaagttcaaactgttcgagaattcggtagaagaaaatctattttttgaaatctgcgcatacacccatgcagttttattattttgcgagtattcatttagttacaattttcaggtttttatcaacgtcattgaataagtaaataatcttctgaaaaactgttaaaaatttgcagtaaatgaaatcgaaaagtatatttgctatattttaaattaaaaacacattttgtgtagtgtagatttttgagaatatataaaagtcgaaaaaccagaaacattgaccaaaaaggagaatgacacacaatcaagcgtacacaaaacttgttacaaaaagcgaaactttttcgaaaaaaaaaacgaatttaaaaactacctcatatttctagggagacggtcgtcaaggattcgcggaaaaggctccatacaatgcaattcacgtgggagcagcttcaaaaggagtccccaaagcg

SEQ ID NO: 30026 - DNA, 857 bp, Caenorhabditis elegans
atgtcgacagtgatggaaatgtcgacgacgcgagctgaaatccgttcagtgctcgtcaaacattggcgttcgctggacaaggcgcgcctccatactattcacttatggcttttgctctacgcggccgcgcaaatttttatcgagtattatttctcagaagtttatgcagttttgatgttagaagcagacgatcgaccacagtcaaaggagaatcatgaaaaggtgggtaatataatttaaaagttggaaaattattgtcaatggggtttttacatttaaatactaagattggacccaaatgtctacaaatgaaaacggaaaaaaatcaaaacgttttgaaaaagttggaaaaaaaactagacgtttgaaaattttcaatccttgctattcttttggtttgaatcaaaggtgagcggtgattgttcgaaattcggcagttgtcgaattgcacaattatcggtaaaatttccaattatcagaatgagagcacggttattaaattttctatatttctttgtttataacaatgtattctgtttaatcgtttcaggtaaaaaagtggtctccattttgcttttatgcatcaatattttttattgcatatctcatcttaacgtgttttgcaattcgcatacggcagccagtgagttcaactttttttcaaggttccgaatcagtgaaaaagtttcagaaagaaggcatgggtttagtactggtatcactttcattgtgtgttttacttcctgcattttcatggatacttcaccttccagttgttatttttgttagtcgtgaaagaattcatactaatgagcacgaccactctgcactttacacaagtttgtgcatagcttcag

SEQ ID NO: 30027 - DNA, 1591 bp, Caenorhabditis elegans
atgctggaactaatttatattctacctttattgtgctttgtctacttcctttttcggcgatttgtcctggaaaacttctatgtggaatcgagcggcaagtatgtgatgataaccggttgcgatagcggttttggacggcttctggccacaagtcttcttgataaacatgtcaatgtgtttgctgcatgcttcacgcaacaagtaagtctgacaaaataagtgaaagctgaaattgcacaaaaaatgaatgtgcactgcacattgtgcagtaccgagtgaaactcgattagtttctggattttattgttgagttttcaaaacattcgatgaaacatgacttgaacgagtctcatggcgcatcttacatatctcatacttattaattagtgtagttagtactaaatttcaaaaacttaatccaaaaaaaatatatcgcaaagtaaattttttagattttaaggaaatttctagtatttttctcattagtttcgaaaatgtcgatattttccaaacgtcaattattgaaccaaatattttagggaatggcaagtcttcattccgaatggaagctgaaaaaaggcccaaaaggacaattatatacacttcaactcgatgtaactagccaagcaagcgtagattctgccaaatctttcgttacaaaaatattgaaagaacaaaattccaaactatggggtctggtgaacaatgctggaattttctcaatccatggccccgatgattggtgtagtgtcgatgaatatgcatcttctctcaacgtcaatactcttggagccgtgagaatgtgccacgcgtttgttccgttgatcaagaaaagccgggggagaattgttacaatgggatcaactgctggaaggcttcatggtttatatgtggcaccttatgttactgcaaagtttgccgttgaagcctatatggattgtttgagattggaaatgagaccgtttggagtttcagttcatattttggaaccaggatgtttcaaaacagaactactgaacaatgatgctcagagaatgagaattcagaagatttggaatagtttgtcagtggagaccaaagaagaatatggagaagactatagaaacgattgtaagttttgaaaatagttttttaaaggtttttgtttttagtttcggcacttgtgtattataaaaacgttaaataaatattttcagtcgagcgtgcttgggaagccggtgtgaacgttgtagcaaacccgaatattggatgggttgttgattgttactctcatgctcttttctcctggtggccacgacttcgctactgtcctggatgggatgccattttcatgttcatcccactcagtatcttcccaactgctcttcaagattggattttggctggactctacaaactgaacccagggccatctttgacacctgctgtgttggttaaaaataagaagcgtcgttctgcgattcaatggattcagtttttgtctcaaattgctattattcccctgttatacactattttctttgtgaaaaacactcaaaagcaaacagttgaaacgtctacacatcatcataatgttacagtttctgagtga

SEQ ID NO: 30028 - DNA, 994 bp, Caenorhabditis elegans
aacgtcggaagtgagcattacgtcaacatcatgtcattcgtcgacaaggaacaactcgagccgggatgttcagtccttctcaaccacaagaatcacgccgtcatcggagttctctccgatgatacagatcctatggtgtctgtcatgaagctcgaaaaagcaccacaagaaacgtatgccgatgttggtggtcttgatcagcaaattcaagaaattaaagaagcagttgagcttccactgactcatcctgaatactacgaagagatgggaatccggcctccaaagggagttattctatacggttgtcctggtactggaaaaacgctacttgccaaggctgttgctaatcagacgtcagctactttccttcgtattgttggttcggaacttattcagaaatacctcggagatggtccaaagatggtccgtgagctcttccgcgttgctgaggagaatgcaccatcaattgtgttcattgatgaaattgatgctgttggaacaaaacgttacgattcgaactctggtggagaacgtgaaattcagcggactatgcttgaacttctcaatcaacttgatggattcgattcccgtggagatgttaaagttttgatggccactaaccgcatcgaatctctcgaccctgctctcattcgtccaggtcgtattgatcgtaagattgaattccccctgccagatgaaaaaacgaagcgccgtatcttccaggttggaacaattttttctaaacattatatgaagtttttattttcagatccatacatctcgaatgacactcggcaaagaagttaacctcgaagagttcatcacagcaaaggacgagttgagtggagctgatatcaaggctatgtgcacagaagctggtctcttagctcttcgcgagcgtcgtatgcgtgtcacgatggaagatttccagaagtccaaagaaaatgtgctctaccgtaagaaggaaggagctccagaagaactctatttgtaa

SEQ ID NO: 30029 - DNA, 1436 bp, Caenorhabditis elegans
atgaaagccattctcgtcttcgctctcattgccatttcgataatttctgtgaacgccggtatgatgactggaggatctgttgaacaagatgcatctcaaaaggagtattctgtgagttttcaattattattcattaatttgattgaattgttctggtttttcataatataaggaatgaaaaattgccagcttggaagtataattcgccttcaattcatcatttttgcaggacaaagcctggaaggctgtgaaaggcatcaacgatcaggcatccaacaacggaccttactactacgccccgattaaggtttgtgatccttatgaaagaggcgcggaagacagaacagctcttgccaattttaagtgaacgaaacatttttttttagttgttaaatattcttcctcgtctgaaattaatggaagagcgaaaaaaaaaacgattaaaaactactctttgaaatttttcgcgtgagctgactgatatgtgacgatcttattttatttatcaatcaactttattgacagcttggctttatacaaaaattactgtccgttggtggttgttgtggttggagcggcagtagtgctcgcaacgtcgtgattattgagcacaatgataaggattgagcctgcaagcagcgctccccaaattccccagaacatcgcaattgcagtgtatctgaaaatagagatttattgatttaaaagaaatagattttatcgaaattactcacctggcaactctccatttcggttcctcccttttagcattgagctcatcaagactgtacccgatttgtggaacctcggcaacctgaatatcaactttaaattgctttcaaccccaccttgaacctacttttcgttgtttgacgcaatcacagctacaatatgaatactcactgctacagcaggaatctgtcacagagtcggttctcattctttgaaaaaataaaatcgagaaatgaaagttggaaaagagaaaatgattaaaattgtgatagagcgtgcgatcgatactaaactagataagacgaaaagcaaatatttaaaacaaaaccataacatgggaaatgtttttgatcgaaaagtgaatgcgacaagaacggctagacgggattatttggctgccagtgagagagagagttgcgggggaatacatgatttccgtattttaaaattgattttttcaggtcacaaaggcctcaacccaagttgtcgctggaatcagcaccaagctcgaggtgctcgtcggtgaatcgaactgcaagaagggagagttgcaggctcacgagatcacttcttccaactgccaaatcaaggatggtggaagccgtgctctgtaccaagtcaccatctgggagaagccatgggagaacttcgagcaattcactgtggagaagatccgcgatgttaccgctgacgagcagttctaa

SEQ ID NO: 30030 - DNA, 922 bp, Caenorhabditis elegans
gtcatgagagctgatgctgacttgggagatttccacggagagaccccatacaacgtcatgttcggcccagacatctgcggaccaactcgccgtgtccacgttatccttaactacaagggagagaacaagctcatcaagaaggaaatcacctgcaagagcgacgaactcactcatctctacactctcatcctcaactccgacaatacctacgaagtcaagatcgacggagaaagcgcccaaactggaagcctcgaggaggactgggatcttcttccagccaagaagatcaaggatccagatgcaaagaagccagaggactgggatgagcgtgagtacatcgatgatgccgaggatgccaagccagaagattgggagaagccagagcacatcccagatccagatgccaagaagccagaagactgggatgacgagatggacggagaatgggagccaccaatgatcgacaacccagaatacaagggtgagtggaagccaaagcagatcaagaacccagcctacaagggcaagtggatccatccagagattgagaacccagagtacactcctgatgatgaactctactcttatgaaagctggggagccatcggattcgatttgtggcaggtaagaaacttttattctatttttcaaaaatgaaactcaaactttattttttcaggtcaagtcaggaacgatctttgacaacattatcatcaccgactctgttgaggaggccgaggcccatgctgccgagacttttgacaaattgaagactgttgagaaggaaaagaaggagaaggccgacgaagaaacccgcaaggctgaggaggaggctcgcaagaaggccgaggaggagaaggaggccaagaaggatgatgatgaggaggagaaggaagaggaggaaggacacgatgagctctaa

SEQ ID NO: 30031 - DNA, 230 bp, Caenorhabditis elegans
gtccatcacgtttcgactttcgacaagggattctacaattgtactgctgcaaacaatgaaggaatcataacttgtacatcagaggtttgtaggatttatagttattttttccaattctcctaatttcccatactagttacattttttcagatcgatgtgctgcccaataaagaagattctgctgctcaggtagccaaacggaaaagtcgaaaggaggccaaagcccccaa

SEQ ID NO: 30032 - DNA, 793 bp, Caenorhabditis elegans
atggcgattgcaatatcgcaagcggttctagcgcatcgaaattctgcagcaacatttacggtccctggctcgacggagcaactcaaattccataattacagggtaaccggaaacatgatcagcgggtaagttgtgatttttaatgccatgactatcaatctaactaaagatcggattgtatcgatcgtgtttctcttttcatgcatgatgcttatgttgtgatgtttgatatattagcttttccttccctgtcactaaaactgaactctagaccaagatatcaacgggtgtgatgcactttgatcttttgttctaaaattctaatcctccaattttcagggccgcacagcagcacaaaaagcggctagtcccgctgcgtcggactgatgcaatgacagtggcggaacgtcgaaactatcagattctagacgatatttttcgatctggagcatccgattgtttccaacaagtcagttcagcggataacggaagcccacagtttttgaagctaaatattggaggcacaagctttatgattctaatcgacgcgattctccgcgcagacacaactacttttctctcgcggtttgtccaactcacacacacagctagattaaaagtgagctaaaaactgggggataatctcatcatatcatcaatctatttctcttttatttaggttgcggatgcctatatttccgctgatgatgcttactatttccaacgatcacctacttcctttgaagctgtgtttcaatactatgcaacaggagtggtgcatcgaccatctgag

SEQ ID NO: 30033 - DNA, 460 bp, Caenorhabditis elegans
aatgttcaacaattgccgatactatcacatcactgtcttcaagtcctctgtacactgctccagtttttactgaacgacttccatcttcagcatgttttgcaaatagtaaattgacactagaagttatgttcagcggagtaccacaaccaacgatttcttggttgattgacgatcatgaattggtttccgatgggtaataacttgtttatcttaacaatcaaaaaaaatttgattttcagtgaaaggatctccataaaatgtgaaaatggtgtgagcgctattcgattcttcaacgtggatcgtaatgcgggaggttttctgaagtgtcgtgcaacaaattgtgctgggcaagttgaaacatcatgtgagatcgtcgcagctgatgagatctctgtcatcagtgactcttcgattacatcttcgacgagaccacattttgttgtgcccttacctgaacgtg

SEQ ID NO: 30034 - DNA, 895 bp, Caenorhabditis elegans
gagtgcttcggagcgtcggagtcacatacaaatctcgaccccatcggatttcatgcatatagttcatatgggtcccgcaccggtcatggagctacaacaaaatttcattgacttgcagtcgaatcattcgcatacttcatccgataaggtgagatttcttgttagataattaaaatgaaaaaattcaatatttttactaaaaattcaaattaattgaaaatcagtcaacgaaggagtcgcgaaaaaaattgatttttttttgaaaatttcctaatttttttgcagtttttaaaaaaatttcatattatcataaataggaaatattaaatagctaaaaattcaaatgtttgtttttttttcattttcaagaaaagtacgtttcaaaaaattcaaatattttcaaaaattttcgttttcattttaaactcagatattccagaaatattatcaacttatgatattacgggaacacaaatttccgaaaatgcatattgcgcaacatatttgacgtgcaaaatatctcgaagcgaaaactacagtaatactttacatgagtactgtagcgtcgatttacgtgtcattgatttatcgaactaatattaaaacagtaacaaaaaacgataaaatattacgaaaaaaaacagatgaaaatggaatatcgctgtcactattcgggaataaattaatttaaaaaatcgagcccgtaaatcgacacttgcgctacagtagtcatttaaaaaactactgtagttttcgctaaaagatattttgcccgtaaaataagctttgcaatacgcattcgctgagctttgtattcccgtgaaatattaacatatctcattcctaaagccaattttttcaggattcactgaacagatctgtaaataacgactaa

SEQ ID NO: 30035 - DNA, 223 bp, Caenorhabditis elegans
aacaccaaacggactaaattcccaattaccaaaatgggaacggatttcaccagacgatgagcacatgaaattgatcagtataaaaccagaaccagaaatgaaaacggtagtttatggatatcgcatgcaacactttgaagattgtctccaacaacccgaagttcctccaggtggaattaaaattgacgaaagtcaagaaatcgttcaaaagcacgacgaatga

SEQ ID NO: 30036 - DNA, 619 bp, Caenorhabditis elegans
atgtatttctcgacgtcctcgtcatcaaatttaccagcctggtactatttaaaaggaccgagattcggaggcgagagcccattgccgttttgccaattttctcctccggttaggcagaaccaacattttacaaaattaaagttaaagccaagaaaaaattatcgctgcaaattcaagatgccgcaattactacttcccatcaaaaaaggttggttttaggttttctaggttaaaaataaacaagtgataagatagtgtaaaagataatcaataactattattacattgttcactttaatttaattgtgcttatttttaaatgtttatgtttcagcccgtgttcgaacatcgagcaaccagagcaacatgggaacttgcttctcaaacttgaagtcaggaaaaagtgagaatgcagtaagtctttatttttcattttcgaagtcagcttacttgaaaagctatctcataagaaccaatactatagttactgtttcagatcgttcgagttcaacaaggactccttgaaggttttcgcgtcaagaccgcaaaaggtgacctctgtgatgtgtttcacggaatcccttacgcagaacctccagttggagaactgagattccag

SEQ ID NO: 30037 - DNA, 655 bp, Caenorhabditis elegans
atgggaacttgcttctcaaacttgaagtcaggaaaaagtgagaatgcagtaagtctttatttttcattttcgaagtcagcttacttgaaaagctatctcataagaaccaatactatagttactgtttcagatcgttcgagttcaacaaggactccttgaaggttttcgcgtcaagaccgcaaaaggtgacctctgtgatgtgtttcacggaatcccttacgcagaacctccagttggagaactgagattccaggtgacctatttttaataactatttggtcgtagaatttgacgtcagcaatgtttctatcacacctagtgataggaatttgccgaattcattgaattcatctagacagattttctaatcgagtggtcattgggagtgaccttcaactgtcaagtgcagttgcgttcggccatcagccacacacgattatattcaatggcatcataagctatatcaaacaccaaccaactttttttgcagaaacctcagccacctaaagcatgggaagggattcgaaaatgtaacaaatacccgaatcgatcgattcacaaggaaatgccatgggataaagctttaccaagtgcaaatcagagtgaagattgtctctacttgaatgtgtttgctccaaagatcagagaagataag

SEQ ID NO: 30038 - DNA, 381 bp, Caenorhabditis elegans
ctgctgttcattgcaccgagctcagatatcttctcggtgaaggagtttacagcaagttcgaaccaacagaggaagatcggaaagttatggagactacgactacattattttcaaattttgccaaatatgggtgagaaaggaattcagaattatgaaattgagtttttttaaagaaatccaaatggaaaaggagccaccgccgagatatgggagaaatacagcttaaaccgtccagagagacattacagaatttcttatccaaaatgtgaaatgagagatgtttatcacgagggtagaattcagtttttggagaaaatcgatggagatagtgataagtatcaagaattggtctatggaaagaagaagtcggcaaagatttaa

SEQ ID NO: 30039 - DNA, 456 bp, Caenorhabditis elegans
cttctatgcatggaacagagctccgttatttgctcggcgaaggattctacagcaaatttgatgcaacgaaggaggaactggaggttcttgaaaaaacaaccacacttttttcaaattttgctaaatacgggtgaggaggaacaaatattcaatatttgtagaagaaagatctttaaaatattgttttacgtagagctcaaaaattcgaattaaggggaaatgattcatataaactggcggtatttcagaaatccgaatggaacgggagttacggatgaaatttgggagaagtttaacttgaacaacccagaaagacattttcgaatttcgtatccaaaatgtgaaatgagagatatttttagtggtgggagaatgccgtttttggagaagctcgaagaaaaaagcttgaagacccaggagctggtgtatggtacaaagaaatttacaaataattga

SEQ ID NO: 30040 - DNA, 907 bp, Caenorhabditis elegans
atggctgagcaaagagcaaacaaaaccagtcgatgctcgatttcctcagttctattccgcgcacattcccccctctctagcgcctccgccttcaatccgtgttttgtccgatccggtctgtcggcgtcttttccgaaaagtgactctctttgtactttgactgacgcgagcttcaacccgatgcaattgcttttccttctacttttcacaccttatacgatcgttggtaagtgtttgaattatctagagccagtgaaaaaggagtactgaattcttgatgatattccaggagaaagccctgatttctgcccccaacatccagtttatggcaaggaacccgaagaggactgtgctcaagcttctgatccaaatgagcttccaaagtctccactggaaaaatggtttacaaaacaaatgtttgaggacttatttccaaagtcaaatattggaatgggacctcatccgtgcttaccgtactcatatgaatcttttataatggctgctcgatactttcccgagtttggagcagcacatccaaataaacaattcaaagctgatgagcatcataagagagatgtagctacattttttgcacacgctttgcaggagactggtgaaaatgatgcaagtgtttataagtgagttataaagatcttagtggaagatccaggttttgtagttttttttagttgattcatattaccaaattcagaagaaactgaactgagaccttttcaaagaaatgcactgtcctttatatagacgtcccatagaaaataaagtattaatatttccagtaataccgatctaacacttgaacaagctcacgagtgcttctatcgtggcggattctataattggtttgaacgtggaccaaactctacattcctttctccagcagctccag

SEQ ID NO: 30041 - DNA, 586 bp, Caenorhabditis elegans
agctcgttacccgccactaagccaacaaaagctcgatcaaatgcgacgcctcacgggaaaacgaatctctctgaatctgatgaatgttgcgactcttcctatcgtaatggcctcattcgtttttggaatgctcttccaggtatgcagaggaaaatcagctcaatagattctcacacagtcagcacctgcttcactagattaattcacaaatcgcagtacaatttttcagaaatgttctagaaatgtacaggatgattaattactgcgaaaatacgtgatatttagcttatcatattcacatatttttgttgctttccaatttgcctcactaacttatgtccaaacatctaacaataaactattcaaatcagttattgtacggatatttcccgtttgtaacctccaaaggctccttatgtttcgaaggtccttcacatcctttgtttttatgcttcagctaactagtaccaattcgataacaaataaatacagaaaaaataatactagtttcagttcattttccgcttctcggcataaaatcgagacatgctggtggaggtggcaaacgcgaaatggcgtacagtag

SEQ ID NO: 30042 - DNA, 543 bp, Caenorhabditis elegans
atggtggagaataacactctcataatcacaggaggagtggtcgtagtttcgagtattgctatctacatttatttgaaagcaacaaatacatgccccttctcactttgtaaaaaggtaaatttgatttttttttgtttttcgcggttattttaataattttttttgttcagagcaagaaacgaactcttgtcgatgattctgtcaagtatccacttccgttgattgaaaagttcgagatcagtcatgacacgagaaaattccgattcggattaccatcgaaggatcatattcttgggcttccaatcggccaacacgtttacctcaccgcaaatgtgaactttccagatccttcattcatcataaatattaacatttcagattgatggaaagattatcgttcgcccatatactccagtatccagcgatgaagatctaggattcgttgatttgatggtgaaggtttacttcaagaacacaaatgagaaattcccagaaggtggaaaaatgagtcaacatttggagagcctcaagattggagacacg

SEQ ID NO: 30043 - DNA, 516 bp, Caenorhabditis elegans
atggttgagaacaatacacttgcgataactggaggcgtggtacttatttcaagtgtttctctatttttgtatttgagacaactcagggctgaaaaagtgagtcttccattctttttatttcctaatacaaaaaagtttagaaatcaaaaagaacgcttgaagacgattcggtcaaatatttgcttcctctcatagaaaagttcgagatcagtcacaatacgagaaaattccgattcggattaccatcgaaggatcatattctaggacttcccattggacatcatgtgtatcttagtgccaatgtatgttttcttcagatgatataattaattattttaaaataatttccagattggtggaaagcttatagttcgatcctataccccagtgtcttgtgacttagacttgggatatgtagatttgatggttaaagtgtattttaagaatacacatgaaagattcccggatggtgggaaaatgagccaacatttggagagcctcaagattggagatact

SEQ ID NO: 30044 - DNA, 598 bp, Caenorhabditis elegans
aaagaagccaagattgctcttttgaaaaaagcttgtgaaactcatgttcttcgaaacaagaagtgtatggttgggcaaggagtcgatcgtcatctctttgttctgtatattttatctcaaggaacggggattcagagtcctttccttgacaattatattaatcaaaagtggaagctatctacctcacatgtgagtaatcattaaaataagatgacatagtgctatgtatttggcagttgtatcacgtaactttctaataatgagctgaaggattttaattcaaacatttttcaacaattgctttttctggattttcctaattattttttttttaactttacaatttgaacatatcctattccaggttccaaacgtgactaatcaatgcgacgaggacactgattcagacaacacttggctcggagcatgcttcggagcagtcgctgctgatggctacggaatctgctatcgctttggaggaaaccacggaatctttgcaaacatcacaagttatcattccgctgccaacactgattcaacaaagtttgcaaagttgctctccgaatcgttccacgaactttcaaaccttttcgtttga

SEQ ID NO: 30045 - DNA, 315 bp, Caenorhabditis elegans
acactgatcttgcggaagcgcacgaagaaaccgccgaggaaggagaaactgaacaatcggatcacgttgattaccacttcatcacctatgtcaacaagaatggacaactctacgaaatcggtgagataaatctgcggaaatggttttcaaatagttatctaatattttcttctagactcatgtgctccatttccacgtccactcggagccaccaccgactctacaatgatcaaggatgcatctacagctatcaaagaactgatgaacaatgttaagaatctcagcttctctgctatggctcttgttggaaaataa

SEQ ID NO: 30046 - DNA, 306 bp, Caenorhabditis elegans
atgctgagctagctggaatccatgctgccgcagcaaccgatgggcagacagcaccttcaggagacgttgagcatcatttcatttgtttcgtcggaaagaatggaattctctacgagatcggtatagttttttcatacgttttccattttaatttctggttttccagattctcgccgcccgttcgctcgtgaaatcggtccaacttctgatgcaactctcgtcaaggacgccggagctgcgtgccaacatctcattgagaaactcgacaacgtcagcttctcggcaattgcagttgtcaatcaataa

SEQ ID NO: 30047 - DNA, 682 bp, Caenorhabditis elegans
gttatcgttgttggaaacccagccaacaccaatgcattcattgctgccaagtacgccgccggaaagatcccagccaagaacttctctgccatgaccagattggaccataaccgtgctcttgctcaactcgcccttaaaaccggaacaaccatcggaaatgtcaagaacgttatcatctggggaaatcactctggaactcaattcccagatgtcacccacgctaccgttaacaagaacggaactgagaccgacgcttacgccgctgtcggagacaacgctttccttcaaggaccattcatcgccactgtccaaaagcgtggaggagtcatcattgagaagagaaagctctcgtctgcaatgtctgccgctaaggccgcttgtgatcacatccacgactggcatttcggaaccaaggctgtaagtttaattattttaaaacttgaatgaagattttattttccaggggcaattcgtctccatggctgtcccatccgatggttcatacggaatcccacaaggactcattttctcattcccagttaccatcgagggtggcgaatggaagattgttcaaggtcttagcttcgacgattttgccaagggaaagatcgctgctaccaccaaggaactcgaggaggagagagatgatgctctaaaggcttgcgatgatgccaacatctaa

SEQ ID NO: 30048 - DNA, 4345 bp, Caenorhabditis elegans
atgtcacaagtggccgcaatggaccttcgtgtacttacacaggtatgttcattttttggattttagtaatgtaccgtgatgtttgtatgtattgtaaatgtgtcatctagggttcgacgggttgttttgaatcacagaaagatagaatatttcagaatctcttttgagaaagaatcaagagcaagataaattttggcgcttacattagtcgacaaaaaatccatacacagaagaaatttcagctttataattctaaaaaatgtataattaggacatctgttctacctagctgttaaactgatttaaataacgaagcaaattcaaaatggcggaaagcgaacgaaaaagcagagaaacccacaaattcgaaactttctgggatccgtaacccgacaccacctacctcttcactttgtttctgtcaatgccgattccaatccacccacattcatccttgttaactgaaaagtccacaaagagacaatatagagcggggtgccaggaaggagagagcggaatgccccgatgaatatctccgttcgagatcggcgtccacatccacctcatctagaaagtcgtgtctgtttctcttcatgcctattcatatactctctccctactggcctcatttcatccattaaacttttatggtcctctatctctacttcactttcaaatgagtcagggagccctaccgggattgctcgtcgcgccgccggaataatcaaattctcgcctagcacttcactttcacgccaccagttttttgtcacttttttgttgtgtcttttgtcggtgagactcctcccttccacaacttcaaccacgtcattccagcttatcgttcgcctcctctcgtgagcttcgtggtatttcagcacttccgtttcgattgttgtttcaacatcaattcatttcttgcaaaagtccattcgtcgccaaaacatcttcctctgcctcttcgttttcttgccgtccctttattttcctcccacttctcgttgcccatctcgttctctttaggcaatccaattttttgcgcgccgcatcgccgaagaccaccatcatcatcaccgccaccgccaccgcattgctgaaattcagctctcgaggctctttatctcgttttctctgttcttcgaaatgtttcttctatctttccctggtattctctgtacccgcccactgatttttcgataggcattgatgtagggattggaaagttttgttgtgagactcaaattttctgagaagttgataaggatcgccaattttcttttttgaatattttttaaactgttctagaagtattcatatatctgcagaaaactcccaaagcattttttccattaattttttgaaaaaaagtttcaaagaacatttttgtagaccaacttacctcaacttgaatagtacctacttcgaaatccaatttttgcaacaaaaaaattcaactggatctaacagagttacattattttaaattcgaagttttttaagtgcatttttattgtagagaatgttcagaagatcagttaaatgtacggtaaaatttttatttgaacaattattgaagctttccataaataagcttaaggtaaaacttttatgttcaattgagaaattcgtgctactgtaactgaatttgaattttgaaatcaacgaatttcttataaattcgatttattttcaaaacgtatatttaaattgactttacagaatctttaaaaataattttgtatttggaactactttagtgaaaacgtgaagactcatttatgaagctcacctcaacccactcagctctcagcgcagctcacttagtcctcaagtaaataaaaacaccaaaaaaaaaaaattaaaagtttacaaatgagttttcaaaaataatcacttctcgagctccagcatttttttcccgatcttagttcagatgactcttagagattcaaattcggcgcgctcctccgtctccatcggggcgcacacacatacacatccaacgaaaaagggaaaacccgtttcgaacacgcacgctcacaagatagaatacgttgacagggggcgctgataggggatacacggtgagacggcagacaaacataagagacagctactacaggcgacggagaaggatcatcatcctatcccaccgtcgtttttctacaatgggtgttccatcttagttggcctctagttactcttgaaattaagtattcgatgctctttgactttttctcaatactgctagatgctgaaacctcgtgcaatttcaaatttgcactccttagttgacaaatgaccttgttcccgtgctcttcaaccacttcctccccaatttctttcattcctccaaatttctaaaattctcaattttcagttcgacatcgccagtttggaagaggaccgcaaaaagatgttgtacggtaagtatcatttgccctaaaactgttcgaaactggcttttgcaaaaagctgaattgcaacaaataatagtataaaaatcacaaagtgcaaaatgaaaaaaagaaagaaaacggaaagatagaagcgcaatggatagtaaggctattcttcgcccgttttctcgccgcctctcgtgtcttttacatcgtcgcgccccttaataatcacaatttatcacttttctatagtctcagtacattctagccctcttcatccgcctcctcagatttttccgtaaggattttatcccagttgttttgtgatttttattctctgatcctgtaaaactgtaaaaaacaatgcagtttattttttgaaagttccaagctccaggactaaatttaatctttaggtgataccttggatttgtttgaaatttagctaggttgctgaaaatttaaaattttgataatttctcaaattatatgattctcctttacaaacagtacaaactttttttctacaaaaaaaaaacctcagcaattttcagctgttctcgaaaatgccacaaaaatttgaacttttgttgtatctttttgcagttgagagttttatcttaatttaacagataaagataacgcagtgcaaatgagtggaattgaaaaaaaaaccaatttttggtaggctttaaattattttgattgaaaactaatacgtaactcccacatatttactgtaaactctggaatttttccaagttttattatgatgtttgatcattttagactatatcactaattttatgaattttcccaactgatgctactccaatttttttttaattcctaaatttcaaaaattttttgatacaaactcttgaaagatttatgactacaagattcttgaactagtttaattgttcggctaacagattgacggagtggacacaacccttgtacagttgcaggctacaccagatcatttcctttaaaattgtgatttgcaaagtcagagaattttaggtttgaaccaaaaatgtggagtaactatttcagtttcctggtccttttccgtccatttagaacctacgactcatctgttccaaattgaattccgtgaaacaagttagcatccattaacgttctgtgttttagtcaatttgtttatttttggttgttacggctacaatatttctaccgtcttcctgaatggaactggttttcaagatgacgttctatggagccaatttcggtaccttattcaccaactattgacgtcatgaaattagtcttcaaagttcttattcttcttcgtttctttgctttcgttgtttctccacgccactccaaacacgcaaacacagcaaaatcgagttatcgtcatcctgaaaaaagtggtggtgttggttggggagatacgaagtaagagaggaaaacaagaagaaaataaggctctggagaagcgctcgtcctcacaattgaggctttcttctcactttcacgacagattatgcactttttcggtcactcgttcccttcgtttgttcgctcgaaacgaatacttttcgagtcgttcgattctatatctctacgtcattactttcacgttccacaaggtatactgtaggtgtgtgcacacaaactgagacagattcgattagggactcaggcgatcttctactcaaacaataacacccacacacaacttaaatgtattttcagaggagccgatctctttggaagaagccgctctgaacgccaacgacgtgatggtggcgccgagtcgaaagtcgtatgtgcacggctgttcgactgttcctttgctttttgaaactgttggagatcgacttcgatcagcagttgaccaggttccagataaggaatttttgattttcaaaagagaaggaatcaggaaaacttattcgcaagtcgccacagat

SEQ ID NO: 30049 - DNA, 1256 bp, Caenorhabditis elegans
atggacgaatcgccgatattcgacaacgagaacaagcgctcagctggaaatgtaagttgaattttctcaaaattttaattaaatcaatgacaatataaattatttcagaagcgccagcaaaccgagtcgccattttccgccgctacgcctaaatcacgactaggaagagaaccgaaacgcatttttggaacttcgtcgggcaatatggccgatagcaacctggaggagacctgcctcgagcatgattcccgcccgtcttctgcttcttctatcacccctgccgacaacacaagtctactggatttgtctacagtaacagctttggctactgatgatgcatccttcgtgggaaccaacgatgcttccatcactccgggcagcaatgttgatgtgaatttagaacaatctgagctctacgacacctcaaattgcacgagcaacctgagcatggttcaagaaagcgacgagacggacgccgatgccacactgtccaatgatttcgataatcaattggcacttgacggagagactacgcctactgcttctcgtactccaatgagccagattctgagccgagaatgtactccaacagtatctaatccacagcttctcacggaaatcgccaaaggagtagatcagcctacaaagccagtccgagatgtcccccagtccccagtgcttcctgtcaaaggtcacattgacttctcactgtaagaaattgtcgtatttatagcttaaaacaaaataatttcagacacgagtttgaaatgttggagcagaattccgagcatgaggagtcaatcaaacttcttcagtcgcagatcgagcttctccgtcaaagtcacagtcaacagctcagtgagattcaagaagctcgaatttttgaggaaaagatgctgactcagcaagtagattctgcaatgaaaaaggcaaaatctgaccgcgaagccgctaaggcacgagaacaagttctcgagaaacaagttcaggagttacgcttgaagctggaagagcctgacgaagagaagaatcagttggtacacaatcttgctgctctgaacgctcaaatcgaggagttgacccagaaggctttgaaagtagattcgatgcaacaaggagcgactgcttcggaagatcggattcgggagttaattggaggccatcaagaagcaatcaaacagcttgagaataccaaacaaatgaacgaaagtcttcagcgcgatctagtagagaaagaagcgagattcagtgaagag

SEQ ID NO: 30050 - DNA, 1057 bp, Caenorhabditis elegans
atggtaagtggttgttttagcgtgaagtttaataattgtaattgtcttgaagaaatacctcattcttgctgccttggtggctgttaccgccggactcgttattccacttgttccaaaaacccaagaagctatcaccgagtatgtgaactcaaagcaatctctctggaaggctgagattccaaaggacatcaccattgaacaggtcaagaagcgtctcatgagaaccgaattcgttgccccacacactccagatgttgaggttgtgaagcatgatatcaacgaggataccattccagcaacattcgatgcccgtacccaatggccaaactgtatgtcaatcaacaacatccgtgaccaatctgactgtggatcctgctgggcgttcgctgccgccgaggctgcttctgatcgtttctgcatcgcctccaacggagccgtcaacacccttctctcagctgaagatgttctttcttgctgctccaactgcggatacggatgcgagggaggatacccaatcaacgcctggaagtaccttgtcaagagcggattctgcaccggaggatcttacgaggctcagttcggatgcaagccatactcccttgccccatgcggagagaccgtcggaaacgttacctggccatcttgcccagatgatggatacgataccccagcttgtgttaacaagtgcaccaacaagaactacaacgttgcctacaccgctgacaagcacttcggaagcaccgcttacgccgtcggaaagaaggtctcccagatccaagctgaaatcattgcccacggaccagtcgaggccgcattcactgtctacgaggacttctaccaatacaagaccggagtctacgttcacaccactggacaagaactcggaggacatgccatcagaattcttggatggggaactgacaacggaactccatactggcttgttgccaactcatggaacgtcaactggggagagaacggatatttccgtatcatccgtggaaccaacgagtgcggaattgagcacgccgttgtcggaggagtcccaaaagtctaa

SEQ ID NO: 30051 - DNA, 463 bp, Caenorhabditis elegans
atggacgctcaaggagatgccggcgcacagggaggaagtcagggcggaccacgaccatccaacaaacgtctccagcagacacaagctcaggttgatgaagtcgtcggaatcatgaaggtaagattttgaaatgtgcaattaaaataacaaaaatcgcaatttttgaaatgatcccatttacaatttataagcgtgttaaattaatcttaattcccctttttgcaataaaatcacgaaaaatagttttcaggtgaacgtggaaaaagttttggagcgtgatcagaagttgtctcaactggacgaccgagctgacgctctccaggaaggtgcttcacaatttgagaaatctgcggccaccctgaagcgcaagtattggtggaagaacatcaaaatgatgatcatcatgtgcgctatcgtcgtcattcttattatcatcatcgttttatgggctggaggaaaataa

SEQ ID NO: 30052 - DNA, 1301 bp, Caenorhabditis elegans
atggtatacatccatggtggaggatatgaatgttcagcatcgagagattattgtgattactctgtggctggaacccttccgcttaaagacgttgtcgtagtcactttaaattatcgagttggaattcttggctttttcactacaggagataccgtatgccctggcaattttgcattatgggatcttacacttggcttgaattggattcaaaaacatattgaatcatttgggggtgatcccggaaatatcacaatattcgggcaaagtgctggcgcggcatgtgtggatcttcttgcattgagcccacattctagaggttggaagttaatattttaaagggtgcactaggaaatttcagatttattcaatcgtgtcatagttatgtctggtggtgctctgtgtgaatacgcggttcgaacggcaaacagccaggcaaaggtatgttacgaatttgctcgtcatcttggatatgatggtaccaattctcaaactcttttcaattggatgaaatcaaaaccactagaagaaatcgaaaaaatgaacgggtttcaagttccagcatctggaattcttgcttggactcctaatttagatgacgacttctttccaaaatcacttgatgagctgagaataggagcaccaaagaaggatattatgatgggatttgctgagcacgaagggctcttttttgagtttttaataaaagatccgacgccgcccctagaagcgctaaaactatatgtgaatgaatattataagaaagatactggagatcattttgaagctacacgaaataaaattattgaattttattcacgaaatgttgaggataccgatgagaaaagtaccaaagagcgattgattgatgtgagtcaaactattaatttttgtgctagcaaatgacacccttgcaatgctgaataaaaattatttctttgaaatttttatagatcacatggaaaatgttgaaaaagttttttatatcaccatttatattttttcaaagcttaaaaaattatttttcagtttgtgggtgatgctctattcaccgctggagtttttgataacgccaagaattgcctcaagcatggtaataacgtatggctctatattttcgattattgcaacccttctggattcgggaatcaggaagaatttatgacattcgttgccccaacgcattgtacagatttacgttatgttcttggagaaggactgtacagtgatttccagccaacagaggaagaacataaaatgattgaaaaaatgactacgatctactccaatttcgcaaaatacgg

SEQ ID NO: 30053 - DNA, 784 bp, Caenorhabditis elegans
atgggtggtcatctttcacatctaaaaccaaaaccacttctgaatgttttaaactcgacatgcggtccagttcagggaaacctttatcgtcatgtgagaattccgagaaaccactattttttcatttctaaaaataaagtttttaagggaaatgaagaggtccatggttatttggggattccatatgctcaaccaccaatcggaatacttcgattcaaaaaacctgtcagtgcggacgtttggacagaaaccagagattgcacgaagtacggtcccaggtgccctccctctggaatgctctatgagaatctccaactgccgaatacagacattccagatgaagcaaactgtttgagtttgaatgtgttttgtcctcagtgggaaattaagcaatcggtgggcacttttacaactgagttgaggagaaaatataacatttcaggcaaaacatccagttatgattttcattcacggtggtggtttcgagcttagtgcatccaaagactattgtgattattctctttctgggtagaataatttattggagtaaaagtatgggattcatattttttcagaactcttccactgaaagatgtcattgtcgtaactgtgaattatcgggtcggcgctctcggattccttactacaggagatgattcctgtcgtggaaactttggactatgggatcttactttggctctgaaatgggtctccacgcatatttcttcttttggtggagacccgaagaacgtgactctttttggacagagtgctggagcagttt

SEQ ID NO: 30054 - DNA, 775 bp, Caenorhabditis elegans
atgggaggatatctttcatatttgaagcctgaaccacttggaacggttctcaatacttcctgcgggcctgttctaggaaacctctatcgtcatgtaaatttttttttcaaagagggagtatagttaatggtatttttattttctaaacaaccgaacgttacggtacttttttagtcaacgggtaaaattccagattttagcttaattaggccttgtgtttgaaatttgagccgccataaaatatgaatgttttttgagaattaaaaacaaatctcatcataaaatttggaatttaggagaaaataatatcaaaaaacccccgaaaacgatattcctccattaacaatggatgtatatcagagtgatagctattaattttcaaccttccagggagacaaagaggttcatggatacttaggaatgccatacgccaagcctccaacgggcgaaatgcgatttgcaaaaccagtccccgcggatgactggacagaaactagagactgtactaaatatggtcccagatgcccaccttctgggcaaggactcgaaaaaggaatgttcgtgaatccagatgagcctgatgaggcaaatgggctgtctgtaaatgtttttgttccgggatgggagtccagtgaatatgtaagttttatgaacacatatttttctaaatcaattttttgattaagaaaaatgcgcgcccagtgatggtatatgtgcacggtggtggatttgaaatttcttcatccagagaattttgtgattattctatttcaag

SEQ ID NO: 30055 - DNA, 692 bp, Caenorhabditis elegans
acaattcgctcacgtcgttatttctacaattcaatggatgaaatcagtggcgctaatcactggaccagctctagttgcagctattgtaaaaaatgaagaaagtgttggtcagtggagaacagttttgtgcattcttggaggtattatgtttgtggtgagtttcagcaataaatattttgaaaataatgacattcaaaaaaagttgacaatagttcgtttttttaattcaaattaatggcatggttcggtaacaattgaaaaatttctgcaaaagggtttgtatcatattgcaaaaattttccgaaggtccttattcaaagcaaaattttagaagaagtaagtagctagcgtagtttgagtagccagtaaccagtagccagtggagaaatttatgaaagccactcccgtggtgccaaaatgaccaaatatcatagtaaaacatattttttgaaaattttattttgttcaaaaagtggtaatttattactcagtttttgccactttttcggaatattgaaaacattttaaatgcaaaactttcacctttcaatgtcatctttgtaggataaaacactatctttcaggcaaacatccttgctctttgtgtgtttactgacaaaccagcggaatatacaatggcagatgctaatgaaaaaactgtcaaatatgaggtgaacgctgaggagccttga

SEQ ID NO: 30056 - DNA, 730 bp, Caenorhabditis elegans
cagcctcatcgaaatgagaaagacttatcagaaggattttgttgccaagcacggagttaagctcggaatgatgtctccatttgtccgcgctgccgcctacgctcttcaagaatctccagttgttaacgccgttctcgatgaaaacgaaattgtctaccgtcactttgtcgatatctccgttgctgttgctacaccgaaaggactcgttgttccagtcttgagaaatgtcgagagcatgaattatgctcaaatcgaattggaacttgccaatctcggagtgaaggctcgtgacggaaagctggctgttgaagatatggagggaggaaccttcacgatttctaacggtggagtcttcggatccatgttcggaaccccaatcatcaatccaccacaaagtgcaattttgggaatgcacggagtgtttgatcgtgttgttccagtcaacggaaaggcaagttttcatttttattccaattactgatagaaattatcaaattcgaatttcaaaatgtttaaatttaactaaaatgattataatactgaaaatatatagaaacaaaaacgtatgattcataaaaatttgttcaattttcagccagagatccgaccaatcatgcaaatcgctttgacctacgaccacagattgatcgatggaagagaggcagtcaccttcctcaagaagatcaagaccgccgtcgaggatccacgaatcatgttcatgaatctttaa

SEQ ID NO: 30057 - DNA, 334 bp, Caenorhabditis elegans
tgatctttggcaatcacctaattatgcagtacgagttgcttgtgctttgtgcgcacctgtcttcctaatcaccacctttattcttttcatgaacgttgtgaaaaagttagacttttgaaaaacgtaaaagtagaaacataattgtttgcgtatattataagatgtgtttttataaaaaaggattatgtatttctaggtataataatgcaaccaaaaatattggcgacacaagaaatgactgtaaaacattaaaacatattacagtttaatttattacatcagtaagttagtgtaacctgtgggctacaattgtttttcagcaccgaggaagaag

SEQ ID NO: 30058 - DNA, 350 bp, Caenorhabditis elegans
agaccaattagatcgctcatcgcaactgattcaaacaatattaatcgtttttctaattactgaagtgcctcaaggagtattcagcattattggagggattgaagtcattgattatttaaagtaggtttcaatataaaaagtttaaaagcatttattttccattcagttactatcagaatttaacaatttttatgaacgtgctgtcttttttcaacacaaccaccagtttcataatctatagctctttgtcagcaaaatttcgaaggatattcgcccaaacattcttaccgaaaaacttacttaatatgtacatggtaacagtagcacatttttcaaaaattaatttttaa

SEQ ID NO: 30059 - DNA, 320 bp, Caenorhabditis elegans
cagaacgggactacaagccataaaatttcaatttctcgacaagcgaacaatatgttcgaatctttgcacgctctcgcacaattcggtacttttaaataaatttgtgcatcgtttattctctaaatattacttttccaggactcctcacggatgacgatgacgaaaataccaaatggactgcacaaaatgtcgacaaattctgcagaaaagcatttccattgtcgttttgttttctgaatctcatatattggtgttattatttataccagaattatttggcaaaggccgaagctcttgctcaaatgacgccaccatcctga

SEQ ID NO: 30060 - DNA, 370 bp, Caenorhabditis elegans
gagcaaacacagtttcagaaggtacaaagttctttcggagacaatttagagaagggattcacccggacttcaaaaaaagaatgtgagtttttgagactacagttttgtgtctactgcacttttgaaaatctaactatgaacttacaaactaaaagaattctgaacgtattcgacttcttggatatttttgacttttttgtgccagtatggaacactaacagtactagaaaataaaatgtaaatttcaaaaacgtaattttacaggtacacccatgaaacatgtgcaatatcggatcaagttcaaataatcatcaatacagtgatagatacagttattcaagataatctcaaagatacgggaatgatatga

SEQ ID NO: 30061 - DNA, 5235 bp, Caenorhabditis elegans
gagaaggaaaactgattgctgatatcaaccgagtgagtttttttcctaaaatcttattatgcctaattattaaaaagtgcattatttatttaaaaccatctattttcaggcatggcaatcccttgagaaggcagaacacgaacgagaacttgtcctgaaagaggaactcattcgtcaagagaaactcgaacaactcgcagcccgattcaacagaaaggccgagatgcgagagacttggctcacagaaaaccaacggcttgtcagtcaggacaatttcggaaacgacttgtcttcggtggaagctgccaccaaaaagcacgaagccatcgagacggacatctttgcttacgaggagcgtgttcaagccgtcgtcgctgttgctggagagcttgaagccgagaactaccatgatcaagccaaaatcaatgagagaaaggagaatgttcttcaactctggaactatcttttccaacttcttttggctcgcagagttcgattggagttgtcaatggccattcaaaagatcttccacgatatgcttcttactctcgatctcatggatgatattaagagcagacttttaagcgaggatcttggagcccatcttatggacgtagaagatttgcttcaaaagcacgctcttcttgagtctgatattaatattattggagaacgagttaacaattctattgctcaagctcaacgcttccgaaatccagatggaccagatggaagtggatacaagccagttgaaccaggaaccattgatgagagaagtgatgttctacaaaaacgttacaaggagcttcttgatttggctgctgaacgtaagcgtcgtctcgaagacaacaagagactttgccagttctggtgggatgttgctgagcttgaacatggtattaaggaacaagagcaagttctttcgtccactgatactggccgtgatattgtcactgtttcgcatttgttggccaaacataagaacgctgagaacaaccttcgcgacttggagaagtacctcgatcgtcttgatgtttctggaaaagaattgcaagatgaaagcatcccaggaagtgacaacattcctccaaggcttgccgagattcgtgattacatcaacaagctcaaggaactctctgcttctcgcaaagaaagacttgccggtggagtcgaatactaccaattcttcaccgacgccgacgatgtcgatcgctacttgtatgatactctccgcgtcatgtcatccgaagacgttggaaaagacgagggaactgttcaacttctcctcaagaagcacgacgatgtccatgacgagctccagaactttgaccaacacatcaaggttcttcacgccaaggccgagtctcttccacaggaagccagagaacatccagatatcagacaacgattggacacaactctcaagcagaaggccgaactcgaaaacctttctcaacttcgcaagcagagacttatcgatgctctctccctgtacaagttgtactcggatgccgattcagtcgagtcttggatcgatgagaagggaaaacttttggcaacattggtccctggacgcgatatcgaagaggttgagatcatgaagcatcgtttcgatactcttgagcaagatatgaagaatcaagaagctaaggttactaacgtcaatgacttggctcgtcaattgcttaatgtggaacatccaaactccgacgacattcttcaccgtcaaaacaagctcaacgctcgctgggctcaacttcgcgacatggtcgatcaaaagagaaacgagctcgagagagctcaccgcctcgaaactttccgcatcgattgccaagaaacagttacttggatcgaggacaagactcgtgtactcgaggattcggacgcgttgaccaacgatctttccggtgtcatgaaacttcaaagaagattgtccatgatggaacgcgatttgggagcgattcaagccaagctcgactcgcttcacaaagaagccgatgacatcgaaagagaacgaccacaagaagctcaagccattcgtgaagatatcaagagaatccaccaagtctgggatatccttaacaagaaagttcgtgagcacgaagctaaactcgatgaagctggagatcttcaacgcttcctccgtgatttggatcacttccaagcctggcttactgccacccagagacaagttgcctcagaggaagagccacaatccttggctgaagctgagcaacttctcaatcaacacgctgccatccgtgaagagattgacggatacgctgaggattacaagaagatgcgtgcaatgggagatcgtgtcactcaagatcaaaccgatccacaatacatgttccttcgtcaacgtcttgctggacttcaagaaggatgggaagagttgcagcgaatgtgggacaacagacaacatttgctttctcaaggactcaaccttcaaatgttccttcgcgatgccaaacaagcagaggttatgctctctcaacaagaaaactatctcgccaaggacgatatcccacaatctttggagcaagccgagaaccaactcaagagacaccaagacttcatcaccactatggatgccaacgacgaaaagattcgcgccgtcggaatgttcggtgatcagctctgccaagatggtcactatgccgctgacaagatccataagaaggctagaaacattgatgaacgtcgtggagccaaccgcgagaaggctcaagaagtactcaagaagctgaaggacgccttgtctctccaacaattcttgtccgactgcgacgagctgagagaatggatcgaggagaagatgatccgtgctcaagatgagacttacagagacgccaagactatcacctccaaattcgtccgacatcaagcattccaatccgaacttgctgctaacaaggaacgtcttgaccaacttaaacatgctgccatcaaccttggtgacgacaagccagagtaccacggaaccattgatccacagatcgaggaactcgctactcaatgggatgagttggaaaagactacagaggagaagggacagaagttgtttgatgctaaccgccaacaactttacgtacaaagtattgctgacatgaaggaatgggcaacccaacttgagaacgagatgactcgtgaagaccaaccaggagatcttaccactgtcaatgtggccatgcaaaaacaacatttgatcgaaactgaaatgatcaagaaggctcaacacattgatcaactcatggagatggagccacagctcgaggaacttcacccagacgagcttgaaaacattaaggctcatcgtttggcagttcaagaacaacttcaaagactccaggctccattggacgaccgacgtaaggcattggaacgcaagaaggccgccttccaatttggtcgcgatgttgatgacgagaaattgtggatttctgagagacttgttctcgctaaagctcaaaatcttggagaaagccttccagattgtcatcgtctccagaagaacctacaacttctttccaatgaaatcgacaaccacgaaccatggatcaaccagatctgtaataatggtcaagagttgattgacgaaggacatgctaacggaccagcattcgagaagaagattcaagaactgcgcagtgcttggcaagagttgaaggaagccgtcaaagacagaaagggagatcttggagaaagcgagaaggctcatcaattcttgtatgattgcggagaggctgaagcctggatgagcgaacaagaattgtacatgatgcaagacgaaagaggaaaagacgagttctcaaccaagaaccaaatcaagaaacacgaacgccttcaatccgatattgacaaatttgctgatacgatccgtgctcttgccaccaaggctcacaagttcgtcgaagagaagtcaccactcaccgaacagatccaagttcgtcaagctcaaatcgagaagctctacgcaggtcttcaagatttgtcgaaggagcgcagaaagagactcgaagagaccttggaactttacgctcttcatcgtgaaatcgacgatcttcttcaatggatcgccgacaaggaagttgttgcaggaagtcaagagaacggacaagactacgaacacgtccaaatgcttcaagagagattccaacagtttgctcgtgacaccgaaaacatcggatccgaacgtgttgccaatgctaatgatggatgtgatactctcattggtcacggacacactgacgctccgactatagcattgtggaaggattcgttgaatgaggcctgggagaatcttctggagttgatggacactcgtgcccaaattctcgaggcttctagacttcttcacaagttctaccacgactgccgtgattgcttgtcaagaatcatggaaaagactcatgctatgcctgatgatcttggacgtgactcaagcagtgttggtgcactctccagaaaacatcagaactatctcaaggatattgctgcaattggagaacaagttgctcaaatcgaaagagatgccgcagagcttcgagatggttacgctggagacaaggctcttgatatcggatctcgcgaaagcgaggttgtcaaggcatggaggcatctccgcggactctgtgacgcccgtacatctcgtctcatggatacttctgatcttttcaagttcatgaatatggtccgtgatttgttgttgtggatggatgaggtgaagagagaaatgaactcacaagaacgtccgaaggatgtgagcggagtcgagttgctcatgaacaatcatcaatcgctcaaggctgaaatcgatgctcgcgaggagaacttcaacgcgtgcatctcattgggacgagatctgctcaacagaaaacactacgcatcaagtgaaatcgagaagaagctgatcaagttgacaaccgaaagagccgaaatgatgcgcagatgggaagatcgttgggaatatcttcagctcagtaagtttttttcaaaaattaattaaaactgtcactaaaacaatttatttcagttctggaagtgtaccaattcgcccgcgacgctgctgtcgccgaatcttggctcttcgcccaagaaccatatcttatttcgaaggaatacggtagaaacctcgaagaaaccatcaaactcatcaagaaacacgaggcgttcgagaaatcggcattcgcacaagaagaacgtttcttggcgctcgagaaattgacaacg

SEQ ID NO: 30062 - DNA, 743 bp, Caenorhabditis elegans
atgacagcagctccaactataattcaattgagcaatggcgacagagtaaatcgtttcacggttttcaaaaaacttggagaaggtacattcggagcagtgtatgctgtgcgagatgatgctggggcggaacatgcactgaaagctgagttggcaacagagaagataccggtgagttggcaaaacgctgcgaaaaaacaggaacaaaactgaaattgatgtataattttagttgctgaaattggagttgtatgtgatgcagaagctgtctatgaagggacccaagcacatggccactcttattggtatattatttttctcttgaaaagaaagtctaaactctattattcagacaagggacgccacgagaacttcaactacattgtcatgaaatttcttggaaaatccctgcaagatgcaaagaaaacaggaccagatggccatttgacattgggttcagcgatcggagcttcgatccagtgtttggaggccttggaagagctacattggtgtgggttcttgcatcgagacgtgaagcctggcaacttctgtctcggaagagcagaactcggcgagctccgcaagatcttcgttctcgatttcggattgtgccgaaaatttgtggatgaccgaaatgtgatgttgcagccgagacggaaggctccatatcggggaacacctcgctatgcgccaatcgcatctcataatagagcggaacatggaagaaaggatgacgtcgaaagctg

SEQ ID NO: 30063 - DNA, 861 bp, Caenorhabditis elegans
aatgatcctccgcattgctgtatctgacccaactgctacgtgcccactcaatttgaagtttggagccgacccaattattgctgcaccacaacttcttaagacggcttccgaagagggaattaatgttgttgggatttctttccacgttggatcgggatgcaacgacgcatctgcctacaggaatgctcttcagcatgccaagaacttgtgtgagattggagaagggctcggattcaagatggatattattgatatgggtggtggatttccaggagccgaacatcataacccattcgagaaggtaaattttaaaactactaagttctaatgtaattaattttttttcagattgccgagacaattcgtgatgctcttgatgagttctttccagacaccaacaagcgcctgattgctgaaccaggaagatttttcgcagccggtccattttctcttgttgcaaacatcattcatgccaccgaggttcctgcttccaaaatcacaaaggatccaaaagactgcgctgatcatggatacatgtactacatcaacgacggagtctacggatcgttcaactgcatcctcttcgatcatgctcatccaatcggatccccgctttttgacactgatcgcaacgagaagttcatgtcaacaatctgggggccaacttgcgacagtctagatcttgtcgaggataagaagttgatgccaaagatgaatgttggagaatggctctactatccggacatgggagcgtacactcttgccgctgccaccacgttcaatggattttcgaagcctgtgccgatgtatgtgatgagcgaggaaatgtgggagagcattcgtgactcaactcatgtttga

SEQ ID NO: 30064 - DNA, 368 bp, Caenorhabditis elegans
gtttgatcatcgacgctttcggagagcttcgtgatcaacaagaatctgcaactgagaagctcgagtcatcatgtttcatttgcgacatcggcaaagaaacgtttgatcggatgcctcgaggcttcgaaattcacaccaccaaagagcacaactttgccaattacctgtatgttaaatgcttttattcaactgttctaacttttcaaacttctaggttcttcttacaacatctggtcaacaaagacgaaacagagtacactggtcaagaaacgtacgtacgtgagaagtacgataatcgagactgggacttcttccctgtcggagagtgtttcgtcaaacagtacgaggatcaattgctccaatcataa

SEQ ID NO: 30065 - DNA, 712 bp, Caenorhabditis elegans
gcactatttcccactggtcattttgttttgtttcattcttccaacaattatccccgtttatttctggaaggagacagcattcattgcgttttacgtagctggaacattccgttattgtttcacacttcacgccacttggtgcatcaacagcgctgctcactagtaagttcactttatttttatagattcggggtcgttttacaatttattacccagtgcaaaacaaaaatttaaatttaaaatcttcaagtgtttagcgggaccaaaacaaagaaaataggtaagttcgctgtcaaaatttctgtgatgacttggtctaaattaaagtttttaaaatacaaatgttttgtttttaagtttacggtaaaactgttttcttttcatcgttagaaaaataaatcaagcttgaaattattaaattaaaattttcagttttggttggaagccatacgatacttctgtttccgccgttgagaacgtctttaccacagttgtagccgttggtgaaggaggtcacaatttccaccacacattcccacaagactacagagcatctgaatattcattgatatacaattggacccgtgttcttattgatactgcagctgttcttggtcttgtctacgatagaaaaacaattgccgatgagtttatcagccggcaggttgccaatcacggaagtgaagaatcaagaaaaaaatcgatcatgtaa

SEQ ID NO: 30066 - DNA, 769 bp, Caenorhabditis elegans
ggatgttattctcaatgacaatgcttttggaaaaccgacacaactcaattctattcaatagattccaaataactaaaaaccgaactaaaatcatatattatttggttcgttatctatcgggtctaatatattctatgtctttactattcttcataccagaagatcaaaattccgcactactccaagttctaaccaaaataccatgcccgtctcaagaatttttcacggcttccgatgtttttgtattgtgtatcgatgagaactacgtcacgttcctggcactattcacagggattggtgtcttgacagagatagctcaaattgtatttttcttagcgtgttgtgtatattatttatttgtctcggtacgatcattcgcttctaaaaagacacgacaaatgcaagttaaatattttgcaagtataattttacaaatatcaattccaatgggattcatgatgcctaccgttctctacatattcctttctttatcatacaagttttataatcaaggtattcaattttgctttgaaaaataaaaagtttaattaattaagctctaactaacttatcaatacttcatgcatcacttcacgacttgttatccacatttatggtacttttaattcatgctccataccggcattttatcttttctttctttaaaaaattggatacaagtgtatcgacttcggaagttcgagatgaatcagtgatggcaacccaaattactattaaacaagtttctatgtctccagttacaaattaa

SEQ ID NO: 30067 - DNA, 1130 bp, Caenorhabditis elegans
atgcaccacgtcctctgtgcgaccctatttattgtcattatcaatgtgcacttaacttcgactcaattaaatattagggtaagtctaattgtgaaacctttctacctagcgtgtggatttttactctaaaaagtaaattaccatttgcaagaattttctagcaagttagatgcacagtctcaaaagaagctggtaattgactggagcttactagggaatataaatctgcgggagcaaacgttccacgtcattttttttttcaaaaacttatttataagcctgattgaactagtcctaattatttaaaaatttcaacaaaaaaaacattctaatagagaaaaatgatccagcgagagagtccacatggattcaaattcctgagtaatccccgctcaaatataggctcctttcaaaactttacaacacaaaccaaatttccgtttgttcgaatattttttgaaagttaattttgatgaagcataataatattttcttaattcaaatcagaaaatcatcgtgtttttaagaaaacattaatgacaaattctaaatatttcttatagaaaatccaacacaacgacaacacccgccgacaacagcagagaaatcgaaaatcagagccatacgatcaatactcacacttgacagacaccggtgaagtcagtgatcaactcaaatattacacacatagtttcgagcaaaaagttcgagaaacagttcgagacgaggagtacatgcttaaaaacttgtggtatgatccggaatatgtcattcacgatctttgtgaaccacataaatcgggtgggcaaacgggagagttgaaatggttagttcaagtttatttttagatttctagcaatattttcaaacttcctttcaggtcagaatcaggagatcgactattaaaagtgattggaaacggggttgttgaagacgggtataatatgttcatggcgccgggacagtcacaaggaaaacgaactgatgtacacgtggcagtgtacatcgaatcgatgtcatcgttcaaagcacagtctatggattttgaagttgatatgtatttggcgatgggttggtttgatagacggctagcacataattgtacgcatccaattttggtgactagtaaa

SEQ ID NO: 30068 - DNA, 713 bp, Caenorhabditis elegans
aattggagcaattttacaagctttccgacaaggaaggtaaggtgattggaagcaactttggccaaaagccgtacactttcactcttggaaaaggcgaggtgattcatggaatggaaattgcaatggagggaatgtgtgtcggcgaacagcgaaaagtgatcattccaccagagcaaggattcgacgaagatggagatgaagtagaaggagtaagttgatttatattttttaaaatctatttttaaattgcaaaacaaataaaatggtaatttgtactattctagaaaggagaaactctatactacttcgtcgagctgaaatcaatcttccgtccaaaacccggagccaagtggatcactgatgaaggagttcacattcacattactcacgaggtagagggatgcaccgaaaaggctcaagccggagatacacttcatcaacagtacacactaaatctcgaggatggatctttcatcgattcgagctggagccgcaatcgtccatttatcttcaaaatgggctccggacaagttatcaagggaatggacattgccatggaaggaatgtgtcagggagagaagagaaaagttgttattccaccagagctcgcttatggagaaaatggaagacctccagcaattccaggaaactcgtaccttcacttcgatctctcacttgagaaacttgtcagaccaggaaaagaggaactctag

SEQ ID NO: 30069 - DNA, 579 bp, Caenorhabditis elegans
atgcatttgctgattttcgttctgttttatttcttcaacagttactctgtaacttcttcaaaagtaccagtatgtaccaatgaatttacactgatcaacaataaatgcttgaaactatttacaaccccagcgaatcattctgctgctgagaaaacatgtcgaaaatatggagccacattggtaactgtgaaaaatgaaaatgtaagattttttagatgtgcatgggcttcatattagttttaggataatcatgcaatatctacatttgctggaacttcagcttcattattatggatcggactgtattgttttggtaatgatccttcaaaatgtttatgggacgattcgacgggctcagcagatgtatacgataatttcgcaagtggtaagactttgaacatagcatttgtattaactgatgttttaagaaactaatttttcctttaggtttcccacttgttgacattggaaaatgcgtctactattccgtacaaggtgcattgacaggaaaatggttgactgaaaattgcgatctgagttcgaaagcattcatgtgcgagttaccaactacattttctg

SEQ ID NO: 30070 - DNA, 255 bp, Caenorhabditis elegans
tttttacaagctgacgatattcatgcatttattattcagaagttatctggatggctcgtcctttctaattcttctctcaatgtttttatttacttttggagaactcccgattacaggtgtcactataattttcttctttaacaaatgtaatctttcagaaaagcaattttgaaactttttggtatatccaagtccgtcgtggattcaaggattcatgtgtcttatatgccgaataatcctgttgctattttttga

SEQ ID NO: 30071 - DNA, 365 bp, Caenorhabditis elegans
attgcaatgccaaagtggaaaatcgaaactgcacttgggttgaatcgaggtttaatggccgttggaattgagaaagctttcacagattccgcagatctgagcaactttgcagatggaatctatatttcacaagcagctcacaaagcacttattgaagtaggatcatatatgtctgctttcaaattaaaattgtattgtttcaggtcgatgaagacggaactgttgcggctgcagcaacaaccatctcatcttccgtcggatcagtccagcgaaccgaaaaaccaatcgaatttactgcagatcatcctttcctatttatcctctcaaaggataaccatccattgttcattggggttcataattaa

SEQ ID NO: 30072 - DNA, 368 bp, Caenorhabditis elegans
attgcaatgccaaagtggaaaatcgaaactgcacttgggttgaatcgagctttaatggccgttggaattgagaaagctttcacagattccgcagatctgagcaactttgcagatggaatctatatttcacaagcagctcacaaagcacttattgaagtaggatcatatatgtctgctttcaaattaaaattgtattgtttcaggtcgatgaagacggaactgttgcggctgcagcaacaaccatttcattttcacttacatcagtttttattccggccgaagaaccaatcgaattcactgcagatcatccattcctattcatcctctcaaaagataaccatccattgtttattgggattcataactag

SEQ ID NO: 30073 - DNA, 775 bp, Caenorhabditis elegans
aatgtcgaagaagatgaattcgcgccacgtcatcaacgagaggtggatccggagcaagaagcacagagacagcaagtacttggcgaccggcagcgtcgtatggacagagtggcggagccacactgggtgcaccgaatggaggtatgttaattttttaaagtttttttctggtataatgcgaaaaataattttgtggtatggccgtgaaaagagtaaactcggtaattttctcaaaagttgcatctgtagagaaactgatatgcttctaacttgtaattttcctcgtagaacaaagaacctccctggcgtccctgcttacaagccgtgaaacgcgtttgcttggtaggctggcagacgggaggtagacacaaatgacttgaaacttgctggtctactatggaatattcacttttctaataagtgtttcataaactttcctgaataaaaaataaaaagtttagtattggccaactaaaatatgttttccaacttattatattgattctgagaattgtttcagcttgaacccaccgtatcccactggctcgaccgcaaacctttaatgtacgacttccaattcccgtgtatcctgcaaatctgcctggtccccaacgccaagaagaagttgatcgatttcgaaggaatttgttacatactctacggccatttgagatgtcccacagaggagtgctttttcaaggattttcagccattcgagatttctctttctcgccggaacgtgaagatcaaccgagaccggctcgagtcaaagtaa

SEQ ID NO: 30074 - DNA, 518 bp, Caenorhabditis elegans
atgagctttccattctccatttttcttctcgccttcctcctggccccagtagccgccatcccttgtccaactggcttcacgcgtctcgtaacaactggtcaatgtctgaaaatgattgttgctccgttgagctactcggatgcctcggcaaaatgcaaatcccttggtgccaaggtgctcactattcaaaacgctattcagaataatgccgtcttgagcttcgccactgcttcggcaactggaaatgacaaagattattggcttgggctccaatgcaccacagcttcctctagttcttgcaattgggctgacgggagcaagttctcgtttgatggttttgctgagggtatgtaacttcatattttctaaaaatttccaaacttaacacatttttaggtcagccaaacaatagcttgggaacttgtgtatttgttggaaatcgcggccagactgccggtcagtggttcagtgcagagtgtggtttggtaaagactaatgttatttgtgaagttaattga

SEQ ID NO: 30075 - DNA, 517 bp, Caenorhabditis elegans
ttcctcggggattttatattcaacggaggagctattgccacggcacaggcaagtttaaaatacggaaatgatgtttggttttatgtttttgattacacaaaccctgcaggatttggatgtcttgacgaaataatgcctttcgtcgggcccactcattgcacagatcttcgatacttgcttggagaaggattatacagtgacttcaagccagacgatactgactggaaaatgatcgacgaaatgacaactttgtacaccaattttgcaaaatatgggtgagagtgcacacttcaaatttgaaaaatgatatttcaaacaactattcagaaatccaaacggaaatgaaggagctggaagttgggagccttatacgttggttaaccccgagcgccatttcagaataggatacccacaaggggaaatgagaaacgagtatcacaaaggaagatgggagttcatgaaaggaattagagatagaaacaatgttctgaatgaggttgtctatggaatattgtaa

SEQ ID NO: 30076 - DNA, 1513 bp, Caenorhabditis elegans
atgttgctactactctcccgggttctggtgaacgtgatggtgctgatgtgctttggtggaattctcacgaacttcatctcattctacatctacactcgtaaaacattccggaaaaagagcataaacgtcttgctcgcagccttgtcaatgtctgacctttgcgtctgcgttcttgcaattccagtttttgcaagtactcaacttcaacaagtcattccgccaacaattactgcaatgatcatggtgtacttgtatccagtgaccataatgttccagtcagtgtcagtatggttgctggtatccataacaattgacagatacttagccgtatgtcatccattcatggtcaatacgtattgtacaaggaatcgcgctctcataactgttggagttgtcgtgatattcagtgttgcttacaatttgattcgaatttgggagtacacgataaatttcgatgtcgctcctgagaatcgtacgattgaagatcttgttgtaccgaagcttcgagcaaatccgcacttcttattgtggtaccagaatgttgccacgttggtgtcgcaattcgcatttccacttacagtgttatgtgttctcaacattcaagtaagttggttacaatgggttgaggagtaggagtaggccttaggctcaggcttatgcttagatgtatgcttaggtttaagcttaaacttagtcttaggcttaatcttagatttaggtttcggcttaggccttggcttaagcttaggctgagtcgtatgcttaggattaggctgagtattaggcttaggcttacgtttaggcttggtcgtgtgcttaggctgaggattagtcatgggtagggtcagtattacatcctagacttaactgaaggtaggacattatttttatttatttagataaagcatgtaatcctaaaaacgattagttttagtgtaactgcccaaattttctaacaaagcaattttccaggtagcgcgaacaattatcgaggcatccgagcaacgaagagaactagtggcaagtgtgaaacgagaacattcgactgcaaaaatgatgataatggttgttttaggtaagattcattttttggatattctagaaatcggatttttgctcagtggtcgtgaaaatgaaaatacggtcacactcatagactgatagaagggatttgcggtaaaaatttgttttatttttttctacctaccgcgaggacaaacccaatcttaaaattagtcactagttttgagaaacattaaattttttggatagcatttgatgaaaaaattatttacatatccccaatacaatttagtattaaagtcaacaaagtcatgaagctttcagtattcctcgtttgctacatcttctcatttattctaaatatatgggaaattcttgacaaggagacttttggaggagatattggttggtttatgaatgacatcaacaatgtacttattgttgtcaactcgacgagtgcaattgttttctactataaatattcaacaag

SEQ ID NO: 30077 - DNA, 2292 bp, Caenorhabditis elegans
atggctgtctcagcaatggaagtgctctctgaagcgaagcgtcaattcgcccaaggtgaccgtatcgatgtgactcttttggatcaagtcgtcgagattatgaatcgaatgagcggaaaagaacaggccgaggctaaccaaatcctcatgtcgctcaaggaagaacgcgattcgtggaccaaagtcgatgcgattcttcaatattcgcagctaaatgagtccaagtattttgcacttcaaatccttgagactgtcatccaacacaaatggaagtcgttgccacaagtccaacgtgaaggaatcaagtcgtacatcatcaccaaaatgttcgaattgtcttctgatcagagtgtcatggaacaaagtcaactgcttcttcacaagttgaacctcgttttggttcaaattgtcaaacaagattggccaaaggcatggccaacattcatcaccgatattgttgattcatcgaagaacaacgagaccgtttgcatcaacaatatgaatattctgagcttgttgaggtattttgaattagttttaaaatgttttgctacatttattatatttttcagcgaagaagtatttgatttcggatcccaaaacctcacccaagccaaggaacaacatctgaaacaacaattctgtggacagttccaagaagtattcacactgtgtgtcagcattctcgagaaatgtccatccaactctatggttcaagctaccttgaagactcttcaacgattcctcacctggattccagttggctacgttttcgagacaaacatcacggaattgctgtctgaaaacttcctttcgcttgaagtgtatcgtgtcatcgctcttcaatgtctcacggaaatttcacaaattcaagttgaaaccaacgatcccagctacgacgaaaagcttgtcaaaatgttctgctctacaatgcgccacattagccaagttctatctttggacctcgacctggctgctgtctacaaagatgcttccgatcaggatcagaaactcatcagtagtctggctcaatttcttgtcgcgttcatcaaagagcacgttcatctgattgaagtaactgatgagccattaactgaggctaaaattttaatgcgagaatctcacgactatgctattcaacttcttttgaaaatcactttgatcgaagaaatggaggttttcaaagtttgcctcgattgttggtgctggttgactgctgagctctaccgtatatgtccattcattcagccaagtactctttacggaatgatgagtcaggttcgtgagcatccacgtcgtcaactctaccgtgaatacctctcgcaacttcgttcaacaatgatttctcgaatggcaaagccagaagaggtgttgattgtggaaaatgatcaaggagaagttgttcgtgaaatggtcaaagatactgattcgattgctttgtaccgtaacatgcgtgaaacgcttgtctatttgactcatcttgacaacaaggacactgaagtgaagatgactgaaaagttggcatcacaagtgaacggaggagagttttcgtggaagaatttgaatcgtttgtgctgggctgttggttcgatttctggaacgatggttgaagaagacgaaaagcgattccttgttcttgttattcgtgatttactcgggctctgtgaacagaaacgtggaaaggacaataaggcagtgattgcgtcaaacatcatgtatgttgtcggacagtacccgagattccttcgagctcactggaagttcctgaagacggttatcaataagcttttcgagttcatgcacgagactcatgaaggtgtacaggacatggcttgtgatacattcatcaagatttccataaaatgtaagaggcatttcgtcatcgtccaaccagctgagaataagcctttcgtcgaagagatgctcgaaaatttgactggaatcatctgcgatctttctcatgcacaagttcacgtattctacgaggctgttggacacatcatttctgcgcagatagatggaaatctgcaagaagacctgatcatgaagcttatggatatcccaaatcgcacatggaacgacatcattgcagcagcatccactaacgacagtgtgctcgaagagccggaggtaatttattttaaggggttggcttttatatttattcaaatttcagatggtcaaatctgtcctgaatatactaaaaacaaatgtggccgcctgcaaatccattggatcttcgtttgtaacccaactcggaaatatctacagtgatcttctatccctctacaa

SEQ ID NO: 30078 - DNA, 1088 bp, Caenorhabditis elegans
agctcaaaacggtgtccgtgaagcaacattgtcaccagaacgagaagaacgaatggcaacctccttgtcaagtttgtcaaatcttgccgcaggcactcaaaacatgcacacaatcagaatccaaaaagacgacactggaaagtaagttgaatttctaccactatattcaaaactctaaaaatatctgaaaccaaaaattgaataaatgggctgatcatgcatatattacgtatatagtattgcaaaaatagagacctaatagtattgcatgcgagacaattttaattttatttgtagggacaccatactaattttcgaatgcagctttggaaaaaatcaatctaggagccctttagaatttaacgcatacttttccataaatttcttgacgccttggatgtgtctaagttttttcgaccctgaaaacggcaaagttttcaacatttcatagaaaaaatattagaagctacaaaacttacttttgattggtacgttaggttacaagacaaatagaggaaacacggtatttttttatcttttgttaatttttgagctgtccagattaaaaagaagggaattatatatgtagttcattttttaattatttataatatgaaaaacaattatagcattaaaaaagtagtagcctttttcttattttctaatgtatcgtaaaataaatttattgaaagaatgagtatacatctaggttacacaaaatgatttatcaatgttcttaataaaacaataactaacaatcgaaaaaatgaacgaaattaaaaaacctatttaatttttgtagattgggactttccttcgctggcggaacctcgaacgatccggcgccgaacagtaacggagattcaggactttttgtcaccaaagtcacacctggaagtgctgcatacagatgtggtcttcgtgaaggagacaaattgattcgtgctaacgatgtgaacatgatcaacgcatctcaggataatgcaatggaggcgatcaaaaagcgagaaacggtagaattagtcgtgttaaggcggtccccatcgccagtttcgagaacatctgtgagtaggccatgtgagtattga

SEQ ID NO: 30079 - DNA, 445 bp, Caenorhabditis elegans
atgtctcgacgcaccgattctctctgtctagatgagtatctcagcaggttgattagcttttattttttatcttataaaataaacaccgcaataaatttcagtgagctcaaaaagcgtacccatattctggaatgtgcttggaaccaagaacatgatgatgatgaagaagaagaggaagtaaaagtagatcaaggatccgaagagactacatcatcccatgatatctatggagatgttggaaaacgagcaccaaatgagtttgaaaaggttttgtcttttcccaatagctttctgaacatgtaattatttccagattgatagattgacgactatcaaagtttacatcgcatggctcgctttatttgtgttcgcacacattcgtgaatatgtaaccaggtttgggtttgtgaaggacttgtcgagcaaagaaaatgcgaagatgaag

SEQ ID NO: 30080 - DNA, 472 bp, Caenorhabditis elegans
atgggtaagcctttcaaatttccagtcaaaaccaaaaaattaactatgattttcaggattccttcttggggttgttcggtcgcttcgccaacgtcgcgaggccgcagattccgagaatagtagtttcaaagaagcaactcataaggatttgtcttcatcttttgttgagcatcagatgcacattgctcaactctccgaaagattctttcactcaaaaattgatatcgttgaaccaaaaaaatcgaagggattgacaaaacaagaagctgctcaaaaactgaaaaccgacggaaaaaatgctctttcgccaccaaaaactatcagcaatatggagctgtttgttcgtcaatttaagtcagtttattatctatttaaattttaaaacattatcagaaaattttagaaatcttctttgggttctcatgttcggtgcagctgcgctttgtttcttgacctacatctatgatccaac

SEQ ID NO: 30081 - DNA, 1122 bp, Caenorhabditis elegans
atggcttcaggttatagaagtttagacggtatgcacagacttttgacaatgatttcatttttcttgcttttagaaaattttgctgctagactagatattgacgagttgattctaaaagttttgtcggttggacatcccgagaaaagtttgacgaaaacggtgaaagagcatgaactgatccaattatgccaaatggcaaagaagagttttttggatcagccagtgatgcttgaggttgatgcaccaattaaagtttgcggagatgttcatggacagtattctggtaaatgctcctttaccttaactggtaaattcattataattatagatgtaattcgcatgttcagtattgcccgtttccctccacactcaaactacattttccttggtgattatgtggatcgtggtcgtcaaaaccttgagcttatcacacttttcctgtgctataaaatcaagttctacgatagattctacatgcttcgcggcaatcatgagtgtccagcagtgaaccgcgtctatggattctatgaagaatgtaacaaaagatatgctagcactcgtctttggttggctttccaagaagcttttgctgcgatgccattcactgggctcatttcgggaagaattttgtgtatgcatggaggtctgtcgccgaagcttacaaatcttgatgtacttcgtgatttgactcgtccaatggatccaccaagtccttctcttcatattgatttgctatggagtgatccagataactcggtgatagattggcttccaaatgttcgtggagtctcctacatatttgggccaaatgttgtgaagaaacaaatcgagacgttgggaattgatttgatcgctcgtgctcatcaagtggttcaagatggttatgagttctttgcggagaagaagcttgtcacaatcttctccgctcctcactactgtggacaatttgataactcggctgctatcatgaacgttgatgataatcttatttgctcattccatgtgggtttttattcgaaaaattttattttaaaaaagtttttattataataaaaataaaaattaattgaaattcaggtgcttcgtccttcaaatcggaaagccaaacaaccagctaattga

SEQ ID NO: 30082 - DNA, 1225 bp, Caenorhabditis elegans
atgacacacgaagcggatcccggctggcagtttcttcgccagtcgccagaacaggtagatctatcttctctcacactctttcgatttgtttgcattttactttttcttactctcacgcaatgatgtactagagtcaacaagaatatctcgagtattttttgatccgcgagggaatcgatgttgtatctaagattttttattggggaagattttgcaatgagttcatttttgatgtcttgcagttttattaaaagatcaaaacacagatcaacattgatcgatggaactgtataatgaaagagataatttagtttatatgtatctaaaagagcaaagacgtatggctttttgacaatgaatgcatttcttcaaatatacgattggatgtgtcacaacatattcatttgaaacattaaggagataattatttttgtaaaagtaatatctgtatttaggtcaaacttaggtgtcgaaaatatttaaaccctaattctgagtactcatttcgaatactttataactatatataacatttaatatcctaataatcatcacttgattttaattcaagcgttacgtgattttatcttaaaaaatcaataaaacccatcgaatacataattcaagtttttaccatgggaagacagaattattatagattattatcagtcaaactatcctgtagagacatcacaaatgaacataaaaattcccccaattcattcgttatatttcagctattggcggccacgacgaagaagttcgattcgaagaaaaatgtgtgggttgccgacccagaggaaggattcatcgccgctgaaatcaagtcttcgaagggagatacagtggtggtggtaacatcgaaaggagttgagaagacgatcaagaaggacgatgctcaacagatgaaccctccaaagtacgagaaaactgaggatatggctaacttgacattcctcaacgatgcttccgttcttcataaccttcgtcaacgttactattcgatgatgatttatgtatgtttttgaatgttctgaggaagtcatgaaaactttaaaactatttcagacctattccggacttttctgtgtcgtcatcaacccatacaaacgtctcccgatttattcggaatcggtgtgtcaaatgtatctgggaaaaaggagaaatgaaatgccacctcatttgttcgccgtctctgatgaagcttatagaaatatgaccaacg

SEQ ID NO: 30083 - DNA, 1504 bp, Caenorhabditis elegans
atgtccccggtgagcctattactacttcttctattcccattgagcacttttcaacaacgagaagattgcacagtgcagccaccatctccacgtcatccgaacattgtgattcttatgattgacgacttgggttacggtgacattgcgtcatacggtcacccgactcaagaatacacacaagtcgatcggatggcagcagaaggcacccggtttacacaagcatattcagcagatagtatgtgctcacctagcagagctggattcattactggacgattacctattcgattaggtatagttggaggacggagagtttttgttccttatgatattggaggccttccaaaaagtgagacaacaatggctgaaatgcttcaagaagcaggatatgcaactggcatggttggaaaatggcatcttggaattaatgaaaacaatgcaactgatggtgcacatttgccttcaaagcgaggatttgagtatgttggagtcaacttgccgtttaccaacgtctggcagtgcgatacaacaagagaattttacgacaaaggacctgatccatcactttgtttcctctatgatggagatgatatcgttcaacaaccaatgaaatttgagcatatgacagaaaatcttgttggagactggaaaaggtttttgatgacaaggttggcacaagatcaacacgagagaccattcttcttctatttctcatttccacaagtccactcaacacagtttgcaagcaaacgatttagaggatcatcggttagaggtaagcttgaaagtgaatgtttctatgaaaaatggtcagctagatgcaatctacgaatgtttttgattgtgatatgttgtgaacttgatatttttgaaatgtctcggaaacacaataagctatattttaatatttggaaatctttgccgtttgaaaatcgttattctaaacgtagcttgaccattttcggtagcaaaattttcactttttgttgcacgtgtccttatcatatctagaagcttcaaccacaaaatgattcaaagaagcgacttcaatgatctccaagagtgtatgttgatgtctaacttcacaattttgcagaaagaagcactccgttctgacggaattgatatctctgacgaattgcgtggtgagagtgaagatgtggaaggaagcctcggaaaggctcgtccgatcatctactactgtaatactcatctgatggctattaggatgggagactacaaagttcactacaaaacatctccaatcttctttaataattcagttgatccaaatcttgattatttctgtccaaatggaaaaccaaagtctgattggtgagtttccctagcagctaactttgttcaaaacaaacaatttttcaggtacgtttcacaagtctgtcctgatgagcatctacaaaaacattatcctccacttgttttcgatcttattcgtgatccatatgagcagtatccattgcaaaatactgtaaaatcacaagag

SEQ ID NO: 30084 - DNA, 740 bp, Caenorhabditis elegans
atggacggaacttcccgggttgaatacattactccaccggtgaatatttgtggtgacattagaagtcgttacggtgatgttctcgacattttcaaggtattccatagccttttcagttaaatcttcatcgatattgccatgaatcaaacatctttaaaccttgttatcatttctgacggactgtaactgatagcatgacatcagatacaaatggcataaagattaaaatgaaaatagcaacattcagacttgtggctggccattcgaacaaaaatatgtatttcttggaaaccttatcgatggcggaaagttcagtctggaaactttggttattcttctttgttgcaaaatttgctatcctcagaattttgtgattcttcgcggattttatgaacatgagctggtcaagtaatacttattttgttatacaaatatcttgaaatgcaaattttacagatcagacagaagcttcattggtgaattgcgtgtaagattcccggattccaacaagtggcaagctctgaatgcaattatcaaaagtcttctgaaacgtcttccagtcatgacggtcttgaacagaaaactgttgtgtgtcaatggaatggtgacgtcaaacatcaagaatgagaagaatgtggtctcagtgaaaaatggaaacatgtttgaaaatcataatactcgcgtggaagttcaatttttggatattgacatcccatccccagttacaccaaacaagattg

SEQ ID NO: 30085 - DNA, 875 bp, Caenorhabditis elegans
atggcactacttctccaatcggagactgatttcggtctgggacttcttcgtcaacagaatatttccgaatctctcgcattttctccactttccattgccttagctctatctctggttcatgtagcggcaaaaggagaaactcgtgatcagattcgtgaagctctcgtaaaaggatccaccgatgaacagctcgaacagcattttgcaaacatctccgctgcactattggcggctgaaagaggaaccgaagtaaaacttgcgaatcatgtcttcactaggtaaattaaaagtttggatggagatttcaaagttgtttttattcagagccggatttaaaatcaagcaatcgtacttagatgatgtcaagaaactttacaacgctggcgcaagttcacttgattttgacaataaggaagctacggccgaagcgatcaataattttgttcgtgaaaatacaggagatcatatcaagaagattattggatcggacagtatcaactcaggtttcaaatttttaaaataaaattgataataatgtttcttattttaaagatctcgtcgctgttctcaccaatgctctctacttcaaggctgattggcaaaacaaattcaaaaaggattctacattcaagagcgaattcttcagttcagctgattcgaaacgagaaatcgattttctccatgcctccagtgtctcgagagattacgccgaaaatgatcaattccaagttctcagtcttccatataaggacaacacatttgcactcacaattttccttccaaaaacccgtttcggattgaccgagtcgctcaaaactctggattctgcaactattcaacaccttctatcaaatgtctccagtacttcggttaat

SEQ ID NO: 30086 - DNA, 583 bp, Caenorhabditis elegans
atgtagatttgccaaaataatgaaataaaaagttatatgtgccattatttttagaattcttgaatttctccttccaggcacgaatttctctccaaatcagaggctgagtttgccctgaaactactccatcaacaggatcactctcagtcttttgttttctcaccaattgctatttcattggctttatattctctatatgaggcagctagaggtgaaactcgtagtcagattcacgattgtcttttcaaaaatgccactgatggagagatggtaacacatttttcaaacgtctccaccgcactttcagcaatgaaaaaagatcctcaagtgaaaatttgcaatcatatcatatgcaggtacttaggtttcgttttgaaaattttatttgaactaacttgtttcagaaatggaattaaaaccgagtcattgtgtttagataaagtaaagttactttataattgtgaagtgtcatcacacgatttagacaatgaaaaagaaactataaaaacaataaacaaattgatacgagaaaatacggatggacacattaagaaaattaataccaaaataagtattgataaag

SEQ ID NO: 30087 - DNA, 1224 bp, Caenorhabditis elegans
atgtcttacatctaccttttgctaggatatttcctagtttcaccagctttttgtgtttctaagccaaaagtgacaactccatatggtcctattgttggtttcgagcacaaatctacggtaaccggttcaaaatatcatgttttcctgggaattcgatatggaaacccaccggatcatatctacaggttccaggtacagttattattgtttttctacaaaacaatttcgagtaaaattttcgaattaaaaaaaactggttttgaacaaaggagaagcaaacaacaaaattaaattggaaatttgaactttcgcgcaaaaaattatataaagcaacagtattttcattgttttagaaaaatgttagcctaataaaaatttcggaatttgagtcaactttcactacggaaacgtaaaaaaggaatttgggaaacttttcaattcaatttatttttttaaggaaaagacgatatttcttcaaatttcagtgtatttttgcagaaaccagaaccagttgagaaatggcctcacatcaaccatgatgccactcatttccgtgcttcctgtatcccttcactccgatctgagctggaggagcaggtcaattacagtgaagattgtctctttttgaatattgttaccccaccagatgctgtaagtttgcgaaaataacaaaaaataatcttgaatataaaatttcagaaagagaaaaaactgcctgttctcgtttttattcatggtggtggattccaattcggtgatacttcaatgattggttaccagaaagccgctgataactttgtgtccaaggatattatttttgtttctattcaatacagacttggtccacttggattctttacaactggagattcggagatccccggaaacatgggactttgggatcagaccttggctctacaattcttgcacgaagtacttcctgactttggtggtgatccagatagaatcactttggctggtcattccgcaggagctgcaagtgtttcagcacttctctattcaccacattctgatcatttgttcagccaagctattcaactttctggaagtatcttttccgagagcaacctcgatagaaatgtagtggatgatagtcgaaaattggccaaagcagctggatgtccacaggaggattccaaagaattgagagattgcattgaaattagaacagttgatgagttgttagatgctatggaatcaatt

SEQ ID NO: 30088 - DNA, 321 bp, Caenorhabditis elegans
atgccgctcaacaacccgccaagcaaaattcattcaaagtgactgcctttgttctaatttttgacgtgttcttgaattagtcgcgattttctttttcctttctcattaaattttttattcctcaattttattataatatttcaactcgcagaattacattaatcatgagcggaaaggaaaatactgctcctgtgatagacgatcagaaggccgaggtaattgttattaaaattagaaaggcatcaattctaatcttcaggttatttcacttacggaagatagcagacctcagagagttgaccaggcaagggaagaatcatg

SEQ ID NO: 30089 - DNA, 957 bp, Caenorhabditis elegans
cgaccggagaaaatcagttagcaatcccaaaaacgacattcggaattgcaaaccaagtttcagcagatttaaaaaacgacgccaccgatggaatattcggtcttgcattcactacattggctgttgatggcgtagttccaccacttatcaatgctattaaacaaggaattcttgatcaaccattgttcagtgtattcttggaacatagaggaacattgacaaatgttggaggaggagtgttcacatatggagcagtagacactactaattgtgaaccagtgattggatatcagccattgtcatctgccacttattttcagttcaaggcaaatcgattccgactgggaaaatatttgaatgcaaaagttgttgacgtgatttcggatactggaacttctttcttgggtggtcccagtgtagttattaatgaaattgcaaagcaggctggcgctaccgtaagtttttatcagataaaaacctgataagatctcatcttatcttcaccttaatttataactatgaatattttttgtttcgactgaaattttatttcatattaacagtaatggagtcgctcgttataacttcaacttttttgaagccggttgtaaaactaactcttcccattcaaaaaccaaataaacatgtaaaattaatttccactctaaaatgttacagtactatatccttggagaagcgtacgtaatcgattgtgatgctactcctggaccacttgaagttacaattggtggccatgattatcaaatcgaacactacaattatattgcggatgttggcgatggaacgtgtgtgatggctctcttcccaatggattttggaggttttggaccttcctggattcttggagacccgtttatcaggcaatattgtaacatttatgatattggaaacttccgaatgggatttgctccatctttgcaacctgctccaaaatga

SEQ ID NO: 30090 - DNA, 969 bp, Caenorhabditis elegans
gaccaactgcaagaccaagagcaagttcgattccactgcctccagcaccttcgttaagaacggaaagtcctggaccatccaatacggatcaggagatgccgccggaatcctcggacaagataccgttagagtaagtttatcttcaatgcattaatgtgtgcgttgtgtaatcttgatataaattagctggcaaagtgaattttacaaaaaatcagtccttatcaaattgattttcagttcggagctaagggagactcccaattgtctgttccaaccaccaccttcggaattgccagcaagatttccgctgacttcaagaatgacgccaccgacggaattctcggacttgctttcacctcccttgccgtcgacggagttgtcccaccactcatcaacgccatcaaccaaggaatccttgaccagccactcttctcagtctggcttgagcacagaggagccgccaacaatgttggaggaggagtcttcacctacggagccattgacaccaccaactgcggagcccttgttgcctaccaaccactttcctctgccacctactatcaattcaaggctgccggattcaaactcggatcatactcaaacaccaagaccgttgatgttatctctgacaccggaacttccttcctcggaggaccacaatctgttgttgacggactcgccaaggccgctggagccacttatgatgactttaacgaggtctacttcatcgactgcgctgcccagccaggaactcttgatattaccattggaaccaacacttattccatccagccagtcaactacatcgttgatgccggaaacggtcaatgccttttcgctgccttcccattcgatttcggaggattcggaccatcatggattcttggagatccattcattcgtcaatactgcaacatttacgatattggaaacaagagaatgggattcgctccatctctccaaaagtaa

SEQ ID NO: 30091 - DNA, 1006 bp, Caenorhabditis elegans
atgaagacaactcttctcgcttttgtagccattcttggcatgtgctcggcaactgtggttcagcataaattgatctatcgggaatcgccaaagatgcaaatgatgaggcgaggagaatggggagcatacgttcaacacaaggctgccctacgtgacgccaatccagctgtgttcgccagtgctccacaaaatgtcaatgattttggagatgttgaatacctaggaaatatcacgattggaactcctccacaacagtttattgtcgtcttggatactggttctgcgaatctctgggttccaggaagtaactgcgagtcagtagccaccttacacaatggtttttaaatttttatcattttcagtggaacatgcaaaggaaagagcgagtttgactcatctaaatctacaacattcaagaaaaacggacaatcatggcaaattcaatacgaatctggaagcgctaagggaatcatgggagtagatactgttgcttttggtggtgcttcagaacaacaacttcttgtcccatctaccactttcggtattgcctctcacatttcgtctaactttaagaatgtaagatctatttcccagattatttgattcttcatcggaacgaaactttcaggacgctgctgaaggaattctcgggcttgccttcacatctcttgcagtcgacggagttaccccaccactgatcaacgccatcaacaagaaaattctcgatcaacctctgttcacagtctttttagaacataagggaacggcaaagaatgttggaggaggtgtcttcacctacggagccgttgacactaccaactgcggaccagtgattgcctatcaaccactttcatctgccacgtattatcagtttgttgctgatggatttaagctcggatcatactcaaacaataagaaatctcaagtgatttccgacactggaagttcgctcatcggaggaccaagtgctgtgataaatggcttcgctcaagctttgggagcaaaa

SEQ ID NO: 30092 - DNA, 1244 bp, Caenorhabditis elegans
atgaagaccactttcgtagcactagttgcccttttgggcctgtgctcggcaaccgttgtccagcacaagctgatctaccgtgaatctatcaagatgcaaatgatgagacgtggagaatggggagcatacgtccaacacaaagctgctcttcgtgacgctgacccagctgtgtatgccaatgctccacaaaacgtcaacgactttggagatttcgagtatctcggaaacatcaccatcggaactccaccacagccattcctcgttgttttggacaccggatcttcaaacctctgggttccaggaccatcttgcgagtgagtaaatccttgttgtttttgatttttgataattattttccagtggatcctgcaaaggaaagagagagtaccaatcaacaaagtcctcgactttcaaggccaacggaaagccatggcagattcaatacggatctggaaacgccaagggatacttgggagaggataccgttgcctttggagccgtcaccgagaaacaactcccagttccatctaccacttttggaattgccacacacatttcatccgacttcaagaatgtaagtttatagtgtaacaagaactaatgtatatttcaagtatccgaaaatctattttaacacatgtttttttccttctgtttttttcattttctgtaattagaaggacagaaaaatgtaaagcaaacagctttttagtgccgatttttatgacgatgactttaagaatgcatttttacgatcattatcagttcaaacacagtggcaaaatttaggaatgcaaaaatttattgcagctaaagtgcttctactcacatggaatagtacacagtgggaatattttctctttcaggatgccgctgagggaatcctcggacttgctttcacatccctcgctgtcgaccatgtcgttccaccactcatcaacgctatcaaccaaggacttctcgatcaaccacttttcaccgtgtggcttgagcacaagggatctgccaacgatgttggaggaggtgtcttcacctacggagcagttgatactaccaactgcggaccagtgattgcctaccaaccactttcatctgccacatactatcaattcgtcgctgattcattcaagcttggatcctattcaaactctaagaaataccaagttatctccgacactggaacttccttcctcggaggaccaaaggctgttgttgccgggctcgctagtgctcttggagctact

SEQ ID NO: 30093 - DNA, 563 bp, Caenorhabditis elegans
ctgtatctgcattcttcgggctgtcgatttctggtttctacacatcgctcctgtcaattgcgccatctcatatcggaacactcaccagtcttgcaactgttatcggtatgatttcgtgttttactgaataaaagagcacaattatgcttataattttgaaaattcatgtttctttatatacttgaaaatgcaatatttttaacgtttagaaaaagtaaaatttgttctatattgaaaagtttaattctggtaccagcactgatcaaaatcatttattcaacgaaaatcaagttcacaatacattttcaacaaaccatcttccaggtttcgtcggccgaatgttcacacctctcatgatctcatattacaagactgttggaactgctgaagaatggggacacgttcttttaatttatgtgtttgcaagtgccactggtggaatcatttttttgctcttcggctcaggagatgttcagaactgggactactcaaaacgtcacaacacagctaggccaaacgctttagtggcaccaaaatcagacaaggatctcgaagatttctaa

SEQ ID NO: 30094 - DNA, 1389 bp, Caenorhabditis elegans
atggaagaacctctagtacctctaagatatatcatactcttcctatttctgtccattattggtatgattggaaacttggcaattgtgatcatcacctataaatacaaaactcttcaatcaaaatgctgcattctcattgcaattatggcattttttaattttatattttgtatttatctggtacttttcaaatcaaaactattgattttaacttctccgttcagattcaattaagaataatgatgctctttgggatgtaccttcggtattgcactctatgatatataatagaatgcgtattctatgacgagccaacactccaaggaatcgtcttataaatattgtgccagacatattaactaacgagtaatactctattgcaaacaggaaattcaaacttcatcaatctcggtattttccaacttgttggctggctgatttctatttgactgtattttatcctttaatttttattttatttgaaaaatcattagacgtaccaactgaatgagcattcttctaatctccggccaacttgttattcgttttttttatatctcaccgttcaactagcatttttttcttctatattattaaatcgcatttttccttgttctctttttcctactaaaatcttgtcgtttagtttttttttctaatggcctagttcaaaattgtcaaaaatttagctcaagtatcaaacgaaacaatggtggatcctttactgtccctgctcaagattgttgtatacataatttttgcaacgataggtgtttttggaaatctggcaattgttataataacttttaagtataagtcattgcaatctagatgttgcgttcttattggaattatggctttcttcaatttattttactgcatttattttgtaagtgtttttgtaatgtcgtaatcaaacttattgattgaaattctaattgtagttttacatttactgtgtcaattatttttttttaaattttaatttaaaaaaattgaaatttagaatttaagacaacatgagaatttaaataccagttgctcacctaattttagtttagtgcgcaaaagttttatggattaaaaatttgatgtaccgttgacaatttttgacagtttgttcatattctgtttagatccaattgagggtgatgatgattatggaaatatacaatattacgaacaatttgtgttttttcctatcgatttatggaatattttcattaaatatgcagagtatgattggtctttttattggtcttgatagactgtacagtgtttcatttccggttaagtgagtgtttcaggttttcaggttttcaggttttgattacatttgtatgttaaatgttgatttcagatattctacaattccagtgtatcagtatg

SEQ ID NO: 30095 - DNA, 1368 bp, Caenorhabditis elegans
atgggtctgtgccaaagtgaggaggaaaaagttggaacactgaaaagtcgtgcaattgataaggagataaaacagttgcaaacaagcgaggaacgaactgtcaaactattattgctaggtttgtaaattatctcataaatacaatttttatttacaatcaaattctgtccataattaaaatgacgccagttaacagaaggttgccatggtactagacatgactatgtgggattgaatacacatgttaatagtctgttataaagtgttcaaaaacgaaacaataaaatgaaaatcaacgaaaatatacgttcaaaaataatacgtaaattaatattttaatacaataaaggcggattaatccggatatttgaggcgtatgtgggaaaatgaatgatgtgtacttaaaagtaataagttaatttttttgcaaaaatgtaagatgatatgaaaaaagtgtatttaaataattatggaaaccgttgagaagaatctgaagcttttctgaatttttttttgaaatttttgctgaaaacataagtaccgaatgttcaaaatttttaaaactgtacttatttattttttgtagtactgtttatggtattttttcacattaaaattattgaaaaaaagagttctcaacagcaatcgcccttttgaatttgtttcttctagtctctcaacatacataatctttttttcaaacagaacaatgattatcaccagactagaaaaaaatatctcatgcgtaatttctacttattttctttattgtcttttcaattcacaaatcaaaaataaactgatggtgactaaaccgaaataaaattcatgtgtcatcagtttacgtcagatgacgttggattctctagatagttgtgcattgcgattttgtgtttgtttgtttgttcctcctatatctaaacttcatgtgaagaatgaaaagacaaaggatttcgtgagaatgagggctcaaaagtgcacaaggactttgattaaattcaatttaaatttcgattcacacttagaaatcagaatcctcttgggggacaaaccttgtactatgacccttagaatgagtacacttcctgaatgtttgcgcctataataatgaaaatgaaactatgacattaattttcaggagccggagaatgtggaaagtcaacggtgctcaagcagatgagattgctcacgtcaaaacagtacacagatgaggaacttttgacgcaggccaaggtatttgaatttagagattttgaatataaaatgttgaattttcagttggtatacacaaacatagttattgaaatggatcatttagtcaaagcaatgccagctgccggattgaatttttctgatccgatgagagaa

SEQ ID NO: 30096 - DNA, 595 bp, Caenorhabditis elegans
atgtctgacgattacgatgaggaagaggttacattcaagacggtaatgttctccaactgtggtcaataatatgaattgaattttagaacactgagatttcgagcaagaaagcaaattatgtgattgataagttgctcggtgaaggtggttttggtgcggtttataaggttaaggactcaaaaactggaaacttttacgcgatgaaagtggagaagaagcaggagaaaaagccgtcaaaattgaaaatggaggtaatcactattttcagtagttggacaaagttagtacttccactttgttatctttggttttaccaacaaattgtcaactgataaaatatttattgtctatttttctatagaattctgtcgtatgaaaatagtcgagtgcaagacaaatgaaagaattcaagtgtttatctcagataattcagatatttcagataatgattctgaagttggtctgtaatgagcgacaaacatctcatttcacgaaaatcattgatcgtggaaaaaaggataaggagggtttcttctttttagtgatggagcttgctggatctagtttggctgatttgaagagaaatagaggaaag

SEQ ID NO: 30097 - DNA, 1090 bp, Caenorhabditis elegans
atgccaacttcactcgcgtttttaattgtacttcttgtttcaactgtaaattctttggatctgaatgatattagtgagttaaaatttcgttttgatcaatttcaaaaaaaaaacagtctgaaaagtattcttctgctttcgaatttgaattcgaagtttttaaaagatgcagtgggtttgttgaacattatcccaaatttcgcatccaacaaaaagcgattaaacaacttatatctcggttctctatggttttatcaaaaatattgtcaactgatgaatacgtggaaaatgtttctctatatgttggctgtataacttttttgataaaactgtatataaccgagatataagttgccaaattagacgaaaggaaaaagcgagaacaaaggaacctagcagtagacttctacctctagattttgacagtcttaaaaagttttaacatactcagaaaaaataaagacgaatcccactacgatttctacaactacacttttgacaacgacaacaccagaatacgtgacatttacaatcgttgatcctggagcaatgctcattgattgtcctggtggatgtccaaccgggtggcaatatctcaattcgaaatgctataaggttcttattcattttcattgtctgtctttgaaagttcaattacagaaattcgatgcagctgtcacgtacgcgggtgccacatctgcttgtgctgctcagggtgcagaacttgttacaattgacagcttcgacgagaatgatgctttgagaagtaagtataactctgaatatttggaacattctgatatgtatcttgaattcagaagcatttgacactaatgctctagttgacgagactaaggaaacatggatcggcttgaaatcattaagtggtgcatggcagtgggctgatggttcttcagcaacttacactaattgggctccatcacaaccttcgagcaatggtctttgcgttcagatgatcacagattcattgagcaacgctacctataagtatcaacgtggaggttggaagacttacggttgcgggaaaacatctgcgagttacatttgtgagaagggagcaagtgcataa

SEQ ID NO: 30098 - DNA, 470 bp, Caenorhabditis elegans
gaagatatggtatatctccagactgaactcaaaaaagttgtccaagtgctgacatctttcgatgaatacgaaaatgaactcagacagggatcactccattggtcgcctgctcacaaatgtgaagttttttggaatgagaatgctcacagacttaacgataaccgacaggaacttctgaagcttttggtggctatgcttgagaagagtaacgatccattagtgctctgtgtggctgctcatgatattggagagtttgtcaggtatttatgaaaattactgtactgtattcattaaaacattaatttttcagatattatccacgtggcaaacttaaagtggaacaactcggtggtaaagaagcaatgatgcgtctgctgactgtgaaggatccgaatgttcgctatcacgctcttcttgctgcacaaaaattaatgatcaacaattggaaagatcttgggcttgaaatctaa

SEQ ID NO: 30099 - DNA, 910 bp, Caenorhabditis elegans
cgttcacctgatgaacagtaatatgggaatggccattgtctgcatggtcaactcttcagctacatatgataatgaaacatatccagaaaatgctgctccactccttgattggtcttctgatgaacaaggatacatattctctgcatttaatgctggtcttcttgttatgttgttcactggaggaatggctgataaattcaatgcaaaatatatgattctcgtcagtgtggctattgcttcattggccaattttacacttccatggatggcaccaatcagtgtctattgggcaatcttcagccgattcttggttggtttcgccgatgctcttttgcaacctgccatgaactcgttgatcactagatggttcccaacatctgaaagaagttatgctctgggtttggctacgggtggaagacaaattggttagtttttgaataatttttggatgattttataaaaaaataaattatgattccaggtactctcatcatcatcccagctgcaggagcactttgttctcaaactgaaatctttggtggatggccatcaattttctatctttctgggttcatcggagttcttttcatcttttcttacattttcctcggagccgacaaaccatcaaaacaaagctgcatctcggataatgaactgaaattcatcacaatctctaatcaatctgaagatgttggaaagaagagaaccgagaggaaagttccgtggaagaacattttgaaatctggagctgtttgggcatctgtcatttctttggtgtgccacgaattcccattgatgacattgatcatgttcttaccttcatatcttcatgatgttcatcactatcattccacggaaaacggtatcctctctgcacttccgacagtttctctctggtttgctaagatag

SEQ ID NO: 30100 - DNA, 743 bp, Caenorhabditis elegans
atgtatttttctttaaatctcgacgaaaacttgttaattatgattatagtaatcgcttatactcttcagtttttgtaccatttgatcaaaatttctctaaatatatttggtgtttacatattttatacaccgattgatttgaaaagaacagcaggagcatcatgggcaggtgagacacacttaacaacacaattttcaattttctaatcgtatacaattaattttttcagttgtaactggagccactgatggaatcggaagatcatacgcgttggatctggctagacgaggtttcaatatattcctaatatctcgaaccaaatcgaaacttgtgaaaacaaagaaacagattttgaataaatattctgatatcgaagttcgttacgccatctgtgattttacaagggtatcttacgaagattacaagaggttattacatagtctcaacgaagttgacattggaattttgataaacaatgtgggaatgtgttttgacaatccagaagttttacacagagtggaaggtggaattgatactctcactaatgttatcaatgttaatattttgccggtaactttagtgagttggaatttcaaatcaaatcaagccagtttacattttttagttgacagctggaattcttccgcaaatgatggctagaaaatctggaataattgtcaatatagggtctgctgctggatcaattcatatggctaaatggtcggtttattcagcaaccaaa

SEQ ID NO: 30101 - DNA, 721 bp, Caenorhabditis elegans
atgctcttgcccattttattgcattttttgcttctaatcacccaattaaatggctcaccagcagaagtacggcttatcaatgatcttatgtcaggatatgttcgtgaggaaagaccaacacttgatagttcaaagccagttgttgtcagtttgggagtctttttgcaacagattattaacttggtaatttgtatttttcactaatttctaaatttttcatataaacaatgttaaagtttcaaaagatttaatttttgtttacaaattggaacacttttgaaaaacttattgcaatgaaacttggtatttaacagatgatgttcatagatttttattcaactatcaattttttcagtccgaaaaagaggaacagctggaagtaaatgcctggcttaagttccaatggagagatgaaaatttacgatgggaaccgactgcttatgagaacgtgacagatctaagacatccaccggatgctctatggactcccgatatccttctttataataggtaacttccatttctagaggaacttgaaaactcaaaaaccacaatttaaacgttttccagtgtcgattcggagtttgattcgtcgtataaagtaaatctggttaattatcatacgggaaacattaattggatgccaccaggaatattcaaagtatcgtgtaaattggatatttattggtttccatttgatgaacaagtttgttattttaag

SEQ ID NO: 30102 - DNA, 810 bp, Caenorhabditis elegans
atgtctgtctgcacccttctcatctcgtgcgcaattcttgcggcaccgactctcggatcactgcaggagcgcagattgtatgaggatttgatgagaaattataacaatctggaacgtcctgttgcaaatcattccgagccagttacagtacatctaaaggtatttttaaatttatttttgatctaaaaatacgatgaatgtatgttttcgaaccatttgaaaattcttccaaaaaccagagttcgttttttgctggtaaatttctagatgaatttcattttttgtcttctgaagatattccaaatacagtaataaagttatgtctactagaacaatttgatattttatttcaaaacggttactgtatctaaataatagtaattgtaattaattttttgaaaaaattaatgtaaatttaacttcaggtagccctccaacaaataattgacgtagacgagaaaaatcaagtagtttatgtaaatgcatggctggattatgtaagtttttggtactttatttaaaaaaaaaattaaatttcatgtattccagacatggaacgactataatttggtttgggataaagctgaatacggtaacatcacagatgtccgttttccagctggaaagatctggaaaccagatgttctattatataacagtgttgacacaaattttgattcaacgtatcaaaccaatatgattgtgtattcaactggcttggtgcattgggttccaccgggaatatttaagatttcatgtaaaattgatattcagtggtttccatttgacgagcaaaaatgtttctttaaa

SEQ ID NO: 30103 - DNA, 937 bp, Caenorhabditis elegans
atgggtaaacctatagtttgcctaattttgttacttgcatctctccacacagttgtctcaaaagtgttgccgataaatgaagaagaccaacttctgtacgaggtaatctatttcaatcattttatattccttatcaaaccagttgtcatcctatccatccatcaccttgtcaaattatttttgttgtagaaattcgcgcgacatggtgttgaaaaattcaatcagcaatcgaatgatgcctacaaatgggaactcgatagaacatgggaggttgaaagaaaactgtccggtggaatacattattcaatttttgtcacattggtcaaaaccgattgtaagaagggtcagacggacgttgaggggaagaagtgtcggaagacggatacactcaaggtgagaaaacaaaaaccaaaaatagttgatcaaaaaatgaataggaagaggaaatataattttagaattctttgaatacattcaagatttttttgactggacactcgatggggctccatcacacctaacccgggtggaatgtttacttgaaaaaagtattatgcgtttataaagtttacaaatcttttctgaaactagtcacattttgtgctaagtggaccccaacgacctattctaaaagtcttgtatagtttccgattatcccgtgtaaaaaacagaacaatcagatttatagtttttaacaaatctaaaaagtttcaaaattaaatgaaatacgaattgaaacagtttaaagtaaaataattgtcttacaagacaaaatattatttttatgattttattgattttaatgatttatgtcttaattgcagaagtgtcaagttgaaatcagtcgccgtgtaaaaagacatggttatggtctgaaagacatcgtgcacatcagaaattgtgaggaagagtttacaaggaacattgataagttcga

SEQ ID NO: 30104 - DNA, 310 bp, Caenorhabditis elegans
tgggacccaacaaatcaagtatttaacattccttgtgatgccgacgcggggccaattaagatgaaaattggccaattcaactatgttattcgagcaaataactacattttgaagattgatgtaagttttgctacatatcaaaaattatgtgaataatttacagacaaactcctgccttttcgctgcaattccacaaaactatgctggtttcggaccttcatggattctcggtggaccattcatgagacaatattgtaatgtacatgatatcggacagaaacgtgttggattctgtttatctcttgcatag

SEQ ID NO: 30105 - DNA, 4444 bp, Caenorhabditis elegans
atgacagttccaaacgattcaactacagaaggcccatcgtctacagtcacaaattctgcaagtagtgagactccatgtaattctgaaacacaaacgtctgatggaacatcccctatgacagtttcaagcgattcaactacagcaggcccatcgtctacagccacaaattctgcaagtagtgagactccatgtaattctgaaacacaaacgtctgatggaacatccactatgacagttccaaacgattcaactacagcaggcccatcgtctacagtcacaaattctgcaagtagtgagactccatgtaattctgaaacacaaacgtctgatggaacatccactatgacagttccaaacgattcaactacagcaggcccatcgtctacagtcacaaattctgaaagtagtgagactccatgtaattctgaaacacaaacgtctgatggaacatccactatgacagttccaaacgattcaactacagcaggcccatcgtctacagccacaaattctgcaagtagtgagactccatgtaattctgaaacacaaacgtctgatggaacatccactatgacagttccaaacgattcaactacagcaggcccatcgtctacagccacaaattctgcaagtagtgagactccatgtaattctgaaacacagacgtctgatggaacatccactatgacagttccaaacgattcaactacagcaggcccatcgtctacagccacaaattctgcaagtagtgagactccatgtaattctgaaacacagacgtctgatggaacatccactatgacagttccaaacgattcaactacagcaggcccatcgtctacagccacaaattctgcaagtagtgagactccatgtaattctgaaacacagacgtctgatggaacatccactatgacagttccaaacgattcaactacagcaggcccatcgtctacagccacaaattctgcaagtagtgagactccatgtaattctgaaacacaaacgtctgatggaacatccactatgacagttccaaacgattcaactacagcaggcccatcgtctacagccacaaattctgcaagtagtgagactccatgtaattctgaaacacaaacgtctgatggaacatccactatgacagttccaaacgattcaactacagcaggcccatcgtctacagccacaaattctgcaagtagtgagactccatgtaattctgaaacacagacgtctgatggaacatccactatgacagttccaaacgattcaactacagcaggcccatcgtctacagtcacaaattctgcaagtagtgagactccatgtaattctgaaacacaaacgtctgatggaacatccactatgacagtttcaagcgattcaactacaccaggcccatcgtctacagccacaaattctgcaagtagtgagactccatgtaattctgaaacacaaacgtctgatggaacattcactatgacagtttcaagcgattcaactacagcaggcccatcgtctacagtcacaaattctgcaagtagtgagactccatgtaattctgaaacacaaacgtctgatggaacatccactatgacagtttcaagcgattcaactacaccaggcccatcgtctacagccacaaattctgcaagtagtgagactccatgtaattctgaaacacagacgtctgatggaacatccactatgacagttccaaacgattcaactacagcaggcccatcgtctacagccacaaattctgcaagtagtgagactccatgtaattctgaaacacagacgtctgatggaacatccactatgacagttccaaacgattcaactacagcaggcccatcgtctacagtcacaaattctgcaagtagtgagactccatgtaattctgaaacacaaacgtctgatggaacatccactatgacagtttcaagcgattcaactacagcaggcccatcgtctacagccacaaattctgcaagtagtgagactccatgtaattctgaaacacaaacgtctgatggaacatccactatgacagtttcaagcgattcaactacagcaggcccatcgtctacagccacaaattctgcaagtagtgagactccatgtaattctgaaacacaaacgtctgatggaacatccactatgacagtttcaagcgattcaactacagcaggcccatcgtctacagccacaaattctgcaagtagtgagactccatgtaattctgaaacacagacgtctgatggaacattcactatgacagttccaaacgattcaactacagcaggcccatcgtctacagtcacaaattctgcaagtagtgagactccatgtaattctgaaacacaaacgtctgatggaacatccactatgacagtttcaaacgattcaactacagcaggcccatcgtctacagccacaaattctgcaagtagtgagactccatgtaattctgaaacacagacgtctgatggaacattcactatgacagttccaaacgattcaactacagcaggcccatcgtctacagccacaaattctgcaagtagtgagactccatgtaattctgaaacacaaacgtctgatggaacatccactatgacagttccaaacgattcaactacagcaggcccatcgtctacagccacaaattctgcaagtagtgagactccatgtaattctgaaacacagacgtctgatggaacatccactatgacagttccaaacgattcaactacagcaggcccatcgtctacagccacaaattctgcaagtagtgagactccatgtaattctgaaacacagacgtctgatggaacatccactatgacagttccaaacgattcaactacagcaggcccatcgtctacagccacaaattctgcaagtagtgagactccatgtaattctgaaacacaaacgtctgatggaacatccactatgacagttccaaacgattcaactacagcaggcccatcgtctacagccacaaattctgcaagtagtgagactccatgtaattctgaaacacagacgtctgatggaacatccactatgacagttccaaacgattcaactacagcaggcccatcgtctacagtcacaaattctgcaagtagtgagactccatgtaattctgaaacacaaacgtctgatggaacatccactatgacagtttcaagcgattcaactacaccaggcccatcgtctacagccacaaattctgcaagttgtgagactccattcgtctacagtcacaaattctgcaagtagtgagactccatgtaattctgaaacacaaacgtctgatggaacattcactatgacagtttcaagcgattcaactacagcaggcccatcgtctacagccacaaattctgcaagtagtgagactccatgtaattctgaaacacaaacgtctgatggaacatccactatgacagttccaaacgattcaactacagcaggcccatcgtctacagtcacaaattctgcaagtagtgagactccatgtaattctgaaacacaaacgtctgatggaacattcactatgacagtttcaagcgattcaactacagcaggcccatcgtctacagtcacaaattctgcaagtagtgagactccatgtaattctgaaacacaaacgtctgatggaacattcactatgacagtttcaagcgattcaactacagcaggcccatcgtctacagtcacaaattctgcaagtagtgagactccatgtaattctgaaacacagacgtctgatggaacatccactatgacagttccaaacgattcaactacagcaggcccatcgtctacagtcacaaattctgcaagtagtgagactccatgtaattctgaaacacagacgtctgatggaacatccactatgacagtttcaagcgattcaactacagcaggcccatcgtctacagtcacaaattctgcaagtagtgagactccatgtaattctgaaacacaaacgtctgatggaacatccactatgacagtttcaagcgattcaactacagcaggtcaatcgtctacagccacaaattctgcaagtagtgagactccatgtaattctgaaacacagacgtctgatggaacatccactatgacagtttcaagcgattcaactacagcaggcccatcgtctacagtcacaaattctgcaagtagtgagactccatgtaattctgaaacacaaacgtctgatggaacatccactatgacagtttcaagcgattcaactacagcaggtcaatcgtctacagccacaaattctgcaagtagtgagactccatgtaattctgaaacacaaacgtctgataaaacatccacgatgacatttccaagcgaatccactacagcagtttcaacgtcttcagctgcaaacaatacaagtcagttttga

SEQ ID NO: 30106 - DNA, 1329 bp, Caenorhabditis elegans
atgaacacgatcatgagcaactacacgaaaatgttgcccgacgcggaggacagcgtacaagttaatattgagattcatgtacaggttggtagactctataattgcacaccaatatgtgaaagttttctttaaaattaaactgctgtaaatgacttttgaataagtttatcagatagaaattgtctgaacttttcgattcaaactttccgaacttcaaagcggttccaaattactcacttccatttatctctttgctacaatttctcccacaaagcctttttcttcatttaacgttcttttttatgtcgttgttcttacaaacaatttcgtctccttgatgaactgcttgaactgagaatagtcacatgaggataaatttgatggaatgacaagttttgtgcccagaaggcagttttgcactgaacttgttcagttgcagacacatctcaaaacacagaagatgagtggaaaactagtgagagactgccaaaagtcgaagggataatgaaaatttgttgcaaatgaattctgcgaagttatgtgaaaaattattggattgggagttgtgggagtgaagagatgggtcaaaagccatcaatcttgaatgcttcggtcaaagatttgtttctcatatgtttacaacactgaaaacaatctatcctagaaatgtttgaaccaccctctaaagtccttccgtatattttttcatctttataccgaccagaattcaagagttgtttgaaataacttcctcttttttggagaatatgtactcagatttttacattcaaaatttatatattttcaaatagaaaaagtgccaagtaccagaaacttttatcaagttggcggcactttggagagtgaatttgatgaaaaagtgtttgataagtttgtcgggcaaactggtcccctgggtggggaaatggtggcatttttggaaacattttcatagtcgaagaagtggaacaagaaaattggaaaatagagatacatatgtatatgaaaatagaattgaacaggaacttatttttattttcaggatatgggaagcttgaatgaaatatcatccgactttgaaattgacattttattcactcaactgtggcatgactcggcactttcttttgctcatcttccggcttgtaagcggtaagaaatctttgtattagaagggaaaaatatttaaattaatgaaatttcagaaatatcacaatggaaacacgacttttacctaagatttggtctccaaacacgtgtatgattaattcaaaacgaacaaccgtccatgcatcaccatcggaaaatgtgatggttattctgtacgag

SEQ ID NO: 30107 - DNA, 285 bp, Caenorhabditis elegans
ttcgttatatttaaaatcattcatcacatatcgaatgtacttctagtcttttactctgcctcaacattcttcatttatctcatattctctgaaaaatatcgaaatgttctctctacatgtgttacttgcaggtaagatgatatacacattttcttttagaaaaacatatcgattttcagaaatactgatgaattaacagtatcaagtcgaggaagacagaatacaaaaactacccgatcaaattctcaaaatggttatacagcgatcaaaaatgagaagacataa

SEQ ID NO: 30108 - DNA, 313 bp, Caenorhabditis elegans
gaatgtgatttggtgtgtatgacaaacgtctgccagtgtaagaaaggactcgtcagagactcggcaactggaaaatgtgtggagaaaaataaatgcagtaagcttcaaaatttattactagactttaaccaatttaaccatcagtgattattcgctgaaaacctgcacataatactagtcataaatttttcattcaggcaaatgcactcttgaatgctctgagaacgaaaaatgtgaacttgtggagctgacttgtgaggagaaaccatgccaaattgtggacgtatgtgttgcacaacataccactgaataa

SEQ ID NO: 30109 - DNA, 490 bp, Caenorhabditis elegans
atgtcactttaccactatttccgtccagctcaacgttctgtttttggtgatctcatgagagatatggctcagatggaacgtcaatttactccagtttgcagaggctctccatctgaatcttctgaggtaagtaacacgtttttttttcaagagtttgtataaaaaagatttctttcagattgttaacaatgatcaaaagtttgccataaatctcaatgtctcgcagttcaagccagaagatttgaaaattaatttggatggacatacattatcaattcaaggagaacaagaattaaagactgaacatggatattcaaagaaatcattttctcgtgttattcttctacccgaagatgttgatgttggtgcagttgcttcaaatctttcagaagatggaaaactttcaattgaagcaccaaagaaggaagcgattcaaggaagatctattccaattcagcaagcgcccgttgaacaaaaaacttctgaataa

SEQ ID NO: 30110 - DNA, 487 bp, Caenorhabditis elegans
atgctcatgctccgttctccattttctgattcaaatgttctcgatcatttcttggatgaaatcactggatctgttcaatttccatattggagaaatgctgatcacaactcattcaatttttccgacaatattggagaggtaagaaaataatctctttttcaattgtttatttgtcaaatgttttatttttcagattgtaaatgacgaatctaaattctctgttcaactcgatgtttctcatttcaaaccagaagatcttaaaattgaattggatggaagagaactaaaaattgaaggaattcaagaaaaaaaatcagagcatggatactcgaaacgatcattttcaaaaatgattcttctaccagaagatgttgatttaacttctgtcaaatctgcaatttcgaatgaaggaaaacttcaaattgaggctccaaagaagactaactcatctcgttctattcccattaattttgttgcaaaacattaa

SEQ ID NO: 30111 - DNA, 487 bp, Caenorhabditis elegans; identical to SEQ ID NO: 30110

SEQ ID NO: 30112 - DNA, 490 bp, Caenorhabditis elegans; identical to SEQ ID NO: 30109

SEQ ID NO: 30113 - DNA, 524 bp, Caenorhabditis elegans
atgttcgccttttcaaaaggtcccgccggcagctcaacttacgacagagttgctcaaaaatttcaagatggatatgaaaaaatgagagccgcgattgaaatggatgaactcacaaaacatggtttgtttgattattgccggcaatattgatttttcgaataatgaaatgttttcagctggatcgattcaagagaagctacggactgccgaactatataaggaagcgagatcattactgaaagaagcaaatgaattcaacattatggatattccagaaacccggagaagtgaaatcagagataaacgacaaaatatgatgaaactagagaaaagcgctcaggatagactcattgcaatttgtaggttttgtgaataacatgtatgtacagtttttttcattatttgatcttcaaggtaatgaagttgatccaaatgtgaagcaatcgagatcagctacagttggaccgtcacgacctgcaagtgcagccagagtcacgccaaggcctacaagagccacagcacca

SEQ ID NO: 30114 - DNA, 1931 bp, Caenorhabditis elegans
atgcctatttacgtaacattttgattttcaaaagtaataaaattgactctagttgtaatgataattcgcaaattcgtcactaaatttgccttttcgagtttttaaatcaccactttcgatgttatctttccaccaccgaaaatcatactccatataaaagatcgaaatgttaggaagaaaatgctaagtgagaaaatgtatagtcttattttcattttgactttcttctcggtttattccaagtcattggtctacattcctctccacaagtggaatcattgaagtccaagttgttgaaagaaggaaaatggagcgactacaagctacaacaagatcagttgagatctgatgcatatgctgcaggagttgatgattatgagcatgctggatacgtgggaaaaattactgtaggatctcccccacaggaatttagagttataatggacaccgggtcttcaaacttttggattcctgattcaacatgtgacactaaagctacgtcttgtcacaaagttttacccgcaccaaattactcggcaattcccggcaacttcttccccaagtttgggccttttcagcttcttacccaacttttgccaacttctaacccaaagtttgcccaagtcttacccaacttcaacaattctagtgtaaactcgctcacccgagtcgtacccaagccttagccaagttttgccaacttcttacccaagtttgcagatgtaaagaacgaacaagattccgaaatcccgcatgcgcaatgtttagcgtaaatcgacactttgtcttttgagtaatttgtatttaaaatagaggaatttcgatgtaattgaaagaattcacaggaaaacttgtcccttcaaaggccaattctaaatatttttctctggtggctaactttgtttaaaaatgtacgaacaaagtttgatttttattgccattttgtctaataaaccatataatttatctaaaaataaaaagaaagaaaaggtatcttcaagatgattcctaataagtccaatagtaaaataatagacagtcaatccaatggatcgaatttttctaagactgaactgttcctttgaaatgtacactcttataaaattgaccgttattgaaagacatgaaacaaacatgaattacagtagttctgtaaattctgaacttagaatccttagaaagcacacttgaaaacgaatgaaataaggtatgtgagaataccgtatcaatcagatatgtctgatacttccccaataaatatttattagagtatgagtactatatatttttactagtgtgcatcgctccgcgcgaccatcatggctcagcaggtaagacttcggcacaacgggtaatgcgatcaaagttcaacacacaggtataaattgggtaagaaataggcaaaacttgggtgagacttggccaagacttgggcgacgcctcgagacggcgaggcagtccccgacttttttcatttttgaggcggcgccaactcttgcccaaggtttacccaagtcttggcaactccttataaatgtttttattttttggcaaggcttgggtaagaagttgcgaagccttgggtatgaagctggctgcaaacgccgagttgttttggaggttgtttattaatttataatatttaagtgttcatctgtgatgatttgttttcaggatattgtagacctgggccaaatgtttccgtgtcgtgtatgacccaacaaaagttcatatcttccaagttctacttatacgaaattcggaacttttcagtttactgggagcaatttttgagtcaaaaatctttaaaatcaatttgtttttagtacggttccgacagtgccagtggtattctgggatttgatactgtttcatttggtggaatatctgaaagtcaattgattgttccagacactgttgttgctacagca

SEQ ID NO: 30115 - DNA, 495 bp, Caenorhabditis elegans
cttcatttggaatcgcaatttgctttggtcttctctgcctctgcgactgctcacaaagaggcgctgcaatattcttgatatgtttagcaatgtgctttgtttctggatatattcccggttacaataccagcgccgtaaccattgctcctggtcaaacagctgcaattgctgcattctctcgattctggggacaaatcgcttcgtctgttgctccatatcatatcggagcatatacaaaacaaggaacagctgatgaatggaaaattgtgtttgcagtaattgccgcgatatgcgttgtcacaggaattttcttccaatgttgtggtacaggtaatttcggaagcttctaatttttttaaagcaaaagtatatgtttcagccagtctacaagattgggattcaactcattcaaaagctccaatcgaagttgcccgagaagaattgattgacagttcaaaactggacgattctctacggattacaactgtcgaatag

SEQ ID NO: 30116 - DNA, 923 bp, Caenorhabditis elegans
atgaatgaggaggtcccgttgattgagtcaccagtagcaggacctgtaccgaatggatcagttgttaggcctcctgacattgtttttgtcaatgttggtggacgtagagctcggctcaactcggacatcatcataagacggcttgccacatcacgacttgctgtattctgtgaaaaatcacatgttgaacggctgacagattgtgatgccttctttgaaagcacatcggagtactactttgaaagatcgccaattatttttgaatacgtaattgatttctacgtaactggaaaacttcatcgtccaatggatatttgtccgattcgattgagatatgaattggactattggagaattcccacgccgtttatgtcaccatgctgtattcttgaagaaaataacaatatagctgggaaaatgtcaactgagaaagtaggtatccatatatgatttgaagttaattatttttattttaggcatttgttgattcttcattaccgtcttcatgttttgataaagtcgtgttaggaccacaacgactaaaattatacagattaatggaaaatccgagatcatcttctggtgcaaaaatattctcagttggatcagctctttttgtgcttctttccttgctcggactaatcctaagctcaatgccagagctgcaggatgaaaataaagaacctcattatctccttcattggctggaattattgtatgtctagtatgaacatatcagaagttataatacaatgtttgcaggtgtatggtgtacttcacatttgaataccttgcacgtctccttgtgaatccgaaaaaagcagaatttattaggagtccactgaacgttattgacttgctgactgtgttgccgtttatgattgaagcgtttaatgaattgcaatggatgaaagagtttagag

SEQ ID NO: 30117 - DNA, 801 bp, Caenorhabditis elegans
atgtcatcagcagtcacaagtacgtcagactcaactgcgccgggcaattcgcagactttcaaaaaaatcgccacgaaggtatttattcaacaagttctacctttaagaaccagtataatttattttcagtattttttatcatgtacagctgcattagttgccgaaacggtcacatatcctctggatataacaaaaactagactacaaatcgctagaaataagtttacaaaaggaggtatctgtgaatttttcgatgatagttgttttttgattagtttaaattttcagggatggtgcaagtaacatacgatatcattagaagagaaggagcaatggctttatggacaggagtagcaccagcaatcacaagacattatatctacacaggaattcgaatgggtgcttacgagcagattcgtttacttacatttaataaagaagtcagtgatttcaattgtgaacaattcaatttaaattatttttcaggtagaaaagtcatttccgttatggaagtctatgctttgtggtgcattttctgggcttattgctcaattcgcggctagtccgaccgatttggtgaaggttcaaatgcaaatggaaggacttcgaagattgcagaaacaacctttacgatatacaggagcaaccgattgcttcagatccctttatcgaacacaaggattttttggattgtggattggttggatgccaaattgtcagcgagcagcactgctcaatatggctgatattgctacatatgacagtgtgaagcatgggctcattgataatttcgaacttaaa

SEQ ID NO: 30118 - DNA, 388 bp, Caenorhabditis elegans
aatcgaatgattgaatcaatgaggctgtttgaatcaatttgtaattcacgatggttcatcaatacttcaatgattcttttcttaaataagaaggatttgtttgccgagaagattaaaagaacttcaattaaatccgcattcccagactataaaggtaagatttaattgaactttttcacactctgcccatatattttcaggtgcacaaacctacgacgaatcgtgtcgatatattgaggaaaagtttgatggattgaatgcaaatccagaaaagacgatttacatgcatcagacgtgtgcaacagatacagatcaagtacaaatgattttggactcagtgattgatatgattatccaggccaacttgcaaggatgcggtttgtactga

SEQ ID NO: 30119 - DNA, 1157 bp, Caenorhabditis elegans
atgcaaaaccgtagatcttcgctgtcttcacgtccagtacgggaaaaagtgtttcattgccgaaatgtttatttttgcgtttccgaacctgataaccggacaatatcgtagaatgggagaaggaagggcaaatacacagtgatatgttcatgtaaatatttcacgttttttcctgtctcaactcaacatttcaccaacctatcgtttctcttcgttctcttcttaactttctttaactcgtgacttatgttcaattattccaaaatatttcagattcaccgagcctgttcaccgaatcgaaaaaagattgggagcatccaatatggacggaggcgccactcttggcaggggccagttgttcccgctgcaaaacttcaaggtgagaattatttaaatcctactattagatgccatttcagttttaatagttttttgttgctcaactttgttattcaaataattttggaaattttcagaagggagttcgtatttggcaccgccacccaacccttgtatggattggagctactttggaagaggacatcacattccaaacacggaatgttcggataaggctcgaagatgatacggtgagagagtttatcgcattaatcgttttcaaaaacttattcgtttcaggaagtcgagtacgccatcaagtcattggaccagttgccattcctcaggaatcctgcatttcttgttggcaaggatgatctcacacttctttcctatcttcacgagccggcagttcttcacaatctacaagttcgatttgtgaaaggatcatcgatctacacatattgtggaattgtgcttgtagcaatcaacccttacgccgattgctcgcacatttatggagaagaaattatccaagtgtatcgaggagctggaaaatcagctcgtgagatggatcctcacattttcgctgtagcagaagaggcccacttcgacatgggagctttcggaaaatcacaatctattattgtgagtggcgagtctggagctggaaaaaccgtatctgcgaaatttgtcatgcgctatttggcatctgttgcagccagcaagaccagaaatggcgggaccaccagcattgaagcacgtgtgttggcgagcaatccgattatggagtcgattggaaatgccaaaacgattag

SEQ ID NO: 30120 - DNA, 819 bp, Caenorhabditis elegans
atgccacacgactctacatatccaccagtgaagatttccgagcgtccgtaccatgagatgctccttgatgcaattgataaaacaattgccgatggaaagaataaaattgcatttgtgagcggagataatccaaaacatttcattacttttgaacaacttcgtaaggatgcttttgctgtcgctatgtatcttcatagcattgggttcaaggtatgtggcattatgttaaaaatttgggaattttataattcaacaagagaaaggaagtatttcaaaaatctttcaatttgttcaagacaatgccttaaatttttgatatcttttagaaagatgttgctgctgttgttcttccaaacgtctggcactatacttcatttttcattggatgtgccatcaacggtggagctgtatctggagctagtgcacttttcactgactgtaagttaaattgatgaaagttactttcaccaacccgcaatttctgttttcagatgagcttcaacgtcaatttgttgattctcgcgcaaaggttgtttttacttacgaagattttcttccaaaagttcttcttgctgtgaagcaatcgccaaacatccaaaagatcattgtcatcccaaaaccagttggatcttctcttccagcaggagttgtatcttggaatgaagtggtttcaactccagtcactgctctaccacaagttccaattgatgttcacaatgatttactcgttcttccatactcgagtggtaccactggaccaccaaagggtgttatgctatcacactacaattttacatccatgatctccatgtatcttgc

SEQ ID NO: 30121 - DNA, 476 bp, Caenorhabditis elegans
aatcaaatgagaaaacctcgtgacaatgttgaattccgtggaaccgttcgatatgcttcattgaattgtcatcaactgcaagaactgaatagaaaagatgatttagaatcagctttctacgttatcgttgaaatgatcactggacaacttccatggaaaggtcttccagatggtgctgcagttgcacgagtcaagcaacaaagtcgtcacccatcagcaatcgctcttttcttgagagcaccttgtccgatggaagaacttcgtgaagtgatgattctcattgattcctacaattatttcacagctcccgattatgttaatatctgcaacgtatggttttatttacaattgttaagcattgtttctgtaaaatcctaatattttagattctccgtcgggcaatgcgcagaagtcctcaaccggaacatccttatgattgggaacagggaggaactaattcacttggagacgtgtaa

SEQ ID NO: 30122 - DNA, 1034 bp, Caenorhabditis elegans
atggagcagaagtttaaaaaaggaaaggaccatggagttggagtgctgactagtggcggcgattcacaaggtaattggagcacgatttttcatttttaaacctgtgtttcacaggaatgaatgcagcagtacgatcagttgtcagagaaacgattcgtcaaggacataggtgctacttgattcgtgaaggatataatggactgattaatggcaacatcgaacttgcaaaatgggcccacgtcgcaaatgtgacacatcttggtggaagcatgattggaacgtctcgatgtgatgaatttcgcactactgacggacgcaaaaaggctgcagcaatcatgttcgataaaagaatcttccatcttattgttatcggtggagatggatctttgatgggggcacagaagctgaaagaagagtggggaagatttggagaggagctgttcgccgagggcaaaataactgaagaggttgcaaatgaaggacgagaacttcatttggctggaattgttggatcaatcgacaatgattgtattgaatccgacaaatcaattggttcagatacagcattgcatcgaatctgtgaagccattgatggtcttgttatgactgcacagtctcatcagagagttttcgttgttgaagttatgggaagacattgtggatatctagctttgactgcagcgattgctgttgaagcggattacgtcttttatccagaaatcccgcctgatgaaaaatggcctgaacagctgtgccatcaacttggatcagtgagaaaggtgagaagaaaactagacatgatacatttgaattaactttttgtagatgggtaaacgacaaaatgtgatcattttgggagaaggtgtcactaatagcaaaggtcaaaggattgatgtgaggcaagtgaaggaagagattgagacacgtctccagcttgaagttcgcattgccacactgggacatttgcaaagaggtggagctccatcgtttctcgacagactcatcggattgagaatgggatatgaggctgtaca

SEQ ID NO: 30123 - DNA, 596 bp, Caenorhabditis elegans
atggcgtctcttctggcgctcttttttatacaaatattcatattcaccgtcacttcatttgatgttggagctaactttgaagactcattttttgaaatcaacattgatcgaaacaatccagagaagttgtacaaggaattcgaggatttcattgtaaagtacaaaagaaattataaagacgaaattgaaaagaagtttcgtttccagcaatttgtggcaactcataatagagttggaaagtagggtttccagattaaataatttatctcatttttcaaaagtttagaatgaacaaggctgccaaaaaagctggtcatgatacaaaatatggaatcaacaagttcagtgacttgagcaaaaaagaaatccacgtaagaattgcatacccgaaaaggttcatgatttgaagaaactattgttttttattcagggcatgtactctaaatttgggcctcccaaaaacaacactaacgttccgaagttcaatttgaaaaacctgcgtgtcaagcgacaaatggaaggtcttccaaaaacatttgatttgaggaataagaaagttggtggacactacataattggaccgattaaaacacagg

SEQ ID NO: 30124 - DNA, 537 bp, Caenorhabditis elegans
agttctctcatctgttggtgattgtctctggcgcctaacaatgtacaacaatctgaatgctcttgttcttttcctcccacttatgcttttcaatggagaattcggagcagtcttctatttcgataaactcttcgacacaaccttctggattcttatgactttgggtggcgttttcggatttatgatgggatacgtcactggatggcaaattcaagcaacatcgcctcttactcacaatatttctggaactgccaaagcagctgctcagactgtaatggctgtagtttggtattcagaattaaaaactcttttatggtatgtactcgactttgatttaaaataaaactaattcaatataaaaacaattccaggtggacaagcaatttcgttgttcttttcggatccggaatgtacacttacgttcagaaacgtgtcatggacaagaaaaattcaggagcgtctccagctagcgaggcaaaatctgacaaagtgaagcttttaggaagagatggaaatgcggccgaggaatcagtttaa

SEQ ID NO: 30125 - DNA, 644 bp, Caenorhabditis elegans
cttcaaaacgtcagtcaacttcgtgctatcaaacgtccatttgacaatcctgagccaaatacgcttgcaattgacattctttggagcgatccaacaaacttccaaaaaggatggaacccgaactctcgtggtgtttcgtacgtttttggatcagatgcccttcgcaaacttctcgatcgtcttcaaattgatctcgtggttcgtgctcatcaagttgtgcaagacggctacgaattctttgctaatcgtcgtctggttacaatcttttcggcaccgttctactgtggacagtttgataatgcagctgcagtgatgtatgtcaataagaatcttgtttgttcgtttgtggtgagtttttggggaaatttcagaagtggtagttgagactgtttgatcaagtataattaactctagatgtaagtgcaaaaacgcaacattgaattccgaccaagagctagattcaagattattcttgttgcattatcttggttcttattaactacgatgtagtcttcatatacctatttttgactctattatctattccactcttctcccaattcaaaattcatctaatctattttcaggttctccgtcctagaaagaaaattgcgagacgtcgtatgatgccagcggtcaactag

SEQ ID NO: 30126 - DNA, 2424 bp, Caenorhabditis elegans
atgtatcaaatacattacgttgacagtcatctgagcattggtaaagaatttcaaactttgagcgaaacacttagaactttccaagcaaattatatttttctaactcttcagattctttctgttatcgagtctaaaaaacttcaaaattcaattccatttttgaagtgttccgtgccttttttagttttaaaacattctgagaaactaaaatctattacgtttcagaaagtaggaccatttgtagaactacttacagcaaaaaaacacttgaaaatttttgttctttacattttagcattaatccttggaacacctttgtttttaccttcttcaaaccgtcttgttggcttaaaaaatgtaataaaaaactgttttaaggtgatccaactccaaaaaatggaggccggagagacatggaatgtctcccttgaatggcctccaccctctcttgatctttcaacaatcacacaaacaccatcaacgatagtcggaagtggaattcctttgaactacgctggactttctcttattgttattccactcatcacgctacttggaaaccttctggttagttagagttcaattgtcagttaaaaaatatatacaactgtgtaatgttacagataaaactacttgttgatgtttttgataagaatgaaatcttgaaaaataagaaatgtatcttgatagtctaaaattatcaaagaagaaaaaaaaattttgtctcaaaacccagaaattagggagaaatcagaaaactttttttttttcaaaaaatcgaaacatcaaacaacgagttcttttgtgcctcagttcgtctgacatttaaaatcaatatgccaagatacttcttaaattatcttcgaaacggtatcaaaatattattcaaaatttgtgaacaaagaacgattccttgcgattctggagcaatgtcttatagatgttcgtgtgaaactcagttcctcacatttattgtacatttggttcaatttcaaactccaaagcacgttccaaaataataataaaaaagtatattttcttttcaggtaataatatcagtactccggtaccgagcactgcaatcagccatcaatttccttatcctaggcctggctgtggcggatcttttggtggccatcatagttatgccatacgcggtttatgtatatgtaagtgatcaattatatgtcttttgttggcaaccacagcaacagctctccatagcagcataggctcccaatctgcgttttcctgaagtgacgtgctgttccacctctctctctctctctttgcctaacaagggaaaccgaggttgagaaaaaacgagaaaagagacatcagcgaccaagagcagtaatttgttgagtgtctctcacaagagctcccgagctttgctcacacagatttatggttgttttctgacggttgccacgtcataagttttggtaactagctaactagttgcaaacgttgaaagtctcgttgcatttataaatagtactagaacacgttgaaaatgaaaaagaaaagaacatcaaagagaagagacaagacatgaagctggttgatgtaatcccctgacagctatcacataactctattgatggacagagtgccaaacgatacttctttgttaagttccgtaggttttcccgttgaaacagaactctgcaaactgacttgacttaaaaagaatagaaaaaggggcatgatgatggatggtacaaggagcgtgtgcgtgtgtgtgtgtgacgtggaaatgaagcccagtggggtggaaaaggggaaagaacgtggtgtgaaaagtgtcaaattagatgcacggaaagccgtatttattgcttcctagatccttccaaccacgaaggcttttcctttttttccggtagattagagaaagcgtcaggagtgaagaataatggagaattagggtaatgcgtatcagattctgcagaaaaaagcaattgaataatagactttgaaattgtgtttcagttgggaaatttccatcgacagtataaatgaacaccataattactattgtagtacaaaaactaaaaataccatatattctattttagtgctgcatcgcactattccattttggaaaggtatatctcggtttattttgaagatatcaaaaattactgttctacaaaactatagaaaaagaattcaaaatgatttattcatttgacaatttttaataaaagaaaagataaccgaaagtagtcaaagcaatggtgtacagaagtaaagaatatacgttattcgttttttcaactgtccattaattttccctaatttgcaggtcaccaacggcgactggtatctaggaaatctaatgtgtgacatttacatggcatctgatgtgtgctgtagcacagcttctattcttcttcttgccgtaatttcattcgatcg

SEQ ID NO: 30127 - DNA, 1247 bp, Caenorhabditis elegans
atggaggaaagtacaaacgacggcgatgaaaacaagcctgcaactgggaaggtaaattaaatatttttgtatttatcaaaagcaaaacaatttcagaagcgacaacagcttgaatctccgttttctgctgcgacaccgaaatcgcgtctcggaaaggaatcgaaaaggtttttcgggcgttctgctatgaatttggccgatggaaatcttgaagaaactcgcattgagccagactcgcgccattcgtctaccagtacctccgactctattcttgatgattcttcaatctccaatttttccacactcgccccgccaaatacctccgttgatgataacagtgtctgtgaaccgccaagagcttcctcagctcatgatgtcgatcctaatttggaacaaacgaaggtttacagtgaagacagcatcagcaaagactgtagcattgctgacgagagttttgcgactgatggtgacgtcacactggcgaacgacttcttccaacaagcaacgattcaagatctagagaatactccgtcaacaccacttcggagccagacacaagttggagacgaaagtacaccaactgctccttccccacttcgttcgaaaattccaatcgagagtgaggttgtgcagtcaacttctgtagagtcagttcagtcaacatctcagcatgaaaaatcgagaattgaatattctttgtaagattaatttaaatttattcccattgttaaattgtttatttcagatatgaattcgaaatgctggagaaaaatatcgagcatgatgaagtcgttaaagatcttcaattgaaaattgaacttcttggagagaaacatagacaaactcttgttgaaattaaagaagctcgtgaagttgaagagaaaatgctcatgcaacaagtggaggaggctgtaaaaaagacgaaatctgagcgcgaagctgcaaaaactctggaacaacttcttgagaaacggattgaagagctcgagatgaaattaacggagccgaacggagagaaactacagtttgaacatcagttggaagagttgaagagtcgttgtgaagagcttactgacaaagcactgaaggttgatgtcatgcaacacagcattgaggactacgaaaaaaagtttgtggagttgcaagaaatgaaagaggaggctgatgaacaactgcaaaaggctaaggaagacattgagacactacagatgaagtatgtggaattggagacaacgatcaacaaagag

SEQ ID NO: 30128 - DNA, 586 bp, Caenorhabditis elegans
acggagagatggtttgaatgggtttctggaaatgaagttcgtggtgaatcaatctacgttgacgctccaatcacattcactcctatttatcaacgtggaggaactattattccaacctggcaacgaatccgtagatccgcaacactcatgaaagacgatccaattactttgtttgttgcacttgactcaaatgaaaattccaacggagaaatttacttggatgacggaaatactcatgattatcaaagcggccagtttgtgaaggcttcgttcaagtacacaacattgtctaagaattctgcaatgctagaaggagagcatctcgatggaaagtacgctgccaagaattggattgaaagagttgttgtgcgcggtgtggagagctcaccgaaaaaagttgaggtaaatccttattcatttttattgatgctcatgtctacaaatatcttttgaattccagatcacccgtgtctccgatccagttcaatcactcgaattctcctacgatcacgactcgaaggttcttgtcattcgcaaacccgaggctcttcttacgtcgagcttcaaagttcatatcgaattttaa

SEQ ID NO: 30129 - DNA, 1045 bp, Caenorhabditis elegans
atgtttgacgaggattctgatggtttgattgaagtgaggattactgtagttactgttgaaacttggcttttcacgtggtgcttttctccaactttctactcatttatatcattaagaaccggatcaaatagacattccacctagtgtaggcgtcacggggagcctattcccgccttcccactcgccttcctcgcgcccttcagtagggtgagtgaagaggcgaacacgcctcgagtgcatgaagttatttttcatacttcataaactcttaaatgtttctcctggctcttccaattagtaggagcgtcgtcaatataaaagttgtacctatagctgaaaatttcttattgatattcgttgaaaactcaatttgcatctctataggttttctttgttttcgatattctagtattgttttggttatttttattgtaacagtttagagattcaaacccgcgccaatgcatgaaatatctcaaaaagttcacattttttgaaaaatttggtaaaaactgactcaaatttttcaaaagtcgaaatactttttggagagttttattatgatattcggctattatggacctccactgaatcttttaaatccactgaatctttaaaatgtctccactgaatcttttaaatctttcttaaactgaaattccagaccgacgatgtgagtcacgttctccgaagctttggattgaaccccagtcaaacggaattgcaattggtcagtgaacaaactgcaaagaaaaatggaagagtttcattcgatgaccttctgccccgtgtcgtattggcaattcaaaatgaagaatggaaagatgatactccgaaacaaatccatgctgcatttcaagtaataacatctaataattatgttcaaaaagatacattattgcaattgctcacttcaattggagaaccattgactccacaagaagttaagcaatttctgaatcatgtcagcattcgagcaaatggagatattgactgggtttcgtatgttaaagacacttgcgaaatgattacttctagagattaa

SEQ ID NO: 30130 - DNA, 575 bp, Caenorhabditis elegans
atgtatgacgaagttgacgagaagtgtgtaccttgtccacgtggagaatttcaagatgagcatggaagaacaacttgtaagacatgtccagatagtacgactacagtaggtacaggcacacagaaaaaggaacaatgtgttcgtatgtttccatatattttatatagccacctgatcagtttaattccagatgtttgtccttcgggatacttctacgatacttcttcgaaaatgtgcgagacttgcggtttgagaggatatcaaccaaaaagtggtcaggatcgatgcattccatgcccagatggaactgtgccaatttatcaaaactcaacaacaattggacattgtctaggtcggtttatttgcaaaaactgttgcttgataattctcaacttgatgatccatgtttttagacaaatgccgagctggaatgcaaagatcttctgatggttccacgtgtgaaccttgcccaattggatcgtttaaaagtgcggatgacatggtttgtatgatgtgcccaactggaagaactactctttcaaaagcttcgaaagcattgtctgcatgccacatta

SEQ ID NO: 30131 - DNA, 1456 bp, Caenorhabditis elegans
atggctttaaaagccgaggatggagaaggatgtacatgcaaacaaacaaaacgatatggacaacctgagtgttgttgtatgggattgattgtgtctcaattgccaactaacttgactgctgacgttggatatttgtgagttgttcagggttaagttcgggagaaaatttttggatggaacatgtatttaatccttgcaacaaaaattggatttaatttccaattatagttattgctgattatgtacagtgctggccaaaaagatatccacttttggttttttgtgtgtaacttttttctcaagcatccatttgacttgaatttttccgtgtgcataaagcgaaatgttacgcaaatttgcggaccaaacattacatgattatcgattttttctgaattttatttcaattttttgattttttcgttttgcatggaggtgggagcgtcatggtgtgggggtgcttcaccagcacttccatgggcccactaaggagaatccaaagcattatggatcgttttcaatacgaaaacatcttggaaactacaatgcgaccctgggcacttcaaaatgtgggccgtggcttcgtgtttcagcaggataacgatcctaagcatacttctcttcatgtgcgttcctggtttcaacgtcgtcgtgtgcatttgctcgattggccaagtcagtctccggacttgaatccaatagagcatttgtgggaagagttggaaagacgtcttggaggtattcgggcttcaaatgcagatgccaaattcaaccagttggaaaacgcttggaaagctatccccatgtcagttattcacaagctgatcgactcgatgccacgtcgttgtcaagctgttattgatgcaaacggatacgcgacaaagtattaagcataattatgttgtttttaaatccaattgctcatattccggtactttaattgtcatttccttgcaacctcggctttttcaatatttctagtttttcgatttttttgaatttttctgaagttttttcaaaatctgttgaacatttttgatgaatattgtgtttttagattttgtgaacactgtggtgaagtttcaaaacaaaataaccacttagaaaaaagttacacacaaaaaaccaaaagtggatatctttttggccagcactgtatatctgaagaatatctattgatttattctaggtacctccacaatacttcaatctctgttattacaccgaacttttttgataaattcccatctattcgagaactgtaagttttaacattatttcaatttgaacattttccatttttcagtgagattgataattctgctcatttggagcacatcgatggatcttctctctccgttctctcaaaacttcgaaagctttctgtagttaaatgtcccaatcttcgtgaaatttctggaaaacttttggtcaacaacacgagaattcagaatgt

SEQ ID NO: 30132 - DNA, 541 bp, Caenorhabditis elegans
caatcggcaacacgcctccagaagagaaatttggaaaaaatgtagaacagatttctagcggaaaggaagagtggattgcacaaatgcgacaaagattaaaagaaaccggtggtggaattggtggagcgtctggatctggattgaaatcagaaaatggaacaatgggaggatcttctggagagaaatcaggagaaaagaaatcaggaaaaaataaaaagagcaaagccactcaggtcgcagatgaaccatataaaggtatgtttgaaaactacatcaatctataattttttttttgaattcagatccagcaacacgaaaacgagaacgtgaagaacgagaaaagaaagaagctgaaatacaggcagcagaagaagaagaaaaacagagaaaagagtatgaagaagacgctcaacgaaaaaaagctgaagaaatggaattagaagctaaaaaggcattagaagcagcaaattttggattaaaaactgatttttcgatgtccctgcttacaattctaatggcatttgtgctccgagagttttaa

SEQ ID NO: 30133 - DNA, 220 bp, Caenorhabditis elegans
atttgccggatcttttatttgtccaatcatttatctccaactagtcgaatctattggcggatttgcatttatgttatttattgttccacttacaatcacagcagcctatttttatatgtaagatttaattccttgtttaacaattccttatgattatttcaggtaccttcctgaaaccaaaggaaaatctccggtggaaatatatgggcttcttcaatga

SEQ ID NO: 30134 - DNA, 831 bp, Caenorhabditis elegans
atgctattccctgctttttcaattcttctcatttcctttttctcacttttatctgtggtaacaacaaaaacccaatactggtgtcatggcgacggagttctaaacaatgtgagttttttttgcctgttttcagatctcaaaatagaaaaatatcgaacgaagtctacggaaaaacgttgttgttctttgaaagagatggatgcaagcgatacctttttacacaaagttttgcttgaccgatgaaaaatctttcacaaaagacagagagaaatgataagaaattgatgcgaagtttgtagcgacattttaaaatgaatttatttttagcaacacacatgtcgattcttcacgatagtaattgatgcaggatccacaggaacacgattacatttatataaatttattcatgatcccgcaatagcttcacatggtatgccttttaaggttgaaaaagagatatttcaagaggtattgaataagataaatgttatattaaccttattttcaattttaaggtgaaaccaggactttcttcgtttgcgaaatctccgagctctgccgctgattcactggagccacttcttcaaagagctcgaaaagaagttcctcatttcatgtgggaaaagacgccgatcacattgaaagccacagctgggctacgtcttctacctggagatatggccgacgatattcttgaaagtgtagaagagcggatatttaacagtggattttttgccgctttcccggatgccgttaatgtaatgccaggcagcgatgagggtgtgtacagctggttcacacttaatattcttctcgaaactcttttcaccg

SEQ ID NO: 30135 - DNA, 471 bp, Caenorhabditis elegans
atgagtacgatttcaccagatattgtgacgaactctacagaagaagtagcagaatgttcacgaaatgaaacttatgactttaatcgatacgcacttattgtatacgttggaactccgattgcagttgctggagttatttgcaattggatactatttgtgagtttttgaatttcatttcatcaatgttgtaattttcaaattttagagactattcaccaagtcaaagtcgacgaaatcaccagccttatacttacttcttttagcagtgctaggtgagtatttgagaatattttttctactaaatattactttttaaacttttctatattttcaaattttcagatcttttaatggatctcctctacattccctttttcacagttgacgcattagcaatctaccacaaaaatgagtttctctatcatatttggcatgattatgcaatgtttgtatttggactgagtaggcttg

SEQ ID NO: 30136 - DNA, 761 bp, Caenorhabditis elegans
atgtctcaagacaatttatcagcggtactttatggcgtagatgatcttcgtctggagcaagttccaattccaaagcctgggccaaatcaggtgcttgttaaagttcacactgttggaatttgtggaagtgatgttcactattggacgcacggagcaatcgggccatttgtcgtaaaagaaccaatggtgagaacagcacgagtttttgttagaaataatataacgtcgatttcagatcgttggtcatgaaacgtctgggattgtttctgaagttggaaatgaggtgaaacatcttaaagttggtgacagaattgcaatggaaccaggccttccatgcaaactttgtgagcactgcaaaactggaagatacaatttgtgcccggaaatgagattctttgctactccaccagttcatggaaccctatccagatttgtggtgcacgacgctgatttttgcttcaagtagttctacaaagcaaaataaaacatacttcattgaaaattattttcagactcccagataacctttcatttgaagacggggctcttattgaaccactttccgttgcgattcatgcgtgtcgacgtggaaatgttcaaatgggacaccgagttcttgttctcggagccggtcctattggagttttaaacctcattaccgctaaagctgtaggagctggaaaagtagttattactgatttagatgatggcagacttgcgctcgcaaagaaacttggggcagatgcaacaattaacgttaa

SEQ ID NO: 30137 - DNA, 538 bp, Caenorhabditis elegans
atgactcgcatcaaaagtgtcattttaacggtttttctcatttttgcacgtaagattcatttaaatgtttaagcatttctaaactcctgaagttttaagataactcaattgtgtcggctgttgactatggaaatgcaagttcttgtccaaaagctgccaagtatggaacagggcctccagaatcatgcactcaaccaactgacccaaacaatatgcctgcttctgaattagaatcctggttcacgagagaaatgtttgaagacctattcccatttgccaatcttggatggggtccttcgagttgctggccatattcctacgatgctttcaaaattgcatccagatattttccagaatttggaacttcgatcaatgtgaataatacggtaagaaatttgatggaatagttatggatatttctgaaataagtaaaataactgcaggtgtatactgcggatgagaataagaaaagagacttggcggctttctttgcccacgctgttcaagaaactggagagaacaacattgctctatatga

SEQ ID NO: 30138 - DNA, 664 bp, Caenorhabditis elegans
tgagatcccagccgatggaaacttgattcttgaaattaatactgatggatgtgccggatctcaattcgaagtccgctacctggaacatgttcaagcagttgtctcgttcaactcgactcgtcgtggagataccactctctacttgatctctccaatgggaacccgtaccatgattctttcccgcagaccaaaggatgatgattcaaaggatggattcaccaactggccattcatgacaacacacacatggggagagaatccaacaggaaaatggagacttgtcgccagattccaagtgagtaatgcattcatgatgaacaattttatttgagcacttaaatattgtatacctttttctaagttcgcctaacgtttttttagaactagatcgaaatcggctgcgaaatcggctaagataagatatcttaaaatgttgttttctcatagatcaaagcacaacatttatatgataatctgtacacaaaattttctgtaaacactaataatgtttcagggacctggagctcatgccggaacccttaagaagttcgagctgatgttgcacggaacaagagaagccccatacaatctcatcgagccaatcgtcggtcaaaccaacaagaagctcgacaccgttcaaaaagcccacaaacgcagccactaa

SEQ ID NO: 30139 - DNA, 664 bp, Caenorhabditis elegans; identical to SEQ ID NO: 30138

SEQ ID NO: 30140 - DNA, 243 bp, Caenorhabditis elegans
atgcaattcgacgaagaatggagcaaagccgatccaattgtacatgcacttctgcatcagaaagttagtttcattcgtctcaacgtagaaaacattccatttttacagtcagtaactccggctgcatggcaagatctcttttatcacgtgtataaaatcacatcttgggtagatgacgggcctttgaaaattcgcgatattctcactcgatgtatcaatgattatgttcatgaagcaaataaa

SEQ ID NO: 30141 - DNA, 509 bp, Caenorhabditis elegans
gacagggatttctttcacgagacgattttttgaatgttcccgagttggctgtgaatcctcttggtgatcgaatcgtagatgcctttttcacattagcttcttcaaacggtgacaacgaagagcaacagttgaactttcgtcaatttgttcgaattcttgcacactttcaaccgatttcaagagtaaagaaaaatgctctcaactcgagaaaagacaaattgctttgtaagattattctttcaagtttttaattatttaattttatttcagttgcgttcaaaatgtacgatttaaataaaaacgactacatcacacgtgaagaattcaaagtcattctgaacagtatggttggtgccaatataacttctgatcaactcgacaagattgctgatcgaacgattgaggaagctgatgcagatcgtgatggaaaaatttcttttgatgagttttgtcgagcaatggaaaaaactgatattgaggagaagatgtcgattcgattcctaaactaa

SEQ ID NO: 30142 - DNA, 1008 bp, Caenorhabditis elegans
atgtcgatgacaagcttgtcaacgaagtctcgaagacaagaagatgttgtcattgagggatggcttcacaagaaaggagagcacattcgaaactggagaccaaggtttgatttttctatcggtactgatcatatattaccactgattcgataatttttatgctcgaaaaagttagttaatgatttcacatcaaaatttatcttgaaaactccgatgagtcttgttctcgttaatctttttatttttgttttctacataaattcatatatccgcttcatcatatacgtcaactgatttgtttttgccgcgcactcgctcttatcatgcttttccggctgaaaaatcttcataaacgtttttatgaagggggaatgatgtgacttcctggtagagcagatgattctatgtttgctacgctacatagtacaactattcgcttcagaatataattattttcaaacgactgaaattaaccgaaaattaaagatatctatgaaatattcacgattgctaaaaacgtatatcattttcctaacagacagtacattgaaaaattgaataatagcaacacggaagtgaaactgttgtgattacagaaaactcaaaaaatgaaaaacacgattttgtgcagtatttttggatggtttttttgtttttgagtgtgcatgtcttctatccataagtatgtcacccttctcatttaatgttccaaaataataaacacatgtgaacggcgagtgagcgatgcgaaaaataatcaaattgaaaaaagagagaatgagtgagtgcggaagttgagagtgactgaaaacattttaaaaagaaactcgtcagagtgacataacaaaaaaaacaaagatgataaaagattgaaagttaatgacgtagaataatttcagatacttcatgatattcaatgatggagccttacttggatttcgagcaaagcctaaggaaggacaaccgtttcctgagccattgaatgattttatgatcaaggatgcagcg

SEQ ID NO: 30143 - DNA, 1008 bp, Caenorhabditis elegans; identical to SEQ ID NO: 30142

SEQ ID NO: 30144 - DNA, 1416 bp, Caenorhabditis elegans
atactcgccttgatttctacaagcatatcgtactttccggtggaaccactatgtatccaggattgcccagccgtcttgagaaggaactgaaacagctgtatttggatcgcgtattgcatggaaatactgacgcgttccaggtaacgaatttccgaaaattcggccacaaggatattgccggaataatgttgagactaggcaattgtcaaaatgccgatcgctgagtttttcaaaattcagcagttgtcaaagtttcgaattatcaaaaataaattccaattaccgaatagaaaattgaaaatattcaggtcgttttgagttatatttcttcatcaaaaacacatttactacagtagaaattgattttttttgttaatttttatagttattttttctaatagttttgaacccggtaattgccgaaattttttgtcgccgaatttctaaattttcgaaaatttttataactcgaaaatttctgaaaattttttattttcgcccactatggctgtcttttttttaatcaaaaaaaatcgattaaagattagtttcaaaacagttggtagtagaattgaaattttttccacaaataattatcaatcaaaaagtaaaaagtttttttgaaaaaaaaaaaacaatttttatgtaatgccaatttttgaatgggaagtattacgaaagcacaaatttctgaaaatgcgtatcgcgaaatatattttacgcgcaaaatatctcgtagcgaacactacagtaatcctttgtatgactactatagttcttgtgtagattcaagagctcgattagctgagttgaatcatttatttattgatagaacattattaaagttaagaaaaacagatcaaaaagaaattcattttaaaaatcaagctcattaaactagacaatgttaaaggattactgtagttttcgctatgaaatattttgcgcgtcaaatatgttgcactctacgcatttcccagatatttgtgttcctgtagtagttttacttttggttatttgaccattccttttaagaatggcgcttttggtcgtcaatgacgatttgatgatgtgttaactaaatgcatttgatttcttcgtgtgaggtctcctaaaagaacactcactcaacatcttagttttccgccccatcaccccagtgtttacttacatccttctttagtgggcgtggctacgaccttgaaaaaattaccagcaatgttccaatttatttattttcagaaattcaaaatccgtatagaagccccaccaagccgtaagcacatggttttccttggaggagctgttcttgcaaatctgatgaaggatcgtgatcaagatttttgggtttcaaagaaagaatatgaagagggtggtattgcaagatgtatggccaaacttggaatcaaagcttaa

SEQ ID NO: 30145 - DNA, 385 bp, Caenorhabditis elegans
atgagtgttttcacaaatgttgttggtggtgcattcaagttttccgatggatacgaaatgccaaaaattggtcttggaatctctcgaattgaaactcaacaagatttagatgtctctattgaagccgctctgaaatctggatatcgtcaatttgacacagccaatctctacaaaaacgaaacgtttcttggtaattccctgaaggtaaatttaaactgatttctgaaaaactattcaaacctctaaaattttagaaatatctaccacaatttggcttgacacgtgaagatgtgttcatcactactaaagttcgtactctcaatgaaaatactgtggaggaaactgagaaacaactagccaattcccttgcaactttgcaaaccga

SEQ ID NO: 30146 - DNA, 1065 bp, Caenorhabditis elegans
atggaggacgtcgacttgggcaaggaccgaactcaactcattgattttgtatatgcagttagtttgtaaatgacattgacaaccttaaattcgagaagtcatatctttttctattaacctggcaaaccttcaagtgaaaattgtttaggcagctttcaaaagttttgcactgagatcagccatgttttcattaagatcaattaccgtattttctctatcagacttgcactccccctgctttactttgatgacttatatcttggatgtgtttgtgcaagtttaatagggaaaatatgatagatgaatcaaaaattaatctttagttcaaacttttattcattctaatatttttgtatttttatttggttcttcccttttattttttgttaccgtagtttaaccaactttggcactttccacccatattattgttcaaattattatattaaactaaaattcaaaaaacttatctcactttttttactgaattaactttcaaattaaaataagtcgagtttaatctttggcgtcaattaatgttttcaatgtatctaacaaaacagtttaaatcatacgacttcctatttctatttcgaaacaaataagtaggcgtcgatataatttttatctttttttattgaatgggggtcagaaagactaagaactaaggttcaaggatgagtgacggcatttcaaatttattctccagacttttgtcgtcacctacaaaatgattgtatttttcttacagaatggaaatggatcagcatcaaacttgaataacagaaataatattccattgtcggaaaaagcggcaaaagaacctcttcaaactcaaccccaagaagctccaccggcaccgaaacccaaagtacagaaacaaaaaccacctgtaaaaccaaaaaagcgaattgcatgcagtccaggatcagcaatatgtctattcttgctcgcagttgctgcaattatatttgcagctttcctcgggcattatcttacaaaacaaaattacgaaatgatgcaattcaaaagtgccaacgagtcgatgacaacctgtaaaaattt

SEQ ID NO: 30147 - DNA, 297 bp, Caenorhabditis elegans
aaaattccgattcacgacgcctttggcaatccactccgagtcatgtcacttcaaatgactattatgaaaaatcacgaaaaaggcagggactgtgttgttcggttagtttttgaataatgattcttttaatttaaaaaaacccgcactttcagtcattttcgagtgcttggacctttccgcagccgatatgacagcatgaacagaatgattctcggaccctcagcagtgttggaagcacggccaggaacggagccaataaaagatgcaatcatgaatcactatcagtctatgcgttaa

SEQ ID NO: 30148 - DNA, 1728 bp, Caenorhabditis elegans
atggcaaaagaagaagatgagaaatgtctcaaatgcatttttgttggaaatgcggcagttggaaaaacttcgatgatagttagctacacgacaaatgtttatccacacaactacgtgccaacggcatttgataatttctcagttgttgttctagttgacaagaaaccaatacgtctacagcttcatgacaccgctggacaggttagtgactcacttatattttgggtgattctagcaactggtccaactgatttcattggcgcaattgcggtttccattaaaagttgccgaattgatgttatgttttctggaattaaaaaatgttagcataaaatattaatttatttttcaaaagatattttgaactacttatgcactggttccatattttggtattttttagtctcgcataaaatccttcaattttagattgccggttttgtatttgtaatttaataaaatcgaaacaaacataggtatttataaattatcaccaccccaaagtacaacttttacagttcaatctcagttttcatttgttctatttgaacattgtcaacaggcaaaacattttttaattatttttatatcattgtgcaattaggtatatatttatatcattatcaaaataaaccgcgataccactcttcaaagtgagatagtaggggtgccataatattacagaaaatactgtaaatatttagtttggcaaaaactacaaactaagattctaactaaaaatttgaacgacaagctatgtatatcggaaaattcaagtttaaaagttaaagctcaattttgtaaagtttacaactgagaaactactcacccaggtttttgaaattatacggaagtgattgcacagttgttgttctgataggaactgaacttgaagttgctctgattctttgaatacttggtggtaatttacgaatatttggttgattgaacctcctcactggatacctacaacttctaatgttacacattgaccaatacaatacaagttaacctttggaaaccaaaagaaaatccaatgaaacatattatcaaagttgagactaagattccagaaggatacattgagaacaagtgagctattcaaaatgagatgcccattcggatatgcggcttcgttttatggtagacaagaaatttaaaaacaaataatgtctctgccgaggtgacagggtcggatgtcaaatcgaaaatagagaaatgcacaatggcggatacaaataccggatgagtttcggaccggcgcgcgcaatccggaaacaatagaataacggcatttcaaagggattgagcattcgagaacagaatttagtttaaaacgaagatgtatggcatgctatattaactttttgagttttcacactcattaaaagatctcttatgggatttttgccccatttctgtacgaggaaaagttcagaaaaaatttattgcacaaatattactaatatgaatgagtaaaatagattacaaacatcccagaactgataaaccaccttttcaaaaataatatacaaatttacactttgatcttaaatttaattaaattccaaattctttttcagtcctcatttgacactcttcgcccgttgtgctacacagatgctgacgtctttgtcattgtttattcagttgttgatttacaatcatttgaagatgtgtcacatcactggtatccggaagtcaccaagagaaatccggggacaaaat

SEQ ID NO: 30149 - DNA, 885 bp, Caenorhabditis elegans
atggagaacaaattgaaattggtagtcgtgggggatacctatactggtaaaacaaggttagtcctacttttcttttaattgaacatttctgaattatttatatgttcatcgttagttctagtgataagattatcaataaatttttcgaatttcaacttttggatttctgaatacttaaaagactgttttactacatacaaatttattatcaaatgttggtagtcatgcaatgaaaatttatgaactagataacaagttagtcaagtatgtaacttttcaaaaactattaaagctaattatcaaaaagctgaatattgaataaaaagtcgataaatttttttttgatggaataactatgaagaaatatagtctaactgtagaaattaccgaatttttttcaactatatgtatgataaatcagtaatgcctcagcggaaaaataggaaaactcatgagattatcccacagaatgtttcttatttattttttaaattatcatatttttttaaaatcaaaaacaacaaattttaaaacagcaaatccaagtggtaaatgaaatgatatttatgaggtgatagaaacgacttccgttattcatttcccaattgtcttttcctataaaataatctgctaaatccgtcaagtaattcgattaaagtcacatcaagcgcaacgacacttatctaaatccttttgccaatttcattcaattacccatttatctcatttccgaaaaaccagttattctattacagtcttcttgtcgcttacacgaaaaaacaatttctggataactacacaactactgtatttgataactgggctgtttcagttcatattgacaataagaactatgctgtcaatttatttgatactgctggacag

SEQ ID NO: 30150 - DNA, 576 bp, Caenorhabditis elegans
agtcttagaaagttttttgcaataacgttcattggagcaattctttggattgctgcgtattcatacctaatggtttggtgggcaaatacaatcggcgaaacatttggaatcccaactgaaattatgggattaactattctggcagcaggaacaagtatcccagatcttataacaagtgttattgttgccagaaaaggtctcggtgacatggcagtctcctcatcgattggatcaaatctatttgatgtttgtgttggacttccgattccttggctcattcattttgcaatcggagtcttcaaatccgaaccaacacaaaacagttatattttcaaatacaatttagtttaactccaatttttatttacagtatcagtaacatcgaatgggcttgtttgttcacttggtctgctcttcgcaatgttaattgtccttctcacatgtgttgccatttcaagatggaaaatggacaaattcttcggacttttgatgatattctcatactgtggtttttgtatgctttgtattttactcgaaacaggacacttaaagtgtccactccgaaatagttgttaa

SEQ ID NO: 30151 - DNA, 419 bp, Caenorhabditis elegans
gatcagcaacattcaatattttatgcgttcttgcattttgtaccttattctctcgtcaggtacttcatttaacctggtggcctctatttcgtgacatgtcattttatacgttatcattatttcttttattaatattcttcggtgatgaagtgattgaatggcaagaagtgagttgacctcttgaatacaaaaatcatgttgaaaattttcaggcgttggtcatgttttcaatgtacattgcatatggcttctttatgaaattcaatggatttttggagttgaaaacgaaacaatttctatttcgcaaagtcgggattggaagtgaaattgcaccagaaacaattgtagatgctgcagctggatgcacaccaaggagtcctcatagtttaggtgctcaaggacctcgaaggagttttcct

SEQ ID NO: 30152 - DNA, 1109 bp, Caenorhabditis elegans
gagactcccgtgcggttgttgctggaaaaaatgaaattttcggtaccgaggaccacaaaccatatctggaaaaggagagaaaacgaattgagggtgctggtggttctgttatgattcaaagaataaatggaagtctggccgtaagcagagcattcggagactacgagtataaagatgatccgcgactacctgctgatcaacaacttgtctctcctgaaccagatgtttacatccgagagagaaatcttgaaaatgatcagtttatggttgttgcatgtgacggaatctacgatgtgatgacgaatgaagaactcgcagagtttgtgaaagatcgcctttcagttcactctgatttgagagaggtattttttgtacttgaacaaaccgatatgcaatcattttccaaaattaattaccaaaactaaaaagttttgttttgaattccgttttaaaaattgtatctcactccgagaaacagtgacattttaaaaagtgctcttatttttcgaaaaccgactcgaagtttcaatatttttgctggaaagaattgtaacgacatttctcaaaatgtgagaaaatgtaataaaaatcttttccacccttatttatccattttaaaccttccacgtggcatatttttatgatttggattcatgaatttctcagttttagaacaaaacgtaaatttttgaataaatacaaaaatttccaattggaagtagaggaataatttccagtctagaaacttaaataattgcaaaattattcaggtgtgcgacgatgttctcgacgaatgccttgtgaaaggaagtcgggataatatgacgatggtggttgtatgtttccctgctgcaccagaagtcaatattcatcgaaaagaagccgaggaagcatgggtgtcccgagtgaagactgttataaatcaattcctcgatgaggctgttgctgcggaagacttcaaacaagaagaagacatggtcactctcaagagcattctggataaagtaacagcaaatggactgttgccaactgatttgcgtgttcctgaacatacagttactacgctggcccagaaaattctgacacaacgtgacatcaagcatgtgtaa

SEQ ID NO: 30153 - DNA, 611 bp, Caenorhabditis elegans
gttaataatgctggtgccaatttagctgacggaacagctaatacggatcaaccagtggagttgtatcagaaaacattcaagttaaacttccaagctgtgatcgaaatgactcagaaaacaaaggaacatttgataaagacaaaaggagagattgtaaatgtttccagtatcgttgctggcccacaagcagtaagcttcgggagagaggatttcagaacttttgttttaattttcagcactctggatatccatattatgcttgcgcaaaagctgcgcttgaccaatacaccagatgcactgcaatcgatcttattcaacatggtgtccgcgtaaattctgtcagccctggagcagttgccactggtttcatgggagcgatgggtttaccagaaactgcatctgacaagctttacagttttattggctcacggaaagaatgcattcctgttgggcattgtggaaagccagaagaaattgccaatatcattgtattcctggctgatagaaacctctcatcttacattattggacaatcgattgttgctgatggaggatcaactcttgttatgggaatgcaaacacatgatcttatgtccgttcttagtcagtaa

SEQ ID NO: 30154 - DNA, 826 bp, Caenorhabditis elegans
atgtccagaattgagaacgaaagcggatttttgtcatctgacgccgcaagtgttggatccgaagacgataaagttgagatgaagaaaagaaacggaacgattccaaaggaagatcatttgaaatcaatgtgcaatgcctatcagagcatcattcaacatgtcggtgagttcatgtgattctttggttcggaaagtattagtcgatcaacaacaaatttaaaataagctgtttaagaatagattatagagttctgaaaacgtactgtcaactgtttacgtcagcagaattaggaaaactttggtttcgataaacatttcaacacactttttgattcattctagagattataatgttttagcatttattcattatcagtgactcaaagaatattgataaatattttcccaaatataaatttgaccaagatgttttgaaagtcgatgatctataactgatagttgttattgtctggaaggaagttcagttcaatatattccactctcaaatcaaaaatcaagatcgaaaattgttttaatttaaagactcatgacaaattgtaatctattacatcacgcaatcaaggtaccctagcacatcatcaggaacttgtgatttcaattgatatatctataacataaatcagaaaaaaataggttgtgtccgttgattataagggaaaaaatgaaaacaaaatacattttcccacgttgactgattttgggaattcaggagaagacatcaatcgtcagggacttctgaaaactccagaacgtgctgccaaagcaatgatggcattcacaaagggatacgatgatcaacttgatg

SEQ ID NO: 30155 - DNA, 1291 bp, Caenorhabditis elegans
tgcaaatttccgcaaaactgctgtcattgcttggaagcgaattctttgtccaggatacgcagaacggcaaaagggaaaggtaataacttctcactagaataaaataacaaaatatatgtttttctttcaatttcaaaactatcaataattgattttatccgatattcacttattttcattttatcatcccacttatctcatctcacaattcccactatattcatttcaactttctatgctatcttttgacagcgctttcttctctccatggttcattcagtcagtgattcaattcgaaaacggattccaattgctcaaccagcaccacatacagtaagacggaatggcaactttgagatgtctgttcccaaaaatactctcctgcaacattcactgacacacacaaacacacacacgaattgtctgcaatatcaccaaatttgcatgtcacgaacatttatttttcacttatttcacttgcaattttgaaaactttcctcttcttctttttaatttgtttcctttgttgggttcatactacataattttagtctatctggcactatcatcgctcaaattttatggatttctttagtattgatcaaaactttaaggctgccaaggtagttgagcaatggtagtgtaagattagtagaagaatctttaattaatcggaaaagaatattggagtagttagaatttaattcaagactaccaattttcaaaggcgtggaactgaaaagtggggtagtgggaaggaggattttcctttaatatactaagaataatctttatgacatttctgcatttctgatcattttgagtattttaaaccgaaatctcctctactccactttttacaaggtatctcaagaaacgagttagaagttttagggcaagtttctgtatgtgcttgtgcagaataataatttaaaatgtttaacatttaaaattcattgcttaatcactcacctttgtgataaaatgtgctcactgattttgaataattttctgcgtgtccatgattaaaacaagtcccgtctcttgtctcgtattttaattaatgtttcattgagtgtgaaattgttctaattttttcaattttcaggtactcgtaacggatcaaacttcgagaatctcctatcgtatgacgtctgaaagaagtacaatccgtttcccaaacactccttctagagccaattcaccaaagttaactgcttcaaatgcggtttctgttccattacttggaaccgaaattcaaggatcatcaaaagaatcaactgcaatttaa

SEQ ID NO: 30156 - DNA, 256 bp, Caenorhabditis elegans
atggagagaagagttgcttttcggcctcctccaattggtgaatcaaggagcacgacgatcacacatgattccggtttgattttcattgaattcgtgggaacttttcttttatttcatggaaatatattgcagggtccaatgccgatacttacatgaggcttaatgttggtggaaaatcgtattacgttcgtgcggaactctatacatctgaatggacaagaatgcatgaattacttgattcaagtcacgaagaaag

SEQ ID NO: 30157 - DNA, 1087 bp, Caenorhabditis elegans
gaacagctatgaaggatcttgccaatccagatcgtgtgctcattggaggagaatcctctccagaaggacttcaagccgtcgctgaacttgttcgaatctacgaaaactgggtgccacgcaatcgtattattactactaatacatggagcagcgaactttcgaaactcgttgccaacgcattcttggctcaaagaatttcatcgatcaattcaatttctgccgtttgcgaagctaccggagctgaaatctcggaagttgctcacgcagttggatatgacactcgaattggtagcaagttcctacaagcatctgttggctttggagggagctgcttccaaaaagatgtactctcacttgtatatctttgcgaatctctcaatcttccacaagtcgctgattattggcaaggagtgattaatattaacaactggcaacgaagacgtttcgcagacaagattattgcggagttgtttaacacggtgactgataagaaaattgcaatcttcggattcgctttcaagaagaacacaggtgagtataagcgcaaaaagctgttcaacattaatctaaaaatacaccgagaatatacatacgttacatgcttgttttacaatttacaggtattttaaagctatgcatattgccatattgtcaagaaaatgaatattattacaagtttggtttttcaggtgacacacgcgaatcatcagccattcacgtaatcaaacacttgatggaggagcatgcaaaattatcagtctacgatccaaaagtgcagaaatcgcaaatgctcaacgatctggcttcggtgacaagtgcgcaagatgttgagcgtctcattactgttgagtcggatccatatgctgctgcacgtggtgctcacgcaattgttgtacttaccgagtgggatgaattcgttgaattgaactacagtcagattcataatgacatgcagcatccagctgccatattcgatggaagactcattctggatcagaaagcattgcgtgaaatcgggttccgtacattcgccattggaacttctccagatcaagcttataatctattcggaacagctggttattaa

SEQ ID NO: 30158 - DNA, 517 bp, Caenorhabditis elegans
atgtcgaacgatggagatttaaacattgacaatctgatcaccagacttcttgaaggtgggttttaaagttaatagagaaattgatctaatatcgacattcgaactaaaccagctgtatagttgttcagaaattttattgaattttatttgtttgaaattccgactagaaattccaaatattctggttttgaggaattttgtttaatatagcaattatcattatttattatggttggcaactatttatttcaataatttctgtcatttttccactttccgatttttacggtcgtaaaaaatttaattaatatttaaaattttactaattctctttaaagcttattttaagtgactaatttgatttttcaataaaattatttttcagttcgcggatgtcgtccaggaaagccagttaccatgtcggaggcggagatccgtgctctttgtcataaatctcgtgagatcttcctatcacagccaattcttctggaactcgaagcacctctcaagatttgtg

SEQ ID NO: 30159 - DNA, 816 bp, Caenorhabditis elegans
atgaatcctagtaactgctgggaaaatgttggtgcctcgtgttccactttcgataatccaaacgtcctctcggagactaatcggctactctcagtcagtttctctgtattttttcgttttcaaaaaatagtaccgcctaggtatttttgttttctcactaccagttttccaaatttcttcctttttccaacaacaaacacaacttttcatttcctgccacttttttcatctgcaatttctaaacccaaaaatttcacaaatttcggtatcacctaaaaagtgtggtcatcacatcatttttcgaaatcttccttctgaccgcgcccaacaacgttttccttatatgtctatgtctcatcgtcatacagttttctctcgttcattcaattttgattcaccgtccgacaccttcattttgtatttgcctctgttcaactttagaccgaaaacattgagtttaatcagccatgaccacgtcacactcgttttccgtccattttcattcattttttatccattttcacctcgtttaaagattttgtactcctaattacttttccctaatactatgttttcacattattttacttattttcagcatcatcccaatccagatgatgcgccgcaaaaactcatcttcaagctttggagagttgaatattgatcaactgatttccacattagtatctgtaaaaccatggcacaaaacattagatgttacggaaaatgagataaggatggtttgtgtacttgccagacaaattttcatgcatcaaccgatgcttctcgagctggaacctcctctcaagatcggag

SEQ ID NO: 30160 - DNA, 663 bp, Caenorhabditis elegans
gcaaacgacgatacagtgtgaaattgtggaaatgtttccaagatgtctttaattgtatgccagttgccgctctaattgacaataaaatcttctgctgtcatggtggtctttcaccaaatcttcggtctctcgaccaactcaaacgactttcccgtccatgtgatgttcaggaaacaggtcttctgtgtgatgtactttggtctgatccagatgcgacagttgttggatgggcaccaaatgaaagaggtgttagttatgtattcggtgtagatgtccttgctcaattccttcaaaaaatggatttggatattgttgttcgtggtcatcaagtagtcgaagatgggtacgaatttttcggccgacgtggattggttacggtattctctgcacccaactactgtggagaatttgataatgctggagctgtaatgaatgtcgatgaaaatttgttatgttctttccaggtaaaatgtgatttttgagaaaaactaattaaaattttgatttcagattctcaaaccccaatcgcaacttgtaatggatgcagctttggctgagaagcagaacaattttgtagcgaatctcgcaggaatggcaaatattaaaatagaacaaaaaccccagccaatgattcaaaaacggtttcgccgtggaatgttgtaa

SEQ ID NO: 30161 - DNA, 570 bp, Caenorhabditis elegans
catcaaattgacgttgttcgtaaaacattgaaaaagatgcctctgcctccgattaacgatccatcggatttagacaaattccgtgatctgatcaccaaggatttatacgatatgaaaaaagccgatagcgaagtaatttctattgtttgtaaaaaatacatttgaaaattgtttcagagattcaagaatcctgttgccgatgttgaaatggaagaagatgaagacgatcctcaatactatatgcctccacagtctacttcgagaacaaattatgctagcggcagtgaagatgaagtggcaaattctgatgaagaaatgggaagcagtatctcgagacattcgaagcaacctaccacacgtggtagaggtcgtggtgccagaggagcaggtgcttcacgagaaactactcgtggaagatccaataaagttgtttcaacgcgacaaatcgattcagatggattcgaaattatcaatgattcgccgtctccgcctccagcttcacgatcaaccagaggaaaagcaagaggaaaatcagctccatccaagaaaagggatctaagtttcttctaa

SEQ ID NO: 30162 - DNA, 510 bp, Caenorhabditis elegans
atgtctcgcttcactgataaagttgctatcattactggtaagttcaacatttttcaatatttaatcaaatgaaaagtttaaggttcatccaatggaattggtcaggcaacagctcgtcttcttgcttccgaaggagcaaaggttactgtaactggaagaaatgctgagagacttgaagagacgaagaatattttattgggtgctggtgttccagaaggaaatgttcttgtggttgtcggagatatcacccaagaaagtgttcaagaaaacctgatcaagtcaactttggataaatttggaaaaatcgatattttggttaataatgctggagctggaattccagatgctcaaggcaaaagtggagtgaatcaatcaattgacacatatcataaaacatttgaattaaacgtgcaaagtgtaattgaaatgacacaaaaagcacgcccacatctcgcaaaaactcaaggagaaatcgtaaatatttctagcattggagctggaccagctgct

SEQ ID NO: 30163 - DNA, 160 bp, Caenorhabditis elegans
atgggagatcactatggattctcactcaccaccttcaggtagtttaaattcaatctccagaaaagtcaattttatttttatagcccatcgggaaaattgatgcaaatcgaatatgcattgaatgctgtcaagaatgggcaaccatcggttggactgagag

SEQ ID NO: 30164 - DNA, 325 bp, Caenorhabditis elegans
atgactcgttttgctgaaaaagtcgctattatcactggtaagacttataattttaataatataaaatacatttaaatattgatggtttttaggttcttccaatggaattggtcgagcaactgctgttctctttgcacgagaaggagccaaagtaactatcacaggacgtcatgcagaaagacttgaagaaactagacaacagattttggcagctggagtttccgagcaaaatgtgaattcagttgttgctgatgttactactgatgctggtcaagatgagattctcagcacaactttgggaaaattcggaaaacttgacattttg

SEQ ID NO: 30165 - DNA, 529 bp, Caenorhabditis elegans
atgtgcgcgcaatcgtgctctaatgcatctggtgcgcgcgccgttcaaaatgtatcgttttctggttcgattaatacaactttatttttaatacttgctcgatattctcttgattttgcacactgccaagtattttacgttgtatcccttcacgtattaattattcatcttcgaaaccttttcttctcgaataatgtaaatttcacatcttcatcgtttcagatgtttttctcaaaagctggcaaagccgctgttgaatgggcaaagggttcaaagtaagttttttgtggaacatactgttttttatttctaaattttcagagtcccttacaaggagtttgctctcacccttgagaaaatcgaagagttatcgggaaaaaagaaagtggatgaattggctcaatttttcaccaaagttctggacttttcacccgacgatttaacagcgtgcgtgtacatgtcagttaatcagctcgggccatcgtatgaagggctcgagcttggagttgctgaaaattcgctgatcaag

SEQ ID NO: 30166 - DNA, 689 bp, Caenorhabditis elegans
atgtctactttctgcaattactgccaaagatctacgaaagaaatgttccacctcattgactttagcgacctatttaacaaatattttacttttagcaaacgaacacttctggaaaatgttttttgaacgcaaaggccttgttccattttccttctcggcacatccgtcataacaataacttgtagtatgttcaagggacaaaccgcttctgggtttaggttagaatatgcataagaaattgggatgagggaaatactacattccggatagttaggcaacagatcatgtcactaatggaatctttcagcgtctcactttcttcattcaactttcatttctttatttaggtttccaaatggatccaacgtgttgacgggcgtcaagacattgaaaagcaatacgagattggggctattattggcaaaggaaatttctcgagtgtgcatttaactcgacgcaaggaagatggcaccaaatgtgcgcttaaggttcggtaccagtcaacattgcaattttcatttccttcaaagttttttcagcaagttgagaaaagagcaatgcgagggaaatgcttttttgtggacaatgaggtggagatgttgtcactcattcaacatgatcacatcatatcgattatcgatgcttttagcactgaaaatcaatacttcatagttttcgaacatgcacag

SEQ ID NO: 30167 - DNA, 1262 bp, Caenorhabditis elegans
ctcgtctacgagtttttcctgagattcctggagtgccccgattttcaatctcaagttgcaaaacgttacattgatcaaaatttcattcttcgtcttctcatgattatggacagtgaagatccacgtgaacgtgactttctgaagacaactttacatcgaatttatggaaagttcctcggacatcgtgcttacattcggaagcaaatcaacaacattttctactcgttcatctacgaaactgagaggcacaacgggattgctgaattactcgagattctaggtagcattatcaatggattcgctcttcccttgaaagaggaacacaaaactttcttgctccgagttcttcttccgctacacaaggtcaaatcattatctgtatatcatcctcaactcgcgtactgtgtcgtacagttcattgaaaaagactcatcactgacagagcctgtaatcagtgggatgctacgcttctggccaaaacaacatagtcccaaggaagtgatgttcctgaatgaattggaagaagtcctcgatgtgatagagccgaatgagttccaaaaaatcatgactccattgttctcacaaattgctcgctgtgtcagcagtccacacttccaagttgccgaacgagctctctactattggaataatgaatatgtgatgtcattagtagcggacaatgctcgtgtgataattccaataatgttccctgttcttttcaaaaacagcaagtcacattggaataaaacgattcatggacttatctacaacgccctcaagatgttcatggaaatgaatcaaaaactgtttgacgagtgttcccaagcttatcagaaagatcgagttcaagaaaagacattgaatgaagaaaaagaacgcatctggaacaatattgagaaacaggcaatgggaaacccgcaatatgttgaagttaaagcactatttgctcgatttaatccagatgaaatcatcagctcgcgtcagcagaatggagttgacgagaatatgaagacttcaactgtgcttagcaaggatgaaattctgaaaaatgctgtaggagtggtaagttacaaaaacctagaaatattttttttttgtacaataacgaatcattacagagctcgatgaaaaacgatatggatttcggacccaaccacaaacaatccgatttccctccagatgagcaaacgacgagagctttaggcgagtacaagcgtcacgatccatttttgaagaaagtgactagcaccgacgaacagtga

SEQ ID NO: 30168 - DNA, 1262 bp, Caenorhabditis elegans; identical to SEQ ID NO: 30167

SEQ ID NO: 30169 - DNA, 986 bp, Caenorhabditis elegans
agacataaaaagcgactcaattctactgaagcgagacggaactgtgaaactgacggatttcggtttctgtggtcaactatctgaagaagttcctcgtcgtcgttcgcttgttggtacgccttactggacagctgcagaagttattgctcgtgaaccatatgacactcgtgctgatatttggtcttttggaataatgctcatcgagatggtagaaggagaaccgccgtttttcaatgatcagccgtttcaagcaatgaaaaggatacgagatgaacatgaagcaagatttagtaggcatgccaaggtaggtagaataggataacgttaaaaattcaagcagataaagaagaattaaatgaaaattttattttagtatactcgaaatagtcccatatgttttagtaccacaatacaaacgaagagaaaatcaaaaaagatttttaaattaattgaaaaaatggtcaactctcgaaaacgcaattttcaacttttgaatagaatttcctccaaaatcagaactacaaccaatcaatgaactgtccacttttgagccaatcagatgatttgtgcgagtgggtgtggcttctcattttggaggaaattcaaacatgaaagttagcgagatttgaaaattcgcgattttcaaatttcaaaattgtgcgattgtcatacttttgctatgtggtattcgagaatatgtagaattatagagtaaaatccacgttgaccgtactccacctttaattcaattttttcaaaaactactaagttctttcaaaacgcagtttatttgaaatatctaaaattatattttccaggtatctgtggaactctctgaattgctttcacattgcattgtcaaagatgttaataaacggtggccagctaaagatttacttcgtcatccattttttgcaaaagctcagcattcttcatcaattgctcctctccttctacagttacagggtaacacgattaatggaaat

SEQ ID NO: 30170 - DNA, 986 bp, Caenorhabditis elegans; identical to SEQ ID NO: 30169

SEQ ID NO: 30171 - DNA, 1035 bp, Caenorhabditis elegans
tggaagaatcctttgtggtcagtcgtaatgatgggtgtttatgttattgaagctctcaaattcatctcatatggccacgtcaactactgggctcgtgatgctcggcgaaaaatcacagagctcaaaacacaagtcaccgatttggcaaagaaaacatgtgatccgaaacaattttgggatttgaaagatgaattatcaatgcatcagatggctgctcaatatcctgccaatttgacactttccaatatctactacttcatggctgcaccaacattgtgctacgaattcaaatttccaagattgttgcgaattcggaagcactttttgattaaaagaaccgtggagcttatctttctatcgtttttgatagctgcacttgttcaacaatgggttgttccgactgtccgaaatagtatgaaacctttaagtgaaatggaatactctagatgtttggaacgactcttgaaacttgcaattccaaatcatctcatctggcttctattcttctacacattcttccattcatttttgaacttgatcgccgagctgcttcgatttgccgatcgtgagttctacagagacttttggaatgcagagacgataggatatttctggaaatcatggaacatcccagttcaccgatttgctgttcgccacatctacagtccaatgatgcgtaacaatttctcaaaaatgagcgcattcttcgttgtgttcttcgtgtcggcattcttccatgaatatctggtttctgtgccattaaagattttccgattgtggtcctactatggaatgatgggacaaattcctctatccattatcactgataaagtggtgagaggtggacgtacaggttagcttattactttgaggtctcaccacgatttcctaaaaaaaaacatgttttcaggaaacatcatcgtctggctctcactgattgttggccaacctcttgcaattctcatgtacggacatgattggtacattttgaactttggtgtttcagcagttcaaaaccaaaccgttggtatttga

SEQ ID NO: 30172 - DNA, 378 bp, Caenorhabditis elegans
accttgcgagaaagtggtacatactgctcaagattcattgttttcgacgagttctggatggacaaatttccgtggattcttcaatttgtctattttacttttggttcgtaatttactcgttttaaaatctagactatttctaaatgttgaattttcattaatcttctttttattcctctataaccaaatttcaggtactttcaaatggacgcgtggcacttgaaaatgtgatcaaatatggtattttgataacaccccttcagtggatctcaacgtttgttgagcatcactactcaatttggagctggccaaatcttgctctcatcctatgctcaaatattcagattctctcggtttttggaatggaaaaaattcttg

SEQ ID NO: 30173 - DNA, 657 bp, Caenorhabditis elegans
atgagctggcgtaccaccaccgccatcctttgcctctacggagccgtaaaggagtttcgaccagctactccattcctcactccgtttctagcatcaccagaaaagaatataacattagatgagctatattctcaagtatatccatattggacatattcctatatgctagctctgattcccatgtttattctaactgatatccttcgttacaaaccgattgtaatgattgaggcgattggtttggttgccacatgggcattgttagtatttggtaaaggagtatggcagatgcagatcatgcaagtctcttttggtaagaaggtgccatttttatttatttaaaatttgagtttcaggagttgcatcagctgctgaaattgcttactactcttatatttattcaattgttgataggaaacattacaaaagagcaacatcttatattcgcgcagctgctcttatgggaaaactagttgcttttggattaggacagaccttgatttcaactcacacatctgattatttggttcttaatcaaatctctctgggagcagtctgtcttgtcacaatcattgcgatatttctgccacgtgtcaagtcggagaaagccaaagtttcaatgagagcacacgagattgttgagcagcaaactgttga

SEQ ID NO: 30174 - DNA, 523 bp, Caenorhabditis elegans
aatcgaatgcacgaatcaatacagttatttaagcaagtaatcaacaataaatattttgtaaacacttcagttatattattcctgaacaaaattgatttattcgaggaaaaaattgttaccaaaaaacgaagtcttggtattgcatttgagtcatttagtggtaagtgcaatttttgaaggcgaatgtggaggcacttgaaccccgtacacctgtccgccgttctggccgagtggtctaaggcgctgcgttcaggtcgcagtcctctccggagggcgcaggttcgaatcctgcggacggcatttctttttgtgcattctctttttttttgcaggaccgagccaagatctcaatgcagctgtagcgttcgttgaaaaaaagtatagaagtatggcagagaacaaagagaagaacatttattgtcatcacacttgtgctacagacacacaacaggtgcagtacgtactcgatgcggttctagatacgatactatctaccaaactgaagggatgtggattgtattga

SEQ ID NO: 30175 - DNA, 1781 bp, Caenorhabditis elegans
atgcttcaaatattccttatcaatatctcaatttctttcccacttgtgatattcagcttcatctttcagcttctttccatgacccttttccttcctaattggtgctctggcttttattatcatgatgacgtgatgttgtcatcacaagttggtacgttttctttctctcctatccagtcggtttttttctcacgtccccgtttcaaacctattaaaaaggaagaaatgagtgatgagggtgcgagtaaagagtcaacatcttttggaaaagcaactaaacttttcaacttaaattagacagacaccttctgtcttgggtgactcaaaatatgtcgtagtttgatctgttttcctagacaacgtctagaagcaatatgctcttagatcttaagtgatatctagatacaggaagtttgaaatttgtgctattttttgaatatgctgttctgccattttgtgaattatatgtttaccaaaattaagtttaaatgttattccatatttattcacactgtaaagtaagtctttaatgccacctgcgggtttacaaaatatagacaaataatttttccagacataacagtttactaaataggaaaattgtttatattaaaaaataaacattttttgtctagtaaaacaactacaacgttgttttttatacataagatttaaatctctactctcactctataaacaaattccaccatgagttttttctgatgagtttttgtatttgaggaatggagacgtcagattgttgatttcagaaaaatcaatctgcagagttaatgattttttttgttttcaagttcttaattattgccgcgtcattttttggttattccgcccagaacccagtgtagcctggttgcatagattccccagtttcccacgatgcagaagatacaaaaaactggatgatatttggtaaaccgacaatcgtcattttaattctaccactaattaacatttgataattctaaattccaaatgtttccattaagaataaataaatgaaaactcgagattctaaacctcgatgaccaacaaatcataaactttttgacttttcaaaatcgaaacagaccggacgaaagggatttgtgccgcccggattgttcgcattttctgtttcatacaagtttgctcttctcttccacccatttcccgctcctccctcttccactgatgttctactgcttctactttttcgtcttttcctctcaatttttgaaccatcttctactttttcttatttttcaatttctcttctaaagatctcaaatctagagattcccattgattaattattaatgataacttttcatttggttcgcttatcgatgaatgagtaaatgagaattttggagactttccagctgcttgcaatctattttttctcatgaaatttgaaatttagtctcgtggtgcaaagtctagattatccttataaactttgtcttcttagtgcagattttattctattttgataacatattgtcagaaatccgttctcctatttttctaatattgaatattgatttacttttattttcagatgcacaacagaaagacaccaaatagtttcttcatctttttaatacttctttccattttacaaattaatatatgcgaaattataatcgatagtgattataatgttagttctgacgatgatccaacgacaactacacaaaaaccaagaaattgcactcgacaaccagctatcatagacaagcttttgaacggaaccggatacaacaagttccggataccaa

SEQ ID NO: 30176 - DNA, 696 bp, Caenorhabditis elegans
aaaattaactcatgtggaaacttgacaattccctcatttggagattttgttcatgtttatctcaatggaaagtacattgacactctcacgcgaagatattacaacctgaccagaaactcagtgatcattgaaggttgcctggagaatgaagagaatcggctttttatgttggtcgaaaatcaaggaagaaaaacattcgaaacaattaatgatagaaaggtagagctgatcatttttttttgttttgcggattatatgtctgaattttagggaattctttcggatgtttttatgaatggacaggcgattcaattttggactcaatgtggaatcaagcttcctcttcaagaagacttctacttcagaaaagcaatgagaaacaattaccggaagaatgttaaaagtaatcaaaaacagggagttttcattggaattcttagtgtggatgccccaactgatacatggcttgacactactggatggggaaaaggaattgcaattgtgaatggaagaaattttggaagatattggccaactaaaggtccacaaatgactttgtacattccagcagaattcttgaaaattggagaaaattcagtgatgatggttgagctagaaggagctgaggaagcttgtacaagtacatcatcgtgcattgctgactttattgatcatcctgtttttgattttcaatga

SEQ ID NO: 30177 - DNA, 400 bp, Caenorhabditis elegans
atgggagacgaattcaggccatcgcatgaagagcgttcaaaaatgtataaatcgaatggtgagcttttaaggtaataccttataaaattgtattatttttagtgcgtgatcaaaatgagatgcgaagaaaacgacgtgaagatgaagttcaaatcaggaaaaatcgcagagacgaaaagttcgaaagaaatcgacaaattaccgtccagcgttctttgagccatgaggaaacttcggaattattaaaatcagtagcagacggtttacaaagtatgcaggaaactacaattcatgaagcattgacagttttacacgaaaacttgaacaacacggtgtggactattcatgtgctcgtcaaagtccaaattcttcataaattatcagatgtctactgtaaccg

SEQ ID NO: 30178 - DNA, 1156 bp, Caenorhabditis elegans
acaagcactcacggtatgctttgtcaacagcggaacttcagtatttgccgggttcgttattttctcattcatcggattcatggcaactcaacaagaaaaaagtgtagccgaagtagctcaagcgggccctggacttttattccttgcctatccatctggaattcttcaacttccatacacccaattttggtcttgtctctttttcttgatggttcttttcttgggagttgactctcaattttgtacaatggaaggatttttcaccgctatcattgacgagttcccacaaattcgacgaaaaaaatacggacgagaaatatttgtgggagtgatctgcgttatatcatatcttattgggttgactacagtaaccgaaggtggtttttatgtattccaactgtttgatttctatgcagcatctggatgggcacttttatggcttcttttctttgaatgtattgcaatttcatggagtttaggaatcgatcgttggtatgaacatatgaagagtatgattggttattatccaagtgcttggtggaagttttgctgggtttttgcaacaccgtctgtatgtttcggagttcttttattcggactaattaaatatcaaccacttcgtattgatgcctacaattatgactacccggtatggggacatatcttcggatggttcttatcgctttcttcaatgctttgtattcccggatatgctatttggatatggttcaaaactccaggaactgttcaagaggtatatgtttaagaaaacgtacggtttttatattaaaagttgtgtaagtaagctcaaaattcctgtggccggtttttatattttcggtcgtatatggaagtcctaaaaagtaattatttttgtaatattttactatttttctgtttgcgttgtttttttgttaaacacaaaaaattgtatggttcttttaataagtgctaggaaaaatgtttttcattgatctttttactctttcattgtcagactaaaaaaatatacatacattaattcggctctctttaaaaaaaagtgtttatttttaagaaaatcaaattgctgtgccgacccgacattgaaatcaaaggtgcaatggaaaatgcagaaaatctggagcttgttgaagatttccagaatgcgatctaa

SEQ ID NO: 30179 - DNA, 977 bp, Caenorhabditis elegans
gaacggcacgaagttatccgacaaatgtgtattgacggaatggcattagagtggaaggtttgggtgtctgcatttctgatcttctttgcattcttacttccatgcactcttctaacctacttttacgcgaagatcgtccttcgtctgaggagacaaagaaggtacatttttaagatgatgagtcagcacaaaaagaatcaaagatttctggactgaaaaggcgtgtgaagggaaaatgaaagacaaaagaaaaacaacccaagtggtttgcttttatagaaaaaaagtgaactaatttgaaaagaattttcgaaaaagtgagtaataagaaaagaagtttttttcggcatttgaacaagaccagaaagctgtgcttgaatttcttgaaataggggaattcaataaaacacattaattcaaaaattttctacaaattaaatttaacagaaagaaacagatgaatagttatgttttattaattagataaatatttgtttcaagtcagatatcggcctataaaacattcaataaaattaaccaatttcagaacaatgctccaatctcgaattcccctccgccgcattacaatatacacaatggcagccacgttcttctatctttcgtgtcatattccattttggctcccacagatctacaacattttctcgacagttcttgggcacaaaatgaatccaaaagtcatgacattcacctattattcacatcttcttccgttcatatcggcggcatttaactggatattctatgctcgacttaatagtcaattcaaaaaaggattggttctagttacggaaagaatgatcagaaagcgaacaaaatcgatgcatgagaaaggatacagtgaggcagctgttgagcttacgagcaagttcgatgatgtcccattgatgtgtccacactgtgaagctcaactttctattcgttcaagtagtaatggaaagaagaattcaagataa

SEQ ID NO: 30180 - DNA, 304 bp, Caenorhabditis elegans
ttgcgttcctgatctgctggattccgtacttctgcatttcaattttccgtggcgtcttgatgggattccaaattaacatcaacacaccaattcatctgacgctgtttgtctacacttcttggcttggtttgttccatcaaacgctgtttctctacacattcttcaatttaatcattttttaggatatgcccactcgtgtttcaatccgctcatctacatgtgtcttaataagaacttccgaaatacaatgagaaaaatgatgcaaaagacgaacagagcaaaaatggctgaacaggaaggatga

SEQ ID NO: 30181 - DNA, 339 bp, Caenorhabditis elegans
gaacaaatactcaattacgaagaacttccaatgtattcaataaggaagtggacgagatgcgaagaaaacggcagtgctccctcgaatgggagtttttggcaactgtattggatcggttagtgttcggctaaaacaaatttatatgcttacacttgaaataattttcaaatcaaattttctcaaactgtccaaaaattaatagtaaagaaaaattgtttcaggttcctgttgatagttttcgtaggagcagtcgtcatcgtgacagctggcctcattctcgttggcagaatggcacaatacagttatgaccacccggatgaccgattctttaatgtctaa

SEQ ID NO: 30182 - DNA, 1388 bp, Caenorhabditis elegans
atgaatcaatttcaccttcagctccaccggttccatcatcatctcctcttcctcctccattaacacctggaccagctgatgatgttgtatcggtggcgtcagaattatcgtcaaaattcttgacgagcagaatgcgccccaagtcacaaaaggacaacacatttgccgcaatgcagagtaagtcttattttaagaatcaatattgtactacggagccctaacggagcttgaaataaaaacggcactgagtgaaatgccaagttcaaatagcacgggtcttagggaataactcaaaattttaatcctcgttccgtccaaatgttgctaaactttagcgaagccactttttattttgagagttcaaaaaacgtaattgtaggggctggattgagtcgaagctcaatgagacaaggtaggtcgtgttgtacggttaaaaacttcttctatcactatgtttgataacgggtttgatctcgtttcaatatttcagttaatttatttaatcggcttttatttgaatattagctttgcatccaacttctgcgttttcaatgtttataattttgtaatcaatatatcgatagctgaaagtggaatattttgaaaagtgatacatttcattttgttaccaattaaatgacatttcattatgcaatgttaaactaataggaaactcaaaatcacatgttatctggaaattcgtattgtttacactactaacaatttaactagataaaatcaataatatcaagtatcaagtaaattgtgttttactcatatggttgtaatttttttagttatgttaattttttattaattccaatcatagagagttgaacatagcaatgtgtaatctactagaacaatccaaccaactagaacgggttcgacaaactggtacatagggtcaattattggctcaacatggttgagaaacactgatttctaggaagcgttgggtcggcacagggtagcattttgtcaaacctccatcgttctagcaattctataaaaaacactagaaaatagttctaaactattgaaactactggagaaatttttcacagtttaattttgaagcttgcggggttgtacaggtgtaacagaagtatcgtaagacatatctagtaatatatatatatatacatatgtgaccatatcattgttgattcttgatacttcatatccacctaaagccgtttaactaaatttcaggctcaataaaagcaaatcgacagctagcagttgccgaattcgaatggtttgccacagttgtggagagaacgtgctttgtcatatttgtagttgctttcctaataatcacatttggaatcaacttcattggtttcattcactggcatcaagctggtgttgaatatggaggatga

SEQ ID NO: 30183 - DNA, 694 bp, Caenorhabditis elegans
atgcttattattattcaaagcttgctattggctacaacaggtaaggattttgtaacaaaactgcaggcttcaaagcttgatgcctggtgaccatcatactacaaagaatagtgtttgaagagttccggattgttagtcatcatcactcatcagatgttaatttacaacaaacaaatatctttcttcttttttcttgaggacctagagaccctcttgcaacaacaaaatgtagtcgaagtagtactaaaagtggtggtactcctcaccatttcttttttcatttcctgaaaagtgtagttagagtgggaagaggggtcaaacgatgctaatcttagtgacaggaaaatgatgaattttcaattgaactaaaagcccaaaaccttttttctcctatccgtatttggttgattagagtgaaatgaacaagagcaagaaacagtcgtaaaaccagccatcagtttgattcaagatgacaacgaaaaagattcttttagcatcactatgcattgccgacactcctgtaccaacacagattcgacttgtacatgatctacttgacaactacgataaaaaggcaaagccaatgtgggataactccaagccaattaatgtgtcgttttcgatggatctctatcaaattttagagctcaatgaaccacaacaatatattttgctcaatgcttggattattgag

SEQ ID NO: 30184 - DNA, 674 bp, Caenorhabditis elegans
gctctcaagggaatttgtgatccacgacttcacattcttcaactctcactcggatccgatgaatcaattgcaaattttgctgaaaaagtgtctgaaattgttggagaatctggattaactcttcttataaataatgcagctgtgatgcttccatatgtaacaaaacaaaaacctgatcgaaaagttgttctggatttgtttgagtcaaatacaattggtccaatgatgcttacacaaagccttgtaccactcataatcaaagcttcgaaacgacaggaaggcgatacactttccgtttctcgtggtgcaatcattaatattgcatccgaatttcttggttcaatttctgaaaataccagtggttctggtgaatataaagcaatggcatatcgaatgacgaagtgtgcggtgaatcagtttacaaaaactctctcaattgatctaaaagatgatcatattttaacagctggaatttgtccaggaatggttcaaactgatatgagtaaagggaaaggacaacttactgtaagatcatgcttttgaatttcatagttataattgttccttttcagattgaggaatcttcctcacaaatattggcggcattcaacaaactaggagcaacacacaatggcggatatttccgaagagatctttcaattattccgtattaa

SEQ ID NO: 30185 - DNA, 297 bp, Caenorhabditis elegans
atctcgaagaaattctggcagtggtatcacaatatcctaatcagatgtaccgtccagttcgtattcgtaaaatttttgcgtccaaagcatgcagaaaatccgtaatgattggaaaaccattgaatcaacgtgaaatgacacaaattattcgtcatctggcgaagctagatcaaccatgggtaatattattttatatttttcacagtctaaaaactgcattttatttagaactgtccgcatggaagacccacaattcgtcacttggcatctttacctgatcgagccgaatttgaataa

SEQ ID NO: 30186 - DNA, 383 bp, Caenorhabditis elegans
aaaagacgatttttcaaaaatgaaaatcattggtcaattcaaccacggattcatcatttgccgcctacgtggtcatctattcatcgttgatcagcatgccagcgacgaaaaatataattttgaacgtcttcagagcagtgctaaactcactaaacagccacttttcatgtaaagcttaaagccctggtgaaatttgttcaatttaaattatttcaggccaactgcgcttggttttggagctgtacaagagttgatcattcgtgagaatttgcccattttccacgcaaatggtttcgatttcgaattcagcgaaaatgatggatgcattaaaacatttttgactgcaaggcccgagcttctaaatcaacaactcacgaatagtg

SEQ ID NO: 30187 - DNA, 579 bp, Caenorhabditis elegans
gcaagagctctacaatttcggagtgaaagtgagcattctagagcccggaatattccgtactccattgttagatgagcaagctatgctgaagagagttgatcatgtttggacacaaattgacgatgaaactagaactgaatacggagagacatttaaaaattattgtgagttttggaatacacatattagactttcaaaattggatgcaaatatacttaattaaaatatgtaaaaattgagattgttaaagggtgtccagggttttttaaaaataatatcccaaaaaattcagaaccaatcacctgatacataacaaaacatatttcagttgcaaaaatgtggaacaagacctacatctccatgagcacaacaaaaattcattacgtcgttgataactactatcatgctctgacagcaaaatatccacgtcatcggtattactgtggatgggatgcaatttttgtttacgttccattgtctcttctaccaacctggtgggctgattatgttatcagaagtcttggaaaacaagaggttgttccagcatgtcttgaggatagcatgaagaagaaaaactaa

SEQ ID NO: 30188 - DNA, 222 bp, Caenorhabditis elegans
atgtcgatgaaactacgagagtgagtgtatttcactgattatcatgtaaaaccaatgttttttagtatccttcctgctcctgtggcggcagacgaagcagcttcacagattcgacgagatccttggtttggtgggcgcgataacgaaccatccgccgcactcgtatcgaaggaaccaccgccgtacggaaaacggaccagttttcgaccaagagggcctgaa

SEQ ID NO: 30189 - DNA, 304 bp, Caenorhabditis elegans
tacaacgtgatcggcagctacccacaaccaggatctggaggtgaatatgatgttcaggtatatagagaaagatggggtactgtaactgaactcgttgatatttcaggatggatttggatggagcaacggagctatattggatcttctcttgacatataacgatcgattatttgttccagaaaactttgtcaacacaactgtcacaccttcggttgaatctactaccaaatctgctccaaaatatgctaagctaccatgggtactcgttttcgctttcatgattcgtcaactttttaattattaa

SEQ ID NO: 30190 - DNA, 369 bp, Caenorhabditis elegans
atgtctgactccatcatcacccgctccgaagttaacatgcactgtagcgaagatgactgttggattattgttggaaactatgtctacgacgtcacaaagttcgtcgatctccacccaggaggcccagaaattcttctcgaattcgtaagttactaaacaaacagtcatctgaacagtgtttaaaatgtttcttgctttcaggccggaggtgatgccaccgatgctttcgagtccgtcggacactcaatgtgtgcccgcatgatgctcacaaagttcaaaattggctctttaccagaggatgagcgtccagattttattcaagccgaatacatcactcatgcaaagatctctcttccaatggctcattaa

SEQ ID NO: 30191 - DNA, 651 bp, Caenorhabditis elegans
gttgaaatcgagagtggaaaaactcttgcaattcaattgctcgctgaaggaaaactaaacaagcgtggagaacgcgaagtcttctttgatctcaatggacaaatgagaagtatcttcgtggttgacaaggaagcttccaaggaaattgtaactcgcccaagagctctcccaggtgtccgtggacatattggagcaccaatgccaggagatgttttggagctgaaaatcaaggaaggcgacaaggtaatacaacgcatatctaaagatgtaataaatcaatcatgcatccgggatatgtattctgaatttctttgaaaaacaaaaaaagacaaatgggacgaattcagaagcggtgggccccacaacggaaattgtagggaaaaacggaaagagataaatttatagccttatgcctcccacgttttttcttcttgtcctacacaaaaatcacataaaaaaatgatggcataaaaaatgaatataggaattatttcttttcaggttaccaagaagcaacccctatttgtgctttccgccatgaaaatggagatggtcatcgactctccaattgctggaaccgtcaaggctatccatgcaccacaaggaaccaaatgtagtgccggagacttggtagttgaagttgaaccatga

SEQ ID NO: 30192 - DNA, 377 bp, Caenorhabditis elegans
gattcattgcatttatcggagaggagccagctggaatgaaccttttttactatgcatattcaacatgggttgggcaggtatttatgaaacagtactgaaattcaaccaaaaaatcatcatttcagtatcttcacatggaagatctctacattcgacctcagttccgacgaatgggactagcaagaactctgtggaagaagctggctgagttggctcgagacaaaggaattgttcgtctcgaatgggcagttctcgattggaacaaaaatgcgattgctctgtacgacactgttgattatgtaaatttgacaaagagcgaaggatggttcacttttcgaatggacggtgcggcgataaataaatttgctgatgaatag

SEQ ID NO: 30193 - DNA, 851 bp, Caenorhabditis elegans
gtcccggaacttgtacctggctggacacattccggaagctgtgcatgtggacctggacattgccacatatccatctcgttatcaaagattccaacaataccgcgcggatcttttcgaagaatatgctcaaatggttggattgaacaataaagaacatttcatcttttacggaaaaggagcatttggtggaatgctttttgcttcaaaggttgcttggattttcaaatcctatggccatgaaaacatttctcttgtcgatggaggatttgattcatggaaaagaaatggatttgaagtatctacagaactcgtaaaattgcctgcaggaaactttaaagctgaagataatttcaaaaaatatgtcatcacattccaagaactcgaagctaaaaaagacggcgaagataaacagtttatcgaaaaaacatcagaaattaactttctggacagcagaattcgtggtcaattcgatggaactcaagagaccggtcttgatccacatcttgtaaacggcactagaatcgctggtttcaaaaatctacctagtgcagagcttcttgtgaaaggcggaaatttgaaaagtgaagaagaaatcaagtcatgtaaaagataatgagttttccgataatctcaacttttctaatttagggctcactcaaaacggatatgttgaaaatcaaccgacaatcacatcctgtaatgctggaattcaagcagcacttttggcgtacgtaatcgatgctgtgaagccatcacagaatcctccccgcgtatataatggatccttaaaagagatggagcttcgagcaccgaagaaaatttcggagggaccacagcatttgcctcattaa

SEQ ID NO: 30194 - DNA, 874 bp, Caenorhabditis elegans
atgaccgtcgaacttccatccactcaacgtgctcttgtcttcgatacctggaatggaccacttgaagtccgacaagttccagtcccatctccagctgatgatgagattcttgtcaagattgaatactctggaatttgccattctgatcttcacgtatggctcggagatttgaaagatatgagcgtttgcccattggttggaggacacgaaggagctggaagtgttgttcaaataggaaagaatgttactggatggcaacttggagacaaagctggagtcaaggtttaaaactgttaaatttcatttccaatttcttaaatttaagctcatgaacttcaactgcctcaactgcgaattctgtaagaaaggccacgagccactctgccaccacatccagaactatgggttcgatcgttctggaactttccaggagtacctcactatacgtggagttgatgccgccaaaatcaacaaggataccaatctcgccgctgctgctccaattctctgtgcaggagtcacagtctacaaggccctgaaggagtcgaacgttgctccaggacaaatcattgtgcttactggagccggaggtggtctcggatctcttgctattcaatatgcctgtgctatgggaatgagagttgtcgcaatggatcacggaagcaaagaagctcattgcaaaggacttggagctgaatggttcgtcgatgcatttgaaactccagatattgtgtctcacattaccaaattgactgagggaggaccacatggagttatcaactttgctgttgcaagaaaaccaatggaacaagctgttgaatacgtcagaaagcgtggaaccgttgttttcgtcggtcttccaaaggattcaaag

SEQ ID NO: 30195 - DNA, 1074 bp, Caenorhabditis elegans
cttatcaacgcaaattgcctaaattgtgaatactgtaaaacaggacacgaaccgctttgtgatcatatccaaaactacggaatagaccgccatggaacctttcaagaatatctaactattcgggatattgatgccattaaagtttcgaatgacacaaatctcgcagcagctgctccagtattatgtggtggagtaactgcatataaatccctgaaagcaacaaatgtgaaaccaggccaaatagttgtactaacgggtgctggaggaggattaggatcttttggaattcaatacgcaaaagcaatgggaatgagagttgttgctgttgatcatattagcaaagaagatcactgcagaaatcttggagctgaatggttcgtcgatgcttttgataccccagacattgtggctcatattcgaaaattaacgaatggaggagcacatggtgttgttagttttgcagcagccaaaaagccaatggaatatgctttggaatatgtcagaaaaagagggaccgtggtgtttgttggtcttccaaaagatggaacggtaataatgattttcttagtcaaaactcggatcattcgtgagttctttcgaaaaattttaagaaatcggaaattgctggattctcaaatttgcggctatttctatataaattttgaaattaagaaccctagaacaatttgttattctggtattcagtcagtcattttctaaagaaaaagattcaaatgttgagatttcatacactttgttatcttgaaacaatatacatatgtacttttcttttcaaattttagactttctagtttccgagaatcatacatttttcatttttactttttccagattccccttgatacactttcactaatttgcaatgaaataactgtgaagggatcaattgttggatcacgcatggatgttgatgaagcaatcgattttattactcgtggaattgtgcatgttccaatagaacttgtaaaactcgaagatgttccaagtgtctatcaacgaatgaaagacgggaaggtcacttctcgtgttgttgtcgatttttcaatgcgatga

SEQ ID NO: 30196 - DNA, 598 bp, Caenorhabditis elegans
atgccgaaaaagttaatttattcaatatctatgaaatcaacagcttcatctccaaccccaagtgttagaacattacctgaagaacaggtagttgctgtttttttgttttataaattgttcatgactcatgaacatttggagatcattcattttcttaaagtagtcagctgacgtgctctcatacactctatgttatttctgtttatcattaaggtcggcaagcgtctctcccggttaggaaggctatgctgtcaaaacggaaagacgctgagctagtaaatatttgtttttccttatatgtaacaattttggttccgtaatattattctggaaagttttaaagatccgaaaaaaaactgagaacgtttagaaatatttaacagttcaattagcatcaagttcataatgattttttcaggttcgtgttccaacaagtggtgcaccaccagttcgcgcagatgccaatggaacagatcaagacgagttcaataatgagacactgtactttgaaagatcacgcattcggacactgcaggacgaacgtgtgcacattcagaagaagacgttcacaaaatggtgcaactcctttcttaatcgg

SEQ ID NO: 30197 - DNA, 1815 bp, Caenorhabditis elegans
aagaaacaagtttggaacaagggacttcgccttcgtcaagccgctgatcaaaaaggacttgatagaatccttgaagatgcacacgctaagctagatgagatgcaaactgctctgaactccaaagatcaagggcttgacttgcgatcggttaaagatttactccaaaagcacgctgtactcgagcaggaaatgggactttacggaaataaggtttgttgttaaaattagcttataaaactattgtttctttaattttcagctttctgatattgagaatcgtggaaagaagatggctgtagatgggcattacgatgctgatagaattcattcaacagttggtcaacttcttcaacgatatgctgcaatgaagggtccagcacagcggagaaagggagatcttgacgaatctcgtctttggcatcaactagtttttgatgttgactgcgaattacaatggattgctgagaagaagccaattgcttcatctcaagattgcggtcgcacgcttaccgaagctttgaacatggtcaagaagcaggagcaattagaggctgaagtcaaccaacatggcggacagattgataaagttcttctgcaagcgggtgaactgatcaagagacaccattctgcctcatcccaaatcaaagctaaaagctctgaacttgaaacagcttggagtgaattgaagaagcttctacgcttgagacgtgccgttgttgactggggagtgaaggaacaacagtacttatttgatgctgctgaagtcgaatcatggatgaacgagaagcgaaatgcattggcatcggaagattatggaaatgatgaagatgctgcacgtaaacttctgtcgaaacatcgagctctttgtgaagatatgactacttaccgtcaatggcttgagaagttggaagtaaagtgtgtcgaactcgttgaatcaaatcgtccacatgttgaacggttccagaagagacaagatgaactcgttcgtgaatttgatgctttgagcaagctagctgaagatcgtcgcaacgctttggaagatgccgtttgtctgtacgagtacatgagggaatctgctgacttgggtcaatccatcgaagaaaatttgcgagtagctatgagtgaggagtttgctgaggattatgaacacttgaaggagctgcaatcgaaattcgatgagttcaagcaaaaagtcaaaaatggaagtgaacgatttacatcttgtgagactgctgccaatgctattctccgacgcaatccacctttcgcaagagatgttgtcaagaagcaggaagcactcagaaccgcatggaacacactgtgtgaatacatcgaagcacgtgattcgaaacttgccgttgctgaagagcttcatcgattccaccgtgacgttgacgagtttgagcaatggatggcagacaaaatggccaacatgccacgtgacctcggtcgagatgtgaaacatgttcattctctatggcaacatcatgaagctttggataaagaaattcataattctcaaccacgattggcaaagctcgtcgaggaggctgaaagattgaagaaaacatacccaggtggaaacgcagaacagattggtggaagacaacagacgcttgagcaagaatgggaggagttgaaaaatgccacagatgacagaaaggatatgctgagagcagcatttgacttgcatactttcaatggaaaagttcgcgatttgcttgcatggactgatttgaccatcagtgatattcaatcagatcttcatatcaatgatctacaacaggctgaatggcttcagacagagcactcaag

SEQ ID NO: 30198 - DNA, 1085 bp, Caenorhabditis elegans
tcgcaaatggaaatgaagacaacccggctggcgcatacctgttccttcccgatggagaagctagagaactcaaaaaacaatcaagtgattggatattggtaaaaggagaagttgttcaaaaagtgtttgcaactccaaacaatgatctgaaaatattgcaaacgtacacactttatcaagggcttccatggattgatttggataatgaagttgatgtacgttccaaggagaatttcgagttggcactgagattcagttcttcagtaaatagtggtgatgagtttttcactgatctcaatggaatgcaaatgataaaaaggagacgacaaactaaattaccaacacaggccaatttctatcccatgtctgctggtgtttacattgaagacgatactaccagaatgtcaattcattcggcacaggctctcggagttagcagtctctcgtcgggacaaattgaaataatgcttgatcgacgacttagttcagatgacaacagaggtcttcagcaaggagttagagacaacaaacgaacagttgcacatttccgtattgttattgagccgatgtcttcatcgagtggtaataagaaggaagaacgagttggattccattcacatgttggtcatctcgctacgtggtctcttcattatcctcttgtcaaaatgattggagatgcaacaccaaaatctatttcttcgaaaaatgtggaacaagagctgaactgtgacctgcatctagtgacatttaggtgttaaaaaatctgaaatctacagtaaccctcatctttaatcattttcagaacactggcatcgccgacaacttacgaagccaacgaaagatctacggcagctgagaagaaagcagcgatggtgatgcatagagttgttccagactgtagatccaggcttaccctcccagacacgtcatgcttagctactggattagaaattgagccactcaaattgatctcgacactgaagtctgcgaaaaaaacgtcactaaccaatctttatgaaggaaacaaggctgaacaattccgactccaaccaaacgatatttccagtattcttgtatcattttaa

SEQ ID NO: 30199 - DNA, 1517 bp, Caenorhabditis elegans
atggagtcaatgaaaaagtggggaaacgggatgaatgtacgtgacttttttcaacttccttttcatttggataattaattttttgtttcaaaagttgtgacgaaagctcataatcctggtgggaaaatatgtgttttcgaaaatcagggaacatttaaatatattttattaatttaaacatgtaaccaatttttctgtttcaaacatttgatattctcgccgtgcattgagtaatacacttttgatcttataatgcctacgataaaaagtgtgttttactaaaaggaaaggtcatgtgaagaaataattattcctaagtaaacgaagaaattgtgagcactgccgacatttacactgaaatgaagtttattatcagaaacctaccgtaatccagccataattctgttgactgtgtttcgtgttgccgggaaactttttgacagattatagatcggaagtcgcgttttttgttcccaagttcggtttgcagaaactagaaaatttcactgaattccttttaatgaattggtatcacagatgaattccggttcagatgctctcctaaatcagttccgaattaccgatcaaatactgataagaagaaaaggaagggcagcacgtgagcactgagcactggtacgaagcttttcgacgtcaagaactagagaaaaccacagaatcggaagattgataagacattgtaaaatggtatataagggagacgtgcggtaaagaaggcagcttatcgctcaacttctttcaacaaatatggtaagtctttgatttctagttaggaaatttcaaataaaaattactttcgatttttaatttggcattcatcttgacatttcagaagttccttatccttaccgcgctctgcgcagtcacgcttgcctttgtcccaatcaatcatcaatcggctgttgagaccctcaccggtcaggctcttgttgattatgtcaactcagctcaatctttgttcaagactgagcatgttgagattaccgaggaggagatgaaattcaagcttatggatggaaagtacgctgctgcccactccgatgaaatccgtgccaccgaacaagaagttgttctcgcctctgtcccagccaccttcgattctcgtacccaatggtccgagtgcaagtccatcaagcttatccgtgaccaagccacctgtggatcctgctgggctttcggagcagctgagatgatctctgaccgtacctgcattgagaccaagggagcccaacaaccaatcatctctccagatgatcttctctcctgctgcggatcttcctgcggaaatggatgtgaaggaggatacccaattcaagctctcagatggtgggactcaaagggagttgttactggtggagactaccacggagctggatgcaaaccatacccaattgccccatgcacatctggaaactgcccagaatccaagactccatcttgctcaatgagctgccaatctggatattcaactgcctacgccaaggacaagcacttcg

SEQ ID NO: 30200 - DNA, 272 bp, Caenorhabditis elegans
atcaaatcaatcggagcagtgtctgctgaagacaatattcgcaatacggcagccatcactgagttttgtggaaaggaattgggtcttccaaaagataaggtaagtgtagtttatgtcaaacatttaagtcacaaatatttcgttatgttttattaatcaaacaatggattattgatatttcaaaatttcaggttgttatcacattccacgacttaccaccagctacggtagggttcaacggtacaactgtcgccgaagcaaataagaaataa

SEQ ID NO: 30201 - DNA, 1110 bp, Caenorhabditis elegans
gagggcatgagagtaggagtagaccgtaacaagtatcaaattcatcttccgttgcccgccaaaattgatccaaccgtcacaatgatgcaggttgaagaaaaaccagatgtaacatattcggatgtcggaggctgcaaggatcaaattgaaaagcttcgagaagttgtcgagactccacttcttcatcccgagcgttacgttaatctcggaatcgagccaccaaaaggagttttgctctacggtccaccaggaacaggaaagacgctttgcgctcgtgccgttgccaatcgaacagatgcttgcttcattcgtgttattggatcagagttggttcagaaatatgtcggagaaggagctcgaatggttcgtgagttgttcgaaatggctcgtaccaagaaggcatgtcttatcttctttgatgaaattgatgctgttggaggtgctcgttttgatgatggacaaggaggtgacaatgaagttcaacgtactatgctcgagttgattaaccaacttgacggattcgatccacgtggaaacatcaaggtttgtctttaattctttatggaaataacccaaaaaaatctgtaatataaatttatttatctcttgctttcttgaaggcagtttatatcattagttcagtcctttcatccaaaaaaaaagacacacatttttcgtttgataagtttccaaaaaattaatgcttacatgtattgtaaatatgagtgtttcattaaaataatttgatattttcaggtgcttatggcaacaaacagaccggacactctcgatcccgctctcatgagacctggtcgattggatcgtaaagtcgaattcgctcttccagaccttgcaggtcgtgctcacattctcaagattcatgcaaaacaaatgagcgttgaaagagatattcgttatgatttacttgctcgtctgtgcccaaacagtacaggagccgaaattcgctcagtctgcaccgaagctggaatgtttgcaattcgtgctagaagaaaggtggcaactgaaaaagatttccttgaagctatcaataaggttgtcaagggatatgccaaattcagcgccactccaagatatctgacacataattaa

SEQ ID NO: 30202 - DNA, 642 bp, Caenorhabditis elegans
catgattaaagtttccaaacaatcaaatcttacatacacagttgagttgaacaatggtcaagctcaacataaaatgggacatctcgcttgttttgtacctggaatgtttgctctacaagccatcaacgaggatactgaagaagagaaattaagaattatgacattggcggaagagttggcgaaaacctgccatgaaagctatattcgttccgagacccacattggacctgaaatgttctacttcaatgaacgtgacgaagcaaccagtaaacactcggaaaatggatatattcaaagaccagaagtcattgaaggatggttctatttatggagattaactggaaaaacaatgtatagagattgggtatgggatgctgttcaagctattgagaagtactgtagagttgatagtggatttactggtctacaaaatgtttataatcctaaagctgtaagtatctgaacttgtgggcttttctgaatatttctgaatttcagggccgtgaggacgtgatgcaatccttcttccttgccgagtttctgaagtatgcctatttgacgtttgcagacgaatcactgatttcactcgataaatgggtatttaataccgaagctcacccggttccagtcttaactaattag

SEQ ID NO: 30203 - DNA, 879 bp, Caenorhabditis elegans
atgatcaactccgaaagaagaatacttgcaactctgggatttgttgttcacgtgaagcatcctcatcgcctcattgttgcttatggtcacacactcggaatcacacaatctcgtccagacattctccaaaggtcctggaattacatgaacgatgggcttcgaactgacatcttcatgcgctacaagccagagaccattgcttgtgcctgtatttttttagcagccagaactgtcgagaatccaatcgcattaccttcaacaccgttccattggtttgaagccttcgacacatcagatcgagacgtggaggcaattgctcttcaactagtcgggctctacgcaagaagaacatttcctaactggccacgtatcaaagctgaattggacgcattaagaagtgtgaaagatgctgaaatgaaggctgtgaaagcaaaagaaattgctgaaaatttggcaaaaatggcaccagatggcgagaaaagtacctcaactgtcactatcggtaaagacagcaggaaggtttcaccagatagaaaaaacggaacaaaagatcgcggagaagcggatcgaggcaagaaagagaaggatcggcacagaaggagatcgaatgatcgagatggtagaggtgatcggcgtgatcgagacaaggatcgtggggataggcggaaggatgagaagaaagatcggaggaagagaaccagatcacgcagcagggatcgtaaggtatgctatgtgtttcttaatgagaaaaaagttgtagattagttattcttttgcatttggaataatacgtttttttttcaggataaaaataggaaccgcgacgttggcaaaagataccggaaggaaagcagcacaccgccaagatcccggcgataa

SEQ ID NO: 30204 - DNA, 452 bp, Caenorhabditis elegans
atgcctaattcttatcagcaatattcgagaaaacgccaaacttcaaaagttatcagtcgcttgaaacgaaaaaactataaaacccctggtaagcgcttgataaattggtcgactgtcgaatttcccaattctccagccaatcgaaaaatggtaaggcttaattttcctgaagtttaacttcagtttcaaaaacttttcaatttcagaaaactgcaattgctgctcttcttgtcggccttgtcgccgtcaacgcctacaatgttgaggttaagcacggagatgccattccagttgaagctcaaatgcttcgtggacaggaacttgttgattacgtcaacaaggttcagacttccttcaaggctgagctcggatcatacttcagctcttacccagataccattaagaagcaattgatgggagctaagatggtcgagatcccagaagagtacaga

SEQ ID NO: 30205 - DNA, 838 bp, Caenorhabditis elegans
ttcatgacgaaaaatgctggtaaacgactgggatgtgttgtgtcacaaggaggtgaagatgcgattcgagcacatccatttttccgtgaaattgattgggatgctttagaatcaagacaagttaaaccgccatttaagccaaaaattgtaagtaatgaaaaatgaaattggcgaaaactacagtacttctttaattgactactgtaagaagtggttgtgtcgatttacgagatcgattttctaaatgaattaaaataatttatttatcgatgtaatattaaaaattgaataaaatagagataataatacgaagaagcaaaggaaaagggaatatcgctgtcactattcaaaaatgaattcatttcgaagctcgagcccgtaaatcgacaaaagtgctacagtagtcatttaaataaatatacatattttggcttttcgatagattttttttaacaaaaaatcgaaaatttttgtttttttacgatatttcgaacaaaatttcgatatatataatatatcaaattttggtcattttgtttctttttagagaaacttaatttttttctgatttaacaaaatgtgatatttattattaattttcagaacattttttttccgatttacggttttccctgaaaaaaatcgaaaaaatttccgatgacaaacatctaaatcatattcgatttttcagaaatcaaaacgcgacgcgaacaactttgatagtgattttacgaaagaagagcctgtgctgacaccaagtgatcctgcagtcgttcgtgcaatcaatcaagacgagtttcgtggtttttcatttatcaatccgcattttacctactaa

SEQ ID NO: 30206 - DNA, 416 bp, Caenorhabditis elegans
atgacctccaagcgtcctggcgggagctcgtttcaaccagaagtgaagcgaaagcgtgaaagtgacgaattcgagcagtgttacgttgtaagtttttcatattatgatttcaagcttttaaaaattgcattttttatttttaatgatcactaaccatttattttcagtcaagattcgaaaatgaacttccatctgtaccaacgattgataaaacaggatgggccaggccagcagtcgataaagatctcggaattagcaaaagcattgcgtgtcagatcttagaggtcgaaacgtatcatgaagacggctctgcaacatcttacgacagaacaaatgtgaagttgtatggtgtaaccaaatctggaaattcgatttgtgtcattgtgactgactactttccacatttttatttccag

SEQ ID NO: 30207 - DNA, 681 bp, Caenorhabditis elegans
atgatcactcgaaaagcaatattctttttagcattagcgtcaattattcaagcatcagatgattccgaagctcccgataataaaaagtcttcaataagattcactccatcagttattgattcttatagagaaaaagttcaaaaaatgttctaccacgcctacaacggatatttggatcatgcatttccactagatgaactgaaaccaataacatgcgttggacaagacacctggggatcattctctctttcattaattgatgctctagatactcttctggtgatgggaaatacaaccgaattccgaagagcagtgtcacttgttcttgagaaagctcgtgatgatgctaatgtgaatgtttctgttttcgagacgaatatcagagttgttggcggattaatatctgcacatatgctagcgggaaggcataaaggtaatttaaatttcacaaggaatattactaaaccatcataagattcattccagatcttgtcgtagattgggaaggttatccatgtgatagtccgcttctcaaattagctgttaaaatggctgatcgacttatgcctgctttcaatacagaaactggaatgccctatggaactgttaacttgaaatatggagttcataaagatgaaacaccaattacttgtacagctggtgtgggcacatttcttattg

SEQ ID NO: 30208 - DNA, 382 bp, Caenorhabditis elegans
atgaaccctgttaagcatcggttccgctatattgtcgtctttcttggtttggcatgtcttacttcaattctttcaaattatattattattaatttcacatttatctgtatgaaagatgatcctactggaattgaaactactgaaaatggggtgggtgaaatatttaaattattgttcatttatgaaaattaagtttttcagacaatttacaacaggtatgactattcagttgctgagaaaagtgcaatagtttgggctgtggcaattggtacaatacttggaacaggtccaattaactactcctatgttagatttggagctcgtattccgttttttattgctggaattgtatcagcttttgcaacagtgctaactccatatg

SEQ ID NO: 30209 - DNA, 261 bp, Caenorhabditis elegans
gagtttggcaattacagttcagcactctatgcttatgatgtgtttcatcttggcaaacttggtcaagctattgttgctaaacactattggcaaaatcttttcgagccggttggcgaaaagacaaaacgagctgaattgggaaatattactccggaaatatttggattatcttcggtgagtatcttcaaataaaaatgtttctgaatcttaaattttcagggcaattcacttataaagacgctgggaaacagcaagaaatga

SEQ ID NO: 30210 - DNA, 266 bp, Caenorhabditis elegans
gagcatggaaagtacaacccgacattttatgcttcagatctatttcatttgagcaaatttggacatgctgtactcgcgaaacactactggctgaatctatttgaaccagttggagaaaagacaaaacgagcagatttaggagatacgaaaccaaaaatatacgaactaaatgaggtttataaaatttatttcagactcgtttttgttcattttatttttttcagaagaactgtcttatcaaaacagtcggaaatagcaagatgtga

SEQ ID NO: 30211 - DNA, 402 bp, Caenorhabditis elegans
atgtacgccgatttcattgcaggatgggccgcaggtttgtttattttttgttgagaaattctgtaccatccaaatgggaagtttcaaaaattcgaactgattaccacattataaatttaaaattttctagaacaattatattttctactttcaataacggccaaagttatagcttcatataaaaataaagtttttgaacgattaagatttttatatgacttaaaaatttcaattttaaaaaagcatttaaatataaatgcacgatatctttttactgtgattccaggtggagctggtctcctagttggacatcctttggatactgttaaagctcgcttgcagacaatgaatatttataaaggaattgtagattgtatggtaaaaactatgaaacaagaatct

SEQ ID NO: 30212 - DNA, 366 bp, Caenorhabditis elegans
atgagattgctccttcctttactattctgtgttggagcattctgtttagacaatggtctgggaaggactccaccgatgggatggatgtcatggaccgcattttattgtgaaatcgattgtgtgaaacatccgacaggttgtatcaatgagcaattgtacaaggatatggcagatcagcttggtatgtaacaatttgtttaaatttcaaatttataaaatggtttagtgtccggcggatatgataaagttggttataagtcagtgcatattgatgactgttggtcggaaatggaaagagattctcatggaatattggttgcaaataaaacacgattccccagtggaatgaaggctttggctaaatat

SEQ ID NO: 30213 - DNA, 260 bp, Caenorhabditis elegans
atgacaaaacaacgtagttactgtaagggaaatcctgagaaaagcaaaatacaaataattttaattttatttaaaatttaaaaatatttcaccacagaataagtaccttcttctgatctatgatctagatctaaaatccatataacttctaaacatttcagcaataactcaacgacaaaaccaacatcgattctatcgacccggtcatggcgtgtttggacacctgcctgaccctccgaagcgcgtttttgagaaccaag

SEQ ID NO: 30214 - DNA, 4652 bp, Caenorhabditis elegans
atgtaacaagacccttgacgcaaaggagattgagcgtaagcatttcatcggagtgcttgatatcgctggattcgaaatcttcgacttgaactcttttgaacagctctggatcaactttgtcaacgaacgtcttcaacaattcttcaaccatcacatgttcgttcttgaacaagaagaatacaagcgtgaaggaattgcctggaccttcatcgatttcggacttgatcttcaagcctgtattgagcttattgagaaaccactcggtatcatctctattcttgatgaggagtgtatcgttccaaaggccactgatatgacctatgctcagaagcttcttgatcaacatcttggaaaacatccaaacttccagaagccaaagccaccaaagggaaagcagggagatgctcacttcgctattgttcactacgctggaactgtccgttacaacgccaccaacttcctcgagaagaacaaggatcctctcaacgacaccgctgtcgctcttctcaagcactctaccgacaactccttgatgttggatatctggcaagactaccagactcaagaagaggctgccgaggctgctaaagccggacagactgcaggaggaaagcgtggaaaatcatcttcattcgctaccgtctctatgatctacagagagtctctcaacaacttgatgaacatgctttatcaaactcacccacatttcatccgttgtatcattccaaacgagaagaaggcttctggagttattgactctgcgcttgttcttaaccagcttacatgcaacggagtgttggaaggaatcagaatttgccgtaagggattccccaacagaatgctctatccagatttcaagcatcgttacgctatccttgccgctgatgccgctaaggaatctgatccaaagaaggcttccgtcggaatccttgacaagatctctgttgatggaaacttgaccgatgaagagttcaaggttggagagaccaagatcttcttcaaggccggagttcttgctaagcttgaggacttgcgtgacgagattctttctagaatcgttaccatgttccaatcccgcattcgttcttaccttgccaaggccgaagttcgtcgtcgttacgaacaacaaactggattgcttgttgttcaacgcaatgttcgtgcttggtgcacactcagaacctgggaatggttcaagcttttcggaaaggtcaagccaatgctcaaggccggtaaggaacaagaagcaatgggagagcttgccgtaaagatccaaaagctcgaagaagcagttcaacgcggagaaattgctcgttcccaattggaatcccaagttgccgatttggttgaagagaagaacgcattgttcttgagccttgaaactgaaaaggctaatcttgccgatgctgaagaaagaaacgagaagctcaaccaactcaaggctacccttgagagcaagctgtccgatatcactggacaacttgaagacatgcaagaacgtaacgaggatcttgctcgccaaaagaagaagactgatcaagaactttctgataccaagaagcatgttcaagatttggagctttctttgagaaaggctgagcaggagaagcagagccgtgatcataacatccgctcccttcaagatgagatggctaatcaagatgaagctgtcgcaaagcttaacaaggagaagaagcatcaagaagaatccaaccgcaaattgaacgaagatcttcaatctgaagaagacaaggttaaccatcttgagaagatccgcaacaagctcgagcaacaaatggatgagctcgaggaaaatattgaccgcgagaagagatctcgtggtgatattgaaaaggcaaagagaaaggtcgagggagacttgaaggttgcgcaagagaacatcgatgagattaccaagcagaagcatgacgttgaaactactttgaagagaaaggaagaagatcttcaccacaccaatgctaagctcgctgagaacaactctatcattgctaagcttcaacggcttatcaaggagctcactgctagaaatgccgaactcgaagaagaacttgaagccgagagaaactctcgccagaaatctgatagatcccgtagcgaggctgaacgcgagttggaagaactcaccgaaagattggagcaacaaggaggagccactgctgcgcaacttgaagccaacaagaaacgtgaagctgaaattgccaagcttcgccgtgagaaggaagaagattcgttgaaccacgaaactgccatttcttccctccgtaagcgtcatggagattccgttgccgaacttacggaacagcttgagactctgcaaaagctcaaagccaagtcagaagctgagaaatctaagcttcaacgtgatcttgaggaatcccaacatgccactgacagcgaagttcgctctcgccaagatctcgagaaagccttgaagaccattgaagttcaatactctgagctccaaactaaggccgatgagcaatcgagacaacttcaagactttgctgctctcaagaaccgtcttaacaacgagaatagtgatttgaaccgctctctcgaagaaatggacaatcaattgaactctcttcaccgcttgaaatcaactcttcaatcccaactcgatgagactcgtcgcaactatgatgaagaaagccgtgaacgtcaagctcttgctgccacagccaagaatttggaacacgagaacactattctccgcgagcatcttgacgaagaagctgaatcaaaggctgatttgactcgccaaatcagcaagctcaatgctgaaattcaacaatggaaggctcgtttcgactctgagggactcaacaagcttgaggagattgaagctgccaagaaggctcttcaacttaaggttcaagaattgactgataccaatgaaggtctctttgccaagattgcttctcaagagaaggtccgtttcaagttgatgcaagacttggatgatgctcaatctgatgttgagaaggccgctgcccaggttgctttctatgagaaacaccgtcgtcaatttgagagcatcattgccgagtggaagaagaaaaccgacgatcttagctctgaacttgatgctgctcaacgtgacaaccgtcaactttctactgatctcttcaaggctaaaactgctaatgatgagctcgccgagtatctcgatagcactcgtcgtgagaacaagtcccttgctcaagaagttaaagatcttactgatcaacttggagaaggaggaagatccgttgctgaacttcaaaagatcgtcagaaaacttgaagtcgagaaggaggagctccagaaggctcttgacgaggccgaagccgctcttgaagctgaggaggcaaaggtcttgagagctcaaattgaagtctcccagatccgttctgaaatcgaaaaacgcatccaagaaaaggaagaagagtttgaaaacacccgcagaaaccaccagagagctttggaaagcatgcaagctactctcgaagccgaaaccaagcaaaaggaagaagctctcagaatcaagaagaagctcgaaagcgatatcaacgatcttgagattgctttggaccatgccaaccgtgcctacgctgatgctcagaagaccatcaagaagtacatggaaactgtccaagaacttcaattccaaatcgaagaggaacaacgccagaaggacgagatccgcgagcaattccttgcttcagaaaagagaaacgcaattcttcaatccgaaaaggacgagttggctcaacaagccgaggccgctgagagagcccgtcgcaacgctgaagctgagtgcattgaacttcgtgagcagaataatgatcttaatgctcacgtgtctgctctcaccggacaacgtcgcaagttggaaggagaactccttgccgctcacgctgaactcgaagagattgccaacgagctcaagaacgccgttgaacaaggacaaaaggcttcagccgatgctgcccgtcttgccgaagagctccgtcaagaacaagagcactccatgcacattgaaagaatccgcaagggacttgaacttcaaatcaaggaaatgcagatcagacttgatgatgctgaaaatgcggcattgaagggaggaaagaagatcattgctcaattggaagccagaattcgtgcaattgaacaagaattggatggagaacagagacgtcatcaagacaccgagaagaactggagaaaggctgaaagacgtgtcaaggaggttgaattccaagttgtcgaggagaagaagaatgaagaaagactgacggaattggttgacaagcttcaatgcaaacttaagatcttcaagagacaggttgaggaggctgtgagttttattaatattttttctcaaaaagcaattctgctgaaaacgtatttcaatttcaatattaatattacaggaggaagttgccgccagcaacttgaacaagtacaaggttctcactgctcaatttgaacaagctgaagagagagccgatattgctgaaaatgccctgtcaaagatgcgtaacaagattcgtgcatcagcttccatggctccaccagatggtttcccaatggttccatcagcatccagtgcgcttatcagaagttcatcaaatgcccgattcctttaa

SEQ ID NO: 30215 - DNA, 414 bp, Caenorhabditis elegans
atgaaagaaattattaacgttcaagttggacaatgtggaaaccagattggagccaaattctgggaatacatatcggaagagcacggtcttcaaactgacgggacatacaaaggagataatggttcccagcttgaacgtataacttcctattataaggagatggaaggtgagggaattaagaaaatcgttgttccttctacttctgttttgaacatatttaaggtcgaaagtatgttcctcgtgcgattttggtagatcttgatcccgaatccatcaattatgtccgttctacacaatatggaaagctgtttgatccggaaaatgcggtcagtggagaaagtggagctggaaataattggtcaaggggatattacgagcagggagctgaaatcgttgataaggttcttagcgtaa

SEQ ID NO: 30216 - DNA, 862 bp, Caenorhabditis elegans
tccgccgagaagcagaagctgctgacagtctggaaggatttcaacttattcactcattgggtggaggtactggatctggattaggatctctactcatctcaaagctccgagaagagtattctgataaaaccctgagcacgtgctcaatcattccatctgctaaagtttcggatacggttgtcgagccatataatgcaattctctccatgccccatctcatggataattgtgacgagaacttctgcatcgataatgaagcaatcttcgacatctgtcaatacaatctcaaacttgaaaatcgcgtaacatacggtgatttgaatcatcttggtaagactggagagctgaggttttattagttaatttcagaatcattctgtacaacttactgtttcagcgtctcttgcattatctggaataacaactttccaaagattcaaaggaaatctgaaaacggatattcgcaagctcaacactgcaggttcacctcgccttcatttcttcatgacttcattcgctccagtatatggaaaaggaattatagattgtcaggcattcagtatttctgatcttacccaacaagttctcgatgccaagaatataatgacttgtaaccataatcagggaaaattcttgtcttctgctattatttaccgtggtcaacagactgagaagaaggatgctgaacaaatcatcagtgtggaaaatgaagatccatctgaaatgattgagtctttaccaaagagcacaaataccgatgtctgtgatattccatcgagaggactcaagacatctgctactttcattgcaaactccactgcaatccaggaaccactcaaacgtatttctaagcagtttgcag

SEQ ID NO: 30217 - DNA, 473 bp, Caenorhabditis elegans
atgcactggctcattatattttttctacttggaaaatgtgacggattattcatgcaggttatttctacatataatattttcaaacattcaggtccagctagaaaaataagtcgttcaaacttttccaattctaattgtctcatgttatttaatttaaaatacttctgaacaaaaataatactttaggaaaatgcatccatagcaataattggtgctggatttgctgggctccgagcagctcaacggtttgaagagctcggaattgtatatacaatatttgagggatcggatagaattggaggaagagtttattcgtttccttatcaaaatggatacttgcaatttggagctgaatatattaatggagaggataatgatatttatgaaattgttgaacggaaaaatttgctctcaacatctgaaactgacaaagatgaatttgaaaccatggtttatggaaaaccagttcatga

SEQ ID NO: 30218 - DNA, 1646 bp, Caenorhabditis elegans
atggtcgactactaccaacagccgccatcataccatcagccgggctacgactacactcaacaagaggaagaatgggaccgtgaaggactgttagatccagcatgggagaaacaacagaaaaaggttagctttttcaaaaaatttataaaatttataaaatatgaaattgtagtttctgcacgatgaaatattttaaaaaatgcagagatcataattgaaagttttttgttgcattattactctacttttgtattaaaacttgagaacaatgcggctagtaaaataattcgaaaatacagttcagtattgcataatcaacagatcccctggaaaaatatgtagtttcggaatggaatacttaaattctgactgaaaagaaatatcaagcactaaaaatcttatatactcaggagacataggttcagctttgacccaaaacatatttattttaattttttagcttggatctgtttagtcaaaatatatttattttaagatcaaaagcatgtttcatcggttattgaatgagcacatactaaaccattgttcattaggtgttcccttgttcatcatttctatctctcccactcacttttcaaccatcgttccattcaacttgatttactcgaaatatatgtggtgataaatgaggatgctccactcattctcaacacacattctctcgtttttgctcaaaagcatgtgttgattccgcctgttacacctcttcagtaagagagaatccctactatctttttcttttttttttcttctttggcatccttggatgtggtggacaaaaaaccgcgagagataaggataacaggttggaaaatgagaatttagagtcagatggaagagggcaccccttgccccctgagaggttcataatagagtgggaggatttgggggagaaaatggaagggaaacaaggtgagcaagtgacgattctcaaaagttgtaatttgagcttagagaggcttgagctcaaagagttaaggaaacaaaacaaaaaacaaaaaaataaagatgccattgacaccttccagtttgtaacattgacagaaaacaaaaagtacaatcggcaggggaacgggaaagcgaaatttgatatattttgaaatttcctaaccggatatttatgtataataaattccattttactgaagaatttatttttaaagaacagtcgactttaaaagtatttgttttaatatcatctatgcatactatgaaaacagattttcaaaaaaagttaatttctattactgaaattttcagttaccgtatctcctttacttttcaaattttatatacatttcagacattcacagcctggtgcaactcccatcttcgcaaagccggaacctcaatcgacacaattgaagaagatttccgtaatgggctcaaacttatgcttcttctcgaagttatctctggagaaccacttccaaaaccagatcgaggaaagatgcgtttccataaaattgccaacgtgaataaagctctcgagtacatcgaatcgaagggtgtcaagttggtctccattggagctgaggaaattgtcgatggaaatgttaaaatgactcttggtctgatttggaccatcattttgagatttgccatccaggatattaacgttgaag

SEQ ID NO: 30219 - DNA, 1646 bp, Caenorhabditis elegans; identical to SEQ ID NO: 30218

SEQ ID NO: 30220 - DNA, 488 bp, Caenorhabditis elegans
atgagaccacttgctcttttaatttgcattattgttctgttcttggtgacagaagctcgatataatcctagaaaaggtctggcagcaggacggcaaaggaaacacaagtatcaagatgaaggagaagctttcgttgtgttggtagctggatcaaatggatggtataattacagacatcaagctgatgtggcacatgcgtatcacacacttagaaatcatggaattccagaggaaaatattattacaatgatgtatgatgatgtggcgaataatccattgtaagtgtgctctatggagattttgattaattggattttgcttagaaatccatacaaagggaagctgtttaatcgtccacatggaaaagacctctacaaaggtctgaaaattgattacaaaggtgcttcagtgacaccggaaaactttttgaatgttcttaaaggaaatgccagcggaattgatggtggaaacggaagagttcttgaaac

SEQ ID NO: 30221 - DNA, 499 bp, Caenorhabditis elegans
acggtgcggttggaatgatttcattcccagatggcattttgactgtaaagcaactgaatgatgttcttgtttggatgcacaagaataagaagtactcacagttgactttttatcttgaagcctgtgaatctggaagcatgtttgaagaggtactccgatcggatatggatagtaagtttcagagaattctccaatattatagtattatcgaattatagtttatgcaatttctgctgcaaatagccatgaaagttcatggggaacattctgtgagaacgacatgaatcttccgtgccttggagatctttttagtgttaactggatgactgatagtgacggagaagatttgaagacagaaactcttgaattccaatacgagctagttaaaaaagagacaaacctttcccatgtgatgcagtttggtgataaggatattgcgaaagaggcagtagccttgttccaaggagataaggaagatagagagtatgtcgaagatttt

SEQ ID NO: 30222 - DNA, 559 bp, Caenorhabditis elegans
gcaatccgagcagaaagaatggcgatcccatcaaatcttatgcaattttctgaagatatcatcaagcaactgacacctgaagaaatcgacgagttccgtgaggcattcatgatgtttgacaaagacggtaatggaacaatttcgacgaaagaattgggtattgcaatgagaagtcttggacagaacccgacggaacaagagattttggaaatgatcaatgaagtggatatcgatggaaacggacagattgagttcccagagttctgtgtaatgatgaagagaatgatgaaagaaacagattcagaaatgattagagaagcatttcgagtatttgataaagatggaaatggtgttatcacggcacaagaatttcgatattttatggtaagttaaaatctaaaaccacgtcccagtaattgtttaatttcccatgtttcaggttcatatgggaatgcagttctccgaagaagaagttgatgaaatgattaaagaagttgatgtggatggagacggggaaattgattacgaagagttcgtaaagatgatgtctaatcaataa

SEQ ID NO: 30223 - DNA, 430 bp, Caenorhabditis elegans
atgacaaattcagttttctactcgggtttataattagttttcacctggttctttgatttactggcattttacgaaaacatatataccagtgaagccataaacaattcaacgaatttggagaaatcatgctaatctgttccgacgctctatgcttttttcagttgataaggtcatactgatatacattttagaaaaagaagattattaaattggagaaagatatttttatgtacaaaagaaggatcaaagattagcccattctttcactctcaatattgattttattttcagctgaagcttcactcggatcgtggcgatggtaactctcctcatggaattgcagaccccttactatctcaacatttgctcgaaggatactctgaagaagaactccaggagtatcgtcaagtcttcaacatgtttgatgcag

SEQ ID NO: 30224 - DNA, 420 bp, Caenorhabditis elegans
atgaatccgttttcggatgttatgcggaaagctctctgttcttcaccacaatcaccatcttccaattctactggacttgttccgtttggaagtccaaaattctatgtcttgtgcggaatgggtggatcaatttgctgtggatttactcatcttgttatcactccactagatattgttaagtgtagaatgcaagttgatcctttgaagtacactggagttgttcaaggattcaaagttgccgtagcagaagatggtgttagaggttggtaatatatacacagtaatttgtaaattctgaattgatttttaggcttggcacgtgcttgggctccaactacaatcggatactcagcacaaggttttggaaaatttggttactatgagattttcaaaaacgtctatggaagcatgctcagcgag

SEQ ID NO: 30225 - DNA, 240 bp, Caenorhabditis elegans
atgttcaccactttgaaaagtcgccaggacacgcagacttctgcaatgagagtggttttaaattctgcaaaacattatctagtagcggtaattccatacatttttttctctttttgaaatcaatttttagcttcgaaatatgacactcgaagtgaatatcttgaagaagtggaaaactgataaaatggccagagacatgaggagacggggattattggtgaaaatgacacgtcaaatcat

SEQ ID NO: 30226 - DNA, 1029 bp, Caenorhabditis elegans
gttaaaattgtcgaaatgcaaatagcgtatgaccatgaatgcgagaacgatcatctgattattggtgagggacgacaggcagatgtcaacacaattcataaatattgccacaaaatggacggagaacaggaacagaaactggaggatcgtttcaaaattatcaaaagtcatggaagatatcttactctaatatgggttactaacatgaagtatgaagaagctggatggaagattcagtacgaatttttaaacgaaaatgaggaatgcggatatcatacatctggaatgtccggaacaatttacactccaatgtttggggataaagattatgaaaatgatttggaatgcgtttgggatattcaagtgccactgggatatcacattaatttgaagttcaaagattttgatgtagaaacggctgagaactgcgcaaaggtaagataagacactggtgaaacgggaatggcgagagcctgtgactcaaaacttcacagacggctgaaatttttggcccgtctccatttatttttgttaagaatagttcaatttctttcatctgcagtaaggtcgcttttgagtaatccgaccttacctgtgtacacagttcccgtttggttcctaacaataaaaatcatgaggaaaattaattttttcaggaccagcttctgatttcccaagagcactcaactcgtgccaattcaccaaacggagactactatttccttttccaagatgaagaaaaagaaacaccactttgtggaattgagcacccgaaagattttgaatccgaatcaaatcgagttcgtctcaactttacaacagactctcagactacagcaaggggatttagagttaattgggaagctgaatgtggagcaatttatcgactaaaccatggtgttataacatctccatattatccaaatggataccctaatgacatcacttgcacatatctcattgcccctcctgatcaaaattccgttattgcaatcaaatttgcagactttgatttagctacgatgagaa

SEQ ID NO: 30227 - DNA, 251 bp, Caenorhabditis elegans
gtccacaggaatgtgatagcgcacttgactacattcgaaagcgattcatttcattgaataaaaacaaaaaacgctcaatttatgaacatgtgacttgtgccacagacactgaacagattcaggtgagtcatatttttttcttttttcttttgaagacattgaaataaaataaaatattgtttcaggtggttattgattcggtcattgatgttgtgattcagcacacaatgcaaaaagttggaattcaatga

SEQ ID NO: 30228 - DNA, 228 bp, Caenorhabditis elegans
gtcctcgagaacgtgattgtgcacttgagtacattcgagttcaatttatttctctcaataataacaaaaatcggaaaatatatcagcatgtcacaagtgccacggatacagctagaattcaagtgagttatcaagtttaaatataaattggagaatctttttcaggttgtcattgatatgttgttcgatataatcatatctgcaagtttgaaaatggtgggagtttag

SEQ ID NO: 30229 - DNA, 332 bp, Caenorhabditis elegans
gtgcatcaaaagctgctcttgatatggtcacaagatgtcttgcaaatgaattgggatcccagaatattcgagttaatagtgtcaatccaactgttgtgatgactgatatgggaagagatgtaataattttcaaattgaaaagagagcataattagactttttagaactggagtgatcctgataagaagaagaagatgctcgacagaatgccgatcaaacgttttgctgaggttgacgaagttgtgaatgctgtccttttccttctttcagacaatgcttcaatgactactggatccactttgcctgtcgatggaggattttcgaataactaa

SEQ ID NO: 30230 - DNA, 393 bp, Caenorhabditis elegans
atgaagacgtttattgcattgttagctctcttgactgtggtctctgcagaagtccaccaatttaatattgggtaagttttactgattaattgagctcaattttccattattagataccgaccaaacatgcgtcaacgtatgaatgccaaaggaaaattggcagaatatgaaaaggaacgcaacgaacttctgtcaaagaagagccttcaattggcatcatcctcgtccccagttattgattatgaggatatggcatacatggttcaaattagtttaggaagcccagctcagaactttgttctttttatcgattctggttcttctaacttgtgggtcccagatatcacatgtgctggaggaaaagatgccacttgtggaagttactgtaaatct

SEQ ID NO: 30231 - DNA, 399 bp, Caenorhabditis elegans
gtggtgatcaagatgatgcaatagactttatggaaaatcttgcatgcgaagctcttggtaaacgtgacaggtccctataccgtgtctatcgatgtattgcaattgacacacaaatgatggccgaattgttatcaactgtgtttaaagatattgcaaaaagaaagaaataactactgtttgtataatatttaatttatatttttaattgaaatccaatcaattcatcacatgtaattttatttaattcccacacttgtcaacacttatgttgtcacccaataaacgaaaggaaaacgttgcaaaaaagtgaaagagaaagatttattctttggtttttcacagtgtttcttgaaaaaagaaagacgattgattagatatgctaataacataccggtctaa

SEQ ID NO: 30232 - DNA, 658 bp, Caenorhabditis elegans
gatccgcagaaagcggaaaaacaaccgttttggagcaagtccggttgctctataaacaacatttcacagagtctgaatattttcatcgacgtgcattcatctatcacaatattttcaaaagtatcaaagcgttatgtcgtgccatgagaatgtccgatattcaatttgcagacccaatcaatatggtattattattttaaaaagaatttggaattaaatttatattcagtattattctactttgacagatcatatctcagttggattttgttttaacaaaaaattgtgaactgacataatacctgaaaaatatttttctacattttcacagtaatttttttgtggataagacttaaaacaaccaagatatgagccgttaaagtaaaacaaaggagggcgcaaatataataggaaaaatacggtacatcgaagctttttttttcgtaaattggtaaataagttggtcttcgtgaccgtttatcaatttctaaaaatgagggaacttgaactataatattgaaacctaaaagaaattacgaaaaactcatctatatatttgcagggtcgtgctcaatccataatagctgatgaacatggtcattatggtttattctcaaaagatttggctgaaaagataaaacacatttggaatgacaaa

SEQ ID NO: 30233 - DNA, 1129 bp, Caenorhabditis elegans
agactcgactggtcagccactctattacactgtccagctggtgaacctgttccgtgcgaatcctggggagagatgggtcactgaagaaggaattcaaattgatcagattcacaagattgaagcagacaaatgtaaaaaagctgaagctggcgacaagatttatcagcaatatgttttgagattagaagataacacacttgtggactcatcttattcaagaaatgctccgtttgtatttagattgagaaacagagtaagttttttcagttattaaaaaaccaaccgcatataggtaaatgaaatttaatgagaaaaaaaatcatcacagattttttttgacactcaatttaataaaataaaatttctctcccggccactttttgcccaatttaccaaaccttggacgaaagtttgtttgaagttgggccagattttggatttgtattttgagttagagtattcgaagttttgtcagattttggcaaaaattggtttaaacatttttaaaactttggtttactctttgagtacctattagaagttgatgtatgtaatatatggtgtatgtaaatcccgagaatgtacgttttcatttttaatctcataactgtctgatgaaaatgtggtttgagctaggtgttatgtggtttataaaaattaaagaaactggttgttacattggttaatgaaatcttatttcacctgtcatgtgaaatttacaatttttttacgtagggagcaaattacaaaacccaatgaaaattatgcttaattctttgtttgaatttttttattaatattattcttgtttatttgatcttcaaaattgaaatattctgatgatctagaaaaaaaaacatgaaaatatatatatcatgaaattttggcgcaatattatatgatcggaaaaattttttgtggcaaagtacataatacaatataattttaggaagttatcgatggaatggatattgcaatggatggaatgtgtgaaggagaacgacgtcgtgttgtgattccatctgaatatggatacggatcccaaggatccccaccagagattcccggtggtgctcgtcttttcttcgaaattgttctagaaaagcttgttaaaagagatgaactttag

SEQ ID NO: 30234 - DNA, 556 bp, Caenorhabditis elegans
cttgagcttcatctctatttgcctcaaaaagctcacagagagctatgcaaaaaacacaacatcctcataacagcctatgcgacgttaggctctcctggaagaatgtctgtcgttggttcaaatggtagacctttgtttgaaagcactcaaaattctgaaaatgaaatgaacgacaaacatgtgaaggcgctcgcacagaaatacagtaaaactccagctcaggtaaattttcaaataatctgtttacaattttgtgccggattattttcagattcttctccgggctacagttgaaatgggaattatagttattccaaaaactacgaatcctgaaagaatgaaagaaaacatcaacatttttgatttcaacatttcaaatgctgaagtaaatctcctagaagcgcacgagagaacaaaacaggaaagacttttctggtggccaaagtatttttttttaagcaacaaaaatgatactgaacactatttttcagcgttgctgatcatcctgaagatccattcgcgacacagagataacaaatgtccaaaagaaatataa

SEQ ID NO: 30235 - DNA, 236 bp, Caenorhabditis elegans
atggcctccgcctacacttatggctcattccctcaggttttgcgcttatttttatccgaattgtattgttaaaatttaaccatgttacagatgggacatcccccgccaaaagagacaaagaaaggatgccaagtgaaatcattcgtacttcctgtattctgtactttgctcggagttttgataacagcatttatcacatggcacattacaaagtcacagtattcaagaaacgatcc

SEQ ID NO: 30236 - DNA, 900 bp, Caenorhabditis elegans
atgaaacacaaaaaaatgttgatattactatttctatatctgttgatagaaacaacgacagcaaaccctgcattctacccgtatggacaaccggctggagataatgtgagtttttatccaattaccctaggaaaagtacagaagtttagtgagatagtataaaaacgtttttttttcaattctgaaatttatttgtttatggaatcatgcttttttattaacatggttcaaacaactacctgtttttttttattagccaaaaacatatgaaagtgctcttgacacctcacaaattatcccactttcaaaaatgaagctcttgtcccagtctggttaaaactggttaagacaacggttaaaatatttttctttgggcaaaactaagaaaaaaagtttttaaaacttcgcctgtatacctaaatttgtccactctagtcattcattttcaaaaatggaaaaatgtgatacatcagttccctcacagttagatacaatttttaaaacccattttctaaacctgttaactctattcagagacttgactattctatggaacaaagtgcaattgctcttaaaatcccactgacatatatggaacagtccgttgatgagctctttctctcacacaatggaattgtcggtcttggaaaaccgacgccggagaagattggaggcctaatgacaatctctacacctgccatagcagttttctacgtgccggttacaagtggagtaattgattatagagttagctctgatgatcagggactgttgacaaaactgacgcaagatgtgaaacaagtttttgcggatgctgttgagttccatggattgcaagcagtaatcatcacgtggacacaaattgagaatgctgagaaagatgggcctgctagtttccag

SEQ ID NO: 30237 - DNA, 456 bp, Caenorhabditis elegans
atgcctagcaactgccgccgttttgaaggaaaggttgcaattgtgactgcagcgactaaagggtgagacaatgatttttggaaaattactaagttgttcgaagaaatccttggtaaagtttttccagtaatttttttaaaccaattattatttcaaatatatcttcgcaattgtttttgtttcatttgaaaatcaatacatgtttctaaagtgtttataaaaattgtccctattttttataaaagctttgaaataataaattgaataacttataggattggacttgcaattgctgaaagactactggatgaaggagcatccgttgttattggaagcagaaatcagaagaatgttgatgaagcaattgagtatttaaagaacaaaggattgacgaaagttgccggaattgctggccatattgcaagcactgatgatcagaagaaacttgttgatttt

SEQ ID NO: 30238 - DNA, 180 bp, Caenorhabditis elegans
ctttgggatggtggtgaagacgcagagaaggagctcaccgatattcaagaaattgctcttggaagactcggagtaccagatgattgtgctggaactgtagcatacttggcatctgatgattcatcatatattacaggagaaatgattattattgctggaggtgttcaagctcgtctttag

SEQ ID NO: 30239 - DNA, 272 bp, Caenorhabditis elegans
gtcatcgtctctaacttcgccatgttctattcccatacacaagctcgttcaaagatgcccaagaaaagacgaggagtgctctcaatggatcaagttgctcagcatgtaagtaaaatattctaggggaggcattcgtgtatttcaaactttcaggtaaaacatgctccggttcgaaattccaatggaccaacgcaacggaagaatatggaaaatacaccacttgtatccaacaaccatacaccgccacataccttaatctagttgtttcatag

SEQ ID NO: 30240 - DNA, 965 bp, Caenorhabditis elegans
atgatgcttgacagaattatgtttcttttattttttatcttatcactagtgataggtagttttagtgagtatttggatgataaatattattcaactaattctattgatgtggtctgtaagccatgtgcagtcccatcaagtaattctgtaatatggctaccagcttcacgtcctccatgtctacaccccggtcaaccaatcattcattggcctgatttatctgataacttggcttgtcctgttcctggtcttccagattctgtccattcttcgcaaatttcattgctagaaggagaaggacttttgttaacaaaagagagaatttgcttttttgatggtccaatcgattttcattatgattatgtttgtgatggaaaactttatcgatcaaaaatgagaataggacattccattgcttcgaagaaaaagttggaaaccagaagaacaaagagatgggcgagaaggagaaatcccgatgcaaatgctgttcattttcaacaagagaagtgagtattaaatttgaaaagtttagttttagaaccgatgtacattgctacatgcgaattttgttattgcaattttttgaaaatgtgaaacgtctccttaaaagcgcacgttgtttttttgagctggttttgccacgatctcagccattatggtcgctagaactcaaatttaacacgactgttcttgaaatgtcgaagctaaagtttatgaaaattgtaaataaagaaacaatttcataataaatagttttacatcaaggcccccatttttgcgaattcacaataaaaaatgttctcaaaactttatttttcagatatgtaaaagaattaccagaagatactccaattgaaacaataattgcatctgtaaaagcctcacatgcttcatctcaacctctttactactcaatggttgctccacaagattctcgatctcaaaacttgttcaccttggatact

SEQ ID NO: 30241 - DNA, 386 bp, Caenorhabditis elegans
atgagtggagagattcgtttggccaaaagtatggaccgagaagttcttgataaacatatactgaaggtgggtaatttgttgtgatgtggagcactagagctgcaaaattatcgaggaaaaatattttgttgttagaaaaaactttggaatatttattaccgaatttaaactttttttaaaaatgtgcacacacagataatttagaaaatctcattgtttaacaattccctttcattatatattttttccaggtcacagcttacgagagggttgatccaacaatatcggctagtacgactgtagttgttcacgttctagatgttcaggacaatagcccgattttcgaaaaagattcttattttggagaaatccgcgaagatgctccg

SEQ ID NO: 30242 - DNA, 411 bp, Caenorhabditis elegans
acctatgccaacagaaagatcctcgaatacacctgccaaaccgcctacttcgtgtccattgttgttgtacaatgggctgatttgatcatctccaagaccagacgtaactcccttgtccaacagggaatgtccaactggaccctcaactttggacttgtcttcgaaaccgcccttgcctggttcatgtgctattgcccaggacttgacaatggacttcgtatgtacggactcaggtaagaagacaattaaatctcattataaatttgattattatattccacatttttcagattctcctggtggttctgtgcccttccattctcaatcctcatcttcgtctacgacgagatccgtcgtttcttgattcgcagatatccaggaggatgggtcgagcgtgagacctactactaa

SEQ ID NO: 30243 - DNA, 965 bp, Caenorhabditis elegans
atggcgttcacattcgccgcattttgttatctcctggcgttaattgctgtcggattctgcatcttcttcgcgatatacactgtaagttttattcgtcaatcaatttgtgaacgaaattcattaagagacctctcaaaatttcggaaaaaaaagagctgagtgagcttagctaaaatctcaaattgtaccgtttttccgtgtcacatctgttggaaattaactttcatttatcatcctttttcaagttttttttttcgttatataacccaaaagggtgtcatggaaaaactaaaattttaagattttcctaaaaaatagaaaaaatgtttcaaaaaaataacaataaaattcattttctaaaaccaaattttgtttatgttgatgaaaaaaaaacttcaaaaaacctacatataaatacaaaatttttgcaacaaacgatgataatcaaataaacttgaatttccgactgctatatctcggaatagttggtacaattggagattatatctgaaataagcctagtttttcgaaattttggatcaccataaaaacgtttgaaaatttttgagatctcattacaaagttcgtttattttgtttttcgtactcctcctttgaacaatatgttctttccaggttatctgcgttgacgaattgcgtacagactacaagaatcccatcgaacaatgccgaaacttgaaccaactcatcctcccagaatacattatccatggaacgttcaccgtattgttcatcttcagttggcaacttatatcgattctcgcgaatcttccacttgccttctaccacatttacacatacgccaaacgcccagtgatgtctggaccaggaatctatgatccaactactattctcaaccgttccaccctttcttcaactctccgcatctcatggatcaagcttgcattctatcttgtctccttcttctattatctctatgcgtaa

SEQ ID NO: 30244 - DNA, 419 bp, Caenorhabditis elegans
aaccgaatgatcgagtccatgcagcttttcaattcaatttgtaattcaacttggttcctttcaacagcaatgattctttttatgaataaaaaagatttatttatggaaaagattcaacgagtcaatattacgactgcattcccagattatgaaggtggtcaaaactatgaggaggccgtctcgttcatcaagcagaaatttgctgaattgaacttgaatcctgataaaaagacaatttatatgcatgaaacttgcgctacagacactaatcaggtaggttattggtttattggaattttaattctgaactgatcttcaaaaaaaaaaacttaattcccaattttcaggtacaacttgtcatttcgagtgttattgatacaattattcagaagaatttacaaaaagcaggaatgatgtaa

SEQ ID NO: 30245 - DNA, 733 bp, Caenorhabditis elegans
atacctcctatctttctgtcccatccaactcgatcgtcgcaatttctttggactctaaactcactccttatactccaccagcacctccatccggttacagtaccacggtgattcttctcaagaaagatacaaatcctggacagaatatttttgttagaggaggaactagtcaagctcataacggaagtaagttgttcaaattgaataattgtcagttattcaattccagcaaaaaagtaaatctttttcagaatgctcaactggaccatatcaacagtcaagtgatccatgtgcaatcccgatgtatcacgcaacaactgtcccatttgtgtttgccgaatacttaacatggagccaacaagataattatctcgatttcgaaggagctgaaattaatcaaggaactcatgatggagccgctgcttttggaactccattggcatattccacaaatgacaaaacggcaattgaataccagccatacaacaaatatgggccaggatattggattgccgttttaaggatggactgctcaaaagctgaacagggatggtttgaggttaagggatatgaaacaccggacattggatgggaaggagatatcaagcagggatcatgcagtggatctgttggtggatctgctccattctcttctatcaaccacgtggcaaaatgcggagccgttaatgtattcacttggggttcagcaagttgtgttattgattccgcttaa

SEQ ID NO: 30246 - DNA, 327 bp, Caenorhabditis elegans
atgttttttttcttggttgaagcgttcaaaatattcatttttcgaatattctcccttcaaaacaactatttcctctcttccatttcctgtttcgttgtgtgtggccctgctggaagattgaggtgcttttgaaaggagaagcataaacgaaaagctcattctttttcattttattcagcagcttcatgttttttcatatttttttgggcctactggtcgctgttttgggtgaagaagttcatgaacttcgatccgaatgtttgaacgaagctcaacttatggagaaacttctcaaaggctcaggatacagtaaacataaaataccac

SEQ ID NO: 30247 - DNA, 623 bp, Caenorhabditis elegans
atgtgacggtagttggccaaaagatattctgaagtggtggcaaacccatggtctctgtactggtggcaattacaatgatcaatttggatgtaaaccgtattctatttatccatgtgataagaaatatgcaaatggtacaacatctgtgccgtgccctggttaccatactccgacatgtgaggagcattgtacttctaacataacctggccgattgcatataaacaagataaacattttggaaaagcacattacaatgttggaaaaaagatgacagacattcaaattgaaatcatgacaaatggccccgtcattgcgtctttcattatttatgacgatttttgggattataaaactggaatctatgtgcatacagccggagatcaagaaggtggaatggacacaaaaattattggatggggagttgacaatggagtaccatattggctttgcgttcaccaatggggtacagattttggagagaatggtatgatttcttacgatcatttcaaaactagaggaggtctctttttcaggatttgttagatttttgcgtggagtgaacgaggtcaatatcgagcatcaagttttggcggcgcttccagattcggaaaagcataactaa

SEQ ID NO: 30248 - DNA, 368 bp, Caenorhabditis elegans
atggcgtcgacagccaccttatcgtttgggccgaaccaagagaatgaggtgcaacttcttccaccaaaagaagagaaaactctcgataattttatgaaacttggcaaatattgctggcttattctatttttctccgaatttatgctactttccggagcgggaaacacactttatatgatgtatgctggtgagttgtctagctaagttgaaatttgaatacgatatattcaggtgcctatccaaaacttgtgagctgtgaaggacccgatgtttttatcaaagatatttgcaagtcttcatttgatttccacaatcctccaaactgtacgataacctcaaaatatgacttctactcgatcaatgttgat

SEQ ID NO: 30249 - DNA, 531 bp, Caenorhabditis elegans
atgtcggattcgtttgccaatgtgccaggaggatcacaaaagctcaactccggatataacattccattcgtcggattcggaacgtacaaagttaccggagaaaatgttccgccagcaattgatgcagccctcactgccggttatcggatgtttgacacggcaaagtattatttgaatgaaaaggaattaggagaagcattaaaggtaaatttttatatttttatttcaaagataaattatgtttacattctctttgtaatcaaatcttctttattcaaaatttacagattctcctgcctaagcatggattatctcgttctgatgtgttcctgacatccaaattcttcccagaaagcaaaaattgtcgagaagcttgccgtggatttgtcgaagaatctctacaatctcttcaaaccgactatatcgatatgtatcttgttcactatccaaaaccgaatgactctgacaatgatgatgtgaataacgcggaataccggaaaattgcatatgaagtgctggaagaggctaaag

SEQ ID NO: 30250 - DNA, 343 bp, Caenorhabditis elegans
atgtccataaagttgaacactggttacgattgcccactgatcgggctcggaacttataaaattattggagatcaggttctcccagttctcgacgctgctcttacagccggatatcgactgtttgacactgcaaaagtttataataatgagaaagaaattggagacgcattggaagtttgtactcaagcgtgacggaatatttttaaaaattcaagtttaagatccttcttccaaagcataatctgaagagagaagatatttttatcactacaaaaatgcatcccaataccgtagaaaatgtgaaaaagttggtggatgaatcgttgtcattgttgaaaactag

SEQ ID NO: 30251 - DNA, 1111 bp, Caenorhabditis elegans
atgacatccagcaaaacacaatttgaagccatgttcgccgacgttcaacagacactttcgaaagaaataaatgataaaactgaagaaattgaacggctcatggaaagaattgatagccttgaaaaggtgaatcattcaagaatcgaagaattagagagcagattgactcaaagagaacgagtcgttgaatctcttgaagctgatttggctgcagtcagaaatatcgaacaagagaaacttgatgagttgcagaaattgaaagaagaatttgatggcaagtttaaatatttcaagtgataaataacattttgaaattttttagaattgaaaaaagctgaaacaatgtggcaagcagagaaagatatgctaatcgagcggtgtcttggcagtgaaagtgacattgaatacgagaaagagagatcacaagagaataagagaagatttgatgatgctctttcagccatgcatgaacttggaagagccaatcagtcactgcaggtaatttttagcatataatttttgcctttcgaaaatattaaaaaaaaaaacattttcttgtaaagttccgcgaacgattaaattttgtcggattcgatacgattttcaaaatgtttgaagaataattttgaatatttaggacctcttttttcattaaaaatataaaaacaacacaaaaaagaatcattttcgtaaaaatggaaaaaagctaaagttcgacccgtttttatgggtggagattagaggaaaaagtgcggtaattcaaacgaggagattagaaagagttgaaaatcgccaaaatcatcttccttttttcaaacctaataaaataactcgccattgacagtattcatgaaggagtagaatcctgttcaattctaaaaaattacagattgatgccgaccgttacagttctcggaaatggcttgacgatgcagaagcaattaattgtaccgaatgtggaaaggtgttttctctgacagttcgaaagcatcattgccgagtttgtggaaagatttattgcaatccatgcagttcaaaatcagtccgaattgcgagtgccaagaatccagtccgagcctgcaacacgtgcttcactgattcccagaaatga

SEQ ID NO: 30252 - DNA, 629 bp, Caenorhabditis elegans
ttattatcttctccaactctacattccatcatgcatgttagtcatcgtatcctgggtttcattctggatcgatcgtacagctgttccggctcgtgtcacacttggagttaccacattgctcacaatgacaacacaatcatctggtatcaatgcaaaacttccgccagttgcctacatcaaggctattgatgtatggattggagcctgtatgacattcattttctgcgcgttgttggagttcgcctgggtgacttatattgcaaacaagcaagatgctaataagagtcagttgggattttttttcagaatttttcctacgttttttttgctaattttcaggggctcgaactgaaagagagaaagctgaacttccattccttcaaaattcacataacgatgtgtgggtaccacgagaagttgctgaacaagaacgagaagtaatgacagttcgaatgaatcgccgtcaaacaaatagcgtctggaaatggatcaaaacaaagactgaatggaatgacaagtcgaaaagagcagatcttatatctcgagtcatgttccctgtactatttctcacgtttaacatctcctattggactcattatggacaatacggtgtggccatcagtacgtaa

SEQ ID NO: 30253 - DNA, 324 bp, Caenorhabditis elegans
agtcaaaatggaagcagtagtacaaaattgattctaccatcacttgatctgaatagaagtgatcaagccagttttgcaggtgagaaatgaaaaatgactgaaaagaaaagcccctcgtcccattacgggtagatgtgattcttgtcacccgatttttttgtcaaaactaaaaaatctcctgcaaaaatctgtttcccagaatctgaaagtgcagcatccccaatctggcaacccttaaccacgagaaaccttccaaatgttgattggccaaacatcgatgatgacatagattccggatgggatgatggaagtcaggtaatataa

SEQ ID NO: 30254 - DNA, 495 bp, Caenorhabditis elegans
gaggctatgtcattccacgccaaactccgactacaacaacaacaatgagccgattgaaccccttcgagctcctgattgcaccttgccaacttggtagagctgcgggagttctgtactgggatgatggtcagaggattgtggactcatttgatacccatgactatcatcagttcgattttaagttcaactctacgattaacggtgcttcgttggccattacaagaactagaaaggtttgtgaattaaaaattgactttttctatacatgcaaatttacagggaacaactgttttacctacattggatattttggaaatctttaactacacaacacctccgaacttccgatcgttccgtttgaatgggcaatctattaatgtcaatgtgcagacttcaacatactctggaatcaccaagattctaaacatttcaacaaagaattttatagatttgacttcttctgatgtgattactctggaatggtcaaacatgtga

SEQ ID NO: 30255 - DNA, 634 bp, Caenorhabditis elegans
atgtcgagctttggcaacaatgccggcggaggaggtcgtgaatatcacgacgatcgttcaaaccgtgatcatcggcacggaaatggtggatcggatgcaggacaaaggcgccgtgaagatcataactcgagttatcaatcttatcgtcgtccagatgggagacaggattcatacggaggtgggcatcaaggaaatcacggaaacagctacggaagacgtgaggatgatcgttctcgtggggagttcgaatgaaagtgttattttaataatttctctaaaactccagattctcgcgataaccacggtggaagccgctatggggaacgggatgatcgtggcaacaacggacgaagtgcggataatcgctactctcaaagcaattataactacgacagcaaccgtggtggccaacattatcagcgagacaatcacggatcaaaagatgatcgtggaccaatgaaccaatacaacgatcatggttctaatcatattccaatagcagaaacgaccagtatcgtcagggatcttaccaaggcgatggtcactccggctatcgcagagacgatgatcgtcgtcgtaacgacaatgaccaggctagaccatatcaatcgaatagagattctgacagaagtat

SEQ ID NO: 30256 - DNA, 525 bp, Caenorhabditis elegans
atggctctcttcaaacatttggctttatgccttcttttaactctcgctgcagccgaggatgacctcaagtgttatggagctgattgtgaggttccacattatatggatgatacgtaagttctgaagggttactgtagaaatttgtgttcatagattttgacttaaaattaaatactatgaaatgtgatttttaaaaacatactttttccttatactgttatttgttcagaaaagtcggaatgagagttaatattttttttagaataaacaatttttagctagatctgaaaagcccagtgaatatcaatttttcttcaaaatttagtccaacaagacagtactctattttctccaattatctatttatctaattccagtgaacaatgctccggcctcgaatgtgaatcgaaagaaactcttctcgccatgatcagccattaccaaaaggagaaacacgatgaatacttggcaccactcacaaagccgattagggacgaaagtgcggttcgcaatttcctgaacgaa

SEQ ID NO: 30257 - DNA, 525 bp, Caenorhabditis elegans; identical to SEQ ID NO: 30256

SEQ ID NO: 30258 - DNA, 312 bp, Caenorhabditis elegans
acaattccaccaacattgagagccaagatggagggcgatgcaagtaagttttcgagctataacttttcaaatttcctaactaataatgcattttcagtttactacacatgttccaagtccaacttcaacactggatggtggtatgtcgaggatcaactttgtggagctgccaacttgaacggtgtccgatacacatgcccagttattccagttgaaaatgagcgttacttgagatgggccgagggaacactcggacaatcgtggatgtacttgcgtccagttggattcccaaaatatgacactaatatgtaa

SEQ ID NO: 30259 - DNA, 312 bp, Caenorhabditis elegans; identical to SEQ ID NO: 30258

SEQ ID NO: 30260 - DNA, 199 bp, Caenorhabditis elegans
atggatgatggatcgatgacaccggaggaccaggagcctgttaccgataatgatatggaatataatgtatgttaacatttacaacccttttcagaatataatttaattctaattgaaatgtttgtcttcaggacaatggagaagaaagctcgtacagcaatggctcttcttccagctacaatgctgacaaattatcgtc

SEQ ID NO: 30261 - DNA, 566 bp, Caenorhabditis elegans
atgtcatcaaataaaaaaaaatttgaatggccgtatccaaaaattaatcattttcctggaagaattgaacgattctcgtaccgaacttatgtaagttttcagtaaaaaactttatattcaacatgtcaaattaattatttatttgtgataactttcagaactggtttgaaaaccgcctttggccaatcagaccaattccatttctggcccttgtcacaactgctactggttatcaactgagaaactttagcctcccagacattcagcagaacattcaaacgattgtgaggccccttgcgatttctataggatctgtgtacacttccgtattccttcttcgtcatttcctaaaatatttttatttttcttacaaaggatatttgaaggagaacccaaaaaaaccatctttttttacaattttatggggtattctcagaaaagcagtccttacaattgcacctcctcaactgtcgtcttgtgaccgactacttcctaatattccactccctgctctaaaaaacacagtgaagcaatatgtggattcaatgcaattagttttatcagag

SEQ ID NO: 30262 - DNA, 267 bp, Caenorhabditis elegans
tgttgaagccatgctctcggataaatctgatgtacgtatacaaaaatatgttcaattcgataaaattttgattttcagatagcctcccgcaggaagttattgaaagaagcttgtgaagttcatgtgaataactgtaaagaaatcatgctaggaaatggatttgatcgtcatctatttgtactatgtgttcttgcaaaaggacttggatacgaaagtccattcctcaatttcttccaaagtcagaagtggcttctgagtaccagtaat

SEQ ID NO: 30263 - DNA, 256 bp, Caenorhabditis elegans
atgcaccaatacacaatcgaggccattattggccctatgatggtactcggcatttttggaaacgtaaacgtaatcgtcgcggtggccaggaagaaagtactcaggacaaaaggaggtatttattcatgaaatatgatattttgaaacgttttatttttgtttgtttgtttttttcagcaatgctgatatttgtacttgcgatctctcacttggtaatcaacattgcagagctcaaaacattgatattccggttaag

SEQ ID NO: 30264 - DNA, 274 bp, Caenorhabditis elegans
atgggtggaacccaaaatgggaaagccgtggcaaatggaaagtgagttttcccaattttcaaaagtttatagcaaatatttttttagggcaaaaaacggaaacattacggaaaaagtcatcaagttggatccatgtccaaagccagcgttctacgtattttggcttgtccaattgaatattacaatgatgcttgtaggagcaatggttgccactttattcgataaatggggaattgtgaagacaaaacgatcaaaaggagaccccagaatggag

SEQ ID NO: 30265 - DNA, 572 bp, Caenorhabditis elegans
atgaatattgagtggtttgcaataggcgttggtgcaattgtggttttgtacatcctttatcattttatcaaaatgatttggagcatattggggttatatgtgttctaccaaccaattgatttaaaaaagaaggctggtgcttcatgggcaggtgagttaaagtgattttaaaccaaatggtatctttaatgtgtattcaagtttccagttgaacgttttcagtgatcactggaggtactgatggaattggaaagtcattttcatttgagttggcaaaacgtggattcaatatttacatagtttctcgtacccaatcaaaacttgaacagacgaagaaggaaattatggagaaatattcaaacgttgaagttcgttttgcaacttttgacttcacaaatccttctatcagtgactataagaagcttctgagccagttgaatgaagtatcaatcggaatgttgatcaacaatgttggaatgctgtttgaatatccagaaaacttgcataaaacagtgggaggaatagacgtagttgcaaatgttacaattctcaatacattgccagtgacgttg

SEQ ID NO: 30266 - DNA, 942 bp, Caenorhabditis elegans
atggatattgagtggtttgcaacgggagttggtgcagttgttgttttgtatattctttatcatttcatcagaataactttgaatatactgggcccatatgtcttctgtcaaccaattgatttgaaaaagaaagctggagcttcatgggcaggtgagcatttattaccggtgttgttattgtgtggaaattatttaattgtatcgtcatacttcaaaacgaaacatttataacttgaaacaattcccggcggatttttaatttgaatttcacacaacccatttaattttggttttcttgttcataattttgcgacaatatttgttgacgaatcttctaggatttagcaaattaaactctggtgcctatagatccaggtattatatttgcgtctttcgagtcaaaaacctcttgtctcggttgaaccttcgtttataataataggggacgattaatatagttataggacaaaaaatgatgaggaataatattcagtgatttgagtgaatttgcattgcttgttataaaatattcagcaaagtttaatacatacactcattcaaaatttgttgcaaatgcagatattttcttcagtggttactggagcaactgatggaattggaaaatcttattcatttgagttggctaaacgtggattcaacgtttacatagtttctcgtacccaatcaaaacttgaacatacgaagaaggagattttggaagtacacccagatattgaagttcgttttgcaacttttgacttcacaaatccttctgtcagtgactatgaaaagcttctgagcaagttgaatgaagtatcaatcggaattttgattaacaatgttggcatgttttttgactatccagagatgttgcataaaataaatggaggaattgattcaattgcaaatgttacaattatcaatacattgccagcaactttg

SEQ ID NO: 30267 - DNA, 935 bp, Caenorhabditis elegans
aagacaacaagcttgttcggcctgcagaacttgcagaaattgagttcggaaaatcagaagacgagatccatgagcattcaaacaccccttatttggaaattctcacaactccttcagtctggggaatctggattggagcattcggagatcttattgctgttcaactgattcacatttattccccagtattccttcatgatgtcggtggttattcattcgagaaaaccggattcgccgctgcagttccagttctgttccagttcttcgtcaaaatgttcgcaggacattcgagtgacaaggtacatggtatttctgaaaccacaaaacttcgaatctataacacaattgctctcggagccagtgcaatctttttggtgtctcttggatttgtgaagcaaggacaaggagtattgggattggtattgatgactttggcaactggaatgtttggattcaatggaggaggtttcagtaaggtgagttcaaaaaaaaattttaaaagagtgataaaacaaacatctatggtttagctttgaaacaaaatcaagcactttctgcatgaataaatattcggattaaaattttgaaattcgcagtcaaatttgaaaatacctacacatctaatgaattaagctctaacttttaatttccagtgtgctgctcttgtctctcgccaatacaatcactttgtaatggcaattcaacaaattcttgtctgcttgtcaatgatcgtatgtcccatcatcgtttccacaattctacaacatggaactacagccgaatggagaatcgtattctttgtgcatgctgcaattctgcttatttgtaatgccatcttctgctggctggcaactgcaaaacctgctccatggactgatagaactatcaaacattctgctacaaagaatacaccactctatcagacaaaagtttaa

SEQ ID NO: 30268 - DNA, 835 bp, Caenorhabditis elegans
tcgtataactacaactacgggcagttccaagattggttgaaatctgtaaatattacagttgacttattgaaagaaccaaatcttgtaatgactaaaatggatccaccacttgcgattatggcttctctttggttctacatgacacctcaaccaccaaaaccagcaatgcatgatattttaatgggaaactggaatagtggtgcacagaattcagcagctggatatgatgggccaatctttggaccaacttcattaatcattaataatgaatgttctggagaagattcaaaaaatccaggaggaccaggagaatcaagaagaatcaaggcattcaagtggttcaatggatactttggctcccctgttggacctgaacatacactgtcttgtggaagtaggttaccattttcccaacaagttttctattttttttattccaaaatgcactagaagtttccagaaactttcttacttgtccacgaaaaattgcctcatttttctgtttcaaattttttttctctattatcaccagagttgaacgccttaaaatttcctcctataatatacaaatttcacagaaatgccagtgaaacttaatgcgataccccactatcagagttatcaacctgattggagttcatcctggaaaccagaacgatgtgactgtgctcctgcaagttacggaggactcgtgtattattttgatccaaactattacccagccagttttgttgctcaaaacgatttgaatcgcaagaaatgtattgaaactgtttatgcaaatccatcaatgtatttcatggataaaaaaaattcattatgccttaattattga

SEQ ID NO: 30269 - DNA, 560 bp, Caenorhabditis elegans
gtgtatactgcggacgagaataaaaaacgagatttggctgccttctttgcccatgcaattcaagaaactggagaaaacaacaactatctttatacgtaagttttatatagttaaagatggagtactgtatcgtccgtagagattttactgcaaatgaaatcaaacgtgttgaaattgccaaataaaactcttacttctagaaaaaatactaaattttgtatatttttttcctttaaaaactttagaacagttttacgaatttcttagggtaacatttagtcatgacaataatttccagcgcgcttcccgatcaagaggcatccaattgtttctaccgcggaggattttataactggtttgaaggtggaccgtcaagtaactttttaaacccagaaacacctggtcactctccaactgatggaaattcatgtacatctgctggtcgttactgttctgcttctgatcagattacctttttctatccctgctccaattcaacaatttcaaaccctgctgctccatataaaggatgctattttggaagaggaggaattcaaatt

SEQ ID NO: 30270 - DNA, 536 bp, Caenorhabditis elegans
atgtcggcgcaattcgtcgcatttcttctcatcgcatttaatttgtctctaccggccaacgcattcagtaagatctaatgaattttagggtatataaagtttctttgattttcttcaaatcgaaaagttgggtttcgcaagaaagcccgcaagtatactcaacttgtgaaatttcgaatatcaaattcaaactttgtttctgtattttgcacgttaatatgactttttaatcgcattttacagtttcagacggtgcaaatgcatctgttggtctttttggaaacgcgagttcatgtccaaaagcagcaaaatttggaaagggaccaccaaagtcatgcactatacctagtgacccaaacaataagccagcttctcagctagaatcctggttcaccagagaaatgtttgaagacttgtttccattcgcaaatcttggatggggtccgtcgagctgctggccatattcttacgatgcttttaaaattgcatccagatattttccagagtttggaacttctcttaatgtgaataacacg

SEQ ID NO: 30271 - DNA, 366 bp, Caenorhabditis elegans
ggaaccgcctacactttcttcactcatacaaacgcttccaaggcaaaggatctgttgaaggttctcgatgaggctaagcagactgttccacaagctcttcgtgatatggcaaaccgcagttacggaggtagcaactcaaggggtcgctatggaggtggtggtttccagaagagaggatacggaggaaacgataactttgctccaaagaggccacggtacgtgtttttgtgattagaaataaaaaagtggaatatgataacggatttttgaaatcgcacctaatttcgaataaaattaaatcctgtaattttcagatatgacaacggaggatacggtggaggcagcggtggaggtggccgatggtag

SEQ ID NO: 30272 - DNA, 282 bp, Caenorhabditis elegans
agaaattcgaaaagttcttgacgctaacggttgtgactacgagcaacgggaacgatacatgattctgtgtgtgcacggtgatccgaatacagactcacttgttcaatgggagatggaggtgagtacaccagctatctggttactgtagttaattctaaatgttttcaggtctgcaagttgccacgtctcagtctgaatggagttcgattcaaacgaatctcgggaacatcgattggcttcaagaatatcgcttcgaaaatagcccaagagctgaacctttag

SEQ ID NO: 30273 - DNA, 348 bp, Caenorhabditis elegans
atggtattcgtgtcaaaagctgttccactgaaactttcgacgcaaccggtgcacgagcggattctggactcatgtcgtatccatgcagccgccaataaggacgccatagtttttgtgagtacggatttatcatggatcttatggatacttcatgtgggttgccttatgttcaatctcatgggaccgtactcatgaaaccagttaaaggctacctcatattgtcggtcatggtactataaacatcatcatttcaaaatttcagattgacgccgaaaccaccaccaagaagaagctttatcgtgacgtggaaccgaccgtgaacagcctggctacagccctagtcaaact

SEQ ID NO: 30274 - DNA, 522 bp, Caenorhabditis elegans
taccgctggtcaaaagtcattcaaagaagaatggtctccatcacttgacacatttatcattacaaatttagttgctccaataatcactcacatggatcaaataacatttgacgtcgataaaactgtcgagcaaatggaaatactaaaaattgaacgggagaattttttgaagagcgaaaaattgaaaaggaaatcggaattggagatgagtagatggattaaaaagggaagaaaacgagtaataaataaaaggatgggatttatgccagtggaaatcatagaaaatgaagaaagtgaaagtgatggaggatttagtaagttctgttttttgttactttagttttattcgctgaaactaataagaaaaaaagtttaaaaaactcatattttgtaccttaaagtccaaacatttcaggcatcggcttacttttatttggtggaacacttctaggtggaattgtctatgtttcatcttatcaattcttccgacgatctcggaatgggtatcaactgataaattaa

SEQ ID NO: 30275 - DNA, 695 bp, Caenorhabditis elegans
cacggtgggcaaaaaatccttcaaagaggaatggtctccatcacttgatacatttacatgtgcccttgtaatatctccactagtttctcatatgaaacaaactacaactgcttttgataaaacttttgagcaaactgaattgttgtacaaggaggaagttaattttttgaaaagagaaaaattggagagaacgcaagagctaaaaatggaaacgaagagacgagataaagctttgcgaattcagaatagaaaaaatggattggcaaataaagaaattacagaaggagatgaagaagatgagagctcgaaactaggtaattagatctttttgttttttttttgctgtggatttttattttttcgaaatcatgtgagcaaaacaaaacacttaaaaaacacaaatttttaaagattatgatagcctgtcgttaaatgagaagctcatagatttttaagaaagtttttcaaaataaaatcaatttttagttgtttcttattttttttggagaaaaacatttctcaccattcgtttccgtaaaaacaaattttttggattcatacttttatcagtttcaattacagatattctccttatcatcagtgctggaactcttttcggtggaattttgtatgtcacattgcccaatgtcatactacaaaaacgtgcacgagatggatacgagcttctatcataa

SEQ ID NO: 30276 - DNA, 483 bp, Caenorhabditis elegans
cactgcgggtaccaagtcattttctgagcattattccccatcactcgactcatttaccactggaattctaattgatcctattgtttcacatatgaaaggagttgcaaccggacctgataaaacatttgaacagtttgagaaaatgctcctggaaagagaaatgtttctgaaaactttgaaatctgaaagaaaattggaacttttgaaggaaaaatggaggaaaattagaaacggcggaggaagaattgtagagagagcaggaaatgctccgatggaaatgagagatgggaagaagggcagtagaggtggagtcagtgagttttcagaaaaagaaagttgtcgatagttatcaaaacatatatttttccaggtctcctcttaatcatctttggcggaacgcttctaggtggaatactctatgtcactatttcacatttttgcctacatcacaaatctcgggaaggatatcagcttttgaaataa

SEQ ID NO: 30277 - DNA, 842 bp, Caenorhabditis elegans
atacattaatgatctaaaaaatgcggacaaaaaagaagaattattgaaaaatttatgcgagcatattggctatgagctttatacagaaccggaagagttttctagaaaatgccagaaattttatggaaacggagatgatgctcaatttttggcggatgacatggaattttatgatggttctattaaagtagcaaatgcacatgcaagtaaaaatacaaaagtctttatgtacaggtaagaacattttattgatctacataatagaaaattacagttaggtatctatttgaaacaatttattaacaattaattttcgttttaagacaatatattttcttaggtatagataattaaattccaaatttgctcttaatttgtaaaaacattgtaaaattcaaaaagcttcttgacaaagataatattgttaaacacccgcgcatttcttggttatcctgccatttttgccttcaattttcgtgaatgtaacggattttttctgaaaatttcttccaacctattttttgcagctacgattacaaggacgctggacctgctttcaaaaaatatgctcaagcgccaccgcctcatcattcggaagatttgatctacgtttttggaacaagccgtggaaattttacagaaaaagattatgttattgaacaaatttatagtggaatgtttgctgatttcgtgaattttggaaatccatcaccatcaaaagaacaaaaatggaaagaatattctccagagaaacgagaatattttttaattgattttgacaaaaactttactatgcctggaacgagagatgggtattattcaagagctttagagttttggag

SEQ ID NO: 30278 - DNA, 459 bp, Caenorhabditis elegans
tacatgtggaagcaagtctttcaaggaacacttttctccgtcagtcgatatatttataatcggaaatctcttgaatccaattatgtctcatttgaatcataatgaaactggccccgataagacttttgagcaatttgataaattgtataacgaacgggaagagtttttgaaacttctaaaagctgtaaggaaattggaaattcaaaagaaaatgtggagaggtcgaagttccaaagatttaatgctgaaagagcttgtggatttggagaaaataaacgaagaagagcaagaaactggagctagtaagttttaaagttagcctccatattgaaacaaaaccttccagatttccttctcataatatttggtggaactcttctcggtggtattctctacgtctccatttctcatttctgcctccatcatcgttctcgtgatggatatcagctcttgaaataa

SEQ ID NO: 30279 - DNA, 452 bp, Caenorhabditis elegans
taccgccggcaaaaagtcattcagtgaacgattttcgccgtcacttgacaattttgtcatgtcaattctcacagatccaattgtttcccatttgaaaggtgttgcatctggccctgataagtctattgaacaatttgaaaaggtttttaacgaacgggagagcttccttgaagagttgaagctaaggagaaaattgaagttggagaagaaaatcggtgttcaaatgagaaattcagttgtggaatttgaaaaagatgcagatcaagggacaagtggaggagttctaagtgagttccagtattgtatgtttctttgattttcatatcatattttttccagatacacttccaataattcttggtgtcacagtatttggtagtatcatctatgcttccatatcccatttctgcatccctaataaatcaaggacaggttaccaacttctggaatag

SEQ ID NO: 30280 - DNA, 328 bp, Caenorhabditis elegans
gcgtacaaggcatggaaatcaaatacaacaggaatcagtgaacctgctctaccaggattccagaacttcaccagtcaacagatgttcttcttggcttatgcaaatgtacgtctcaaatactttatttcttgaaatcaaattcaattttcagaactggtgttcattggttcgtccaaaacattacattcaaataattctaacagacgtgcatgctccatcaaaatatcgtgcaatgattccacttcaaaaccgtccagaattcgcgaaagcgttccaatgtcctattggatccccgatgaatccagagagaaaatgccaagtttggtag

SEQ ID NO: 30281 - DNA, 841 bp, Caenorhabditis elegans
gtctatatgctgtgcagaagcgaagagaaagccaatgaagcgaaacgaatgctcgtgagacaaggatgcgatgccactcgtcttcacttcattgaatgtgatttgacagattttgaaagtgtacgacgagctgccaaggaaactctcgaatcgactgacaccattgatatccttatcaataatgctggaatcatgtttcaaagcaaacacgagcaaaccaaggatggtcatgagaaaacttggcagagcaaccatttgggaccatttctgctcaccgaactttttctgccagctgttaagaagtcttcctacgctcgaatcatcaatgtttcatctcgtattcatttgaaatccgagaaaattaatttggctactgtagatgacaagaaatcgtttggaatgatgaaatcgtacagacagagcaagttggcaaatgttatgcacgcaagagccttgactaaggaattgagaaaggacggagccgaacacgtgactgttaactccctgcacccaggagttgttaataccgagctcgcgagaaataccattttgaatacaccaggaatcaagcagattacagctgttttccggtaagccaagccaaatttccacacttaaccttaaaataaataaaattaatttcagttggttcctcatgaaaaccagccgcgacggagctcaaacttcaatcttccttgcattgggcaaaaagatcggtggaatcagtggaaaatactttgccgattgcaagttgacccaagaaaacccactagccttggatgatcaggcctgtcaggatttgtacaattatagcttggaatgtactggcctcgccaagtaa

SEQ ID NO: 30282 - DNA, 727 bp, Caenorhabditis elegans
gtcgagtatgccttcaaagcaatcaactctaccaatctgacggctgtcgcagtcaagggagctgatgcagctgtcattgccgttcaaaagcgtgttccagacagtctcatcgtcgctgataccgtcacttcggtttatcaaatctctcagtctgttggatgctgcgccattggaatgatcccggatgctaaattccaaatcaagcgtgcacagggagaagctgctagctggaagtacaagaacggctacgatatgccatgcgagcttctcgccaaaaagatggctgatctcaaccagtattacacacaaaatgcggagatgcgtagtttgggatgtggttagtagaaaaatttccgaattctctaacttcaattattacaattactcaatttcagctcttttgttcatttcctacgatgacgagaaaggaccagaagtttatcgtgttgaccccgctggatactaccgtggtatgaaaggagtatctgttggagtgaaacaacttccagcgacctcattcttggaaaagaaaattaagaagaagtccgaattgacatccacagaagctattgaactcgccattgaggctcttcagacttcattgggaatcgacgttcgttccaaggatcttgaggttgtcgttgtcaccaaggataactccaaattcaccaagctaaccagcgatcaggtcgaacatcatctcaatcaaatcgccaaccgagattaa

SEQ ID NO: 30283 - DNA, 294 bp, Caenorhabditis elegans
aaagagtagatcaagtggttagccgtgtcgaaaagatctacgaacgaacggttgctgatacagatggaattgaaaatgacgagtcagcggatgctgttgttgatcatatttgcacaaagtaagaatatttccggggattttgaaactgagaaagactgaaactaatttccaactttaaggtgcggtcactcaaaggcatcatattctactatgcaaacgagatctgcagatgaaggacaaacagtattctatacatgcctgaaatgcaagaagaaggatatcgaatattcttga

SEQ ID NO: 30284 - DNA, 407 bp, Caenorhabditis elegans
atggaaattgatttacgtgtgtttttttctaattctaaattttttggtgacgttttccacgttgatttatttatttttcgaacccccctttccctcaaccaaaatagtatttattcttcagtttcaatattgtcaaaaagctcgatgcccgagtattttgaatcttctgcgatttcaattagaagaaatgctgcaggaaacgacgttcaaaaggtaattgaaagcatttagaacatctcataaagatgatgtttcagaacaaagttcaaaattggcttcacagtgtgatcgagcgtctcaagtggtggagtcccggacgatgtcagcagctcttcgtcgagaatgagctcatcgagctatgctacagagctcgtgagcagttctggaaaaacaaagtgaagctagat

SEQ ID NO: 30285 - DNA, 632 bp, Caenorhabditis elegans
ggttcgtgaaaagctcaacggtcttcttgcaaagggaacatcgggacaagccactaagatctcaatcaatgactttatcatcaaagcttctgctcttgcatgtcaacgagttccagaagccaacagctattggatggactcgttcattcgtgagaatcatcacgtcgatgtttctgtagctgtcagcaccccagccggtcttattactccaattatcttcaatgctcacgctaagggactcgccacgattgcctcagaaattgtagaattggcgcaaagagcacgcgaaggaaaattgcagcctcatgagttccaaggaggtactttcaccgtctcgaacctcggaatgttcggatctgtatctgatttcaccgcgatcatcaacccaccacaatcatgcattttggctatcggaggagcatctgataagctggtcccagacgaggctgaagggtaagagtttttaggaaatttatcgagttatatagtttttgtatttcagatataagaagattaagactatgaaggtaacattgtcatgcgatcacaggactgttgatggagctgttggagccgtctggcttcgtcacttcaaggagttcctcgagaagccacacacgatgcttctctaa

SEQ ID NO: 30286 - DNA, 295 bp, Caenorhabditis elegans
atgacatcttcgatcccattccgttcgttcaacgagaaatatgagtgtaacgacgatgataatttcacctactcaagcactgaacaggtttgtaaccccgccatgtaattatcatgtacgattatgagtatttcagaaacgtattgaaacaatgcttttcgaaaactacaattcactggtgttagaaccattcaagaccacaagcgacgaagatctcgccgaattgacgattttccgtcagaaacatgcctcgtatttgctcagatatctcaaaaactgcccgtcgagctacgca

SEQ ID NO: 30287 - DNA, 405 bp, Caenorhabditis elegans
agttcgctcctcgatgaattcacgaaatcgactattgtcgtgacaaaggagtcggccgccgttgtcaattctgttgttctggttcacgtggacccatcaggttggttatcataaaaaataaccatcaagaaaattattttttcagtgaatgtcccacaaagaattcttccatcgttcccactcgtctcggagttgaatcagccagtcgaacccgaagttcttcttggatttggagaaggaaatgacgactttgacaccgatgaacttgccacaaagaagcgtcgtgtcacatccttcgtccgccgagacagtcttctcgaaactacgaacaatttcctcagtccttcgtcgattataaagagaagagaacaagcaatcgaagaagaagaagatttcgaaaactaa

SEQ ID NO: 30288 - DNA, 380 bp, Caenorhabditis elegans
gccaatgaatggcaccgagcgcagtgaaaagtgcaccaacgttgtgaaagtggacaaaggaaaacaagctatcgagttgaagggaaagtcatttggcccatttttccggacctatgacccagacacgactcaggaagaaatctactcggacctcgtgtcatcacaaattaagaaggttatcgcaggatttaattgcacagtttttgcgttagtagacaggacggttcaataatattcaatataatagtaattttcagctatggacaaactggaaccggaaaaacgttcacaatggaaggagggagaacagacgcaaaaagctcaactgatgaccctacgactggaatcatacctcgtgccgttgaggatattttcgagca

SEQ ID NO: 30289 - DNA, 338 bp, Caenorhabditis elegans
atgaactcaaacggcccgttgatggagcacggtaagcgccgtgtcgcctactactatgactccaacattggaaattactattatggtcaagggcacgtcatgaagccacatcgtatcagaatgacccatcatctcgttctcaactatggtctgtaccggaatttagagattttcgtaagtaatatttcttcattgaaatattgtaaacgtttaattttagcgcccattccctgcatcattcgaagacatgactcgttttcacagcgacgagtacatgacgtttttgaagagtgcgaatccagataatctgaaatccttcaacaaacaaatgcttaagt

SEQ ID NO: 30290 - DNA, 377 bp, Caenorhabditis elegans
gtcgaaatcggggaaatgaagcgacacgtcgccgaccagaatctctttgcaaaaagcccaattcaaatgctggagtttgtcaagatcgttcgggccacgcaattctatcaccgccccgactacgaaaagcttttcaatctcttgaatgatgccatgaaaagcgcgaagtacaagtggtccgacccatatcattgggagcccgaaaagagaaagaagaagccaagtgttccagcagttggaaatgtccccagaaaaggtaacatattgttttttaattcttatagttgtaacagttttcaggcgtcacaccaccatcaaatgaggaagttgattttttcaccgtcgatgacttcaacacaaacccgctcggattctag

SEQ ID NO: 30291 - DNA, 230 bp, Caenorhabditis elegans
accgtccatcagagctggtttaactaaagaacaagagcttctctggcgccgtgaaggtatcaagctgttatcggaagtcggaaatgccctcaactggtaaatataattttcgaaaaagtcgaaatttcaaaattcaattttgcagtaaaccgcgccccactatcggtgttgcagctgtatattttcatcggttttatatgattcacagtttccagtcattcagtcgagag

SEQ ID NO: 30292 - DNA, 968 bp, Caenorhabditis elegans
gatgcattctcggcggctcgtcgtctcctggattctcgtacgacattaatggaaaagcaggaaatgttcttcactgactatggaatcatgccacttttcgtccaggataattatctcaatatgaaaaatgaaaagcatagtccaatccaagcgatccgtggaatacgaaaagctgcagacttcatttcccttggagaccttattgatcggcaaattcgtggtggaggatcctggaagttgctcaatgagcagagcatgatttctgctgcacttccagcgattgccactggtggacatttgaaggcaatgattcagttcccatcgtggttgggaaaaaactcgacagctggaaaacggaagagattgcttcagcaactggttcaacacacacatctcaagtaagttacgctaaattcattatgggaattaggaatttatttattactttcagagtttctgctggtactcactcatttgccactgattatgctccaatgctccgtcagaaaataacgaaaccacttcttgaacatgaagctgatggaattccagatgtgatcagcacaatgacagaatacgatctcatcaaagacgacactgaagcactcacagaaattgttgcttggcctggaaaaattgatccggctagtaaaattttgagtaaggtgaaagcatcattgactagaactctaaacaagactggtcgaatgcttccatactcgatggattctgtgtcaaaaggaaagaaacgaggtgtgaattcaattggaattgaaatggacgaagaaggaaatctagtggagaaatttgaagatgaagatggagaatccgataatgaggataacgaggagaaaactactgatgttgttattaaagttaggactggtggaggtgccggagcttcaaaatctgctcgaggtggacgtggtggtggtcgggctcgtggaggaagaggaagcaagaaatga

SEQ ID NO: 30293 - DNA, 264 bp, Caenorhabditis elegans
agccttcccatcaaacgcagcaacattcttcacagtcgaatggacatatcgtattcttcttgacttcaacgttatcgataatgtaactaaggaagccgaaaaaatatgcgctgaaagccaacttctaccggtgagcttttcaatattacttaaactaagttaacaaatgctcagcaataacctcagcttctcttatgcttaacaaccaaaaaaccattcaatttccagttcgaggaattgacgttgtcatatcttatcctgtga

SEQ ID NO: 30294 - DNA, 902 bp, Caenorhabditis elegans
atgtccgagaacgccgaaaccttcgcattccaggctgagattgctcagttgatgagcttgatcatcaacactttctacagtaacaaggaaatctacttgcgtgaattgatctcaaacgcctccgatgctcttgacaagattcgctaccaggtttgttttttcgcttctgagtcaattttttaaaatatcggttttaggcactcaccgagccatccgagcttgacactggaaaggaattgttcatcaaaattactccaaacaaggaggaaaagacccttaccattatggataccggaatcggaatgaccaaggccgatcttgtcaacaaccttggaaccattgccaagtctggaaccaaggccttcatggaggctcttcaagctggagctgatatttccatgattggtcagttcggagtcggattctactctgctttccttgtcgccgataaggttgtcgtcacatccaagaacaacgatgatgacagctatcaatgggagtcttccgcaggaggttctttcgtcgttcgtccattcaatgacccagaggtcacccgtggaacgaagattgtcatgcacatcaaggaggatcagattgacttcctcgaggagcgcaagatcaaggagatcgttaagaagcattctcagttcatcggatacccaatcaagcttgtggttgagaaggagcgtgagaaggaggttgaagatgaggaggctgtcgaggctaaggatgaggagaagaaggagggagaggtcgagaacgtcgctgacgacgctgacaagaagaagaccaagaaaatcaaggagaagtacttcgaagacgaagagcttaacaagaccaagccaatctggaccagaaacccagacgatatctccaacgaagaatatgctgagttctacaag

SEQ ID NO: 30295 - DNA, 885 bp, Caenorhabditis elegans
ctggaaatttctcgtagattttccaaaaaagcaagccgaacatcttaaacaagattgtgctggaacattttcaaacttgtggctctttactgtattttttttcttgaagagatacatgagctgcaattctacgaaattttcaattgcccaatattcatccaatattttaattaaaatgtagaaaacaatttggtacatctgaaaagtctatattttgcctgaaacgtatgaaggcgcaaaagtttaatgaaagctgccaataggtggaaaatgccaggtcatcaaaaacaactgcaacattttctgaaccccttttcaaaatttccaattaaaatgaaattcattttcagatcaatcaattatatttctgtaatttaatataaagcctcatggaaaaatgtggggcaacatattgtgatattccattttgcagaatacacaaatttagcagcttgttcataatgtgaaaaatgtaaaataattttttgaaggagtgtttcaaatttttttttgttttttttttacaatgtgggattacacgtaaaaatataccatgcgtttcctttctagatccctccggcaatatatacattttccaaagatcccacacgaacattttatttctaattacaggatcgtcattccacaagccaatggctcaagtcgtcggccgagcagcgtgaataccaattcaactcgagactggtgacaccaccaacttctttttcatcattttctcattttctcattattttcattcacttttcttcccattttcatttcatttctctcattgtcctccgctcttcctatctccattccctccgggttcgtgctctgtcgtctttttgccatttttgtgtctgtttcgaaacgaaacaataa

SEQ ID NO: 30296 - DNA, 326 bp, Caenorhabditis elegans
aagccaaaggatctcatgttactggagcaataaatttcccaatggcgaaagtaattggaccagatggatttattagtcagcaagacgttgacgaacagatttcaagtcttggccttacttctgccagtcaggttttcgtcggatgtaacactggtatgcaagcatctgtaatctttgttgctctagagagaagtggttttaaagcaaaactttataatgtaaggttttttcagaaatatttgaaagtgattcttggttttttttagggaagtatgttcgaattgtcctatcgcgcaccagagcttgtaaacgcaactgggatttag

SEQ ID NO: 30297 - DNA, 259 bp, Caenorhabditis elegans
atgaaattcttgaactcccttgctcaacaatatccgaatgatgtgaagcttcaaaatatcggaaactcatatgaaggacgttctattacagctgtccgggtaattaattttttatttgattccattttttcttttttgatgacgtagcatttttcagatagcagatgacgggtcaagtaagccaattgtttggattgacgcaggaattcacgcacgtgaatggatctcatataatgtggcactttatttgatttatacg

SEQ ID NO: 30298 - DNA, 213 bp, Caenorhabditis elegans
gttggtcgagcaatggcatctgctatccgtgcagtcaacaatacggattatacagttgtaaactctggagatggcctttgtaagttcccgacgatacgattattctggtaaactttatatttcagatcctgccgctggagcatcagatgattgggcaaagtctcgtggaatcaagtactcctacaccatcgagctctctccaattgatgattt

SEQ ID NO: 30299 - DNA, 819 bp, Caenorhabditis elegans
cacgaaaatcctgacaatggacttcatgagaaagtacatccatttggcaagatcagttcaaccaaaactcaccgatgaagctactgagtacatttctgaagtatatgccgatattcgttcatttgatatcaccaaaactgatcaagaacgaacaatgcctgtcaccgctcgtcaactcgaaacattgattcgtttgtcaactgctatcgcgaaggcaagattctcgaaaaaagtcgaacgagaggatactgagaaagcttacaatctgctccactttgcctgtttcaaggagaagccaaaggctcgtcaagagtatgagaagaagaagcgagctccacgaattgatggtgacgatgatgaggatcagagcgataacgaggacatggcaacatcggaagagcctcaatctagctccgttccgactgcagccaccccgcgtcgtggagtcagaaggcgtgctgaagatgatgatagccaggattctatgatggatactaccattggagaaagtcagccaactgctaagaaagcacgtactggaccggctgccatcggagttgatcgttataaggagcttcggaagtacgtcagaaaggcgttcgacgacattggaagcaccgacgatatggttgaacttcaaattatcacagacagtaagcaaatgtttcattaaaaatgtttattacaaaaatgttttcaggtgttcaaactcaagccggatcacacaagttcactgaggatgagctgaaggctggatacgaacaattggaaaacgataacgctgcaatgattgccgaagataagatcactctcatctaa

SEQ ID NO: 30300 - DNA, 236 bp, Caenorhabditis elegans
tcattttctggaaaaatcgattttttttcaaaatagaaagtgatacaattttcaaataaaacattattcaaataattaattttgaaatttcagccgaaagttggtcatgtccattcactgaatgttccgcaaaaaacaatcaaaatgtgaatgtcacatttgcggaaatcgtacgagaaatgaattatgtgcagaataaatcaagacaaagcaaatcatgttgctctctgatgtga

SEQ ID NO: 30301 - DNA, 808 bp, Caenorhabditis elegans
ctacctgggaaatttcaagcggaacttcttctcgaaaatctccacataccacaatgattactggtgcccagacgtcttccaatggcgacttattcactgttggttgggatgatcaattgaagattactgatggatccggagacacgaaaagcttcaaattgccgtctcaaccatgtggactagaagtttctgatgacttggcaattgttgcatgttacaagcacgtcgtcgttctgtcacggggaacgccaacggaaaatccaattgaattccattcgacttgtgtggcgttttgtgcggagaaaagtctggtggccgttggtggaaaagatgcgaaggttcatgtgtacaaactgaatggagatggacggctcgaggagttgaagaagattgagcacagtgcggaaatcaccgctgtctcattttccgacgatggggaatatctagcggtcactgatttggctcgaaaggtgattccctactctgtctccacggatttttccgtcacctctccaaactcgtggactttccatacttcgaaagtactgacagtcgcatggtcccctgacaatcaacgtcttgccactggctccatcgacaccagtgtcattatctgggacatgaagaagccaggcgaacatccggttattattaaaggtaatattgaaattgtcttgctagtatatgaataacgttttcaggagcccatccaatgtcatctgtgaatgtggtccgctggctcgatgagactacggtggtgtctgctggacaagactcgaacatcaaattttggaatgttccactctag

SEQ ID NO: 30302 - DNA, 340 bp, Caenorhabditis elegans
acaattttcaattatcactgcattcctgcccatgaaaaatcaactcggagaagcctggtcctatttgattctttttgttgctccggtggcagtatctctggttttcctgtatttttcacttccagagaccaagaataaaagtccaattgaggtgattaagaacgtgacgtataattttaaagaaacaagggtcttgcaaagatcgcgctgaaacccattttttaattatttttaattaagtataaaaatttcaaatttccaggtggaagaagccattgaggaattaccaaagttgccattatgccgatcaactcgttcgaattcaatcaaacctatttaa

SEQ ID NO: 30303 - DNA, 529 bp, Caenorhabditis elegans
atgggaataatcacgtatctcatttttgtacttgcaatttttatatttccaattgcttcaatttcgtgtccaagtggctttacacttctagtttctacatcccgttgtgcaaagtttatttctggcgagctgaattatgacggagcaacattgtcttgcaattcttctgggggaaagttgatatcaattcataatgcaatcgacaatcgtgtaatgatgcagtttgcgaattcatcaataaccaacgataattacaattattggctcggactcaagtgctcagaaactggaaatccaaacgcctgtgcttgggcagattcgactaaatttagctacagtggatttgcaaaaggtaactatgaagtcttatttttttgtcaaaaaattgatcagtttagcttatccaaacacagggtatggaaactgtgtatttgttgagacagcagggaatagtgctggacagtggttcagtgctacgtgcaatgcaatcagaactaatgctatttgcgaaattgcagtgaattcttaa

SEQ ID NO: 30304 - DNA, 253 bp, Caenorhabditis elegans
atggcaacgaaacctactgacattttgcgtgatggtaaattgattttctttaaatatgaggaggtgaggattttacattgttgtaaaaaaattactctttgtcaatggagcgtatttgggtaatcaaaaatatttaaaattatgaaattttcagaattggacaagccgaaatgccgttcgtcttcatgttgatccaacaccttatattttgtattggaggtacaaggatcctaaagttttcaatacaaaggag

SEQ ID NO: 30305 - DNA, 507 bp, Caenorhabditis elegans
ataattctatcaaaaccgttttcaaatcactatcggttactgtatgccttgtcgtgtgcggttggatgacaactgacttgattggtgcgcttacagtaatacttccgatggataggagcgtggcaagaatggttcagctctactgtggaacttttatattcacgtcgagtgcttttaatgcagttgtgtattataaattcaggtaatttatgtaaatgttctgtagggctcccatgcatcaccagcgtttagaaaataggcgaggagacaagaaaggtctgaggcaagcgtcaggccttaacagagcacctgcgtcctatgaaagtcctagaaaaacgttgaacatgaattatattatgacatcttttcagtcgtgactatcgttcagcagtgcgtacaatgctcggtctgtccgatgaagtttcaatagctaatattaatatctatcaacaagcttccgatccaccaaagtcaagtaatcagagaccatttacaaatacaagctga

SEQ ID NO: 30306 - DNA, 469 bp, Caenorhabditis elegans
gagcttctgcctacaaagtcaccactacgaaatccgtcaccgaaattcaaactgaaatctaccattacggacctgtggaggcttcatacaaagtctacgaggatttttatcattataaatcaggagtttatcactatacttccggaaagcttgttggaggtcacgcggttaaaattatcggctggggagttgaaaacggagtggactactggctgattgcaaattcctggggcaccagtttcggcgaaaaggggttcttcaaaattcgccgtggaacaaatgaatgtcaaattgaaggaaacgtggtagctggaattgcaaaattgggaacggtacgtgaactttgaaaggactttttaaaaatctaaaatttcagcactcggaaacgtatgaagacgatggcggtgcagcgacctcgtgtagttttattatgtgtacattgatggtgctgacgtattatttcgtgtag

SEQ ID NO: 30307 - DNA, 506 bp, Caenorhabditis elegans
atggctcgtttttctggaaagtctattattataactggctcttcaagtggaatcggaagatcggctgctgtgattttcgcgaaggaaggagctcaagtcaccattactggaagaagtgcagatcgcctcgaagaaaccagactacaaatcttgaaagcaggagttccagctgaaaaaataaatgccgttgttgccgatgtttgcgaagcatcgggacaagatgaagtcatcagaacaactcttgctaaattcggaaaaattgatatcttggtatgtgacttcattgacagtgagagaattataatcagcagttttaggtcaataatgctggtgctcttttgactgatggaacatctaatacggatcaagcagtagagttgtatcagaaaacattcaaattaaacttccaagctgtagtcgaaatgactcagaaaaccaaggagtatttgatcaagacaaaaggagaaattgtaaatgtttccagtatagttgctggtccacaagca

SEQ ID NO: 30308 - DNA, 190 bp, Caenorhabditis elegans
atgctgcgaagccaggccaagaatgtcgacctgacttcacaaggtgagcggatttcctcgaaaactatttatagattttaaattttaatttacagcagattctcggcatcaacaaaaacgaaagcaggctgagcaattggatgctctaaagaatccatcggaaccggcagccaagaagcaacacagcaag

SEQ ID NO: 30309 - DNA, 1483 bp, Caenorhabditis elegans
atgacagccgaggcggatctgttagagggatatgatgaggtaagagatttagagataaaaatacactatcagttacaccgtaaagcacaatctaatatctttttttcaatttgtgatgagcgaggaatgcttggaatcaatgaaaaataattgaggaattattatagaaattaaaaaattccagacaagaaaaaactggttttactttctttttttaaattttcttttttaagacggacacttaaaaatgatgtgaatgacctttatgagatagatggaattctacggaaaaaacacaaaaaatggaaaacttcgaaaaatcaggtggtggtggtgaccttctaaatttggaatatacttgggacaagatcaagtgcccataattattttctttgaaactccaaagtgtgttagaattttttttcagatttctaattttcaaaaaaataatttttctaacggaaccattgaaaaaggtgcttgaacattcacagacaaactagaaaagtttctagaaatgtttattaaaattttataacataaagaaaaaaattgtcatttctcttcttttattctttcttgaaaaattgacaaaaaaagtttgttgactgaattttacaaaacttgcctatttcatcttttagaaagattacagcaattgaaaacagttccaaatcgttcggaaaaacttttataaacattttcaatccatcttttcgtctaattcaccaaaactgactaaggaattccaagcataattgaatgaacacaaaaaatgcaacacaaaaatgggtacaaaaggactgtcctccacctaaaaacaggtccttccattctcatttttagttccgtctcgccattttaccgcttttttcatcagaatttttttttgcttgctgatgttttctaattttgtttgtttgtcaataattccccctccttgctaaaaggtgttccgactattcatggcagaggaggtggaagtgtccagtttttcggatgaattccttttaattctatttgcaaacatattttgatgcgggtgtgtgctcatgcttctttgaaggcatggttggaggaagtctttcgtttcaatgatacttttgagaatttctagattttttaactattaaaactaaagtgaaacatttcgaatggctgatttattttttaattctagacctagttcttttctttttcattttagcgttttttcggcgaaaaaaatttgtaactaaaagtggttttatcgacttttaggtcatttttaaagtttattcacttcggtcaaattcatttcgggttatcaattttacttttttaactttgtgaaatctagcaccataaaatcacacttgaaattttcaggagctcggcggaaacgagtctcaaaaacgtgactgtaagggcatcaccaccgctatagtcgtggtgctcctcatattggtaatgatattcgcagcgctggtattcttcacaccac

SEQ ID NO: 30310 - DNA, 1483 bp, Caenorhabditis elegans; identical to SEQ ID NO: 30309

SEQ ID NO: 30311 - DNA, 528 bp, Caenorhabditis elegans
agcttcttcttcaccaacggagccgcccatgtgaacggctactcaaaaggcgcacttcacccgaacacccctccagctcacattgtgaaaatggaggagataaccggtggtggaagtgttaaaagttttgtgatgtctcaagaatctgcggcaacatcgacactgttgacatcgtcgctaatgaaaataaaagttgttttggatgacatgaaagcatcaattcatgcaggtgagctctttatagctcttatttttggatcggaagtaaagtgtatagtaggtgtgtcaggaatacataaaatctaaaaataagattcttaagaatacaccctaaaaaaagtattctttccagaacgcgaactaaagcgaataaaattcgagtggcaacaagtgacccgtcttatcgatcgatgtatcatgttcagctatattctcatcacaattgccttcgccatggtcatgttggcctcccgtgacccgccaatcgtgctcaatgatcttattatggattcggtgaagagcacctag

SEQ ID NO: 30312 - DNA, 586 bp, Caenorhabditis elegans
atgcgctcaatcctcgtatcccgccgtttcgcccacgtgctcacaagcactcacgcagctccatccacctcgaacatcccaaccacagattctcatcacctgacccatccgtcggttcatcgtcagcacaccaacagctacatccacggaacctcgaatattccgctcagaaatgagactttgggacagacactgagaaatactactgaaagagttccggataaggagttctgtgttttttccaaatacccaattagaaagacctatgaggagttctaccatgacgtgagttcccctttcctaggctctttgacaaaaggctgtaaactttcaggtccgtcaaatggcagcctcgctctacactctcggtctcgagaagggagatcgtgtcggagtctggggaccaaactactacgaatgggtggttctccagtatgcatgtgcatttgcaggagtcattcaggtcaatgtcaatcctcactacctccacgaagaacttcgttttgtgatgagaaaaactggaatgaaggtgctctttgcaccaaagagacacaagcacagcaactatgttcacacaatgcttgag

SEQ ID NO: 30313 - DNA, 495 bp, Caenorhabditis elegans
aagccgaatattctaattatggatgaagccacatcggcactcgacgcctcgtcagaatatctcgttcgaattgctctcaacaaattgctcgcgaatagtaaacagactgttatgattattgctcacaggtaaagtttttagagcaaaaaattcaaaaaaaaatctaaatttttcgatttttggcattttaaaaattacttttttgaaacattttggagtatacaagatgcgtcgtaaatcgacatcttgtcgatttacgcacatcgtgtgtactcctcgaggaaaacaagaaacatcggaaaaatgtcgatttttaacaatttccgaaattccagactgtccacaatcaagcatgccgatcaaatcgttgtagtcgatagaggaagtgttgcagaatctggaagctatgacgagcttatcgctatccccgacggaattttcagaaagctggtggaaaagcagacatttggattcaaaaatcccgaatcttattaa

SEQ ID NO: 30314 - DNA, 724 bp, Caenorhabditis elegans
atgctctaccaactgcttcatactgtgctctccgtcgttggagtctcattgaacgcgttcatgatgtatctggctctcacaaaatccccgaagatcatgcttccatgctcggcaatcatcacgatcaagaccttcacggatatcctgacatcggctatgagcttctttgttatgcaaaggttggttttcttttattgtttcagctgatttctaatatcattcattgattttcagaatcgtcaccgacgggtcctcaatccacgtcatccccaccggaccatgcactcacctcggaccaaccgcttgttatattggtcacatgttcatgctatgcttcctggagtgcaacctgatttggatgatctcttcctacatcttccgttactacatcctctacgtccgtgatccttccatcaagagtcttgtctttgttgcaatctgtctctccatcccttccttcattcatatggctacttggattagcaactacgacccagctgttgccatcgccatccctgaaaatgttggaatagaagctagggatatggtacttggaggtaaaatcgtaacatggtcggcactcactcttataattcaactcttcatcacctcaatcctagttttgattgcttatgcctggatccggaatacacttttaagttttgcagtcaagatgggatctgacaaaaatgatgttaagaaattgaatacaagacttgtcaag

SEQ ID NO: 30315 - DNA, 487 bp, Caenorhabditis elegans
ataattctatcaaaaccgttttcaaatcactatcggttactgtatggtttgtcgtgtgcggttggatgacaactgacttgattggtgcgcttacagtaatacttccgatggataggagcgtggcaagaatggttcagctctactgtggaacttttatattcacgtcgagtgcttttaatgcagttgtgtattataaattcaggtaatttatattttctgtagggcttccatgcaggagtcgaaacttcagcctcacagacgttcaaaaaatagacgaggaggccggtaggtattaggcaaggaagtcctagaaaagcatccaatgtgaattaaattatggttttatttcagccgtgactatcgttcagcaatgcgtacaatgctgggtctgtccaatgaagtttccatagctgatattaatatctatcaacaagcttccgatccaccaaagtcaagtaatcagagaccatttacaaatacaagctga

SEQ ID NO: 30316 - DNA, 982 bp, Caenorhabditis elegans
atggctacttttccacactttggaactgatgcagtccacgttggccaagaaccagaacaatgggatattaatcaggtttgtgatatcacctggggagggtatgacatttttttctgtttattttgatggttttatagaatttcctttctttttccgctacttgaaagaaaatttataaaaacagttcggttttgcagcttgaaattgaccagttttccaaaaaaagcaaagtcccaatttgcctaaaacttttggcaatttccgatttttaggcatattcggcacaacggtagtttgtcgacaccaactttgcagttttcgcagttaaatatttattgaaaaaaaaaaacaaaatttcaggtagttccaccaattagtatgtccactacctacaagcaggataacccaggagagccgaagcggtacgattatgctcgtggtggaaacccaacacgcgatgttcttcagaaaaatttggccgctcttgagggcgccaaacattgtcaagcattttcttctgggctcgctgcatcttcagccgtcatcaatcttctcaatcatggcgatcatattgtgtgctccgatgatgtttacggaggaactatccgttacattcgccaaattgctgttaaaaagtatggaatggaagtggattcggttgatttaactgatgttcagaatctcgagaaagccatcaagccaaacaccaaaatggtttggttcgaatctccatctaacccgcttttgaaggtggttgatatcgcagccgtggtacagactgcaaaaagagctaatccagaaattgttgtggttgttgacaacactttcatgactccgtacttccagcgcccactttctctcggcgcagacattgctgttcattcaataaccaaatatattaatggacattctgatattattatgggagccgctatcactaataatgacgagttccagcagcatctacacttcatgcaacgtg

SEQ ID NO: 30317 - DNA, 975 bp, Caenorhabditis elegans
atgtcatctcaaattcgcggctccaaacaggtaagcaaaaatgattggacatagctttatcctcaaagccctccctgggctgttaaatgggacgagcgtgtatgttctttgtcttgccccgaaggacccgggcgcgttctagtcataccagtcagaatgcatctccaacgttaaactatttatcttcagcatgaagacgttgaccccgtcacgatcaaaaaaattgaggaagcatatgtcatgcttaacggtcctgatggtgcaaaatgcagctcgcttcttaagaaaaatttgaccaaggatgtcatcgagaagctcaaaacaaagagtacaaagctcggagccaatctttacgactgcatcagatcgggtgtttactgtttggacgcactggtcggggtatacgctccagatgctgaagcttatactttgtttgctccattgtttgataagattattgaggattatcatgggctcggcccggatcagaagcaaccaccagtcgatcttggagagggaaagaccaaggagttcccaccgttggatcccaagggaaaatacatcaaatcgactagaattcgctgtggacgttcgttgaatggatatcaatttaatccctgtctcactgaggataactatctcgagatggaagaaaaggtgaagaaggcattttcagaattttccgacgaggaactcaaggggacttactatccgttggatggaatgagcaaggatacccagaaccagttgattgctgatcacttcctgttcaaggaaggcgacaggcatcttcaatacgcaaatgcttgcaacttctggccaaaaggacgcggtattttccataacaacaagaaaacttttttgatttgggtgaatgaagaggatcatttgagaattatttcaatgcaagaaggatctgatgttggtgctgttctcgaaagacttatcaagggagttcgtggaattgagaagcag

SEQ ID NO: 30318 - DNA, 384 bp, Caenorhabditis elegans
atgtcagacgccgacagccagaaacaaatcaagctcacctcttctgatgataaaactttcacggtattttttaaattataatttcctttaactaaataataaaatgtaagtttataggtctcacgaaaagtgatcagtcaatccaagaccatcacagatattatccaaaaccttggaattgaagaatctggatccacttctgaagacacgattccacttcagaaagtgacttctactatccttgagaagattatcacctggtgcgagcatcacgccgacgatgagccaaagaaagtcgacgaaaacaaaaagacggtagacattagtgaatgggacgccgaattcatgaaagtcgatcagggaaccttgttcgaaattatcttg

SEQ ID NO: 30319 - DNA, 606 bp, Caenorhabditis elegans
atgtaccctgatcacatgttcaaatatgtgataatcggagacggaggcgtcggaaagtctaatctattgctgcgattcaccgacgaactttttgatccgattcatacaacgacgcttggagttgaattcgggtataaggatctgcagattgacaaatacaaagtgaggcttcgtgtttgggatacgtgcggacaagagaactttcggtcaattattcgtgcctactatcggaatgcacttggagcacttcttgtttatgatataacttgtcgtaagtccttcgttcacttggagcagtggctctctgatcttcgacaacatgggcatcccgagatggtgataatgctgattggcaacaaaagtgatcttaaagcggtccgtgacgtcacaacggaagaaggtgaagcatttgctaaaaagaatggcctgacgtttatggaaacttctgcaaaagccaataagcatgtggagaaggcattcgtgaatacagctcatgagatttataaaaagcttaagcttggagtgattgaagacgacgatgtgaaaaagaaaaaaattggtataattttacgctctagatccggaaaagagaaaaaatgttgttaa

SEQ ID NO: 30320 - DNA, 612 bp, Caenorhabditis elegans
atgtcatcagatcatgtgttcaaatatgtcataatcggagaccgtggcgtcggaaagtctaacttgctgctgcgattcattggcaaacctttcgattcaatccatccgtcgacacttggaattgagtttggttttcgaaatctggaaattgacaggaaaaaggtgaagcttcatgtctgggatacgtgcggccaggagagatttcggtcacttgttggatcatattatcggcatgcaattggtgcacttcttgtctatgatattactagtcgtgagtccttctaccatttggagcactggctcacagatctccaacgactgggtgatcccgatatagttatagtgttgattggcaacaaaagtgatctagaagcagatcgtgaagtcagaaaagaagaaggtgaagcatttgcaagagagtttggacttatatttatggaaatttctgcaaaaaccaatgaatatgtggaggaagcatttgtcaattcagctcacgagatttatagaaagcttaactttggaattatcaaagagatatgtgtgaagaagaagaagaagaaaatgaatataattatacgatctatatcgggaaaggagaaagcatgttgttaa

SEQ ID NO: 30321 - DNA, 869 bp, Caenorhabditis elegans
atggttggcttctcggtgtcccgaaagctatcccaagctcaacaagttcccgaccaggacctcaattttcaccacaaaacccgatttatcatcctcgtaatttgcacattatgcctgtcaattgctcaatccgatactctcactctaaacttcacgatcatctgtatgtctggagatggtgctccagtgagcaatagaagtgctcttacaaatctggaaaatatggaaatgacgctggtaaatgcatcgggaagtttgacggacaacgtggagaatatggagcacaagattgcggatggaaggtataattattcgccgtcggagaaaagtttgctcttctcgctggttgccgttggagcaatggttgcagtgtatccagttatgcttttgattcaggtgagcttcaatttaaagttaaatttaaataaagatgcttaaagtagttttaaaaacgtcaagaattggtttcaaaaatatcaatggttgctcaaaaaccagcttcaaaattgttcaaactggctctaaatttccaaaaagcgtaaagattgaaaaaaaatttggagcaattatattggcttttttgcagtcaaatgtgctcctaagtagcaaaataacataagtttcattcgtaaaattttcagaaattcggctctcgctcaatcgtcttctgggtgggaatgctgtctacagtgtccaccgcacttatcccttggatggcatacatcggattctggcctctactggttatgagatttttccagggagctgggctatctaccagcttcaccctaattggaattgtcactcgtcaatggtctatgcaagttcaaagcgccttctacatcgcggttctcacaactttcttccag

SEQ ID NO: 30322 - DNA, 306 bp, Caenorhabditis elegans
atggctacctggattgtcggaaagctgatcattgcatctttaattttgggaatacaagcccaacaagctaggtactggacgtttctaaatattacacatttgtcaattttgttaataagcaaaaattttcattaacatataaatagatattcttgggaactttctgatggagttcaatattatcgttcaaagaagtaaccaaaaaagatctttaaaattttcagaacgaaatcacaagatattttcgaagatgataatgataatggaacgactacactggaatcgctagccagattaacatccccg

SEQ ID NO: 30323 - DNA, 610 bp, Caenorhabditis elegans
atggatatccagtggtttgcaacgggagttggtgcagccgttgttttgtatattttttatcatttcatcagaattattttaaacatactggttccatatgccttctgtcaaccaattgatttgaaaaagaaagctggagcttcatgggctggtgagcattttttgccggtttaattttgtgaaaattattcaattttgtcttctgaaacaagagatttgtaatttgaaagttcaagtgatttcatgaatgttgtttgcagtggtcactggagctactgatggaattggaaaatcttattcgtttgaattggctagacgtggattcaacgtctacattgtttctcgtacccaatcaaaacttgaacaaacgaagaaagacattttggagaaacaaccagatattgaagttcgatttgcaacttatgactttacaaatccttctgtcactgattatgaaaagcttttgagcaaattgaatgaagtgtcagtcggaattttgatcaacaatgttggaatgttttttgactatccagagatgttgcataaaataaacggaggaattgattcaattgcaaatgttataattatcaatacattgccagcaaccttg

SEQ ID NO: 30324 - DNA, 1184 bp, Caenorhabditis elegans
atgccctcttacaaactgacttactttgatgcttgtgggtttggagagtcagcacgaatgttattccatcttggtggggtaccatatgaggatgttcgactgccgacgatcaatgctgttccgggatttcaaagtgacgaattttcagcgttgaaagacagtgagtcaaactaatagcccactgagcatagtccacctttaaagaaacatgagcccttccacttttcggcggaaaattcatattcaatcagaaaaaagttttgctaggaaaggtttggaaagttgtggaaaaaccgataaatttttgtgattttctcgatttttctgaacatttcgggaaacttcttgaaaacttaaaataattttagaatcatctggatatttatggagttttcaagaaactcctagaaatttttgaaatttcatgagacttcttgacactttctgaaaacttctggatagtcatgcaatttttgatttcaaggagatgtcatggtaattctggaataaaaacatttggaaatttgaggaaatttttggaaccttcagacaatttttgatgacttcaagaagcttccaggaaactcaagaaactttttgaaatttaaaaataacttttgacaatttgacaattttagctgaaagaattttgctaaccagacaatcaaaaaattacattgttttcagagaccccatttggccgattcacagttctttccatcgacggttttgatcttgctcaatcttctgcaattcatcgttatctggctagaaagtttggctacgctggaaaaacaccggaagacgaggcttttgctgattctatcgttgatcagtttaatgagtactacgcgtcactccatccctaccgtgatgccgtgaaaactggaaaaacaatggaagaagtgaagcaaattcatgacaaagtttacattccagcaaaaaacttaatgttcaaaatattgactcgaattcttaaagagaacaaatcgggtttccttgttggagatggattgacttgggcagatctggtggtggctgatcatttgtatactctgacgaatctcaaggaacttgatccagaagatccaattcatttaactttgagaaaattccaggagaaaatatttaatcttaccgagttgaaagattacatcgagacaagaccagtgacgcttgtgtga

SEQ ID NO: 30325 - DNA, 282 bp, Caenorhabditis elegans
atgcacggaagcgggcacagtctaacgggcgctccgcatcaaattccgccgccacggacacagggagccgccaccggtggccaacaactctcggcgacagctaatcaatttgttgataaaatcgatccgttccataataaaagaggaacttctagacgattgtgagtggctggtttaatttatttttatcgatttttcccgatattttcaggcgcatcaacaacagcagccgatataatgttgattcggctcaagaactcgtacaattggcgctcatcaaag

SEQ ID NO: 30326 - DNA, 625 bp, Caenorhabditis elegans
atgtccgctgaagctgccgccgtcgatgtcccagaggctccagttgctgccaccgctccaatcatgtacaagttggtatcggaggataaacaagaatttacaatcagtgcgaaagcagcaaaaaaatcgattgtgctcaacgatgtgatttctaggcgtgctcctgaggatagtgcgccaatggctccaattccagttgaaaaggtcaccggagacatcctgaacatggtcatcaagtggtgtgagcaacgcaaagaagacgagcttccagttgatgatggcagtattccaaagaaaatcgatgttccccaatgggatgccgacttctagtattccaaagaaaatcgatgttccccaatgggatgccgacttcttgaaaatcagcagcgatgtgctcttcgacttgattgttgcctgcaacgaacttgatgtgcctggattgatgaattatggatgcaagatggttgccgacatggctgccggaaagtctcctgaagatatgagaaccatctatggaattccaaccgataaacaggatgctgatgcagctgagaaagctgcaaaggaggaagctgagaagaatgctacagcgcagagggacgaagctggaccatctgcctcctaa

SEQ ID NO: 30327 - DNA, 627 bp, Caenorhabditis elegans
atggctcgtttttctggaaaagttgctctgatcacaggtgagtaagactttactttattttttgaaagaaatctcatccttaaaaacatctttaatgtcaagacaaaggctttaatgtcaagattgtgctcattggttcaattttgtcaaacaaaaggcttagaatttcaatttcaaaactcatgaatgtttttcttaggatcttccaacggaattggccgtgccgccgctatcctctttgctcaacaaggggccaaagttaccataaccggaaggaatgctgagcggctgaaggaaacccgacacgaaataaaaaaatctggaatcccggcagaaaatattcttgcgattgtagccgacgtgatcacagatgaaggacagatgaggcttatcaacgatactgttcgaaaatttggtcaccttgacattttggtgaacaatgccggaggagcattgatggatgctcaggggcgtgttggaatggatcaggatatttcggtgttcgataacactatgcagatcaatatgagaagtgtggttactttggtgcaaaaggccaaggagcatttgatcaaatcaaagggagaaatcattaatgtttctgccatggcagcaggacaccatggg

SEQ ID NO: 30328 - DNA, 416 bp, Caenorhabditis elegans
cccatagcaactttctacggaatgtccaaggcagctcttgatcagttcactagaagctctgcgatttctctgatccaacacggagtccgcgtgaactccgtcagtcctggatttactaagacaggattcggagaagccatgggatttccaccaatagcgatgaaaaaggtaaaccttatattgtgatctttttaaaatatttattaaaccaggtcataagcttctacgaatcccacaaggagtgtgctccgagtggtgcaattgctcaacctggagacattgctcaagtcattctattcttggcggatagaaccatgtcctcatacatcatcggacaatcaatcatagctgacggaggatcctcgttggtgatgggaatgcacgctcatgatatgcttgacattttgaaggcatga

SEQ ID NO: 30329 - DNA, 1190 bp, Caenorhabditis elegans
atgagcgacttgtttgcagctctcgatgaaagctccaaaaatttctggatgactgttgagctctttatgcgacctatatttgactatctgaattttgcacatttcattgtagcagttattggtgttttctctactctttttcatattctagtgttaaccagaccatcaatgcgagcactgactatcaataactttttgttaggaattggaatttgtgacctaattgggatgatttcgatgatatttcgaggttgtacaatgttgtacactaactatgaaagttcagttttgttgaattggtacgataattggtctttgtgaaatgagttccagaactcaaaactaatacagataaaggatttgagcttgacggacggaattgtgtacggttcactaaaaccggtacaacgtttgaagtagggctcccacgagtagggctgtacaaatcggcgtccggtcgtccgattttgacaccaccggacgcactgcgtccggttttggggtaggtttccacggcggccgacaatttccgagtttcgccactcactatacttaatcagcaattttatagtgagtggcgaaactcggaaattgaaaaaaaaaactcggaactacccccaaccggacgcacatgcgtccggttcggacgaccggacgtccggttgtacagccctacccacgaggttgcggtcgccgcttttttccaaatgtatagtgcgacgcggaaccccaaacgtgtcggccgcctccaaataaccccctttttgcactaccttgcgcacacaccaagatactcgtttcatgcgaagctgcggaaccccaaacgtgtcggccgctccaaaaaactacgtttcgcatttcattacattgatgcttcaaatgtattattttcccaatgcattcaaataatcatcataatagtccgaaaaattcaaagtgcatgttcaggattattggttttctaacttttgtaaacatactaaatctcacaatgattttaagaaaatcattttcactgaaatccgaaaacttgtaaatttttccagtaaccctccctcttcatatattttcatgatagcaatgaaatacatccagtgtataacaaaagtaacggaacgactcgcaatttggtatgctgttgcaatggctgtactgagatgccttttcataaaacttccgataaacaaaaa

SEQ ID NO: 30330 - DNA, 1081 bp, Caenorhabditis elegans
atggtaagtttttcatttaaccaacgagtgaaattatttgaacatgatattttacagaacctcatccttctttcttcactctttgtgatcactttcgcttttgcaccaatcagaccgattcccgaagagctcactggtcaagatcttgtcgaccacatcaactctgcagcttcaacctttcaaacagaaaactatgccgtgactcacgaaaagatgcacacaagaagcatgcatgagaagttcaatgctccgttccccgatgaattccgtgcaactgagcgagaattcgttcttgacgccaccccactcaattttgacgcccgtacccgctggccacagtgcaagtccatgaagttgatccgcgagcagtccaactgcggatcgtgctgggctttctcaacagctgaggtgatttccgatcgaacatgtattgcaagcaatggtacccaacaaccaatcatctccccaactgatctgctcacttgttgtggaatgtcatgcggagaaggatgtgacggaggattcccataccgagcattccaatggtgggctagacgtggtgtcgttactggaggagattaccttggtaccggttgcaagccatatccaataaggccatgtaatagtgataactgcgtaaaccttcaaactccaccgtgtagactgtcatgccaaccaggatacagaacgacctacaccaacgacaagaactatggcaagttgaattggtacatctcctatagaaaacgttaacttttcaggtaactccgcataccctgttccaagaaccgtcgctgctattcaagccgacatttattacaacggacctgttgtcgccgcgttcatagtatacgaggactttgagaaatacaagagcggaatttacagacacatcgccggtagatcaaagggaggacacgctgtaaagctaattggctggggaacagagaggggaaccccatattggctcgctgtcaactcttggggatcccagtggggtgaaagcggaacattccgaatcttgcgtggtgttgacgagtgtggaatcgagtctcgtattgtcgctggattgccgagataa

SEQ ID NO: 30331 - DNA, 541 bp, Caenorhabditis elegans
atgcaattatccgcctggttatactgaattgcagtatgcaattcgagttgggcgaaagattatattcacagaaatgatgtctcaaacaatatttgcatatttgaatggctccttgaatataatcccagctgtcttgtacccagtcgttgccattgtcttagtaatacgacttttaaaaatgagaaaggatagaaaaaatgtgataagtcgacggcagaatgttaaaaggtgagtagtacattttatacttctggttcatcctttttcctacagagagcacacgacaactctagtcatcctattatcaattacattcttcatatctcaattgccttctggaatattcctatggcttggaaatctctacaagttcaacactgtcgtgagaagtattgtgttcgaaggaaaaaatgtcacctcaattttgtttacggttaatgccacgtcacactgtatcatttttgcggtactgagctcccaatatagccaagtagcaagagaaaggttcagatgttgcagaaaaaaggtaatttgttgctaa

SEQ ID NO: 30332 - DNA, 1225 bp, Caenorhabditis elegans
gtcccagatgaggttgactggcgtgatacccacctcgtcactgatgtcaagaaccaaggaatgtgcggatcgtgctgggccttctccgccaccggagccctcgaaggacaacacgctcgcaagctgggacaactcgtctccctttccgagcaaaacctcgtcgactgctctaccaagtacggaaaccacggatgcaacggaggactcatggatcaagctttcgagtacattcgtgacaaccatggtgtcgacaccgaggagtcatacccatacaagggacgtgacatgaagtgtcacttcaacaagaagaccgtcggagctgatgataagggatacgttgacaccccagaaggagatgaggagcaacttaagatcgctgtcgccacccaaggaccaatctctattgctatcgacgccggacaccgcagcttccaactttacaagaagggtatgttttgtgggaagatgtgaggggggggggggtactagtttttattgacgggtcagttttatttgcattttggatgataatgataagaaagctagttactcgggtttttcatcagagacagagagggcaatagtgataagagaactcgtgtttttgaatgataccctcttgacaataatagtttgggttcgaacttgaatgtgaaagtggtgaaggaatttataaattgtttagtagcaaagtataaccccatcagcctaggccaaagtctaagcttaagcttacgattaagcctaagcctaagcctaagcttacgcctaagcctaagcctacgcctaagactaagcctaaacctaagcgaaagcctaagcctaagcctgagcctaagcttaagcctaagcctgagtctaagccgtagctcaagactaagcctgagtctaatcccaagcctagctcataagcctaagcttaaacaaatgcctaaaccaaagcctaagcctaggcctaaaactaggcctacagcataaactcagcctaagttccaccgaatatcatccattttcaggagtctactacgatgaggaatgctcatccgaagagctcgaccacggagtgcttctcgtcggatacggaaccgacccagagcacggagactactggattgtcaagaactcgtggggagctggatggggagagaagggatacatccgtatcgcccgtaaccgcaacaatcactgcggagtcgccaccaaggccagttatccattggtctaa

SEQ ID NO: 30333 - DNA, 855 bp, Caenorhabditis elegans
gatttccaaatgttgtctatggatattgcatttatttcattgtgactggaaattccgccggacagtgggggagtgagcagtgtagtcagttgatgaattttgtctgtgaacttccgactacgatccgtggtaagttagtttagctgcagacttcaggggtcttttttcactgaaattgacgagaaagtgaaattttgcttaaaaaacgtgcggcgaccttgcggcaaaaccttgttttccaggaagtctgcgacacactatagttatactcaattctaatttgacacgtggtgtcagagtaccccatttcggtttgatctacgagaaatgcgggaatatataggcagatttcttgactgatgtcgcacggttaaaaatgtgctgacgtcacatttttctaggagaaaagttcccgcatttttgtaggtcaaaccgtaatgtgactgcctgacaccgcgtgaattgataacttcagatcccgattgtaaatataactataacaagaattgctacatccgattcgatatcaccctcacaattcctcaagctcaacggttttgtaacgagaaaggcgccgatttagtatcaattcattcggcgaacgaaaatcgatttattttaacaatttacgatattcacgggcagattctactgggcggattggctcctgcagtggattttattgtttggctcgatgggtcaccaactacttatagtaatttactgtatttttatgatacacggagctgtgtactcatgacagttgcacgtggaggtccttatgatggcgattggtatacaatgaactgtaattttcaggagttctttttatgcaaacgggctattgatttttga

SEQ ID NO: 30334 - DNA, 269 bp, Caenorhabditis elegans
atgcctggctgcttgccttcagtgtttgaaaaatggagtcaatttctgaagtttcataggaggataatattgatcggtggagcctctgagattattataatcactgtagcagttattgttacctattgtctaacaaaacaaccagcctgcgaaatatgtaggttgagaggcaaaatttttctaaaaatggtttacagataccggcacaagctcccctgcgtttcaaactagtactgtatcaagtttcacagaatccttgtctaactcag

SEQ ID NO: 30335 - DNA, 556 bp, Caenorhabditis elegans
gttatccaaataacgtgtatggagattgcattcactatatgactactggaacgcaagctggacaatgggcaagcggatcctgtaacgagactatgagctttgtgtgtgagctaccagctacgatttatggtaagaactcgaggatccattacgtcaacgtatccaatcaattccagatgacacctgcgactacaactacgacaggtactgctacacgcctcattacttcataaaacactcgagtgaggctcagcaattctgtgcaggattatgttccaactcggtatcgattcattcgggaaacgagaaccgattcgtgctgacactctacttatacacaaactcgtcaattttaattggtggaattgctccatcttacgattttgttctttggtatgatgggacacaaacgacttataataatatcgactcgattgcgaatggaaattgtctttacttgaatgacctgaacactcgaggaaattggtttgggctcaactgtttgacaagcaggagttggttcatttgcaagagaaggatcggtgaaaattgctag

SEQ ID NO: 30336 - DNA, 478 bp, Caenorhabditis elegans
atgggagcagttttaaacactttccttgctggcgagactccacctttaaagtcttcagccccatcggatttctcatgccagcacggcttcaccctagtcaacaacaagtgttggaaactggtaacttcaaatcaagcaagaccagacgccgacaaaatttgtaatgggtatggaggtgccactcttttttccataaaaagtgaacaggtatcttgcaaaactgaaaagtagttctgtgttcgatttgctcggcaaattttcatttacgaatccttccgcgatttgaccggcaggaaaagaaaaaataataagccaattagatcccgctttcaggacaacagagcaatgatacactttgtaaaaggccaggacattgattttctgtggtcgggtctgctgtgtagtgctggagaacccatctcatgcatatgggacatcgaaaacggatcaacagcgaattatagcaattttgcagatg

SEQ ID NO: 30337 - DNA, 316 bp, Caenorhabditis elegans
atggacgccaacgactatccgcgtctctactacacaagtgtgagctcgactccctttataatcgaaaaaaatgcatttaaaaaaccttaaagaattcaaaaatcatcgagaaaaaccgctttgcagatgccctcgagcagcacttcaatggtcacgacgacgcgattttcgacatctttttcgccgtcaattccctgccatcgacaagaaaacttcagacgacactcaacttcagctctagcaaaacgaaacggctcagaaagcgaaaaatcagctgaaattcgagaaaatccggacgaaatcgaagtttccagag

SEQ ID NO: 30338 - DNA, 1125 bp, Caenorhabditis elegans
atagtggtaagaaagtgtgccgattttttataatgtcgaaaatttgaaaaaaaaattaattttttttctacttattgaaagttttcagtatcaaatttccgatttctgatttaaaaatttttcgatttttcgaattttcaaaaaaaaattattgaaaattttctgggaataaaaaaatatatgtacatatttaaaaaatttcgtttaaaaaaataaatttttctgttgaaataaaggggaaattttcaatgtttagtttttttttttaattagaataaaagtagacagaaaccgaaaattgttttaaaattcaaaaaatataaaaatttcgtacattttttggaatacttttttccgaattttgatttcaaaaaatattcaaaaaaaattgattaaaaataatacaatttgttcaaaaataaaagtaaacatttattttggggggaaaatttttaaattttgatttaaaaaaaaatgcactgaaattgtaacaaaagttgttttaatttttgaaaaatctgtttcaaaaaattttttttcgaaagttaaattccaaaaaaaaagtatatttttcgatttttttttgaaaaattatatagatttgtaaaaaaaaaaaaaaaaaaaaaaaaaggaaaaaagtctcgaaattttgaaattataaggaaatgcacaaaaaatttcaaaaattaggaacttttctgatttattgaaattggaaaaatcggctcaaaaatgcaccaattttttaaaactttttttcaaaaatgaatagaaaattggtcaaaaattattgaaatttgatatttacccccaagaaaaaacctaaaaattatcatttttgaactttttgaaaatcaaaaaatttaggttttttttcaaaattttcaaataaaatctcaaaatttccaaattaaaaaataaaataaaaattttccagacgacgaagtttggacaccgtaccgtccgccaccgaatcgggaatactcatcatccagtgaacctatgatgggtgatctcacgtttagacttcaatccggtattcacaaaaaatcaattgctgtcgaaggaactgaaattgcgcttcgagaccttcgaaatgaggctctacagtttatcaaggaaatt

SEQ ID NO: 30339 - DNA, 841 bp, Caenorhabditis elegans
ctatcgaattcatcaacggactgctccaagttaagatgagcaagcggtatacggtgacgaaagcgcagtcgcagatctggatgcaggtaggcatatggagaccttttttgggtctcgcagcgaaaattttttcgagctgaaaaagttaaaaaaagaaaattaaagattttttctgtgaattgaaagctgaacttttttttactttctactgtaaaaattgtgaaaaaaaattctaaaatatttttttaacgaaaatttaaaattttcaaaatttggggaaaaaacacaaaaatcaggaaaaaatacgaaaatctctttttttttaatttgaaaaaatccgaaacatcggctttaaaaaatttcgaatttagaaaaaatgtttgaaatttttttttaatagcaaaaaaaagttttacctgcaaaaaatcgggaaaaaaatccgaaaaacttagaaaaaaattgtatttttttaatttgcaatcattttaaaatcatatgaaatttagaaaaatccaaaaaaagtaaagaaaaattgcaaaaaaaaataattttaatccaaaaatccgaaaaaaaatttacttacagaaaaatcggtttaaacatttttttaaggataaataaaaattgttttaagcgcaaaaatcctttgaaaaaaaataatacaaattgcaaaaaatgcattttttttttgttggtttttcaataaaaaataatttcgaaaattaatttttttacgaaaaaattgaaaaactttttttttcagaactacaccctatggtcggatctacgagtactggaaaaagctgtcggtcaacgattcgtaactcatgaaagtgatgat

SEQ ID NO: 30340 - DNA, 819 bp, Caenorhabditis elegans
gagaaactgggcaccttggcgcgaaaatccaaacggaacacgaattctcacaactttatcaaatattcgctgaagaagtcctcggatccggacagtttggtactgtttacggaggaatccaccgacgaaatggtcaacacgtcgccgtgaagctcatcgataagctgaaattcccgccgaacaaggaggatctgttgcgggctgaagtgcagatcttggagaaggtcgaccatcctggggtggttcacttcatgcagatgcttgagacgactgatcggatctttgttgtgatggagaagctgaagggtgacatgttggagatgatcttgtccagtgagaaaggaaggctttcggaacggactacgcagttcctggtggctcagatccttgaagctctccgttaccttcatcatttgaatattgtgcattgtgacttgaaaccggagaatatccttctcaactcgaactcggacttcccacaagtcaagctttgcgatttcggattcgctcgaatcattggagagaagagcttcaggcggagtgtcgtcggaacgcctgcctacctggcgcctgaagttctacggaacaagggattcaatcgatcgctcgacatgtggagtgtcggtgtgattgtctacgtctcactgtcgggaacgttcccgttcaacgaggacgaggatatcaacgatcagattcagaacgccgaattcatgtacccgccgacaccgtggaaggagatctctgagaatggtagggcgaatacttttgttagaaaagaatctgtgagatttattgaattcttttgcagctatcgaattc

SEQ ID NO: 30341 - DNA, 261 bp, Caenorhabditis elegans
atgtcgacattttcgcgtcaagaccaacttccgagtcttccggttccatctttagtggagactttagagaagtacattgattcaggtaccccgcggccgcgagaaaactcggccaccagttgtaatttttcagcttcggcaattctgactcctgccgagaaggcgcgtgtcgagaaagaagctcatgaattccagcactcggagctcggagctcagctgcagtcggctttagagaatcgagcaaagaatcataagaattgg

SEQ ID NO: 30342 - DNA, 511 bp, Caenorhabditis elegans
atgtcatcgtctcacctgtttgaagagctagaatgtgatcaacctgaaagccaaacgttttttaaaaagcttcaacttgtcgatgactggaggaacatattaaaaaaaggagtatttttgactataatcgttatctttgcggttctattaacctattttctggcaagaaaatcaatatgtgaaacaggtttagaaaatagtaaaacagaataaaaatttatatcttttatagggattgccacaagttctactttttctacgtccgctactttgccaactccaggtgggaatgtagtgagctcttcatttctaggtgtcggataaggtacggaaaatacttgttttatcgatggtattttcagttgcggggaactattcttgcgctactgggtttacatatatcagtcataagtgttggaaattgatcactggcccacagaatagaacagatgctgatcatgcttgctttaatcataaaggatcaacacttttctcaattagaaacgagcag

SEQ ID NO: 30343 - DNA, 629 bp, Caenorhabditis elegans
atgtcaaaatcttacgtgttcggagaactagaaattgaagagccatctaataatcaaacacgtcttgaaaagcttcaacttgtcgctagtgatcattggaaaaatatattgatcggtggattatctgaaattataattgttgcctctgtggctctattaacctaccttctgacaagacaaccaatatgtgaaacaggtttttttaagaagttatattctgtatacattttttgcattctacgttcattgtttacagcagtttctacaatttctacattggcaaccagtactttacctattacaacaaaaagctcaacaacacattggtcgacttccagtactccgatttccagtacttcgccaacttcaggtaagactggattagccacgacccttcaattccatgtcattatttgtttcatacacactcttctacataagggcgtgtacagtactttgccaatagtttgtattttacagctcccgagaactattcttgtgctgctgggttcccctatatcaatcataaatgctggaagttggtcactgggccccaaaatagagcagatgctgaccaggcttgcaataatcttggtggatcgacccttttctcaatcagaaacgatcag

SEQ ID NO: 30344 - DNA, 353 bp, Caenorhabditis elegans
aacttttcacaagttctacattgccaactatacctatcacatcttcacgttcaagacctggtaagaagtgtcagttgtatataataattgtttctgggacttcagattcaacgtctacatccactacaaggtcggttaccagtacaataccaactccatgttagtcccactgatggtactttcccaacattcattaatttacagctgtggggaactacacctgcaccgatggttttacttatatcaataataaatgctggaaattggtcactagctctcagagtagagcagatgccgaccaggcctgctataatctcggcggatcgacccttttttcgattagaagcgatcag

SEQ ID NO: 30345 - DNA, 562 bp, Caenorhabditis elegans
atgataattgtgataacatttacaacaaccattgctacctacgctacgatttgtcttacactgttgctgaagctcaaacgttctgcaaaacaaagtgcgccaacctagtttcaatcaattcggccaacgaaaatcgttatgtacaaagtatttacaatgacacaaacggatatattcaacttggtgcaatgcttctttcatccgacgacatatattggctggacggatcactaccggtctataataatattaaacgaactttgaatggaaattgtctgttcatgagtgtttcaaaacaccgtcgtggtttttggtacactgtcgaatgcacccaaagatcatggtttctgtgtaaacggccggcaggaattgtgtgttgatttgaatgaattttcgagaataaaatgttgtaataagaattgtcagaaatatttttcattagttggcttatcatcaaatatatgctcatggacacatttcaaatactacaccaataccaaagataaaactactttttcagaccaactgtggaaattattattacattttgttctcctcttag

SEQ ID NO: 30346 - DNA, 500 bp, Caenorhabditis elegans
atgctcaaacattttttcatttctcaatttgagtttcaacaaaatgttagaaatatgaaaatttgaaaggcgtgaaacgagcaggtttcaggcaggcagcaggacatgaaaccgcgcctgcctactatagaatccctaacctcgacaacaggttttcacagctcctggggactattcttgtgctgatggttttacctatgtcaatcataaatgttggaagtttgtcactggcccacagcgtagagcagatgccgataaggcttgctttaatctcgacggatctacacttttttcaatcagaaatgaacaggtaaggataaccaaaaaattttaatttagaaattatgatttataggaaaatcaagcagctctggaatttgtaaaagatcaaaaagtcgataacctgtggacgggcttgatgtactatgcggatgaccctttttcatgcacttgggatgttaacagtggaaccacggaagcctaccataactttgccgagg

SEQ ID NO: 30347 - DNA, 614 bp, Caenorhabditis elegans
atgcttggaaaattaaatcgattcctgcaacttcattggatggttatattgcttgggataatatttgaaattttatttacaattggagttgttcgtttaacatattttctgacaaagcaggcatctgttgaatcaagtaggttttacgtttattcaatacaattatgggtttggttcccagataaaatcacaagttctgctattcaaacgagtactgtatctactttctcaggaatatcaactaaatcacgttaagcacatctagttttcagtaggtcactctattaaacttcaaaagttcagatacttcacctacacccagattgttgtccacttccagcacactcggtaagattacaaccaagttatataaaatgggaataaaaaactttaaaaattcacataacttttgagacaattatttctaacacttttggtactctgacaacggtttatgttttacagcttctggaaaccgtacttgcactgatggcttcactcatatcaataataaatgttggaagttggtaactggcccgaagagtagagcagatgcagacaagacttgctatgatctcggtggatcgacccttttttcaatcagaaacgatcag

SEQ ID NO: 30348 - DNA, 508 bp, Caenorhabditis elegans
atgtccgatattgacgagattcaagagcttcaagaaccatctcaaccaaaaactcaaccttattccgaaaaatttaaacttttcatgacaaatcattggaaaaatatattgattggaggattagctgaaatcataataatcgtttttgcttttatgttgacctttattttggcgaaacaaccagcatgtgaaacaggtatttaaatagttaaactacaataatatttttgcttgtttgttaggtatagtaacgacttctatattccacactagtactctacccagcacattgacatatgcctcttcttcttattctacaaaacctgacaagagttctattgcaacaagtactaccttaaaaccgaaaactttgcctgttacgacaacatcaaattcactctcaacacatacaaaacttggtgagagatacataaatattccattattaataaaatgaattcagacacaacatcaatttccgcaactttcgctactatgcccaccccgg

SEQ ID NO: 30349 - DNA, 564 bp, Caenorhabditis elegans
gctttcccaacaagaccattggggactgcgtttacttcatcgcaaatggaacagaagctggacactggaaaagtagcgcatgcaatcagacaatgagttatgtgtgtgaactacctccaactattcatggtaaggcttctagctcggattatttatacaagttgcttcattgaagatgataattgcgataacaattataacaataattgttacgtacgctacgataagtcgtccaccattgctgatgctcaggagttttgcaaaacaaagcacggcggcaaccttgtttcaatcaattcggccaatgaaaatcgttatgttcaaactttatactacgtgagtggatatattccactgggtgcagtggttccaaactacaacgtcatatattggatggatggatcaccagcgacatataataatattctatattatacgaatggaacttgtctgtttttgaatttttcatggggaggcagtggtgatttctgggaaactgtcgaatgcactgataaatcatggtttctgtgtaaatggcccattggaattgattatgcacagtga

SEQ ID NO: 30350 - DNA, 750 bp, Caenorhabditis elegans
gtatcaaagtggtcatttgcaatgctatctacttcaaggcgaagtggcttaagatcttcgaagatagttgggaggtgtcgtttttctctgctaaaaaaacttctcgccaagttgaatttcttcacatgtgcgaaatgacaaaattcaacgagaacgctcacttcaaggtcatcagtatgccgtacaaagacgagaatttcgctcttgcaatttttttgcccaaaaagagatttgcgttgaaaaaggctctcaaatcattggattctgcgagcattttgcaattgctcacttcattttcagaatgttttgttaaggtgagtagtaattttaagtaacttaaaagctaattcataacattaaacattctagatcgcgattccaaaatggagcattgaaacagatatggacatcggcgcggcacttcaggacttgggaatcaaggatgcctttgacaattgtgctgcaaattttgaagatatgtacacttcggcaggaggcgacccattgtacatcagtaaagcacttcacaaggcaatcattgaggtttgtggtagatatgatagtgaaggttcgaaattttttgattttaaggttgacaaaatgggaaccactgctgcggctgtcacatcgcttatgtatacggacggcgtcccacagcttccagaacatgtcgagttctgggccgatcacccatttatgtttgtgctgacccataataatcatccaatgttcatgggcatttataattga

SEQ ID NO: 30351 - DNA, 521 bp, Caenorhabditis elegans
atggcagttacaccagttacccgttgcacataccttctacgcgatgaactggactttgcgctgaagttgctccaccaacaagatctcaccaagtcattcgtattctcaccaatgtccatatctatggcgatggctcttgcccatgcaggagcaaatgatgagactcgggaggagattcggaatgttcttttgagtggctcgacggattcgcagcttcaaaaatacatcagtgatctctgtgaagagctgcgtgagacggagcatggcgctgaagtaaatgtcgcgaacagattgtttatcaagtatgtcatactgttggaaactgcacatttacaacattgtttttcagaaacggatatccaaaaaaatcctattgaaggaagttcagaagctatacaatgcttcggcgtctaatctcaatttcgatgacacaaaaagaagcgcagaagtgatcaacaaatttgccagtgacaatactaaaggaaaaattaataagatcatcagtccagaggcacttgaag

SEQ ID NO: 30352 - DNA, 357 bp, Caenorhabditis elegans
atgagcagcgaagagcaagatgtcaaaattgttacttctgatgatgtagagttcattgtaggttttattgacttactattagtacagagatttaattttttgcgtcaggtttctccgaaaattgccaatcaatccaagcttctcgctgattttgttgtattgaatcagcgcgaaccaattccattgaaaaatgtcacctctgagattttcaagaaagttatcgaatggtgtgagtatcatgctgaagatatccccaaaccgccagacaatgtggaagaaaagcgaacggacgatattggtgaatgggatgtcgagtttcttaaagttgacaaaggtactttgttcgaattggtgctg

SEQ ID NO: 30353 - DNA, 703 bp, Caenorhabditis elegans
agatgccgccagcacactcattttgctctcactgtgagctctttgggaatttacgcaaactactttggtgctccaatagtcgttggaatactcacctcagctgcagggaatactgcagaaaatgtgagaaagtgtgatatttatagttgaaaatattagaaaatctgaattctacactaaaattgaccctaggagccaattttctgaaaatttgaaaattatcggccacagtccccggctaggacgtggctcaaattacagcccagagggatcaccaccaggcagtgtacctgaatcccagatccgcagtgcatagcacttgaagaacggatcgtcctttaatccttttaaaatgtcgaagtggcgcagtagggtaaaggtttggctatggcccagaaggtccgggtttcgacacccagtggcgcgaaattttttctctgctatttttgttgtgcgaatgtgcaaaataacaacatttttcagttgagaggtggaaatttttttttggaaaaaattcaaaaaattaaaaacaaatttttttttcaatttttaaattaaacttttataaaacaattttcagtggtctcacctattcataattgttgccgtggtaactgtcatcacaaatgcaccgttcccattcttgacctccgacgagcctggaccatacgtgaaagtcgggcagaaaccgaatgaagcctag

SEQ ID NO: 30354 - DNA, 196 bp, Caenorhabditis elegans
atgggtctattcaaaaagaagaaggatgattcatcatcggaagggtaggtatttctgaggaaccgcacctaaaaacgctgaaaatttttgcagatcatcagagaaaaaagaagaagctccaccgccgccaaaaatctcaatttttcaactataccggtacacaagcacagtagatcggttaatgttggcagtagga

SEQ ID NO: 30355 - DNA, 606 bp, Caenorhabditis elegans
atgactcaaatcaaagtagatgcgattatatctaaacagttcctggcggcggacctgaacgagatccgacaaatgcaggaagagagcaagaagcaggtgatcaaaatggaaattgtctggaagaatgtcgctttatttgtggctctacacattggagccctggtcggactatatcagcttgtgttccaggccaagtgggctacagttggatggggtaagtaggatcatacttgtagtttcctcctgaaagcctacgtttcctaattcagtattcctcctgcacaccctgggaagcatgggtgtcaccggcggagcccatcgtctctgggcccaccgagcctacaaagccaccctctcatggagagtattcctgatgctcatcaactcgatcgctttccaaaatgacattatcgactgggccagagatcaccggtgccatcacaagtggacggatactgatgctgacccgcatagcaccaaccgcggaatgttcttcgctcatatgggatggttgttggtgaagaagcacgatcagttgaagattcagggaggaaagttggatttaagcgatttgtacgaggatccggtgctgatgttccagaggaa

SEQ ID NO: 30356 - DNA, 388 bp, Caenorhabditis elegans
catcagagaaaaaagaagaagctccaccgccgccaaaaatctcaatttttcaactataccggtacacaagcacagtagatcggttaatgttggcagtaggaatcattgtatcatgtgccaccggtgtaggactccctttgatgtctattattatggtaaaataattttttttaaatagttttgtcttaaaataacctaaaaataatctaaatcattgcagggtaacgtgtcacaaaacttcgtcacccttggtaccattttcctggatcctaactcaactgcgtcagaaaaagctgcggcaagagccgagttttctcatgaagttattcaaaattgtttgaaatacgtttaccttggatgtggaatttttgctgctggttttctacag

SEQ ID NO: 30357 - DNA, 1660 bp, Caenorhabditis elegans
atgccaggtactggagaatctccagagcttaccggaaacaagacccaatatattggatacagtaggcaggagaagacgtggttgttcagtacagtggctgtgggcgccatgttcggattgtttccagtgatcattggaatcagtacatatggattgcgaaaagtgttttttgccgctggtatgttgacctcgtttacaacatttttgattcctatcgtggcaacgatgaatttcaatttgttcctgctgatgagattcctacaggtattagtctcccctaattttttttcgaatttttttgcggaaaactagtagaggaatcggattcagcatgtaaaaaagctttaacaccttaaattttatttagctgatcaaaaattggagattttgtagtactgaagacaaaattcccaaaaatattttatattttggtgggaaattcaaattttttgagaatactattttgccgggaaataaaaattttctgagaaaattatttttccgggaaattaaaattttctgtgaaaatattttggcgggaaattaaaattttgtaagaaaaaattttggcgggatattgaaactttttgagaaaattattttggcgggaaattcttattttctgaagaaatatttatgcgggaaattcaagctttctgagaaaattattttggcgggaaattcaaattttgtgagaaaaattttttggcgggaaattcaaattttctgagaaaaatttatggcgggaaattcaaattttgtgagaaaatattttggcgggaaattcaaattttcaaaaaaaatattttggcgggaaattgaaattttttaagaaaatattttggcgggaaattcaaattttctaaaaaaaatattttggcgggaaattgaaattttttaagaaaatatttttgcgggagactcaaaattttttttagaaaatattttgacggaaatttgatttttcttgagaaaatgttttggcgggaaattcaaattttctgagacagctaatttcactacaaacggcaaatatggcaatttgcagatgtttttttttttaattttcggcaacttgtggttttgcacatttttttttggaaacttcagaatttttattttaatcggtaaatgctatgaccgaactttcatctattttgaaaagtcagtaaatgctatgaaaatatctaaagaaaacgggaaaaaattttcaaaaaggcacagttttaagtgtttccgtcttattaaaaatccctttaaaaacttccggctaattgatatccggcaaacggcaaatcgacaatttgccagaaatcaaaatttccggcaaattcagcaaaacggaaacttgccgatttgccgatttgccagaaaaaatatttgccgctgacccctgtactgtataccttccagggaatgtcctacgccggatgtatgccagctgttggggccatcacttcttcctgggcatctctaacccaacagggactgttcattgctgcactgaccacattcgggcagctctcctcaattttctcaatgccgattgctggggagctctgcgtttctccgcttggctggaagtctgtctactttctgcatgccgcaatttcaatggtcgttttcttggcgtggtttgcagtttttacagattcaccga

SEQ ID NO: 30358 - DNA, 541 bp, Caenorhabditis elegans
atgatcaggttaacactacttctattcgggctattgggagccgccacagcacagaactgtaacaccggtgggatttataattcgcagtttaataggtatgtttctttgatgatggttacctacctacctacctgtccgttctccagatgctaccaatacttcaccgcccccgctcaattctcatttgccgaacagcaatgtaacctcctcggtggccaccttgcctccgtccagaacggccaagaaaacgctcttctccagtcaaatgcagccaactctttcaaaaaatccaactactccgattactggatcggagccaacgatctcgagacatctggtacctggaaatggacagatccatcagtgacatttgattattccaactggcaactcggcgagcctcaatccggaagtgattgtgcaattcaggataagggagacggaacctggtcggctattggatgtacttcctacaggccatatttatgtgttactcctgttattatgactgccacgtgtccaccaatcactacacccattc

SEQ ID NO: 30359 - DNA, 283 bp, Caenorhabditis elegans
atgctttttctccaatttttcttgaattttcaagcttttctcggtatttttgctctggaaagcagctcggagcccgaattttttgaaattaatatcgatagggaccacccggagaaggtctatcaggaatttgtagaatttaagaaaaagtaggtcaaattttttgaaattttcagattccataatttttttttaaatgcagattcagcagaacttacaaatctgaggctgaaaatcaactgagacttcaaaattttgtgaaatcccgcaacaatgttgtcag

SEQ ID NO: 30360 - DNA, 851 bp, Caenorhabditis elegans
atggtcgctgttgtgagttttttttaattgtttaggttttgggaaagttttggcaaaataaaaaaatctggaaaattttgaaaaaaaaatttttaagctatttttttttttggctgaagataaaaatttggccctaaaagctttattcttacttttttttaagttgaaaaaattttgtttccaatttttccaacatattttaggattcccagaattatggttttaaaaatatattttattgctaaatatgacagtgacgggcttaaaaagtatgttttgtttaaataattatttaactagagtgttacgaaaaagaaaaattgggaaaattctgaaaaaaaaattttggaattcttttttgaaattttttattttttttatttttcaaaacacttttcaactgaaattcagaacttttgggttgaaaaagcccattaccatgacaataagctataaaaaattagagaaaaaaactttgaaacagcaacaaaaaataattaaaaaattcgaaaaaaaaattgtttttttcgaaatttttaaattcaactttatttaagctttagtattttttttattttgactgaattcagcaataaagtttacttttcaaaacaaatttcaactagacaactttcaggccgcattttccagtagtgggcaggacaagcccgcgcatactcccaaattgggacttttcgtatatattttggctgccgcttcagtaattggcggttttctatttggatatgatacttctgtagtgtcggctgcaatgctttatatgcccgatgctccagggctcaagcctatggatactgtgtggcaggaggtgctggtcagtatttctccag

SEQ ID NO: 30361 - DNA, 665 bp, Caenorhabditis elegans
atggttgccgtggaattcaaagtgtctgaatcaggccggcctaggcctgagaaaaacccaaaattaggctttttcgtctacttattgggctctgccgccatcatcggtggcttcctattcgggtatgatacctctgtggtgtcggccgctatgctctacgtgccagaagctcccgggctcaagcctatgggaactgtgtggaaggaagtgattgtcagtattacaccaggttagtgaattttcgaaaaaattcgtcgtatttttctacttaaaaaatggttcaaaaatgttgaaaactggcagagttacgaatttttgaaaaaaaaaattttcgaaaaaatttttttttttcgaaaattcataactttgttcattttcgagatttttgcaaaacgtttagtttttcaagtttcttaactatttagctattacaaaaaatttataaaatcacaaaatttcaggtatggcagccgttggcgcctggttttcgggagccggctcggatcgctacggccgtaagccaattatcatcggctcaactctgatttttgtttgtggagccgttatttgtgccgttgcctggacaaaaatcgtaatgcttattggtagaattttcctgggcgttggtattggattcgcgtcaatggtggtgcctgtgtacctcg

SEQ ID NO: 30362 - DNA, 1079 bp, Caenorhabditis elegans
agagccttcaactttgccgtaatcaacccacgccgagccgaagaacaaatcatccaggtgctcaccgagtggaaggtcccagtagctgtctgtaagtcggcgggaccaactgggggacatgggacatccgggagttttgaaattattaaattcaaaatctcctaaaaatttgcaaagttttgacatccatattggctatatttggagaaatttgaaatttgggcctgaaacggcctaaaattggcctaaaatcggcctgaaactcaaaattttcagtctatagcccatgttagtgtaccaaaaaaaaatttcaattaaaagccaagtattttggctatatttcagtaaattatattttaagacctgtttcaggcctatttcggcctgaaatcggctcaatactcaaaattcttttgttttggtgtcacaattttaccattcaattgaaaacttgaaaatatttggaacatttcatttcaaggccaattttaccctaaaccggcctaaaaccggcccgaaactcgaaatttgccgatcgaaatcgatgtcggtgccaaaattttgaaaattaaataaccaactcaaaagttttgctgaatatgaagtactttcttttcaggcctgttttggcctagaatcggcctgaaattggcccaaaacccaaacttatcgaaatatagtcgatatgggtgttaaaattttgcaaatttaacgtgtaattcaaaaatctagctgaaaacctgcagaaactccaagtttttcgaaaaaactcgaaattaaaaaaaaaaattccagatttcaaagtcggcgatcaattcaaagaatataaagaaggagtgatcattgaggacgattgtagaagagctactcaatggcatgccggagcaattgtgggttacgataccgttgaggatagccgtggaagaagtcacgactactggattatcaagaactcctggggaggcgattgggctgagtcgggatatgttcgagtggtcaggggtagggattggtgctcaattgaggatcaaccaatgactggagacatcaaagatcataaagataactattactattaa

SEQ ID NO: 30363 - DNA, 850 bp, Caenorhabditis elegans
atgaaggaaacggatgaagttggcggaggaggaggcagtattgaggatgtggtgagttgaattttttttttcggattttttagaattttctggaataaggattttttgacataaccttgatagaattttctggattatttttttgagttttctagaattttctaaaaaaagttagaagtttttggaaaacttttagaattttctggattttttttttaatttttgacataaccagaaattgtataaaattttccaatttttttcagttttctagacatttatagtgaaaacatttataggtgttttgaaaatttttcggaaatttcttttgaaaaatttcgaatttttttaaattccgtataaaatgattttttttcagaattttttgcattttcttgagtttactagggccttctgaaacgtttagaagttttttgaaaatttttagaattccctgaatttttcagaattttctagaactttctggaattttcaaaataatttttaaaataaatttccaattttttttttgaatttttaaaaaattttctggaatataggcaggaaatcaaatttttcgcatttgaaatgtataaaaataattctggaattttctgcaactttgtggctatttttagaaatttttaaaattttttggattttctatactcattgtcaattgaattttttttttaattttcaaattttcaactttaaacacaatttaaagttgcctaaaactcgaaatcttataattttccgtttcaggatagcgatgatatggagagctcaacgacgagtagctccaatggggaaatcgctataaagcagcaggatcagagctttttga

SEQ ID NO: 30364 - DNA, 305 bp, Caenorhabditis elegans
ccaataacgtgtgaaaagtcttctgacgtggcaacatgccaaaaacagtacaaagatcagttgatggtgtcgataatccttccgcaattggattttaagatctacgcggagacccctgcaatggatgtatgtttttgagaggttttttttccggaaaaatcgataatttgcagttcaacaagtttttgtcacaactcggaggtcagctaggcgtcctgatgggaattaacgtagtaacttttattgaagtagtttttctgttttttggaatgtttatggttttgtgccagaaatatgaaaagtag

SEQ ID NO: 30365 - DNA, 1062 bp, Caenorhabditis elegans
atcctaatggaagttgaagaactattcaaggaactcgatgcacatggaggagaagaaattgatttgccgaaattaatcgatagaagtgttggaaatgtcattaacttgacacttttcaacaagagattcgatatggtaagtttttggtttttactcggcctaaatcggcctgaaaacggcatagtaacaaatatttgaaaaacttttcttctgtaacaaataatcacaaaaagatcaaagaaatgttaatactgtgatcccaaaatggcttttcaaggcctaactaggcctatttcggcctgaaacggcccgaatgtcaattttttaaaaatatggccagtatcgattttaaattaacaattttaaattgaaaatgaaagttcctaattaattgacaccagtctaatcaagacctgatattttagacctaaataggctaatttcggcctaaaacggcccgaacttcaatttttgaaatttttggctaatggcagtgttaactttacgattttctaatataaaacccaagttttgggaaaactggcttaaaaatcactaaatctggatttttaggcctatttcggcctgaaacggcttgaatttcaaagttcatcgaatatagccaatatgggtgtcaaaatttagcaaattttttgttcaattcatattctgctctaaaatagcaaaacagtgtccccctgatgggacaaaaagtcccaaaaacttcccgaaaaatttttttccggaaaaattgttttttcaggacaaaagagacgaatttgcccatttaaaatctttgattgatggaatgagaaacgtgacgtcacagttccgttatctaatccaatatttagtcccatggacctctacggtgctcccaggacccactttatcggaaaaagtacgagcaaaacgcgaggagctcgacgatttcttctacagccaaattgatgagcaccggaatgagattgactttgacaatacggaaaatctagattttgttgaagcctatctcaaagagcagaaaaaacgagaagaagacggagattttaagactttttg

SEQ ID NO: 30366 - DNA, 1408 bp, Caenorhabditis elegans
caacaaacaactatgcgccatgctatttgatctctggattgcgggactaatgacaaccacaatgactatgacatggggtctgtcttattacctctataacccggaagttcaacgaaaaatccgtgaagaattggacaaagttatcggaaatgaccgactgattagcacggctgacaagaatgatctaccgtatctacaggcttttgtaactgaaactcagcgaactgcaaacattattccgttgaacttaatccacatgacaactagggatactgtaattgatggattcccaattcaaaagggaaccggcgtgattgctcagattagtacggttatgtacgatgaaaaggtgatttttttggcttttaacttactctttttgtgttctcaaccaaaaaattgagttctctgtgaaattttgatattatttgaccctcatattgttatgttttcgaaaattttcgattttaggccaatttaggccgatttggaccaaaaataggcctaagtcctatttttttgaaataggatcaactaaaatgtgaaatttttgcaaattctcaattaatggactctaatacggtcctgattctgaaatttttggttttaggccaatttaggccaatttgggccgaaaataggcctgaatcctcatttttcgaaataggaccaactagaaagtccaaattttttacaattctcaattaatgaatcgtaatattaaattaattcatagattgtgggtttaaggccactttaggccgatttgggccgaaaataggcctcattccgtagttttcgacataggaccaatcaaagtgtaaaacttttgccaattttcaattaataaactctaatactaaaatgactctataactttgggttttaggccaattgggccgatttgggccgaaagtaggccgaaaataggccgaaaatattatttttcaaaatatagtcaatatgggtgtcaaatgaacggaaattttatggagatttcaaatttgtcactaaaaaatgtcccacaatgtcccatgtccccacaactgtcgggacaagttaaaaatttgattttttttcaatttttcataaaaaatcctacaaaaaactaatatttattatttttcaggtttttccggagccatacaaattcaagcctgaaagatttattgaaaatgggaaattcaaaaaagtcgatgaagtaattccattttccatcggaaaacgccagtgtttgggagaagggctcgccagaatagagctttttttatttttcgcgaatattttcaatcgatatgacgtcatgccagacttttctggctcgctgccagatttggacaagtcaaaggacaattttgtgatcccgcgcaagttcaaggcagtgctgaagagaagatatatggactaa

SEQ ID NO: 30367 - DNA, 1654 bp, Caenorhabditis elegans
gctataatggacaccggatcctcctggtttggcttaccatactccgttatagccgggatagcaacacagactaacgccacctgggatttgtatgccagtgtctacacagtcccgtgctccactatgaactcactgcctgaccttgtctttaccattggagcagaaaaattccctatcagtgctcccgagtacgttgaggatgttggcctagacgatggaacatgtgcccttgccatgtatggaatagacgcttccggctttggaccatccgtgacactcgggaatatctttattcgtcggtattgtagtgtatttgacgttgggaatgcgagaatcggatttgccgatgctattcacccaaatagtgtgatttgattatttttgttgaatgaattttgcacacagttttgttaatctagagcgattcgacatcattgattctgtaaaaattttgtagctttgcagcccagctcctgtcccattagagtttgatctacaaaaaacgcgggattttttttacaccagaaaaatgtgacgtcagcacgcccttgaccatgcgaaatcagttgagaatttttcccgcataaaaagaatttttcccgcgtaaaatatatctcatctttatggaatcgtttcaaatcgagttgacttcttttaactagggctcccagctgagtgaggcgcgaaatgcctcacgccggcctaacaccggccggcattgcgctgacgccgcgcgccgctgtgtgtgtgaattgaagtgcgagaggtagttatttgaagcgcccgacacgttcggggttccgcagcttagcgtaaaatgagtatcttggtgtgtgtgcaacgtagtgtgaagcggtggttgttcggaagcggccgacacggtcgcggttacgcgcctcactatacatgcggcgaccactgaggccggcggaggcgcctttgcggcgacctcatgggagccctctttttaacaaaaaatgccaataacaagcaaactgtgacctttaggtcacccgtctctatttttttcatgagatgcacttgctgttttgtagctcactcgggcaactaaaaatatttttgataacaccttttagcacttacctattatcaaaatatgttatccaagttaatctgtataaaagcaaacgacggtgcttcattccaattagacatgaagctcctgctattcctagtgaccacctgctctgccgcgctcttccaggcgtctatcaactgcaagcggttcaaccaacaggcgaataggtacttcaattttgatgactcgtgcattggaaacatcacgattggaactccaccacagtcagcctcggttttcatggacaccacttcagccaactggtgggtgattggctcaaaatgcacatctgctaactgtaatggatactcagggatcagaaaacacaagttcaacacaacgaagtcgacgagctttgtggaaggaaatcgaacattcagcactgaatacgggctgtgcactgggtacctgggaacggacacagttcagatgggaggcctcaccattacaaagcaagagcttggaattgcaaccattgttggtctaggttttggactgaaaccttatgtcggaattttcgagctcgcgtggccagcactatccgttgatcaagta

SEQ ID NO: 30368 - DNA, 192 bp, Caenorhabditis elegans
actccaccaatgcagaaactcatctcccaaaatcagctggatgctccgatgttcacaatctggcttgatcaaaaggatcagggcgtctatgtaggatacactggactgatcacctatggaggcttcgacaacaagaactgcgatgcaaatgttacctacgtcgctttatcctcaaaaacattctggcagtag

SEQ ID NO: 30369 - DNA, 878 bp, Caenorhabditis elegans
atgattcattccaacgagccactgccctacgctatcgaatatgcaaagtctggccggtcgacttgtaaaacatgcaaaaagaatatcgcgttggtgagagctttataaagcctaaaaagcctaaagcctaaaatcagcctaaaaattgaatttttcaggatcaattgagaatgtcaatgaatcgcccgtcaacattcttcgatggaaacatggattcgtggtttcattacaattgcttctggaataaaatgattcgcggccgagatgacatcaatataagctcaatccgaggagtcgattggcttcgctgggaagatcaggaaaagcttcgccaggaaattcaacactttaaaaccgcatcgccaccgactctgacacccctgttctctaccactaccgtcattttgtccacaataaaaaccgaaaaatcgttgtcaaatcgtgggaaatgtggaaaatgcggccaaaatttcgagcgcggcgaaatcaaggctcataacaagggaaaagccaaccatttcgagtgttttctgcaggaatttgataaaatttccggcaccgttgaggatattcctggctgggcggattatgaggcgaactttaaaattaaggcgactggggagtatgtggaggctttagctgcaaaagggggatccacggagccagctaccccggcttctgcctctccaacaccaccagaagctgaaactccagttttatctgcagaaggatccccggaaagctccaataaacgtccggcaagcgctgaaatcattgaaatcgacggtgaagggaatccagatgagaatgattttgcgaagaaaagacgaatgaagaaggaagcaagattgatggaggttcagaagaagcgaatgaag

SEQ ID NO: 30370 - DNA, 814 bp, Caenorhabditis elegans
caaccacatgtcccacaccggctccatgtcccatcaagcagtgtgtcccgtcttgtgatcaaggctggacctacttctctccaaccgacttctgttatcgtgtgtaccatggtgaaaagttcaatgacgctgaggcatcgtgtgtgctgctgggaggacatttagcatcaatccactcgctgacagagaacacttttgttaatagtgagtatttcattttatagagcacctggtataggcttaggttcaggcttacattagtcataggcttgggcttagtcttagacttaggttcaggcttagtcttgggcttaagcttagggttaggcttaagtgaatgcttaggcttaggcttggcgtcagtggcgagcgttagctatttaggcttaggattttccggtttttttatttttcagggggttcctgttggccgatcaaggcgaatcaggattaggcttaagttcaggtgtaggatcaagctcaggcttaggcttacgattagacttaggcaaaatttttgtcaaaacttccccggtcttcagacatcgcttcctgcgggatcaaagaaggcaaatatgaacacctagcgtggatcggtatgcgcaaggtcggccaggactgggtatggactgacggtaccccatcggactacttcaactgggccccaaagcagcctgacaatccgaaaaaagagttgtgcgtgcaaactgctcctgatctttctcacgataagtggtatgagaactggaacaatttggagtgtaatgaagtgatgcgggcttatatttgcaagaaggcttcgattcataattag

SEQ ID NO: 30371 - DNA, 524 bp, Caenorhabditis elegans
caactacctgccctacgccagctccgtgccctgtcaagacctgcgtgccgtcttgcgaccaaggatggacctactttgcaccaaccgacttctgctatcgtgtctaccataacgccaagtgggaggacgcagaggctgcgtgtgtgctccttggagctcacttgacctcagttcactcggaaaccgagaacaccttcgttgctagtaagtctccacaactacctgtaccacctcaacaccaataatcttcagaccttgcctcgtgtggaatcaaggaaggaaacccgaaggatctcgcgtggatcggtatgcacaaggtcggtcaggactgggtatggactgacggtaccccatcaaactacatcaactgggcaccaaagcagcctgacaatccgggaaaggaaaattgtgtggagacagcgccggatctttcccacgataagtggtatgagaactggaataacgaggcgtgcagcaccgagatgagagcttatatctgcaagaagggatctattcatgcatag

SEQ ID NO: 30372 - DNA, 3297 bp, Caenorhabditis elegans
atgacctgtctctcattcatgatgtccaatgtgatctgcttcaacttcaccgtcctctgtatgccaggcactggcgagtcgtcggagctcaccggaaacaagacccaatacattggatacaataggcaggagaagacgtggttgttcagtacagtggctgtaggtgccatgttcggattgtttccggtgatcattggaattagtacatatggattgagaaaggtgttttttgccgcgggcatgttaacctcgctaactacttttttgattcctattgtggcaccgatggatttcaatttgttcctgttgatgagatttctgcaggtacgatttatttacagagaatgactaccagggcacgtggagtcagaaattcccatttcgctttgatcttcgaaaaatgcgggagatctgatttcccagagcgtgctgacgacgtcacaaattttctgggaaaatactcccgcattctttgtagatcaaactgtaatgagacagcctgacaccacgtgccaggggtgtgcggataaaagccgatttagccaaattcgcagatcgacaaattgccggaattaaaattcccggcaaattggtagattaccggatttgtaaatttccggcaaatcgacaaactgccggatttgtaaatttccggcaaatcgacaaattgccggatttgtaaatttccggcaaatcgacaaattgccggaattaaaattcccggcaaatcgacaaattgccggaattaaaattcccggcaaattggtagattaccggatttgtaaatttccggcaaatcgaaaaattaccgaatttgtaaatttccggcaaatcgacaaattgccggaattaaaattcccggcaaattggtagattaccggatttgtaaatttccggcaaatcgacaaattgccggaattaaaattcccggcaaattggtagattaccggatttgtaaatttccggcaaatcgacaaattgccggatttgtaaatttccggcaaatcgacaaattgccggatttgtaaatttccggcaaatcgacaaattgccggaattaaaactcccggcaaatcgacaaattgccggaattaaaattcccggcaaattggtagattaccggatttgtaaatttccggcaaatcgaaaaattaccgaatttgtaaatttccggcaaatcgacaaattgccggaattaaaattcccggcaaattggtagattaccggatttgtaaatttccggcaaatcgacaaattgccggaattaaaattcccggcaaattggtagattaccggatttgtaaatttccggcaaatcgacaaattgccggatttgtaaatttccggcaaatcgacaaattgccggatttgtaaatttccggcaaatcgacaaattgccggaattaaaattcccggcaaatcgacaaattgccggaattaaaattcccggcaaattggtagattaccggatttgtaaatttccggcaaatcgaaaaattaccgaatttgtaaatttccggcaaatcgacaaattgccggaattaaaattcccggcaaattggtagattaccggatttgtaaatttccggcaaatcgacaaattgccggaattaaaattcccggcaaattggtagattaccggatttgtaaatttccggcaaatcgacaaattgccggatttgtaaatttccggcaaatcgacaaattgccggatttgtaaatttccggcaaatcgacgaattgccggaattaaaattcccggcaaattggtagattaccggatttgtaaatttccggcaaatcgacaaattgccggatttgtaaatttccggcaaatcgacaaattgccggatttgtaaatttccggcaaatcgacaaattgccggaattaaaattcccggcaaattggtagattaccggatttgtaaatttccggcaaatcgacaaattgccggatttgtaaatttccggcaaatcgacaaattgccggatttgtaaatttccggcaaatcgacgaattgccggaatcgttttgtttgattcggctaactcgagcaatattagtcgaaatagccgttagccgtatttatagcaattcggagcaaaggcggtcaatcggtagtagtcgattttgggcgatgttatccaaaaagttcatcaatgaatttgctcaataacaatttagagggatttgtaattatacggaaacacctaaaactgtgcctttttgaattttaaaaaaattttaaaaaatttaaaaaaaatacaaaattttcccgttatctttagatattttcaaagaatttgcttacttttcaaaatagatgtaggaaaagtcatagaatgcgtacattttttccggcaatttatcaatttatcaggaatttcaattcctttttttctcaattccggcaatttgtcgatttgcctgaaatttacaaatccggtttttgccaatttgccggaaatttacaaatccggtaatttgtcgatttaccggaaatttacaaatccggtaatctaccaatttgccgggaattttaattccggcaatttgtcgatttgccggaaatttacaaattcggcaatttgtcgatttgccggaaatttacaaatccggtaatctaccaatttgccgggaattttaattccggcaatttgtcgatttgcaggaaatttacaaatccggtaatctaccaatttgccgggaattttaattccggcaattcgtcgatttgcctgaaatttacaaatccggtaatctaccaatttgccgggaattttaattcaggcaatttgttgatttgccggaaatttacaaatccggtaatctaccaatttgccgggaattttacttccggcaatttgtcgatttgccggaaatttacaaattcggcaatttgtcgatttgccggaaatttacaaatccggcaatttgccgatttgccgatttgccgaattgccgggaatttttttgccaaactgcctatttgccgtttgccggaaaattgtttcccatcgactccctgctgtatactgctacctttcagggaatgtcctacgccggctgtatgccagctgttggggccatcacttcttcctgggcttctctaacccaacagggattatttattgctgcactgaccacattcggtcagctctcctcgatcttctcaatgcccattgctggggagctctgtgtttctccgtttggctggaagtctgtctactttctgcatgccgcaatttcaatggtcatttttttggcatggttcgcagtatttacagattcaccga

SEQ ID NO: 30373 - DNA, 1715 bp, Caenorhabditis elegans
atgctcctcatcgccgttttaactactctcatatcgattttattcgccattaccatctgctacctcaactttcttcttttgatctcaatattctggcgcaaaagaatccctgtaaatttgcatatgatgctgacttactgcagattcggtgtggacttggtttatactatagttctgttgattctcaaaatatattatatgcttacaaggatttctaatgactttatcatcaaaaacttatactttttacttgtatttccagctgcatcaattgggaatataagatcagtactaacatttttaatagccctcgaaagagttattgccatatattttccaattttcttccacatttatcgacaaaaacttccgaattttgtatttttactcataatcctatccagtgaacttttcaatcagtacatgctttttggatattgtggaaatgttcttgaaacaccactagagtgtgtaaattacttttgtgctgttaacagttgttactaccgctactggttttcacatcaacaaatagtttgctttttgaatggagctttctcggtcgttttatttcttcggcttactttttggagttatttctcgggaactgaaacgaataaggatatttcgagagtgagttttatgtacagtgcaggggtcgccggaaaacgattttttctggcaaatcggcgaattgccggaattgaaatttccggcaaatcggcaaattgccggaatttaaaattactgtaagttggtaatttgccggaattgagaaattccttccggaaaaccagcaaattgccgaaattgaaaattacaggcaattcggcaaattgctggaactggaaatttcctgaaaatcggcaaattgccggaatttaaagttactacaagttggtaatttgccgaaattgaaaattaccggcaaatcgacaaattgccggaattgaaaatatccgcaattcggtaaaatggcactttgccggaattgaaaattttcggaaaaccggcgaatcggaaatttgccggaattgaaaattaccggcagatcagcaaaccggcaaattgccgaaagcgaaatttccggcaaatcggcaaattgccggaattgaaatttccggcaaatcggcaatttgccggaattgaaaatttccggcaaatcgacaaattgccggaattgaaaatttccgggaaattggcaactttccgatttggcgagcggcaactacatcaaaatatcaaattttcggaatttaaaaatctcgattttttttgaatttctgaaagttttatggttttttctccgaattgttataagctatcaaaattgtttaatttttttcaaattttttgaagttttcaaatttttgaatttttttttgacaatttttttgaaattttagtggttcattaaaaactttttcgtcatttttacagctagatatattcgtacattaccattattattttttacaattataaaactgtttcaggccacccgcatagctcttctcgactttttcataatgctattcttcaatatcattcctttgtacatctctagtcatattactggtgttaatttggagatattgggattgtttattgttcttatcaagacatttggatttttggttgaaggattgataacctatcgatttttatttaatttgaaaattgactctgtcaatgaggctacagtagtctcgtaa

SEQ ID NO: 30374 - DNA, 252 bp, Caenorhabditis elegans
atgcttcgcttatttatcattgtctgtctagtgtgctctgtcgcgccggactgtgttccgggagatgttggatttggagattcgtaagtgaaaagagttttgtgggacagaaaactgaattggagagttccagctgctactcgttcaaccgtgttcatggaaagttcaaggatgccaacgatttgtgtgtaaagatgtttggagggagtctggtaaaaatcacgaatattatcgataacaattggatgcaaa

SEQ ID NO: 30375 - DNA, 442 bp, Caenorhabditis elegans
aattaagagcattagaaaatctcccagacttggatcaatgcattcatatcaaatgtagtcttggtagtcattgtgaaaacggacagtgtgttccaggtaccaaatttttcatttgctctgtaaaatgtccaattccagatctcggtccaattgacgcctgcgactcgataacatgtgaaactggcttcacttgcgttgttgaaaatggagcaagcgtttgtattccaggtaggcacttgaagcaaactatttccaagatttattttatccagacggtacaccaataaacccatgtatcattatgcagtgcccaactggagaaaagtgtattttcaccaatggaccaccgatctgtgttccaggtaggctttctcagtcacctcttagttatcctattggttgtcttattgtttcagacactccgttggctggctccgcctaa

SEQ ID NO: 30376 - DNA, 207 bp, Caenorhabditis elegans
gacgtcattctcgacaccaacgacgattacgatttggcaaagattatgtgggattctgtggtctattcgcatacgcataagtacgtttttcttttagattaaaaattaagtacactttaaatttgcaggaaggatttccaagagctagccgagcttctgaaaacagttggaacggttgatgagagaaaggagctgctgaaaatctaa

SEQ ID NO: 30377 - DNA, 1144 bp, Caenorhabditis elegans
agaagcaaaaatggacatagtacgtgctctgataatctgcggcgctggtgcatgcgatgatggattcattggatgcgcattcggatgtatgcataagactggtctgacgtcatgcaaaacccaactgggttcctcgtcaagcgacgaacaaagtatggaggatcgtgtcaaggatattcatgtcagtgataatgctgcatcggctccatatgaatttgtacttgatccggatactcaactcgttgaagaagcatacgcagagagaaatgaaacaagagcatttccacatgaagaagctttgaaaagagttaagaataagttgaaggagttggtggaaaagaagaaaacgtcaaatgtgattaatgtgctcggattggatggtggaggtattcgtggactcgttactgttcaggtaaatttttaatttgaaatatttgaatagtgcaagactaagagaatttcaaataaatttgtgtttatgttttttttaattcaaaaaaattacaaaatttgaaaactttttttaactcctaaaatccgacaaaaactaaatttaatttccgcccgtaactatttgacaaatgcgaatcttaatttttttcgaaatttcaaaaaattcaaaatgtgtgttttttttatttgaaaaaaagcgaaattaatttttttcgaaaattccaaaaattatgaaaagttgaaaagattacgaaaatgtctttttttatgtcataaatgcatagaaatacataagaacatgtattttaatacagttgtgatgtcataaatgtatttaaatactttttgcaaaattacttgaataaccccattattctgaaaaccgaacattttcagtttttattaagttattcaattttcaaaattttcagatgctcatctgcctggaagccttcctggatcgtccgctcatcgactatttcgattggatcggtgccacgtctaccggatgctatatcatgtcgactatgatgactggtggctcacttcgaaaagctcaaagatactatctgatgttcaaagatcaactattcgatagttggacacgtccatacgacacaaaaacgctggaaacattcattcagagagctttcggagccgatcgattgatgggagatatcaagtatccgag

SEQ ID NO: 30378 - DNA, 450 bp, Caenorhabditis elegans
attcttctctgttggattgcaggttccggtcctaagaaaatttgtgataaaacggatttcgaactcaaaatcttattagacacacatttgcatgatcaattgaaaaactatctcgatgtgaaagcatcggtaaaaatttatcgaaaaaactggataaatgatgaattcacacttggaagttactcttacctaacaccggggcaaattgttggtgaggatatttgtattcttgcgcaaccagttttaaaagacaataagtgagttttcaacaacttttttttaatcacatgtgttcttttttgagatttttaaaaattgttttattttagccctgttatttgctttgctggggagcacacggattcaacaatgtatcaaacaaccgttggtgcggttcgtagtggtctcagagaagctagtcgaatttctgaacacacttttgaaaagtaa

SEQ ID NO: 30379 - DNA, 471 bp, Caenorhabditis elegans
atgattatcaaatcgaagctaccaaatttggatattccggataagacatttcacgatttcttgttccatgaatgggaaaaatttcgcgaagacgtggcgttagtaagttttacaaataaaatgaaaataaatatttaaattttggatttttagattgacaatgacacatttgctcagttcacgtttcaagatgtaatgcaaaaggcagacttcattgccaaaagtttggtatatctgaaagttgaaaaaagtgaagttgttctgcttgtgatggattggtctccagcagccatatatattgcgttgggagcatcaatggctggtgctgcaatccaggttgtcagtccgaagttgcaagcatgggaaatgcaatttccagttaaagagagtgaatcgagatttgtgttctctgatccactcggccttcatgaaattgacaaattgatgaaaactctgaaccgagaatataga

SEQ ID NO: 30380 - DNA, 468 bp, Caenorhabditis elegans
tggcacgtccgactttatatagtacggaattttcttcaaaaagtttgcacagctccaaaggatctgcaaccagttcttcgagcgctttcaaatctgtatatatttgatcttcaagtatctaataaaggtcattttatggaaaacggatatatgacatctcaacagatagaccaactcaaaatgggtattaacgagtatgttttcttggtagatttttttgaaagttaataattacaatatttgtttttcaggtcactttccacgattcgtccggatgctgtttccattgtggacggttttgctatacacgaatttgaactcaaaagtgttctcggtcgacgagatggaaatgtttatcctggactatttgaatggacaaaacatagtcagttaaacaacaaagaggttcaccctgcatttgataaatacttaacacccatcatggataagattagggccaaaatgtag

SEQ ID NO: 30381 - DNA, 772 bp, Caenorhabditis elegans
gtgccacaaaatcagaatggaggaagatggcttatcactatcgagaaaggacgcactccggaaatcatggacactatctggaccgaaattcttatggcgatgatcggagagcagttttccgacgatatcgaaagtctgtgcggaattgtctgcaacgtccgtggaaagggctcaaaaatctcagtttggactacaaacagtgctgatgacggggcaaatctgagaattgggtaggtttttatagtctaaaaactaatgaggttgtagaaataacgttattggttatgaaactagtctagttgatcattacatttgattgagccacagacaacttctgggtgttacaagacgcaattcatccgttcaaaaacaattttccactgctaaccgtttgcaacacataacgttattggttatgaaaccagtctagcgcatctttcatatgtaccacagaatttgattgcttaatggtcagcgaaattccaaaattatgttaaagcagcggtacatgtaaaattgacaggcaactgtagagtaactaaagtgaaactttcaattttgcagaggcgtcttgaagcaagtgctcaacaatgcaagcatgatccatcagagaccactctacgacgttctccgttatgaggatcatgagagttgccagaagaagacgagctcaggagtcaaagcgaagcacgccatttacgcggtggagccacgcgaggagaaagccccagttccagtctcaaccgagactcctgccacaccagccacttaa

SEQ ID NO: 30382 - DNA, 1090 bp, Caenorhabditis elegans
atgtttcctgcgtctctatctcgcaccgccccttcatctctacaggtcatggacgtcttcgagtgtgtgtgtgtgtgtgagtgtcttatacattctatccaatccttcttccccatttctttcttgtagacgtggaacttgacgcgtcgttctctttttggtgttctcattagttgactttatatttgcaggtaatgtggcggctggtcgtcgcgtggctcctgattggagcacttgatgctgtcgatagacagaattttaaaacttgcgaacagtcgggattctgcaagtgagttgttacaaaaaattacattattttcaacaaaacataactaccgtatttcctgtattagtgctgcaccccagtactcaactttggcagcttatatctcacaatcagttatcgtttgttctattcaaaaaattgtccactaacaaaatatttgttagttttttattcttatttcgtacttgaaaatatattgatatattcgaaatgaaccgagatataatgtttcaatgttgagtagtcgggtgcattactaatagaggaaaaactcttcttatacttgtttttaaaaattgctaaataagtttgaaatagtgtgccattttcaaaagttcaccaaagttctgagatattcacttcacaaataactaaattcttgactcttcaaatattctttgtagcatggaagcttaagcagagttttttaaacattgttctgatcaaaaattactacacgtgtatatccaatttcgaagtaagccattcaaaaccggttccaatctttttctgctagcatgcaacacgcggaagtttccaccacctttttctccaaccaaatgtttctaggcgtcatcgagcggtcacatcgccaactggatatgaagttgttggtgattccgtgaaaacaaacgaaactggacttcatgctcttatcaagaacaaggatacgacattgcggttgagcattgttgctttgaaggattcaacggtcagagtggtcattgacgagaacgatggggctttgagaaaacgttaccaaccattggaagctttggttgacagagagcccgcgcagcaaaa

SEQ ID NO: 30383 - DNA, 640 bp, Caenorhabditis elegans
tcaaaaagtgacaattactcagtttttgcaactcataattttggaaatcgaccaacaaaattttttttaaatgcatttttatactgtaaatttgtttcaattatttgtattaaaacattgcaggggtcggaacatgcgacattgctctaggctcttttttgtttcaaaaaatttggcaattcgtcaaaacttagaacggaaattttgaaaaatctaaaattttttgtagtgtttcattattttatcgttttggattattataagtgtattccaaaaaaacctactggcgctactccaccttcaaattgcagttattttgtacttctagagtttacttgcatatagaacttatgcattatgtatgtaattttcaagtcaatgtgccgcgactattgctagcgttgaagttgtccgaaacataaaccgattgtaattttcagacaccctgtcccactttactggactgatattgacttcacggacccatccctgtgcaacaactagtcatccaacaagaatggatttcaatatcattttctattgccatgccaagtattcactggactttttgaccaataggttccccttttgccacttctcccgtttattgaaccctattttcccgattccaacgttttga

SEQ ID NO: 30384 - DNA, 901 bp, Caenorhabditis elegans
gcgattcacaagtgtgggaagctttagaaaatgctcatttaaagccatttgtgaaatctttacaagacggtctcgaacacaaaatttcagaaggtggtgaaaatttgaggtttgcaggttcaaaatctcaaaaatttcaattgaatttcagtgttggccaacggcagctgatatgtttggcgcgcgcactgctcagaaaaacaaaagtactggtgcttgatgaggcagccgctgcggttgatgtggagacggatagtctcattcaaaaaacaattcgtgagcagttcaaggaatgtactgttctaacaattgcacatcgtctgaacactgtaagtcgtcaccatttacatttttgcgttttggatgaggcacgggtgtctaagtggtagtggtgtaccaccggatcggaaagtgggtagtgactttggttcgcgaaaggtaattggccataccgctagtcccggtacgtcttaaattaagactagaagagatataaacgccaccagtaaccctgaaaaatctcttgcccgcaggaggttttaaaactttcacctttaccttttaagtagtttacaagaatttttttaaacattctggggctcaggaatagttctagttagcctaaaaaaacgttttttaatcaattcttttcaatttggaaggaacaattgggacatttgaactctttttttgaatttttggtaccactgaacatgtgaactgtcatatacttagaaaaatatagcgctcttgtatgattgaaaattttaaggtgatggacagtgatcgtcttttggtactggacaaaggacgcgttgcggaattcgattcaccaaagaaccttctcgcaaacccggatggaattttctactcaatggcaaaagatgccaatgttgtttaa

SEQ ID NO: 30385 - DNA, 253 bp, Caenorhabditis elegans
atacaaattttgcgaagagacagtgatgaagaccctgatgctggagaggaaagtatggaattggttagtttatttctcgtactttatactattatcttctaagcttcaggttgaccttggaattcaccacaagtgctcaattcgctctcaatctcccatcatcaactcgacctctcaccttcttcagccaatgcacaagaactcttgttccgttcgaagaggcatgttagctcctccagcttctcattcataa

SEQ ID NO: 30386 - DNA, 1372 bp, Caenorhabditis elegans
tttttcgtggtctccctggtattcctactaacctggacaacttggcagtggctgccctacatgtccgaatccaaatgggcgtactttgtaatgacatccttattcttcatcaacaactcggttaacccaacagtctatatcattttcaacactcaacttcgacgggaacttcattatctcatttgccgacatcatgttataacaactgctcaaaataagaggaaacagacgttgtttgggcgcggaatcgcggctgccaataaaattgaaacggtgagaaacggttgaaaagtgaagctgcaggctctgctttatttagtcatgtagatttgggtactaaacatgtatttaaaattctacaacttctttattcgaccacagattacactcactctgatcgcattaaacgtttatgtctatcagggatctttgtgaatgaagcagtgaaaagattactgacaatacttatgttgcagtcagtgtcccagaattgatttagaattgattttttttgattgatttaaaatttgcccgtttggtcttcaagcctgaaaacgttgcgctagaagtttacttggtttctaattattcctgaagtataaattattattttctataatcttatcaccttttaaaatgttctcaaaacagaaaataatcaaaaaccatacctagaggggatgctcgaaccttctacagttggaatgtgattattttgaacataattaaaacataaatctgaacggtttctttttttgacagacgacttcaaaaaatatgtgaacactctttggcttgtaagaaaacaaattggaacattttttaaaactgttatgaggctttttaatcatcataggaataagtttttgggatttccccactcgcacaccttgaaaaagatgtggctgttgtgaaaagttttcactgaaaacatcacagagcgcagtagctaattttaaacgtagtatagtcgattctctttattgctttattagacttggaattgtctgaaaacaccgaatttcataataaaactttttgaaaacttctcaaaaaaaagttatggcggcttaaagaatgacctaaaatttgttagaatttcaaatttcaaaaagcaataaaaaagttaactacaccactattatcgttcaaaagttttgcatacagacccccagagtttgttcctctagttctagtatgcaaaaaaaatatctcttaattccaggattttcaaaataatactcgagacgacgccaccaaatcattggttgatcaagccggctctctttcctctcaatcgcacggaacaattgacgagcatgtaagacaccagcttctgataaaggttagacatgcttctaaaaacttttaa

SEQ ID NO: 30387 - DNA, 1075 bp, Caenorhabditis elegans
ttgatgtgatgggtgggatcgacagcgacatgtttctgtatttcaaaagtttgctactccgtggattaatggcagcgagaaaacaccaccgacggattgtatcgctcgctgaaattatgtctgcaggtgaggtttttcacatgccaattctcattctcggcatgctattagtaccgctcgcccgagatgaagaaaaaagcgagactacgttactaataattggatgaaacctgactaagcagtagaacgaatgctgaattcgtaatgaaattggtagagggaaatggcagggttttgtgccacaaaaaataggtagaatttgtttgttaattttcaatagaacaggggccaaaaacaagtgagctctagttttcaaaatttgaaatatgcttaactgatcttgtcattgtaaaatgtagcaagttttatgaagtaataatgatatgtgcgtcgtaaatttggtcagtgcatctaatttttttggtcagtgcatataattttttggtcagtgcatcatagctttggtcagtgcatcatattttcggtcagtgcatcatatttttggtcagtgcatcatagctttggtcagtgttaagtaatttcagtcatttcatattgtgtttaattgttttggcctgaacaatgatagttaaacagaacgtggtaattgtcgtcagtgcgtaatttattggccagtgcgtagtaaaaacagtagtgctgtgtgaagtaaagattcggttttaactagtccaaaataaaagtttaatctttatcactgtgccgcagaaaaattgttcagtggtttaagcttgtgaaaaaccaaaatattagcgaaactccgtaaagagggggtttttcagttgtttgataattaactaaaaaagtttcaggatcaaaaatgcaatgcttccgtgctggcgcagagactgttcgagctctagaagctagattccatgtaagcagcactgacgagcagctccaacaactcgtcgacacgcttgtagaaggttctcgggatagttacacaacacggttttacgactcgtttcaatattacacaaatggaatccattga

SEQ ID NO: 30388 - DNA, 336 bp, Caenorhabditis elegans
atggtaacctccaggtatgcttttgttcatctttgtatttttagtttttcaaaattatcacaacttttcagatatctcatcacagtaaccactgtagtattaggcggaagcgcacaattttacagttatggagtagtcaaccctgcacaagtggttatcactgactggattaatcagacttatattgataggtacaaaatcaaagttcaaaaaagatagtaatatcgatttttataggtataaagcgccgttgtcattaactgtttcaaatgttatatggtcgtttgttgtatcaagtattgcaattggagcaattctcggagcatcttttacgag

SEQ ID NO: 30389 - DNA, 792 bp, Caenorhabditis elegans
atggtagatgaggacaaaaaatcgggcacaaggttggtggaactgggaaaataatttttttttaactttaaacgtatataaaaaaagacaaattttgcagagtgttcaaaaagacgagcccaaatggaaaaataaccacatatcttggcaaaagagattttatcgaccgcggtgactatgtcgacttgataggtgagaataagggcaccgagccacagaatgtgggctttatactgactggtttatcgcgtgatttggtttagagcgttgattggttttttgcgcgttttctgagtatggaagtcggttggcagaaacctcgcaaattttctattcgacgtacaaaataaggaaaacgcttttattggtcatagcactgacaaaaaatgttatagcactgaccaaaaatgttatagcactgacaacatagaaatgaacgcaattactgaatagtgcgactaagacgggagtagtcaaaaaattttaccctattaagaattaattttagatggaatggttttgatcgacgaggagtacatcaaagacaacagaaaagtgacagcccatctgctagcagctttccgatatggccgagaagacctcgacgtgttagggctcacatttcgaaaggatttgatatcagagacattccaagtgtatccacagactgataaatcaatttctcgaccgttgtctagactgcaagaacggctgaagcgaaaacttggtgcaaacgcgtttccattttggtttgaggttgcgccaaaaagtgcaagtagtgttactctacag

SEQ ID NO: 30390 - DNA, 1124 bp, Caenorhabditis elegans
gggcgttcaagttatatgatttggatcaagatggatttattacgagaaatgaaatgctgtcgattgtagattcgatttataaaatggtgggaagtagtgtacagttaccggaagaagagaatacgcccgagaagagagttgatcggatttttagaatgatggataaggtatgagtttgggttcgagatatttagaattttttcaatgtgaaaaattgctttcactcacttgaaaaaagtgtactttctatttgtatatttttttaatttgccaaagtttgactgggaattttgaacaaaaacctaaataccatcgtttttttcacagttttttttgaaaaactggtttcatagtttattgaaaaaaatgtggaatttggccaatcgattttccgcacaggcgacactacagctagacgattttttatttttcaaaaaccgtaaatatttcattttacgttgttcggttttccggttttcgatttttagtttggctcaaaaatccgataaaaactttttctgaacagattctggaaatttttcgaaaaaaattcgagattttcgtaaatcaaaaaaacaccgtttaaattaaaattaaaagttaaaaattaaaagtataaagaatttttcaacatgttttaaacttcaaacagcttatcatcaacaagaattttctttaaaagttatatatctaacatggccaaacatcgtaacaaaacacttcaaattgtttttttgagattttatcattttaagcaaagtattaagctgccagatattttgaaaattattatttaaacatttcaagactttctgcacagtttaacgtttacaatgtacaaatttatacagttaaaacgcaactaaaaatgtttaaaattttgaaactaaaaactgagttttttttccattttttttaaatcttacaatgttgtttggtgattttagtaacaaatttgtggtatcgactaaattccactttcaaaatttttagagcattaaataatttccaaatttttccagaataacgatgctcaactgacattggaagaattcaaagaaggagccaaagctgacccctcaattgtgcatgctctttcattgtatgagggtctctcctcttga

SEQ ID NO: 30391 - DNA, 656 bp, Caenorhabditis elegans
atccgaattactacacatgaagaatggccggttcaagttgacggcgaacctcatatccagccaccgggaactatcacaatattgaaatcagctttgaaagtacgtttaaacagttttcctaacgaaaaaaaaattgaaaatacaaaaaaaaataacctggggcattttgttttaaaactaagtttctttacaatttataatttgacatgttattatttcgctgcggctccatgtcctagtgacgtcatcatattgtcttattttattgatgtgactctgtgaatattttaaattttctaatttgcgctgcattcacgcaatttgtttccccccaccaccctgctctaaaatcgtggtaatcgaattttatatattattttttcttccatttgacaccaccccaatttttatcagcttcgctttagtgcagtacaaattgagtctaattacaggcacaaatgttgaaaaaagcaaaaaagtcgcgacgcggaggcgccacaaatgccacatctctaactcatccgcatccggagacatccgagtcaatgtcaggaccactcggagtgccatcaacactcggcgacccaaatcatggcaaaacgacgcccgacaatacagctgcggattctgatgaggaaggcgacgcttttctctga

SEQ ID NO: 30392 - DNA, 656 bp, Caenorhabditis elegans; identical to SEQ ID NO: 30391

SEQ ID NO: 30393 - DNA, 1756 bp, Caenorhabditis elegans
atgggaaaatcgcaaagcaaagtgcagacgaaaaagaaggcaaacaagaaattaacgacggaagaggtacaaacactagaacaagtcacttattgtaagtttgattaggaaaatgttgaaagtggttgtgttttatttttcaacggtatggaaacctgtaaaaaatttttccatgagccagttaaaaaaaagagtcttaatatcttaaaaagtttttatgatagtctaaaattaactaacaagttccaattagccaggtaaacctgaaccaactatactttgtagttaaacttaattgacttatcgcaatccttgattaatattggatgcatattttcagtaaaatttttcatagtttagagaaaaccatcaagtaaatgtgattaaccctaattaataaatgttcttctttcagtcacaaaaaaggagctcaaaaaatggtacaaagattttgtgagagactgtcccagtggagaactcaagatggaagaatttcaaggaatctacaagcagttcttcccaaatggtgacccatcaaagtttgctgcttttgtgttcaatgtatttgatgacaatcacgtgagctttttcaattcgaaaaaaagtaaccggtcagaaatgtattttgatcgtaagttagagtaacatgcgtggggattttgctggaattggtaaaaaattcaacgttatgatagtaaaaactttaaaaagtttaataaattttttcaaaatttttgttttaattttgcaaaagatatttcacaagcaaatgcgtgattaagttataaccacactttttgagttctccgttttccgaaaaatttagataatttttttcgattattggttttgtgatttaatcaaaaatgtcacgtatcaaaactaaaaacctataaacgccaagaaaaatgaaaaaatatcaattaaaaaaatttagaaaagtggtataaatttttaatcaagtatattacactattgcagtctatcttctgatatttacggaaatctaaaaaaatgaccgtggcaataatcagtcattacaaaaccgtttacaaaattaaaatactatcaaagtttagataaattttaaagcaggtataaactcattttttggcatttgaaaatatttccgcgacaattattattaacctaaaagacaataattttgtattaaaactttcaagaaaatattttaaaaaaattatgatccttcaatttttttaacgagcaataaatacaatttataaattttatttcttcaatttataattgattggaaactgatttttttttcgttttcgtaattcaatgcgtgtgttgcttttgagcattttcagtcgataagtatttgaatatgattacttaaaagcttgaagcatgcttaaatgtacgaaattaagctaaatatatctgggagtattagctaaaattaaggattattttcaagttcaaactgtaaaaaaaagagagattatagttatgcaataacaaattttttgttcatagactcccactccgatacatactttcaggatggtcacatttccttcagtgaattcattgctgcattgtcaatcacatcccgtggcacattagacgagaagctagattgtaagtcgaaaaaaaaaatgcaaaaagagacattattgaaaatgtatgaaagtcactttgcaggggcattctcactatacgacgtggataaagacggctttattacaaaggatgaaatggctgatattgtcgatgcaatttatag

SEQ ID NO: 30394 - DNA, 274 bp, Caenorhabditis elegans
gatgctcttcttggaaccggcctccgcttggaaggacaaaaattcttggtcctcaacgcagataatgacagaataattggaaagcaaggaggatctggatttttcatctacaaaactatccaaggtgaactaactaggattactagactgatttaaacaatctctgaaacttttagccgttattatttccatctacgagaaaggactccaaccagaaatgtgcagcaagaccaccggagccctggccgattacttcaggtccatcaagtactga

SEQ ID NO: 30395 - DNA, 1254 bp, Caenorhabditis elegans
atggaagctgaaacgtcaactcaggaagttgtgaagcaggtcaaaaatttgccaattttgatggtaagatttcactttgcaaaagtaaaagttggtgaacaagtaatttttgaaattcaaaataaattaacttctgaatggaaaacatttcaaaaaaccacgcggttttccaaccaattatatcaaatgtttgatgctccatgctcgtgaaaacatgaagtttaagtttccaacagctttttaaaattttgttccagtacacttcacacttcaaatccacttatcctatctccaaactcaccttgatgaattctaagtggagcttgccctctaaaaaattccatatttttcaggaagatgctccggtcggctctgacgatcaccaacttcaatattcatacacattttcgtatttcatgaggccaactggcaaattcgatccggaagattatgctagttatgtgcagcctgttggaataatgaagtctgtcgagcaattttggagtattatggtgcatttcaaacggccaactggtaagggttttgatagtggaaagtatttaaaaataaatcaaaaactatgctttaaaaattaaatttgaaaatataaaaaaaactccagtaaccttataagagttcaggggtattataaatagtgaaacttaaaagtacctaaagaataatttgacctagtagtgcaagactgataaagtgtttgaaacgtagttgaacactttcaactgttcctttttaagtttttcacaaatctttatgaatatcgagtttttaaacttttttttaagcgacgaataaattttttgatactgcttgaatggtttcaaaatctgaagttaaaaaaaaatctgaagctaagctaaattaaaaaaaaaattgcctaaagtatattattaaccaatgtctagatttgctgataattgacacagaatttccagaaattttttattttcaaaaagatttcccttccattccattccataacttttacttaattccagaaatgtgcgacaaagctgacattcacttcttcaaaactggcgtcaaaccagtgtgggaagatccggcgaactgcaaaggtggaaaatggattatccgactgaagaaaggattgtcgacaagaatttgggagaatctgctcatggcaatcattggagagcagtttttggttggagatgagctctgtggagctgtgtgctcaattcgcaatcaggaagatattatatcattatggaatag

SEQ ID NO: 30396 - DNA, 1118 bp, Caenorhabditis elegans
atgaagtcccggattttttttataacattactgacaatagttgccgctcaagaatccgcagatcagttatgcagtagtttcgatgcccagcagagctgtggacagtgtatcaaagcacatgcagagtgtgcatggtgtattgatcccgtatgtttactttaaagtgcaggggttttgagagggggtactaaaaagttggacgtcttagatttctgacctttttgtaaaatttgatatctagctagttactttgagttagttcaaaagattttccaactaaagaattatttaaaatcgttttctatttgtatagttcattccttttaactgcaaattttcaaaaattttaaaactgggtttaaatttaaatttaaattttatttttattaattttaaattttaattttaaagcgccactctacatgcacctgaaaaattgtagaatatcacattacaaatgttatcttagtttgtaattatttggaaaaaaccgaagaattaaattataggtgctttatgatgctttatgatgcttacaataatcgtgcagttacaaattcagaaaaattataagtgcatatgcacgtggtgtcaggctgtcctattatggtttgatctacaaaacaagcgggaattttttgtcaaaacaactgttacgtcagcaagctcttagccatgcgaaatcagttgagaagtctgcgtcttttctcttgcattttttgtagatctatgtagatcaaaccaaaatgggacactctgacaccacgtgcatatgtgaatacttttgtttcgcaaaaaaactttcagcactcttcccttacaaaccgatgccagctgaaatccaagtttaccaatgagacatgcacgccgcacttggtgtattctccacaaaccgctcaggtcaaaattcaacaagtaagtgttacagtggtatagatcctcgctgtttaacctttaaaatgttacaatttttgaaagtaaaacagcgaggaggcatacccattggagcctaattttccaactttttctccagaacttaccacttgaaaccaaacagcatgatggtaaaaccattgttcgacaacagccacaagcggtttccgtccgtctaatgccat

SEQ ID NO: 30397 - DNA, 1145 bp, Caenorhabditis elegans
atcccttcgagtcgtgatatttggagagcaagagtcgctcaagaaaagtatgcgcactgaattcagaagccgtggaggctgtaagacggtaactactgcagagccagcaaccttccagagaatgaatgaaagtatgattctgagtgcgatggagcaagatgagcagctgtgattgtttaagaaaacatgtagggtaacaataaatcattccgtcattgtttcaaaacgcttctaaaacctaatttatttgattttgatgttctttttttttactttttttttcgtttccgtcagtatgttgctgattcagcctattatgtttcacatatgaagatttgtaaatgaagcttgtcataagagagatgattggtcaaatttgagagaagtgaccgaagattagggaggggactgactgaaatgcgcagtcatgcggaaaatttagggtatttttgagttgaacaaccatattgttcggcagcttttcaaaacaaatggcgtcatggatatggaagtttttggttcttcgtttcgagacaggaaagtgaattttaatgaactactcatcggaaactggtcaaaaaagcttgttttttttaagggaggggggatttgatgtaagaatgataacaaaaatcttttgggacaaaagtatatactcacgtggagtcagaatatctcatttcggtttgatcttcaaaaaatgcgggagttgagacgcagacatctcaattgattttgcatggttaaaagtgtgctgacgtcacaatttttgcaaaaatattcccgcattttttgtagatcaacctgtgatgagacagcctgacgccacgtgtatactgtgtacactaaaaaatgcaaacgctacgtttgagtattatatgcaaatgtaatttttaacatgcttgcagggggttttcaaaaatgaaaattctttatagcttttttaaaattgtgtttttcttataaaaatccaattttttagatcgagtgggggcaaactttttgttctaaaaaaatatattttgaagatgttccaaaaaggtggtcacaagcaatcgactccagcctctccccggctaggatttggttataattcaattatgacctctgaactcttttctatagttgaaggggtactgagttga

SEQ ID NO: 30398 - DNA, 616 bp, Caenorhabditis elegans
gaagcgtctagaagatgcaaaatcatcgttgttggggccaaaaatgcaggaaaatcgacttttattgaacgtgtagaatttggaaagtttcatgaagagaaacagacggaaaagttgtatcgtgttattgcaaaaaaggtgtttgaacaaacattgaccgtggaactgatagagaaaggttcccatttttctgtaataatgtctataggttaaagtgaattttctagatcttggtggcttaacgaatgaagataatggattcaaaaaggtaaatttttattgacatttattcagggttgctgaaaaaaaaattttaatcggaaaagttaggtatattacagaaaattcaaaaatattaaaatttctttgaaaattgataaattaaattgtaaaaatggagaaatttttttagaaatcaaaaaatcgaaaaaaaatatatttaaaaaattccgtgtaattgaatatgtgcttaatggcttaataataagaataattagaaattccaaaattccagactgaaatgagagacgtggatgcagttttattattttacgcggctgatgacctggaatcttttaagcagctcaaggagaacctggtacatgttcagaggaag

SEQ ID NO: 30399 - DNA, 835 bp, Caenorhabditis elegans
atgaggcaaccaccagatttttgtgccgctcaaacgatgcacgtcgtcttgttttctctgttcgaaactggaaaaagagaagatttgaaaactgaagaaatagtcggagatggctcacatcctccttctctcctcccacgcccctttacaaaaaccttttgctgtttagtatgttccatgggatggaaacctgttggtttatcagttaagcgttcgcactgaccaattgtttgtatttattgatatcaccgtgtttaattctcaaataaaactgccctcctccttttttttttaatcttttatttttcaaaactctttttcctacttattattcccttaataaaccaatatgcatatcatttttcagcaattagcctacatcaaaatgttggcttacgggtctgatccgaacgccgaagacctctatatcacaatgacaccgtccgtctcaacagaaaacgacaccacagtctgggcgacagaggagccggcggcaattgtgtggagacatcccctattggcaattgcattgttttccatttgtctgctcacagttgctggaaattgtctggttgtgattgcagtgtgtactaagaagtatttaaggaatcccactgggtgagtttggcacaggaactctgaaatatcatatatttatgctcaattttagcctgtgtgcgcttttaaaaaatacagtaactttctcgctgcggaattcgcaatgtcttttcagaacatttattggcggaaagggtatcatttattggaaatttgctgtgccgagacctaattttaaaacaaaaatcacaacatttcgcatttgggtaacccgttt

SEQ ID NO: 30400 - DNA, 759 bp, Caenorhabditis elegans
atgtccaagtggtgtttgaatagcaaatcttgaaaacgtaaaaacaataattattttctatatctgtaaatattttcaacgaattttcagcttccaaattttggtcgtttttggatctttttacaaaaaaaatattttatcaactgacactgataatattttctgcctcatattaaaaaatattcctctagcaaaaactgtaagttgaacgaatttacaataaaaaacacagctgcactgaccaaaaaacaattacactggccaaaattgagcttgcactgaccgagtttagcgaccatatcttttttgtctaatttgtggtgtgtgcggcgaattcggcaaaattgtcgagctcggaaaacagaaaatttggcaaatttaccgcaaactcttcaactgaagccactattgcacattaactgtcaaaattctggatataattagcaaaacaataagtaacatttctgaaaaattagaacctttcccgcattgtatttgtagacgcacctaaaaaatttcaaaacaccaaaaaacaagcttccagtaaaaccctaatattccaggtattccgatgtcgcgaagtggcaacagatgcgatgttcgccgtcaaagtgctccagaagtcgtacctcaaccgccatcaaaaaatggacgcaatcattcgcgagaagaatatcttaacatacctgtcacaagaatgcggtggtcatccgtttgtcacacagctctacacacattttcacgaccaggctagaattt

SEQ ID NO: 30401 - DNA, 464 bp, Caenorhabditis elegans
atgtccaacgatcaactcaaatcgaaattgagggaatttttcgatcggcagccggatcagtcggaggtaaaaaaaaaattatttttaaagtttatgctgaaaaaaaaaattaaaattttccgtttcagaaagcccatcaagactcaaaaattttcgaggttctctattcccaattcctcgagaatcagcactgtattgactggaattcatggaaatttttagaggagaagcaccaagtcactctgaaggatttggagccttttgacaaatccaggctagttttatcaattttttgcacacgaaaaaattgaaaaagtttcttcagatttaatattttgaataaattggcagtgattaagcttaatggagggctcgggactactatgggctgcagcaaggccaagtctttggtcgaggttcgagaaggctacacttttatggatctggcggttttggagcatcag

SEQ ID NO: 30402 - DNA, 1004 bp, Caenorhabditis elegans
aactcacaatgtaaaaagagcaaaaaccaaaaagagccaattttcaggtggtgcatccggcatcggcaaggccatctcgcagacgttggccaagcatggagctcgtgtcgtagttgccgatttggattccggcaacgctgcagccactgcaaaggctcttccagctagccagagccattcctcgtttgcctgtgacgtgtcaaatgcagacagtgtgaaggggctcagtgagcatgtaaaatcgctgggaacaccgtcgattttggtaaattgtgcagggatcacaaaggttcggtttttttacaaattcatcctaaatcgtacacctacagtaatcctttgttactaaaaaggtgctgttggagtcaaaatatgtgtctagcgaactaaagaaacaaaaatttttttaaaggattctacacttctaaaaatgaagcaggagcaatgggacagtgtcattaaggtcaaccttaccggagtcttccatgtgagtttttttttctgaaaattgaggcgaaaaagttttccgatacagtgtgatcctagattattttttaaaagtgattgaaacactgtcagaataaagataacaaaatcaaagaggtaataatattttataccctttttacagtttttttttttaaattttgacttgcgactaccgatcgtgacggcgcacaactttagactctcccccaaattttaccattggttgtcagataagaaagcttgctcagcatgaaaaaaaaactataaaacaaaaatttaatatctacttgaaagttactaatttttacatcagttccaaaatgttttaaatacaatttcaggtatcccaagcatttgtcaaagcatcagttgacaacaacaaccacccattatcaattatcaatgtttcatcaattgtcggcaaaatgggaaatttcggccaaaccaactacgcagccaccaaggccggagtcatcgggttcacaaaatctgcagcgaaagagttggcgaaaaag

SEQ ID NO: 30403 - DNA, 733 bp, Caenorhabditis elegans
atggtcatccagtttgccgaaaaaaacaagttttcaggaaccctatgcattgcatctattgccagtaacatgactgtcatcaatttcacaatgatttgtatggcaaaaccttccgagttagtaccaactaccgaccaagaaggaacgatcaatttttcatactccaacgagcagaagtcagttataatgtgggcagcagcagtggggactctagccgccgcatggccatttcactggtaactttgagcattgtaaatcccaaaaatccaggaaatgtatttaggttctacgaaaaattcggagctcggagggtgttctttgcagcaggagcgttttcaacaatttccacagctctgatgccactggcagctcacattcatttcaattttctagttgtcgccaggtttttccaggtatagaaattctgaagctctaggggtaaaaaggttttttggtccaaaacctgcaactccaactactttgcctatatttttcagggcgtaagcttcggagctgactttgcagcaattggactgatcgttgtcaactgggccagcctgaaacaacacggactgttcatttcacttctctcatcattttctcaaatttctgtaatgttcacaatgcctgtagctggagaactttgtgaatcgaaatatggttgggagtccgtgtactacgggcacgcggctgtcagtggagctttgttcgttttatgggcatggttttatag

SEQ ID NO: 30404 - DNA, 517 bp, Caenorhabditis elegans
atccgcggttgggaaatcttacagttgtcgtaaacaacgctgccgtcattcctggaataaaatctcagatgtcgcttgctatccgcattaacgcgttttatccaacagcatttggagctacaattgtacacaaggtcctctccacctcagctcgtcgtgaattttggattcagtctattcaacagatatcttctcgcatcaagcaaatgagaactgctttgtttgacgttttgagtgctctcaaaactccaggaagctgggatcatatcattcgacaaactggaatgtttagctacactggtctcacttgtgagttttcttttgccacactttcgtaaaaaaggacttttaaaaaatttatttttcagctactcaagtcgatcacctcgttcgcaaccacaaagtcttcctcctcagcgacggacgcataaatattagtggactaaacatgaaaaacgtcgaatacgttgccaaggcaatcgacgagactgttcgtgccgtcaagagcaacgtctaa

SEQ ID NO: 30405 - DNA, 561 bp, Caenorhabditis elegans
cactcctacaaacttccatacgtgatggtgcgcatgaacaacgtctatgggccacgccaaatccataccaagctcatcccaaagttcaccaagctcgctttggatggaaaaccctacccacttatgggagacggtcttcatactagaagttggatgtatgtggaagactgctcggaggctattacaagagtagcacttgaaggaacactaggagaaatttacaatattggaactgactttgagatgacaaatattgaacttacgaagatgattcatttcacagtgagcaaacttttgaacaggtgagtgtaattttttcaaaacgattttgaaaatactttaaacaaaaaaaaacaacgaaacaattacagagagccaacggctccaacgtttgctccgatcccagatagaccataccacgatcgccgttattacatcgacttctcgaaaattcgcaatgcaatgggatggcaatgcacaactccattcagcgaaggactcatgaaaacgatcgactattacgtgaagttgcacgtggcgacagctcgtctccagggttaa

SEQ ID NO: 30406 - DNA, 466 bp, Caenorhabditis elegans
ttgatcaaccgattggatgaaagtgtagacttgttcaaatcgattcgtgagaatagcttcctcaaaatgtcgaatttcatgttgtttctgaataaaaaggatcttctgaccaaaaaactcacaaaagtcgtgttttccgactacttccccgactacaaaaagtggattaccaatgacaattcggacgtttctgtcgcggagtttatcgaaaacatgttccgtgaggtgatcactaaaatagaatatggcagaaaaaagtgtgcatataattgtagttataagtacacatgtctgcgtggttttttgtgtcaaataatttagctagaattttcagggtcttgagccggagaagcggatgtacgcgcatttgactcaagcgacagtaactgccaatatcgaaggaacgtttgcattgtgctgtgacgtcatctttgggaaaaactatgaggacaccaatttagaataa

SEQ ID NO: 30407 - DNA, 449 bp, Caenorhabditis elegans
atgcgacttttaattcccatacttatattcgccctgattaccactgccgttacttggttctacggcagagacgacccggaccgttggagcgtaggaggggtatgataagttttaatcataacattgccagttgtttattgcaggtctggccactcccgaaaaaaattgtctatgggtctaagaatcgaacaatcacttatgataaaatcggaattgatcttggcgacaaaaaagattgcgatattttactatccatggctgataattacagttagtttgtagaaaaaatatattttttttaccttcaaaatttcgaatttcagtgaataagtggttgttcccattcccagttgaaatgaaaactggtgggactgaagattttattataactgtcactgtaaaagacgagtgtcccagcggtccaccagtacacggagccagtgaagaat

SEQ ID NO: 30408 - DNA, 425 bp, Caenorhabditis elegans
atggcggaagttcctcatcacaatatccctgcggtcgacatgctcaacgcaacgtctcgtcttcagctcgaggctcaggaggtaagaaaaacgttattttcactttgattttccgataatttgtgcattttcagctccgtaacaataagccaaactggggatcttacttccgctctcaaatgattcaagaagacgactacaacttcatcaccagctttgaaaacgccaaggtgagattatttaatttaacaactgtgaaaattgaatatatgtataaattttagtcgaaagaagagcgtgaccaggttcttgccgctaacaatgccaatggacaggcagctaagaccatggcaaacctcatcactcaagtcgccaaggatcagaatgtacgatatgtgcttactcttttcgacgacatgcttcag

SEQ ID NO: 30409 - DNA, 260 bp, Caenorhabditis elegans
ttatctctacaacttctacctttatgctctgtgttcttctgaataccgtcacgcatttctccgactatttggatgtagatcaagcttatcgccaacttccactggcgactctccaaccgttcgagtctcagttcacggaaagcgatgtcatcagtgagtttttcccctctccgtttcaaaagtcaatcataatctccgtttgcagagctgtcgtccttcttggaaacgagaatcatgaaaatccagtggatgaagtttaa

SEQ ID NO: 30410 - DNA, 885 bp, Caenorhabditis elegans
atggattaccatctagacgtgtattttcaagaagaatggtacgaccatcgtcttgctcacaatgcttcggctccaattcttgtccgagacttgacagttttcaaaatgatgtggcacccggatgtatattttgcaaatgcaagatccgccgctttccaggtcagttcacactttacatgcttccacttgtgttttgacttgtgacttcaaaagatgtgagaaaaaaagacggaaaataaatttgctttttccatctctacacttcgagcacttttatgacgaatgagggtcctaataacatgcaaatcctatttcctatttcaggacatcaccgacgacaactttcttgtatgggtttatccaaacgggcgtgtttggtatgacgcgagaatctcaattgtaagcggaaaaaaattatattcaaatagttattcaaaaagtcatgtgttcaggtcagctcctgcaatatggatctttggaagtatccattggactcgcaggaatgtgcacttcggatactctcatatgcttacccaatgacagttcttcgtcttctctggtcagaaaaagaggacgttccggcaatcgaccgtaatccagacatcaccatgccggatatgtcgttaaaacacattaggacaggatattgcaacggaacttatgccactggagaatggagttgtatgacggccattttctatgtggaaagagaaatgatgcaccatgtcatgcagacttatgtgcctacagctctaatagttgtgatttcctggtttaatttctggctggaaattgactcagctccagcaagagtatcgttgagcattaccactctcctaacaatttcaacacaagctaatgcagtgaaacttgcattgccagaag

SEQ ID NO: 30411 - DNA, 1698 bp, Caenorhabditis elegans
atgtccgtcgcctggaacgtacaaaacggagagatcgatgcagtgaagcagagcgtcaacgagaagaacgttcacgagatctacaacggccgcaccgccattcaaattgccgccgactacggacagacttctatcattgcgtatttgattagcattggagcgaatattcaggtgaatcagcacgatattcaacaatatgcatttatgtttgttgattcaggataaggacaaatacggaatcacaccgctgttgtctgccgtgtgggaaggacatcgcgacgcggtgaagctgctactccaaaacgtgagtattttatggtgcagtagcgcctgtcgtgtgctagtaagcttaaattttacagtgaaactttccagaataattttattcgctgtcaaaaacggctatttctcagttttcgcctcaaaaaatttacgagtaggcgaaaaaaaaggcgatttttgaactcatcaaataatgtttcaaatattctaaaaattcaatcattgctcttcatcttacaaaaaatctagaacttttgtaattttggcattttactttttgagaaaaccatagcactgttacgtgttcgaatttcgaggctgtttaaatatcaacagttgaaacgtaagtaggcattaaaattcgaaataaaatttttttgatcgacaacttccaaaaagtggcaaaacctgagatttttccaattaaaaaaaaataatttaaaatttagatttttctttaatatttttattatgataattgatcattgtggtgtcatagccatttttttttaaggcggaataaagaaaaaaaaatactttaaaatattttctcaaaattttagaaaatcgaaggttatgatcgaatacaacagtaataattaatttttttaaatgatttttgtaaatttgcaaaaatccaaaaaactgccgaattaaatttcaattcccgcgcaattgagtgacgtcatgtttgactatttggcgttttctggctaaatacagtttttcttgaatttttctgtaatatttgatttcaaataccgtttattaagttttcaaacattttccagcaaaaaaaccataaataaaaatccttagtcaattttgcaaccaattttgcacttcttttcgcaattttcttttgggttattagaaattctctatggaaaaatgtttgcaaaattgacaagcggcgtataaatattgaagtaataccgatgaatttagccagaaaacgtgattttgccaaaaaattatgtcactcatttgcgcgggaattcgaatttattcatgacttgtttttcgatttttgcaaaattggaaaaaaaatcataaaaaattaaaatttttttgcacattacttcacctttagaacaatttccccactggcgccacaccatctcaaaaagtatttaacaattaataaaaaataaacataaatgaggtacatatacctaatcaaccgtggtttgaaacggattcctcgccctaacttaacctttaacatgaaaattacattttaacaattatacaagttttattagatacaagcttttttgaagtttaaaaaaattacataatattcatatatcagttgcttttcagggtgcggaccgttcgatacacgccccagacggcacggcactcatcgactgcaccgaggaggaagacattcgtgaacttcttaaaaattga

SEQ ID NO: 30412 - DNA, 795 bp, Caenorhabditis elegans
atgaatggaaaaagtattggaaaatgtttttgggttaggtacactacacaagcactaacatttcatcattggctaacttacatgtgtatgccaaatgcgcgtacacaagtatttgtaatataattaaactttgaatatgattgaacatgccagctaatcaatttgattgcagattgttgtggttggagatcacaattgcgggaaatcatgcatattgctgcgattcgctgagaacagttttcgcatggatcatatcagtacattaggagtcgattttaaattgaaaactatcaagttgggacgggataaggtaagcgagacgttgaagacattgtccttcgtttcttactacatatttacttttcctgtttacctagggttttcgctcctgtatgtattactttattatactgagtttcaccacaaattttgacaggaagttttttttgaaatttttcttatctgaaaaagaaaaaaatttctcccacgcaaacaaatggtttgataattcaccaattcctgataacaatctttctggtcagcaagtacaactatgctcattgattgcagatccgattagaactatgggataccgctggaatggaacggtataggactatatacaattcttactatcactcagcgcacggagtgatgtgtgtctacgatatgacaaatgaaaaatcgttcgaaaatctggagaaatattggctgaaagagatcaaacaacacgctccaccaaatgccgtattgatgttagttggcaacaaggcagatatggatcaggaacggaag

SEQ ID NO: 30413 - DNA, 364 bp, Caenorhabditis elegans
gattacatctcgattcctcaaaacaatccggatttggatttcctcggtgcaaccggatcattcgggccaccgggagggctgtatccaaaatgtttcaacaactcggccaatgaatacatctacaaccggtatgaacattcatatggatcgtttggcagtggactttccacgcctggaggtactaaccctaaccaataacaccgtgtgcataactcatcctcattctcatttcaggagtttcagatatgtacggcgtggcgatgagcgacaaattgccggttatggagacgctacaggaagtggagactcccaaaacgtccaactacaacttcctctcgtcgccggaagtggtccgaccaattag

SEQ ID NO: 30414 - DNA, 378 bp, Caenorhabditis elegans
atctatccaatgtggttgtgcccattctacttgaaatcccaaccaggtctcatgaaattgagaaatgctactcacaagatgtacgtggatgttggagcgtatggagtaacatccaaggatggttatcatcacgagagaacaacacggcgactggaatcgtttgttcgatcagtcaatgggtaaaatttgcctataaattatcactttaataatttatcgttcagattccaaatgacatatgccgacatttacatgacacgagctgagtacgctgaaatgtttgacagaacactctatgattggaaaagagcatcttgcaaatgtatcgatgcgttcccagatatttacgataaaatttgcagaagtggaaggcgttaa

SEQ ID NO: 30415 - DNA, 522 bp, Caenorhabditis elegans
gtcggtggacaaggattgtttggcggaggcttacgatcgttggtcgctgcagcgaaagctgccgaatcgcaacattcttcccacactccacaaccgccagaggaaaccactccgataattccacaacatgcacagcagttctcggcagcaccgacgatgagcgcacaaggatccttgcaacaaatgcagggaacgagtagtggcggtggtcaagtaatgcctgatacagagtgtttgaaaacagattgtataattgttcagcgtccctattcactcttcaatagcttcgtcgacactatcaaatctggaaaacaggatggagacgtcacagatgtgcaatatcaaagtgttgatcagcagcagtatgtttccatttcctactcagaaaataaatgcgcagtagggcttctatgggaggcaggcgcggtttcaggatctggtgcctgcctccaacctgcctctctcgtcaacctctcgcctcatttctgcactacagcaaaaagccgaaggattggtgtttaa

SEQ ID NO: 30416 - DNA, 576 bp, Caenorhabditis elegans
atgggtgacctgcagtacctgcaggtacagagggcggccgttgccgatcctgccacacttgccgcgtgggcacagcggaaactgtgctgggtaccagatcagaacgaaggatttctcattggatccatcaagtgagtttgcgtgctctcaactcattccgtaatcggtagtaatttcagacgagaaacaaacgatgaagtgctcgtcgagcttgtggacacgagtcgccaggtcacaatcagcagagatgacgttcagaaagcgaatccaccaaagtttgacaagatcgaagatatgtcagagttgacgtatttaaacgaagcgtcggtacttcacaacttgaaagacagatattattctagtttaatttatgtgagttgagaaaaaaaaacattttaatttcaaaataactattttagacttactctggtctcttctgtgttgttatcaatccttacaaaaagcttccaatttactcggaagatttgattgaagagttcaaaggaaaaaagagacacgaaatgccaccacacatatttgcaattgctgatactgcgtacagaagtatgcttcaag

SEQ ID NO: 30417 - DNA, 915 bp, Caenorhabditis elegans
atggacgcggacgcatcaacaatcacgccagaagagctcgactttatccgtcagcgagctttgcgccgcttcgactcaatcgtcccaactgctggaagagaaggaactgagattgcgtcggatattttcaagggacgtactctcgcgatttacacgtccggaggagactctcaaggtacgaatgaattagggcaaaatttgaaattttgacctgccatgaaaattttgtgtggagtctccatataaaattcatttcacttttaataaaattcaaacttttccttgtaagaatacgtttgaaactttattttccaggtatgaacagcgctgttcgaagtatcacaagaatggctatatactgtggatgtaaagtgtatttgatctacgaaggatacgaaggaatgattgaaggtggagatttcatcaaggaagccacgtggaacaccgtttccgatattattcagcaaggaggaactatcattggttccgcaagatcttccgaattcagaactcgtgaagggcgtctcaaggtgagaaaataattagcccaataaaacaaatttttgaaagttttgaaagttaaaattaaatttccaggcagccaccaacctgattaatcgtggaattggtcgtcttgtatgcattggtggagatggatctctcactggagccaacactttccgtttggagtggaccgatcttgtgcaagaacttgtgaaaaatcaacgagtcactgcggcggctgcgaaaaagattccttacattcaaattgtcggacttgtcggatccatcgacaacgatttttgtggaaccgacatgacgattggaaccgactcggcacttcaaagaattatcagttctattgatgctgtagtcgcaactgcacaaagtcatcaaagggcttttgttattgag

SEQ ID NO: 30418 - DNA, 231 bp, Caenorhabditis elegans
gcgatgggagttctattcatggaaaccagtgctttagacggaagtaacattgataacgctatgttggcactaaccaggttatagatcaaaagttgagcatgtgacgcaaaataatatttgttcagagagctcatggcagtagaagatgttgaaattcgctcaacaggtgttgtgctcaatccagcagttgcaaagaagggtggatgtttctcaaagtgtcgtggttcttaa

SEQ ID NO: 30419 - DNA, 833 bp, Caenorhabditis elegans
gtctacaactcaagagacccagctgagatccaatggggagcctctggagccgactatgtcgttgagtccaccggagtcttcaccaccatcgagaaggccaatgctcacttgaagggaggagccaagaaggtaaattagtgatttaatttttcaagataaatatatttaaatttcaggtcatcatctctgctccatctgctgatgctccaatgttcgtcgtcggagtcaaccacgagaagtacgatcatgccaacgaccacatcatctccaatgcttcctgcaccactaactgccttgctccacttgccaaggtcatcaatgacaacttcggaattattgagggacttatgaccactgtccacgccgtcaccgccacccaaaagactgttgacggaccatcaggaaagctctggagagacggacgtggagctggacaaaacatcatcccagcctctactggagccgctaaggctgtcggcaaggttatcccagagctcaatggaaagctcaccggaatggctttccgtgtcccaaccccagatgtctctgttgttgatctcactgctcgtcttgagaagccagcttccctcgatgacattaagaaggttatcaaggctgccgctgacggaccaatgaagggaattctcgcttacaccgaggatcaagttgtctccactgactttgtctccgataccaactcttccatcttcgatgccggagcatccatctcactcaacccacactttgtcaagctcgtctcatggtacgataacgagttcggatactccaacagagtcgtcgaccttatctcctacattgctaccaaggcctaa

SEQ ID NO: 30420 - DNA, 832 bp, Caenorhabditis elegans
gtctacaactcaagagacccagctgaaatccaatggggagcctctggagccgactatgtcgttgagtccaccggagtcttcaccaccatcgagaaggccaacgctcacttgaagggaggagccaagaaggtaacttgtaatcaacttttgtgcataaatatatttaaatttttaggtcatcatctctgctccatctgctgatgctccaatgttcgtcgtcggagtcaaccacgagaagtacgatcatgccaacgaccacatcatctccaatgcttcctgcaccactaactgccttgctccacttgccaaggtcatcaatgacaacttcggaattattgagggacttatgaccactgtccacgccgtcaccgccacccaaaagactgttgacggaccatcaggaaagctctggagagacggacgtggagctggacagaacatcatcccagcctctactggagccgctaaggctgttggaaaggttatcccagagctcaatggaaagctcaccggaatggctttccgtgtcccaaccccagatgtgtctgttgttgatctcactgctcgtcttgagaagccagcttccctcgatgacatcaagaaagttatcaaggctgccgctgacggaccaatgaagggaattctcgcttacactgaggatcaagttgtctccaccgactttgtctccgataccaactcttccatcttcgatgccggagcatccatctcactcaacccacacttcgtcaagctcgtctcgtggtacgataacgagttcggatactccaacagagttgttgatctcatctcgtacatcgccaccaaggcctaa

SEQ ID NO: 30421 - DNA, 333 bp, Caenorhabditis elegans
agatggttacgtaactctgcaagagtacatggcgttcatgatcagcaaagaaaccgagaacatccagtcttcggaagaaatcgagatggcattcagagctctttcgaaggaattccgaccatatgtcacggcagaggagctctacgcggtaggatttttgaatatttttcctagattataaatatttaatttgtttcatttcagaacctgacaccggagcaagccgaattctgcatacgaagaatgaagccatacatggacgccatttcaggtcgttccatccaaggtggtctcgactacgagcagtttgtgcatgccttgttccagagctaa

SEQ ID NO: 30422 - DNA, 1525 bp, Caenorhabditis elegans
agacaaataatcctaactcaatggccgcgtctcctgtgtatatccctctgtgagcaggcagaagatgtctctttcgacgaccacctgacgagcctcatgctcaagttccgacgtttagacgtttcgccggctgaattcaattgcttgaaagcgatcaccatcttcatgaaacgtgagttgagcctgtggagagcgggatgggacaacagagcaagcatcattaccgtataccccgctggcgaaagaggagcacgccttgttgctgccgcgcttctgttggcagagcacagcgtgatgggtttcggcaattgtgttatccctctcgcgctggtcttttctaccaaaagcagatatgtgatacaacggcatgccattaactctttacccgcctgtgtccccggaggcacgtctgcgcatcctgtgctcagatgctccatgggttcacggcgcgaaaaggtaatttaggggggtgggggggagaaggagttggcgacccatccaaccgcttatttgcttggatccgagtttacatgtgtatcccaccgaatttgatactctcaccggagcacggatcctaaaacttaaaacctaaaacctaaaacctaaaaccatgggtcaaatgtaaaagggatcggttacataaagcattgaaaaaagatatgacttttccgaatttgaatgaatcaaacaagtttttacgtaaaagggcaaacattatttaaataaagctggtttcctcacactaaaaatactggaatttcaaaagatatgagattattgcaatcgagttaaaaaaacactttttagttataattttttcaaaagtgagttataccattttcacatcttctcgctagggcttccaggtaggcgacaaaacgtccacctcgtgccttctgaatattgcggcgcggaacccgaaaagtgtcggccgcgtcgaaaaaaaccacttttcgcactatgtggtgtaaataccgagccattgattttttgccatagtgcagaaacgagacaaaagaccggtttgaggtgagggttggaggcaggcgtcaggccttgaaacctcgcctgcttctcatggaagccctagtccgtgcactaaaaaaagtgaacgagaaaaaagttatcacagtgttaaaacaaaaaggtttagaccagtgtaaatgtatcaatattggcaagtaaaataggtgaatttgctaaatttgattagtcaaactattagttgggggttgcttcacaacatttgtattataattccaatttgtgaagaacttgtgaaaaaaataaaaccatctgcaaataaaaccaatttccagcaactgaagactctcaatatcaatttgaagagcaactagaccaatgcatttgcctgcttcaacaatgctgtctgaaacttgactcatcgccttcccgatttggaaaactgctactcctcctcgccgaaattcaattttacccaactagttatctcgaatctctacttgacaccaaaatttcacaacttgtctcccgtttcttgtaa

SEQ ID NO: 30423 - DNA, 285 bp, Caenorhabditis elegans
cttcttcacggatccaacaccatcagctaaaacgattattgctcaaaagaaatatggaataatcacagttggatacggaggcgcagttgacaccggaaagttgcagaccatctctggtggaagcgcttgctcgttcaccgctactgacttcacaacactgaacaaccaaattaagccaattcaacaacttattacagccgctaggtaagaatgaggtatatgaactttttgtaataacaagttactttcagcaccaatggaggaaactactgtaagagcacttaa

SEQ ID NO: 30424 - DNA, 285 bp, Caenorhabditis elegans
cttcgacaccgatccaactccggcagctcagacaattctcgcgcagaagcaatacggaatcatcactattggttatggtggcgcgactgataacaacaagttgcaaactatttccggaggaagtgcttgctcgtttacagctccagattttgctagtttgaataaccaaattaagaccattcagcaacttatcctcaatgccaagtaagatatataagtgtgttcattaagtgaaatgttcttattttcagcgccaatggaggtgtctactgtatcaacaactaa

SEQ ID NO: 30425 - DNA, 1537 bp, Caenorhabditis elegans
atggtcaacaatcgctcggtaagttattttatagaaaatgtagtaaaacacgtggaatttcagcgtgaagtgatttcaattcacgtgggccaggctggagttcaaatgggaaatgcctgctgggagttgtactgcctggaacatggaattcaacctgatggaatgatcaatgaagaggacagcttaggtaggtctggataatgaaagatgtgctgtaatacctcttttttcaggtgtggacgacgactcattcaacacattcttctcggaaacgatggctggcaagcatgtaccacgcgctataatggtcgatttggagccgaccccgattggtaagaagcgggagtgttgagcaattatgtgggagactagtagcggtgcgcgcgtgcttgacaaagcaattgtgcatgcggaaaacgatcattgtcttgattgatgctctacccttcaaatggtgtcgattataaagctattggaagcgattcgagcgtgttgtgtagaacggaagagtttaggaactttcaaagtgtgaatagtacgaggattgtactatggtgctcagaaagaagtagaatattgttctgatcaaacttacttctgaaggaacaagtctaagaattttccgtcagtgctgttatttcgttacacatgctcaaaacaatttaatcaaattttggaaaaaaatggagtagattacaaaaggtttttaatgtgaaaatacatttccggagcctcataaagaaggctgaaaaatttaagaaaagtaaaagaaactttacatcagattgaaggataacactctagattttccaaaataacaaattaacgtaattaagattacgaaatagcgctttaaatattttgagattttttaaaatttttattcaaacttgcaacattacttgaataaccacgtggaatcagaaagtcccatttcgctttgatcttcgaaaaatgcgggaggttagacgcagacttttcaactgatttcggatggttaagagtgagctgacgtcacatttttttgggcaaaaatttcccgcattttttgtagatcaaaccgcaatgagacagcctgacaccacgtgaataacgccataagatattttaagaagagttgaatatctgtattgatatacgtataaaacaataaataaaaaattttatagtaggaaaatgtataccaagatttaaaaaaaatggactcaccaccgtaatcttgcagtcacacaccacaagtgccaagaatataggaaatgaatatgaacacgaccaaactacttttatgtatgattcatatctataatcatcctgtccagactgtataatcattttaactatcttgtctacactgtcatttatagatgagattcgcaccggaacatacaaaaccctgtttcacccggaacagcttttgactggaaaagaagacgcggccaacaactacgcccgtgggcattatactattggaaaggaaatcatcgatgttgttatggatcgtgtacggcgtctcgtcgaaaattgtagagggctgcag

SEQ ID NO: 30426 - DNA, 547 bp, Caenorhabditis elegans
atgttattcaatgcgcctccgaatattatttacatgctattgtgttttttactgatggatatcagcaatacagtattaatgctcctttttccaactttggcagatattataaatgagatgaacaatcacacattgtcagctcattttggaattgaaccgactattgcaaagtgagttttcgaatgtgagttcccaagcacttatatatgttttagtgtcaatgtgatgaactctatgattacgggggcaagtacggtaggattatttgtttctctgtttgttcttgtgccatttgcggaaacaaaaggacgaaaatataccgttgtctatttccggtcagtttttgtcatttcgtagctttgaaatatttattcaactttcagattcattatatcagtagtttcatcactgtgcatcattatgtcagctttatttcaagcctccgaattttttatccttggttcagcggttaatggtttacagttaccaatgcgtatgttcgtaacaatgcttttcataacagagtgtgcacccgacaaatatcgag

SEQ ID NO: 30427 - DNA, 1359 bp, Caenorhabditis elegans
atgaatacacaatacgctattggaatcgatttaggaactacctactgctgcgtgagagttttcatgcacgggaaggtagaaatcattgccaacgatcaaggaaaccgtacaactccatcatatgtggctttcaccggcaccgagcttctcatcggagatgctgccaagaatcaagttaccatgaacccacataacactgtttttggtaagtataattattttgattttgatcaatcacaactaacttgtttttcagaagttacacgtcttattggacgcaatttcgaggatccaacagttcagtctgacataaagcattggccattcaaggtcatctctgccgaaggagctaagccaaaagttcaagttgagtacagagcagagaacacgattttcactccagagaagatctccgcattggttttgctgaagatgaaggagaccgccgaggccttccttggaaccaccgttaaggatgccgttgtcactgtctcagcttacctcaacgactcccagcgtgaagcaaccaaggatgccggagccatcgctggacttaacgttcttcgtatcatcaacgagccaaccgctgccgcaatcgcttacgggtttgacaaggaggtacacggagaacgcaatgttccttatcttcgatctgggaggtggtaccttcgatgtctccattcttaccactgaggacggaatcttcgaagtcaagtctaccgctggctgcgctgatctcttcacatccaccatggactcagtcgagaagtctcttcgtgacgccaagatggactagagccaagtgagtttttgagaacgtttttgtttgtctgcttctcctcttctgttccggcttcgattcccgcagtttttgccgatataaaatgagaaaacataaatctggcataaccctactgttgcacttttatgtgttgtctgtttctcagtcgcatgtacaattaaaacaataaaatctaatttgattattttcaggttcatgacatcgtccttgttggaggatctacttgtatcccaaaggcccagaaactgttgtctgaccttttctcaggaaaggaattgaacaagtccatcaacccagacgaggccgttgcctacggagctgccgttcaagccgctatcctctccggagacaagtctgaggacgccaaggatcttctactggacacttctccacttttcacttctccgtcggaacacaagtttcatagtcaacctctaatttcagtagtgttgtgtcgacaagcccaactaccgcgtcgttgccgcctccatacaaggcctccttgtgccttattttctcccccctggtcatctcatcaatcgtgtcaatgccactaa

SEQ ID NO: 30428 - DNA, 698 bp, Caenorhabditis elegans
atgaagttcaccgttcctcgaaatattcttttcatgatattcacttttgtactgttggatattgtaatgcagatgcaagtactcacattctctgctctagcagaacttgtaaatcagatgaataattatacattgagtgcgcattttggtatcacgcctacagagactaggtgagtcttattagaggcagattaactttggatctgagttattttttatggtaggtgttttttggaattgacgaaaattttcattggtgtgactttgaatgtaatcgaaaaagtatggtgttacataatacaatattactataattctgaaaatttaaatcataagaaaaaagttgtaacttcttatatttacagtgttggcgttctgaactcaattttcgcagttacacatgaaactggaaacgctctcgcaattatttttctattacctgttgcagactcaagaggcagaaaatttatggcagtttatttacggtagcatttattttaaagttattacttcacattaaatacttgattacagatttgcattattatttttaacgggatttttccatttgttagccacttccttccaagctgctgaagcttatactttgggacaattgtttcttggaatacaaagcccgctgcatttgctcatcacgcccatgtatattttagaatgtgctccagataattgtagag

SEQ ID NO: 30429 - DNA, 1612 bp, Caenorhabditis elegans
atgtttcaggagaatgcagtcaccaattgggaatgtcaaatcgaaagattcgtgatgagcaaatctcggcgtcttcgagtttcgacttgcaaagcactggacctcaacatgctcggtaagtggtttgggaactactcatttgaaattcgtactacgtttgaatcccttgaaactttaatgcaaatttccacggacttgatagaaacatagaaaatttgaattactttctctctgccaatccttttagcattttctcacgagttatttgaattgtggggaccgttcaaatttgaaatacactacacaaaaaattagttggcatcttgcttaattatagcgagctgactgtcaacaggaagagagctattgtgttagcctaataattagtctcttccctaattacggtatccgctttcacatcgttttgtatagtgttgtgaccccacccaggagaattcacgcgttcccaaaggcggctttacaagatggttagaggggggattactgctctttgcaagttcacgcgttcgccaaactcattgaaattgaaattgagagcgcattggcatggcacatctaatttggacaagcttctgacgggggaacgtgatgcttcatcagtagcatacgttaacgcctcaacaagcgatttatctagtttgattgttttgacaggccgcatgcggtgctgggggctttccattgcttcacttcctaattgcaatgtgttgcattgcgtagataaaatcttgattaggagctcatctggagaatgagaggagaaggaagatggaatggaaattgagagccacacaacgagaaattgcaatatacaatagtataaatataaaataacatactttttatcacttaaaggtgaactacggtcagtagagaaatattcctaatcttctaaaatatccaaataacttattttttgtgtagaatatttttattttcagtcaaaaagcggtaaaaaacggttattttaaaaacctctaattgtgaatactgtcgcatgcataaacccctactgtcttgagataggaattttccaaataaaattaaacataaaactgaatggaacatatttttttcttgatttacgatgtccaaaaaatgggtgaaaactgagttttcaccgctttttgacttgaaatgaaatttccaatattttttgaaaagttttattacaagattggaagcaccataggaatgttttttgtctacctacaagtctcaaatttaatacatttaaacatttatcgttatgtattgttttcacatgggaatgaattttatattttaatattccaattcaattttttcagagctcatcaagaatctggaagtggtgcctggtgtccgaagaatcaaataaactctctcagcaaagaatggttgcagatttcgttttccgtggatacaggtttcgagcagaatctagaaaattctaacaaaaagcccaattttttcagtaataacttctgtggagacccagggacgatttgacgacggacgtggaatggagtatgcgaccgcattcaaaattcagtactggcgaccttcgctaaacgcatgggcatcttataaagacgattttgagctagag

SEQ ID NO: 30430 - DNA, 1713 bp, Caenorhabditis elegans
acaaggacgagccaagtttgtgccagaggattacactccaggactctgcacgcatattctctttgcattcggatggatgaacgctgactacaccgttcgagcatatgatccagcagacttgccaaatgattgggctggagaaggaatgtacagaagagttaacaagctgaaagtcactgacacccaactcaagacccttctctcgttcggaggatggagttttggaactgcacttttccaaggaatggctgccagttctgcgtctagaaaagtttttatcgactctgctatcactttcgttcgcacttggggattcgatggtattgatatcgactgggagtacccttctggagcaactgacatggctaactacgttgccctcgtgaaggagttgaaggctgcttgtgagtcggaagccggaagcactggaaaggatcgtcttcttgtaaccgccgctgtcgccgcaggaccagccacaatcgatgctgggtatgatattccaaacttggcaccgaactttgactttattcttctcatgagttacgatttcttcggagcatgggcttctcttgttggattcaactctccactctatgctacgaccgagctcccagctgaatggaatggatggaacgttgattcatctgctagatactggaaccagaagggtatgccaaaagagaagatcatcgtcggaatgccaacatatggacgaggatggactttgaacaatgccagtgcaattaatccaggaacaagcggatccccagctaagatcactcaatatgttcaagaagccggagttggagcctacttcgagttctgcgagatgctcgccaatggagccaccagatattgggatagccagtctcaagttccatatctcgtacaaggaaatcaatggtggtcgtacgatgatgaagagtcgtttgccaacaagatggcatacgttaagagagaaggttacggaggagcttttgtatggactcttgattttgacgatttcaatgctggatgcagcaactctaatggtcagctttacccactcatcagtgtcattgctaaggagcttggaggagttatcattccaaagaaaggtggcgtcacaactgctccaaccactgtagcaactacggtcacaactggacgccctccaatgacttcagcagtaaccacaactactgccgctaccacaactacaacacgtgcagctactacaaccacagcttccaatacaaatgtctgttctggaaaatcggatggattttatccaaacagcaacaactgcggacttttcgttctttgtctgagctgtaagtttttaaaaattatattatttagaatgtttatgaacaattttcaatttcagcaaaatcatacagcatgtcgtgcccatcaggacttcaatactctgcttccctgaaatactgtaccacttccactgcttctggatgttctgtgaccactactagagctccaactacgacaacaaaatctgcgccaactgtcaccacaactacaagagcaccaacaaccactacaccggctttcaagtgtaccaaggatggattcttcggagttccgagtgattgcctcaagtttatccgctgtgtgaatggtatttcatacaactttgagtgccccaacggtttgagcttccacgctgacacaatgatgtgtgatcgtccagatccatcaaaatgtgcaaaataa

SEQ ID NO: 30431 - DNA, 4304 bp, Caenorhabditis elegans
atgaagtcgataatcattgcctctcttgtcgccttggcgattgccgcctcaccggctcttgaccgtaccttctctccaaagagcgaatacgtctacaaatttgacggacttcttctctctggactcccaaccgcatcttccgatgcttcccaaaccctgatttcttgccgtacccgtcttcaagctgttgatgatcgttacattcatcttcaattgactgatattcaatactctgcttcccacattccacaatctgagcaatggccaaagatcgaatctttggagcaacgtgagctttccgatgagttcaaggagcttcttgagcttccattccgtgctcaaatcagaaatggacttatttctgagatccaattctcttccgaagatgccgagtggtccaagaacgccaaaagatcgattctcaatctcttctctctccgcaagtcagctccagttgatgagatgaaccaagatcagaaagatatggaatccgacaaggattctcttttcttcaatgttcatgaaaagaccatggaaggagactgcgaagtcgcttacaccattgttcaagagggagagaagaccatctacaccaaatctgtcaacttcgacaaatgcatcactcgcccagagactgcttatggtcttcgttttggatctgagtgcaaggaatgcgagaaggaggggcaatttgttaagccacaaactgtctacacctacaccttcaagaacgagaaattgcaagaatctgaggttcattccgtttacactttgaatgtcaatggacaagaggtcgtcaagtctgagactcgcgccaaggtcactttcgtcgaggagagcaagatcaacagagagatcaagaaggtattctatttgaaaatatattttacgggcttttgatagctaactctaacagcagcacacaagttttcaggtttctggaccaaaggaggagatcgtctactccatggaaaacgagaagcttattgagcaattctaccaacaaggagacaaggctgaggtcaacccattcaaggctatcgagatggagcagaaggttgagcaacttcaagaaatcttccgccaaattcaagagcacgagcagaacaccccagaaactgtccaccttattgcccgcgccgtccgcatgttccgcatgtgcaccatcgaagaactcaagaaggttcacaccaccatctacactaaggccgagaagaaggtaaccaatacacatttcataatcactaatatcatgctctctcttaggttcaacttgtcattgaaaccacattggctgtcgctggaaccaagaacaccattcaacacttgattcatcacttcgagaagaagagcatcacaccattgagagctgctgagcttcttaaatctgttcaagaaactctttacccaagtgagcacattgctgatcttcttatccaactcgcccaatcgccactctctgagaagtacgaaccactccgccaatctgcctggctcgccgcaggatctgttgttcgtggatttgcttcaaagacccaagaccttccattgatccgcccagcatctagacaaaccaaggaaaagtacgttcgcgtcttcatgcaacacttccgtaacgctgactccacatacgagaaggttcttgctcttaagacccttggaaacgccggaatcgacctctccgtctatgagcttgtccagattatccaagatccacgtcaaccactttccatccgcactgaggctgtagatgctcttcgtcttctcaaggacgttatgccacgcaagatccagaaggttctccttccagtctacaagaaccgccaaaacaagccagagctccgtatggctgctctttggagaatgatgcacaccattccagaagaaccagttcttgctcacatcgtttcccaaatggaaaacgaatccaaccaacacgttgctgccttcacctacaacgtcctccgccaattctacaaatccaccaacccatgctaccaacaattggctgttcgttgctctaagatccttctcttcacccgttatcaaccacaagaacagatgctctccacctactcccaacttccacttttcaactctgagtggctctccggagttcaattcgacttcgccaccattttcgagaagaacgctttcttgccaaaggaagttcaagcatcattcgaaaccgtcttcggaggaaactggaacaaatacttcgctcaagttggattctctcaacagaactttgagcaagtcatcctcaagaccctcgaaaaactttctctttacggaaagcaatctgatgaactccgttcccgtcgtgtccaatctggaatccaaatgcttcaagagattgtcaagaagatgaacatccgtccacgtgtccaacaaaccgattctcaaaatgctcacgctgttttctaccttcgctacaaggagatggactacatcgttcttccaattgacatggaaactattgacactcttgttgagaagtatgtcagaaacggagagtttgacatcaaatccctcctcactttcttgaccaacgactccaagttcgagcttcaccgtgctctcttcttctacgaggctgaacgcagaattccaacaaccattggaatgccactcaccatttctggaaagatgccaactatcctctctatcaacggaaaggtttcaattgagctcgagaagcttggagctcgtcttgttcttgatatcgttccaactgttgccaccacccacgtcactgagatgcgcttctggtatccagtcattgaacaaggagtcaagtcacttcaatctgctcgtctccacactccattgagattcgaatcaactgttgaattgaagaagaacactctcgaaatcactcacaagtttgttgtcccagagaacaagaagaccactgtttccgttcatacccgcccagttgctttcatccgtgttccaaagaaccaagactctgaatatgttgaggctgaagagaagactatttcccactcacaataccaaatgtctactgaagagattgatcgtcaatatgagacctttggactcagaatcaatgcccaaggaaatgttctttcccaatggactcttccaatggttttgatgactgaacaagatttcgagtacactcttgaaaacaaaaaccgtccagttgagttcacagctcgcgtcactattggaaacctcgagaagactgatctttccgagatcaagttcgacaagatcttcgaaaaagaattcgaccttgagaacaacgaatctgagaaccgccgccaatacttccacaagatgatccgtgagattcaatctgagcaaggattcaagaacctcatcaccctcaagcttgaagccccacaacaaatgtactggaacactgaacttcgtaccgtctgtgacaaatggatccgtatgtgcaaggttgagatggatgctcgccgctctccaatggagcacgagaacaaagaatggactcttcgtactgagcttcttgctgcccgcccacaaatgccatcatccctccgtcaactccgtgagcaaccacaccgtgaggttcaactcgcattcaatgccaagtggggatcatcaaagaagagcgagatcacagtcaatgctcaactcgaacaatccacggaacaaaagaagttcatccgcaacatcgagcgtgagtacaagggaattccagagtacgaacttttgatcaaggctgctcgtcttaaccaagtcaatgttgtctctgagtacaagctcaccccacagtctgaatacactttctcccgcattttcgaccttatcaaggcatacaacttctggactgtttctgagaagcgtgtccaaaacgagaatcgccgcgttgttcttcaactttctgttgagccactttcccgccaatacatgaacatgaccatccagactccagaacaagaagttgagttgaagaatgttcgtattccacgcgtcgttctcccaactattgctcgtagtgccatgttccaacaaacctgggaaaagaccggagccacctgcaaggttgaccaatctgaggtttctacctttgacaacgtgatctaccgcgctccactcaccacctgctactctcttgttgccaaggattgctctgaacagccaagattcgctgttcttgccaagaagatcaacaagaactctgaggagcttctcgttaaggttgtccgccgtgaggaagaaattgttgtgaagaagtctgacgataagttccttgtcaaggttgacggaaagaaggttaacccaactgaacttgaacaatacaa

SEQ ID NO: 30432 - DNA, 341 bp, Caenorhabditis elegans
gttatcccgtactctgttgcgaacaacttcgagctagctcacacaaactcctggactttccataccgccaaggttgcatgtgtttcctggtcaccggacaatgtccgtttggcgaccggttccttggataacagcgttattgtatggaacatgaacaaaccatctgatcatccgatcatcattaaaggtaaatatttctctattaatttaacacatttaacaacatttttataggtgctcatgctatgtcgtctgtcaattcggtaatttggctcaacgaaactacaattgtgtcggccggacaagattcgaatatcaagttctggaatgtacctttttaa

SEQ ID NO: 30433 - DNA, 464 bp, Caenorhabditis elegans
agttcaaccatcagacgaaggtgaatacgtttgctatgcacgaaatccagcgggaactcttgaagcatctgcacatcttcgtgtccaggcacctccatccttccagacaaaaccagcagaccagtcagttccagctggaggcacggcaacttttgaatgcaccttggtcggtcaaccgagtcccgcctatttttggagcaaggaaggccaacaggatcttcttttcccaagttatgtgtccgctgatggtagaacgaaagtttcaccaactggaacattgacaattgaggaagttcgtcaagttgatgagggagcttatgtgtgcgctggaatgaactcggcaggaagctcgttgagcaaggcagctttgaaagttacaactaaaggttagtgaaagtatttatttcatatttcaggcaacatttgaaaccaaaggccgtgtccaaaaaaaaaagagcaaataa

SEQ ID NO: 30434 - DNA, 1273 bp, Caenorhabditis elegans
atgccgccagatacacggattaacaaagaaattgtgagaaaaaagcggccgaagactgccgcatcttgtgttttcatcaattcattagttcattcatcgtttcagtttcctcccccctattcatttattgtgttacatgttcattctcattcttgcatgcagatctgacacaatcctcattgtttccattgggcgcaacgggggccctccaagaaaaaaaattggaaaatacgttgtttcatgtggcaaaaagaaacatcttgagtctacaaccgcacaactctaatgaggaatttttcgagagaaacaacatagcacaacacatctctttctttctttttttcgttacttttttcaacgattgacctaccaaaagatgtgaatatgaatattacatattcttatttatgcattgtgttacttcatttgttttgcatgtctggaatttcgtttttcagaaaaaaaagacccccagtttctccgttgttattttgttgcgtctacctttgaatatttaactagttcatttttcagatggtatcctggataaggaaaaacctacttctggtgctgacggtttcgtccgtcgttcttggagcactatgtggtttcctgctccgcgggcttcagctttctcctcaggttggctttatttaagttttttgagaatctataattgtttctaaaattagccttattacgttgtatttttggcgtaagctttagaaactttgggaaatcctttaataaagtgcgcagtctcggtagagactggattactgtaaccgacaggtagggttctataggtaaattccatcgatcgaccggaatagatataaattaatcaagaaaaattaaaggttttttgtagtcaaactaggactttcaaggctggcatacctgcccggtggcctcacgccgcggcgcaaagccctaaatgtgtcgggcactgagaaaaatagacttattgaactatatgccgggaggttttaggcatgcgtcaggcaggcatcagaccgtgaaaccacgcctgcctcccatagaagccggaagttgaacaaacgacggtataatctaaaattgacaatttcagaacattatgtacattagtttccccggagaacttcttatgcacatgctgaaaatgatgattctcccacttatcatgagttctctcatttctggtctcgcccaattggacgctcgtcaatcgggaaaacttggatctcttgccgtcacttactacatgttcactactgccgtggctgttgtt

SEQ ID NO: 30435 - DNA, 1804 bp, Caenorhabditis elegans
atgttcattctaaaagttgtctaccaaaagtgggaaatttgtttaaaaccttttctacagtacctaacatattatattaaaactgttaaaactgtttgatattttttcatttatagtcaaatgtacagttaatttgtgtcatcattataaaaatcttgaatctatcatgcaactattttttatagtgagaaaagtttttggaaaaaagtttgaaatttaatttttttttaaatctggcgtttaccaatctagcaaagtttaagacatttttttataaatactaaatactaaatttttcaataagtcactggcgctaccccacctctgagcaaaactaagaataatttaaaaatgacttttctttcaaaatctgtaaaaggttgagacagtgtgaataaattccatgacaaagtaaatcaatcaacgtcctttcttctatctttctatgttagtgtgcctcacaaatcgcaattttccagcctcgcactttttaattgctccagttgtctctttctcaagggtcttcacaatcggttttcttccttattctgacctttatgtgttttgatccaaacaagtcctaacctatttgtttttttttctttatttcctcgtactatatttataaatttatgtgtgctaccaatagaaaacacgccaaaaatatcaaaaaccatccacactactgcaaaccaatttggaaatttttcactaaaattttattattttatttctacctcaaaaattttagtagtacggccaataagctgaagctgccaataacagccattttgaattgcgtagttgcagtccgagaatagagcccctcccgtttcctcatttcgtgaaaaaagaccaaaagaaaagttaaattttttcagcatgcgatgagcgattcctcgcaacacctacggcttgcgctgacggtcacacatctgctgctcgtcgctttgggatccgtcaacctcatcattattctgttaattatcacaagaccgtaagttggataaccagaaaccttaattttcatcgtgatgatgataatgtagcctttttctgctgctcagatttatttaaatttcttattgttaaaatttaaggttcttgtgtggtagatctaccccaaaatgttttgcagtgaataaaattcaaaacggtcaccacggaaaaaaataaccattctaatagtatttttatttataggcttatgaattatttttcctaattcacgttttattatttaaaaactgaaaacatgttgggatgcagctaatacacagctaataccaaatttagaaactaacttgaaaaatgactagcaaaaataaaaaatttgctaatcaacaaagtagaacattctaatcctaaaaatctcaaaataaatttttccgaaaataatagaaactgtttcaaaaaaaagcaaaacaatttagatttaaaaataagtgcaaatacatttaaaccacaagtactattaactacaatccccttttttttcagatacctccgatctataacaaatgtgtacatgataggattatgtcttgctgatttcatatatctagcagatttaatactcgttgccgccacatcactaaatggcaaaagctggccgtttggtccaacaatttgtcatcttttccatggcacggaggcgacgggtaatttgaaatcaaacgtgtgttctttcaataaaaacaaattcacaattttcagggaaatacgcatctgtacttttcgtcgtacttctagccgctgatcgatacatcgcgatgtgtaaaagtgatttgtgcggcagatatag

SEQ ID NO: 30436 - DNA, 1120 bp, Caenorhabditis elegans
atgtcaagtgctcagtttcaaactttcgatgctgacctctcattgacaagtcagactgactgtgaaaactctgcacgggaaattctaaccaagcttcgaccagaatggaaatcacctgaaataacgtttgaggtaggtttttaaattaccaaattttcgcaatgcccgaaatatattcaataaattctttaaattttgttattaaactaaaaaaaaatcaatttcagtatttctcagtcggaatcacgaacaaaatattttctgcgggattcggaaccgaacacgtgatctttcgtgttttcggtcacaacaccaacaaggtcattgatcgggagaacgaggtgatcgcatggaaacaactggcagaatatggattcgctgctcctctttatggaaaatttaataatggattgatttgcggatttttggagggaaaaagtctagcgattgaacagatgagagactcgaaatttaatatgtaagttctgaactaaattgttcagctttcaaatatttttacaaatttatgtggaagttccagtcaaaatcttgctatcaaatgttttgcaaaattatcgaaaagttgaagtttttatttgctttattttttttattagctttgttcctctgcaagctaatcgaaaactagtctttcagtttccataagctctgtgatttaatagtgaacattttgatcagttctctgcgttcaaagcatcaacaaaatttttgaaaaatttgtatattttgaggttaagactctataaaaccaggattttgttgaagagcgttcgagaaaaaagtattgccgtcagtaaattgaaacagtaggctagaaaaaaaaatgcatgcaggcatttaataatgcctacctaaaatcttttaataattacgcctaccaaaaagtaggctctattaattttaatggtttttgaaggttaattgattcaaattgagcattccaaacttgaaatctaatataatatgttccaggaacattgccaaaagaattgcccaacttcactcttccgttccaaccaatggaaaaactccagtgtttgaaaaaatgcgaacatttttacaacagctgaatccgtcatttgaaaaagaaagccaacag

SEQ ID NO: 30437 - DNA, 536 bp, Caenorhabditis elegans
gtagaaatcttcaaaaaactcatcgaaagcacaatcattccgttcatcagcgcgtttgaaaacattctcgtcacaaatggaaccggttactttgtaggtgataaggtaggtaatgatgggggttttgcgaaaaaacattttgtggaaaaaagtgccatcaaatttactctaaaacagagcttatattatcgttaatgttaaaaaaactagtttctaattcaacaaaatgttccagcttcgtcaaaaagttttcatttaaaataaaatttgaacttgataattgttcattttcctaattgtcgcatttctgaatgaccatattattgaattgccgtaaattttgtaaatccgcaggtgtctacttatagaattgccgaaaatgttgttcctactgtactgaaactcaacaaattttgtttcatttcaaagtgttctcatttcagatatcctacgccgatcttgccattttccacattttctggtttatgaactccaaaatcttgcctggtgcacttcgaaaatatccaaaactacag

SEQ ID NO: 30438 - DNA, 295 bp, Caenorhabditis elegans
gttggcccgtgaaaagtcgcccgctcgtgccaagtccccttcaattctgacaagattacgagatcgtagtccagcgaaatcgaagtcggacaacctcgaatcgactccatcttcttctagcaggttcttattatttaattcaaacactatttgacaatcaattgttactttcagaaatctactttctccatttgacgcagaaaaacgcatggagcgaagctcaccatcgcaacaattgttcagccgaactaagaaagattcgtcctccgaaaagcgaccggcgtggaaattttaa

SEQ ID NO: 30439 - DNA, 276 bp, Caenorhabditis elegans
ccaagtggcctactgccggatgacttgggaaccaagcaagccaaagtgatcatggactacgatgcagtgctgccacaagagatcagcgtcacccagaatgatgtgagtcttgagaggaggacccctattgaaaccaaatattgtgtgaaattacgtctgctcttgttgcagattctcatcgtgtatcgccttcctggaatggatgcggaatatgtgatggctgaaaaaggaggaaaacgcggaaaattgcctgtcagctatattgagctgctctag

SEQ ID NO: 30440 - DNA, 2759 bp, Caenorhabditis elegans
atgtcttcgtcgacatcatcagtggaatcagtggaagatgaaagttgttcaaacgagtgttcagcctcattcaccttcgacaccaacaacaatagtcgagggaacaaccaggtgaacgtgagtgtttaacacaaagtacccggtccctcggaaggtcattttgcaggagcttgccgaggaaactcacatgaaactcagcatcacaccaacccgcgaatccttctcgctgagccagttggagcgtattataacgattggtaagttggtagttcagaattctttcgttgaaatttgatttcactttctgggtgcggaatagtcttttctgtatcgtttacaagaagggttagaaggcaaacacggtttcgaactctcggctggtagacccaccttgagtctcgcggttatataaacaactgatttttgtcaacacaattgcgggcgaactcaaggaagcttgagtacgggttatcgaaaaaaaccaaaaaaagtaatcgagggaaagttcctggctttaatgtcttgttcacattcgagttaattattaggtatcaaatatttttcatagttttcatagagtttcccaattatcaattatcaaacaaagtttatcttaggtgccatatttttccaatgagggggcgaacccatcagtatacaagtttaattcccgcttgatgcgattatcaattaacaaaccatcgatttcaaatcaataaagcttttgcattcaactattcaacttcggcgccgcactcagtcttccgaccaatatttaccatgttgaaatgctaccgtatgacgtaaaccattgtgttcttcacacccgcctagccagaaaattaatcaaacgagctttctgtgcgacagtcaaaattttcacataaaatcgtagtattcattcttatgtgccaccaggaacaaaaattttttgacaaaaaacaaatataagcttatctttctgcaaaatcgagctcatgatctctgaaatttcaacaaactgaaaatcatttccacttgatagatgatttgttttcaaatctttttttttcggagttgaaggttgaaggttcctgatgggtcttacaaagtttaacaagaccagtttatgtttttacttgcttgcgagttttgtcaatttccgttagatgagaaatcagctgtcagttgcaacaatcagtcgtcgtcggcgtcatatcttctgtggtcaaaatcgaaaaatgataaatctaggtacacatgaaaaacggaaatattcgcaacgacgggatgcaaactaatacgagaagaacagagaatgatgacgacagaatacactcagtgtaacgtttcaatcattgcctccgagagcacttggttttgccgccgaaacaatgaagcctgcggagcttcttgaaagcttgtgaaaaaacttgtctgtaatttgatgactctaataccaaacacatttattctcaagacatttggcagtgaaccaaaaaagaaaaccaaaaaagaaaatgctatacaataaagtagtacatgtaaaaaattcataagtgctctctgttgtgtgaaccctttttggtgctattttttcctagtttgaggcaccgcagacaatcgtatagcggaaaatggaaacccgagcccagttgatgtggggtaacgagtatgtttttaaacccggaacttccacaattggaaatctatcaaatattcattacatatttacgaaaaaagtttgaagtaacatttgatttttcgatcctggtttgtttttttttgtctatttttccaatacacaatggggttcctcttttcactgcagttaccttccattgaaagctgaaagctggcggagtcattgagcttggaagaaaaacgtcttcctttgtcaccattctgtttatttcccaagagaaattcagtttttcgtaatgcgggtccgactcgagccgtgctccggaaggaggaagaacaaaaaaagtaatgtgcgacacacacacacacacacacacaaaattttgatggggccacttttgataaatgtgtgagagagggtgccagatttgaagatttttttgaagattttttttgcagaaaaaatgactagtcaaatccagagaggaagttttctccaaacataattgagctcttgagaatgtattcttgaagtgtgtgcttgtgaaaatgacattgtaagaaatatgcttccagtttgaatattataattacaacttccaagccatatatctgaggtgattgagagagtcaatcaatgttataaaacattttctgctaaacatatccgtttgcgtattggagtcttctcacagcctaatatcaagatgtccatccacctcaatgcgaaaaaaatataagttgtgatggagagggaaaaagcgcccggccgtcattctgtgcaacatttatctgatcactgagcggcaactatcttttcttgaccagtgaccatggagtaagacacttttgaagagcggggaataaaaaaaactaaactataggtgtgtcccaggagattgacagcagacaagatgaacatgtgtaactcgaaaagttaaatttctaaacatcaaagttttttcaggaaaaggaacattcgggcgggttgagctggctcgggacaaaatcaccggagcacattatgcactgaaagtgctcaacattcggcgtgtcgtcgacatgcgtcaaactcaacatgttcataatgaaaaacgggttcttcttcagttaaaacatccgtttattgtaaaaat

SEQ ID NO: 30441 - DNA, 696 bp, Caenorhabditis elegans
atgttcatcagcaaagaggaaatgaatcgtacttttggtaagaaatagttatctgttaaaggttgagtgcggtcagtgggggaatatatgaaaaatatttatttggttctaaagtgacctaatatcagaataaaacattcaaaaaaatgttgaaaaattttggaaaagattattgaaattccaacatttaagctatggcctaaaataatttattacaggtgtcaaagctgagctgaattacattgaaatggggaatgttagctcgtactctacaaagtttcactacagagttatggcaaacatcgactacctctcgttcacatggaatgctgttggaattgtaataaaaacatacattattaaaatctaaataatgagacttattttgtaaacaggtacactatgaagtttacgtcgaatctgatgactcttctgtgcttcctattgttcgaattccattgaaaggaacggtgccagaatctttgcagggtattcatttcgcgaaacatttttcaaatgataatttattgtttcttacagacttcaccgttgaatacagatgtgccggacaccgatccggacaatttgctgtcagtctatatttcacattcaaatatggtaataaggagccgttgaaagtgaaattgcgacaggagaagatctgcgcttcaagggacggacgtcgaggtctgaacg

SEQ ID NO: 30442 - DNA, 1262 bp, Caenorhabditis elegans
atgaaggtgttccttcagcagattttgaatttggtaagtttttcaaagcttacatctaattcgccgttgcggtagaaaattgggaacttgcgccagtgattaaaggtcctatatcaattgaaacctgtactaaaattttgaaccaaaatgtggcggagctcccttggctgctaaaaactcttgagaaaccagctgaaactttttactgttggaagttatggtagtatttttattttgaagtcagatgtaaatacttttcttgtaagaagcatcgggcttgaactaggctgatgagcattttaaggaaacatttttaggctcggacctgagagactggaacttattagaagcaccaagttgtctacttgactgccagatcagcctagcatttgaagataaagttgatttttaatccttgatatgatcatcaactatggtatgagtttgacgatattttgctcatttcagacttctttcagttcatgaaattgaaaaagatgcgttactgatgtactataatattaatacgtactttattattaatatactttttttttaaaactctctctctctctctctctctctctctctctctctctctctctctctctctctctctctctctctctctctctctctctctctctctctctctctctctctctctctctctctctctctctctctctctctctctctctctctctctctctctctctcgaataaaatgggacttttttgcataacgaaatttataaaatttcgtgaaaaatattttaaacagtttattattttagaatttaaaaaaaaacttgaaaccatgcaaaaatttcaggatggacaaaatcaaataattgaagtgaacgcctggcttaaatatgtgagtcatttagtcatcttgctttaaaaattccactatttttcacaggtttggatggattaccgccttcaatgggaccccctccagtatgataacataaccagtattagatttgcgggtggtgaaaatcagatctggaggcctgacatacttttatataacagtgcaagtgaagactttgattcgtcgttcaagtccaacgaagttgtttataatacgggtgaagttaattggattccaccgggtatttttcgggctagttgtaagatggatatcacctactttccttttgatgaccaagtttgctacttgaaatttggttcctggacctatcatggtctcgcgctggatttaagtattattgcagaagaagacgattcag

SEQ ID NO: 30443 - DNA, 1436 bp, Caenorhabditis elegans
atggctgccgttgacgtcaaccaaccaatcaccggacacaagtccgccattatccgcaactacaatactaacccaagactcatctaccagaccgtatgcggagtcaacggaccacttgtcatcctcaacgatgtgaagttcccacagttctctgagatcgtcaagattacccttccagacggctcaaagcgttccggacaggttcttgaaatctccaagaacaaggctgttgtccaggtatgataatgtattcaatatactaaaataatgcttacgtgatattcaggttttcgaaggaacctccggaattgacgccaagaacaccatctgcgagttcactggagatattttgcgtactccagtttccgaagacatgctcggacgtatcttcaacggatccggaaagccaattgacaagggaccaccggtacttgccgaggacttcttggatatcaacggacagccaatcaacccatggtcccgtatctacccagaggaaatgatccagaccggaatctccgctatcgacgtcatgaactctattgcccgtggacaggtaattggaatttgaaactttatccagattaaccattttgcatattttcagaagattccaattttctctgcctctggtcttcctcataacgagattgccgcccagattgtgcgtcaaggaggtcttgtacagcttccagatcgcccacacgagcagaccaacttcgctatcgtctttgccgctatgggagtcaacatggagactgctcgtttcttcaagcaagatttcgaagagaacggttccatggaaaatgtgtgcctcttccttaacttggccaacgatccaaccatcgaacgtatcattactccacgtatcgccttgacatccgctgaattcctcgcctaccagtgcaagaagcacgtgcttgttgtcttgaccgacatgtcctcatacgccgaagctcttcgtgaggtgtctgctgctcgtgaagaagtacccggacgtcgtggtttccctggatacatgtacactgatttggccaccatctacgagcgtgccggtcgtgtcgaaggaagagacggatcaatcacacaaattccaattcttactatgccaaacgacgatattactcaccctatcccagatttgactggttacattaccgagggacagatctacgtcgatcgtcagcttcacaatcgtcttatctacccaccaatcaacgtactcccatccctttcccgacttatgaagtctgctattggagaaggaatgacaagagaagatcactccgatgtgtctaaccagctctacgcttgttacgctatcggaaaggacgtgcaagctatgaaggccgtcgtcggagaagaagccttgtcatctgatgatttgctctacctcgagttcttgacaaagttcgagaagaacttcatcacccaag

SEQ ID NO: 30444 - DNA, 335 bp, Caenorhabditis elegans
gcctatcaaattccattcatggagacgagcgccaaaactgggttcaatgtagatagagcattcctcggattggcagagtaagttcccttgtgtctcccattgataggcaccaatggtagaatggcaaatataaaacgactgaaaaaaaaccattaaaagcaaacatttcgacattgcaaaaaaagcagaaaaatctttcaaatattaaacgtgattcgttcagacgaatgctcaagttgaaatacggttttgttcccggaggtgaaatggcggacacgatttccgtcgccgacaccaagaagccggaaatcgccagatgttgcacgtttaattga

SEQ ID NO: 30445 - DNA, 304 bp, Caenorhabditis elegans
gaaaaattgcaactttcaaagagctgcgtggtggtgtgtttttcatctcggaaattcccagaagtgtatgtggaaagattttgagacgaaaccttcgacaattctgggatcgagaacgaacaaattccaaagtaagattcaactataaatattcaactaattgataatttaggtggacagtctaaccaacaaagatggagcaaaaacagctggtgccgcgaaaggagcacctgcaaagaaagttaacggctcgacaacaccatcgaggcgtccaccatctgctggaagaccagtgaaaaaatga

SEQ ID NO: 30446 - DNA, 620 bp, Caenorhabditis elegans
atgcaactaatatttttcagaggcatgaaggagcttctctccaccatggatcttgacacggatgccaacaccatccctgagttgaaagagagagctcacatgctatgcgcaagattccttggcggagcatggaaaactgttccattggagcatttgagaatcagtcgcatcaagtgagttcatgatcctaaagcctattaaaattattgaacaaattaaggggtggaatgagcaacatgttattcttatgccgactttcggaagtctatccaccaattcgtaacgaaccaaacaaggttctgcttcgtgtctacttcaatccagagactgagagtcatctcgttgcggaatctgtcattttcactctgctctctgagcgtcatttgggtcccaagctttatggaattttcagtggtggacgtctagaagagtatatacctgtgagtctaagcctttctgatgtataaacggaacattggacttcagtctcgcccactctcttgccatgaaatttcattagcacacatgtctacaaaaattgcaaagcgcgttgcgaaggttcatcaattggaagtaccaatttggaaagaacccgattatctgtgtgaagctctgcagag

SEQ ID NO: 30447 - DNA, 895 bp, Caenorhabditis elegans
aaagcaattgttttcgatggctggatgtacccactggactcaactcaacaagagcaagcgaagcagccaacgctgtttttgaatgttggagattggcagtggaatgagaatttggacgttatgaaaaaaatcatctcacacaatgatgggaatcttgcgttgactttgaatggtgcggtgcatcaatgcttctccgattttccattcattttcccatcgtggctcgcaaagaaatttggagttcaggtagatatttttataaaaatagactctcccacattgctaaaatgtttaaaagtgttggaagtattttttattcttaggcaaaaatgatgaaatcttagtgttcttcttttttttaagtcgtcgatcaaaaaactattttttcagttgtatcttctaattgtgtttaaaatattaatgttttaatgtttcaacattgtaagagtttgaacatgtgacagtgctttagatatttcggaaagtggcgtaaagtcagggttcaccactttttgattcaaaataaaaatgtttttaaatttaaaaaaaaaaaccttttttatttcaaaaactgacaaaaacacagttattgctaccttttcacagtcgataaacatttttcaaaaacattattgaatagttttactatgttatacttgttctttttgacatcataagtgtcgcttccactaaccgttctaaaaaaaattaaaattaaaacgttaaaatttaattgcagggccgaacggaaccatcattgtgcatgcaagctgccatcgaactttctctcgcttttcttgaaaatggaaaggatggagctcaaaagttgaaagatgaaaagttttctagcttcatcagcaacgagatttatggacgtgaaaaatacaaactttaa

SEQ ID NO: 30448 - DNA, 1353 bp, Caenorhabditis elegans
aaaacccagactagttggagaagatgagattccaagagacattttgcgagctgctgacgagacggattacattgaaaaggctaaagaagaaggtcgagttccttacttggaagtcatgcctggatcaaggaggacaagaagagaggtattttaaagcccagaagatacatttatcacatatcttactttaaggttgactactctgctgatacaatgtcggatgataagtttctggaaaaactgttcgacgaggatgatacgacttcggcaagaactgaagaagagccaaatcctgcacagcccggaccatcttcagtgtcaatcagtttagaatcatcatgcgatacacaaaaagatatcaaggttgatgatgtacctgctccgccactgacatttaaagttccgcggctcacgatcaaattgggtggagatgagaagaagcggaagcataacagaagtgaaagtgattcggatgataatagtctgaaaaaagagaagaagcatagaaaagaagatcatcccaaggagaaggaaaaggaaaagaaaaaggaaaaggagcaggaaaaatcaaccgattcggagaaggatctcaagagaaagattgaggctccaatcgaaaaaattcgaatcaagttttccggggagcccagcgagaaatatcgcaaaattaacgaggaacctcctaaaaaggagcacagggataaaggacgcaaagaagaaaagtctcataagcatcgaagcgatgatgacgactcgtctccaaagaagaaaaaacatcgcgacagtgacgagtcttcagaaaagaagaagaaaaagcacaagcatgatagtgattcggcattaaagctgcgagagggatcacctttgagtgtagacaaggaaaagtctccgatgaagattcgaattggacagggtcaaccttccatatcattagcagcgaatgaagataaaaatcaccctccgatcaaactcaagttgaatgttaagttcaatatgcccagtcaggagactgatggttcgaaaaaagataaaaaggagccacataaagaaaaagaaaaagacaaggaaaaggaaaaggaagaggacaaaggtaaagagaaggagaagcacaaagataaggacaaggataaggagcacaagaagaagtcccgtgaagatgaaactgaagaggagcgtcgtgctcgaaaagaagcaaaacgcctgaagcgtcaaaaagaggaacaggaggacgacgctaaacttcaggagaaacttgctcgaaaggctgcaaaaaaggagcaaaaacggttggaaaaggagaagtcggaaagtagtacgggtactgtgaatttgtcagcagctggatctgcttaa

SEQ ID NO: 30449 - DNA, 459 bp, Caenorhabditis elegans
atgaacgaatcggaaatcgcggccgcggtggcggcgatggagttggaggacgaactgctccagcctgaatgggcatatctggtactttccattgttcctctcgtctgcatcttgggtaatcttatggttgtggctgctgtttggacaaccaaaagcctgcaaacacctacgaatcacttattggcacgtgaacatcttaagccttttacaatttattcagtttttttcaggtttccttagcaatggctgatttaatagttggcgcatttgtaatgcctttcagtatatatttatcagtaagtatttaaaaccttaaactatatactctacttaaacactgtttcaggtaaaccgtcttcactggcacttgccactatttgtctgttatttctattgcgtcttggatgttgcagcaagcacttcgtctattattcatctcgtcttgataagtattgacag

SEQ ID NO: 30450 - DNA, 337 bp, Caenorhabditis elegans
gcagtaacctggttaggatacgcaaactcttctgccaatccattaatctatagcattttcaatcgtgactttagacgagcattcaagaagattattgtcagagttttcggatgctgttgggaagagcctgatctaaataagtcaatgtaaggaaaaatgtcgtaacacataaaaaacatggaaatttagctcgtcaagatatgctgctcctgacaatatagaacgacggcgttcatgcacacggtcttccgagtcagctcacgacaataacaacgatgcgaatgcaactcgcctgaatcttctttcgaataataacgaggaaaccattccggaatag

SEQ ID NO: 30451 - DNA, 710 bp, Caenorhabditis elegans
atgacacatgacaatgaatatcaatctgcacttgtattcgatagaattagacgattaatcttaaacaactcgaataccccaataacggttggttctaggtttggctttcacaaacaaaaaactatcggtttcagacaaaagagcttataaagcattgctttcatccagatgttcagtttcttgctcacatgaccctgaaatcgttggatcatcccggtgaacagtttaataattcatcaaatcaacttttattgtgagttgtgcattgcagtttgctccaacctttttttttctggcacgtaaattgacaacaattttcgctcactaattggggtttttaaggttttaatcattaaatacctgctccattgaacgacgaaatgtctgtaaaaaatatttgaattcgcaacgagaattcgggttgcgcaatcaaatatattagacatagaaaacaaattaaaatgtaaacagtaaaaatgaaagaattgctcgggaagttacctgaataaaccataaatatttaagcattagaataaactaatacaccttaaaataatatcaacaaaaaattagcaaaaagcattgttaatttatcaattatttttttcagagatcgcgcttttctaaacccaatactcacactcatttttgtttttgtcgggcttgtgggtctcattggcaatttgctcacagttattgtgattttcaag

SEQ ID NO: 30452 - DNA, 2238 bp, Caenorhabditis elegans
atgtctgaccacgagaacactggtgaaaacacctccgaatatcagtacaagcaaccaccacaaaagagcatcgacgagcttctcaatgctgacaaggtttgttaaatttatttttaacaaaaaaaattgaacattttgcgaaattgctaatggatgtggattgatgaatctgatcacaagacagctttggccttcgatctattaataaaaagtagttaattgaaacaaagaaagccgagccaagctacgttcaaaacacaaaatccttgcattcaggctacagtgttctgcgagttttaggtttgataattgtaaaatagaatcaaaaggtagtgcaacgggcggcaattcaccccggcaaactcgttttggtatgacaatctaatatttttaagtaaatgctgaaatatagaaaatattttatttctttgaaaatgaaatttacttttgtagaaaaacttaacaagatgttgaaaactacctgaaacttgttattagtagaaagaactgccgttaaaatgttatcggcacaacactaatatcacctctttctgattgttgtgtcaaagttttcttttgagaatgtatatagaaatatgtgtattttccaaaaacaacgatagctttgataagtttctcaaaaactgtctcataatctgtatattcctccttgagatagtttttgaacactttcccaaaacttttcatacaaaggagagttatttttggaaaatgcatatattcgttactaggggtggcaagagtgcgacctaggtcgctaggtcgctgttttcatttaggtcgcatcgcgacctaggtcgcattgcgacctgcgacctagcgacctgggtcgcattgcgacttgcgacctagcgacctaggtcgcattgcgacctgcgacctagcgacctaggtcgctttacgacctgcgacctagcgacctgggtcgcatcgcgacctgggtcgcatcgcgacctgcgacctagcgacctaggtcgctttgcgacctgaagtactgacattttttatactaacaaattgctacaaatcatttattttacattgttttcgatttcttatccataagacaccttgtcgaaaaaagttagaacagccgacatccgccggattttctgcttttttctacgtttttaattcgaaaagtggaaaatgaaattttagaaacaacaaaaaccacaaaaacgtgaactttttgaaacaatttgctgaaatgcatggttttatttgtagaaatgaattctttgttccgtacttttgaaaaaaaactacgcataaacttataaaatcttaatagagaaaatgttagtggaatacacatattctgcaatctttagttttcgagttatacggattttaacaactcaagtgaatcaaaaccgaaagagaacaaaatgtcggtaattcaggtcgcaatgcgacctaggtcgctaggtcgcaggtcgcaatgcgacctaggtcgcgatgcgacctaaccctctaggtcgcaggtcgacctaggtcgacctatagccacccctatttgttacatttctatacaaatttccgagcgaaaaacttcaacataacaatgagaaaaagggcattttgtgaattttcctaatgtgccacaattttggtctctattaaccctaataaacttttataaaaatccaatgacaatcacattttagtatgaaatttttacaggaggacgagtctctaaaagtgtacaaagccaaacttctcggccaaggaacagtcattgtcgacgagaagaacccactccgcgtgattgtccgatccgtcgagctgctcattaatggtaaaactgcgcaatcatttgacttatcggatccagcaaaacttgtcaactctgacttgtctgtttccatcaaagaaggttccaattaccggttaagctttgctttccatgtgcaacgcgaaattacgtccggattgcagttagtttttttgtgtgtttaatcttaacttaaaataataaattgtttcagctacaaacataaggtgaaacgatccggtatcactgtggagaatgagaagtacatgatgggaagctacgcgccaaaacttgagattcaggagtacaaatcaccaaacgaagaagctccgtctggaatgatgcatcgtggaaagtacaaggtgtactcgaaaattaccgacgatgacaacaatgtgtatcttgactggcaatggacccttcacattaccaaggagtag

SEQ ID NO: 30453 - DNA, 2156 bp, Caenorhabditis elegans
gggttaaaccgagatgaagtggttgttcgactgcctctgggagacattgttggcaaagaggttcatctccacaacctgccctggacaattcacaaagatccaaccgaagagcttcccaaggacggaacacactttgatccgaatccactgaagcccaaaaacaatatcacagtcttcacatttctaggagtgccctatgcagaaccaccgacgtctcagagaagatttaaggtacacttattccgacatatcataaattgaataactcattttacatttttacagccaccacagcagcttaccgtctttccagggaaacaaccgtatttggcattcaattacgcggcttcatgtgctcaagatgttgaaaagtcgcccagtccatttgtagatcatccttatccattcatggtcgatgaagattgtctttacttgaacattttctctcctgacgtaagaagttttattgaatttttcttatgaaaaataattatttaattttccagatttccaaaaatgcacaaaccacttatccggtaattgtgttcttccacggcgggaatttccaaactgggtctgcaaatgagtggccagcgcatggacttgcttctcgaggaatggttgtagtaactgtcaactatcgtcttggtgctttcggcttcatgagtatgggagattctgaaaccggcaactatggactacaggatcagagactagccttggagtttgtgaaaaacaacattgtaacgtttggcggagatccacaagctgtcacagttgtcgggcacgatgcaggagcagcttcgatcggatttcacatgcagtcaccgtattccaggcacctcttcagatcggcggccacaatgtccggagcggaagtttcatatcactcttacattggaaaaactgcactggctttcaacaacacaatgaagctgggacgctacgcaggatgtacacaagctgttgcacaacatcgttgggattgtattctgacaagatcaaccggagacatcattgatgcaacaaggaacattcctatcgagtacaacagatacttgttcatgccaacggtggatggaaaatatctccctggaaacccgctatggactctcgtcaacgcgccgagtggggagacttcaatcatgagtccagtaccaatgcttattggaatgaatgctcaagatggcagtgaagtcgtgctggaagacagaagactcggagagtttagtcagttcaacgatgtcgaccacgagtatttgaaaagttactcgctggaatattgctaccgtcataactactcaatgaatcgggaagctaccgccgacgcgatcctctccaaatacactttctggcctgatagagcagctgcttgggcaatcaaggaaaactttatccaatttgctaccgatgcttactacactgctccgatgcaactctcctcgcatctccacagttcttcgggatcacgagtttttcaatatgtaaataattacaacttcagtcgccagcatccaaacctgctatttattcctgactggatgggagtttgtcgggattgtgacttgtatctgatgtttggctatccgtttttaccggacgagctgagaccgattggtctgcgaggcataaattttacggatacagatagaaacgcgagcaggacgttttccaacatcatacgtcgattcagttatcatcagaacccaaattttcaatttgatggcagctgggcagcatacgaaccaaggcgtcattggtacattaactttaactacacacatgaagaagactggaagattcctggaactcttgcaagagactatcgctatcaagatgttgcattctggaatgagtacatccctgcattggtgaactacatgacaacgacgttttcccctgaaaatgttgcgtaccgacgagaaatcatggttttcaaatggatcactggagtcaacgtcatcatcatcgctctactgatagtacttgctggcgcgtttggatatatggtttggggaaacaaggaggacgaggaggcggcttataaagcagaaaaccaccaactcgtcgaataccgggacactggtcactcagtgtcggatgctactatttcttcacggactcgatcaccaagatctagaataaccaatctttaa

SEQ ID NO: 30454 - DNA, 324 bp, Caenorhabditis elegans
acccaagaatgcgaaaacggctcataattgcgtcgagcagcacaatttcccatgctccaaatgccaaccgatccgagaaagtattacttctagatggattagaagagacacaattttctcaagtggaaaccaagtttagttcaatggcatcgataaaaatgaagaaggtaacaaaaaatggtgaatattgaaattgttacataaaaatgagtttagcattggaccacagaagaaatcgatcgattgtcgatgataatgtttcccggattgttcacactgttcaacattatatattggacatattaccttactgttaacacatga

SEQ ID NO: 30455 - DNA, 1044 bp, Caenorhabditis elegans
atgaacctccaggtcattttcctatttctcggtctacttgtcatttattcttcccaagattgtgcatggaatgtaagttgaactagagcattttccttattggtatggtgcgccgtagtgttgtagactgtaatactaatgtttgctggtcaattcaagatcttaaataaaactttgaattttgtgatataaccggtctaacgcgcagttttaatgttaactgtttattaagattagttgcaaaatctcaactataccgttgtaaatcgagtagatcttccacggaaggcaggtgcgtataaagggactgccgcctgcctggaacctactcgcctttcgccggtattctcgcaacatttctgtactctggcgtaaaatctgaggcttcgtagtggccaacacgttttgagttacgtttcgcattactcagaaggcgcgcgtcgcggcgtgagacaagcggaggtcggcgcaagaatggtagacgttttggtgccaaaaggaggccctactggtgacattaaggttcaaacttgttttacttagccgtattaatgaaactataatgacaaattttgaagctttccataaagtacgagaaaatttgactttgcatttgttgaaatttgaccgttttttatctttggatctccagctgaacagtttcaatgttttaattcaaaaatttcagcaattttattttaagcttaaatttcaatagtaacagcattaaaatcagattatttattaaaaatgagagcatacagtgtcagattctcaaaataaccataacaatctcagacgtgccataaagtggatcaagatccgaatgtcatcacggctcatttgattccgcacacccatgatgaccttggttggataaagacagtggatcagtatttttggggaggcatgcatttatttttctcgccttgggcggtgttccaataattcgtttgtttcagcaaaacccgagttagttcctgttggtgtgcaatatatttataacacagttatagatgagctacttaagaatcctgatagaag

SEQ ID NO: 30456 - DNA, 322 bp, Caenorhabditis elegans
aataatcaatcaaacatcagtttacaaaacaaagatcgtgcatgatacgaagcacttgaatggaagagccaaaattggcggtggtggtagccacgaggcgttgaaggagagggagctgaactcgtgttcggaaaatttaagctatcatgtgaacggtcatacgaggactcctacaccggaagttcagttgaatgaagtttcaagtcctgaaataaggtagaacgtgaatttgaaatcgtaattaaaattttgattttttagtaaacttgttgctgagccggaagaattgatcgagttcagcgtcaacgacacgctagtctga

SEQ ID NO: 30457 - DNA, 503 bp, Caenorhabditis elegans
gaatttcgagaacccttgataacgagggagaagagctgtgcaacgttgcgggtacattttattacatggctccagaagttggagcgaaccttttaaaaacttgtcagtatgactcaaaagttgatatgtggagcatcggatgccttctctaccaatgcgttacaggagaggttagtccttccgaaccctaaagtttttccaagaacaaaaacgcaaataactccccaggggcttcgcagttgaagtggaagaatgacgtagataacttcatattcacaatttttcttttgcaggtcccattcgatgagtgcagtttgtgtaagctcttcctgtatgtggcaggggctaacttcgacgcctacgacccgcctgagctgcccgacgagctgagtcaagaggtttcggggattattcaatcactgctgcagctcgataccactcaaagatgcacacctactcagttttatgacaaagcaatcaactggagtcaacaaatatgttag

SEQ ID NO: 30458 - DNA, 869 bp, Caenorhabditis elegans
atggaatgccccagttgcaagatcaagataatgtatctggcaagttgtctgttctgactgaaaggtcggaagaggcacttactgattatcagcggactattcagtccatgaaacaacaacatcaattgttgcaaggtgacaaagtcatcgtgaagtgatgtgccatttttgttgtgattgttaatttgcatgagtgcctctatattctacttctgaaaaaaattaaaaatgaaaccaaatgaaatccttctgtaaatataacaaaatgttaaaggccactatcacttatggggtttttgtttcaattagttcaactcaaagttataatgatatggatatataaaaacattccaatagtgctccaatgttcaaaaatcgtgagaaaaattttacaaagttatattgaaaatttttatttcaagtcaaaatgatctgaaactttcaattttcgtttttttttttgaaggcgtctattaaaaaacacttttcttgcttccaattgtaagttataattacgctcaaaatatttacattccataattttaggagtttgaacatgcgacagaaaatagttttttacgtttgtcggtgaacttttcttgttttcttgaaaatttaatgaactttctctatgaactcatatttaatcaataaccccaaaagtgacagattacctttagaaaaaaagctcctataactttaagttgaagtttgacgcttattttttcaaaatttaatatgcaaaattttcagatctggaggaagagaaacgcaaacaaaagcaaaacggagttgtcgaggaaggaaatgaaatggatgacaatgtatgttcatccaacaacgataatgataaactgatgttttactaa

SEQ ID NO: 30459 - DNA, 1964 bp, Caenorhabditis elegans
atggctatttggtggtggtttgaaattttgtctgctaaaagtgattttgaaagtattatggcttggagcgtgtttatttacatccaggtaagagttctaatagttctcaggaaaaattcaaaatctcggaggttcctagaaaaattgtggtgatttctggccagtctgtttttcgcaattccaagctttggctgacctagttccggttctaaattgcaaaacgagtgatgtttctgtttctgtttcaaagagcattattttttctttaatgttgtacatagtaactttttcttgctttccgcctgagcttactcatttttagctaattaggctattggatcatctgctttctcaggtttcatctgaaaaataataagacgacacatttttttgttgaagatttttggtcaatgaggtttcttaaaacataaatatttgaaaaacaaaaacacaaaacttatttcagcatttatttattaacattttatagctctacataacaaatgcttcatttccatattgtatttcattttttaaagttgaagtaacgactctggtttttcttttattttataatattaaaaattgccccaaaattcgaatttattaacaatacttatcaaaaatgcctcaaaaagtttttatgatggcttgaaattgcgtaaaacccatgtatcagttgaagcggcctaaaattgatttttatataattttgctcttttttcatcaagtatctacgttggtttagatacatttaaacacatatgataggtagaataggtaaccaaatttagtccaatcagcctatgagtacctaaaataaagtaatatttggagataagcaaccaaaatattcaacattagacagttagtaaaacagttaacttcttgccgctgagtcatgaagaaagttgtattagtttaagaatttagctgaaattgagataaacaattttcgaaaagtttttgacagcgaaaccgttagttctcttcaccccctcacaatagaaaaacatatataacacaagtaccgtttgtaagttttcaatttcctgttcccaaaaaggtacttctcagaaacaattagtacttcaactaactcgccttttttgacatcttgaaattgcgtggagcaaacgatgaggtaggaatgggtgaatgtgtgacgcgagtccacttcctgtggaggcactagaaacgatttcgattccaatttgtgttgtgtgctgttggtgctctctctaacattcaccttatccttcttcttttctgctccaaactcttttcacttttctcgcacttactttttgtcctcatctccctacactccataccgtctacgtccacttcctaattaaaaggctacgcgcgtgggataataagagatgaggtccaattaaagaaagaaagacggcgcgtttcgcaagtgaagctcgttcctatcctgaagcgcaaacattcccaactttcaacaatttaacacccaattattgcaggcggcgcttggcggctcgctttggacgagtatttcgacgccagaaggatcggtcagtttgccgtccagcacgactgccacaattacatccacaacggtcacacccgtctgggtggcttcaaagaacagtattccatttgctgacacattaggctcgaactctccactttctgaatatttaccggtcaagctatgtctgggtatacacgatgtatttattgcattatttctggtgagtatcttttaaaataatttcttaaaaacctttttaaaaacttgcaggtaatgctaattctgctaacaatatttggtaatattctggtggttctctcggtggttgtttacaaacgaatgagaacgttcacaaatatattgctcacttctctagccacagccgacttgcttgtcgggctcatagttatgcctatgtcacttttggaccttttgcataatcatcgatggccgcttg

SEQ ID NO: 30460 - DNA, 799 bp, Caenorhabditis elegans
caagctcgttccaaagatggatgctgacagcgatggcttcatcgaggagaacgagctcaaggatcacatcaacttcatgcaaaagagatacgtcaacaacgacgtggaccgtacctggaagaactacaaggccgagaagattgtcgacggaaagatcaagtgggaagactacagagagatggtctacggatctgctgacggagctggccaggagctttctccagaatacgctaaaatgatcgcacgtgacgagaagagatgggctgttgccgactacgactcaaacggagccctcgacagaaccgaatacggttgcttcatgcatccagaagactgtgatcacatgagagacgttgtcgtcgccgagactgtcgatgatattgataagaacaaggacggatctgtggatcttgatgagtacattggagatatgtatagaccagatgattacccagagttgaatggaaaagaaccagactgggttcaatctgagcgcgaaatgttcaaggagcacagagacaaggacggagatggaaaactcaatcaggtataataatgtctataatatgatgtctaattaataatgattatatttcaggaggagatgcgcgattggattatgccagttggattcgaccacgccgaggctgaggctcgtcacttggttggaatcgccgatgacaacaaagacggaaaactgaatctcgatgaaatcgtcgcccactacgacacattcgtcggatcccaggccaccgactacggagagcaactccagaaacacgacccagccgagctctaa

SEQ ID NO: 30461 - DNA, 962 bp, Caenorhabditis elegans
atgtcgactcacgacgatactcgaagctctggtggaggagacggaacaattcatattccgtcggcagatgccaaggagccaactccggagagcccaggctctcgttccaactacggagaattctactggtatgtataaatttatcaactttgccgatgcatgcgctttggcttggtgcagaatctctctcttcgagaaattttgtcaccaatgtctttatataaaatctctctctcccttttcacgccacacatctctcccgttgttgttttttttcttgtcaaataattccatgttgttttccaaaatgaacaaaacccagccccctatgtcataagagctgtgagcctcgctagttttaatatcgaatctagttcacaaacacatattgcaattcttaagtccaacaacagacagtttgaaaacgtactcctatactattcacatgaagaagtcggaggaagaaattcatgattttgatatgggaagctggtaagttggcggagataaaggttagactagctaaggtcttttttaattctcataatacaccttgcctcataacaagcttggaactcaaaaattaacaccacgcgtcattaataaaagataatcagagatctttaattaaaaacaaaaccaaaaccaacattgagttgccgtgttgcacgcaatagccacgtgttacattgttaagggatgagtactccagggatacttctggtgagaacaactatcaccacacttcctcgtttgacgatgatcttctcctcgaaattgatagctctcgtggagccgcagtcgctcgtcttgaccgtactcaggtaaagcttaggagatgccaataaaactttcaaatgttatattttcaggacgacttgaacaaatttcgtcagcgtatcgacaacaatgttgagcaacaaagagaatatagtgagatgatggctgctctccaaaacaag

SEQ ID NO: 30462 - DNA, 517 bp, Caenorhabditis elegans
atgggccactatgttatagtcggtggtggtggctttcttggagcccatgttatctccgcgctccagaagattggctgcaaagagcgtattatcgttgtggatccgtgcccgcaagaattcaaaactatcaaaattgataaaagcaatatttcttacatcaaggtacgttttaataatcttagcaattaatagcacctacttcaggcttcctttcttgacgataaagttctagaaaacattttgaatggagcatctgcagttgttcatttggctgctgtcggacacacaggattgatcgcggtaacatattttcaatgctgaatttcactaaaaatttgttcagggcgatagaaaatctgttcataatttcaacgttaacggcacaaaacaattgataaaacagtgtaaagcacttggcgtgaagcgatttttgtatgcatccagtgttgccgtatcttttattggggagccactagacaatgttactgaagatgatccacttcctgatccaaaaaag

SEQ ID NO: 30463 - DNA, 876 bp, Caenorhabditis elegans
aattccttgtaatcgccaaagcgaacccactttcgctttcattgaaggctgtttttgaggagttggatgttgacggagatggttacataacaaggtaacttgaaaaactgcaaagaaacaacttttcgcttgccgcaaaaacttgtagtacacaaatctttgatgacaaagttttagtatgtgttgttcggaatcgttcaatttttaattggtagtagaaagttagagatttatatgaagaagtacgacgtaattatgtattttatttttgactggaaaaaaactaaaatgtgataaattatgtcaaaaatttgaaaattgcccaaaatattcatcaattggaatggcagaaaaatgtacagtttttttgaatttcagcccaatttagtcgttgttttttttaaatatttttaaccgctaaaaacaaagtttaaaaaaacttcagaaaattttacaataaaacaccccttttttggccaactttcagtcaacttggacaataataaaaaatcgcgacacatcatttaatttggaacaactacaaaattagaagaaaacgtaaaattaacttaatgattcaacttctaatttaaaagtttaaaaaagtgttcaaaattgtttttatctttgttaacccatcaggtttttttttggcaatttgcaacatttttaaattttttgttcaaccctgttttaaaactaatagtggcatattactatgagaaatacagttcactcttttttttcagatccgaattacgcactgccttccaaagaatggggcactctctttccgatcaggatatcaaggccatttataggcacgtcgatcaaaataatgacgggaaaatcaatttccaaggtgagcaattttaa

SEQ ID NO: 30464 - DNA, 453 bp, Caenorhabditis elegans
cgaggagattccaaaaaccagacaaccaggagatggaggaaatggtttgccaagtgaagatagagtcgcattcccaggaggagaatgcgtgaacggacaagagtgtcttctcgattctcactgcaacggaacaatttgtgtttgcaatgatggactctacactttggagatcggaaacactttcaactgtgtcccaggaaatccagctgacagcggatttggggatggaaaggtattcccttatttaaactttcagttttaattttgaattaaaaattgcagggaggacttgtcattggattgttcaacaatgaagtcacaacaccagaaccatcagcagagccagaaccaacagctaagacaaccacaaaaatgccaccacgagtgagggcagcaacttctccattctcattgtacttgacggttttgttaattatctattttgctttgtaa

SEQ ID NO: 30465 - DNA, 498 bp, Caenorhabditis elegans
atcaaggtcacaatagaagaggagaagaaggctccaaaattggtggaaacatcagtacaaactgatgatgaggacgatgatgaggactcttcctcgtccacttcatccgaatctgatgaagatgaagacgtaagggtttccaatcttcatattaatttaattgtttgcatttttcagaaaaacatcaaagagcttcgtgtcgacattgagccgatcatcgatgagccagcctcattctaccgccacgacaagctcatccaatcaccagaagtcgagcgttcagcgtccagcgtcttccaaccatacgtcctggcatcggcgatgttcatcaccgctatctgcatcatcgcctttgccatcaccaacgctcgtcgtcgccgtgccatgcgcggtttcatcgaggtagacgtctacacaccagaggagcgtcatgtcgctggaatgcaagtcaatggctatgaaaacccgacgtactcattcttcgactcgaaggcctaa

SEQ ID NO: 30466 - DNA, 257 bp, Caenorhabditis elegans
attcgcgaattgaacattctcatggactttgacgagaacggttatcttctccaaattttcagcaagccattgcaagatagacccacgctcttcatcgagattatccagcgggcgaatttcaaggtttttttttcaaattaatatgactgactgagttgattgtctaattcgattttcaggggtttggagctggaaatttcaaagcgctgttcgacgcagtggaacgtgaacaggaaaagcgtggaacccttttttga

SEQ ID NO: 30467 - DNA, 652 bp, Caenorhabditis elegans
atgcggttggtaagggatgatccaggattaccgctttacaacacaacatctccgaaaggtcacacgtttcgacggataagagctcgagctcggcacgttagttttacaatgtttattcaaaatttaggcttaaatttttcagtggttttcaacaaggaatacgccgacgaaagcttgtataatctttacaattcttctatcaattttcgtattaataacaatatgtagtcaaggtgaagcaaaaagagaacagccgatagttgaagttggatattctaaacgtttgttttgaaaataaaaatttgcatttcagaacccagagatcatcatcaacgaacaagtaatcgcaggacaaaaaactaaacattccaaagaagaatccgcggaaaatttgaaacccgtgcacgatattgatcgacaaattgtggaagatgaaatggatgcaccggagactggcggaggcaatgaaaaaattgtcaagtttacaggcaagttacttccattttcaatttttaaaaacttgaaagttaattagtttcttttaggaccaacaaacgataggcaaaaagctgttgtaaaagctttccaacatgcgtggataggttacaaaaagtacgcatggggacatgacactttgaagccggttagcaaa

SEQ ID NO: 30468 - DNA, 1444 bp, Caenorhabditis elegans
atgtgggtgatgagagcgaagaggggccagaccgggagcccctgcgcttcttcgactagcattgtgcattcagaatcgatagctgtgtgtgtcttgccatttcgtctactacattgggctagtggtgctgctgctgctgtcgctgccgcgaggaacctcacatacgtcttcttattaaaatttcggaacgagcgacgacggccaacgggtcattctttcattcttttattttgttgtcaactctaccttggttttaaatggagaatgtctgttttcagcaaagattacgaggtaaacatataatttttcatatatttgtttattgtcggctgagtacgtagcaaaatattcgtagattatgtatattccgtttagaatctttgatgaaaatttaatgaactgcaaaacaggtcaaccaagttgctgattgccagaaagtagccttaggttcggaaatcatcggttgtcggctgccgaaagttttatcgttcgccaacttcggcaactttcgatattaatttcaattgttttgtaaatacgcattcaaagaccctaaatattgcgaatatcgtcactgtaaataaaacaattatattttttcctcgaaaaacactctgaaatatgagtttaacagaaatatatgtttgaacaacgccaaggcctcggcagccgacggttgccggttgctgaaaatttcagcgattggcaaattcggtaaccgctcattgactgatacccagatgatgctgatgcaattaattttcaacctgtaacctaaattttagtgaaacaaggtagccaacgaacttatacctcttgataagaaaagtacttggcttctcgggcaataggtaccacaaaaactactaaaaataaccaaagtgtcaatcagcgccaaacacacaatctcatttcctccgtgttgagtctgtaataattgattttagatctggagacgagggtgagaaaatggaaattcttgaagttgggattgactgaggttcggctacggccgagagatcgccgatcaacttcggtagatcaaaaacataaaggtttgtcttgaaatattggtgtctagccttcaaatggcatcattattcttaaaattccatctaattattctttgtgatgagatcatcggctcaattccaaaaaacacgtatgtgttgtcattcttaattccctcaaattttgttttacagaatgctcttccacatcttcaagtcctcaacaccaacggccgaataacattgggtatttaacaagccccatggaaagaaaatgtgtgcctggagaacgacctttagttattacatacatacaatttcagttactccgctttccatgaaaccatcgccatccagaagagatactgagaaagatgcgttggaatacgagtttctagaagggtacaagaaatcgggaacattagaaattgatg

SEQ ID NO: 30469 - DNA, 746 bp, Caenorhabditis elegans
atgccgacgttcggacgtcgagttccgagaccaaaactggatttgccagcgctcagagaaacaattcccgaggtgttgaaaaacggtgctcttggttatatctgtctgtctggtaggaatctgaacgttccggaagatatgcttcatggtggagtaagaattggaagtggtgaaggacaatcagcagtgtaccgcttaatatacaatggaatggttattgcaagaaaagttagtttacaaagatttttaaattaaaagttgtggttaataaggagttgaattagttccatcctaatagaaaaacgatgatatatccactgcattttggattaatgaaattactattcaaaatacgtcacctagtgacttttatattttttaggatgtagcggtaagattacctcaaggcggagatgaagattcaacaaataaattaatggcaaaacgacttagagaagtgaatgtaatcaatggatgtgctccatgtccgttcattgtgcatttctttggatattacgttcacaagtataaagacgtatgttttcagaacactaaaaaaacggtatacgcgaaaattacacacattacagtgcgtgaaaattcatatcttcatggaggaaatggcgctcagtgcatccgttctcaaaaaagaagtactgaaacgaggcggaatagttcccgagtttgtaataggacgtatcgcttgctctgtaattcacgcaatgtggtttttgaaggagaaaatg

SEQ ID NO: 30470 - DNA, 759 bp, Caenorhabditis elegans
atggttcactcaccaggatattcgatcaaaagtgatatatggtcactgggaatcaccatttttgagcttgctacattgacgtaagcatttaaaaagtttttgtattctgtttgtcgaaggaaattaatttttgtgtgtttttccagtcattcgaattataaattgtttttaggcacccaggtagctgtgacttgagcatgctgggcatttcagatttttgctgaaaattagcttttttcgaaactctacgtctctagaaaatagtttgagaaagttttaaatttggtttttttgggcctatttttttgtctaatttagcaatgacccttgttatgcaccacctttaataaaatttcagatacccatatccagttggaatctccgagtttactctctcctctacgattatgacgtcaccagcaccttctctcgaaagggtaactttttttgaaccaaaaacattgaaatcactttttaatagggaatttactccgatagtcttgttgagtttgttgagcgactacttcaaaagaataaagatgatcggccaagtattgttgctgtgcaggtaagccagatattaggcacaatgttgacaaaacaacgacatttttacaggagctcaaatttttcgtgaaaaatgacattccattttcgtgtatcggaacaggagttggtgattccgacaatgtactgaatgcaagaccgtctgttggagcgtggttggatgatttcttctttcctagagacacgattccg

SEQ ID NO: 30471 - DNA, 366 bp, Caenorhabditis elegans
aataccggaacagtgcttcaagctcagaagagactgcaaattaacatgcttgtcaaccagttcaaacatattcgatcttactcggtgatgagacctggagcgtatccattggcgtgggtgaatgaatcattctatatggatcagaatacaattgatcagctaaattctcaattgttcacacctgtcagcacggttaacacaatttgttggatagctgttggacttggcggtaagtgatgatatattcaaaattagtgcattaatacatactttaattgattttcagctggtctcattgccttgtcgattgttatggttattgtatcattctgctgttttagagatgaacatcacaaaacttcataa

SEQ ID NO: 30472 - DNA, 1015 bp, Caenorhabditis elegans
atgcaaaacggtgacattgccgattcacaaataacggccagcagtagttttgacaaacaaagtgtcggaccacaaaatgcacggttgcactctgagctggcatcgggagcctggtgtccgaagcctcagattaactccaaaagttatgaatttttgcaggtttgcaaacacgacatatatggaacaaaaaatttaattaactgcaggtaactctgaacgacacgtttctcatcacttccgttgaaacccaaggaaggtatggaaatgggacgggacgggagtttgcgagccattacatgattgactacttacgtcctggaagtcaatggatacgatataaaaataggacgggacatgtggtatgtgtgaaattaaaaggtgcttataaagacttttagatttgtgaaaatttatattttggaaaagttaaaacattaacagatttaactgagctgaaatatagaacaatgattcattcttaagataaatacgcaacctgaggttgtaactgtgaaaagttgctcaaaacgtcctcaaattttgaaaaattaaaaaaaaacatttttcgatgatttctgaggtataaatttttggctttgttgtttgaaattattggtcaatttagaactgcaaacataaaaacttttttttcaaatctgcctgtaaactgattgtaagccaaactatttaaaaatgtgtagtttaaaaatgaaattttagaaagttagttgttaacaaattttaaacaaggtagagtcttcatcaaaaagttaaatgaaaattaaatgaatttcaaaaacatagcgactgaaaaacggggatttacaaatttttcgaaaaataatgttttaaatacaaattttccagtacatggacggaaactttgacacaacaacccctgtcatcagagttctagaccctccaattgttgcttcccggatccggtttgtcccctcgtctaaaaacacaagaactgtgtgcatgcgagccgaaattcacggatgcaagcatgaag

SEQ ID NO: 30473 - DNA, 181 bp, Caenorhabditis elegans
gtaactctggtatcaacccggtgatctacacagtattcaatcgtgaattcaaacggggtctttgcaaacagctgcacaaatttgagcgattcattcatccactcatggagttctacaaatgaaaactagtttgcaatttgagcaattcgaaacgggtcgcgccctcctttatccattttga

SEQ ID NO: 30474 - DNA, 784 bp, Caenorhabditis elegans
atgaaaaagtctacacaactcgccagacaagtcatcagagctatcggatgtgctaatggacttgctggaagacaactcggatgtgaaaacgcagtagaggttatcaaagcatctacatatctggctggtgttcagacgagacttccacttgaatggggaaaaatcatagaagaggtgaacactggaagacatgcgagtgcaatgtcaggagttacacaggtactgttctcaatttgcaaattaaaacaatcatgcttaactacttttgattcagacatgccgtcagcttgcacatgaaacccgacaagtaatagaaaataaggaagagttacttgtgttcggaggagatcatagttgtgcaatcggaacgtggagtggagtagccaccgcaatgcgaccagtcggagatattgggcttatttgggttgatgcacatatggtaagtcaccttgagaattcgaaaaaatatttggaaactataatctctgatagtttgcactttctgcaaaatcgtgtttttaaccagcgcgtggtcatttgtctgcagtggttatgtcgtaaataaccgattgactgtcaacagcaagatcaaaaaatcaagaattatttttaggatgcccacacccctgacacaagtgacaccggaaacattcatggaatgccagttgcgcatcttcttggcttcggtgacaagacgctggtgaaaatcggagatcggctgcccaaacttcttccccacaacctttgtatggtcggtatcagagactacgaatcggcagaacag

SEQ ID NO: 30475 - DNA, 715 bp, Caenorhabditis elegans
accgtaagaaggacttgctcaaattggctcacggtgaatatatttccctcggaaaagttgaaactaatcttttgactaatccaaatgttgacaacgtctgcgtgtatggtgattcgaacaaaagcttcctggttgcgttggtcgttccaaatcaaaagaatctaactcaattggccagtaaagctggtgcaagcaatgataactttgagaagctctgcgaagataagaaggttgtagaggcattgcaaaaggagttggctcaatatggagcttgtaagttttaacggaattttttaaagaaggattatgaccagtgggaaaatttttaaaaatcattcctatgatgctgagatgatcaggaatcataataaaatttttcaaagaacattttcgagttattttgagagtaaactaaattttcatcaatttctgacaacataaaaaaatttccaatatttttgaaaaattttgaatgaattttaattatttcccattggccctattccacttttaaaatgccaaagattcacgaatttctccaaaataaaaatcaatattttcagccaaacttcaacgcgtcgaaattccacaaaaaatctttatttgtcacgagccatggaccccagcctccgggcttcttaccgaagccttgaagctcaaaagaaaaaatatcgagaaggccttccgcaaagaacttgatgagctttataaatag

SEQ ID NO: 30476 - DNA, 375 bp, Caenorhabditis elegans
agtgtttccacaatagcaggacaagaagttcaatgggctctcggagcaatgatctatcatatgagattctttccccttcgggattcttctagaaatctcatcgttaaagagtatgttcctaaaaatgggattgggccttggtttcatattttgggttattccaggactcattcttcctccgaaagcttatgggctccgctattcttcctttccgccgttttctgtcttttcgtcttggtatgcgctaaggagcagtctgtactatgctttgatgacaaacgtcggtcctcttttgggatgtcacgcagtcaatactcctacaaaatgcttaaagaaaaccgtacttcttcttcatttcttgagaactttgcctag

SEQ ID NO: 30477 - DNA, 740 bp, Caenorhabditis elegans
ccgatctcgaccagtgggagcgcgctaacgtggctgatgctcttgagagatgcgacttcgagccaggaactcatgtcgtcgagcaaggacaacccggagacgaattcttcatcattctcgagggagaagccaatgtgttgcagaagagaagcgacgacgcaccattcgacgttgtcggacatcttggaatgtcggactatttcggtgagcaataatcagaaaaaaagagaaaaattggaaaaaaaatgaacaaacatggaaagatcaaaaaactaattgtatttggcaatatgcgggtgattcaataaatgcaaacattttttttattgaaatataactctagacaagatttttgtgacacttcatatatcaatgtaggcttttcatgaaatgcaggcgcggtttcagggaatgacgtcgctttgcattttggtgttaaatcaaaaccctggtgtttgcaccagagcccgacacgttttgatttttgaaccgcactaatcagtaggcgtgggtcgcgacccttgtcgacgcctgaatgaaagctttatttcaatgtcacaatttcaggagaaatcgctcttcttctcgaccgcccacgtgccgccaccgttgttgccaaaacccatctcaagtgcatcaagctggatcgtaaccgcttcgaacgtgtcatgggaccagttcgtgagatcctgaagagagacgtttcaaactacaactcatacgtcaaactgatgacctaa

SEQ ID NO: 30478 - DNA, 388 bp, Caenorhabditis elegans
gctatctatctcattgctacaaatggcaaacccgacttccctggaagagattccatgactttgttgttcaaggtaagagaactcgagaactttcgaaacagaagatttgataaaaaaaatatttgttaacagttagtcacaaatgtacaaaagatgactcaactgctaccgcagttttactttactttcagtacagtatcaatttctcccattctgtcccaatttccaggactttgtcgactctgcgttggaagtacaagttgaaaatcgatggtcggcaagccaactccttacgcatccattcctccgatgcgccaaaccgcttgcttcactgtactacttaatcgttgcggcgaagaagagcatcgccgaagctagcaactcataa

SEQ ID NO: 30479 - DNA, 1113 bp, Caenorhabditis elegans
gaaaccgtatcaccccatcctacgttgctttctctggagatcaaggagatcgtctgatcggagatgctgctaagaatcagctcaccatcaacccagaaaacacaatctttgatgccaagcgtcttatcggaagagattacaacgacaagactgttcaagctgacatcaagcactggccattcaaggttattgacaagagcaacaagccatccgtcgaagtcaaggttggatccgacaacaagcaattcaccccagaagaagtttccgctatggttctcgtcaagatgaaggagatcgccgagtcctaccttggaaaggaagtcaagaacgccgtcgtcactgtcccagcttatttcaacgacgcccaacgtcaagctaccaaggatgccggaaccatcgctggattgaacgttgttcgtatcatcaacgagccaaccgccgccgccatcgcctacggacttgacaagaaggacggtgagtttatgagaaaagtgctctctaatatttgtctctggactacccttttgaccgttttgtgtaaacaatagattttgggtcagtgactggtacaggttcctctctcgttaggaatgaggaataggaatgtttgctcaggtccgaagctgtaccaaatcacagattaagtatagagggttgactgcagatttgaaacaaaataattcttccaatcatgaatgtctttcatttacaggagaacgcaacatcctcgtcttcgatcttggaggtggtactttcgatgtatccatgctcaccattgacaacggagtcttcgaagttttggccaccaacggagacactcacttgggaggagaagactttgaccaacgtgtcatggaatacttcatcaagctttacaagaagaagtctggaaaggatctccgcaaagacaagcgtgccgttcaaaagcttcgtcgtgaggtcgagaaggcaaagagagctctctccactcaacatcaaaccaaggttgagattgaatctcttttcgacggagaagacttctctgagacccttactcgtgccaagttcgaggagctcaacatggatctcttccgtgccacccttaagccagtccagaaggttcttgaagattct

SEQ ID NO: 30480 - DNA, 1513 bp, Caenorhabditis elegans
atgagcgtttccaagaagcttttctctaccgccgtgcgaggaaagtcgtggtggtcgcatgttgagatgggaccaccagatgcgattcttggagtcaccgaggccttcaaagccgattcaaacccaaagaagatcaaccttggagtcggagcttaccgtgacgatcaaggaaagccatttgttctcccatcggtcaaggaagctgaacgtcaagtgatcgctgccaatcttgataaggagtacgccggaattgttggtgagtgttataaacttattgatccatttgaactctttatttgtttgcaggacttcccgagttcaccaagctctctgctcaactcgctcttggagagaactctgatgtgatcaagaacaagagaatcttcaccactcagagcatttctggaactggagcccttagaatcggatctgagttcctttctaagtacgccaagaccaaggttatctaccagccaacaccaacttggggaaaccatgttccaatcttcaaatttgccggagtcgatgtcaagcaataccgctattatgacaagtccacctgtggttttgatgaaactggagcactcgctgacattgctcaaatcccggaaggatccacaatcttgcttcacgcttgtgctcacaacccaactggagttgatccatcccgtgaccagtggaagaagatctccgacattgtgaagaaacgcaacttgtttgtcttcttcgatatggcttaccaaggtttcgcttccggagatgttgacaatgacgcgttcgctgttcgttactttgtcgagcaaggacacaacattgttctctctcaatcctttgccaagaacatgggactttatggtgagtttacatactaatttgttaaatttgaattttacaagctggagttcaatacgaaatgtattgtttttgtgcaatagagcgcagtttcttcttggtgttggaagttaggccatgataacgcggatatcactggtgtcgcattatcctatcttttctacccttttgtagccctaaccctgaatactgcataatttttataatttattctgtttaaggtgaacgagtcggtgctttctccgttgttacctcggacgctgatgaggctgctcgtgttgcttctcaagtcaagatccttattcgcccactctactccaacccaccagtccatggagctcgcattgcttcccgcatcctcgcggatccagctctcaacaagcaatggctcggagatgtcaagctcatggctgatcgtatcatcaccatgagaactacgctcaaggatttgctcgccaaggagggatctactcgtaattgggagcacattaccaaccaaattggaatgttctgctttactggaatcaacccacaacaagttgagaagcttatcaaggaacactctgtctacctcaccaaggacggacgtatctcggtggcgggaatttcatcgaacaatgtcgcttaccttgcccacgctctccaccaagtcaccaagtaa

SEQ ID NO: 30481 - DNA, 510 bp, Caenorhabditis elegans
attcacgttgattggagaacaaaacttgcattgtacaactcaaggaacttggagtcacgacttcccatactgcaacgttgtccattgcccacctcttcttccgccggcaaatggtcattttattggagagccaaaggagattaacacaaaaggagacattgttttgcttggatgcctcccgaattacatgctgactggcggcgatttttctgtctgccaagccgatggcgaatggagcgagatcaagacgaaatgtttgtttgttttggttgattgagaaatggaaactggtttttgtcattttcaggcgacggctactgtaggcatccagggcaacccgaccatggagctaccaccacaattgctaaagattattattctatcggggagaaaattgtgttttactgcccgtctcagaattacaaattgagttctgacaatgttttggtttgcatatcgcctggtcaatggtcacgacgtttaccgctatgtctaccttccaattcttaa

SEQ ID NO: 30482 - DNA, 305 bp, Caenorhabditis elegans
ggccccctaaggcaacttgtgtgaatggtgaatggatgccaaaagtgtcacccaaatgtgtttcgcaaacgcatccaatgattgaaggaaaaattctttgggaccgaaaaaaacgaagtttgcctggcagagccgtaagagaatatgtcgatgatggtactttataatagtgatgcattttttcagttatttttatttcagaactatcaactcatcggcaacactcgggaaaatgtggaattgtgtcgggaaaacttgaaagaatgataatgcaacactctgacaatggagtctcggtctgttga

SEQ ID NO: 30483 - DNA, 1358 bp, Caenorhabditis elegans
atgcgcgagctgctgttgctgctcacatttattttcagctgggccaacggccaattgttggaaaaatcgcgatcggtctgggtggaacaaggtcttgttcgaggaaacatatataatatcgatggaaagcatattcaaatttttcgaggagttccttacgcagagcctcctattggagaattgcgatttaaggtatgatgtgcccctattttttttgacgtacctacaaacttggtgagcaccgaaaaaagtttaaagattgataaagaaacatctataagtccctcgccctaagaaataatcggtacctgtcctgtttttaactgtaaaatagtttttctattccaaaactaaacattttgatctttaactttgttgatgattccaggaaaatttttttgcaaataatgtgcatattttggggtcactcctcaaaaagctttttggaaaattttttgaatatctccaaaacccgtgacaaatcaccagttttgggaaaagatttcaacccctcgccaaatgtttccagagagtttttgccaaaaatggaaatattagtaaaattttcaaaatcctaaaagtaggaaaataagcaagctgactaccaattttggatcacttgaaataatgttaatttccaacttaaacctattatcctctgcaatctaagtgcaaatattgaaatcataagtttcacatctcaaatacttcattttgagttttcaaaaacatttctgaactttttaccagaataacaaaaagttaacacctatgcatcaccagttgttattcaatcggttgttctcaaaactgtctttcattaactcgtcataatgacgactcaatattacacacacatacacaaacagttgtttcttttattacagccacctgtgaaaaaaactcgctggcaccaggaacttcctgctgttgagtatggaccgccctgtctacagtttatggattttcacaaaaacgataaatttgcaaagacgaacatggataggcaaagtgaagattgtctatacttgaacgtattcagtccttatgtaatgttgaacagcaaacttaaaattatgcaaaatatcatttaggacactgatgatgaatctaaaacttatccgattctcgtctggattcacggaggatcatttttagcaggatcagctgatactggaattgatatggaagtgatagcagcaaacattgtgtcaaaaggaatagcgtttgtctcaataaattatcgtttggggccgcttggatttatgaattatcagaatggcgataagttggaaggcaattttggaatttgggacatggttatggctttgcagtggattcagtcaaacataaagcag

SEQ ID NO: 30484 - DNA, 2323 bp, Caenorhabditis elegans
atggcaactgagtttttctcactttttgaaaaccctatagcactgtcgcatgttagatcccctacggtatttgaatattaatatttgaaattacaccaaaaagttcaaaggaaaaaccataggagtggtttgtaacaatttcccactgttactaaatctttaacaaacttctgaaaccatttagaaaactattgcaacttctgggcaaattttttgctatttttcatgtgactgatcttcagattccgcgaattcaaaacggatttttaaaaatgtttataaaattttgatttgtaattcaaaagtttgcttgaaaagattttacggttcgcaatgtcgttgggcattatggtaaaaacacggtatataaattgtgagaacacaaaaacagtatttgggatagctttcacttcaaactgggccaatgtcccaataattttattaaacaaaaaatactcattcaccctgctcgtctagtcaaaaatgttgaaggaccgttgatcacgcaaaactaccgactttggtcgaggacataatttgtcccgatcacgcgcaacaaacgtttggaagaaaccaagaggcgcgtatcccaacaggcattgaattggctccaaaaaatgtcacattcaattgtaggtagtgttttgtgtggggcacatacatactcacacacacgcggcctcctctccaagtagtcctcgacgacgtaacacctcaatttcatgggcttttaacggcagtgttgtcccacacaactaacaaaaagccaatggcttccaacacggggcacccaaaaaacttgtctggagaccaaaccaccttcgatccctgttaattttctttgcattgatcgatgctcatcatttttcttcatcttcttcttttctttaatgtttgctgataccttggatcaaatgtaaatattaaaattttgcctgcatccttccgcattcaaatttattttcttctctcttttttccccaattgagtatacatcagtgcttcactcatcttttttactttattcaagtatcgggtatgtatggcagttcatgtttttccaacaagtataaagatgattaaacttcatctcaatgaattattcatgttataactttgtctgtgaaccttgaagctgtaagctgaaattgtcaggagtcttctccagtcttgtgattttttgttcagtttccgtcatacctagcaaaaacaaatttcacttttccttgcgtgttgtatgtatctcaaggcttgtttcttgtttgaaagcttgaatttttttggttatcggtctcgggttttgtttatatatattttttttcattttcagaacaagatggcaaaactttccaaagaaaacctgctgctcttgttcactgttcttggagttgtcgtcggaattggactgggattctcgttgcgagacccaagcaaagcttggtcaaagcgtcacctatcttacctccgatttccgggagatctatttgttcagatgctaaaaatgctcattcttcctatgatcatgtcaagtattatgtgagtttgttgccacaaaataattccgtagacacagatacccccctcttgcctcttgacgttttcttcagctcgctgatctttcaatgaccctcaactcaatgcgcttttttgcgcttgcgcgactagtgtttaacacgttaataatttgaaaaggtacttggtgcaaacgacaacacatgttagaccaaagatactctccagggtttagagcaatgataaacaaagaattgaaactggacatatcttgcggtacaggctgagttattaattgttattattaaaataataattaaatatatgtacgataataaattttcagtaagaaaaatacgtattgggtaccaaagtatggaagttgaaattttttcaaatacaatcgtcatttgaaggttttttaaaccatcacttttacaggattcgttttcaaaaaccaactgagtctgagtgcatttttgagtggttgtatttaaaaattaagtcagcgaaatttattaaaaatagtttttgtcgtttatttaaaaaaaacatgggaaatttgaaaattgctgaatttgtcaaaattataaaaacctgaaagtgaacagctgtgaataaaagttgaaactgaaaaattcaaaaaaatctacctgaaatcaaacttcctctacaatatcaaacgcatttccaatcaaaaccaacattttcagtacgagtttggcctcattggattctggaactgcaggaagattaggaatggtgtctatgatttattacacgttgaccacattttttgctgtatttcttg

SEQ ID NO: 30485 - DNA, 884 bp, Caenorhabditis elegans
ggttttaatctataacggagatgtagactctgtgtgctcaatgttcgaagccgagtcaatgatcaacaacttcgccgctgctcaaacgtttgtttcgaaccagccaagaggatcgtggatgtacggaggacaaattggtggatacgttcaaaaattccaaaagaacaacatgactattgaccttttgactgtcaagggagccggacacatgtcaccaactgatcgtccaggaccagttcttcaaatgatgaacaactttgtccatgggcaaggaaactataacacatcaattgctgttagtatggtgcgccagccacttcttgcccaattccttgtaagttttctgggatcattacttgaattagaataattttaaaaatttgctgatcagtctatttttaacccacaacataaaagtcaaagcgaatgttttgcaggaacaaggaattggaccagttggaacaagtgctccagttgcttcaaccagcacaacaaatacgccaagcccaaccaatcagtcaccagtaactcaagcaccaccagtaactctaccacctccttcagtagcaacagcaggacctactgggcctatcttaaccgttgtgccagtttcatctgctccaacatcaggtgctgtctcctcaacaacaaatacgccaagcccaaccaatcagtcaccagtaactctaccacctccttcagtagcaacagcaggacctactgggcctatcttaaccgttgtgccagtttcatctgctccaacatcaggtgctgtctcctcaactgcaactgctgcaccagtaattactaccactaaaacttcttcagttttatcggtctctttctctatgtttatcgttttgattaccaagtttttattgtaa

SEQ ID NO: 30486 - DNA, 230 bp, Caenorhabditis elegans
gtacaacagtctcaattacggaaagagatcttgttattagcttcttcggaacatgtagactccaaattattccaaccactgataggtaaggaatgattgagaagatggattgaatcatgcaaaaatttttcagaatcattctcggtcttccattgtatcgtggacgttgcacatatttcgatccaatcatgcaaagagtcgggttcactccagcgcttctccaagattag

SEQ ID NO: 30487 - DNA, 285 bp, Caenorhabditis elegans
aacaatcacatttatcgtaggatttttcgcaattctttggtcaccgtattacataatggtaatgtttctatttaacctcaatattattccaatttttttaaatttcaggcaacagtgtatggtttctgtaaaggcgaatgcataccatcatttctgtacactctatcgtattacatgtgttacctgaacagtagtggtaacccatttgcctacgctcttgccaatcgtcaattccgttcagcgtttatgagaatgttccgcgggaactttaacaaagttgcatag

SEQ ID NO: 30488 - DNA, 325 bp, Caenorhabditis elegans
ttcgtctccccatggtatctaaagacaccatcacatataccaccggaaattgaattcgctacaccaacgccattgatcagttcgccactagaagctgtgagcccaattctcagccaattgaaatcaaactcgttgaatttcacggaactcggaaaccaggcaaacaactacttctctgcagcattaagtgcattcgcagaaacaaagaaggaaatggcacacaatgacccatggcggactatcataggtttgttgtgacaccaattaatgagttcatgaatgtataaagatttcaggagcaatactgaagtttttgagggagtaa

SEQ ID NO: 30489 - DNA, 270 bp, Caenorhabditis elegans
atggtaggcttttgaactttgaagtaatttttagagaaaatttgaattctagaagacgttgctcttcctttcctgcatagtggtagcagcttattgcgcatgcaatgataaccttgagtccgttttgggtaggttggatattgatgaagctttctgaaaatttcaatttattaagacaaatatcgcaatcgtgaaattgactcagaagcagctgagcttgacggagatgacttgatcgactatgtcaatgaaaaccaaaatctttggacg

SEQ ID NO: 30490 - DNA, 1842 bp, Caenorhabditis elegans
atggacgaagaaagtggaagctcggtgagtatgtggttaacaatgagaaaattgagtccggtagccatggtgagccggtcacagaaaaaaacggtgggaatatttgaagcatgtgacgaaaatattttggattattgtgacttgtaacttgaaacactactagagcggacgaacctaaatcattttgacattcattttagtatccggtttcgaccgaatacgcatccctcttgtctcaaatctattggtgtgcttcccacatgactaaatacgagtctgaacacctttttgaattgttttatattagagaaacaaaataagttgttattttttgacactcattgtctagaatatttatcaataccaattcatattctgatgattgttttctgttatgcaatttctcttttcatgaagaaagcagtggtcatttctaaggcttcttcgagccgagcttgacagctctgattctctcatctcttcacacatttctcttcggcagttcctgacgactattgccatactgatataatactgattgtgagagaaaaaaagaaaacaccaattttctagtatcactacgaattctgcttacaaaaatcttagattccgcactggcttgattatagtcatcgtcatctttctataaacaaacacctcttaccaactcaccaaaaaatggtgaaatataaaattagagctcacacgcgcgattaacgtcacctctggtttcaaaagtgtgttggtgtgtgtataaagtgcacagactcactcgacaactccaattctttgcctaataatagctattttatatttctgagacgatgatttttatgattttttttcaatccgactaaaagaggatgtgagaaaaaaagatatccatgctttccatatttactttttataggtagaattcttgtatctctttacaactccagctcacagctgaacatacaaaatcttttctattgttcacactatacagctctagagctcatttttgaaagctagcagaataagaattcagacagattttatttttatatatcataaacggtcaacattgtgacactcataaaatcaacacttttgcaaatttactttcaacaacatatattgattaacttaaagtaatttctactagcgtgaaacatataatcaaagtgggcgtactaaactgccgattttctcacaaaaccttctgtctataacttccacctgttcttgtgaatgttcaaacatttggaagtgtttccaagttttttgttattagtttcctcacatcaaaaacgtcttgctcataatccatgagatgtcaaagataaacaaatgtttagcatgattatcctagaataagaagataagattagaacgcaatcattatacttactcttaactacgactatttaaactactgaggatttatttattgaatatcatgactgactgcttctacctctacatttttctacttgtagtcattttttttctgctcaaagggttactcttgtttactgatattgggtaacgaagtcacttatgagagaatacatttagaagcagtcgttgaaaatggtttgggatgaagtcttattaaccctcagatgtacttctgttcaaattttcagtgacgttttcagactgatcaagcagctccaagtgatgagcagcaggaagctggctcgtcttcagcaatcggtcaagaatctcgaaaaacagttgtatttcaagaacccggtaagcattattaataagcttttacaataaccagttgaatactttctagatattggattcccgagtgaacacgatcaactgacaactctacacgattctgag

SEQ ID NO: 30491 - DNA, 516 bp, Caenorhabditis elegans
atgaatgtgctcattgttggaagcggtgggagagaacatgcattggcctggaaaatgaagcagtcaccaaaagtaaaaaatgtgatagttgcacctggaaatggaggacacagtgaaagaataggtttgttgtcattgtttttttttaattttaattgaaaactgaaaacattgaagatatcaattcaaacgaccttgacgctgtagcggacttctgtgaaaaacataatattcattgtgttttgattggtcctgaggaaccattgtccaacggtttggctgaccatcttataagaattcacccaaaccttatggtgtttggtccgttaaaggatggcgctcaacttgaggtgaacaacatttcaactccacgtgtcttacgtaaaacccattcagacatcaaagtcattctctaagcatttcatgaaagagtatggtcttcctactgcggattttgtgactgtgtccattgagaatgtcaagagcctcgactgtgtctttgagaggtttccggct

SEQ ID NO: 30492 - DNA, 2595 bp, Caenorhabditis elegans
atgggagaggacgaagatcggctggtcatagatctcttccgagagtacaactttttgattagacccgtcaaaaatgttagcagcccaccggtggtcgtcgattttggagttgcaatgatacttctgatcaatgtcgatgagaagaatcagattttgcaaacaaatgtgtggttgacaatgaaatggaacgacttccaattggcatggaatccagcggaatatggtttgctttaacactgaacaaaatgactgtctcatacaaattttccattctaaaaatcagggcttaaaattaaatttatcaaatttgtattagtactgcgccccgttgctcaaaattttcaactcataactcggttatctttagttctagtaaaaattgttaactaacgaaatatttaatatttatttttctctcgtttgtagtgtttttgatatttgcaacattaaaaaaagcaatggtatgcaatattattttaggaaaaacgttagactattaacaaatttaaaagattttttggcacttataaggttttgttttcatctcttcctcttttttattgttaacactgttttactcatgaatgtttgttttatttcattattttttttttaaaagaaaagtcaaattttgcttctactgtttcaccaaaaagtttttttttcaggaaacatctccaatcttcacgttccatccgatagggtgtggctgccagacattgtcttgttcaacaagtgagtaattgatttatcctttttttgtcggccttgaatttttgaaaaacgaaaacacaaaggttgacaaaaaagtagatagatatgtagatatatgtgcaaaagcctaaattcccaaatccactttgcctaaatgtgtgtagtaatgtgcacaaatcaaatcgtcgatgctccttgtttctgtagttttccccgacaagtgatgatgagtcaacgtgaccgacgcctttcctttcttttcaattcgttttatcaaatttgccagatttccgagttgcctttcatttcttccaaaaatttcgaaaatttaaaatgtatttatagtttagaatttagtccaatttctttagaaatcatgtttggaaaacaaaaatattgtgacttcattcctaacttgacttgaattacaaggtcaaaaactggaaaagcgactaatttgaagtttttggttttgtggaatctcaaaaagatgagaattctaagttgtgacgcaattaagagcagcgaattgctccagcaacaacaacagatatgcacgcaatttcaagagtccttatggggaatgggttgcaatgacaaagtttgtactgaagaataaaaacgtcaaaaattgcaaaaatttgttgacatttcaaacgtacatattcataaacagtagcaaattcccacacatgaaaaataacttgttttggcaatagatactcgcaagaccccagttatgaaaaatgacctgaagtcgttttctgttggcggttttttttttgagaagtggcacactttctttattctttttagcattgctcaatgcaaaggggaaaagaaagtggaaaaataggattattgcctagactgaagataattaaataggaattcttgatatacctatttgacaagtgctcgaagtattactccccttcagctaactttgctgatcagggcgaccaaatagagaaaagcaatagtaaatgaaggagtgcgaatatctagaacagatagggaggaatattctcggaaaaagaaaaaacacacattcatttagggaaatgaaaattacatttaaaaacataaaaataaattagctggtatagaaacgaattgtttttttcctcgaatttaagttctaaattaaaacaaaaatatatatacacagttatatatagttatgtagttatgttatgtagttgtgcgatattttttcttccaaactagataaaagaagaattttcaaaagatttttgactggctcctagacacaatttacgtttaaaaacatttgtgagtaggtattttaatactaatttgagttgtgtaacttacaaacgattattgtaaaactaagaaaatctacttttaattttgaaggtggcaaaatttcttagataatttgtggctattttgtcagcatttggcaactttcatgtagtttccaaggattttttaaaacttgaatcaagtaagaatttaatattttaaccaaatcttttttaatatgtatcttgacacatttttaatatgtatcttgacataaatgatgaggaaaaatattggaacaaatgtccgcaataggctagttagtataactgccaaaaatttctcccacactgccctgaccaaaacttgaattaaaaaaaaaattaaaattaatatgacctcccaagtaaagttaaaactcgaatatacatgttttctaagtacataacacatctacttcctcgcatacaaatgacgtttttttttctgcagcgccgacggaaactacgaagtttccttcaaatccaacgtcttcgttgaccaccacggagatgtgacatgggtcccacctgcaatgttcaaaagcagttgccgcattgacgtcgaatg

SEQ ID NO: 30493 - DNA, 304 bp, Caenorhabditis elegans
gctagtgtggctactgtcatgactcaaccattggacgtgatgaagaccagaatgatgaacgccgcccctggcgagtttaaggtattatcggcatcataaaaaacgcctaccaaagtctactttatttttttttttgcagggaattctcgactgcttcatgttcaccgccaagctcggtccaatgggcttctttaagggattcattccggcttgggctcgtcttgccccacacaccgttcttacattcatctttttcgagcagctccgattgaaatttggatatgctccaccagtaaaagcttaa

SEQ ID NO: 30494 - DNA, 751 bp, Caenorhabditis elegans
gtggtcgatataccggtcgcggtgggacaatcccgacctttcgacggaatatttgttatcccgtctgcccctcctactgctagtacacttacaattgctttaatttcttctatactgctttttgttttgatttttgttgaaactgaaatccccgaacagatggcattgcgagagggtagaaaactgaaaaaaggaggtggccttcattgggacttgattgttgttggattttgcacactggttagttctgttcttggtcttccgtggatgtgccctgccgctgttcaatctctggctcatatcacttctttgactgaatacaagaaatctgcaccaggagtcccgtctagtgagttttttcatatatcttttttttaacttgtgacacttgaaaatagattaaaattcaaattcctaagtacttaagtttataactaatagtgagttaaaacaacgttaccgatgaaaatgtattatttcaggaatctcccatgtcattgaacaacgcgtttccggaatggtcacctacctcttgcttggcacatttgccattcttggacattttcttgcaattcctgctgccacaattttcggtgtattcttctatcttggagttcgtaacttggagggaagtaagatgatccttcgtctcaagttgtgcttcctacccagcaaataccgtggatcgcacaaattccttgaaattgtgagttctctaaaaatttgcagtttgattttcaatcttcactga

SEQ ID NO: 30495 - DNA, 421 bp, Caenorhabditis elegans
ctcaaggactattattgtcatgacagtcacgaacacaaacttgaagataatcgttcttctgattccactccattgccatctccatctccatacagctacccttcaactccgctgaaccattttcaatcgtcatcaaactccccagtattttccaataatcattcaaaattcaacacagaggttcgtataaaatttctagttgcttaataaactttgagaaactccgtaagaaaaagaatttcgccgattctatttctgtcattctattttctaatagttacaggcggtgacatgtgaggctggaatgctgtgtcctccaactatcgttgtgcaatgtccgtcaacatgtgcctcacccaatcatatgagaagaactcggaatcaaatggataaaagtcgcacaaggtatagtattgcgtag

SEQ ID NO: 30496 - DNA, 757 bp, Caenorhabditis elegans
atgaggcgagaattggctctatttcttgtttgttcagtatttgccactgttttcgggtatgatttcgttttttcattgattagttgaaatatttatagtttagaacagattcatctccatcattcaagattgacactgtgaatagtcaatttttacttgatggagatcctttcacctacattgctggagaaatacactatttccgaattccgcatcaaaaatgggatgaccgtctgaagcgagtgcgagcgttaggatttaatgcaatcaccgtaccagttccttggaatcttcatcaattttatcaagatgaaactcctatcctttctggaaatttggatttggtcaaattcataaaagctgctgaatcaaatggattgtatacgattctcagaattggtaatagtaaaatatgtattatgggagaaacgttaaacatcaccgttgggttttatattttgattatgcatgtttttttacaaatattttagggctttgaccacgcgagacagctagagttcttcaaagtctaattttttactaattactttttttttacttttactttttttactaaaaaatttactaaatttcaaaagtttctttgaactgagggaatattttgaagattaaggtttagcggttgaatataataaactatagggccgtacatttctgctgaatgggataacggcggccttccttggtggctcatcaggaatacgaaaattggaaagtaccggagcagtgacccatc

SEQ ID NO: 30497 - DNA, 572 bp, Caenorhabditis elegans
atgtcgggccgcgttttccttcttctggctcttgtcgccttggcttctgccatccagaggttagttacatttttaatataccattcatatatttaaattattttattttatttatttatcatgtttcttctttttttagaatcaagctcgagaagcgcacttacactcgtgaacaatacaagttcggatcaatccaagagcatcttaaggccaagtacgtcccaggatacattccaaacaaggatgcattcaacgagggtctttctgattactccaatgctcaatactatggaccagtgaccattggaactccaccacaaaacttccaagttttgttcgatactggatcctccaacttgtgggtgccatgcgccaactgcccattcggagatattgcctgcagaatgcacaacagagttagttttgaagtattcaaatcaactttttttcaataaaataattttcagtttgattgcaagaagtcttcttcctgcactgctactggagcctctttcgagatccaatacggaactggatccatgaagggaaccgttgacaacgatgttgtctgc

SEQ ID NO: 30498 - DNA, 711 bp, Caenorhabditis elegans
atgtctcttcgttttgacggaaaagttgctattgtcactggagctggaggtggtcttggcaagacatatgctcttgaacttgccaagagaggatgcaaagttgttgtaaacgatcttggaggagatagacatggaacttcatcctcttcatcaatggctgacaaggttgttcaagaaatcaaatcagctggaggacaagcagttgccaattatgacagcgttgagtttggagacaaaatcgtaaaaaccgccatcgacaattttggaagaattggtacagttttttgataatagaatactgatggatttgaaattggttccagatattgttatcaacaacgctggtatccttcgtgacgtttctttcctcaagatgaccgagcttgattggggtttgtaatagctttcaaaaaataaaataaatctgctcaattttcagatcttatcttcaaggtccacgttaagggagcctatgctgtcaccaaagccgcttggccatacatgagagatcagaagtacgggcgtattgtggtcacctcttccaatgccggagttcacggaaactttggacaagccaactacgctgctgccaaaagtgctctcattggtctgtcaaactctctcgcccaagaaggtgcaaagtacaacattttggcaaataccctggtcccaacagccggatctagacttaccgagactgtcatgccacag

SEQ ID NO: 30499 - DNA, 1259 bp, Caenorhabditis elegans
atgatcacatcagtattgcgctatgtgctagcgctctacttttgtatgggcatagctcatggagcatacttttcacaggtagcacctagggtgtttttatgagtaaacatttgtttttttttcagttctccatgagagccccagaccatgatccttgccatgatcatactggtcgaccagttcgatgtgttcccgagttcataaatgctgcttttggaaaacctgttattgctagtgatacatgcggaacaaaccgaccagacaagtaagtttattttcgagagctatttttcttgttcaatcatttttcatttcttaaatttctcattgattaaccttccttaacatgattacgcaaacgcactcattgttgactgtttgttctttaatttttccgacccttccatgcgaacaattttctaacagaaccttaattggatttttgttgttttttcagtctcttaaaaaatctctccatctctctacaccgcgatactaataaaattaaacccttcgccattttttgattaagaaaatactagcgaatagaaagaatcgaatagcttttcatgtaaatgtgtagccatgcaaaatttgttagattggtttggttcagaggaaattgaaaaggttgtcgcccaaaagtatacatagtataaataagatgacagatactgtatttttacttagttttttaaaacacgacaattttttttagatattgtactgtgaaggagggtccggatggaattatccgtgagcaatgtgacacttgtgatgctagaaaccatttccaatcccatccagcctctcttctaactgatctcaattcgattggaaacatgacatgctgggtttccactccaagtttgagcccacaaaacgtttcactcactttgtcactcggaaaaaagtttgagctcacttacgtctcaatgcacttctgttcccgtctcccagattcaatggcactttacaagtctgctgactttggaaagacctggaccccgtttcaattctactcctccgaatgtcgtcgtatatttggcagagatcccgacgtgtcgataacaaagtcaaacgagcaagaagccgtttgtactgcctctcatataatgggtccaggaggaaaccgtgtagcgttcccttttctagagaacagaccttctgcacaaaacttcgaaaactcgccggtgcttcaggattgggtcaccgcaactgacattaaagtggtgttttcaaggcttagtccagatcag

SEQ ID NO: 30500 - DNA, 245 bp, Caenorhabditis elegans
aatgtatgtgctggttcaattttgcaaagattgcagtccgaatgctcacattgagatgttcattacttggcttgggtacagcaattccgcaatgaatcctatcatttatacggtaagattttcaaattaaaacctgatgctattatttgtattatttttttcaggtatttaacagagactatcaaattgctttaaaacgccttttcacttcggaaaagaaacccagctcaacttctcgtgtctaa

SEQ ID NO: 30501 - DNA, 594 bp, Caenorhabditis elegans
atgcttcgtgttttgttctttactcttgtcgcgcttttgtgttttgtgtcaccaaattgtcttcctggagatactccatttgagatttagtaagttatttattgttataaattgtctcaatatcacatctttcagttgtttttcatacaatcgagtacatggaacattcaatgactccgatgctcattgcttgaaaaccgttggtggaagtctggtatcaattcacagcatgatcgaaaacaactggattcaaagtatgtcttgaacatatgaatttctaaaccaaatacattgatttcagaactagctgttgataatctagatgctgactatgacttgttctggattggtggaagcgacgaaggacatacaaatgactggagatggacagatgggagcgttttgaacttcaccaatcccggacctggacagcctcttgaagatcgtcattgtggagcaatgcaactgtcaacaggaagatggttttccgatttgtgcacagttaagcatcagttcctgtgccagtatccaaatggagcatatccaactggaggatcgtacacatgcccaccatgtccatcttgttctaaataa

SEQ ID NO: 30502 - DNA, 593 bp, Caenorhabditis elegans
gaagtaattgaacgcgcaaactccactccctatggcttgtcagcaacagtttggagttcagatagtgatgaattgttaaacacggccaacgagctgagagccggaacagtttggtgcaacacttggctggtaagataatgggagatgataattcgagttgggtgtgaccaagttctagttaattacggacgataagagcggtatgtgtgggtagacagacaacatgacgattgaccaatttgttttgcttggaatgatgttcatgtagctacagaccaaactaaattaattgtaaatgtaccaagaatccatgaaaatcaccaaaaataaagaatgcttttaaaaaatttatagatattctgtgctgcttaattgtttcactaagcgtcactaaaaactacttggaacttttccaatagttaatcaactctcggttttaaattattctcatgttgaaaattcaggctcgcgacctgagcatgccgtttggtggatgtaagcaatctggaaatggaagagaaggtctccacgactcactccacttttactccgatgcaaaaactgtttgtgtgaatattgctgctaagtactaa

SEQ ID NO: 30503 - DNA, 1691 bp, Caenorhabditis elegans
aagaaggcggtggaactatcaaaacaaaatccaaggcaatcaaagatgaaattgttgctgctcttgagaagcttacctcgattgatgaatctgttgctcaggccaaagttggagctgatgctgctgaaaatgatatgaagagatgggaaattattattgagaatgctcgcagagaaattgaaaatgtgctccactacctggaaaccgaaggagaagagagagctcaaattgcgtataacgccagccaaaagtacggagagcagagcaagcgcatgtctgagttggcttctggaacacgcgaagaagctgagaaacatttgaagcaagcttcagaaattgaacaactttcggaacaagccattgctaacgccactcaagctaacaaagaagccagtgacgcaatctacgggggagaacaaatttccaagcaaatcgctgagctcaaggagaaacaaaatcagctcaacgagtctattcacagaacgctagatttggccgaggaacagaaaaaatcagccgatgaagctaataatcttgccgctgtttcactcacaaatgttgaagccgtcaagattccaagtgtggatcccaaggagttgagaaatgatgtagctggagttttagaagaatctgaaaatcttgttgacagctccgtcaaagagaacagtgccaatgatgaactttttgatgaagttaaccgctctgttgctgacgctcgtaacgaacttcaaagctcacaagaccaacaaagagtttccgatcaactaatgctggaattagaaaaatctcgcgaaagaattgttgactctgtatcgactgctgataagactttgaaggatgccgaagccgctttacaagttttggaagagttcggcgccaagatcgaaaaatctcgaaatgatgctgtcgcagaatttgctggagtagaaggaatcaatcagagacttgatgatattattgatgctcaagataaaagaagaaactctctcccaattgataagcagtttgttatcgactacagaaaatccgctgatgttcttctcaatgaaactcacgctcttgccgacagatacaaggatattattcattcagatgttgatacgcgagattccaccgaagctgttcagtatgatattgaacaattaatggaagaactcacagattcaaatgaaaacctgcagtattacaagaaacaagccgaagacgataagcaaatggctactgaagcggtccgcaagcaactcttgccaagaattctgccatcgaagcaaatgctaccattctcgctgaggaagatgaaatcaagaaaatcatcaattctttgggtaagaacactatttagctcagtcaattatttaatgtcactcatatttcagataccatggaagaagtgaacaacgcggagctagatgagctcgaggaggaaattgacagacttgatcaattgttggctcaggcacaacttgccaaggaagttcccacgtatcagcaataccgcgctgacgaggacgtaaaggtggcacagctcaaaaatgatatttctgagctccagaaggaggtttgttttgctggctatagtattcgtataattaaactgtatttttcaggttttgaacctagaggaaatccgtgacaacttgccaaccaaatgcttcaatgtcatcaatttggagcaagagggacagaaataa

SEQ ID NO: 30504 - DNA, 992 bp, Caenorhabditis elegans
atgtcaaatgagaaaaataaaaatgagagcacaaataaaaccaacgaaattggaaatgctgaaaaaaaagaagaagcagaaacagaagacaagaaatctctgaaatcaatgatctatccgattgaaccgtcaacgttatatattgatgatttgaagaatagtaagaaaggttagttcaatgagtttaagaaatgtttttatcgttgttaaatagagtgttcccgggaaagttgtgattttgaagcttattggattccaagaattgtgaacaattagttatgagtataagtaatattgtttgttctaaatttaaaaaaagttgtcgagttttttgcaatggtaaacctgtgccttttgaaatttaaatattgatagattttatttactacatcatattaacaaagctgtgaattttagtaacttttaacctttagtaactaagcaattacataaaagattgtgtccagattcagttggaaaagccgcgtgcggctttgaactcacacaccaaaatgtgaggaattctgatacagtgaatgtaccccctaaatttttttgagtggttctatttctctcatttatttttcaagttggattagcttgctataatgaaaatgaatttaaaaaaataattatgtgattcgaaaaattgaaaattgcttctaatataaatttgacttgtgatatgagcgtataggccctttttttaattatctttactcattcagcatatgacgtcacaatggacgaccccttggataaatcctcagattccaagccaaaacttggatttttcgaaccctacaaaaggctttatgcgtttgccgatagtattgacatgcaggttttgattaacattacttttattctattaaatttcatttattcagctgatggcgatgggtctgtttagtgcactacttcagtctgcacttcctccatttgtttggcttattatgggtaattttgtctcaatatcaattttaagagag

SEQ ID NO: 30505 - DNA, 1043 bp, Caenorhabditis elegans
agccaatttggtcacatgagcatgaccaccccacgaagcgaagcactaaatagtagcggtgaagtgtgtgagggagctggagagcaatggtctacacctttaacagatgatactatgatggattcgtattgcaacagctccggacgagattcatcaagtaagatataagatgacaatttaatttgctctaggaagctaatcaaatttaacaaataactttcggccattttgacatttgccggatgtcaaaattttgaagatgtctttagaaaagcagtttaaaatataagctcaacaaagatatatgttcgataattttcaaagcttcggcaacacgattgttcgttgccgaaaacttcccgaagtttttatatattgccaactttgataaacgcaggattccaaagattctatctacatacatagttttgcttaccattgtgagagcgaaaaaaaaacttaggaaaattgttatagatgtaatttttcaacttttttaaaataacaatcaaaatttgacaattattcattttacatagttacccattttttggaagtaaaaattgtttaaatgtgaaatgaaggtttttaattaacgtatttgctctataagtgggggtgccaaaactttttgaaagaatacatatatttcgtaatattttatttcggctgtatgattgttttgtttttttcttaagattattttactaaacttttcactgacgctactccaccttcgaattggattgagacaatatactattaaagaaactatgaacctagaaccaaaaacaaatatttcttcagaaccatacaactcaccaatgtaccattccccaccagcaatgtatccagaatactcaattggacctcccgagacgtacttggatccccatgccacagcatcttgttatccgcgaccaacgcctcctcaatataacagctatgaccgtagtccaccagtttacaacgaccttccatcaaaccctggtccgagtagtcattcgtctgattattatccttctaggaatagtcgattttaa

SEQ ID NO: 30506 - DNA, 967 bp, Caenorhabditis elegans
atggcagacgacagtgaaaacttcgtattaacagttgatattggcaccacaaccatccgatcagtagtttatgactcaaaatgcaaagaacgcggcagttatcaagaaaaggtagagttattaggtttcaatttctaatcagttgggtcttatactttctttcaggtcaacactatctacacgacgagaaatgatgatgaagtgctagttgaaattgagccggagcaattgtttcttcagtttttgcgtgttatcaagaaagcttgtgagttggtttctggctccctacaccttgttaaaatgaggtggtgcaatcaagtgatgagaaagtacttagagcacgtggggtgaccgcttggagactttgctcttacttttctcggaataaagtgtcatgtgttcaactaggcagagtttcatattttgacaaattcaatcctgattggttgaattttattcgaccgtgatgattaatcttgatggccaatattatctaaacttctattgtctgaccgagtgtttcaaagatctttaaaactcattttagtctgaccggtcacatttagtagtgtgagaatttgatcgggcaaatataaaccggttggtactttccaaaagatcagcagcatttaatgctgataaatcagaaaatgttgagaaaaagtcttcagggtgttcagggggccacgcctaagtactttgatttgttgaactattagcagctgttcctctattctacagtaatgaaggtctatcccttttatcagttagcagcatagattaaacaaaaccggtatgatgatatccgaatagaactagtgtgtagtttaatgtgtggtgaagtgatacgaaaagattgactttttggtaactgaaggtttttttttccagatgaaacactcccaccaaatgcacacgttgacgttggtctttgcactcagcgaaactcaattgtcctttggaacaa

SEQ ID NO: 30507 - DNA, 868 bp, Caenorhabditis elegans
gactaccacaacggattcgctccagatgccaagcagccaaacaccgacctcggagagggaaagacttctgctctcgttgatcttgacccagaaggaaagttcatcaactccaccagaatccgttgcggacgttccctccaaggatacccattcaacccatgcctttctgaggccaactacctcgagatggaatccaaggtcaaggctatctttgacaacatcactgacccagagctcgctggaaagtacttccctctggatggaatgaccaaggaaatccaagatcaactcatcaaggatcacttcctcttcaaggagggagacaggtaagataacactaattggttcgagtgttcctacaacataaatgttcttcagattccttcaagccgccaacgcttgccgttattggccaaagggacgtggaatcttccacaacaaccagaagaccttccttatctggtgcaacgaggaggaccatctccgtatcatctccatgcaagagggaggaaacgtcggacaagtcttggagcgtctcatcaagggagtcaagaccatcgagaaacaagctccattctcccgtgacgaccgtctcggatggctcaccttctgcccatccaacttgggaaccaccgtccgcgcctccgtccacatccgccttccaaagatctcggccaagccagacttcaagtctatctgcgatggactcaagcttcaaatccgtggtatccacggagaacactccgagtctgagggaggagtttacgacatctccaacaaggctcgtcttggactcaccgagttcgaggccgtcaagcaaatgtacgacggaattgcccacctcatcgccctcgagaaggctgcttaa

SEQ ID NO: 30508 - DNA, 329 bp, Caenorhabditis elegans
cgaagagggcatggacgaggaagttttgctgtttgtgaaaatggttccgggtcaagagctcacacacagtatccaggcagccattgtttctaaactccggaacgacatgtccccgcgacatgttccaaacaaaatttacgcagttgatgatattccggtagctatttacgattgagatatttgtaaaaactttgttttttcagtatacttcaagcggaaagaaagtggaagttgccgttaagcaaattgtgagtggaaaggccgtccagaaagcgtcttcgattcgcaatccagaatctcttgatcatttcgttcaatacagactttaa

SEQ ID NO: 30509 - DNA, 1006 bp, Caenorhabditis elegans
atgtcttccgcaactgcttccatcaagctttccaacggagttgagatgccggtcatcggtctcggaacctggcagtcaagccccgccgaagtcatcaccgccgtgaagaccgccgtcaaagctggctaccgtctcatcgataccgcatccgtataccaaaacgaggaagccatcggaactgctatcaaggagcttctcgaggagggagttgtcaaacgtgaggagctgttcatcactactaaggtttgcaaaaatagcatctttatattattttatacaaatccggttttacaggcttggactcacgagttggctccgggaaaactggagggtggacttcgcgagtccctcaagaagcttcaactggagtacgtcgacttgtaccttgctcacatgccagctgcattcaacgatgacatgagcgagcacatcgcttcgccagtggaggacgtctggcgtcagtttgatgcagtctacaaggccggacttgccaaggctgtcggtgtctccaactggaacaacgatcagatttctcgtgctcttgctcttggattgacaccagttcacaactcccaagtcgagcttcatctctacttcccacagcacgaccacgtcgatttctgcaagaagcacaatatctcggtcacttcctacgccactttgggaagcccaggacgtgtcaacttcactcttccaactggacagtaagtttaacaagtagcttgttccttttctcaacacctatttgcaggaaattggactgggctccagctccatccgaccttcaagaccaaaatgtgttggctttggctgagaaaacccacaagactccagcccaggtgctcctccgctacgctcttgatcgtggatgcgcaatccttccaaagtcgatccaagaaaatcgcatcaaggagaacttcgaggtgttcgacttctctctcactgaagaggacattgccaagctcgaggagagcaagaactcgcagcgtctctttcttcaagattt

SEQ ID NO: 30510 - DNA, 758 bp, Caenorhabditis elegans
atggggtttcatggtaatatcattcgttactcgttcacaccgcttatcctcctcttcgctcggcactctgcaaccgccagttctctcttagactcttcttccggcttgaccccagttgcggctccccaacccgctacactgggcggtcaacaggcttggactaatgaacttgctcctggtagactggagggagcacttcgtgattctctcaagaaacttcatctagaatacgttgacttgtatcttgctcatatgccaaccgcattcagtgatgacatgagccaaaaaatcgaatcttcagtagaagacatctggcgtcagtttgatgcagtctacaaagccggacttgccaaggctgtcggtgtctccaactggaacaacgatcagattcggtaacttcctatgccacgttgggaagccccggtcgagtggattttactctttctaatggacagtaagtaatgatgataagtatggtttttaaaaacaatttttcagcaaattagattgggcttctgctccatctgagttgcgtgatgaaaatgtgctggatctcgctaaaaaaataccacaagagccccgctcaaattcttcttcactacgcccttgagcgtggaatcgccatcattccaaagtcagtgaatgaaacccgtattaaggagaacttcgaattgtttgactttgaacccactcagaatgaaatttcaaagctcgaaggaagcaaaatttcccaacgtctattcctccaagatttgtga

SEQ ID NO: 30511 - DNA, 551 bp, Caenorhabditis elegans
atggaagtgaaagatatagataactactgtgatcgtggaatcagtccgaatgcatccaattatctcacgtacccatttgacgggctctgtctacaggtaaatattttgaaatgaaaaagaaaaaaatgtataccattaactttcagaaatttttttatcaactccaaacttctttgcgaaggttcactccttacgaagaaatcatttacacaacagtttacatcattatctctgtagcagctgttattggaaatggattggtgataatggctgtagtacggaaaaagacaatgagaacaaacagaaatgttttgattttaaatctcgcgctttcaaacttggttagtaaaacgttttcatatatagagtttgtcttttgtttatacgtctcttttccagatactcgccatcaccaacatcccatttctatggcttccgtcaattgatttcgaatttccgtactctcgatttttctgcaaatttgccaatgtgcttccgggtagtaatatctactgctcaactttaaccatctcggtgatggcaattgatag

SEQ ID NO: 30512 - DNA, 660 bp, Caenorhabditis elegans
atggagagagacttcgaccttggcatgggcagacctggcgggctcggaggacttggtggtgaaccgatcatgcaacaaatgccacagccagcgcctcatcatccatcccgtagtagtaacgaccacaatgtgaagaacctcatgaagcaggccgaggagaactccggatatctcacattgcaaggtaatttggctaaataaataatcttgaaacggtaacaattgatttttaggtaaccgtcgtaaagctgacttgaaggagcttcagttcgtggaagatattggtcatggaagctgcggtacggtcacaaagtgcagatacaagagtgtgatcatggctgtgaagacgatgcctcggacgtcaaacagttatgaaatgtcccgcattttgatggatcttgacgtcatctgtctctctttcgactgtccgtacattgtacgttgcttcggatacttcatcaccaacgtaagaatttttatgaattctttgacttttccaattatcatttttttcagttcgacgtccgtgtctgcatggagtgcatggctacttgccttgaccgtctgcttatccgcatcaagcagccaattccagagagaattattggaaagttgagtgtgagcatcattaaagctctgcactacttgaaaaccaagcac

SEQ ID NO: 30513 - DNA, 412 bp, Caenorhabditis elegans
tgttgcaatgggaccgattgcttggttcattacttctgaactggtacctatcaacttccgtgcagcatcgcaatccctggttcttgctcttaaccacacagttgcattagttttagcttttctgacatttcctctttacaaaacaattggtaaggtttgtttcatttgataacctagaaaagaaaacaagcagaatgttgaagcaacagtaaacatttcaggtcctataacattggtcattttctttgtgataccgggaattttgtgcataataatgctgatattgtatctaccggagaccaaagataaacatattaacgtgatagtagaacaactcagagaaacgaaagctaaacggaaagaatcccaaaagttggaaactgaagagagcattggaatgaataaattataa

SEQ ID NO: 30514 - DNA, 728 bp, Caenorhabditis elegans
atagaagaagatttttgttcaaaaccagctgatctggtgcaagagttaaggttttgtatggaggaaatcaaacgatatcttgacgaacaggattcgacagagaagaaccgaattatatggcagaggtttttctcgtggacagatattatattcagtatattcttttttgttgttaattgtcttgtgacattttacatgtttatggagtttatgttttgagttctatttacagtcgaaattaataaatatttgtgctttgaaagtagaggctaattaccaaacatcataaaaaattctaagaaatgtttaacttgcagtgaaaaaaaagaagtttatcagtttgcgcccctcacaactattgaagtttaccaaaagttgttctgttatgcagatttcatattccaattttgttttaattaccgtatttccttcatgcatcccaaaacttccctttaaaagattatacgtaactcgcttcatcttgaagatatcaataaaaaattaactaaatacgatagaaaaagaatcagcaaacatttctggttgacagtttttaaatggaacaaacgtcaaccaaaatatatgatagaaaagttgaaaaatgtaatgcaatgctactaaataaaatatatatatatatatatatatatatataattttcagtaggacataacttgctatacggtttcaaaattcttgaaaagatgatcacaaaattgtcatattga

SEQ ID NO: 30515 - DNA, 376 bp, Caenorhabditis elegans
cttctacaattaactgtccaattggatatgatttggttaatggaatgtgtgtgaacagtgaaaccttgtcggttattcaattaggtaagtaaaccttattttgcaaagttagctagttgtgaaatttttgaataaacaatacgtattaaggttgtaactacctttcaaaatgtattaatttgtcaattattaataatgaaagtgcgtttaagacaatatttcaaatgtttcagctgcacctggtggcgcatgtgaagatggtacaattctctgtactggaaattcagtttgtgcgaataatgtctgcatttgtcccggtggcgaaacagtacaaaatggaacttgtgtatcaattaacacttattcatctcctggc

SEQ ID NO: 30516 - DNA, 987 bp, Caenorhabditis elegans
atggactcaccacaagaagaagatgtggaggtgaagaagaaggcgacggaagtggagtacgttgtcaggtcgttggcatcagatgagccagctccattttccgacgaggcgttggcgattacgacaagagaagcggtggattattcaaagaaaataactttggcaatggcagaagctaatgagggtgagaatttttaatttgaaaatattatattggaatatacttgaaatttctaatagtaaaaaggaaaattagccatttgcgaaaatttgcgagttataactagaaaataccgtctacgttctcgaaacatttgaatattagaaaaaaaagagtgtgtgcacttaaagagtacagaagttgccacgactctctattactcagtttttcttcgttttttctctttatttgcttcaaaaatatctgtagctttctgtaacttacagctggccgacctgtgcgaatttatgctgatggaatttatgatctgttccatcatgggcatgcgaatcaacttcgccaagtgaagaaaatgttcccaaatgtctaccttattgttggaggtttgattttttaatctttttcaattatgattttcatttcaaatttcagtttgtggtgatcgcgacactcacaagtacaaaggaagaacagtcacttcagaagaagaacgttacgatggtgttcggcactgtcggtacgttgatgaagtctacagagaggctccatggttttgtactgtcgagtttttgaaaaaccttaaagttgatttcattgctcatgacgctattccatatgttgcaccaggagaggaggacttgtatgagaagtttcgtagagaaggaatgttcttggaaacggaacgaactgaaggtgtctctacaagtgacgtcgtctgcagaatcatccgtgattacgataagtacgtgcgtcgtaatttgcaaagaggatattcaccgaaagagctcaacgtcggatttttggcg

SEQ ID NO: 30517 - DNA, 918 bp, Caenorhabditis elegans
ctcgttacgcacggagacaaccgtgaacaggctctgaaccgcatgcaagaggctctcgacaactacgtcattcgtggagtcactcacaacattccacttcttcgtgatattgtccaagagaagagattccgtactggagacattaccaccaaatatcttccagaagtgtacccagaaggcttccagggaaccagcctctcaccaaaagagcaagacgttgtcattgcctttgcctcggctctcaacgctcgtaaacttgctcgtgccaatcaattcttgaaccagaacaaacaacgtagcactcatgtggcttccttctcgaagacctacaagttcgtgtcttctctgccagtgaaggagggtgagaggccaaccgagcacgctgttgaagtcgaatttgtcgaaggaagcgccaacaaggcccaagttcgtattggtggaaagactgtgactatcagtggagatctcaacttgtctcatccagtcaactcaattgaagtcgatggagagcacatcaccacccaaattgttggcaagcgcgccggagagatcaccgttctttacaagggaactccattcaaggtcaaggtgcttccagagcaggccgtcaagtacttgcagtacatgaaggagaaggccaaggttgacttgtccacagttgtgctctcaccaatgccaggagcaatcaagaacgtcaacgttaaggtaacattattttatcactaccattagatgtgctaaaactgattcaatttacagccaggagatatggtttccgagggacaagagttagttgtcatggaggctatgaagatgcagaacagtcttcatgctggaaagaccggacgcgtcaaggccgtcaatgtgaaggttggagccacagtcgacgagggagaggtgctcgttgagctcgagtag

SEQ ID NO: 30518 - DNA, 386 bp, Caenorhabditis elegans
atactcatctggtatgcgaacattcgctttgacactgaaaagttccgctcgccagctgggaatgatgggaatggtcctgtcaactggtgtcgtattcttctcaacacttttatatttcgtcgagaaagacgaaaaagacacgccgttcacttcgattccagctgctttttggtgggcaatcgtcacgatgacaactgttggatatggagattatgttcctgtgacagttcgtaagtatttctttcaattttcactgaaagatgttctaaacattgatttcagctggaaaactgattgcaagtggagcaattatcagtggagtattggtacttgctcttcctatcactatcatcgttgacaactttatgaaagtttctggaaagtga

SEQ ID NO: 30519 - DNA, 360 bp, Caenorhabditis elegans
aacaaaaacgccgtgtgtcatgattgccacaaaagttgaacgggaagaagttgaccagcgttgggaagtgccgccgaaggaattctgtagacaatttgagctcccgaaaccaatcaagttctcgacgggcaatgtaggctagcttataagcttataagcttcaactgcggtttcaccgtcttaatatttcagattggtcaatcctcttcaccgatcttcgagcagctcgccatgatggcagtttatccacatctccgtcgtgttttctacctcaacgactcgaatcttctctccaaaatcacattcggcgctgccatagtagctctagctggtttgcaacaccagtctctcgccgtctag

SEQ ID NO: 30520 - DNA, 533 bp, Caenorhabditis elegans
tatcgtgccattactgtccctgagctgacccaacaatgtttcgacgcaaagaacatgatggctgcatgcgatccaagacatggacgttatctcaccgctgctgccattttccgaggaagaatgagcatgaaggaggttgacgagcagatgctcaacatccagaacaagaactcttcctacttcgtggactggattccaaacaatgtcaagaccgcagtttgtgacattccaccaagaggattaaagatgtccgcaacattcatcggaaactccaccgccattcaagagctctttaagagaatctcagagcagttcacaggtaaaattttacgatttgtattttgactaatttcatattttttccagctatgttccgccgcaaagctttccttcattggtacactggcgagggaatggacgagatggaattcactgaggcggagagcaacatgaacgatcttgtttcggaataccaacaataccaggaggcagctgctgatgaagatgccgccgaagcgttcgacggagagtaa

SEQ ID NO: 30521 - DNA, 403 bp, Caenorhabditis elegans
atggagcgaaaaggtaagaaaaatctcatttacctcaaatttgccaaagcatctaatttcgacttgttgtaggacgtgagcgcaagctgccgggcatgaagatcgtgatgccaacaccggtcgagacgcccacaatgaatctggaagacagatgtcttatcaagtaagtattaggtgatacccgtgtcgggtttgatattgaacacgtaaagacggcgcggcgaattatgtaataataatataagtatgagaaatttttgattgatgcagattgacaaacgagtccgaagagattgagattgccgccaccgacctcgtcgtactcgaagaacttggaaaaggtggatatgggattgtggagaaaatgcagcacaggcagagcgggataattatggcggtaaaa

SEQ ID NO: 30522 - DNA, 1591 bp, Caenorhabditis elegans
atgggaaaggaaaaggtccatattaacattgtcgtcatcggacatgtcgactccggaaagtccaccaccactggacacttgatctacaagtgcggaggaatcgacaagcgtaccattgagaagttcgagaaggaagctcaagaaatgggaaagggatccttcaagtacgcctgggttctcgacaagctgaaggccgagcgtgaacgtggtatcaccatcgatattgccctctggaagttcgagactgccaagtactacatcaccattattgatgccccaggacatcgtgatttcatcaagaacatgattaccggttagtttattgcaaatttcaggcaataagattaaatttcgaaatatttcgcaaaattttaagcccaaaatttaggccagattttaggaatttcacaatttcttctaatttcacaaaatttcaaatttcactaatttcacaatattgcaggaacctcccaagccgattgcgccgttttggtcgtcgcctgcggaaccggagagttcgaggccggaatctccaagaacggacaaacccgcgagcatgctctccttgcccagacccttggagtcaagcagctcatcgtcgcttgcaacaagatggactccaccgagccaccattctctgaggctcgtttcactgagatcaccaacgaggtctccggattcatcaagaagatcggatacaatccaaaggctgttccatttgtcccaatctccggattcaacggagacaacatgcttgaggtctcctcgaacatgccatggttcaagggatgggctgttgaacgcaaggaaggaaacgcttccggaaagaccctcctcgaggctcttgactccatcatcccaccacaacgcccaactgaccgaccactccgtcttccactccaggatgtgtacaagatcggaggaattggaaccgtcccagtcggacgtgttgagaccggaatcatcaagccaggaatggtcgtcaccttcgccccacagaacgtgaccactgaagtcaagtccgtcgagatgcaccacgagtctcttccagaggccgtcccaggagacaacgtcggattcaacgtcaagaacgtttccgtcaaggacatccgtcgtggatccgtctgctccgactccaagcaagatccagccaaggaggcccgtaccttccacgctcaggttatcatcatgaaccatccaggacaaatctccaatggatacactccagttcttgattgccacaccgctcacatcgcctgcaagttcaacgagcttaaggagaaggtaagcaatatatttagttactttccaaagctcatcctcatttttacaggtcgatcgtcgtaccggtaagaaggttgaggacttcccaaaattcctcaagtccggagatgctggaatcgtcgagctcatcccaaccaagccactttgcgttgagtccttcaccgactacgctccactcggacgtttcgccgttcgtgacatgcgtcaaaccgtcgctgtcggagtcatcaagtctgttgagaagtccgatggatcatccggaaaggtcaccaagtccgcccagaaggctgctccaaagaagaagtaa

SEQ ID NO: 30523 - DNA, 1079 bp, Caenorhabditis elegans
gttggaaatctcgggtctctgttcttccttcttttcttcatatttgctgcacttggtgttgaactgtttggaaaactggagtgctctgaagatcatccgtgtgatggattaggagaacatgcgcattttaaaaattttggaatggcttttttaacactctttcgaatagcgacgggtgataattggaatggaattatgaaggtacttggggatttatctattttttttgggtcacacaaagattaccaatagcaggagattagaattgcagaaacaataagtgtagatttccaaaggttacaatttgcatgcgagaattttgtagcaaaatgttattgtaatcaatttttaaaactaaaagttttacatttttgatagataaaataactgtcggaaaataataattgtatctagtgtcaaactgggggttgtagtaaaatttattgcgttgtgtcttcaaacttcctatttcgtaacaattattcaaattttgaatctaaaattgatgaggaaaaataaaaacaaaattgattaacttgaaattaatttcaatttttgttctaaaattcgaaaagaatctcaagaactacctgcattttgccatctgtcgaaacaactacggttttttttggcaaatgacaacttgtgaccagtttttctgattcacttcaaagttttccacaaaaataacattaatttcaaattaaacaaatattttacactttcccatttgtttttgatttgaaaaaatgaattatcgtaccgaaaggggcagtttaaaaaaaatattgataggttccaacgtcttgagaattgaaaagaaacaatctctcatcacaaccttacaaattattcaggatgccctccgtgatgactgtgattcctccgatcactgtgaaacaaactgctgcgttgatccaatcctggcaccatgcttcttcgtaattttcgtcttgatctcacaatttgtacttgtcaatgtagtagtcgctgtacttatgaaacatctggaagaaagtaacaagcgagatgcggaaggaccggcagaaccaacaggtttttcattctttcatttttaa

SEQ ID NO: 30524 - DNA, 885 bp, Caenorhabditis elegans
atgttcgctattgcccttctctcatttttagttgtccttatcaatgcacatcctccaatgcatgcggaagtaagttgagagtcccgattttattttattgtttgattccagcaatttaatatctaaattaaattattttcagatgcactcagctgttgttactctagctaatgagatagatacaaactatctcacctcgccagcaaagataaaaatcgtggcgccattggaaagcgcgctgattcctggaggagaaacatatcaattgcgatgtgatataatgtccactcctgctgctaccattcattggaagttcaatggaaagttgatccagggaagtaatgaattgaatgtcgaagagaagttgctgaactttggaaaagcaattgttgacactggaattgttgcctccatactcaccatccagtgcccatcagctgaaaactcaggaacatacagttgtgtcggatacaatggacatcaaacaatagaaacggttgccgaagtcgaaattggtatgttgtataaaacctgaagtaatttggataaatatttaatttttcagaaggagaagcttcggggtgtagatcaaatcacaaatccgcacctgaaattgttttctggactgattctcgttttgagatgactggaaacgtggccacccttgtctgccgcgcaaatcagcaagtcgactgggtatggatgtccaacgatgagcttgtaaagaacaatgacaagttcacggttctttcaaatggagatctcgttatcaaaaacattgtatgggacgatatgggaacatatacttgtatagcaagaaaccaatttggagaagctcgccaagaaacattcctttacccaaccgcgaaaaaatcttctttctaa

SEQ ID NO: 30525 - DNA, 776 bp, Caenorhabditis elegans
aaccgcttctgtttcgcgtactcacacaatattgctgtcagatatgaatgtggagactaaatttgtacaggccctgtttgatttcaacccacaggagagtggagagctagctttcaaaagaggagatgttatcacttgtaagtgtttttgaaacacaaattttcatgattttaaaatgttcaattgaaagtttgaatcaaaaaattctaggtttaattgaaaatggtaaaaatggatatatcttggactgtatttcgaaaattttgaaactattcactttatagatcttaaaacaagaatatttaagaagaaccataaaaataacaaaaaggtaatacaaagtactaggaagataatatgagacgtcttgcttaaactaactttcactggaacaaataaatgcacgtattgaaaatcagttgttagattagtttttgtataaactcaaattgaaatgaaaaaactctgtggctattatttacttttcggagaaacattggatttcaagatacaatttgcagcattatgaatgttcacaacgtaaaaatagagttaatcggttgatcatctatttgtcggggttgagcaaccccgaaaaataaaacatttagaaaatctcttatattttattttcagtgatcaacaaagacgatccaaactggtgggaaggacagctgaacaacaggcgtggaattttcccatccaactacgtatgcccttacaatagcaataagagcaactccaacgtggctcctggcttcaactttggaaattag

SEQ ID NO: 30526 - DNA, 1071 bp, Caenorhabditis elegans
cttccactggactgcaagcacgaaatcgacgcagactctgttatcgacttgattgacccattgaaagatgtcgatggactgactcgtatcaatgctggacgtttggctcgtggagaactccagcgtacgatctttccttgcactccgtttggatgcttgtacttggttcaacaggcaactggtgatgccaactttgtgtctggaaaggaggtggttgttttgggacgctcgaaaattgtcggatctccagccgctgcgcttttcttgtggcatcatggaactgtgacaatctgccactcaaaaactccaaatctcaaggagaaatgcctgagagcagatattttgattgtggcaattgggagaaaacatttcgtcaaaggtagattatcaataaacctaaatttgagatagtgcacagtactggccatacagatatcaaaagattgatttcaacttcagcaaacgtggttattccgagctgagatctgactatagtaaaatagtgaaagtttttatatcctgattttttggaattcatcattgaacaaatttcgcgttgcttttttcataattacgcccaaatccatttaaaagaagaatcttggcaaaagttattacgagtagacctttatatgagcagcacggtatttacttgctaacctaaaagtttgtaagtcattaaattatgcaaaatatctataatagaaaccccaatttaagaactatcaatgtttagtatgcacctgactgtttgcaacttctgaattgttttgcatcaaatagaaacagactctctgttctgataagtgtcagcgttttttacaaataaaagcatatatttcagctgattggatcaagcctggcgcattcgtcatcgactgtggaatcaacgttggtgacgacccaaactcacgcaaaatttacggagatgttgacacagaagccgcaaaggaagtcgccggattcctcacacctgtccccggaggcgttggaccaatgactgttgccatgctcatccgtaacacatttgagcaggctaagagacgacgtcttggacaaaaggtaaaatag

SEQ ID NO: 30527 - DNA, 413 bp, Caenorhabditis elegans
atgccgcggaaattgctggaggagagaagtaccggcagtgctacaaaatggcttcgcgaagaagaaaagattgaaaaaaaagttagagttgaactcaaaaatgaaattatttataacaatttatgttttcagagtcgtgcagatcaactcaagatcaagttcatgcagactcgagacaacagtgatatcaactcaatattctcagagccaccttcagaattctccgtgttatgcgacgacgacgattgtgatgtgagatcaaggaaaataatatcagaaaattgagttattattttcagaaaggctccgttgtctcttcgacattgaccacaagcatacgcaaaaccttctcatccttccgctttgatgaaaatcaacgtaaaaaaggaactagaaaacgaagaagcagtgaa

SEQ ID NO: 30528 - DNA, 830 bp, Caenorhabditis elegans
atggcaattacagtaataaggtcatttttaaagttttgttaattttttgtatctttcaggcgagttggaatgaagtgacaattcagtttgaaacaattgagttcgacaagcaagcgccaataattggaaggggacgatttggaaaagttctccgaggatttcactacggtgacgtcgcagtcaaagtttacaccatggaacacatttccgatgcttccaagaaagccgaagagttcaagcttgaagtatccgcgtataaggttggtttgctaattctaaaatttcaacaaaaaaaccgagttgttcatttagattctataagaaatgaaaaatagtcagagaaatacccaccgtatttcaatgtacccccgcacaactacaatttttgctataatccttttttgaaaacatcacgaagaaaatttctgacaattttcttcaagtagttcaaactagaccatggtttgattgttgaaattgtaaaattaataaccagtagaaacaaaattcttgtttaagaatacccgtcatgacaacattgctcttttccttggctacttcatgagtgacggccaatacggaatggtgatgtcactgtcaaaaggcagccagtctttgtacacactcctgcatgtagttagagaaaagcttgacttggcaaccaccagaaaaattgcccagcagatttgccaggcagtttcttatttgcacacaaagaaaattctccacaaggatttgagaagcaagaacattcttcttgagagcaagaataaagttgtaatcactgactttggcattctgtcgatgaaacgtcttgctcatccaaaaca

SEQ ID NO: 30529 - DNA, 1133 bp, Caenorhabditis elegans
atgctaattttgctcagtttcttcgtatttcaacggcttaaccataaaatggaaaatctaaagcacgaacaaatgttcaatgattttattttgaagtttgacagaaaatacacgtctgtggaagaatttgaataccggtaccaaatttttctgagaaatgttatagagtttgaagccgaagaagaaagaaatcttggattggatttagatgttaacgagttcacagactggaccgatgaggaattgcaaaaaatggttcaagaaaataaatatacaaaatatgattttgacacaccgaaatttgaaggaagttatttagaaactggtgttattcgccctgcttcaattgattggagagaacaaggaaaattaacgccaatcaaaaatcaaggacaatgtggatcgtgttgggcgtttgctacagttgcttctgttgaagctcagaacgcaatcaagaaaggaaagttagtgtctctttctgaacaggaaatggtggattgtgatggaagaaacaatggctgcagtggtggatatcgtccatatgctatgaagtgagtgaactattttcaaaaaaataggatttgaaagcctgaaaagttaagatttgtgaaagaaaatggcttggaaagcgaaaaagaatacccttactccgctttaaaacacgaccagtgctttttgaaagaaaatgacactcgggtgttcattgatgatttccggatgttatcaaataatgaagaagatatcgcaaattgggttggaactaaaggacccgtcacttttggtaatgaatgccttattaaatcattaaaatatacaacatctttttgttttcaggaatgaatgtcgtcaaagcaatgtacagttatcgttctggaatttttaatccatctgttgaagactgtacggaaaagtcaatgggagctcatgctctcacaattattggatacggcggagaaggagaatcagcctactggattgttaaaaattcatggggaacttcatggggcgcaagcgggttagtgatttttgtttcggaaattcatcagttattcgttctcaggtacttccgtctggcgagaggagtgaacagctgcggtcttgcaaataccgttgttgctccaataataaactga

SEQ ID NO: 30530 - DNA, 443 bp, Caenorhabditis elegans
acacgaattaattgatttcaatgtctccgtgcatttattggagcctggcttcttcaccacaaacattacacaaaccgctacaaatgatttggacgcggtttgggaacgactagacgacgaaacaaagaaggagtatggaaaagagttttatgatgattgtgagtggttttcaaaattttgaatgaaatttgcatctttgatttccagacaagaattcccgattctctcgtctatcccactgcgctgatgatctaaacccagttattgatgcatatgatcatgctctgcttggaaaatacccaaaaactagatactgggttggctgggacaccattctgttttacattcctctggcaacacttccaacttttgctcaagattggttcatttcatttcagcgttgtagccggccagttcctgcctcaatgaagaatcatcattaa

SEQ ID NO: 30531 - DNA, 307 bp, Caenorhabditis elegans
aaaatacgaggaaatctttccacctatcctatcgaatacccgacattcttttgatggagcgattctttattggaaagttcgacttcatcgtcgcaatgcccacaccatcttggatcggatcatgctttgcacagagaatgaactttacaaagtgagtttaaaaatcataatttttagctcctttggaaaaaaactagcgatttctctcaactttaacgttaatttttcacagaaagatgcggaatgctgtcaaactcctcgagctgtcgccgatagattctcattttctacgttaccgcccatctga

SEQ ID NO: 30532 - DNA, 804 bp, Caenorhabditis elegans
catcctcaagaacacctctgccggagttggagttccagaacttccaaagaacgccggagaggcctccgttgccaacattgacaaactccgtcacaacaagggagacatctcaactgccgagcttcgtctcaccatgcaaaagtcaatgcaaaaccacgccgccgtattccgtcgtggagatatcttgaaggagggagtcaaggtcttatccaagttgtacaaggaccaagctcatctcaacgttgctgacaagggactcgtctggaactcggatctcattgagaccctcgagctccagaacttgctcattaacgctacccaaaccatcgttgccgctgagaacagagaggtatggtttgaatacacatttaggtacttgtatagcatacctggcccaaaaatatgaatagttgtgtttcacgtgatccttttcgcccatttcaggcttagtttctaacagtaagcttaaaaatgtaagtaaagttcacgttttaattaaattatcatttcaaaaagaaatgaatggaaaacgtattgggaaacaaatttctgacatcaaaatttcaggaatcccgtggagcccacgctcgtgacgacttccctgacagactcgacgagctcgactacagcaagccattggagggacagaccaagaaggagttgaaggaccactggcgcaagcattcgatcatcagatcgaacatcgaaacaggagaggtttcacttgactatcgtccagtcattgacactactctcgacaaaagcgaaaccgactgggtgccaccaaaggtccgctcctattag

SEQ ID NO: 30533 - DNA, 340 bp, Caenorhabditis elegans
gagcacaaagatgaatcaatcgtcattgaaaactcaaacagctataagtccaaagatctttctaactggaaaatcaatcattatgtgaatggagcgctaactggaacgttcatcttaccagttgcaactcacattcacccacatgagaagatttcggtatgataattaattttgatttcatttttgaaatatatattaaaaacaattacagattcattcattgaaatctccgaatttaatggatgatattgttgctactcaaatctacagcttcgatttctccaaaaacacaaagacagttcttcttgatgatgttgatgacgtaagccaatttcattga

SEQ ID NO: 30534 - DNA, 4104 bp, Caenorhabditis elegans
atgaggtatggttgacaattttttattcatttttgtagacgttaagatctgaaagtgagaaccttagaatttttaaaattaatttcgtaaccagtgtgtttccgaatagtcattcaacctgaatacacagtttgaattttttttagtttttcatactacaaaatacggaaataagagtgtgaatgtttttgtaattagacaagaatgactagatgcaagcatgaaattttaaataataaggtactttctgaattttaaatgatacacaatattgtttttaaaacgtgtattaattttataaccagacattacgttggatgaaacattacgaatacagttttttaaaaagaatgaatttttaaaaagaatgtgaaatagaaatgttggctgttcccattttaaaaatatgctgaacattgttctgtaacaaatttaaaaaatgcttcaaagaggtagagaaatgtcttttaaaaatagtttattgttgccagttgtactgttcaactgttctttgccacccggcacatacagtgtgcgtcattgtttattcttttttgctctctttcttgacgaccttccaacctgttgattggtgtctcagtttgaccttaaaaatctagaaacattcagtattaaaattgtcagcttgaatagcagttcaagttttatgaattatatacaaaaaatatatacaatctaagttgtttattccggagtgttttttttttttggaaacctctaaattcttaaagaaatattttcaaaactttaaatagatcagtgaacttctgaaacgtgttttcaaaaataatattagagtttagaaataaagtttgttaaaaattttgtgaaaagttgtttcataaagaattatcaaattacaattccaattattttgtttgctttttgtttttcagtctgtattgtaagcgatttttccgctcacgtgtataaaaagtttgaacgagagaaacacagttcttgtcatattttaaaattttccacagtcagagtagtttaataatttattccacatttctagcatatttcaaatagcaaattttaaccgtttccttgtaaaaaattaaagttacattccctaggccatatgttggtgaagtgccgggattgagttcaactgccttgtttattagatttccgccctgatttaaatcatgatctagactacaattaatgtttgaaacctgaccggtgcttgcttgtgatgttttacatgttggcagttcattgataagataaaatgcacagtcgtatcatgtcacgggaaacatgagcgttaaaaacatgaacataccgagttgtatttatttgttcagtaactacagtgtggcgataagatattaaaattttgaaacggtgttttgatgatgataaagtaatatgaacataggatttgtgcatttttgatgtgctctcaaactttgtttcatagtaaagtaaacgcttttatatctctcttttcacattaaaaaataacattttatgaaaactcagcttcaggaaaatgccgttttcatataaaaacttgattcaaaattaaagtgtaaataaaaatttaattcattttcaaaatattcaattttataaaaaagttctcaacacttatttttcccgtaaaaaatacaaaaaatgaaacgtttattgttatgatgtatgtatgtttgtatcggtgttgtgagatgaacttacttcttgagggaagtcaacaaaaacagttttcgaagatggcaactctctagttgatgtgtgttgcctagttgtgtacgtatgtctacattattggaaaatgttctaatcctagaattatggcttcttgtatcatttccatcctatttcctttgctaagaaaaaagataagaggtaatttatacttttaaagattaattcatgaacgaattctaaaaaatttaaccagaattatttttttagttgtaataaaaaagtgccttttgtgttgtcaacgcgactacactgcaaaggttgtcctttctctcgtgccctctctgcacttacgcattgcattgtacatatttcattcgtatcatgtatcagaattcttgtatcaagaccctcagtcctcctctctttttttttctcactaatctatgagagaaaagtagacagattgttatacaactaattgttgatccgagacttaattaggaaggctaagaggtaagcacttgggggaaactggtgttcagtgtgagtaaaaaacaaaaactcggagaggtgaggattgtactagaattcatcatattcttgcaatcaaaccgcaaaccggtcgtttttccctctggtgtcttccctttctctcctctgtcccgatccttacgcgcgagggacagcaacaattccacacgcatcatacagtgtacatagggcatgaatgcctcccacgccctctcctaacaccaaaaagcccttgtcttccgatggctttttcttgagtcgtctatgtcatcgccgtcgccgtcgtcagcgtaggcaggacaaggagatgtccgaggaaatgctaattcagctatgttgtcctcgttttctttgtcaacgatctcgataaacgaccgtcgttttcctggtgtgtttaggttagtctctgtacttctgttcagattaatttactattaggcacacaatagaatattagaagcaatacagtgacattgttacttgtttgataggcatattctagtagtagtatggaataatcgttaattcccaaacgttttttttgtgaattttgtgaccttttgatttctaaatcaataatttacttcaaaatgattatgattcacaaaaacatttaactatgtttttaaagattcgcccttcaaaacacgtgatctatagttcttgtatttcacttttgaaaccaagttttacaattagcataggaaacgaaaaaaaatggttccactttaactatcactactcaaaacacattgaacatgtgtcattgtctttttcacttactttggacttttaactttctttttataccagcacatctccttccccagttctcagtcaaaaccaacatttttccaaaaattgataactatctaatcgctgaaactgaattctagtgtagcctggtgctcttcccgccaatctatttattagtgtgcagttacactcccccatggtcattctcatccactttttgattactaaacatttgcaccttttgttggtttgatgtgtaagttttcagggaaatgccggacagtcccaagtttgcgttagtcacgtttgttgtgtatgcagtggttttgtacaatgtcaacagcgttttctggaaatttgtattcatcggatatgttgtatttaggctgcttcgcactgattttggaagaagagcacttgccacgttacctagagattttgcgtaagttttgtttggttatctgcaatacatatactgaacaacaaaagcactttagagtaaaaatgttcgataaaatactggtaattttataattctataaactcaaaagttttagtaaaaatttttattggaaaatgaaatcgtttcgcaatttagagcctaattgcattcaataagcttaattaaaatcttaaaaattgaaatatccacttctgtaaaaaacaattttcaattgtaaatatgtggaggaagcgccgaatgcgcgtagattgaacaccgataaaaattagatcaatttaaagctgctttcacctgcgttttatctataaaaattgtttttgcttctcatgaaggggacattttcgaagttggtgtaatgttcaacataaatctatatgtgatttgaagatacattcaacttatctatttcttttttacccttgaacaccctattagtcatttcatttccgtcagtgcgcgtataccgggaagtaggagaatgggaaattgagaaactaacgcagttgggtgcaaaatcttttcaattgtaaatgacttgtcaggggaaaaagtaaaagtgcaaaaaacaactttgaactttcaggggactgaagctcttaatatcggttaagtcgacaattcgtggcttgttcaagaaagatcgcccaattcatgaaatctttttgaatcag

SEQ ID NO: 30535 - DNA, 857 bp, Caenorhabditis elegans
atgttgcaagcttgcctaaacaccaccgaagaccaatgtgattgccttgcattcaattgtccaattgtttatagtcattcggaaagcgaaaaagaagcgtgttacatggagcactgctttatttcaaaacgagcactggatgacgtcacgttgtataaggttggtgaaaaaaagaaattaaaagttgggaagctatagataaattttaaagtcattgaaaataattgcaggaagcaataaagccctaatttacacttcacaataaattgacaccatacaattactattttcctctattagaaaaaaacatttgtttctaaaatggcaaaattccaccataacaaaaatgttaagttaactggcaccccaaaaaagataatttcaaagttttaaatcatatttattttctccaaaaatgaggaaaatgtctgaatagagaacataatttttcaacgtaactatgatctttcttgatatctttcgtgttatcggcgaaactataaatcttgctgaaaaccttaaattcgcatgttagttcaaattcaaactataaatttttttcaggtgactgctctttacattttcattttcttagttggtgtaattggaaacactacaacctgcttagtcatgaaaaaacatcccatgatgaaaacccatgcaaggtaaggtaattcttccaactaccaacataagccttattactttagcatgtatctcatgaatctggcggtttcggacttggtcacgttatgcgtgggtttaccgtttgaagtaatgatgaactggaatcagtacccatggccatttccggattacatatgcaacttgaaagcgctcattgcggaaacaacgag

SEQ ID NO: 30536 - DNA, 1404 bp, Caenorhabditis elegans
atgaacggagaatggaaatcagctctccgattgcaaatcgaggcactcgccaaaagaaacgaattgcaccgtaaatcatcagttgacgagattaagaagcgaacggtagatatggacaagcgaattgtcaaacttcgagaacttgttggttcaagtgctaatgacgctgccctattttatttggagtgtgtatgccatgcagacgaaacagaacgtcttttaaaccgaggaagttcagtgggaaaagagaagaaatggaaaaaggtgaagcgaaaaacaagctcatcagtagctccgccattatcccgaacaatatcgtcccttccaggtgtggtgagtgtgaatttaatctctgaaaaatgaacattggtgtaggacgttcaagagttttgtcagaaattgtaacaagaaacgtccgacatttttttcaaattgagagtaaattgttttaaatgtggccgatggcgtccatgttaatttaagtttcaatataaagcatactcagcttaagttaaaaaatttagatttctcctacatttttttcacgatagatgccgattaaacgcctcacaagacaaggtgatttcagttacgttgacaaaacgatcagaaaaaacttggacaatatgataacctgtcatttgaaaaacggaattataaataagttaactcttcattcaaattttcagtcatctcctgatgttattcaaactattgatgtatcagcccttgaagaccaaacgcctcaacgtccgcactggtgggaccaatttcaattgtacagacgaacagacttacttcggttttccaagcaaaatgatcgacgggagctgtggagaacgcagaaagatttcttcctctcttgccttggattcatggttggagtcgggcacactatgcggtttccagcaaaagtctatcagcatggtggaggcgttttctttatcccgtacctgttttcgctaatattttttggtcttccattagtatttttgcacttatcattaggtcagtatactggacaggcagctaatacagcgtttcagagattgatgccaattggatcaggtaaatcagatatgagtgcaaaacttatcaatcgtaaagatattcaggagttggttgggctttggttgtgattgcaattccggtagcggtttattacaatattattgtggcttgggcaattcactacttttttcaatcggcaaaaggacttttgttgggagacgaactaccatgggaaacttgtagagacggtgagctgtttaaaactcaaaataatcataactggaatgatccaaatatagaatggcaactagacaaccgttgctgtaacttgcacaacttgcatagctgcttcaattctacaaactctatcactgcaccagaagcattttttca

SEQ ID NO: 30537 - DNA, 676 bp, Caenorhabditis elegans
atgtcgcaggcaattcctctagtaactatcggtaagtttcaaccttaattttatattgtccttgcaagacatatttttcagcggcagtggtaatagccgttggtatcgctattggatcattggtcctcaacattattatcctcggcaatgtgaacactctcacaaccaccgttaacaataacccagtctatcattacaccccagctccacaagtaaactcaactcctggtacggttaacacttctccatcttacacacaagctgccaattatttgctgaatggacttgatgacaccgttgatccatgccaagatttttacgctttcacgtgtaataaggtgagttgaatttataaagaaattgagttggtacatagtttattattaattatcactattttgaattaaaaaaatctatttaactttgtatttgtagtcgattttgaggtgttcgtaagttagaactttggaataagaatatttaaattattcaacgattatcaaggtccaataacttttagttccttcaaaacaccgatctccaaaaactcggccgatctcgtctaggaacctatgatcaagctcaagtcgacgtctactctgaaattgttgccgctctcagtaaaattgatgtcacgagcaccacaacctccaagaccgaaaggattacaaaagcg

SEQ ID NO: 30538 - DNA, 300 bp, Caenorhabditis elegans
tatattgcaaaagaatttggtgactttgacgatgagcttgccgaaaaagtttttcgcgaacttgacgtttctgccaacggtcatttgtctgcagatcaggtctgtgtttgtttcaaaacataatccttggaaatgtaaactttcaaatgtttccagttcgcaactatcgttgaagactacttgctaaacgaccccaaacatgacattgacactggtgattctgatgtggaaagatacgacgaccggcatgacgaccgagcgagccccatgccaaatcatttgtctactgtgcccgaatag

SEQ ID NO: 30539 - DNA, 817 bp, Caenorhabditis elegans
atgccgttgcccccttgcattgtactcgcgacctcctctcccgtgtctactgtttgcaatttgcattttcgtatttcgcttgatttttccctttagcttgtaaacacttgtcaagttctatgtattgtctggtcactttgattaaaacaaaagttcaaggtcatcgctacggcttctagttttgtagccgtttttaggtgtactttttataaccttatccttttctgatatcatctataacaattgtattgcgttaacgttttctccttgtcgacagatattagaccccttcacgttctcatatttaagtgcgaccttgacaacaattgacgcctgtcttccatgaaaatcggcgacatttttttgagaaacgtaaacatttaaccatttttcaggttgttcaacatggtatgctgtttcgggaaaaaagatgaaaggaccaaaacgattgaaaaagaattacacaaagagagaaaaattatgcggcgacaagtataattaaattattttctagtgcaaaataatcgacaattttcagattaatttattgcttctcggatccggtgaatctggaaagtccacgtttgtaaaacagatgcacataattcacggggccggagaatttacagcagacgaagttcgagcttacagacagcagatatatcaggtttcatccttttacgtggtttaaaaaattcaaagaaaattattcacagaacgcgataagtgcaatgcgggtgttgttagatgctaggaacaaattaggaattgcatgggaagatccaaaaagacaagtggaagttgaaaaagttatgag

SEQ ID NO: 30540 - DNA, 235 bp, Caenorhabditis elegans
acatgctttggagaaatgcgtggacagggagagttcaagcgggggctatactctattgtctccggcagatactcctaccggtatgtctaactgttcacctcggaaaaattcatgtttttgtaatagagaaactttcagagcagacgacgaggaaaatcatcacagacaaaacacacgtatcgaactggctaacaatcaaactggtgatatcgaagttctcagaacggatctttaa

SEQ ID NO: 30541 - DNA, 1572 bp, Caenorhabditis elegans
atggaagttccacaagcacagtctttagcggcggctgctctaatcagccctgtgaaaaacaattccactggtggaggtgggaatcaacaactttgtattcgaaagtctatatcaaacccttctagtctaaaggtttacgcccatcacgaggcacccggtatcatacattttcctagatttgaattttctcatcgtctatctatccggccattgctgaaaaggcttcacgaacaaggtgagctattctacaaaacctcccaatttgcttccttttttgaaattgattaccaatgaaacacttttgaaactggcttggtattgttagacggaaattttgtttgaaatcagtgagcaatattttttaaaaaaagtttctgaagatacaggtcctagttgaaaaaaggtcaaaacaatgtgaagagggatttgtttttcatcagaaaatgtttatttttattaagtactataaaacatttgttagtttatgtttttgaaatctgacagtataaaaagccaatataaaaattaatattgcaaattatccatgcaaagttagcccaacaaataaatgtagcttttctcattatgattttttattgatttctaaaattttttaatataaattgcattaacagcaatcttgtaaacaaaacaaacatagtagtgaaattccattaaaattcttccgttcttaagaaaacaataaatggcaaaaagtttctgaggacctccaagacaaaagcatcttctgcccgcatgtcctatgactattgaaaaagggcgaaaataaaaaagtgacacaacccagtgtttcctgataaaaattgttcataccctcccattttcccctatttcgcttcccaccattcccatgaaacgcgcatttacgattgtaaaaaacttgcgacgtcgaatttgtaggtttcttgttttttatgttttcaagagtaatcattttgttctttaaaacatgcaaaaataaagttaatccttaaaatgacctcacgacacggaagccaaaccccatttcatttcaaagtttgcaactatagaaaacgaatacaaaaggagggaggggaggttacactaagaaataaaatggtggggaagatataattgcgcggggctcggagagcaaaactcacctatttgattccctttttcatgtttgtcttcgtttcagctcaacggatcgaaggaaaagcatttgttcgtcgtggtgcacttcgccagaaaaatgtgcatgaaatcaagtgagttgataccaaactttgaaacaaaaccctcgtaaaagtcagcactgtccgttttcctatcttggttatttgatagctgacatttattttgactgaaaaattgaaaaaaaaaattctttcattatctttgaatatcataggtctttcaaatgaaaacaaaaatcaatatcttgttcttgttgcacaattttgattcaaagtttaattcttatcagatcgcacaaattcattgcaaggtttttcaaacagccaacgttctgctcacattgcaaagatttcttgtggggtataacaaaacagggatttcagtgccaag

SEQ ID NO: 30542 - DNA, 817 bp, Caenorhabditis elegans
atgctcagttcaacttgcaccgctgccgttcgtggactctccaccaccgcccaactttcaaaaattaataatgtgaccattattggtgccggactcatgggatcaggaattgctcaagtgtctgctaacgccaagcttaacgtgacagttgtggatagcaatcaatctgctctcgaaaaggctcagcaaggaattgccaacagtttgaagagagttgccaagaagaagcacgccgacgacgcagcggtaaggtttcttcattttttcaaataaattaatgagctgagataattttacaggctcaaacagctcttgtcagctcagttttggaccgtatcaagatgtctaccaacgtctccgattctgtcaaggacgctgatttggtcattgaagccatcgtggaaaacattgatatcaagagaaaactttttgcagaggtggaggttgctgccaaaccgtaagtactccactaaataaaaatgtattgccaaagttttcaaaaccatgtatgctagaaaaacaatgttgtatctagaaattctaaattagaacgtacacaaataaatccagtcccaattaatgtctcaattgaaattttagaactactctcattaccacaaatacttcttcacttcgcctcgccgacattgggctcaacttgaaggacaagtcccgttttggaggacttcacttcttcaaccctgtcccaatgatgaagcttttggaagttgttcgacacactgagacctccgatgcaaccttcaaccaactcgttgactacggaaagactgtcggaaagaccactgttgcttgcaag

SEQ ID NO: 30543 - DNA, 567 bp, Caenorhabditis elegans
atcgctcaccgttccagagctcacacaacaaatgttcgacgccaagaatatgatggcagcctgcgatccaagacacggtcgctacctgacagttgctgcaatgttccgcggaagaatgagcatgaaagaagtcgacgagcaaatgctcaatgtgcaaaataaaaactcctcgtactttgttgaatggattccaaacaacgtcaaaactgctgtttgtgatattccgccaagaggagtaaagatggcggcaacattcgtcggaaattccactgcaattcaagagcttttcaagagaatcagtgagcaattcacaggtaagaactgataacgttttcagcttgaaattgaagttttaaaaagactaagtgaaactgaaaatataattttccagctatgttccgtagaaaagctttccttcattggtacactggagaaggtatggacgaaatggagtttactgaagctgagagtaacatgaatgacttggtctcagagtatcaacagtatcaagaagcaaccgccgacgacgaaggcgagtttgatgagcacgatcaagatgtggaataa

SEQ ID NO: 30544 - DNA, 179 bp, Caenorhabditis elegans
gtatggaggaaggagaattcatggaagctcgtgatgatctggctgctctcgaaaaagattatgcagaggtttgtgaggaaaaatcccaaaatacaactaatttacaagtgatttacggaatattgtttcaggtgagcagagacactgcagatttggaagaagagaatgacgagttctaa

SEQ ID NO: 30545 - DNA, 2744 bp, Caenorhabditis elegans
atgggacggagtccttcatggctctacggggtcctgggtctccttctactggccactacgtgctcatcagtcaatgatgacaaaaatgaccctactggaaaatcttcactcgcatttgtattcgatataactggttccatgtttgatgatttggtgcaagtacgggaaggtgctgctaaaatcttcaaaactgtgatggcgcaacgtgaaaagctaatctacaactacatcatggttccttttcacgatccatgtaagttatttatttatgtcaaagtctagagagtgggataaaaaataaaaattttacactagcgtgattcatgtgatcagattgcaattaatcttgcactctttctactagcattttgcaacacaaccaggacccacgagcgtatcacgttatctaataatctaacaaaaacatattatttgaatgtctatagatcacatttcgtgaaattctcgaaaaaaaaggttaaaccagttgctcaacttgaaaagccatcaattgtgttggttgaaatattgcggggttacaacaactgtgcatcagtttatcagttgcatcggactgccaaataaaaaaaacgaagaaaaagtgacaccttcgctccctagctatgtacctatcttttacaacaaaaacggagcaggaaactgctctttgtcaattctaacaccacatcaagatatatgggggataataaaacttcctaatggcacttaatgtgatttttcatttttcagacttaggagagattatcaataccaccgactcaacatacttcatgagacaactcagtaaagtgtacgtgcacggaggaggtgattgtccagagaagacgttgaccggttcgttttaattttttaaaaattagttgtatgttttggatagttagtatttgttttgccagaagatcctattccttttggttttctttttgaaatgttgcgaaaagttgagaatacgtgtgagaaaaggtgacgaagtgcgttacgcacaattgcgctcttgcaaaagaaagttgtctgaagcaatgggccacaacacctgccgaaaacggtccgaataagaaggttttgagtcagcaagcgggattgagggcgaatgaatagaatgtgttaattgatagtttagatagtgggctttagaaaacaggaaaaaaaacggtttcctttccaaatagtcaccatgaatataaattaggttctagaagatattgatgtatgtgatcgtagaagaatggaacaaatacgaagaagaaatgaatactgctgctctaacccagaccatacttgaaactcagatacttgacatttgtccttaatactgtgacttttttttaaatattgtgaacaatatagaatggggaatagtgatgaaaaaggctttgttttcaaaagttataaacatatgtttcatttgtgtttaacaataccgagtatacttgaaatgttttcttgagaaattaaaaaaatttaaagtgacgtttcatggaaattcaaccgaatatacatgtggtttctatgaacattctccgttaaaatattcgatcacttgaatccttgttcaatatattaacaagaaccaagtatcggaaccacatggtagcgtgagctcaaatttaaaactcgtaaacttttagacacaacgttttcctaaccatctgctttgttactctcgtctcttgccacagattgtagttattactggacgaacggaaatgaattgctgtatttcgaagtcattgaaacttgacaccatgaacattcacagatgtaaccgatcgtctccatcctccgaacttctcaattcaaattcatcgccccgaactttgtagaaatgtgtgtaataactttttcgaaacttgagatgaagttctagagaggaacgtgcagaaaccaaatgttaacaattgttggaaaagaagtgatgcaacatcaaaagaacagggttgtaaatccttctacatctacaataatatttgcacattttacaactgcgatgcgcatattagtctgtgttgcgcaacgttctctgcgcgggggagatagaaaaaattagcaagtatcaaaatgtactatttttacttacaggtattctcaaggcacttcaaatttccttaccgtcctcattcatttatgtgttcactgatgcccgatcaaaggattaccacttagaagatgaagttcttaatacaattcaagagaaacaaagctcagttgttttcgtgatgactggtgactgtggtaatagaacacatccaggattccgtacatatgaaaaaatcgccgctgcatcttttggacaagttttccatcttgaaaagagtgatgtcagtaccgtattagaatatgtcagacatgctgtcaaacagaagaaagttcatttgatgtacgaggcacgtgaacggggaggaacagtgtctagaaacatcccagtagacaagcatctctcagagctcaccatctcattgtcaggagataaagatgactcagataatttggacattgtacttcgcgatcctgaagggagaacagttgacaagagactttatagcaaggaaggagggacaattgatctcaaaaacgtgaaactcattcgtttaaaagatccatccccgggagtatggactgtaaacacaaactcaaggttaaagcataccattcgcgtttttggtcacggtgctgttgactttaaatatggatttgcttctcgtccgttggatcgcattgaacta

SEQ ID NO: 30546 - DNA, 2744 bp, Caenorhabditis elegans; identical to SEQ ID NO: 30545

SEQ ID NO: 30547 - DNA, 701 bp, Caenorhabditis elegans
aatatctggaattccacaaccagacgtcatctggactaaaaacggaatggatatcaatatgacggatagcagggttattctcgcacaaaacaatgaaacatttggtattgaaaatgttcaagtcactgatcaaggaagatacacttgcacagcaaccaatcgtggaggaaaagcatcccatgatttcagtcttgacgtgctatgtaagttttgtgcatgaccgtttcagaaaaaaatttaatattcagcaccaccagagtttgatattcacggtacacaaccaacaattaagagagagggtgacactatcactttgacttgccctatcaaattggctgaagacattgccgatcaagtgatggatgtttcctggaccaaagatagcagagcattggacggcgatttgacagataacgtggatgtgagtggttcattggaaatatcaaattacaaaattcgtttgttgattaatatcaagtttttaccgagtttttcaaccattttataattaaaattaaacaagtgctcattaaattagattacattatatagattatttataaaacgttttttgcagatttccgacgatggaagaaaactaacaatttctcaagcttcacttgaaaacgccggactgtacacttgcattgccttgaatcgtgcaggagaagcttcgctcgagttcaaagtggaaattctgt

SEQ ID NO: 30548 - DNA, 701 bp, Caenorhabditis elegans; identical to SEQ ID NO: 30547

SEQ ID NO: 30549 - DNA, 368 bp, Caenorhabditis elegans
gaccggttctaaacatgaatggactattgttttcgagatttcagcgtttgtcgcaatcttaccaactatctttttcacactctggggatcagctgagagaactgtaagtgtcgtaaaaaaatataatctccaaaaataatgcaaaagatagggtttttatattttcaaataaaaatgaaagaaaactattacagctttatagatagaaaaataaattattgtttcaggaatgggcgtccaaccgagtatcagttccgaaagatgctgatcaaaagtctaatgactccggctcctcaacatcctctacaattcaagcaattgccaagtacagcatgttcctatctcatgatctcaccaactctgcctag

SEQ ID NO: 30550 - DNA, 739 bp, Caenorhabditis elegans
ttctaatcgttggcaacaaccaagtgtttgccgagaagacactcaaagaaagtcacaaaatatcgtattctgtgagcgattagacaacacgtcaagattaatgtttccaggtttgtacgtttgtggaagttaaattctttttgtattcttgtatttcacaaaactgtaactttacttccaacaattattggtgataaagtatgaaaaatcaaatcaaaatttgtttgttcaaagtgtttattatccttgataaaaattaacatttagcatctttcaaaagtgatacttctaaaaatgtattttttaaacactcaaatatacgaaataaactgacaaatatacagaaaagtttcccaatagaccaaattttatgactaaaattattttcactgcttgttttttatttcactattttcgaaatcattattttaaaattgtgcacttgataaatttgtaaattcaaaaatttagctttagtttttttattgcgttggaaacacagaagtgatatggtgttttgagaatacattaaacaaaatttataatgaaaagtattgaaatgaatgttttattatcttattgtcaaccaaagaaaaaacaatcaatatgcacaaacatgagttttgagcagtgacaaaataggaacctcttgattctttatttttcagtagtgttcacattctacaacttcatatattggtttgtttacatgaaacaagcatgggatcaggcaccataa

SEQ ID NO: 30551 - DNA, 704 bp, Caenorhabditis elegans
gacgaagttttcatgcgatggggcgatcctccattaacgatcttcaaacccatcgaactacctgatttcacaatgacaaactttagtacttcaaataaatttcaggtgagaacttaccaaatccaatttagtctctgttcaaaataaaaatgtattatgtcttatactgaaacagatttttgttcgaaatcatcccaataaacttaccccagaagaactgagattttttgaagataatttttaatagaagttgtggaattttgatttttttgaaacaaataaccaatattctaattaattatatatgattagcctctaaaacagtagagcattatcctgagttttcagtctctaattcattgacatttaaagccggttgatttcaatgttggaacactataaccataaacaaattgtttcaaaactaaatattatttaaaaaaaacaaatattcatcaaagtaaaaacaatatgaaactttagtcctctagacaagccatcacattaactttaaaatcaataatttcttgttttccagctttatgctgccggctactggagtgaactcaatgtgaactttctcttccgccgaaggtctggatggtatctcttgcaaggttacattccaacctatatgacagtgttcatttcttggattccattttacttgggcccaaaagcaatacccgctcggactatgatag

SEQ ID NO: 30552 - DNA, 1342 bp, Caenorhabditis elegans
tcaggaaatgttagcaattttgaaagctgctggagctactcgttgtccaaaaggctacaaaggatgtagaagtaactgtcgtcatgattgttcttcggccgaagacgaatatgaagagactctacaaaaaattcgcattgggaatgaaagtgattacgagaagactgaattcacagcctctgagaaattaaacattcaagacacccttgatggaagtcggcgaggaaagaaagccaaagtaaacttgatctcaatggacggaggcggaatccgtggtttggtaatcatacagacattgattgccatagaagaaagactcggagatgatattttcaagtatttcgactggtctgccggaacatcgactggatctttaattatggctggtctggcgactggcaaaagtctacgcgagatgcaacagacttatcttcttttgaaggatagagtgtttgatggaatcatgcccccatatgatacagttcagctcgaaaagtttatacaagatcagtttggaactggaactgtctgggaaattccatatccaagactgatgattagtgcagtgaattctgagaagcttccagttcggcttgaaatggctcgtaattataaaccagctaaagatgttgcacctgagacaccgaaagaaatgcctttgtggatggcacttcgtcgatcaactgcggcgccagttctgttcaaaccctcagaagaccggtacatagacggtggaataatctccaataaccctgcattggatttgatgagcgaagttcacgcctacaacagagaacttcagctttctggaagaaaatcagacgcagttcaaatgaacgttcttgtatcgtttggaacagggcagattccaagcacagtgatcgaaaccttgtccattgacagtaactcaccactacaatccataaaaactattaagaatctggcagcaatgtttatcgatcaagcgactgcgtcagaaggtgcaccggtggcaagatccaggcaatgggcagactctttggaaatccctttcttcagattctccgcaccattatcaaaagtatgttttcgacctttatctcatcagtgtcacaaaacatttattggcagtttatgaaatagttctctaaattttagctgtaaaatatttttgaaaaataaatgaacatttttatttcagaatatatttctttcttcaactagcgatttggatgtatgcacaatgatgtgggattcattcatctactgtcgaaagcatcgcgattatattgatgagcttgtaaaagtgctcaagcacgacaccgaccacccgcacgtcaaaacaccattcacagatctctaa

SEQ ID NO: 30553 - DNA, 543 bp, Caenorhabditis elegans
atggtttcaatcaaacggtatgaaattatctctttcgtcattgctgctttcttttttttatccggtcttagtatgtggatagctttttggccaattttcaattctgagttacggagtgtatgttttatcttaggataacgtaatcatatacattgactcaaattattcagaattacaaactaggagcaaatgatgacgggtccttacattatgccgcatttttatatgcaaatccaccaatgaaaaatgttatgaagttcaatttatttaatgtcacaaatcctgatgaagttaagtaccttggtgcaaaaccggaacttattgaggttggcggctacgcgttcttgtgagtccttttttagcgaaatgatgtttcattaaaaaaaacgcagagaatccgagcagaagaaatactacgagtttagtagtgacaaaactaaaatgttctaccaaaactataaacaatatcactatagcgaagtagataatgatgcgggatacaattacaatgataaaatcatgtttcctaactcaatagccgag

SEQ ID NO: 30554 - DNA, 685 bp, Caenorhabditis elegans
atggaacccaacttacaagccaagctcaaagggatagacgcattttgcggagagcggtattgggtgagtgacataccaagaaattgcaagaataattatattattttcaggatcctgcggtgtggaatgcgtccaccgtgcccatcctcagtcagtgctaccagcacacaacgctggtatggttcccgaccgcgattgtcttccttttggctcccattttgacggcacaaatcttctatcgccgacccaacccgatcccgtggactagacggattcagctcaaaattggactggcgtgcatcctgattgcggactccctgtcactgttcaccgttgccatctacgagacactgttccaaggatttccgtacgccgtggactttgtctatccgctgacgctttgcctggcaatggtgagtgagattttctaggaaaactaggatgagtgtgattttttcaggttgttctcacggctctcattgtttcgtgccgaaactatggaattgtcacatcgggaggcctcttcatcagctggcttgtgttcaccatttccgctatccccgagcttctctattggatccagcagatcgtgaaccctgcagaggcctggaattggattgactaccctcgatgcatcgccttcttcatctggttcttttgctgtgcattcgaaacatatcttcac

SEQ ID NO: 30555 - DNA, 2230 bp, Caenorhabditis elegans
tgctacgcggatgcctctcctgaaggatacaagtacctgagcgctgcccgtaatccaagtccagaaaccacgtcatcgttcctcaaccgaatcacaatgtggtggttcaattcgctgtgcagtcttggtgtgaagaagccgttggaagtgagcgatctgtactctctgaacgaagcggacacctcgaaccttctggttcctaagtggtacaatttgtgggacaaacaaagcaagagtaggcgttttgaaaatttttcagatttaaaatattaatttacagagttcgaagagaccgccgctcgtcgtcgcattggatctaatgccagtcgtaccaaccgtcgccgtacatcttctaatgacaccacgccgttgctgaatgatcaatcaaccgacgactacggatccgtgccagctgggcagtcaactcagaagatgccatctattatttggacgctcttcctcatgttcaaatgggatgtgataactgccatgtttgtcaagctactctccgacgttctgctgttttgcaatccacttcttctgaaatctttgatccggttcaccgaggaacttgagcgtccgatgtggcaaggagttgttctggcattcaccatgttcttctctgccgagctgtcttcaatcctcctctctcattacttctatctgatgtatagagttggaaccagagttcagacttgtctcactgctgccgtctaccgtaaaactcttcgtctttcgaatgcggcacgtcgtgaaaaaactgttggtgaaattgtcaacttgatggcaattgatgtggatcgcttccaacagattacgccccaaacgatgcaatattggtcaaatccgtttcagattggacttgcccttttccttttgtttcaacaactaggagtctctgtgttcagtggagttgctgtgatggttcttctctttccaatcaacttcgtcattaccatgatcattcgaaaatggcagattgctcagatgtactataaggatgagcggacaaagatggttaatgaggtgctcaatggaatcaaggtgatcaaattgtatgcctgggagccaccaatggagcaggtcattgaggatctgagagaacaagaattgggactcatcaagaaggctgcattcttgcgcaccttttcagatatgctcaacacagcttcaccattccttgttgctctttccacgtttgccactttcatctacatcgatccaaagaatgtgctcactccagaaattgcattcgtttcgctcacactcttcaatcagctacgatcaccgatgtcacaagttgccgaactcatcacccaaacagttcaagtggtcgtttcgaacagaagactgaaggagttcctggtgtctgaagaactcaatgtggaagcgattgatcacagagctcgtgatagtaagtttccagattagctttcctatattgctctatttttttcagataacgacgtgatttgcctcaaggaagcttgcttgtcctgggagtctgctgaacatcaacctgtgccaacactcaccaacatcagtttttctgtgaacagaggtcaattggttaccattgtcggacgtgtcggtgctggaaaaagttcaatgctccaagcattgatgggagaaatggagaagctcagtggaagcatttcaatgcatggacgtctttgttatgtgccacagcaaccttggatgcagaataatacgcttcgtcagaacatcacctttggaaagcagtttgatgaatacttctactctcgtgttcttgatgcttgtgccctttaccgagatcttcagattcttccacttggagataatactgagattggagagaaaggaatcaacttgtctggaggtcagaaagcccgtatatcacttgcccgtgccgtgtaccagaatcatgacatctaccttttggacgacccaatgagtgcagtggatgcgcacgttggaagtcagctgtttggctctgtgattggaccggaaggaatgctccgcaacaaaactcggattttggttaccaatgagctctcttttctggaaaaatccgatttaattattgtaatgaacgaaggaaagattgaatactctggaaagtatgatgacctaatgcagcaaggggcatttgagcagcttttgattgaatgcgagaaggaagaacgcgagagacgtgaagccgaggcatcagcggatgaggatgacgagaattcggaaccgggaggaa

SEQ ID NO: 30556 - DNA, 197 bp, Caenorhabditis elegans
acgattcatttaccagtgcccaacagcattactcaccatccaaatggaatataaaccagatactcaaggaaccaatgatgcttatttcgtaagtttaaaattgaacgttcatatccatattaaattaatttcagcaacagtacccagaatgctgctctggatatacgcctagaagaggagtttgctacaaaaactga

SEQ ID NO: 30557 - DNA, 604 bp, Caenorhabditis elegans
atgttcaacacaagatggaaggtgttcatatttttggcactatgctatcgaatatcacatggagaagagttggataagaaaaagttacagtaagttttttaattctttgatggtgacgagtgttaaaataataatattcctcaaagttcacctttatcatgaacttgccgtttcgcagcaaaacaagaaagcaaatgattgattttgaaagaatctaacagaacgttttttttttagaaaagaggcatacgacatgtttatgcatggatacaattcttacatgaactacgcatttcctgctgatgagctcatgcccctttcatgcaaaggacggatccgaggtgtgacccccagccgaggagatgttgacgatgtcctgggaaagtgagttgtcagacagaatgtgatttaacatctattcaacattcaaattacagcttttcggtgactttattggacagcctggataccttggttgtaatgaatgagcttgatgagtttgaaaaagctatagacttggttatcaaacatgtgcgatttgattctgatcacgttgtcagtgtttttgaaactaatatcagagttctcggtggtttgatctcag

SEQ ID NO: 30558 - DNA, 708 bp, Caenorhabditis elegans
attcaaacatcatctctttgtatttcaatttccatgtcagccaatgtggcattagcatgcatattttcaccaaagctttggatcattttgtttgaaaaacacaaaaacgtccgaaagcaggaaggtgaaagtatgcttaacaaaaggtgggctgactttcaaaaaaaatgtgaacagttaatatgatactttaacaccccattttaaaaacgaacaacaattttaaagttttgaaacgaaaattcagaaaaagtacgaacgcagactctgatgcacaagacactaaattttgaattacatgaaggttttactttaccgagtattttttaaacattttgaaatatgaataagtgttgtagtctttttaacaaccattaaacccatctttataatcactttgtctgtgccattgaaataaataacatttttcgagtgaaattatttttgcatgttgagtaactaaattatctaaacttttcgagtgtatttgttctgttggttcagaatattatttattattatttattaatatttattattttttccagtagcagatcattaggaaactgtagttcccgattatgtgccaatagcatcgacgagccaaatcagtacaccgctttgctcactgacagtacacgaagacgatcatcacgcaagacatctcagccaacgagcaccagctctgctcacgatactttcttatga

SEQ ID NO: 30559 - DNA, 1770 bp, Caenorhabditis elegans
atgatcgaaacggaatgttttgcggagttgaacacgtttcacgatgaagatggaaatgttatgtggaatttgagacctgatggaataaatatggatgaaaggaggaatgggaccagtaaacctggcttcttttcacgactttttcgcaagaaggttagtgacactttgaaagcatcattttattttagtttgttgccacataaacaccctcacacatcccaaaaattaccagttttgcatattcacattttcaatgtatatcttccatgagtaccgaaccacttttgagcagtgtgatgacagtagtatttgatttaaacaatataacacatttgagtattaattttatttttgtgtttttgctgagcttatgtatatatgtgaatagattaatatctctctctctctttctctcgcctctttttcttctgcttgttgcctcacatgatgtttatattttatttaatcgtactcggtgcatccacgtgttgcagaaagcagaaaatggagcgagtgagcgcagatagagatggagtgaacataaatttggactcggttacaggactcgaggcatcccaacgctgataaaacttgaatgatttgtgattgtgaaccatccccatttcatccatcccactcaaacccccggatcaataattcaacatcacttgcctttcaataccaacatgcaattacgtgtcttcacttcaaacaataccaatcaaaatgctcatgttcctagatcaaaaattaaaacgatttggttcacgatctcttctcttccccccgaaacctcttcgcacctttttgccacacttcaattaaaagtaagttttccattcccattttatatatttggcgcacacacatatacacattcacacttacacattcatgaagcacctgttgacacacttagacgaaacatgttgtatatgaacctttcctttttttctttcccaaatgagcactctgaatttctttctatcgttttacaaaagtctgtctctgattttgatagcatgcacgatgaccctgactattattttttatcaactggctctggagagctatcgccacttttctgtttatacttcagtgtgttgatttttctgcaatatttagtcaaaattttctccggttgtcacatttcacagtcggctcagggttttagaaacaaaacaaaaaacgactgccagcttggaattatggatataatttatagtaaatttttaaacactaaattaaaaataaataattcaacaatggtgcaagtagatacattttaacactttaccaacagaaaaataacaatcaattaaaaagtcattcaaaacgtttacagtgatatttctgacagatatttcttgtgagcatttgcggaacatttgcacataatttttgaactatcacaacgtaccaaatgccgttcataaattataaacttagctactttctttagaaagttttatagtttgaagtttcattgttccaactgcgcaaaaactgggtttttaaaaaacgcaagtttctgccaaaaaattgtacttcaaacccattgcctacattttctatttcttagttatctaaattctcagtttttcaaatgaacggtaatttaattttcagaatatcgaagtcaccaaatcccttcatgatctctcccatctcggtgtcgaacaacaacaaccacccaaaacatcaactcaaactcctgctgttcgatcaagccgcgccgcttctgcaagtgggagaacattagtgatttga

SEQ ID NO: 30560 - DNA, 362 bp, Caenorhabditis elegans
ctaaaagaagcactcgaaacaattgtggggggactttgtaaacaatcagaaaggaaaaacgaacttattcctcatcataatccattggaaacatccctcaattgtgctgttcgacaatatcctcttttcaaaacgctgtatggctgtcgcataggggacagaatgtttgcaaaacatgtaagttcgtttttagctattccagaaaaattattatctaggaagaattttgcaagccgtttggagatgatgttaaagttgaagattatgcagtaaaaagtagttctgcaaacaaggatgtaggcggtttctttaaagatcttttgaaaacatcgaaaagtttcaatttcacttatggaatctga

SEQ ID NO: 30561 - DNA, 699 bp, Caenorhabditis elegans
atggcgaacattttctacaacgcccttcatgcaaatacagagattttgcaacaaatggaaatacctatttccagtaaaaacaaattcctgcaccatttgttcaatacactgaaaacaaatgcaataaatgaattagaaacaacaacaatatcagaagcagcgaaaaaatcaatgaagaaaggcattgaaatgtcaaaagtttactttgcattctacgattttaataacataacagtatataaagaagctaaactggtatatgaaacggagtattatcgcttgaaaaaatggttgtctccaaagtaagttctcattttaaaattagttttttagtgttgtgtgtgcttatctcaatgttttatacgtgaatttaaaggttatagttaaaatgactcaactttttcaacaatttgactactggaaaactattttcttattgtattcctagaactttgctacttgttaggcattttcagaccgccaaaaaacaatttcctacatattttcattcaaaatggaaatttaatgcgggttaggttggattttctgggttaaaaacccatcatttataagccccaaatttttataaaatgcaacgcaattttcaaactaaattagttgattcggtggaaagacaaagaagatattttattctacgaaatactatactattctgatttaccaatattttatttcaga

SEQ ID NO: 30562 - DNA, 845 bp, Caenorhabditis elegans
attcgtgatactgtggaacggtcagtggcacggttttgtacaaagaacagagagaatcttcatcacaatccacttgatgtttcgataaatgtagccgcttctgaaatgccaacattcaattctttatacaactgtaaacctggggatcggatgtatgttgcaccagaaaattattgcaaaactttgaatatggacattgacgttgaggagtacaagtcacaaaaaattgaaaacgacgacctgtttgtactgactcattttatggatgttctcgaagataccgccgtcgaattagatgctgcaaacattacaacatttgagggaaaactttttgatatcactgtggaagaagtcgaagaacaagaagaatctaaagaaggtagtgcagagagttcatcatcatcatcgtcggagagtgatgaagaatcaagtgttgaaagagaattggatgaggtttctgatggacttgatgattcagaaaatgaaactgaactgcgaaagtcagagattgcatctactagcaggtacgcgctctaaccacattattgaatccaaagaaaccgtacaaaaagcatggccgcgtggcgcaatggataacgcgtctgcctacggagcagaagattgtaggttcgaatcctaccgtggtcgaaattttgcatatagttgtatttctgacattttctagatcatacttcagaaatacttaataactttctagtaataaatcaaaactagtgattcattatttcactgcaaagatgtatgtagtttttttaaatttcagatcttcattcatttggcctgcaacagttttcacgctacttataaaatatattaaattttga

SEQ ID NO: 30563 - DNA, 505 bp, Caenorhabditis elegans
atggttcaagaagatgacgagaatttacgcaattcaatgtcccttcggccgacttcgttgtcaacacgtcccacatcactttcggtaaacggaaatgagaagacgcttccagaagaaagtgtgttgtgagtgttttttccttttttcaattagtcattagtaatcctctcgttttcagacgttctctttcgacaggcacattaaaataccctgatgacgaacatttatacacattcagctccgctaatttacaagatcttggagcaattggaaacggcaattttggaacagtttacaaaatgcgtcacaaagaaactggaaaactgatagctgtgaaggtttgaccaataatttgttttgtgaaaaacaatgtttttttcagaggatacgatgcaacaacattggacatagagaacaaatccgcttacttcgagagcacgacacaattgtgaaatccgagaaaggaccaaatatcgtgaagttttacggagcgattttcagcgag

SEQ ID NO: 30564 - DNA, 315 bp, Caenorhabditis elegans
cccgaaaggattacaagttcagacaaatatgatgtgagatcggatgtgtggtcattgggaataactttggtaatttttttctgttttcaaaaatccacaaacaaaatttttagtacgaaatagcaacaggaaaatttccctaccaagaatggaattcactttttgatcagattgctacagtgagttattatctatatcattgcgctatttgtagaaaaacatgttttaggtagtaagcggtgatcctccaattctacatccagacagcgacgatttccattacagtttgccgcttgtcaagtttatcaatacttg

SEQ ID NO: 30565 - DNA, 536 bp, Caenorhabditis elegans
atggaccacggcgatgaccaagattttcccatgttcgctcgtccagtgtttttggccaatcgaccaactcttgaatctcttagcagtaacgacggatctgttgcggaagaaaatccattgttagtttttattgatttttaaaacagcaaaaaagtattaaaaatatcaattcatccaatatttcaattattcatccataatttttgttaaaggcgttctatgtcaactggcatactaaagtttcctgacgacgcccatctttatccgttcaatcacacaaatttacgtcatctgagccaagttggagctggatattacggaactgtgcataaaatgcaacacaacgaaagtggaagacttatcgccgttaaggtatttctgaataacggaaaaaacataatattcttcaaatttttaagaaaatacgatacaacaacatttgcgaccagactcgtctgctcaaagaacacgacacccacatgaagtccgagaatgttccaaacattgtaaagttttttggagcatgcttcagtgag

SEQ ID NO: 30566 - DNA, 698 bp, Caenorhabditis elegans
atgttctgggaggtactgttgaaaaaaagaggtgttttgataatatgcttacacatgttgatagatggtcttcagttatctcattaatatcatcttgtcaaccaaactctgtgttggccaagcgagtgaggatgttgtaaagtcggtgtgtgccgaaagcgaagaaaaaagtcagctcctccggctgatttctctatccatttcacgattctttgcttttgaaactaccttctatgcctgaaaactctaatattcatagtaaaaagatataccatcggtttggaactcgaaaatcagtgcaactttccggggtcttcacccaaatgtgtctttgaacaaggtataattgtatctgtgattctacaaatgttcgatatttatagttaatgaaatatatatatttttttttaatttaaaaaatatatttcctacttttctgttttcaggtagtggatgaaactcatttctcaaaaaatgaagtcagagcaatatacagagccttcaaagaaacatcaccaaacgctgtcatcaacaaaagtaaaacacatttgtcacaataagtcatcggaaaatatatattttcagatattatgagagaaaaatttgcggaattgtttcctcatggtgatattgaacattattctgatctcctttttgaaacgtttgacaatgatgggaatggaacaatcaatttccag

SEQ ID NO: 30567 - DNA, 444 bp, Caenorhabditis elegans
atgattaagcctctagtcataattgctgtgctactagtcaacgatgtcgtgtgtcccccgccattgagacaacaagcagagcaggcccaggctcaggataatgttcaacaccaggtatttctttcatttattaacaatgtttagccaaaaataaatgctaccactaaatttcgtcagaaatattcaatcacaaattaaaatatttttagcccgccactggagacgcacaacaaggacaagggcaagctcaaaacacagagcaacaaggagaatatgatggtcggcacccagtatgttttgaaacaattttgagataaacatataaactacttgcagggatatcaattcgcctacacaaaatatttggaagaagtagtgaagattcttgaaagcgacccaaaatttaatgaacgtctgaagaacatgaaagaagaggacatcaag

SEQ ID NO: 30568 - DNA, 192 bp, Caenorhabditis elegans
gatatccgcaagaacacattctactcaccattggaaatctccaccgcccatcataaggtaagaacatgctttcttgcaaatgaaacatataaatcatttcagattcgcccatacagctcggtagactcatctgcggagtggcagtcaaacagcagtgaaggtatcgtctcaccagacgagcatgacgaatag

SEQ ID NO: 30569 - DNA, 3089 bp, Caenorhabditis elegans
caatggtggaagcgattgttcagcagccagcacagtcagccttgatacgattacagaggatttcgaagaggtttgtccgtctttagtttccttagtgtttgtcaagaaacttttgatgcgtgtatgtgtcacacgccagcttttttctattccttaaacattggtggtcgatattcatgacgttcagcttatactacttgtttttttccaaatatatttgtgaatcatcctgttaaaaattatttacaagatccatgtgatagaaaattgaggggaacaagtatgaaacgcataactaaatattttcgaataaattgtgttcatagtttgtgtacttccttgattaacaatcaatacgggatattcataaaagttttcactgaaacaagtacatacaaagttagattgctcaaaaagagcagaaagaagacaagcaattttcttaagtagtagctaatcttattaactcgcccacaggcaataaacaatttttataacttggaagaagtaaacagaaattcgtgtttatttttttttgtttgaaacacaaaacgataactctctaaagacacattcatcaagttcagatgttcgagaaaaacaattttttgttaaatcgtgcctcaggttttttttgtacaaccgttcacatttttatattaaactgtacgttttcttattcaaaattttaaactgaatgagttgttgatctgtttaataatctcaacttaaccgtagataacaaaaaatttggaaaaaaaatccaattatccaataaaacatacattcaattcaccatccaatttaaaacttcaggaatttagaacttactttcaatgtttcaaaccccgctattccttttttgattatcagtttttcagctacaatgaaatagtttttcaaaatattctgataacttttcaaatcaaaatgcacaaatgtttttgagcacaaccgagtcagttcaaaatcaaccataaaagtttagattagaacgtactttttataaataataaagttcaactccaataaactagatttttaagttttttgttgcattttgcaagcaatttatcttgtcgtgtatgtgtgtgaccagcgcactttacatctttatgaccacactttttgataaacgttagtctattctcctcacgaatcgtaaatgagacgaggggatatctataaaaaactgtttgatggtttgtgggaggctaaacaatcattcatctgcttttacttcggcttcctcctattaactcattatcttcatcctcctcggatattttctatttttcgttgtctttacaaatgcttgtgattttagcttgaagaagccagtaattgaagaaggtaaaagtctataaatcaagaagtataataatagtaaaaaatgcgagactcaggaaactaattttcggaaatataagatgccgacaattccgtcgttggggtgcggtttttccttattttctcgctaatgttctttaaccgtagttccaaaagttttcattgttccatctgtttcttgcatggattaaccttcaaagccttttgtctgtcacttgatcattttaatttgataaagtggagatgtggattcaaaatgtcaatgtgttcttgtccctttacattcacccctccacttcttcccgcataaggttagtgccgctgcatttcattcttatgcaaaattgattaattaaaaatgctaaccattttcatttacgtcatgaccacaaccacagcatgactcacattgtaacctgtatagtctgcacagtagggaagaaaacgttcgctttgaaggtttatttcaacattgagtcagttttctgataggtttactgcccagcattcaattttaagagttgttaactttttggaaatgattttcaaacaactttcgtattaaattgtggaatttgttttatagttctatcatttttatctattcatttttagaacaccgcaatttttatcgcaatgtattcttttactttttttttcgtctttagttttagaaaatatcaaacctgaaaccatgttccaatgtctcgttttaaacttaacatattggaatttcacgtataactgaacaaaaacatgtcatgatggtaaccgaaaagacttaagatattgaaaatgacgtgaactgtctttcaaaaagctttcaaagcaaccaaaacatcttgaaattttcttgcctattataattgtggtatgcgtagaagatgaaaatttggtgggtgcaaaattaatcgaaactataagactgtttttcagttattcattttggggataagcctaatgaatatgcaattataacagggggcaagaataataagaaaatacagtacgtcagtaggattacttatttatattttaaaaagtgttagagtttcagatgatggatattatatttcacaaaatctttccaatttgaaaacttctagggtcagaaattgtgataattagttcattggtagcagcaagttccattggaagtattgcccttgaacacccagcgacaaacggtaatcaatcactttcttagaatcaaattaagacgcaccctctatgtatctcaattcgccggtgatacgatactgacgggatgtttttctttgcaaaacaccttttgttgcgtttacccgcttctttcaagaaaaacattgatttttaatcgttattaatattattattgtgaattcataattcacgaataaattttaaattaagcaggtcaacttgagattagaaaatcgtgaaattgtgtgaattagaccgtaaactcgggattctcggatgttccaagtgtcccctcctaccgaatgatacgcatcttttgaaaatctatgaatttcggttttgaatattcaccacaacgtaaattatgtataagattctcgacgtcatcatcaatcgttctttttcatgtgtttttggagataaccatctagatagccttcacctaatcggttacttcattttgaatcaacgtttatttacaggtttttgccaaggatattgaaaccgactatcaagcgttgtatagggaaaacgccgagctgcaaagggcattgaat

SEQ ID NO: 30570 - DNA, 336 bp, Caenorhabditis elegans
aacgcaccgctatgataactaacccgtttcgacgtgcaaaccgaaaaaaaaaagtggaggaacagcctgttacggtgatttctggtgagttttacttttatgttgtttgatccttagttattcttcgttaagaacttttacacccgacatccaacgaagaataggaagccattcattccctgcatgcactcgttgtcagtgaacttttcaacaaaccagcaatctttagaaacagattcagagagtccacttcaaactgcagtggagccgcagcgcagtatcgtgtatctcgatgagcctgagaacggatcaagttgtcagacgcttctgctttaa

SEQ ID NO: 30571 - DNA, 520 bp, Caenorhabditis elegans
aaaggcacaaactgcgattcagtcatatggaaaatcagtagaaattccatttctggatcacaaatcgtttagtgccagcggtggaaatgggaactttttgttgtcaacaaggtttgaaatttttctatcagttattataatttgtttgatactgttagaaagtttctcaaatattataattatttctgaaaataatttataatttgggctatactggtcaaaaacatctggttttcaaatattgctgactactctaattctagtttccttggatatcatgaaaatggttgtttcggatacgttgtgccaatgtgtaaagatggctacggaacattctatcgcatcaataaaacaaggtcacattttcaatactttgatcaacactattttcaataattatttcagctttacattcaccatctccaattggcttgatgatgctacaaacggggacgaattccgtgaaaaccttgagtattctctcaattttatcaagaatgtaattctgaccaacgaataa

SEQ ID NO: 30572 - DNA, 415 bp, Caenorhabditis elegans
aggattatcatcagctcttcagtttgtgatagcttctcgagcaattttctttggaatcttcgacagtatcagaacaagtgtagaagatccaaaatccttaaatttcgctgcatgctgggctattgctcaaatctcaataacaacaagcggaatggtatgctatcctttggatacagtacgacgcagtatgatgatgcaatcgggtaaacaaattaaacaatatacgagtacaaaagactgctggaaaacgctttataagtacgttgttcaaaaactcccgatttaattttattttctgaatttcagaaaagatggtatcaatggattttatcgcggtgccctgacaaattcgctccggtctacaggtggagctttgatcatcactttctactacgagttctcaaagtacatgtaa

SEQ ID NO: 30573 - DNA, 348 bp, Caenorhabditis elegans
gaatggcggttattcagcctatgagagcatacaaaggaggagttttcacaccatccgaatatgcatgcaagaacgaggtatactactttttctttgtcttttttcttatcagaatattatacaatttttcattctatagaatttactaatcagtatgcaacttgataggtaatcggactgcatgcacttctcatcactggttacggaacaagcaagactggtgaaaaatactggattgtgaagaacagttggggaaacacttggggagttgaacatggttacatctactttgcacgtggtatcaatgcgtgcggaattgaagacgagccaattggaattcttgcttaa

SEQ ID NO: 30574 - DNA, 499 bp, Caenorhabditis elegans
atgaggtacaatactgatggaaaaaatacggaagtcaattttacgaaacataaacttactgatagattactattcgactaaatgttttattagaaaattaaactttcaatactaataaatatccatcaattcaattttaattttaagtgaatatttattttttttgttcattaatagcagttctctcgtgttttcaaaatgatttttcctggttacaccgtgtcctacttgctcttgattccatctctaacccttgactcttttgacgttggctagaaagaaaactggcaatgttatcttaagagtgattaactctatcaatctttatctctcttctcactccagcttcatcaaatccaccactaccaaacactatctgataggaaaaagtcgatcccttgtcgagttgactctgaaacgccactcaacaactcctcaccacgcgatgaaaccgacaataccatgaacttcgcatttctgctcaggatttttgtatatg

SEQ ID NO: 30575 - DNA, 358 bp, Caenorhabditis elegans
aatgctctgtctgaatccagcaaatcgattgactgcatccgaagctcttcaacatgactggttcaggtgagtacagtttaaaccgtgtttttagttagaccaagcacgagttcattatttatagatatgttctactttgttttctaatttcagtgaacacccgaaagctgttcctccagaggaccttcccgtgtacccagcaaagagtgagttgaatgcggcgcctcctgagaaccgaaggaaaaatagactagaagcattgttggctgatgaagaaccggaacgagcagcgcttttacgtcagttcaacgtgaaagccgagcagctgaagccaagtggatttcagcttagaggctaa

SEQ ID NO: 30576 - DNA, 404 bp, Caenorhabditis elegans
atgaaaaagtactggtcaactctacatttgttccaagtgttatgcattttgtaagttcaaattttgaaatttcattgagtgccgcttaagaaagataatataataatttttttatttttcaaaacgtctcactattaggacacaattgttatatttatggaactttctttttttttcaaatggactttagtgtagaaaagtttaaaaactactaaaaattgtaaagcaaatcaattactttcagtattttcatccgaacatcctcacctttaacgcaaccaaatatttataacctcttacaacaatcaaatactcggccaccaacagcaaatgcatcagtaccactcggtgtcaaacttggaatgtatttggagagtctcggaaactttcgctcatcagaaatg

SEQ ID NO: 30577 - DNA, 157 bp, Caenorhabditis elegans
atgagagtgaaaacaatataaacatttatcaaaaaacttatctgctttcaggttatgaacggatttgtcgagcctgtcataaaaacgtataattgtacaaaagaccaagccgatactgcggttttagttgttcccatggcttccagtcttatattgg

SEQ ID NO: 30578 - DNA, 1756 bp, Caenorhabditis elegans
aacgccaaggtcagcagccacaaatccacctcgacagcagccaccaatggtcacatcaaccatctcatctggaccattctcgccattccatgagacactggcaaatggcttctatgcaggtatgtgtgaagcaaaactcatttcaattaattttgcattgggacctttgatcgtccggagtgtaactatcattagtgggagcagatgcaaatgtacataaatcgcccggtcagtgtgatggcgtcggcgaatgatttgttgcgagatgataaattgatgtcttctcgtcaatcgaaggcaacacggttgcattcaatatattcggccactgtattccgggggaatatgctgcctcaagcctatccgttccgtctgttccggatgggcaaatatacacaaaaatatgagacttgcataaaagtatgcatactttttgcattccggacactcatcccgtccatttttcgcgaccagtctatcaatcaatgtgtacagctcgaggatgtgctagtttgttgtcgagctgtttcttaatgacagatggcgtggcctcttcttcgtcttcttgtgcttgtgtcacagaatggggaccccttcgtatgaatgatgcaccaccacacatactcttctttcccccatgtgtctaattattcctggtgggaagacgatgagagctcttctttcttattgaaagaaaccaacaagtattggtgaatgacacgccagaaattatattattgaaaacggagagatgatgatgatgatgaggatcaagatgggtccaaattatatatgagtgccactgaacgagacacttctcaagttttctattttggcgcaaaaatgtaggcagagatgtttagtttttttctttccacaacacttgctttgaacaaacttttttgtgtttactgccttttgtgaggaagtacagatgccttgaaatgggtttttaaagaaaacatagaccccttatgacgcgtgtctcaaaatgtggggaaagacgaattgttcagtaaagttgacatctcttctcaaaacttgctatgctttcttcttttgtggttatcaaaatctgagcagcatcccacatctaacaaaggagccccagctctattctcttgagaaaaagggcctgaggttcgggatggtgggacggaagccgctgaagaaagaaggaaggcaaggtcaagggtcgcattttgtgcatatttgattttatgacactgagtggaggaagtgtctgtgaggaaaaggggaaccttttgaatgaaaggttttgagagaagatgacggttttgaaaggatttagtgagttggaaaggaaaactaaaattttttttcacttagttacaaaattaaactcttattgaaattattcactaccaagaaagttcaatttaggacaatgcaatatttcttacatgcatcgcattactgatattatatgttgtccttacgggttgagatcataaaaatatgtttggaataaagcacaaagcttatttattttttagtaacgaaaagatttaaagttgtagaattatctattttaatttgatttaatttgatattttcagctattgccggaggtgttctcgttgcggtgattacagccattctactcgtgctctttgtagtctttcgaatcaggaaaaaagatgaagggtcatacgcattggatgaacccaagcaagcaagaccatatgcctcgtatggttataccaaagcatcgacaaaagaattttacgcgtaa

SEQ ID NO: 30579 - DNA, 395 bp, Caenorhabditis elegans
atgtttcaccaacagcctccagttgttgacttgaataacctgttcatgtatcacttactagtttcattcaatgaacctacaaattattgtcaattgctacaaattcacaactattcatatccattaaacactcctcaaattattaaatgcaaagaacaagaaaaacgatggagacatagaaagattaaaagtgtgggtcctagtttaaaataagatcttgaaacgttaaaaaaatattaatgttgcatggttggtcaagttgtagtaactgtgattggtcctttgaaattaaagatttttttaatcttcattaatttttttcaaattacagcctcaaatgagcacaccagatgatccagtcatccacagtccaccatcaattggagcagctcctg

SEQ ID NO: 30580 - DNA, 450 bp, Caenorhabditis elegans
atggaagagatcatcaagcatttttttgatatcatgtacgattgttgatttgtgtattctgaaactttttaaaatatgcctaacagtttctgacttctgctattcaaggttccaaataaacaatttatcgatttctcaatttatgcacacgttgtatattgtgtttggctacagagcgttcctctcctgacgtcaccaccacgcatcagttggagtgtgcaaacacgctccactatacccctccccattttattattttaccgatgtcgttttttttgtttcatttcattttacgttctatttttcaatttatttgtaatgtaataatttaggaaaaatttcagaatagaaatgtcagaacgagcgcttcgaagaacaacttttagtggtagattgcttcgtttcaaggaggaagaagaagaaattgataggaaaactgcaattgtgaag

SEQ ID NO: 30581 - DNA, 94 bp, Caenorhabditis elegans
atgctcgacgcgtgctcgttcaacagattcgactcgaatcgttcctcagctcggaggttttcgcggcgaggaagtgactattttggggacaaag

SEQ ID NO: 30582 - DNA, 287 bp, Caenorhabditis elegans
gtatttctatggatgagaggattgtgttgaacgtcggaggagtacgtcacgaaacatatcaggccacactgaaaaagattcccgccacacgactcagcaggtaaattttggatacctcttattcttgaaacatctcaaacatctcattttgaaaaaccaaattaataccaatttgggaacgaagtttttaaagatgattttttttgagattaactccgtcacttgctaacttcgatcctcttctcaacgagtatttttttgacagacatccggctgttttcgcaatg

SEQ ID NO: 30583 - DNA, 623 bp, Caenorhabditis elegans
aaaattgatgaggaaaatgtggttgacgtcaatttgcaccatcttcgcgaaagtgtatctttagtttcacaagaacccgtattattcaactgctcaattaaagaaaacttcttgtttggaatttctcacaatgcatctcaattagaaattgatcaggcattaaaagttgcaaacgcttttagttttgtaagccagttcccacaggtaaatttgaagttcataaaacttaaaatatgcacaaacgagttgtttcttctcagggtctggacacacttgttggtgaacgtggagctcagttatccggtggtcaaaaacaaaggattgcgattgctcgagcaatcctgagaaatccaaaagttcttctattggatgaagcgacgagtgctctggacagtgacagtgaaaaagtagttcaaaatgctcttgacactgcaagtgagagactatccactgttgttgttgcacatcggctatcaacagtagtcaatgcagattccattgctgttctgaaaaacggaaaagttgcagaacaaggaacacatgaagaactattaaggaaaagaagtatatactggagacttgtacagaaacaaggaattcaagtggaaactctaatagaataa

SEQ ID NO: 30584 - DNA, 392 bp, Caenorhabditis elegans
gggttagatactattgttggggaccgaggcgctcagctgtctggtggtcaaaagcaaagaattgccataaccagagcaattcttcggaacccaaaactgctgcttctagatgaagcgacaagtgctctggataccgaaagtgagaaaatagtacaaaatgcactggacacagcaagcgagcgcttatctaccatagttgtggctcatcggttatctactattatcaatgcagactctattgctgttttgagaaatggaaaagttgtagaacaaggtatttatgtatgaaataccgcagtttcattcaacgtaattttacaggaactcataatcaattgttggccgtgaaaggagactattggcgccttgtgcagcatcagaagagctcatag

SEQ ID NO: 30585 - DNA, 629 bp, Caenorhabditis elegans
attgctatagaagtactggataacatgaaaacagtgaaagcgttgaatatggaagcaagggtgataaacttggttatggaatatcttgcagttttgaaaacaagttatcccagaagatctgtggttatggtctgttattccgataaattctgcaataaatctgttttgtagggtcttgcaaacggattttctgctggatgttctcaaattgtgtacgccatttctttcaaattcggcacttaccttattttacaaaaagaagtcattccaatggatatgtacttgtctctgataacactatcatatacatcgaatatggcaggatcagcgatatcatatatgccagattttaggaaagctattcattcagcaggattgattttcaatttgttcacatatccagctacaatgcctttcaattctgatactggttcaagaagcattaccaaaggagaagtcaatggagaaaatgtgaaatttcattatcatcaacgtccggattatacagtattagacagtgttaatttgaaagttgaagctggtaaaacactggcaattgttggacctagtggatcaggaaaatctacaataatttctctcctcgaaatgttttatcgtgccgatcaagg

SEQ ID NO: 30586 - DNA, 749 bp, Caenorhabditis elegans
ggtgctgcaaacggtctttctcttagttgctatttgtttgtgtactcggtttctttcaaatttggaacatatttagctttacggaaagaagtagctccaatggatacttatctaattttagagactctttccatgacagctaatatggctggatctgcagctgcatatctcccagattacaaaaaagcagttcatgcagctggattaatattccatttgttcacatatccagctacgatgccattcagttccagtgatggaaagaaaaatattgaaaagggagaaattattggagagaatgttcaatttcattatgatcaacggccggatcgtatgatattgaatggtgttaatctgaaagtagacccaggaaaaacccttgctcttgttggtccaagtggttgtggaaagtcgacaatcatttcattgctagagaggttctatcacgcagttgatggagaagtcgtaagcattgatgcgcacgtgtagaacttttaattcctagttcacttcagaaaattgacagcgaaaacgtcgaggatatcaatttgaaccaccttcgatctaatttagctctggtatcacaagagccaactctgttcaactgttcaatcagagagaaccttttgtatgggctcacaagatccgtgccacagttagaacttgaaaaggctttgcaaacggcaaatgcgttcaactttgtatttcagttcccacaggctagtttcaactgtgctcaacttacataa

SEQ ID NO: 30587 - DNA, 749 bp, Caenorhabditis elegans
ggtgctgcaaacggtctctctcttagttgtttcttgtttgtgtactcggtttctttcaaatttggaacatatttagctttacggaaagaagtagctccaatggatacttatcttgttttaatgactctttccatgacagctaatatggctggatctgcagctgcatatctcccagattacaaaaaagcagttcatgcagctggattaatattccatttgttcacatatccagctacgatgccattcagttccagtgatggaaagaaaaatattgaaaagggagaaattattggagagaatgttcaatttcattatgatcaacggccggatcgtatgatattgaatggtgttaatctgaaagtagacccaggaaaaacccttgctcttgttggtccaagtggttgtggaaagtcgacaatcatttcattgctagagaggttctatcacgcagttgatggagaagtcgtaagcattgatgcgcacgtgtagaacttttaattcctagttcacttcagaaaattgacagcgaaaacgtcgaggatatcaatttgaaccaccttcgatctaatttagctctggtatcacaagagccaactctgttcaactgttcaatcagagagaaccttttgtatgggctcacaagatccgtgccacagttagaacttgaaaaggctttgcaaacggcaaatgcgttcaactttgtatttcagttcccacaggctagtttcaactgtgctcaacttacataa

SEQ ID NO: 30588 - DNA, 448 bp, Caenorhabditis elegans
gaggatcacgtaagcatgggtggatttgcagcccgaaaagcacttaccgtagttgagcatgttgaagctgttctagccatggaattgctagctgcatgccagggaattgaattcctcaaaccgttgatttctacagctcctcttcacaaaatttaccaacttgttagatctgtggcaccgtgagtgaaaatgcacacacttacataattattctactttttccagaccgctcaacgaagatcgctatatgaaacctgagatcgatgctgtgcttgaaatgatccgagaaaatcgtatctgggaagcagttcttccacatttggaaactttggaggctatggaggagcttgacccagatgccctccgtcaattcacaaagacaccaactggaattgttcaggatcgttcaatgatcccaatttccgatgatgaggaaagcattgaataa

SEQ ID NO: 30589 - DNA, 545 bp, Caenorhabditis elegans
atccgcgccgccgctgccaacctcaactacattcgtcttgatggaaccatcggatgcatggtcaacggagctggactcgccatggccaccatggacattatcaagttgcacggaggagaaccagccaacttcctcgacgttggaggtggtgccaccgttgaacaagtcactgaagctttcaagatcatcaccgctgacaaggacaaggtctcagccattttggtgaacatctttggaggaatcatgagatgcgatgtcattgctcagggaattattcaagctgccagagagttggacctcaagatcccaattgttgtcagattgcaaggtttgtggaaactgctcaaattatttttttaaacataatttttatttatttaggaacaaaggttgaagacgccaaggctttgattgccacctcccaactcagaattcttccatgcgataacctcgacgaagccgccaagatggttgtcaagctttccaacattgttgatctcgctcgtgccaccaacgtcgatgtcaaattcgagctttccatctaa

SEQ ID NO: 30590 - DNA, 557 bp, Caenorhabditis elegans
atgaaattgaagctcacggtacttctaatactggttcatgccagtgcatcatacaaaccgcccgcaatcgaagttgaggattatcaagttcaggtttgtatttcttaaacttgagaatctatctaaatcgaaattaattatttatataaatttaaaagacaatcggaaaaaaacttcgctctaaaattggataatctgactcgtttgtcttttatgtcggagctgtttgagacacattctattaaaaaatatagtgaaatgagcttcggttcgttataaaaataataacgtatggaatgtttttgtaaaatttaggaaattgccatttctaaaccaagagagtgaaaatccatttcaaagttaatttaaagtaaaaaacaaatgatatttgcctttaatttgaaattaagggcatagaatacataagtacctgagtttgtgtagaagcagatatctatcttacagtaaatttgttcaggaacatgacagcataggaaagttcgtggaactagaggaacatacccgccttatcctaaagtgctctgcacatcataatg

SEQ ID NO: 30591 - DNA, 203 bp, Caenorhabditis elegans
atgagttatttccttgcatcctgcctcggtgtgggcttactttctacagtttcttgttctcttcaaggattgaccagtcattacagaggtaagagagttgtcacaaaatctaatttattttcatattattcgattttacagaaaatattccccgtttcaagcatgtagcaaacgaaagatacgaagtatttcttggagatgag

SEQ ID NO: 30592 - DNA, 249 bp, Caenorhabditis elegans
atgccggaaagagctgatgcaagctccggaatggtgcttcttaccggaaactcgcatcctgagttggcgaaaatggtgtcagagagacttgagattcgcctcggagaagcgactgtttacaataaaactaaccgaggtaaaattttgtgttgcattaagaaaatctaaaattatattgacagaaacctccgttgacatcaaacaatcggttcgtggaaaacacgtcttcattctccagagcgggtcaaa

SEQ ID NO: 30593 - DNA, 1163 bp, Caenorhabditis elegans
ccaacagagcccacttacgatacacaaagaaaaagatcccaccaaacgatcagactctttcgatgatccgtcgtgatgaagtttataaaatggaacgagaattttatgattttatcaacaatttattcgacgcggttttcaagtgagttttcattcaaaatattgacaattcaaatgcgtgaatatgtgaacttctcttctttatttaatttttcatgtcattttaatttcggttttcccttttctgatccctcattacattcgcccgaccagtggctcatttattagcttaatttatttcaccaaaataagtatgcacgaaaaaagagaaaagagcaaaaggcgttcaatcaagtacgtcgcgagagcaaaagagaatgtcgtgtttcattagcaattcttattttagttgatacatagactatgacaaactactcagaaaaaaagttatacgcatctttactggtttttgatcttgtttcttaactagtttattaattttattagatctcgtatactccaaaaagttttgtacttaataacttgaattttatcgggattcacctagacaaaagttctgttcgaggccaaattgattcaccgttgattcgcgttcatgcgcataatgtttttttttgcattttgcactttatggatcttgacagaaaatacgtctgtggcaaatctactgcatttctatttttatgccgtattttttaaacaccaaaaaactaatcaaatcagtagttcaatgaatgacatttcagaaaagccacaaatggaatctcaaaagcagacgatcttgtcaagcttccgctccaataccactttgagaaaattaaaccatcataattccttcctctattcactttcctcaattaaaaatcttaaactcgcttagcttttcgtgtaacttgcatctatatcagattttattaattgttttattcccatatgtaattatttcttctctgaaaaaactacgcttgtactttttttttctggtgcttttccccatctctcatcattgcgttgtgtgcttctttttcatcttcatcttcaatttttcttcaatttttccaacaatcccaaaacaaaaccaaacgggtcgagcgatctattgcagcaattcactatgccatctggttagtttttacgtataa

SEQ ID NO: 30594 - DNA, 278 bp, Caenorhabditis elegans
atgttaagccgtctgacatcacgcaacgtacttcttgctcgcaatgtggctactgcagcaactcaggaacggcagaaaattaaagtggataacccagttgtcgatttggatggagatgagatgacgagaatcatctggaaagaaattaagaataaggtgagatactatacaccaaatctctgaggagtgcaaattttcagttaattcttccatacctggatctcgacatcaaatattatgaccttggtcttgaatacagagacgagacaaatgatcag

SEQ ID NO: 30595 - DNA, 282 bp, Caenorhabditis elegans
atgtctttcacttccacaacaccttcagctagagctccgctcggagggcgtacaaccggaaacgttacttgtaagtttattgttgtctgtgcaaaacatttaaatcaacatattccagcccaagatcgtatgctcaaaattgtgaccgagatgcgctcaggtgctggatccggcttgtcgccatttggacaaaatgctgcatcaaccatccgtgactctcgtgaacgtgagaagaaagaaatgagcgatttgaacgatcgacttgctagctacatcgaaaag

SEQ ID NO: 30596 - DNA, 741 bp, Caenorhabditis elegans
ggcttctcgtgatactactccagaaaaccgcgagttcttcaagaacgaactctcctcggctattcgtgacatccgtgaggaatatgaccaagtcaacaacgttcaccgtaatgacatggaatcctggtatcgtcttaaggtccaagagatccaaacgcagtctgccagacagaacatggaacaagggtatgccaaagaagaagtcaaaagactccgcacccaactcagcgatttgcgtggaaagctcgctgatcttgaaagccgcaactctctcctcgagaaacaaattcaagagctcaactaccaattggaagatgatcagagatcttatgaagcagccctcaacgacagagattcccaaatccgcaaaatgcgtgaggaatgccaagcccttatggtcgaattgcaaatgctcctggataccaaacaaactttggatgccgaaatcgccatctacagaaagatgctcgaaggagaagagaaccgtgctggactcaagcaacttgtcgaacaggttgtcaagacccatgctatcacacaggaaaccgataccggtagcagaaagacaattttttccattaaaacatacatcctttttcagagacgatgagagtcgtcaagggcgaaactgcatcccgtcaatcgttccagcgttctgcaaagggaaatgtttctatccacgaggcatcgccggatggaaagttcatcgtcctccagaacacacatcgtgccaaggacgag

SEQ ID NO: 30597 - DNA, 363 bp, Caenorhabditis elegans
acggtcaaggatgcgaaaacatactttgcaaatgttactgaagccaatatgaaaaacaaggaaccagaatgggtgctttcttacgacaccagagaacactatcaaatggctgatttctcacctcaatcgtggtccgatttgagtgacaaactttggactaacactacactgtttagggattacgtgaggttcgacttgtagaatgaagtttcttcactaataattgaaatttgtaggctctattaccgaaatcactacaacaacgaatgctatactgattacaaatgcagatatacgtttgtctgtgacattaaaaaaggaagaagctatgatgagagtttctgtgatcatttaacaaaatag

SEQ ID NO: 30598 - DNA, 1503 bp, Caenorhabditis elegans
atgtcgttgggaaatgtcatcattgcctcttcagtaaatacacgttcacccataggtgtataattgaacttatgtatatgttttttcctattcgcaattgttacttcccgcttttttccatttctggatatctattacgatgccaaattggatcagagggtccctgacacatacacaaacgtcccggtgttgctctttctttaagttcttctcctatgcttcttcctttcctattctccaccatctggagcgtagtcacgtcgggcatacagcaatactgactgcgtgcttaattgaaacatcaaacagattcacatttgatttgcgccccatctaaaagagatgcacactaatccaattttttgtctatatcgatgtctttctactgtgtgaaggagcagttttgcgctccgtttcgcgtaaaggaaaaggaaaaagggaggcagtgctcaatacacggctactataaaaacaagtgaaagactaaagaggcggcacacaacagtgtcgaaaaggggttgaaagaagaaggatgggggtgaagaagaagaacaattatttttgtgctgacatgagatttttgcgtattgactgacttgactattttccgacaatatttaaccttgggatattttgcgacatctgggtctgcaggctctgtgtccgctggtccatctcatccaattccatcaaattcgcagctcttcttccatttttctcactgaaaccatcatccatcgtatgcacattaaactcccccgcgtgatttcactcaatcactttactcactccatttcagcaaatccatctcattttgaaaaagtgaaatgaaaagcgaatacgtcaatctttgaggaagaatttcgtccctctcatttttcaatccttcttcgtcccccaacggacggtttctaagcgatatggctcataactcatcgggccaactcttacgttgggaaaaataagatttattccctcaactcgaaatgttttgttcctccttttctcaattctcattttcttagtcaccttggttactttagctttatgaatgtattttttataatacaaatatatcttacagttcgctttcatatcttctaaattcttttgaaatcatcaactttttgacaatggaatttgaaaacctgactaaggaagaaatggaacaacttcaaaagtagagtttaagattcccacttgtttagaaaaattttgtgttttagaatttatgacgacactatcagttttgagagaaaaattggaataatcattccaacaatttttgccgttatcattttggtcggacttgttggtaatgctctggtggtgattgttgcttttggacgacaaatgagaaattcaaccaacactcttattattggacttgccatatctgacttgatgttccttttgctttgcgttcctttcacagctgtggattacgcagctccgacatggatctttcccgagtggacatgctctatgatcaatttcttccag

SEQ ID NO: 30599 - DNA, 439 bp, Caenorhabditis elegans
atggctttcaacaaccttatccgcaacttggctatcggagataacgtctacaaatactttgacttgaatggtctcaatgatgctcgttacagtaagtataactattttacatcctattctcaatctatctaaaatatatctgcatatattcaattttggaacttttgtaaacgaaaaaaaaaacagcgaatttcgacgagcaagaataaattcattatgttaaagtcatatataaatcattttctttaaaaaccttcccaaaattttcagacgagcttccaatctccatcaagtacttgttggaagccgcagttcgtcattgcgatgagttccatgtattgaagaaggacgtggaaaccattcttgattggaaaaacagccagcgtaaccaagctgagattcctttcaaaccagcacgcgttattctccaagattttac

SEQ ID NO: 30600 - DNA, 559 bp, Caenorhabditis elegans
atggatcgaacaattgtgacagagtggaaccgagtttgtgacaacaattggagtcgtgctcacgttcatatgagttattctcttggctacctggtcggatgttttgttggaggatttatcagcgataggtattacaatttttaaaaccgttttaataagcaattttttacaaattttaaccgaaacacaaccttgttaatagtttcatgatataaaattttaaatctctactgggaattcggaacttatcaaaactattgaaaaaatatacatttttagatatggtcgtaaaactgccatcaccggatttggaatacttaccatgctctttggctttcttctcacatactcgaaagaattcgaaatttttcttgttgttcgatttcttctcgccgctacaaatgaagcagctgatcttgccgcatatgttctctgcatggaagttactggtaccaaatacagatctattgttggatcattgattcaagcaccttgggcatgcggttacgctttcttggctcttatagcatacttgaccaaatcctggactatgattcat

SEQ ID NO: 30601 - DNA, 260 bp, Caenorhabditis elegans
atgaaaaaaacgaaggtaaacccagaagacgatataacacttggcaaattcactccaaaaccaagtcctcaagattcttatcagggaaacttttttgatgtggtaggtcgtttctattgcatattgcaaatgtggaatacgaattatttcattacagtttcgagatgccgactacaaagattacatattattcagtggtggattaattttgagtgcagttaatggagcattggtgccattcaacagtttaatttttgaag

SEQ ID NO: 30602 - DNA, 386 bp, Caenorhabditis elegans
agagctgaaaattctgaaaggagtctcgtttgaagtaaatccaggtgaaactgttgcgcttgttgggcattctggatgtggaaaatctacaagcattggacttttgatgagattttataatcagtgtgctggaatggttcgtttaaattcgtagattatgaagaacataaatttgtttttagatcaaacttgacggaatcccgattcaagaatataatattcgttggcttcgtagcacaattggaattgtgcaacaagaaccgattatttttgtagcgacagtcgctgaaaacatccgaatgggagatgttttaatcacggatcaagacatcgaggaagcatgtaaaatggcaaatgctcacgagttcatttgcaagctcagtgat

SEQ ID NO: 30603 - DNA, 251 bp, Caenorhabditis elegans
atgaaaattgccagcgagcatgtggagctggggtccagacctgataagaagaagaagaaatctcgttcatcgcagggaaatagtctttccaatttggtatgttaacagaaagtaaccattatctacgaactaatcaacaaaatttcagtttcgacactctggatgtgcagactatttgcttcttctaggtgggcttgtactaagcgcggcaaatggtgcattactcccatttaacagtctcatttttgaag

SEQ ID NO: 30604 - DNA, 268 bp, Caenorhabditis elegans
cccaaccgatgccgatccctcagaacttcttcgaactatcaaacgctcaggattatacgaagttgttgtagttgctctcgacatgcagccatctgacaagttgaccaatatggtcaacccaagatgcttctacttagctcaggacttccatgatcttatgaattacggagtcaactttgttcaaggacaatcttgcttgtaatatttaaatttccatattcaaaactctcaaacttttttcaggcgctggaatttctgcaactactaa

SEQ ID NO: 30605 - DNA, 645 bp, Caenorhabditis elegans
atagcaattatcttattgcctatccaactggagttctgccatacacccctgacaccaaaccgtcgatggaaggaaaactcaattatgctgtgttgtcaagcaacagaactatcacaaactcgttgccacttggaaatcgtgcttgcacgtatgctacaatctctgccccattcagttgtccagttacagatgggtctctttcggacttctccatcaaggtaattatcttgataactgatgagatcaataatctaaatattttagtttactggaatcgatcaatacggatatgcattcgaacgatattccgatgctctctgcacaaaggctgttattaactgtgctaatggaggattcttaaacaacggagtttgtgtttgccgtgctggttgggttggaaccgactgtagcactccagtttgtcaaaacggcggaatcgagaaaagcggagtttgtgattgttcttcagtcccacagttcaccggccaattttgccagttggcccaatgtgagccaccatatccaacttcgttcaatgataaggatagaacacttgtccttatgcttgaaacatcctacaacatgggatcatcaatcttccaattgaagaaaaacttgaaggcatctcttgatagcattaacaac

SEQ ID NO: 30606 - DNA, 267 bp, Caenorhabditis elegans
attgatggagttgacgccaacggatttaacttcagaagaaccggaagattctcatgcatgcgtaagtcaacaacgcttttgttatttgaatgattagttttctataagctgaaagtgtcatgagtttattgagctcaggcgttcaagaattattagtttcataactgttaactacaaattgcaatcagtcttttttcagaacttctcacatcaccagctcctccaacaacgacccaagctccggtgacaacttgtttcaacaatgga

SEQ ID NO: 30607 - DNA, 427 bp, Caenorhabditis elegans
atgtcttcaccgtcgaggcagatcaaatgtgtagttgttggagacggaacagttggaaaaacatgcatgttaatatcttacacaactgactcttttccagttcagtatgtgcctacagtgtaagttgttatattttaaagtgtgacatgaatcatcagtgttgattcaagtgccgaacgttatatacatttcagatttgataactattcggcacagatgagtcttgatgggaacgttgtgaacttaggattgtgggatactgctggacaggaggattatgatcgtttacgaccactttcctacccacagacggatgttttcattctctgcttctctgtcgtctcgcccgtatcgtttgacaatgtggcaagcaagtggattccggaaatacgacagcattgtccagatgcgcctgtcattctagttg

SEQ ID NO: 30608 - DNA, 294 bp, Caenorhabditis elegans
atgtggataccacaacggataagccacatatttctattagttattttcatattacgtaagtctcatatctcaaagcatatgtatgtgtctcttgtttcagatattgtcacaattaatgccaacaaacatgtttcgcaattattagaaaatttactcacagactataataaagctgtcagaccagttcataatgcatcagatgctctaaaagtaaagtttggagccaatttgtgtagattgattgatgttgatgaagtcaatcaagtgttaacaactagcctatggttagaaatg

SEQ ID NO: 30609 - DNA, 580 bp, Caenorhabditis elegans
cggttgtcgagaagtcgcagcaaagctaccaagaggcgttcgacattgccaaggataagatgcaaccaactcacccaatccgcctgggacttgctctcaacttctctgtcttcttctatgagatcttgaacgccccggacaaggcttgccagcttgccaagcaggtgtgttaatgtttttattttattttagcagtagccaacattggacaaacggcttacgcggaggcacttgaaattgcaaataaagatctgtcaccaacgaactgtgttcgccttggtcttgcactcaattattcggtgtttttttatgaagtagcagcaagcccggatagagcatgccagctttccaagcaggtgctcgttaagtttttgacatagcatcgtaacttcaaagctattgattacctttaatctttcaggctttcgatgacgccatcgctgagctcgacaccctcaacgaggactcatacaaggactctaccctcatcatgcagcttctccgtgacaacttgactctctggacctcggacgctgccaccgatgacactgatgccaacgagacagagggaggcaactaa

SEQ ID NO: 30610 - DNA, 731 bp, Caenorhabditis elegans
atgacgtacccgcagcaacgactactaacagttgacattctaaatttcaaatgttaccaacaccacaaaagcttcgggccatttgaccatgtgacaacttttattggaatgaatgggtgtggaaaatcgattatgatagaagctattgcctttgtatttggcgaagacttacctgatcccaaaaatccgcacaacgaggttagcataacattatgaaaatcgagaaaaaaattattttacagcacctattctatgactacaacattcgatgcgtcgtgagtttgaagttcgaaatgccagatggatcaacgaaaagatttacgagaattggactgaaaactacatacacctacatgatcttcaataaatacgtcacagaagaagaatatttattggaacttggaaaaatgaatttcagatttgctggtcaaaatatatctgtctacaacaaaacaacactaaaagtcacccgcaaaagtgcagaagaacttggagcatttttcgacatagtttccaactccattgagttcaaaccagaatacgatgagctaaaagcgaaattgaattttgcggagagtactgttctccggtgggcaaaaatgattgatagcattgaactagaaaaagaaaagtttatcaccttgacgctttacaagctgtatttatgtgataaagaaatccaggaaaccaaggagaagtttgtcgcagagcagttaaaagtgaacgcaaag

SEQ ID NO: 30611 - DNA, 342 bp, Caenorhabditis elegans
atggtgactgcgttcagtggtagcatttgcgaagaagaacgggccattacaccgacagaaaacgaggtaagtgctgcggatattacgaatattgctcttgttttcctaggacatttagagttgtattcaagtttattcttgtcttagtgatgcttcagtataggttttcaaattttcttactttgtgtttgtattgactgatgcttttagtgaaaaattcttataattaatgaagtttgcggtacatgaacattttttcaataattttatttccagtcagagtacatccaaacgttgaaggaagagatctctcaactgcgtgatatcaatcacagcttgaag

SEQ ID NO: 30612 - DNA, 1072 bp, Caenorhabditis elegans
tcattttataaaaagaaaaataaggatttgacaaatcaagtgctccaaacagaagatcgctggacaattgagattgaaaagcagcgtcagatatttgaaaaagaaatcaagacgttaggaatcagagtcgcggatgctaaaagacagaatgatgaattatcagagctgttggaatcaaaatcaacaacacttgttgaaaagacaagatctttagaagaacaagaggagagaagcaagaagttaagagctgaaacagaattgttgagaaaagatatgcaggtgcgtagttttatatacagaaggtgtgatccgcaactatacttttaagtaatttctccatctcaaaaatctgaattcatcattaaaggtggtgtagtcgaattttttttattgctttattagactcaaaattgtctgaaaacaccgaatttcataatgaaacttcttgaaaacttttcaaaaaaaaagttatggcggctcgaaaaatagcctaaaattagagaaaatttgaaaaaattagaaaaaattggacaaatctcttcgtccatcgacttttaaataccttaataaagctgaaaacgcaagataatcgacttgtataccccaaattagacaacaatttcaaaaaaaaattgtttccagcctttgcgacaatgataagttgtttaaatttcaaattttcacaaattttaggccatttttcaaaagctaataactttttttttgataagtttttaagaagtttcatcatgaaattcagtgttttcagacaattttgagtctaataaagaactaaaaaaaattcgactacaccacctttaaggtttcatattttaattccaaatttcaaaagtatccttgagttagttaactttcgaatgaatttcaaagtcttcttaatttcaggagttagaaactgataagaaaacggtgaaagagtttgaaatcaagtacaagaaactagaaagcatatttgaaaccgaacgtgaaaaaatgaatggagaaagaaatcgttctaaaaacgaactcgccgcaatgaagaaattgaaggatgacgctgaagagcatttga

SEQ ID NO: 30613 - DNA, 891 bp, Caenorhabditis elegans
tacaaacaaagatgctctgacaaatttcgaaaaacaggttaccgacgaaaggaataatttgaaagtgaaagagaagtcggccaatgaatcaacggaaaaagtaaaggaacttgtaagttttatttcacctttgtgttttacttacccccactaaccatttctaattttcacagaaaactcacatttaccacgtttgatattaacacaggtgctcatttgatgtgttttaatgattatcacaaattcacgggtgaattgaactcacaagcaataataacatttagtagaaggtaatttcttttgaagtgaaacacgtgtactaagaattttcccgctccgtttgatctccgcatactgcgggtattttacacccaaaaaatgtgacgtcacattttagagtatagaaaacttttgtctcaaatttggcgcccgttctgtagatcaaaatgagaggaataattctaactacgcatggtgaaataaaccgcccatggttgaccattgatcattttaaacgtcatctttcagcaaaatcgattaaccgccaaagaggaagaactagaacgcttaaacactgatttacggttaacaaaagaagctcgaaaagcggatcaaattttatggaacattgatagagctagaaataggaatgaaaaaatcgacaacactgattcggttgaaacgattcgcaaacaatatcgcgactgtgaaacattttattcaaaggagatggatcgattaaatgataaaatcacagaaataacagcagagaagaatcgacagaagaatgaagcacagaaaaccattagagtgctcagcgagcagatcaaagttttggagattgagcaaaagaatttgtcgcaaaataaagatagtcaacaggtcgtaaag

SEQ ID NO: 30614 - DNA, 306 bp, Caenorhabditis elegans
atgtcctccaaattccttttcaccagtgaatctgtgtccgaggggcatccagacaaaatgtgcgatcaagtaagttttttttgttttatttatttaattttatctatttctgttttttttagatttctgacgccgttctcgatgctcatcttaagcaagatccaaatgcaaaggttgcttgcgagaccgtaacaaaaactggtatggttatgctctgcggagaaattacctccaaggctgttgttgactatcaagttctcgtccgtcgtgtcatcgaaaagattggattcaccgactccagcattg

SEQ ID NO: 30615 - DNA, 134 bp, Caenorhabditis elegans
gatcagcggaaaacccaatcacatacagtgaactgcactctggtggtaagaactttgcttttacagtctttctgttttgctttttgctaacaactcacgtgtgtgccttcttaaacactaacacctctttttaa

SEQ ID NO: 30616 - DNA, 363 bp, Caenorhabditis elegans
caaattgttcggggaaactgtgacactattgattttgtgaagcaactgttccaatatgatgcccagaagaggataaacattcaagatgctctcctacatccatacatccagagagttattccagcagaagcaccacagaaaaaatgtccattcagagtgagtttcaatcttattatataattttccaaggatcaaaatgtggaaaattgggctaatttaccgcatattattgtaatttagttttacgaagtgcgccaattaaatcactcaatcccatattgtaattttaggtgaagaaagatatgatgcaagttgaagatctcaatcatcaagaattgatcagcatgatgaagcaagatgtcc

SEQ ID NO: 30617 - DNA, 679 bp, Caenorhabditis elegans
atgaagatcggatttattggagctggaaaaatggctcaggctcttgccagaggcctcatcaactcaggtaaacattattggtttcagaaattattgatttcaattgctaatcttgggaactgtttttataaatccaaagcctgaaagtatactaaaactcgaaacctagtctataataaagttgcttcataaagcacgtagaagtaattttttctaggaactggtattggtaacagcaaacagtccaattaaagctaagtacagattaaattacagattttgttagatctagcaagtcaaatgtttatgagttctgttaatattactgtcaactactgagtacaattaaaagttcaaaattaaaatttgttaaaaattaattatgccatgcataaccaattccaaactaacacctcgcaaaattgcaggcagaatcacagcagacaacattattgccagttcgccaaaacgcgatgaagtgttccttgaccaatgcaaggcactagggttgaacactactcatgataatgctgaagttgtgcaaaaaagtgatgttgtgtttcttgccgtcaagccagtgcacgtgagcaaagttgcttctgaaatcgctccagcccttagcaaagaacatttggtagtttctattgcacttggaatcactataagaaatattgaatcg

SEQ ID NO: 30618 - DNA, 442 bp, Caenorhabditis elegans
atgagcaaacgggacgagccgggtcccagtgggagcagtttttcttctccagagctaaaagacccaaaacctgtcaaacgacgaaaaataatggatggaggtaattatttttgtgttccaaactttggtttgtaggagttccaaaaaattaagaaaagatggtatttgaaaacacagttcaacctcaaaaactatgagaaaattgtgatttcttaaaaagtattaaaattatacagttgagtaaaattattaaattatgtttatctttgcagtttgatccaaaatctctaattttgattgcaatttaacttttcagaaaaagtaataattgccggacgtgttgcttcaattcacttgaaaaacttcatgtgccatgccaacttgctcattgagtttgatgttgcaaacaagaactgtttctatattggcgggccgaatggaa

SEQ ID NO: 30619 - DNA, 309 bp, Caenorhabditis elegans
atgaacatttctagcaatatcactactagtttctcaagttttttagatgatttgtgcggtgagggaatcccacttaccattctcagtgctccagtgacttgcaatccgtcaatcagcagttgcccagatggttagtgtttaatctttaatttttctgatttctcaatcaatttccaatttatttcaggatacagttgtcaattctatgaacgcaccgggtcgagctactgctgccagaacccgacaccaaccgcaaagagctcgactgataagattaactgcggagagggacgagttacgtacatcgag

SEQ ID NO: 30620 - DNA, 527 bp, Caenorhabditis elegans
gtatcaaactggtttggaaataagcgaattcgctacaagaaaacaatggctaagaatgaggatgaaagaagagaaaacagaaaaccagaagatcgccctccgcctggagctcctggagctccgtatagtctggtacccaacgcgtttgcaggaatgatgaacccatatcagatgatgttacctggtcatcaatttcccatcggtgttgcccctttcaatttttccatgtacaatcctgagatggtaagttttcatttcaaatactgtgaacttgcaaaaatagagcaatatatgtagtttgtttcaaaacccggatttttgttaaacttgaaaaaaaactcgttcttggatacatcaaattctggaaacgatgtactccaagttgcgagcagctggaaaagttgagaaactaggttttttcttactgccagattttgaaatcatgcatattccgaaaaaaacagttttctcattttcagatggcccaatatcaacagtctctacaaaacccaaatcaaactcgatga

SEQ ID NO: 30621 - DNA, 697 bp, Caenorhabditis elegans
attcgtgcgctcgattcacaacctcttctgaagtttacccgaacaccgaatgattccaacgtcacatttggtgaaaagtttgtgctctcttgtggagcgaacggtgctcccctaccatcaatttactgggagctcaatggaatgagaattcaaggagaggagacttcaaacgtgtacgagaacattttgaacgatggaaaacaagtctcaaatgcagcaatggtgtccagccattacagaatcccatgtgccacggcccgcaactctggggcttataagtgtatcatagataatgggcttaccaagttagagcatgttgcaaaagtatttgttggtaagttacagagcatagagattaaaaaatcttattttaaaatgtttaggtggaaacaaaaccaattgtgctttgaacgataatggtgccccatttatttcaatgactgtcgactttcgtttggaaatatctaacaacgcagttgccctatcatgccgttccgagacagctacagagtggtcatggcacaaaggagaacaacttttgaccaatgatggagagcgttaccagatgttccccagtggtgatttgattattcgcaacatttcctggtcagacatgggcgaatacaactgtaccgcacgcaaccattttggagagacaacagctatcacattcctctacccaactctagctaaataa

SEQ ID NO: 30622 - DNA, 461 bp, Caenorhabditis elegans
atgcgggaaacaattctcatgatggcttgggccatgattggcactgctttctttgtcttttttgctctaaaaatggggcttactgctggatacggaagatacaccaaccaggcacaatggggaatcaatccgaaactcgcatggtttatccaagagtctcccgcttttttcattcctttctatttcttgtttggtggactatcttcaactggacgtattttgaattgcatttttctcgttcattatttctacaggtttgttttatcgagaaaatgaaaaaaatcagtaaaagtagtttttcagggccttgatctatccgttccgcatccgatcgactacaaagtctccactcttaattgttgccgctgcagtagccttctgtacatacaacgggaccttgcaaggagtttggaattcctactatcaactggaggaagaattgacataccgtcatcttattg

SEQ ID NO: 30623 - DNA, 461 bp, Caenorhabditis elegans
atgcgcgagattcttctcacaatggcttgggccatgatcggcatggcagtcattgtcttcttggcattgacaagaggattcaccgccggatacggaagatacgccgacagatcgaaatatggaatcaatcccaaactcgcgtggttcattcaagaggctcccgctttcttcattcccctttactacctgagacgcggaccttccaattctggatatgaactgaacgctgctttcctcttccactactttttcaggtagaattagacaattcaaaaactttttaaagcaatatttggtttccagagcgttgatctatccttgccgcatccgatcgactacaaaatctccagtcgcaattgtcgccgcagcaacattcttctgtgcctacaatggatttttgcaaggatattggaatgctttttatcaaccggaggaaccttggaccacgcgtaaactcgttg

SEQ ID NO: 30624 - DNA, 365 bp, Caenorhabditis elegans
tcacctgaaagaattcaagaatccgggtataatttcaaatccgatttatggtcgactggatgtctgttatacgaaatggcagctcttcagtcaccattctacggtgacaagatgaacctgtactcactttgcaagaaaatcgaaaactgcgaatatccacctctgcctgctgatatttattcaacgcaagtaagtgcaaacctgtgttttgttcaacttaggtgttgaaacatttggaataagtgctttcagttttcaaattcgaaaaaatttttagctccgcgacttggtatcccgttgtatacttccagaagcttcaaaacgaccagagaccagtgaagttctacaggttcgttccgcgttag

SEQ ID NO: 30625 - DNA, 165 bp, Caenorhabditis elegans
atggacaaaatttcgaacatctataattttgacgatccaccaccggataaactcagcttggaactattcataatcgagaagaaaatcggaaaaggacagttcagtgaagttttccgtgctcaatgtacatgggtagatttacatgtggcactcaaaaagattcag

SEQ ID NO: 30626 - DNA, 753 bp, Caenorhabditis elegans
atgccaggacagtgcagcccttcaaaacatcaaaacatcagccgcttatccaggtattttttgtgaaattcctaaaaaaaaaatcaaatactttcattttccaggggtccgtgtcaaaagaagctgctatcgccacacattccgcgctacactttgacttgacaccagagaaggagaaaaagtgaacattttagatatctaaaatatacttcaaagattatttaatttaacatgtaaaaaatttacttcaataacagatcttcaaacttgtgcatgattcagcactagttatagtacttgagaaaaaattaaacaaaaatggaattgtttaaaaattaaaagtttgtcgaaacttttaaatggctcatctaaaaagcgcagaagctggtttagaaattcgattttcgatttttaatggcattttttaacgctcggtacaatttaaagagtttgggaaaaagtagtttataaatttactaaaaatgtgaaaacagtatcaaatgttggcgtttaagttgctaaattttgatgacaatttctgaaatcaaaaatgcattgaaacgtgactaaaattcaacattacggccgatgattaaatataacttttaaaaaattatttttttgaataatttatttcacagaatacgtgatatgtacgaccgtttggatgctgataacgatggcagcatagatattcgtgatctcacacaagccttgtcgctacaagcgcatatcccagctagtgtagctcca

SEQ ID NO: 30627 - DNA, 1048 bp, Caenorhabditis elegans
gtatgtatggaacaaagctagaaaccattcgcaatattcataagagtggaaaaattgcaattttggatgtggaaccacaagcattaaaggttctgaggactgcagaatattcaccatttgttgtgtttattgcagcaccaaacttgcaaggaatgcaggatgtaagtttgaaagttgttagtagaaattgcactgggaattttaagttaatgtaaaaaacgttgcgtgttttcatttttatggagtacggccagttggggaaataaataaaacccatattgtgccaaaataggtaaacgtcattaaaaaaaagtttcaaaacatgctggaaaatgtttatttcaaatcaaaaagaaataaaaactcagttttcacctatttttcagaagtcatcgattaaaaaagttgttccagttttatttgtttaattatttttaaaatattcattttccaacattgtaggggttcatcaatcatgcgaaattgctttagaatttttgaaaagtggctgaaacttagttttcaacagcctttgactcaagataaattgtttccaaaattgttccaaccgtttttcacgatttttgatcatttgatttgaatgaatttcagtaattttcacactggccctactccatctcctagataacatcagattggataaataaaagtgatcgagatttaaaaagaaaacggtggaaaaaccccaggttttgaaagtatcaatttattgctataaacgttcaatttttatggtttgaaaaatattatttttgttctaatcaaattatttaactaactccggtattctttctgaatgtgaagataaaattaagtacacaaataccaaaattttcaatttttccagccggatggttctttggaaaagctcttgaatgaatcggatgttcttcggcaagcttttggtcaccttttcgactttatcatcacaaacagcgatattgatgacacgattgctcaattagaacgtttagtcgaaaaattacccgcttacccgcaatggcttccagtcacttgggtctactga

SEQ ID NO: 30628 - DNA, 1048 bp, Caenorhabditis elegans; identical to SEQ ID NO: 30627

SEQ ID NO: 30629 - DNA, 302 bp, Caenorhabditis elegans
atggattacgaaaacgacccaggatggaagtaccttcgccgcagtcgcgaggagatgctccaggtacttttataaagcatggtttttttgtctaaagaatgttataagcttgcttagtttaaaaaaaaaaatcatctttataaattttcacttttttacttccatttttaaaggatcaatcccgcgcatatgactccaagaagaacgtctggatcccagattcggaagacggatacattgagggtgtcatcactaaaaccgctggagataatgtaactgtgtccattggacagggagccgag

SEQ ID NO: 30630 - DNA, 3257 bp, Caenorhabditis elegans
tccgttacaactgcttgaactggcttgagaagaacaaggatcctcttaacgacaccgttgtcaccgttatgaaggcttccaaggagcacgctcttattgttgaggtctggcaagattacaccacccaggaagaggccgctgccgctgccgccaagggaactgctggtgcaaagaagaagggaaagtctggatcgttcatgactgtttctatgctctacagagaatctctcaacaagttgatgactatgcttcactctactcacccacatttcatccgttgtattattccaaacgagaagaaggcttcaggagttattgatgccggacttgtgcttaatcagctcacctgtaacggagtgttggaaggaatcagaatttgcagaaagggattccccaacagaaccctccatccagactttgttcagcgttacgctcttcttgctgccgatgagtctatcattggaaagactgatgccaaaaagggatccgctcttatgcttgctcgtttggtcaaagagaagaagctcgaagaagagaactttagagttggtctcaccaaggtcttcttcaaggccggaattgtcgcccacttggaagacttgcgtgaccagagccttgctcaactcatcaccggacttcaagctcaaatccgttggtactaccaaacagtatgtctatttaataatacaaaaatgttcaaataatgattttttattacagattgagcgcaagcgccgtgttgaaaagatcacagctcttaagatcattcaaagaaacattcgcagctgggctgagctccgcacctgggtgtggttcaagctttacggcaaagtcaagccactcgttaactctggaaagatcgaagctcaatatgagaagcttcaagagactgtagctactcttaaggacactgtggtgcaagaggaggagaagaagcgccaactccaagagggtgcggaacgtctcaacaaagagacggctgacctcttggcgcaattggaggctagcaagggaagcacccgcgaagttgaggaaagaatgaccgccatgaatgagcagaaggttgccctcgaaggaaagcttgccgatgccagcaagaagctcgaagttgaagaagctcgtgccgttgaaatcaacaagcaaaagaagcttgtcgaggccgaatgcgctgacttgaagaagaactgccaagatgttgacctctcattgagaaaggttgaggccgagaagaatgccaaggagcaccagattcgtgctcttcaagatgaaatgagacaacaggacgagaacatctctaagcttaacaaggagcgcaagaaccaagaagagcagaacaagaaactcaccgaggatctccaagctgctgaggaacaaaacttggcagccaacaagctcaaggctaaactcatgcaatctcttgaagactccgagcagaccatggagcgcgagaagagaaaccgtgctgatatggacaagaataagagaaaggccgaaggagagctcaagattgctcaagaaaccttggaagagctcaacaagtcaaagagcgatgccgaaaatgctttgagacgcaaggaaaccgaattgcacaccttgggaatgaaactcgaagacgagcaagctgctgttgctaaactccaaaagggaattcagcaagacgaggctagagtcaaggatcttcatgatcaacttgccgatgagaaggatgctcgccaacgtgctgatcgctcgagagccgaccaacaggctgagtacgatgagctcaccgagcaactcgaagaccaagcccgtgccaccgctgcccaaattgagctcggaaaaaagaaggatgctgagcttaccaagctccgtcgtgatcttgaagagtctggacttaaattcggagagcaactcactgttctcaagaagaagggatcagatgctattcaagagctttccgatcaaatcgagcaacttcaaaagcaaaagggaagaattgagaaggagaaaggacatatgcaacgcgagttcgatgagtcctctgctgctcttgaccaagaagccaagctccgcgctgaccaggagagaattgccaagggatacgaggtcagacttcttgagcttcgtctcaaggctgacgaacaatcccgccagcttcaagatttcgtctcctcaaagggacgcctcaactccgagaactccgatttggcccgccaagtcgaagaattggaggccaagatccaagctgccaaccgcctcaaactccaattctccaacgaattggatcatgccaagagacaggccgaggaggaatcccgcgagagacaaaatctttccaatttgtcgaagaacttggctcgtgagcttgaacagctcaaggaatccatcgaagacgaagtcgctggaaagaacgaggcttctcgtcaactttccaaggcttccgttgaactcgatcaatggagaactaagttcgagaccgagggactcattggagccgacgagttcgatgaggtcaagaaacgccaaaaccagaagacttcggagatccaagatgctcttgatgcctgcaacgccaagattgtcgcactcgagaatgctcgcagccgcttgacagctgaagctgatgccaaccgtctggaggctgagcaccatgcccaagctgtctcttcattggagaagaagcaaaaggcatttgataaggttattgatgaatggaagaagaaggtcgatgacctctacctcgagttggacggagctcaacgcgatgctcgtcaactttccggagaagctcacaaactccgtggacagcacgataccttggctgatcaagttgaaggacttcgtcgcgagaacaaatctctcagcgacgagacccgtgacctcaccgaatcactttccgagggaggacgtgctacccacgctctctccaagaaccttcgtcgtttggaaatggagaaggaagaacttcaacgtggattggacgaggctgaagctgccctcgaatctgaggaaagcaaggctctccgttgccagatcgaggtttcccaaatccgtgctgaaattgagaagagaatcgccgagaaggaggaggaattcgagaaccaccgcaaggttcaccaacaaaccatcgacagcatccaagctactttggactccgagaccaaggccaagtcagagcttttccgtgtcaagaagaagttggaagccgatatcaacgagctggagatcgccctcgaccatgcgaacaaagcgaacgaagatgcccagaagaatatcag

SEQ ID NO: 30631 - DNA, 417 bp, Caenorhabditis elegans
ctggatttggtcagtgacgttcaacattctgagggactatgaatatttgccagagctcatcaaaactcaagaatatatctttggaattgctacacattgcattgcaatgacctcaacggtaagtagtgtttaatgtgaagatacggacgttctagcaaaaatactatttaaacatttttggctttagactcttctgaagttagtattcaggtatggaacccgttactctacgcagtgctcaacctccaactgcgtgcagcattcattgacctgatgcctcactggcttcgtcgtcatttaaacctggaaggagacaacagctctccattgctcaaccatccgacgatgacaattacaaacaagtacggatcaactgcaacaaaggtaaacgcccgttcgacgacactatgcacgtga

SEQ ID NO: 30632 - DNA, 181 bp, Caenorhabditis elegans
atgctctcaaaaaaatgcaaaagtacatactaattgaatttttgtgtcattttgtatacatgggaagaacacactcgtctctggtttgtcgccgtggatgatgaagatgagcagaaagccaacattgatatcgttttcgccgccggcgatcatgaagacggagagccgttcgatgggaaag

SEQ ID NO: 30633 - DNA, 3602 bp, Caenorhabditis elegans
atgcggttactgacgtgtgactgtacctttatgggccaaaaacacaggtgagcccttgtcactgttttgctccaaaattattgcttgatatcaagatactcatgtattgttgccaatagattttcgtattacttgatttctgtcgacaactgattctacatattcttggcgaacggtctattggctaattaggctcacttccccgctctttctcgagctctcttgagacattgaccagtattctatcagttatttattgaaactttcaaaacttctaccgctgctgtccaaaccgtttatctctacatcgagatgggtggacgttcgtcgactataatgtaggtgatgataccgtttccaaaaagtatgcaccaaattgcaatgacataaaacacttataataatccagtaagtgtcgagccattttgactatgtgcataatccgagatggagtcctagaataattcaggtttgtgtagaaacagaaaaaaaagagtatttgaattttcataaaacacctgcaaggtgacgtctctcccaagtaccgtggaaatgttgaagtttgttctcaaattcttgtgtatggtaccatgcaaatcaaggagcatcaagaaatgctctcaacaaccttttcagtaattgaaggggtgtatgaaacatttgtgatagtgggaaaaaataaatttcggaaagatcatgcaaaacccctgaattaaaatttgggctagcctataatttgaagatttgagataaacgtttattttaataatcccccccccccccactaaaaattgataattcttgaacaattaacttttttagtgaacaaggtaaatccaatgttgatcttgtttttaaaattgaaccaccccaaaaaaaaacaaacatcttatttaaaattcataagccacggtcgttcgccgtcgcccacacaagtttttcacacatactagtagttgacgccttaactcaataaatatcaccaccgaatgtatatttagatttcttattcctatttttagcgtttcggacaagggattcgaggtcctctctcctattttcgtggtggttgcgtgagaaaaaagttgcggagaggcgttttattgcgcttacaacaacttcttgttgtgttgtgacgtatcacttggcaccggaaaacggtttgcgtgccttcccaatttttttcaatttctgtgcttcgaatggaaactgtgaagcttcgtacggagttcagtgtgcttgaatttcttccataagttcatgaatctttgattggataacattcagttcagttttcttgctattcataactcttctcaatatacacattttctaactctttctaaaaatgttttttttctttctcacgtagtacttcaacttttccaggtggagggtacagatagtcaatggaaaagaagagcagccattggtgcccggatctttggtatgagtaatgggaaaaaaatagattaggaacataacaaaagggaaattatttgtttctattgtcctgacagaacaaaattcatcacaaaaaaagatgaaggagattagatatgtattatcatttcatttcaaaaagcttgatatatctaaacgccgtatattcattcctgttagacctaaaccagctcacagtcttgctttcctttaaaaggtccactaatttgtaggtggaactatatgcgaagtctctctctctcacatgagttgggcgtgtgatataagacagcgcatttctctctcgctttgtgctctatatctcattgagctcgctggcttcattctcttcttctgattcttattctcttgttcttgctagctacctgttcaacttcatttttaactatgcccgatcatcctccaaccgggttctcgagttatctacggaaacttagcttcgccttctgcggttgctgtactgaacataggaagtaagttgaccagtcagatgttgttttgtatttatgttaattaacaactagacatacgctcatttttttgttttcaattttcatttgtatcgtattattttccctgtggaacgtagcttctaatttccgtgaacaaagtttcgtctcaagtatatcaaaataactggcatttttctcatataccagtttactcgcgttgtgttatgcctcgctattctaaatttctcctggtactaaaagcatatacaagatatagaaggtatagagtttctttggtatgccttttgaacaagaattccaacgaatgttggaaaaggtcctagacctaccaccacatcacatatcatgtttcaagttactcttcgaaagctgaatcttgcactttgacaaattcaatgtttgtggatgatttgaactttttgaacaataatctctaagtgtctcaaaaaatattgtgatttcatttcggatgctattctcacggttcaaattttcatgactttcacaaggtcattttagcggcttaaaatcgtttttagattttcttagaaataaaccggaaaaagtgtagttttttagtttttcccagtgacgtctcaaaccgtgggaatattcagtgtgttttgcaaatgtgaagtaagaaaaaagtgggaagaaggaatgggtttaggattagatttttcttcgtttttttttcgttgttaaaatctaattgaatacgtgtctgtgcctttgatccccaatttgaacaatcttcaatcaagtagaattgcatatatacacaaaaaatgctcattcgtcttgctcttgccaatcccatatgcttggcttcttcttcttcttttttccaatataatatccaggagcatatgaccgaagcgattaatccttgactctgttagagagcgaagacgctcctaatcctatcgctcttgtttgcctctctttagaaaaagaacctcttcgaatttctgagccatcagtgcgtttcatttttctacaagatattgcaagtgtagatttttgaagaagtagaaattatctgtagaaaccagcccgtgaaaaaagaaaaagtaacagcttattcattactaataccctggactttttgcactaagtctccgtgctcgcctgcttcggctccgcccaaccaatctccccactccacgtcttctactagtttttttttctggagagagcagcagaaggaaaaaagaaacaaggaaagaagacaccctttttcttattttttctcccttttctcctgagcaagctacaaggctcgtcgaatccgaatccgaagcagcagccgccgttgctcttctgtgtctcaatttatcaattattcatcaacatcatctgccacttcgctgaagttgggagttgaatttgaattccaacatttcgaattcagtttttgtttctcgccggcacaggccaacattatccaaactctgtcaaaatagggttcctttgtgattgtggtgacaaaatgggagcagttcttcggaactgttttcgcaataattatgagtaagttcaggaaaaaattacgagtttaacaaatagtttttgatatcaatattgctttgaaacgtttataatactatcaattttcagcggaagcgtctcggtcgaaaagaaaaaccaggaaaacgatggccc

SEQ ID NO: 30634 - DNA, 237 bp, Caenorhabditis elegans
gctcgcattatctacgaagatttcatctcgatcctttccccaaaagaagtttcgttagactctcgtgtccgtgaaatcgttaacaccaacatgggacgtccatctgcctccacctttgacgaggctcaaaaccagatctacacccttatgcaaagagacagctacccacgattcttggcctccaacatctacaagaccgtgatgggcaccttcggaatcaaggaggaagccgtttga

SEQ ID NO: 30635 - DNA, 510 bp, Caenorhabditis elegans
atgaagtggcgtaagaatggagatgcgatcgagccaattgatggaattccaatggagaatgggaagaagaaagatacagtatgttctcaaacaaattaaattgttcggtctaaacttgatggcattcaaatttttcaatcttttcactcatcatctctacattttcatagcagaaatatttgtgataaagtcgaaaatcactgaaagttgtcaagataaaacatagggacagaactaaaatgatagttaaaacgtgtattaagatattttttatacaaattacgcaaactagttttttttaatttttagttgttttttcttgtatctaaaatattttgattccagactgtgaatgtgtcgactgaggatgtcggttccattgactctgacgaagagccaaaaattgtttacgaaccgtcgaaaatggagaagctgattaattacatgttgtgcagaggtgatttggcaagcagggagctttctgtcaaacctgtcacacttcttggattg

SEQ ID NO: 30636 - DNA, 421 bp, Caenorhabditis elegans
atgccaccacaagaaaacacggatggttctggaaagaatctatctagtttgagaacggtaggaatcatttcttaaagttacgtttttccatgatcctctaagatgttgggaaattgaaaactatttgctctttataaagatatttgaaaatacaacacaatcaaatatgatttttgtgttgtattttcaaaatagtatacaattggaacaaaaataaaactgaattgattatttgtgagagtatttaaaaaaagtttcaattttctgaaattacattccttttttttcagaaaattgatttcgatgagaaaatatctgctacgagcttctccgattcatcatacaacgatgacgacaatgataagaaagtggaatactatccatctgtatttgaaaaattcgttaactttttactctgcag

SEQ ID NO: 30637 - DNA, 1556 bp, Caenorhabditis elegans
tcagtcttgtttgctgttgtttcggaaaacttatcaatgagattccgcgtccaatcattccgaaatcttctctaccaagatgcttcatacttcgataatccagctcatgccccaggaaagctgatcactcggcttgcatctgacgcaccaaatatcaaagctgtcgtggatgctcgtatgcttcaagtcatttatgcacttgctgctattattgcaaacattgcgattgcgtttatctactgctggcaaataggaatactcggaacatctctcatcctccttcttgcgtttgtcatgatcgggcttgcttacaagatttctctcatgaacgtcgaacaaatccaaaatgatgatgcaggaagaattgcgattgaaatcattgaaaatgtgaaaactattcaactgctcacaaggtgtgagcttttctttgatcactaccaaacatcatccaagcaacaaaagagatctgaactgaagaagggaatgattgaagccatcaattacagtctaactcaatctttcatgtacttcatgatgtgttttacatatgctgttggtatcagaattatttatcaaggagacaaatcttccgatgacactttcaagggaatcattgcaatgatgttgggtgccgttgcagtcatgaattcggcacaatacttcccagaatttgtaaaggctaaaactgcagctggaatgttgttcaacattatctacagaaaacctagaacaggagacttaatggaaggagatcgccctgaaattagaggaaacattctctttgaaaatgtcaaattctcgtatccacaacgaccattgcaaccaattatgaaaggacttcaatggacagcacttcgcggacaaactgttgctcttgtcgggccatccggatccggtaaaagtacgaacattggtatgctcgaacgattctacgatgttactggcggagcacttcgaattgatggacaagacattcgaaaattgtcactgttccatctcagaacacaaatggcgctggtcggccaagagcctcgtcttttcgcaggaaccatccgcgagaacgtgtgccttgggttgaaggatgtgccacttgaaaagatcaatcaagccttagaacttgccaatgctaacagattccttgccaacttgccagccggaattgacacagatgtaggagaaaaaggaggacaattgtcgggaggtcagaaacagagaattgcaattgccagagctttggtccgagaccccaaaattctgcttctggatgaagccacgtcagctttggattcggaatccgaaagggtatgttgaaaatgaaacgctatctcttaataattatgatcgttttctttcaggctgtacaagaggcattagatcgtgcccgagaaggtcgtacgtgtatcacaattgcccatcgtttgtcgtccattcagaactctgaccttattgtgtacatcgataagggcaaggtgcaggaagctggcaaccacacgcagttgatgcatcaaaagggcagatactacaagctcatcaagaaacaagatcttgctgtttaa

SEQ ID NO: 30638 - DNA, 515 bp, Caenorhabditis elegans
gtgccaatggagaagatcaatcacgcgttagaactagcaaatgcaaatcggttcctggctaatcttccggcaggtattgagactgacgtcggagagaagggatcaaaactttctgggggacagaaacagagaatagcaattgcgagagcgttggttcgagatccaaagattttactgctagatgaagccacttcagcattagattcggaatcagaaagggtatgtgatattattgtttttaacataaagatgatgtaaaggacacaactagtacaaatatcaaattaggaaaatgagtaaatcgagtattccaggctgtacaagaagctttggatcgagcacgagaagggcgtacttgtattacaattgctcatcggttgtcttcaattcaaaattctgacgttattgtatatattgaaaatggacgggtgcaagaagctggaaatcataagcaactgatgagcaagaagggaaaatactatgagctgattcagaagcaagacttgggaatataa

SEQ ID NO: 30639 - DNA, 199 bp, Caenorhabditis elegans
atgacgtgccgaatatctgccaaagcttgtggaattggccaaaaatatattgaagtaagatttcatctcattgtttctttcttcatttcttctcattccaggcagattgtttgttgtcagaccaagaattaaaaaggttgaaagaacacaagtactcagcagttgacaacagttggttggacgagttgtgtatgaaaag

SEQ ID NO: 30640 - DNA, 694 bp, Caenorhabditis elegans
ggtacctcagtcctcttcccactttttccacttttgatggttgtcattccgttcatcatgatctacaataaaactgaatccacagttttcgacgatcatatcacgctattttcattgtgttttggagctgtcggtgagtcgggaccccttgttgacattttagtatttctaacattctcgggaggtcgatcaggtttccggtagcagctactacgtaggtgcctggttgacatgataattattgtccagttcctggaaagccgctacgtaggaggaaaaggatgttagtttacgagtttggatattaaagttcagaggttaaaatgtaatagcctagattataagctttgtgtaaataaaatacaaagtgactgaaaaaattaaaaattcaggagccaaagcgacaaaccgacttgttattgctcatatgtcaaaaagtgagctcagactctgggattggatctacgttggaccattggctttgatgctcaaccaatattacgattttgtgtttgacgaatacgtcttgttatggattgcgacggtaggttttgaaaatttttttgtccatcttgcaggcattgttcaaacattctgtttggtttttttttcaataatagggaatttaaaatcagatttttgttttttgaaaacaaaaccgcactactgtgagaaaattgcacaggtactgtag

SEQ ID NO: 30641 - DNA, 224 bp, Caenorhabditis elegans
atgttccgcgcaactcgatgtctgcgacttccactcagaaactcgcatattaatattctccgcccaacacaggtaaaactacaatacctctttaaaattaaaaacaaggagttgcagacggaacttattaaaacgagatcatcagcattggcaccatacgagaaagtaagcccaatcacagcagtaggagcaactccagttggagttggaaatggaaattactg

SEQ ID NO: 30642 - DNA, 290 bp, Caenorhabditis elegans
atgaagtcgttcatccttgggcctttgggtctcctggtcgccatatgctgtctctaccaaccggcaggtttgaatgtggtatagttgactgattaattttaatgatttttgtagacgccgctcttgctgcaatgtcaatcgacctgggaagtcagtttatcaagattggattggttaagcccggcgttccaatggatattgtgctgaataaggagtcaagaagaaaaacgccaaacgttatctcttttaaaaatgacgaaaggttttttgctgaggcggctgcagctatg

SEQ ID NO: 30643 - DNA, 822 bp, Caenorhabditis elegans
atggaaaacatcaaggcatcaaccgaacaactctgtgctgaggccaacattcaacgaaaaaaagtttccgaagtttcaaaggagtaagttattttttatgagcaaaggtgatttacatatgagaataggtatctatttttagtattgctactccgagacgttatttggataattctcattattaatgtaaaaattgcacatttcttgttggtattttttttgtctaaaagtgtactttatatcctaaagaaagtgtgatacgtaacatcgtaatatggcataatttgctccagttctttcatcaaactgtggccaggttcattaactgtggcaagcactaaactgtagaaataatgaatgtcgatattttattggtaggcattctttcaacgattttctttttttttttggaaaatcaataacttactcgaaaaatcttcaaggcaatcgaaaacaacgcataactaaaattaggttacacaaaagtatagttttgaaatacttcacaattttagtgatatttagagtacataatgtcgtcacaaccatttcgacagaaccgacagaacgacaaaattgtttcagatgtttgaataatttaaaaacgaatcgaatttttgtaaccatcgaaaattacaagaatatatatgacaatgtggaatatcaaatagcaaaagtgaaatatttacttatatgcaatcaaactataatttcagactgctcgatttttgcgagaagaacaagaccaacgacatgctggtctccgggccaaccgatcagcacaatccattccaagagaagaaaagctgttcagtactctaa

SEQ ID NO: 30644 - DNA, 977 bp, Caenorhabditis elegans
atgaggttattcgtggcgattatcctagccgccgttattctcttagtttttgcgttaggtatatttttgcttatcccgttcccaattgccatatttcagtctattgttgactcgcaagtttatttgcagtaagttttttttttaaattttagttaattttagggtttttcaattctttaatgtgagagtcgcaacttgtgacctcgatgaattttggctacaatttggccagcaagtctccaaaactagttaaattaatagtaaaatcagaaactgaatgcggtatttttgcaaaaatttacttttatttttatagttttgttgtaagactttttgatatctgtaagataaatttagcagttttagtaattcagcattaatgttttgtttaaccgaaacaattacattagatcataacttgaaaaaaaatttttttttaaattacgtttatacctcgtcaaaatatattcaaaaaattttacattctcccaaattcaacacgaaactggaaaattttagttgaatcaaattttggttaaacctgggacaacctgaacaagctttgcgaaaaaaaaaattcagtctgtagaacatctgaagcattaattaactttccaaaatgacttacaaaaattaagaaacatttcaaattgttcaaactgtgtaaatattaattcaacttaatgaaacatttgtataatacaaatggtcattttattcaaactaccatgtaaaaaattattttgactggcttttttgattttcgatgaatttttagcaattagtgcaataattttttaacaaacacattacagacaaaaatcagatggtcaactcccaacgggtacattttactggtcgaaaatccctgcagttcaaatctggacgtttcatcttttcaacgttacaaatcctgatgaagtactctattatggcgccacgccaaacatgcttgaaatcggaccatatacctacac

SEQ ID NO: 30645 - DNA, 261 bp, Caenorhabditis elegans
atcggtgattgtgaatcccttcctttacggttactgtaatgaacactttcgtgctgcatttgcggctcttcttgacacggtgaaggcagcttgtggaatgagacgagtgagtccggtacgatagctattttccttcgaaaagaaatggttttttaaaacatacaatttcagggcaatccagcgtgctcccagctactcagtactcactttgaaagcaccacaagacgatccgtgactaccacgattccaagttcaatttaa

SEQ ID NO: 30646 - DNA, 336 bp, Caenorhabditis elegans
ggacttgtaaatcaaatcgaaaattttgagttgtttccaaaatgtgtacagtctcaaacattttcgagttgttatcaaaaaagaattccacaaaatataaatttgcgcgcaatcatgcaattgaaactgagtcaaaacacaatggatctgattgtggcatgggctgaaaatggagtgaatgaagaagcgaaattgggaccaaaattgatgcttgggtgtagcactaaagaaaacctcaaaaagtgagataatccgacatatttcaattcattattatacttaattttcagaatttctgggaagctgggtggaaaacaaatgaaatgcaatctctga

SEQ ID NO: 30647 - DNA, 434 bp, Caenorhabditis elegans
attgaagaggtaaatgatatcgatatattttcgaaatgtggtccttttaaagaatttccaaaatgcttctttaatgcattcaacagctatgatcatttttgtgcttctatgaaacttgatttgagtaaaagttcaattgatcaaattgtttggtggctgaaatttgatcaatacaaatcgatgctcatttcaatgttacattgcctaaatgaggattcaatgcaaaagtgaaaatttgatacttgaaactgaaattgacctcaatagatttcagagttcttcatgaatttgttgatgtatcagaaaccccaggtccagaaaatcctcacaacaagggaaaattgtcggatagtcaaggaaaaacaagagcaggaaactttttcaaattttctgataaatctcccttttccgagtttctcaaaatgcaaaagtaa

SEQ ID NO: 30648 - DNA, 238 bp, Caenorhabditis elegans
atgggtgccggggcaactggtttacggggagcgcgtctctcgccagaggtcaggattttacattttgcacataggattttattctgaaatagaatgtttaggaacgtgcaaatagttcaaaatcaagagctatcgatcgggcgttgtcaaaagatcacacggatgacttgaacagatttaaaattcttctacttggcacggcagagagtgggaaaagcacaatattcaagcagatgag

SEQ ID NO: 30649 - DNA, 748 bp, Caenorhabditis elegans
gagttcaaccagtgttcaacactcttttcgaacagaagaaggtcccatcgaatcttttctcattttggctcaaccgtaacccagactctgaaattggaggagaaatcacttttggaggaattgactcaagaagatatgttgagccaatcacctatgttccagtcaccagaaagggatactggcaattcaagatggacaaggttgttggatctggagttcttggatgctccaatggatgccaagcaattgctgataccggtacttctctcatagccggaccaaaggctcaaatcgaagccatccaaaatttcattggagctgagcctctcatcaagggagagtacatgatcagctgcgacaaggttccaacacttccaccagtctcttttgtgatcggaggacaagagttcagtcttaagggagaagactatgtccttaaggtttcacagggtggaaagactatttgcttgtctggatttatgggaatcgatctcccagaacgcgttggagagctctggattcttggagatgtcttcattggaaggtgagccatatcttttctcaaattaaacattgacgaacccaatgaaaaatcaggtactattccgtcttcgattttgatcagaaccgtgtcggatttgctcaagctaagaccgccgatggccgtccagttgatccagctccacgaccattccgttctgtcttcgacaacgaaagtgaggaatccatggaacaagacgacgaataa

SEQ ID NO: 30650 - DNA, 522 bp, Caenorhabditis elegans
atgaccacaccacgatctgcgcccttgtacaaactgaagtcagaggatggtcaaatttttaatgtcgaacgaggaccaatgaaattttgtgcatttatcaatcagaagtttattgaccatggagtgaacgacagaaattgtgaacgagcagatccaattctcgttccattccactcatcgattgttcaagctgtaatagagtggctttaccattatcaggacaacccgctcgcccgacgagactccaaaattcgttaccacgatttttccgaatgggacaagcagtttttcaacgtggaatcgggagttctttttgcactactcaatgcttctcatgcgcttggagtcgaagatttgatgaatatggggtgtgcagccgcagcagaattgattcgaggaaaaagcacggaagaaattcgcaagatctatggaatcaggtcagatgaagaacaaatggaggaagcgttggcaaatggtggagagggaacatctgcaatgacattcacaacggattctgattga

SEQ ID NO: 30651 - DNA, 756 bp, Caenorhabditis elegans
atgcaagttgaagaacctgtaatactctacaaacttcggtcaacagatgggcagagatttctggcagataggcgaacaatcggaatgataggacggattgaggacctatttagaaatgctggattagacctgattcctgccgatcaactgcagccaattcaactagaaatccctgcgacagtgatgaggaaagtgatcgagtggtgcgaccatcataagcacgacccgccctacgacgaatctgaaccggaaaccaatgatattcctgactgggatgcgtcgtttctgatggtgaggcacaacatgctctttgatataatccgagccgcgagggattttactgtacctggtctcttcgccatgtgctgccgtgtcgtcggacaaaatcctagagagattattgacggattggtgaatgatgaagaggaggagcagccagtatatccagtggtggctgcagcggcttaggaatttcatttcagatgtgtggtgtttcgtatggtatgggaaaatttagactatttgttttcatttcagtaaatatttgaagtgagaaaaatgtaatcataagatcaaagttgagcccatttttgaaatttttgtgataatttgggcaacattttagcaaaagtattcttcgtcttttatattttacagaaaaaatgcaaaaaccatactaattttgtaaacaatgcaactttatttttcaagtttgaatcaaaaattctcttctcgattccctacaaaaaaacttaa

SEQ ID NO: 30652 - DNA, 417 bp, Caenorhabditis elegans
gcaaagaggaaactgaaattcacggaaacagagttccagctggttcattagtttttgcgcaattgtggtcagtgatgagaaatgacacagtgtttgaagatccagaaacattcaatccaagccgctacttacaatccgatgggaaaacgtttgataaggtagagcatgaattaggaaattgaattttaaaaaatgtgtcttgtatttcaggctgttcttgaaaaaacgatcccctttagtattggaaaaagaaactgtgttggagaagggcttgcaagaatggaactattcctgattttcagtgcactaattcagaagtatgagtttgttgccacttctaatattgacttgactccagattggggagttgttttaaccgctaaaccttacacttgtaatattattcctcaattttaa

SEQ ID NO: 30653 - DNA, 421 bp, Caenorhabditis elegans
accgagatgacattctacttaaagggaagaaaataccaactggtacccttgtatttgcacaaatttggtcagttctgaaaaatgacccagttttcgaagagagctctaaattcaaccctgatagatatttaatggccgatggaaaaacaataaataaggtaaaatacaatcaatagttgaagtatttcgttcaattaaaattttatttcagtctgtattagaacgaacaattcccttcagtgtcggaaagcgaaattgcgttggagaaggattggcccgcatggagctcttcttgatttttagtgcattgatccaaaaatacgagttcattccaaaaactaatattgatgtcaaaccggtctgcggagcagtcctcaccacaaagccatacatatgcgagctagttcctcaggctgcttaa

SEQ ID NO: 30654 - DNA, 191 bp, Caenorhabditis elegans
ccatcccgttcagtgttggaaagagaagctgtattggagaaggactcgcaagaatggaactctttttgattttcagtgcactaatccagaaatacgaattcattgcaaacggtccagttgatatgtcttatgattttggtgcagtattgactatcaaaccgtatacatgccaactgaaagctcaattttag

SEQ ID NO: 30655 - DNA, 225 bp, Caenorhabditis elegans
gcaataaggataccaacgttttaggacaaaacattccagccggcacaaacgtgcttgttcaagcatggtcggtcatgagaaacgaccctattttcattaatcaattgtcatttaatcccgataggtacctgatggctgatggtaaatcgttcgataaggtgaattaatattccctacatatattttttacaacatcactctttttacagaatattctagagaaaa

SEQ ID NO: 30656 - DNA, 312 bp, Caenorhabditis elegans
ggcctcactttgcaaattttctgtcatacgctggtttacgttcctatttttgtgtgctcatcaattagtctggtgacaagtaagcttcactgttcctgctggtttcttaataaaatattttcagaaacagaatacattttcccgcagtatttcatatttgttttaccgcatctaacaactgtcatcgatccggctgtaacaatgtatttcgtgacgccgtatagaaagaaattaataatttggctgcgattgaaaaacaataaaatgcactctattgcgcattcgacatttgtagtttcagtcaaccaataa

SEQ ID NO: 30657 - DNA, 1083 bp, Caenorhabditis elegans
ctcttgttcgtgaagcaacgggaggctacaccgtggtgtttttcatttcgggtatttttgctctggcctctgggttctttggcttcatgttcagctacgaaatgaataagaggaacaccggcgacaaagattcaattgaaagtggaaaaccgacggagtaagtttactcggactgcctctgaactaatgcaaatttaaaaataatttatattataaaaattacaattttcaattatttttcacaaacttggaatttttgaaatttttcattatttttagtaaattcggctggataaaaaaaaattttgtgctcaaagcgttatacaaaaaataaaatccgagaaaagccacctaaaactgttttggtttcgttggtacaaaatttgggaaataatggcttagtttttgctagcacctcaaatttaatcagttattttgtcgttgaaatgaccgaataccataattaatgaactgtagtggggtcggaatatgcgacattaattgggatttcctcaaaagcttatacttctcatagtttcggcattttgccaaagctttgaccagaaattatgaaaaatctaggatttttttgaatgtttttatgatattcggtcattttggaataacataagtgtatttagacaaaatacccactggcgctactccacctttaaatgttccaagattaacatttttaacgaatcacactaacaaaatatacaaaaattcgataaaaactacattccggtttctgcgacaggttttagcaaaattaggttttaaaaaaatttatcctcgtttcaaactaccagggcttacgcattttgaaaactaaacaacgttaatgcaaaaattaaattaaatattcaatatttctatttcacgaaaatccgaccaaatagaaaaatgctaaaatttttaatgctttccctgtttgtgcagttttcattttgatatggattcaaagttattaagaatccagcttgaactgacaaatatctatgtttcaggttaacgaatggcaataatcgacaaacaagtaccggatcaggagctgaacaagagactcttcttgatgtgtga

SEQ ID NO: 30658 - DNA, 519 bp, Caenorhabditis elegans
tggacacgaactccatactacccattggcaaaggcagctcttgaccaatatacaagaagtgcagcgattgctttaatatctgaaggtattcgcgtaaacactgtgaatcctggaattgtgcaaactgggtttcaagcaaatgctagtggttcatcgtcagatgatgcacagaaggtatatttttaacattttacacatatatattttagtaaaaaattacggctttcccaattatgttgtttcacctaccgccaaaaaaattgaaaatgtcgaataacttcaagctttcaatctgaaggtattttttaaacaaagttattatagttttacgacgacatgggctcaaatacaactgcaattccatgtggatttgctggacgtccagagcacatcgccaaggctatcgcatttttggctgatcgaaattcttcagaatacatcgttggtcaaaatatcattgcggacggaggcacaagcttggttcttgggattcatgggcctgctggcggcaaaaaatga

SEQ ID NO: 30659 - DNA, 294 bp, Caenorhabditis elegans
atgagatggacgccacaattactaataagtgttttaattggttatgttcaagcaagactagaaatcagtgagctgaggtttaaagatatattagtaagttgaatatttcgcaacattaaaatttgaaaaaaaaatctatctcagagctctcactacattttcaaacccctggaagtcccttgcaacgaaagtctctgcactggacctctctcagaaatctattgccatggcccaattttaacaaattcctggcagtttggactacagaaaacatgtcctggagacaaactcaag

SEQ ID NO: 30660 - DNA, 526 bp, Caenorhabditis elegans
gttgtcactctttggtatcgatcaccggaagttcttcttcaatcctactacaacagtacagttgacatgtgggctctcgggtgcattgtatcggaaatttactgccgacagccactttttgtaggccaaaacgaggctgagcagttgacagacattttcaagtaagttttacaagaaaatctaaaatttagtatgtatgtttaaaaaacccgtaagattgcctaattacagaaaaactgcaatattgaacttatattaattgttcaggaaaatgggcaccccagttggcaaggattggccgagtgaatctgtcatcgcccgagactcattcccacaatatcgcccgaccaacctcaaggatctgagcccgcagatgtcaaaacaggcaatcgagtttgtgcaacagtgcctgagatatgatcattcgaagcgactttctgctcgtggagcattgagccatccgttcttgaagcctgcggtggcaacaaaatctcgtgttctcaagcaaatcaacttcaacaagtga

SEQ ID NO: 30661 - DNA, 526 bp, Caenorhabditis elegans; identical to SEQ ID NO: 30660

SEQ ID NO: 30662 - DNA, 126 bp, Caenorhabditis elegans
atgtgcgagaatctttatggagaggagtacaaaatggagatccttcgactccaaaaaatgatgaataatatgacttgcggacagatggcaaaacccttgacaatgaaggattttcaaattcatcag

SEQ ID NO: 30663 - DNA, 591 bp, Caenorhabditis elegans
atgttctcattcaattgggcactaatcctattggtcgcagtcggcggaactaatgcgtttaagataaaacggaccgcaaaggacttggagagccagctttatgaggatttgctcttcgactataataaggttagttgcatgaattgtgttttttacgagcaagaagtattgcgtccaaggttattattaataattcagttctgtatcaaatttcgtatttctttcaaaaattaatgtgaaattgtcatttcttccgaatgaattactgatttttcaaaacgttttttaaatgtcatactgaaaatagataaactatattgtattataacaccgttttttccaaatttctggatttttgaaattacattgtcttaccgctcaaatatatcaaatgattgagatttgtacacaacaactctgcattttcaagtaataaaatattataaaatgtatttccgctatttgtaggtacctcggcctgttaaaaacagctctgacattttgacagttgacgttggtgcttctctcattagaatcatcgatgttgatgagaaaaaccaagtgctcaccacaaacttgtggctagaaatg

SEQ ID NO: 30664 - DNA, 518 bp, Caenorhabditis elegans
atggcgagccccatcagccattctaggtgagcactttttttttcaattttcaattttattcttagaaaaaaacaatccgtgtatcaaaaaaaaatattccagccatgaaaatgcgtccggcaaatacggatatggggatgagtcccaacatggaaagaacttccaccagaaggcagaacattccgggcatgaagcgaaggaaaagggctactctcaagatggaaaagccgctgaccacgacgcgcttcacaaggacgctgccgagcacaagcaaaacaaagaggctcaccaatctggatccggtaacaagtacgtcgatgatgcctcgaactacaacaaggatgtgaagaccaagactttcggattcttcgactaccgttacgttcaaccacaataccacatggagcagtaccataccgatgagaagcacgccaacaagtatgccggagatgagcacaacgccgggcaacagcacaaggacaacggaggataccacgccgacggacaccaaggatacg

SEQ ID NO: 30665 - DNA, 208 bp, Caenorhabditis elegans
gaacccttactatccgcatcgcacaagaactcaacttcgatgcgacccgcgggaatatcaccaacgtgtccacgtcacggacgtgccgcgcttgcgcttcaaaatagccggtaagtgattgcagcgtgttcttttcatactgacatgttcaagaggtaacagtttgactgctgctcaagcaccgacattggaagagatacaggtctaa

SEQ ID NO: 30666 - DNA, 46 bp, Caenorhabditis elegans
atggaacgcatttatcttcttctccttctttttctgcccaggatac

SEQ ID NO: 30667 - DNA, 287 bp, Caenorhabditis elegans
ttgtcatgacggaattgaacaagtatatgcagaaggcgtgtttggagcttaagaacatttcttcgcagaccagagcaatgagaaagaaaatggaagaagatgaaagggtatattagtttgaaatcatgaatttagttgtagcattttgcgtttaggatgagcaagccgcgaacgactggaagtttgctgcgatggttgttgatcggtgctgccttattacattttcagtgttcattgtagttagcacctgcggaatcatgttcagttctccacatctaattgcttag

SEQ ID NO: 30668 - DNA, 559 bp, Caenorhabditis elegans
atgaccgacacacttgatctgaagctatctagtcgtcgtcaatggaacccggtgagatgtccagttcgtctggaagtcgacggaagtgctcaaactcccacatctctagtccaaacagccctcaataatccgtcattcgacctggtgattgccgcgccaaacggtcaaaatgtgtacataccgtttacggaagataggtaggtttgaaactgtgaaaataaatttttaacaaaaatgttgagaatggtgaacaaaattgaaataggcacattaaaactatgacatgtcaactagaaattgaaaaaaaatcaggttgttgctgagttaaaaaaaaaactttcacattgtgcagtttgccggaagcttggtggccaatatttcaattattttgccgaacccaattacctatcaattgaggtttaagagatagtaaaactgagtaaccaccatgtagacacatatttaaatattttcgatagtttttcacaaaataatttatctcatttccagaaaactattcaccgcaaacatcgccgacgacccatcgacttcatctttg

SEQ ID NO: 30669 - DNA, 183 bp, Caenorhabditis elegans
gatcgactgtgagaatatagttgtttatttcatcaaaagtcacgtttttgcagaaacaaaacgttgccactgccaccaccactacccaaggaaaaaccgaaaactgcaagttctacgagcctgagaagaaatgagagtatacgacccgagcaggcaccaccaccacctccaccagcacatgct

SEQ ID NO: 30670 - DNA, 944 bp, Caenorhabditis elegans
atgaagcttctgtcggtgtcttgtctgcttttgttgcattttgcaagtgtattggctgatccaacatatgatgtgacagtgcaaacaccaaatggatctgcaacgatacgaggtgagaaaaacggcatattttgaaacattccagagtaacgtttttttttgcgatttctgtttgttagagttacagtaaaatatataagttggtcatttatttaaaaactgagacagctgactggttttcaatataacaagaagtcatagtgtcccagtaaattgctataaactttttttttgattttgtctaggaatttcagataatttttgaacagttaatattattttaaggaaaaagagctattttgttggaaaaaaaaccctattgattcgttaagttccaacatgaagtttaaacaaaaacaattagaaccgaccattctttcacagaaattctgaaatcaaagtttagttttttgtcagtttttttaaattgcgtcttcatttgtattgttgttaccgtctatcaattagtacatgtattgcatgcaatactagtaaggaaaatgcgacacttagataaaaggtattttttcgaacgtcattttcaattttattaaatgtagtttattcatcaatgcgacatcaacgcgatgacatagtttcgaaacgtttcgttagatataccatatttgtcattatcatcaaaccaatatcaaataccaaaacttatttcaggaatccaacacacttatggaacgtcatttcgtggaattcggtatgctcagccaccagtaggcttgtttagatttggggccgcaaggcgactcgacccggttggacttgttgaggcacaggcatacggtaacatatgcgtccaaggggacggaagaacgtcgcacgaagattgccttttcataaacgtgtatacaccaaatgtaagtttgggt

SEQ ID NO: 30671 - DNA, 618 bp, Caenorhabditis elegans
acttcattcgacaaggaacatctcggaaaagtcaagtacatcccggagaccggaattgacggacgctactacccatatgtatttgttccatcttaccagcaaccaattgtaagtttttggtttcaaatgattaaaaatgattaaaaatgatatgtatatcattttgagaaaattcatttaagatttatgacatcaaaattttgaacaaaaagcctaatctttgctaaaatctccgattttggtaaatttttccgtccgaaattatcgtttttaaaattatcatatgttcttttatatttaggtaagtttgttgcattaagaaaagctgtagtttccgttcattttgaattttttttaaacaaaaaaagctttctttcaaataataaaatcaagttttaaagtgtgataagatgtgatagtggtatattgaaattatctcaaaaagacatttctcaggctatggtcaaattcgacacgatcccccgcaacaaattggtcatcgtcgagtgccgtgcctacgcttccaacatcgaacacgacatctccactcgccttggaatggtctatttcgagttgttcgtcgaagacaagaagcccgtcgctgcaccagccgcttaa

SEQ ID NO: 30672 - DNA, 340 bp, Caenorhabditis elegans
atgcctgacaataatcaacaagccgacgaaaaagctgccgctcatcaggatcctgaaacagttgagaaagagttagaagatgcaggatttatcgcaccgccagatggtaagagttttattgaagctgaaaatattttaaaatttggatcataactgttttctataggtggttatggatgggcaatcgttgctgcttctttcctccttaatatgattgttgatggtgtcattttcactgtgggaaaaattctccaacccgcatgggttcatagttttggaatctcggaagcatctgctgcaatgaccatgtcaattctctccggatgttatttctttgcag

SEQ ID NO: 30673 - DNA, 684 bp, Caenorhabditis elegans
atgattttcagaatggccgatcttaagcaaatcacccttaaggaaattgccgagcacaacacaaacaaatcagcatggcttgtaattggaaacaaggtgtttgatgtgaccaagttcttggacgaggtaagattatgttctgatatttagaaatccgtactcgaagcacgtaggcagacataaaccacactttacggtacgaataacacaaacgcagattcattgttgatcaatagaaagaaattgacatctatgaaaaatgaaaaggaattaaattttttctctgcaattgataggatttcttgctcaaaaatttttagcatcaactttatcaaaaatagccgttaccgtctctttcaaatatgtattcttattttatcgttaaaacaaaatttactgtttgatacaatcaaaaccatgacgattaagatatcgaaatacttgaaaacaaataggggcaaaaattcccgaattttttgtagatcaaaccgtaatgggacaggctggcaccacgtggcgcatcaaaactaaaaattaataatgtttttttttcagcatccgggaggttgcgaggtccttcttgagcaggctggaagtgatggaactgaggcattcgaggatgttgggcactccactgacgctaggcatatgaaggacgagtatttgatcggagaagtcgttgca

SEQ ID NO: 30674 - DNA, 674 bp, Caenorhabditis elegans
caagccttcctggaatgtacgaacgaacaatttcaattggaagcgccggaaaagcgttatctgtaaccggctggaaactcggatgggcaatcggaccacaacatctcctctccccgttgaaaacaatttctcaaaattgtgtttacacgtgtccgactcctattcaattggcaattgcacgtgcctttcaacaggattggcctaaattcatggagaatccaaaccagtcgtatttggcaaccggcttgcccaaagaagttatgcagaaaaggaagattttggcaaacatgctggaaaaagccaatttccaaacaattcttccagaggctggatttttcatgctcgcagagtgcaagctgccaatgagtcagtttttgcattcagttgtacaataattgcagatttttgaaatttcagaatctttcagtttctctcccattgtcgggaaagatccactggatgttcagtattcaaagtggctgtgtcgcgagaagaaacttgccgtgattcccttcagtatttttttctcatctaaagatcagaagcatctcagtggaagatttgttcgactctgttttttcaagaaagacacaactcttcaggctgcagagaaaattttcaaaactttcgaaaacaatgatgagaagattttggaacgacctgtcaaactttaa

SEQ ID NO: 30675 - DNA, 407 bp, Caenorhabditis elegans
atgtctactgaaaacgcccatctacaaaaagaagacattgttattgaaagttggcttcacaagaaaggagagcacattcgtaattggcgccccaggtaagtttttcattgttttaccaggcctatgtatccaatctagtacagtagttttaagtttcatagctactgtcccttatgaaaagatattcaaaaagttttcactttaattgcactgaattggaaatgaaaatcttccaacaggaaaccaaaactaatttggaaataaatgaaaattaaatcctaagatgtcagtattttaggtacttcatcttgtttcgagatggaacgttgcttggattccggtcaaagccaaaggaagatcagccgttaccagagccactgaataattttatgattagagacgcagcg

SEQ ID NO: 30676 - DNA, 300 bp, Caenorhabditis elegans
ggaaatcatacttgctcttggataccttcatcacagaaatattgtgtatcgtgatatgaaagtaagtagaagctttttgagaggggttatcacaacttgaagtatttgtcagaaatttttgaatttcacaactttgatgttttttcattgttttttccattgttttttcagctcgaaaatttgcttctcgacagagatggtcacatcaaaatcactgactttgggttgtgcaaagaggaaatcaaatatggagataaaacaagcaccttttgcggaacaccagaataccttgcaccagag

SEQ ID NO: 30677 - DNA, 638 bp, Caenorhabditis elegans
actggtcggaggagccggagtcgtgccaggacaatctgtgggacgtgactttgtcatcttcgagccaggaagtcgtcactctttccaagaggccatgggacgctctatcgccaacccaactgccatgattctctgcgctgccaacatgctcaatcacttgcatcttgatgcttggggaaattcacttcgtcaagccgtcgctgatgttgttaaggagggaaaagttcgcacccgtgatttgggagggtgagttttgtgggaagcagggatgtgcggcaaccggcaattgccaaagttgccgaatgctacaatttttggcaacccgcaactatcggttgccgaaatttcggcaatttttcggcaacaggcaacacagccccggtggcaatactaatatttgtaaattgtttcaaatttgtttcaaaatttgttttaatttgttttcaagtatgataatcgacagttgacaaaagtacatatttgataagtataaagtttattctaaatgtattatttttaaaaactttcgcccatttttactgccagcaatttgaagaaaccaataaataaatcccaatttcagatacgccaccactgtcgattttgctgatgccgtcattgacaagttccgtatctaa

SEQ ID NO: 30678 - DNA, 258 bp, Caenorhabditis elegans
aatcccgtattcaatggaagactttataaaaggactctcacactttgataaggaaggcgaaggatttattacgtcagctgaattgagacaagtgctgactacaatgggtatgtccgttttctcttcagttttagtgtttattcacaacaattttcaggcgacaaactctcagacgaggagtttgacaaattggtagccggacaagaagataacggaaaaattaaaatcgaaacatttgtgaaaacaataatgcaataa

SEQ ID NO: 30679 - DNA, 493 bp, Caenorhabditis elegans
atggaagacgtcggtggaatgtttgaacaaaagaagcttttagagcaggttattatatggccaagaaaggtgagcaatgaaatttaaaaaaaaaaattttttttatatttttttaaaaatttttcacaatttacgaagttattatgaaaaatgtgttttgaattttgaaattttgagggaacaaactaacattttatgacttttttatgcggtagttttatattacactttgttttatttcgagctacatattaagtctatatttggataataatggtttgtggggtataacattgagcatagatttcccaaaaattcttattgaatataaaacaaaaattataaaaaatgtttttagtatcctcaacttttcgaatccgttggagtgccagtcagcaaaggaatattgctgcatgggccgagtgggtgtggaaaaacgcttttggcaaacgccacaatttcgaattctaatttcagtgtggttaacgtcaaa

SEQ ID NO: 30680 - DNA, 953 bp, Caenorhabditis elegans
atggagcaacgcggaagagcttctcaagatgaagagcaagcaatagttggtgcggaaaccggtagtcagccatctcttccagtttcaccaatgcgtcctattatagcagtgagtattttactccagaagttgtgaagaatgagaaaaaattactattgcgtttactgtttaaaaaagtaaaatcctgagttttaaaactatgttcagtatttgctgccaatttcctgatcaactttcaaccaaagagaaatatttagagcttaagataatggcaaatctcaaagaaatttctggcagcgcttgttcttgagtgaggctgcacccaggttacgcttgagctatttgtgtcttttgaaacttgagctaaacataggcaatcttgcccacatttagcttgaaccatatctttgctcaagttgctccatcttctgaattaactatataaatttttctgaaaatgaagttagttagaaaatatgaaaaatgttagacgaaaatatgaaaaatgttagacgaaatgtagaaagctaaaagaagattcacacacaattataattatagtttttacattatttttgattaaacacttcaatgcagttgacgaattctataaatttccaacacattttcagccatccccagctatggtcttaccaacccctggacatggaatgggaattccacaatttgggccggtgggtctgccagctcaagcttcgacgcctatgctttcttcaacgccaggaccaagttatagctctgcaccaactccaatgccgaacccaagtgcagctaacctttggcctacctacaaacttgttgctgaaattccaaatgcgcacaaaaagtcgatctcagggatcaaattttctccagacggacggtacatgggaagtggatctgcggattgtagtatcaaaatttggaggatggattttgtgtatgaaaaaacg

SEQ ID NO: 30681 - DNA, 265 bp, Caenorhabditis elegans
attcaaaccgatggtgttgatgaacgagaagctatccaagtatgaagtacactactcattttttgaccagactgaaaggtaggttaacaaacgtgataagcaatgaaaatttcaaaaaccatagtttaagacaagaattagtgttgagccttttgaaaatatgcatattattcaaattttcagagtctgcgattttgatgcgcaaactatcgaaaccgaagaaacagaagacgagcatcatcataatgcatctggtttcctatag

SEQ ID NO: 30682 - DNA, 685 bp, Caenorhabditis elegans
gaacagctgggagatgtggtatttattgagctcccggaggctggtgtggaaattgagaagggagattctacaggagcggtggagagtgtcaaggtaagacttaaaaattgtttcctcctaaaataaaattatatgaaaaaatatgaaaagtccacctattttttgcgtgctccttatataattcaaggttttaaaaattggaaatcattgacgtatacacattcaataataggtatcttactatgcaattatgattcgcgaagctcggaaaaacaaaaatgactaattaacgtatgaaatctccactagtcatttggttgactcattaacttctttttgatatatgaagtttatctgacatgaataatcatcagtctagatatagctgaagtaagaatgtacttttgttaattagaaaaatatttcattattttcattacttactatgtctacctctaacataagcctttacttccaggcagcttctgacatttacgctccagtgagtgggaagattttggaaaaaaatacgaaacttgaagatgagccgggaattatcaacaaaagcccactggagaagggttggctttacagacttgaaattaccagcaacgaacagctcaacgaactattaactgaggagcaatataacaagttcaagagtgaagaagaggccgagcactaa

SEQ ID NO: 30683 - DNA, 348 bp, Caenorhabditis elegans
atgactgatacccaatccccgttttcatttgccgccgcactattgcaatgcggttcgcccggtcaaacattttcaatggaatccctgttaaaaccggaattaggagagtattctccttccggagagaatggaattgatggcgaagaatcaacgatctggtatgtgaacgatcatatgatcccaatctacttttgtcttttttttacagttctgtatgttgtgatgaggcatccggaagacattacggtgttgtcgcctgcttcggatgcaaaggatttttcagacgtactgtacgagctggaaaaaactatgtgtgtcgttacagtaaaaagtgccgaattgataaag

SEQ ID NO: 30684 - DNA, 516 bp, Caenorhabditis elegans
atgagattactacttttcaacttattaatagctggttgggtgtattcacagtgtcctacactgcagctccaggtagattttaagtgattattgcactcaattcaatataaaaaatctaggaaccttgcacatgcacatccacaagatatgaagctgtgagcataaactgtgacggaggaagctcgctggacgcagtcctagaatcactctcgaactcacctcaagctattgacagtttaaccatcagcaatacaccaatcgaaaaggtattagtattcaatcacgataaaattagctatttactatttgaacagatgcccggctacgcattccaagggtttcaaatcaaaaagctgttcctacgaaataatgggttgcgaagcttccatccaaacacttttaccggaaatcttgaaaactcgttagaagaattggaaattcgtggaaactatattgatggaattccgcaatcaggagtgtcaattttgaagcaattaaaaatattgtcactacccg

SEQ ID NO: 30685 - DNA, 1338 bp, Caenorhabditis elegans
gcattcggtactccttcaaaagaagacatggctaaatggaactacgaatatgttcatattccatacgatacaataaccggagttggaattcagaaagtaacttttttccttcaaaaaaacattcactcggcattcgaaggcaacttcctgccacactttggcaacttatttagtgccactaaaataagttgccaaagtgtggcaggaagttgcctctgaatgccgagcaaatggtttttctcttattttccctgaggtgctcgaactcccagaacctagtttttcttagaataaaaattgaacttttacccgtcagtatcttcaaaagtgtgtacttaattcccagtggtgttgggttttaggttttatgtcaaaaattttaaaaacaaacaggaaataaatcatagtcataaatagtcaaattttgtgactttcgaaatgttagtagtctagacgagatacttttgaagagttggactaaaaaaagagtattaagctcaaattggatgctgaaaaaattgtagtaaattttgaatttcccgaataaccaggttcagttaattttgtgtaaaatgttggacgggtaacaatgtctgagattctaaattctaaaaagcggtctttgtgtataaaacaaatttaaactttgtttggttgacaattacggttggcattattttttaaatataaaagccaagaaaagtaacagaaataaatgaatattcaaaaaaaaaaaactcaaatcgtcgataggtaaattttgaaaaattgaatacattctgaaaagcgaacagttttgtcaacttttaaaatctagcaattaaaagttttctttaagtaggcaactttaagtgtacgtacacagcggaattttttttccatcatttttcactttttttaaaaaataatttattgatgaaatttgagatcaattaataaaaacgcaatttgtcgtgagcacctctgtaggcaggcgctggttgcttgaaagacattacgttgcatgacatttttgtacgaactcagagtaatatatacaaatccggattttcaacaatatactcttcttttcagttcattggaagaaaactttccttatccaccctcgagttgctcaacagtttgatgaaaatggatccgaaacttcgtataaaaccatacgaggctctgactcttccatacttcgatgatctgagagacccccactacaagctgcccagcggtgctccgatcccgccacttttcgattggctcgagagagagtacattgccaaccacgagataattaaggacattttcccccggagtgaggaaggcgacaaagttgagtgcttgtga

SEQ ID NO: 30686 - DNA, 1135 bp, Caenorhabditis elegans
atgcgattcaaaagttccaacaaaacttgcaacaaaatgcgatctttgtctcaattctccatgcaaaaacaatgccatctgtgaaacaacgagcagcagaaaatacacatgcaattgtactcctggattctatggtgttcattgcgaaaaccaaatcgatgcttgttacggctcaccatgcttaaacaatgcaacatgcaaagttgcacaagctggtcgcttcaactgttattgtaacaaaggattcgaaggagattattgcgagaaaaatattgacgactgtgtgaactccaagtgtgaaaatggagggaaatgtgtagatttggtaagattttgttcggaggaactgaagaattttcaaagttttcagataaattcttatcgttgtgactgcccaatggagtacgaagggaaacactgcgaggataaactggagtactgcactaaaaagttgaatccatgcgagaataatggaaagtgtattccaattaatggctcttacaggtaatttacaaattttttgttttttcaaacattaattttacaataaataacataatgttatggaacttttttgagttcttacaaacaaagcccgtgtaagattttggtactttaggtttaaaaactaatccttgaccggaagagagaattgtacactctaaataataataaaaactacgttgcgtgtacgcccaatataagtccggcctttttgtctgaaaatcacgaaaatcgaaaccccaaccaatatcaaccgccgacatcaaccgagttccgcgcgtcactataatttcctcgcgactggcgggacaccacgcccactgcgagtttaacacagtggcgcgcggaacccgtaagatgtcagcggcctgatattggttgggggacctggtatttgccttttctccgtgattttctaaaaaaaaaaggcgggcttatcaagtttaagtttcgtggaaaatcaacgaaaattcaatttaagtttaaaatgcgtgacacaataattaacatctattgcctattacatcacaatttcagttgtatgtgctctcctggtttcactggtaataactgtgaaactaacattgacgactgcaagaatgtggaatgtcaaaatggtggaagttgtgtg

SEQ ID NO: 30687 - DNA, 1203 bp, Caenorhabditis elegans
atgacttggatcaaacttgctagccttgcgctagtggttgtgcttgcaagtgcaggcatctccaaaaacgaagacttggaatgcatgttcttaggatatccagatctcgaatacgacggattcgacagaactgaggtgagttatttggatataggatttataatgtctattttgtccattctgcaaatcttttctgaaaatctgcaaaactaccgattttgtttttttttttacaaatcaaaaatgaatgtacatagaaataaatgagaattttgtcaattttgtcaattttagttggcaagagttggcgagaattgccagtgaactttcaggctttttttctttttccttcttaggctttttttccgttcaaatttgccaataaaaatattattttagagtcaatcaactttttagaatccaaaattaccaaaataccaaaactgaacaagtttctagatttttcaacaatttatccactaactagaaggtatagttaatagttatttggttagaagcgatttttttaaaaaatttttttgaaacattattcattagtattatcgaaaaaatacgatcgcacacatttctcataatttacttttgatctacctgttgtctccgcccccaatcttgtcgccgttgttattttgttgtggctgtcttgtcgaaggaaggggaggagcctcgtcaacaaggtagatcaaaaataaattatgagaaaattgtgcgatcgtatttttcgataatatttgagtttaaaattatcaataattaaataaaaacaacttctaagcagactatagattcctatagttagttcctatagttcaaaactaaaaaattttgagaacaattgttctcgactatcttgatcatcatttttcatttaattctttaacttaaattactcaataacaagacattaatttaacttcacaatgtcagtaaacaattgcgtcattctagcaaaacttgacctataacaaaattttcgacatccggggttttcgaaccaacctatcatattacactgcaacagatattcatcttcactcaacaaaaaaaaatcaataattgcaggttctgaccgagaagaacttcaacagaactgttttcgctgaagacaccaaatcggtagtgttcttcaacgacgtggaagaggacgactcagagcttgaccagtatgagtgcttccttcag

SEQ ID NO: 30688 - DNA, 180 bp, Caenorhabditis elegans
atgttgagtcagcaaattgccaacaatgctagaactttgcagaagggtatgtttgcctatttcatttaaatcaccttatttgtatttccaggagctgctcgtttctacaacagcacttacaacaacctgaaaatcaacaaggacaccaaggttattgtgcaaggattcacaggaaagcag

SEQ ID NO: 30689 - DNA, 536 bp, Caenorhabditis elegans
acatcaagcccaagagctcaatggacattccaatataacagtaccttccaaccaacagttgctggataccaaacttcgtacacttcaaacgctattaatattgatgtgctcactgttaaggtatgctttttaagaattaatatttactcataattttgttccagggctccggtcacttcgtgccacttgatcgtccacagcaagctcttcaaatgatctacaactttgtgaagtccagaggttacaacactccattcgatctaaatagcaattttactacaacaacaacaacatccaccaccacaacaacaccaggaactggacctacagtaacagcagcccaaaccaccacaacaacgccaagcactccaggcgccggtactacaggaacaccaggaactggacctacagtaacagcagcaccaacaaacggcatttcaactacacaaccaattattacaacaactaaaggtgctgaaggcagaggagtcttgacaattatggctacaattctttcagttttattgttcaattaa

SEQ ID NO: 30690 - DNA, 678 bp, Caenorhabditis elegans
aaatctgacatacggagaactctcaacggatttgcaaatccgaatttcctcaattctaacatccgagaagtatgctcaaaataacatgaaaatcatgatctacaatggagatctggatctctggagcaactttattggtgctcaaagatttggacaagaaattgcggcagctctcaagttgaacacaaccgaggatcgcatttggagacataactatgattcggcagcatttgtgtggatggatggtggagttattactagttactcgagcaattttcatatcgcatccattagagtaagtttatagtttcagcaaattcgagaattacataatacaactttcaagaatatctagttgaaattttcgaacttttgataaattgatacaagattctttatcgatatcatatcgtatacttctatgatactttttcaatacctttaaagtttttcaaaaattttccttattgcgtcagcgaatgcaatttcccattattacagggtggcggtcacttcgcaccacaaaaccgtccgtcacaatcgctacaactatatcgcgacttcgtcttaggactgtttttcaacaattgcctcagccgagttaacaaagtcgccgcgccattgctgcccgcttatcaacaacttgccgcgccagctactcgtcgtgatgctgataag

SEQ ID NO: 30691 - DNA, 486 bp, Caenorhabditis elegans
gtgaacttcaaacagtatgcgggttacctcaactctgatcccaacaaaaactacaacaatcttcactattggtaagttcaagatattaatctaaacattttattatctggatactgaaccttgactaccaaacaaaataaaacaatttcaggttaatcgaatctcaactgaccccttccaatgatacgctccttctttggattaatggaggtccgggatgtagttcagttttcgggcagatccaggaaatcggcccattccatgtgtctagtgatagtcagacggtgtatgaaaatgtgtttgcttggaacaaggtgtccaatttgcttgccatcgacggtccgggcgccggcttctcatggcaacaaaatctctttcaagacgacagctacgtaactggtgctcttcttaacgctctcatggatttctatacggtgtatccaaatatgctaaactctgatctctacattgctggtgaaggatacg

SEQ ID NO: 30692 - DNA, 1327 bp, Caenorhabditis elegans
atgcaaactctaatgagtcacagccgtattaccccacttccgggagccatcaccaaggaagaaatcaagaaccagcttttggtgcacgagcgtcgcttcttgagcaaggtaattacatgttttggctcgcaattgagtaggcgtgcttttaattttaccctgtagactttcgtgtataaatattccacccaactcccccaaaacttcattcactatcatgtcttattatttatatttacagccaaaccgcaaggatcagtggaacgttctcccacaatcagctcactccaagaacaccgtcaacccagtccgcaaaattgctgatgcttgcgccgtacctccacacccagaaaagaaagtcatcaagcttcaccttggagacccatcagtagggggaaaacttccaccaagtgagatcgcagttcaagcgatgcacgaatctgtcagcagccacatgttcgatggatatggaccagcagttggagctcttgccgccagagaagcgattgttgagcgatattccagtgccgacaatgtgtttacagccgatgatgtcgttcttgcctccggatgctcacatgctcttcagatggctattgaagccgttgcaaacgctggagagaacattctcgtcccacacccaggattcccactttactctacactctgccgtccgcacaacattgttgataaaccatacaagattgacatgactggagaggatgtcagaatcgacttgtcttacatggccaccatcattgacgacaacaccaaagcgatcattgtaaacaaccctggaaacccaactggtggagtcttcaccaaggaacatctcgaagagattctcgcattcgcccaccaatacaagcttatcatcattgctgacgaaatctacggagatttggtatacaacggagctaccttctacccacttgcctccctcagcccaaaggtcccaatcatcacttgcgatggtattgccaagagatggatggtacccggatggcgccttggatggttgatcattcacaaccatttcggtgtgctcactgacgttaagaatggaattgtcgccctctcacaaaagattgtcgggccatgctcgctagtacaaggagctcttccaaagatccttcgtgaaactccagaagattacttcgtctacaccagaaacgttattgagacaaatgccaacattgttgatagcatcttggctgatgttccaggaatgcgagttgtcaagccaaaaggagccatgtacatgatggtcaacatctccagaacagcctatggatctgatgtcagcttctgccaaaacttgatcaga

SEQ ID NO: 30693 - DNA, 201 bp, Caenorhabditis elegans
atggagaatgatgttagttttatcattgatgtattgaaccaaaatctaattctacctttcagaactatgacgtcgaagaacaaggatgcagtgtattcaatggaaagcatggatattttgcaagatcatgctgcgtggtcttcatactcattatctgtgtgatattcgttttttcagtgattttcacatttatgcaaaatc

SEQ ID NO: 30694 - DNA, 348 bp, Caenorhabditis elegans
atatcatgtttatcaattatgtcgctatacttggaaatctaaattcttgccttaacccgtggatctacattttgttcaaccgatcacacgttcgcaaggcactttgtcgttcaagacgctcgttcacagaagttactaaaaaacgaagttttgaaaatttcggtgagcgaaattcgaaggataatactattttttttataattgaaattttcagagtgttcctcaacagcaacaatgaacaataattataacaactgtcatgcttacaccgctttcagtaaccggtctcaactgaagtttgattcatatgcaacagactctacttccttgaagaccaactctaattaa

SEQ ID NO: 30695 - DNA, 362 bp, Caenorhabditis elegans
gattcaacgtggagactgttaccttccaaaaactcactctcattgtttgggatgttggaggtcagatactaaaacactactttccaaataccacagtaattatcaagaggaattatacaacaaaaattgtttaatttcagatattagtgtttgtggtggacagttcggatattgagcggattcccgaggcaaaggaaaaattgttcagtttgctcgccgagccagagcttgcggattctcatctgcttgtctttgcaaacaagcaggatatgccgaatgcaagatcaccagccgagctgactcagctgcttgatttgggttcactcaagaatagagaggtaaatagttgtattgttttgtag

SEQ ID NO: 30696 - DNA, 275 bp, Caenorhabditis elegans
tgatcaagactagaatgcaaactattaacaaaggagcaaatgagattgtctacaagaatattccagacgcatttgtgtaagtgttaggtaatcgagtcaattgaaagtatgaatttttcagcacgattttcaaaaatgaaggaccaaaagctttgttcaaaggagccgcttgtcgtatgatggttatggcaccacttttcggtatcgcccaaactgtctactacattggagttgctgaaaagattcttggaatccaaaaagccacacatgtctag

SEQ ID NO: 30697 - DNA, 248 bp, Caenorhabditis elegans
atgggcgtatggcaggactcgaattacacaatgtgcatcaaagttgttgaggaatatgctcaatgtctacaaggattttgcagagttgtacgtctaaacaatagatgttctactttacaaaaataacttttcagtgtcctgatgttcttcgagacttggtgatatcggtatctttaacgttatcctttgtatctgtcatacttctagtggcggcaatcgttttgttttcgatatttgactcgattcag

SEQ ID NO: 30698 - DNA, 331 bp, Caenorhabditis elegans
atgcttagccgcaacattggagctgttcgcggagcccataaggcagcaacgacaaaaccagtcgaaaaagtggccaaacttggaaatggattgaccgttggaactatcgactctcacaaaccaattgcacatttggtttttttttaatttgtttcttctatccgaaatcatcttcaaattttaggttcttgccttcagagctggaagtcgctacgaaaaagccaaccaggccggactctctcataccatcagaaatttcgtcggcagagatacccaggaatactttggaaacacagttgtatggacgttgtcacagaccggaggagttctg

SEQ ID NO: 30699 - DNA, 2178 bp, Caenorhabditis elegans
aacaatcacgaagagacgacattgagtctcttggctacgtgtttatgtactttaatcgtggaactctcccgtggcagggactaaaagctgtcacaaagcggcaaaagtatgagctgatatcagagaagaagatttcgacgcgagttgacgacctgtgcgctggctaccccgaggcgtttgcccagtacctcaactattgccgtagtcttggatttgaagagcagcctgattatggttatttgagaaatttgttccgcacgttattccatcggcaacagttttgctatgactacgtgtttgactggaatacatacaagtgagtgtttcctattgatttttctattgatttgcaaagattttgaaacaaaaaaatatagaaaatggagaagaaaacgaaggcaatcccctaatttttccagatttgacttgccattttaactcaaattcccctcaaaaaaaggtttctcacacacgttctgttgtgatgtgtgtgtgtgtatttttctttgttgttttgtacttcttctttctgctattttaattttaatatttcaagctgttttctttcttgcttagaattttgatttcatcattttttcataaactatagcttatttccgttggtgtctcgtcactgtgatgttgctaaaccgacgagtgaaacaaatagtatgtagtggctagatgataatgcttttgaacgaataaccggtaaactagcggtgtactttgctttcatttttctacattcaccaaataatacaaaactactgacacgctttgtgtttttacagatttcgtcgcaactgaaactgatcgcattgtgtgtctgaaaatccaaataaaaacatactatcctaagaatagatttgaactgccagaggtaagagttgagcaccaccaccaccgcacgtttccaatttgcacccgttttaaccaatcactaatttggatttttgacttttttttaattttgaaaaaatcgaaaaatatctctagtaactaaaaacaaattagtcttgcatacagcaaaaaaaatatcttcaaattttttcctatataaagctccgcccatatcttggttttttggaatatttttgaacacgtacactttttcgttttaaaggtggaaaagcgccagtaagaaaatgggagcagaaattgataaaaaaccactcctataatacaatgccaaaattgccaaatatcatagtaaaacgtttcaaaaaaggatattgaaaattcttttattgacagttccaaagtggcatttgccccaggtcttgccgcttttttgaaaacggcggatcagaaaaaaatttttgctccgaattttatggcctaaattattacttgtgaattgtagggattcaagaatgcgacagtgctctagttttggaaattttaaaagtggaaaaacttacgaattgccactttttgactgtcaataaatatttttcaaaaaattttccgaaaagttttactacgatatttggttttttttggcaccatagaagtggtttttaacaattctcccaatggtgttacttcacttttgcaacattttcaacccaaaactttgaaaagttcacttaatattccccaacgagtaatgtacttatctgttttgaaaaaaatgcctcaatttttcacgaaaatttagttttttttttgttttccctgtgttttcctttgttgaaaatctcgtaattggaaaattcaaattgttattttttaaaaatttaaattacaattttcaaattccctgcactcaccgtactcgagcaactttgattccagaatttcaattttgcagattctacaacgaaagtctggaggctcggaacaatttccagcaagcggtaccaaatcaacgtcgacattaattgtatcatctccttttcaagtttgtgctccatttcctctttaatatctcatttcttacccccgttttgtgatactattcatgtttcatttgcctcttccttttctcctccttcctgtctctttttttcctctgtgtttttttgttgttttcttaaaaacaacaacaacaacaacaacctgtttctagtatttcacttgcaacgttttcttccatttctctctgttcattttcctcgctctgtcattgatctttgtctcagttttttcggatgtatatttttacttttttga

SEQ ID NO: 30700 - DNA, 371 bp, Caenorhabditis elegans
gctactccacctttaacaatatattatcgacaaaataagcacgcaatttttttcatcagatttattttcggtcttcatgatagactgaacctttcgagaaaacaatggatgagaactctagtccaacaggtagatcaaaaatatattttgaacaaactttatacattttttccgacagtaatcagtttgaaaacacacatttttctttccaggttgaacaggctttcacgtggcttggctatatcaactcttcacttaacccattcctttacggtattctaaatttggagtttcgccgagcattcaagaagattctgtgccctaaagctgtattagagcagaggagacgacgaatgagtgcgcaaccttag

SEQ ID NO: 30701 - DNA, 456 bp, Caenorhabditis elegans
atgtcgtggcaaaaccagggaatgcaggcgttgatccctgtgatcaatcgtgtccaggacgccttctcccagctgggcacatctgtcagcttcgaacttccacagatcgccgtcgtcggaggacagtccgctggaaagtcgtcggtgctggagaattttgtcggaaagtgagtcacaagaagaaaaaaaacataactttgcgaaataaaatcacaatttttttcctttccagagacttcttgccacgtggatcaggaatcgtaacacgtcgtccacttattttgcagcttattcaagatcgcaatgagtacgccgagttcctacacaagaagggtcatcgctttgtggattttgatgcagttcggaaagagattgaggatgagactgatcgtgtcactggacagaataagggaatcagtccacatccaatcaacttgcgtgtcttttctccaaatg

SEQ ID NO: 30702 - DNA, 345 bp, Caenorhabditis elegans
gccatctttcttatcggaaacaaagccgacctcgaagatcaacgtgacgtgccatacgaggaagcaaaagctttcgccgaagaaaacgggctcactttcttggagtgcagtgcgaagacgtaagtttcttccccccacccccccactgcaaattcatcaatttcaaatggcttttttttcagtggcagtaacgtcgaagacgctttcctcgaaacggccaagcaaatctatcagaatatccaagacggaagtttggacttgaacgccgccgacactggcgtccagccaaaacagaacttgccacgtgcagctgaaaataatgggaagaaggactgcaactgctag

SEQ ID NO: 30703 - DNA, 356 bp, Caenorhabditis elegans
gccaatccggacttcctggtttctttttgcagtacgaatttagtccgttgatggtgcaatatgaagaattcagacagtaagttatattcttaaaaattatgtagtttgaaggcaacagaacaaaattcacgaaagtaaaaaaataatttaagtcaccttgattacacacataaatattcaaaattttccacaatacttataattatgtcctaattttcagatccttcgcctcatttctagtctcactgtgtgccatcgtcggaggtgtcttcgcaatggctcaacttgtcgatatcacaatttatcattcatctcgttatatgaagagccgaattgccgggggaaaacttacttaa

SEQ ID NO: 30704 - DNA, 283 bp, Caenorhabditis elegans
aaagatgcggaatgatgtcaaactcctcgagctgtcgccgatagatgctcattttctacgttgccgcccatctgatgctgctcagagtcacagaatcaacaattcgaccaagtggctgctaatgatggatcctaggaatcgggaatcgaaacgaggctcacactaagccgaaatattaaataatatttatgtttttttcccttttgtcagatttattttttcatttttcatgttcaataaacaaaatttttggcaatgtttctctttttgtatcaacatttaa

SEQ ID NO: 30705 - DNA, 727 bp, Caenorhabditis elegans
attcctgatgaaagcagccgaaggagttagaaaaggaactgctaacctagcagacatcggagcttacattggaaagcctggaaggaaaacctcgcgcttaacaactcaccaccactacacagatgctgatatcgttgaagatcttgagcacgttgctcgcaaacaagtattccgagcctacgaccgcctgaaaaaggctcaggagcatcttcgtccggaagatgcttggaactcggtttctgtggaacttgctaaagcttcgagatggcacgttcgtctgtatctcgtgaagaacttattgcacaaagtttctattgctcctcaggatttgaagattgtgctcttcgatgttgctcggctgtatgcttatgacatcattacatcatcaattggagcatttttggaggatggctacatgagctctaatcagatgaatgaagttaaagaaggtatttataagtgagtaaaaaacttggaaagtggtgattgctcataattgtctattttcagatgcttgtccaatatgcgtccaaatgcggttggcctagttgactgttgggattatgacgataaagagctcaaatcagttttgggaagacgtgacggaaacgtgtaccctgctcttctccagtgggctcaaaatagtcaactcaacagatcggaagttcttccggcctacgaaaagtatcttggtccaatgatgaaagacgctcgatcaaaattgtaa

SEQ ID NO: 30706 - DNA, 343 bp, Caenorhabditis elegans
ctcaactttcttgttgcaatggccgtcgatgttcgctctcatatgctgaaatgttacggtgaaacggaaaagaagcttcgagaactgtttgtgagaaatgcagaccgttcaaacccgattcgaatgtttttcatttacgatatcttctggacgtttgccaagtttcatgaaaattggcaattatggatcattcgtccagagtatgaaaatcaatcttcgatacggcacagtttgagatacgacttctctttccagcctgaccgtgaacccagaagagtgggggccggaagctatgaagactagatggttgcggcactggattgaccaatatttatgttgttag

SEQ ID NO: 30707 - DNA, 1538 bp, Caenorhabditis elegans
atgatagacccgaacaatatgactacagtgatcgaaaaaacgactgaaatcgtgaacagtgttctaacgagcaacgaatccgatggtgttttggaacaaacgagcacattgataagtgtactggccacccaatcagctccgcttcaatgcttttcctgtcatccgaagctgtacttcatcgtgtttggtctggtttttatgatcatcatctgtgcgggcgtcatcggaaatattttcatagtttttgtgattttaatggaccgaaagctgatgagctcctcagttaaccagtttctcctgaatcttgccattgcggaccttggaaacctgatattctgctcaccagatgcaatactggtattgattgatcggggttggctcctgccgaatttcgcgtgccacttgcttcgattccttcaagaatactttctatacgctagtgtcttgcttcaggcgagtttttttctcttggaaaaaacacgtacacgctatagttctgaataattttcccacgccacaattttgtgttcagatataatttagaaatatagaatagttttctttggaaaattgaaaaaaaagaattaataatttcccaaaaaagtagaaatcgggttgttttgtagagcggggttgctaggatatcgcactgaagcgtggcctcccttcatcatcattgtcatagatcgagttcgcattgaggaacaactttagaaactattcattcatgaaattgtgacatttatgaaaagaaaagttccataacaaaattaataaagtctgatcaccctatatggcttaattatattttcctctcgaacagactcagtgggaaaaatgaagaagtttgaattctcagaaaatctcagaaattgaaatttgaggaaaaatgctgaactatgggaaatttcagttagtcatgtgtttttaattacaacttgaaaacaatttagcagtggagtagcgccagtggggaaagtgtgaaaaactactcctatggtgccaaaatgaccgaatatcataataaaacattttgaaaattttttgaaactttttaatttacagtcaaaaagtaacaattataattacgtttttgccactcataattttggaagtcggccaaaaaaaaaaaatttcctacggtttttatactttaaccaaacattgtaggggttgaaacatgcggcattgctttggatttcagaagctcatatttttgaaaattttggaaatttgccaaaactttacctgaaaattttcaatagaaattgcacaaaaaactgctttttttcaagttttttatcagaattcaagaaaaaccttaccaaattggttaaaagattaactatttgtaacagattattctacagatttaactagaacttgacctttttaatataaaacctttatacaaaatctgaactattttcacaatgatctacaagaaaatccaaatacttcagatggcgatcggtgtcgagagatttctggccatctgctccccaatgagaatgcagagattctccacaaaaactacg

SEQ ID NO: 30708 - DNA, 518 bp, Caenorhabditis elegans
atttaatattgatccaaagggacagttcaccgatcaacagctgtggttagccctggagaactcgaatctgaaagcacacgtagaattgctgccacacaagttggaaagccccgttgcggagggtggagagaatttcaggtatatcatcgaaattttactttttgaacagtttgttttaattcatttcaaattctgtaatacatttcagtgttggccaacgtcaacttctatgcctaaccagagctctgcttcgaaaatctaaagtgcttgtgttggatgaagcgactgctggaatcgacaaccggactgatacaatggttcaagcaactattcgtgaaaagtttgcggattccacaatcatcaccattgctcacagacttcatactatcattgactatgatcgaattattgtgatggatgctggtagaatcgtggaggacggaatccctggagagctacttaagaatagaaactcacagttttatggtctcgctaaatcagcaaaaattgttaattga

SEQ ID NO: 30709 - DNA, 859 bp, Caenorhabditis elegans
atgggttccatagaccttgcagcaaaaggagaggaaaataataataatgtgattctgaaagagcaccatgagcaagtttcggtgaagcataagaagagagagttcaaagaaaaaacttttgtggttcgagagtcactgctgacgtaagttgtgttcatgaactttaactattggaaaattgaatttaattgaaaattaaactattttgaaattcctcttatatgcttcgaaatttaaattgtttgtgttttatgcattgatgttattttgtgtttattgtgttttaatgtcagcttactaataaggatttagtaaaaaatgattgaatttcacaactgaataatccaaaaaaagttttttattagcgtcaaagttctggcaaaatgccaacattttgaaaattctttctggctaggttacatatgtatatgaaaatatttaaaacaatataaaagtataaatttgatagaaattaaacttttcgatttcctttcactcaatgaaaactaggttccttgcaaaaattgcaacatttatttgaatataaaattacgaacaaaagttatcgacactaaacaatgtttgtattttcagatctgaatttcgaaatgggcacatgaaaatcatctacaactgcttcaccgcagcattcctactttttttcctgagagccatgattgatgacattctggttcacaaaatgcctttccatcatacatggctcatttggtggaattttcaaaacttcatcccaacaatggctgtctggacgggaatgtttttgagcacaattggagtttactatgcctacgagcactggtcaacaattccatcgaagaatactgatttggcgtcaaat

SEQ ID NO: 30710 - DNA, 605 bp, Caenorhabditis elegans
ttccaccaacctacgagacggccactttgcgtaaattcaccgagggtcgaaccgagaacatccgatctccgaatacagctgcagcatcatttgtcaagaaggtgtgtgtttgtgtgtgacctagatcgatcacccaatttaactcactcaattttcagatggtatctaagcctcctacgccggttagtgaaatctacgatgcacttgttcacgcaacaaattcgcataaaaagtacaccatggattgtatggatgcagctggaatggacagacatttattggcatggaagttgatcgctactgaaaataatctcccaaccccagaaatcttcggttccaacatctaccaacaactcaaccatttccaagtctccacaagtcaagttcccacacggcatttcatccaaatgtgcttcggaccatctgcccttgattgctatggaatttgctacaacccacaggaaactgaacttcactttatgatctcaacattcaagagctacggctcgacgagttccaagaagtttgccaaggaacttcaaaaggcgctaattgacatgaaatcggttattaataaggctacaaaagaaatgtccaagttgtag

SEQ ID NO: 30711 - DNA, 1287 bp, Caenorhabditis elegans
atgttgccaattctcttagttttcctgttcagtgcactatcacaatgctcccgactcgccgaggaagaagaacaggtaagattatgattattctgaaactctgaaaattattttggcattgcctatgaaatataatttggttattcaggtaatgttgcaaaatgtatttaaatacatttataacgtcacaactgtatcaaaatacatgtttttatgtattttaatactgtcgtgacgtcattttttctatacatttttactacttgtataattccataacccatcaaaaagctttgaaattattaaacaaagcattgtttgccattgaaaacccagtgtttttaaaacaataatcatttcaaaacaattttcaaatagttatatattgtttgtattcccgcggaaacgcaggctatcataaattgaagtgtttggtacaaaaaatcaaagtatcccaaattctttaaaagtttcaactttccaaatgttgcgtaaattttttttaacgcaatttttaaattttggatcaccctgcaaaatcatggaccaccctgtaatataagggacaccctgtacagtcaaagaccaccctgtaatatcatggaccaccctgtaatatcatttgccaccttgtaaaatcatcgaccaccctgtaaaatcaaaggccaccctgtaaaatagcctcgaaaaatctcgagttgtaaatattcatggtaaaaaaaacgttctattacaacaattttactaacaaccatttaacttgtagtttttaagttctaggaaaatgaaaacgttttatctaatataataacgtgagtttttttaaaatttcttttgagtaacattcacacttttttattttttcctcaggttgctagagagagtgcaaatagtattacaaactatcgaactcttgaaaatcgagaatttaattagtccaacaaaatggaaatagcctaattttatagttcatttaaaaaaaaactagtctgactctagatgaaaacttttaaaaactgatatatttgaaacgaaaatgacctgttttttttgaatttaaacgctattttcttttttttacggtaaactaaatacaaaactcacaatttacttcaaacacatttatcactctttccaaaaagtgacaattgacagatgctaatccggcacttcacaaaagaaggagaagtctcgaccatggaccaactgcgggataccatcggtccgtttcgcgaccctcttaacttctcacacatgaactactcgacattgacggatcacattcat

SEQ ID NO: 30712 - DNA, 877 bp, Caenorhabditis elegans
aatggaaaaccaactcaaaagttcttcgcaccggattgcttccatttctcacaatggggacatgctcttgtgagcacttatctttggaataacattttacagccagttggctcaaaatctacagtttcaaacatgtcagtgccacttcagacattggcctgcccagatgcggtaagttcagttatcaagggaaccatcacatatgtattagtaaggaaaaaaggtttttgaaggtctaaacttttttgattgttttttgcatcaaagacggatttttccgaagttttgaaaaataactaaccaggcgtaatcctacagtactgagtgttagttatgaaaaatagtagtagtacactcggaggtgggtaacaaaaagcaacataaaatattctgtcagaaagttgtccaccgcaaacttcgatttatgtcggctgcaaattccacaactgcgcgtggtgtcaggttgttccataaaggtttgatctacaaaaaaatgcgggaattttttcctcaaaaaatgtgacgtcagcacgtttttaactatgcaaagttaattgaggagtctgctcctaatatcccgcactttttgtagatcacaacgaaatgcgacattctgacaccacgtgcaactataatgagataacatagatcaaaccaaaatctacaggcctaagttcacagtataaagaaaaaaccattatttctttattggaacttatctttagcagtttggaactgaaaacaaaaatctggaattttgttttttattccataatactaccttatctcaaataggaacatttttcaggcttgccccttcatccgaacacctaagaacagccaggactgtagtcaatacatgacccctcatgcttaa

SEQ ID NO: 30713 - DNA, 1118 bp, Caenorhabditis elegans
atggagaaactaaaagaaggtggcagacaaatcacagctggcgggtccgcaggtaagaccacatgcttgtgagggttcaatgggagaacaacaaatagttattcttgtccttgaatcaaaaagcaaagtgacctcatgactggttgctcttttacttgaaatttttgaaaattagaaatgatatgagctagggttgtcttaggccgtcctctgcactttctgtgggttttatttggtgtcgttttaacaagaaactttagcctcaattttgactctagatagtatttacccaaataatcaatttttcttattaaaattaacgtatcaagttcgagaactttggttttaaaaaaatttggaaggtgttgagggcgtcctacctaacagatctaatatgaacagtttgaaataatttttaaaaaaatgacctgtcaaagtacttgtgtcatcaaaattttacatagttcaagtacacccaataaaaccatataaacgttctttaagcttcccgtaataaaatcaaaagtctacttttcgaataaatcaccctactaccattgtaattgttccaattctgtcaccacacctttaagcagtttttcattgtaaaatcttcttgaaaatatcatctgatcattaggtaaccacaagcttttgtaatataaaaagtcaaaaatcaaatgatagcgtcatcaaaaacaaatgtaacaatgaacacgatttttgaaaaacatgggggtcttgaaaaaagtttgtgaaaaatcaaaaactcaaacgtaggaaaaaatggactgagaaaaaagttacctgcaaaaattgatttttgcccttgtttccatccgaacacacatcaagcacagcttgtccgctagacatttatcaatcaaaataactaatctttgattggatactataatttactaaaccgtttattaaaaacaacaaactacgcaacgaaaaaaaacaaagtaatcttcgtttcaggtctcgtggaagtatgtcttatgtacccattggatgttgtgaagacgcgacttcaacttggacaacaggataagggaatgatggattgtgtggtgaaaacgttgaaaaatgaaggaatcggagggttttacaag

SEQ ID NO: 30714 - DNA, 2024 bp, Caenorhabditis elegans
cctccattctactcaaaagatcataacgagatgtacgacaagatcatcaaccagccacttcgtctcaagcacaacatctctgtgccatgcagtgagctcatcaccgggctcttgcaaaaagaccgttcaaagcgtctgggccatcgcaatgatttccgtgacattcgtgatcatccattcttccttccggttgattgggataagcttctgaatcgtgagcttaaggctccgttcattccgaaagtgaaaaacgcaatggatacatccaatatttcaaaggagttcgtggagattcaaattgatccatgtaagatatatgtacaataattggcataattaaggatggttggggatagaactggcatatttccggtcatcgcgtccggttttggaattttgagaattttccgaaggtagtttttcacggcggccgacaatttccgagtttagccactcattatcgaattatgtatatgattaagtatagtgagtggccaaactcggaaattgtcggccgccgtgaaaactactttttctgaaaattttttaaaattccaaaaccggaccccaaatatgccagccctagttggggagaagggttggttccaataagaatgtaaaaatttgtagtaactaatcttagttcaacgctctattcaaagtgacatctaatatgtagtaagaccaaatcttgtaatgagaggtcttcaaaaatttcatttttcttcaaaaacttcctttttctgtacggtttcttttcaaaatcaaaaagaacagtctcaatataccgaaaatgactgcgaaaaaatttgaaacatttttttcatttttttaaaaactgttttcaaactttccaaaactttttaaaaagcctcatttttcaagcccacgtcttttgattccttttgtttctcggcaaagtttattaagtttctttttcggtttttgatctcattaaaatgtctaattttaatagaagcccaaataaaatattaagatgaaatgagctgaggaaaaaagtaagagatgccgtatttgcctgttttcattaatgtatgcacgaataaccacagtccttcatgatataatattgaaagttattcgatttctttgtgaaaaaaaattttaactacactcaaaattaaaaaaaaaactgcgtggcgtgtacagcagaaaacctagtatttaggtaccgcctttttttcgttcactcacggggaaaagacaaaaatcgggacccaaccaatatcaggccgccgacatctcacgggttccgcgcgccgcaaagtttaacttgctatgggcgtggcgagctgtctccgcccgctgcgagttaaacctagcggcgcgcggaacccgtgagatgtcggcggcctgatattggttggggtaccgagttttgccttttccccgtgcgtggacgagaaaaaggcggggcctaaatactaggttttctgcagtacacgccacacagttttattattttgagtgtaactttttgaacaatttcaaagttactgataaataaaatgaagccgagcgcacactaaaacatcccagcacctaattacaacccgccaaccgcctcaatggcaaaacagcgttctgagcataaatatgagaaggttatacccacactctcaaatacataatatgtgtatatatatatatatatctaagcacatataagttcgttggaaccaagcacctatacaccgctaattaggccgagctttgcttctcgagcatagtctcacatactctttcagtctcgcctctcaacctctcaccacatcaccaaaaggaaaatagaatatgttgggtggtgggggggggggggtccagctcataaaccccgagtgaaaccacgcccccattattctctgcttcttctttttcgttttgctcatactcttcgttttgggttttcagcttcgttggcaccgcaacaacttgctgtcactcatcgagatcacgattttgagaactttacattcgtcgacaccaatcgcgttttggtctga

SEQ ID NO: 30715 - DNA, 225 bp, Caenorhabditis elegans
atcttcgcccgcggacaaggaatcgccaatcctccagaagtgctcattttcgaaggtgacgaaacattcggtgttggcgccaacgttcaaacaatcctttacaacaataagggagaggtaattcaacccccaaaaatttacgtgcagaataaaatgttatttttttctttgcaggagcgcgcgacacacatccaacgtcaaagccaacaaacgacatcttcctaa

SEQ ID NO: 30716 - DNA, 809 bp, Caenorhabditis elegans
gaagtctccccagaaggcaaatttgtcatcttggaaaacacgcacagagacaaagaagagccactcggagattggaagctgaaaagaaagattgacggaaaacgcgagatcgtctttactttcccatccgactatatcctccacccggttcaaactgtcaaggtttgtgaaattttattgagaattcaaaattatatctaacaatttggaaatgttggatataaaacatttcaaattggtgtctcagagtgaaatgtgttactgtcatttctgtgtgtcgaattgataatctgatgcgcactggggtgtgacaaggtcatctgaaaatgatgagtggactttttcctggctatgtagcaaaagatagaagactgggaagcatctagttatgttttctgaaactgatataatctaatttttcaacagagaaaaacatcaaaaacaattaagaaccagaaaaaagtgatgtttcaaaaaattttagcgacaaaaaaattaaagtttttcaggctgcatgccaaactgtcaaaaaaacggtctatttccagattttcgcccgcgggaacggtgttgccaatcctccagaagttctagttttcgaaggtgacgacacatttggtgctggtgccaatgttcaaacaatcctctacaacaacagtggagaggtaactcaagccaaaatttcaaaagtatttagaatctttttttgcaggaacgcgcaacacacatgcaacgccaaagccaacagactacaacttcataaatctaaccttgctcggataacaatacgagaaatttccccatcttag

SEQ ID NO: 30717 - DNA, 243 bp, Caenorhabditis elegans
atggccgatccagattcctaccgcagctccattacttctcggccagctttcaaccgtaccgtcacaagtagtactcaaaactacggaacaccagcatctggaaatcgtgtgctcaaaattgtcaccgaaacacacacctcctcagttgcgagtggactttccccatatggccaaggcgctgcttccaccatccgcgatgaccgcgaacgtgagaagaaggaaatcacggagctcaacgatcgt

SEQ ID NO: 30718 - DNA, 994 bp, Caenorhabditis elegans
atgcgaaattccttactattcttcatttttctgccttcggtaaatttttctttgattttgcattttaaattggcatttgatttatttaatatttttttaacatttaagcaaaaatacactcataatgatccaaaacaaccaaatatcataataaaacactcctaaaagatttttcataatatcctgtcaaaattttgaaaaataagaacttttgaggaaatccaaagcagttttgcatgttcacacccctacaatgttttaatgaatgaataagtaaaacaaaattaaagtataaaaaatgtaggaaaaaattttttttggtcgacttccaaaattatgagcttcaaaaactgagtaattatcactttttgacagtaaataaaaaattttcgaaatttttaagaaacgttttattatgatattcggtcattttggcactatagaaatagtttaaaacagtttccccactggcgctaccccacctttgaaaaaaatttagaaattttctggtaagcgaaaattaaatacactagtttttttggcaacaaacttctaaattatattggaaactaatttgataattgtttaaaatttaagatgtttctaaatgttcaatgactttttttgcaaattttcgaaaaagtttaaaattttaaatttctaactgcgatcgaaattaaaccatatataaatactgtttattgaattttttggttttttgatttaaaaattcttttgagtacatatgtagtattatacataaatagcaaatactcttttcaaaaatcacactaatttgagtttgaaattgttttgattattttaaaaatatataaacgtttttttttctgtttcagacgatattagctgttgatctcattcacctccatgatggctccccactttttggcgaagaagttttatcacaaaccggtaaaccattgacaaggtttcaaggtattccatttgcagaaccaccagttggcaatctcag

SEQ ID NO: 30719 - DNA, 615 bp, Caenorhabditis elegans
gacacgctggatcatgcctccaaagattctccaccatgccattcctgttctgcgacttcaacaacgtctgcaactacgcctccagaaacgacaagtcttactggctctcaacatctgaagctatcccaatgatgccagtcaacgagcgtgaaatcgagccatacatctcgcgctgcgctgtgtgcgaagccccagccaacacgatcgctgttcactcccagaccatccaaattccaaactgcccagcaggatggagcagcttgtggatcggatactcgttcgccatgcacaccggagccggagccgagggaggtggtcaatcactctcctcaccaggatcctgcttggaagacttccgtgccactccattcatcgagtgcaacggtgcccgcggatcttgccactactttgccaacaagttctcattctggcttaccaccatcgacaatgactcagaattcaaggtaagaattcaaaaatagactgagaacatgtaacatatcaacacgccttaattttcaggtgccagaaagtcagacactcaagtcaggaaatcttcgtacccgcgtctcaagatgccaagtttgcgtcaagtccaccgacggacgtcattaa

SEQ ID NO: 30720 - DNA, 735 bp, Burkholderia cepacia
ctgcagagcaaggttgcggccattaccggagcggcgggcggcctcggcacgggtatcgcaaagcggcttgccggactgggcgcgagtgttgcgttgcttgagccgggaatcgaacgtctcgtctcgctcgcgagcgaactgacagattccggagcaaccgtgttgaacgttgcgtgtaatgtcaccgatgccgcatcgacacgttacgctgccgcacaggtgttgtcgagcttcgggcgcatcgacgtgctggtcaataacgcaggtgttctggctcgtccatcggcgctcgaaagcatatcgctcgaggactgggatcgcagcctcgcggtgaatctgacaggtgcattgctgtgcacggcaagcttcggtgcggcaatgctcgaagcgggggcaggcagcatcgttaatattgcttcgatcgcggcgtacagcccaaacacgtccgttgcctacagcgtcagcaaggcgggactactggcactgacgcgtcacacggcagtggagtgggcgccgcgaggcatacgtgcaaactctgtgagcccgggattcattcgcacgccgctttcggaagttcactacgccaatcccgatctgttgcaacttcgcacgcaagcgacgcccgtcagacgtcttggcaccgtcgatgacgtcgccgcaatcgtcggctttctggcgagtcctgcaagcgccttcatcaacggagaggacatcgtcgccgatggcggatttctg

SEQ ID NO: 30721 - DNA, 795 bp, Burkholderia cepacia
atgaaatttcaggatcggatttgtgttgtgacaggtggtgcgtccggtatcggcgcggcgatctgtcgcgccttcgacgctcagggtgcaaagctcgccgtgctcgacgtggaccgcgactctggcgaaacctttgcacggagtctgcggggcgctgtctttatcgaatgcgacgttgcggatgcggcttccgtaaagcgtgcattcgagcggatcgcccaacgctgggatcgtacggatgttctcgtcaataacgcgggcattgtcgggcgcgaagaatatggccgcgtgcagacccggcgagtgcaacagatcgaagatgtcagaagcggccgcaagccgggaccgcttcgcgcaaccgtgagcctgaccgacgagcaatggcgccgcatgatcgacattcatctgaacggcacattttattgcacgcgcgaggccttgctccagatggagcggctggggcagggcgcgatcgtgaatatgtcttcgatcgcgggtctcgacggcggctttggcaatcctcattacgcagccgccaaggcgggaattctcggattcacccgcgcggtcgcaaaagaggcaatccagcagggcattcgcgttaacgcggtggcgccgggattcgtcgattcgccactgcggcgaagtctgtcggaagcgttgcagcaacttcagatcgccgcgactccgatgggccgcgcggccaccggtgacgagattgcttcgctcgtgttgtttctcgcgagcgacgacgcgtcgtacctggtaggcgaaacgatcagtccgaacggtgga

SEQ ID NO: 30722 - DNA, 1815 bp, Burkholderia cepacia
atcgaggcgcccgcgtgggtcaaaaaccgaaaactggtcgactgggtgcagcgcgtcgccgccatgaccaagccggacagaatcgtctggtgcgacggctcacaggaggaatacgaccggctttgcgcgcagatggtcgaggcgggcaccctcaaaaaactcaaccccgcgaagcgtcccaactcctatctggcatggtctgacccgtccgacgtggcgcgcgtcgaagatcgcaccttcatctgttcgcagcagcgagaggacgcgggccccaccaacaactgggtcgccccggccgagatgcgctcgacgctcggcggcctgttcgaaggcgccatgcgcggccgcaccatgtatgtggtgccgttttcgatggggccactcggttcgccgattgcgcacatcggcgtggaactgagcgacagcccgtacgtggtcaccaacatgcgcatcatgacgcgcatgggccgcaaggtgtacgacgtgctgggcgaagacggcgagttcgtgccgtgcgtccactccgtgggcgcaccgctcgcggcgggcgaaaaagacgtgccgtggccgtgcaacgcaaccaaatacatcgtccactttccggaatcgcgcgaaatctggagctatggctcgggctacggcggcaatgcgctactcggcaagaagtgtttcgcgctgcgcatcgcctcgactatgggccgcgacgaaggctggctggccgagcacatgctgattctcggcgtgacctcgccggaaggccgcaagcatcatgtggcggcggcgtttccgtcggcgtgcggcaagaccaactttgcgatgctgattccgccggaaggcctgaacggctggaaaatctccacgatcggcgacgatatcgcgtggatcaaaccgggcaaggacggccgcctgtatgcgatcaatccggaagccggctacttcggcgtggcgccgggcacgagcgaaaagaccaacttcaacgcaatggccacgttgaaggaaaacgtgatcttcacgaacgtcgcgctgaccgacgacggcgacgtctggtgggaaggcatgaccgacgaaccgccggcgcacctgatcgactggcagggcaaggactggacgccggccggcgcgaagcaaagcggccgcaaggcggcgcacccgaacgcgcgctttacggcgccggcctcgcaatgcccgtctatcgacgccgactgggaaaacccggcgggcgtcgcgatcgacgcgttcatcttcggcggacgccgttccaccaccgtgccgctcgtcaccgaagcgcgcaactgggtggaaggcgtctacatggcggcgactatgggctcggagaccaccgccgccgccgccggccagcagggcgtggtgcgccgcgacccgttcgcgatgctgccgttctgcggctacaacatgagcgactacttcggtcactggctgaaaacgggcgagcgtctggagcaactcggcgcgaagctgccgaaaatcttctgcgtcaactggtttcgcaagggcgcggacggcaagttcgtctggccgggcttcggcgagaacatgcgggtgctgagctggatggtcggccgggtcgaaggctctgctcaaggtgcggaacatgcattcggcgtgtcgcctcactatgaggacatcgactggagcgggctgaatttcagccgcgagcagtttgagcaggtgatttccgtggatgacgccgcctggcgcgacgaactcgccctgcacgccgagctgtttgacacattgcaacacggcttgccgccggcgctaacccaggccaaacgcacactcgaaggaaaactc

SEQ ID NO: 30723 - DNA, 1941 bp, Burkholderia cepacia; identical to SEQ ID NO: 27968

SEQ ID NO: 30724 - DNA, 1374 bp, Burkholderia cepacia; identical to SEQ ID NO: 27969

SEQ ID NO: 30725 - DNA, 1353 bp, Burkholderia cepacia
gacgaagctcgggcgctgagctatacggacctggaaacccgcacgcgcaccctcgccggccgtttgctgacgcatggcgcgaaaccgggcgaggcgcttgcgatcagcatgaaccgttcgctcgatgcggtgctgttactgctcgccgcgattcgcgcgggtctgagcccgtgcgtgctggagcccagacttgccgacggcgaagctcgcgcgcgcgtcgccgccacggctgccgcgtggctcgtgtacgacgacgacaacgccgcgctggccggatcgttcgatctgcccggttgcacgccgctcgccttcgacgccctgtgcatggcaaccccagccgacgcgctcacgctgccggagattgcacctgacacgcccgcgctgctgctgtttacttcgggcagtaccggccggcccaaggtcgtacaactcacgcaagccgcattgctcaataacgccctcggcgtgatcgacatgagcgcgctgaacagcgaggaccgcctgctgcatgtcatgccgatctatcacaccaacggtgtgaacaaccagttgttcgcgccgttactggccggaagcaccgtcctgttctgttcgcgttttcgcgcggcggacatgcccgctctgctcaattcgtatcggccaaccatcatcaccggcgtgccgaccatgtattcgcgcatgctctcgcaatcgttcgataccgaagcgctcgccggcttacgcatggcacgctgcggatcggcgccgatcaccgagacactgcaccgcgaagtggaagcgaagctcggttgcccgctggtcgtctcgtacggactctcggaagcgacctgcaccagcacgctcaatccgccgcaggcacgccgcatcggttcagtcggtaaggtgctggcgggacagaccgtcgagctgcgcgcgcccgacggcagcatgagcgcgacgccgggcgtcgagggcgaaatctgtatcggcggcgcgaatctgatgagcggctatctgggcgcgccggatgccaccgcccgcgcggtcaccgacaactggctgcgcacgggcgacctcggccggttcgacgacgacggctacctgaacatcacgggccgcatcaaggacgtgatcattcgcggcggcgagaatctgtcgccgctgctgatcgaaagcgcgattgtcggcgtcacggcggtgtcggcgtgctgcgtggtcggcatggccgaacgcgatctcggcgaggtgccggtggcgttcgtggtggcggatgaagcggcgagcgggttgagcgtcgagctcatccagaacgccgtgcgcgagcgaatctcgcgcatctttgttccacacgaagtctttttcgccaatacgctg

SEQ ID NO: 30726 - DNA, 768 bp, Burkholderia cepacia; identical to SEQ ID NO: 27971
  unsure (1)..(768): unsure at all n locations

SEQ ID NO: 30727 - DNA, 1406 bp, Burkholderia cepacia
aatgcaaatccgaaacacgtcgcggatccgaccaggcttcgtaatcagaatctgattggcggccagtggaaagctgcgctttctggccagtcgatcgccgtcgagaatcccgcgaatgaagagatcatcgcgcaagtcccgagaggacagcaggaggatatcgacgaggcagtgaaagttgcgcgggcgacgttcgagtcggctgcgtggcgcaagattcgtcccatcgaccgcggtcgcatcctggagaacatcgcgcgcaaggtcgaagagcacgccgaggaactgtcctggctggagtctctggacactggcaaggcgatctcgttcgccagggtcatcgatcttccctcgaccgttgacgtgttccgttacatgggcggctggtgctccaagctgggcggtacgactccgcctatctctttcgatggaaaggaataccacgcttacacgcgtcgcgagccggtgggcgtggtcggtgcgatcacgccatggaactacccgctcgcactgggctcctggaagatcgcatcagcgctcgccgcggggtgcacgatggtgctgaagcccaccgagctcacgccgctcagcacgcttcggctggccgaattgtgtcttgaggcggggttgccggaaggggcactgaacgtcgtcaacggctacggccatgaggccggtgaggcgctggcgcgtcaccccgacatcgacaagatcaccttcacgggatcgacggtggtgggcaagaagattgtcgagtacgcgcttggcaacatgaagcgcgtgacgctcgaactgggcggcaagtctccaagcatcgtgttcgacgacgctgatcttgatcaggtcggcctcggtgcagcacttgctgtcttcttcaactccgggcagatctgttttgctgccagccgcctgttcgtccaggccagcgtctacgatcgcgtcgtcgaagctgttgccgccgtggcgtcgcagttcaaggtgggcaacgggcaggacaccgacaccatgctcgggccgcttgtgtcccgtaagcagcaggagcgggtcctcggctacgtccaatctggcatcgagcagggcgcaagcctcatctacggcggccagaaaatcggcgacaagggctacttcctgcagcccacggtgtttgcggatgcggatcagtcgatgaagatcgcgcaggaggagatttttgggcccgtggtgagcatcatccgcttcaaggacgaggtggaggccattcgtcttgcaaacgacacaacgtatggactggccgccaacatctggacgcgcgatatcaagaaagcgcatcgggtcgcccaccggttgcaggccggatcggtgtggatcaactgccacggcgtcatcgacccggcggcgccatttggcggttcaaacagtcgggctgg

SEQ ID NO: 30728 - DNA, 750 bp, Burkholderia cepacia
atgagacttgaaggcaaggtggcgatcatcaccggtgcggcaaccggtatcggcaacgcgatcgcgcgggcgtatgtggccgaaggtgcgaaggtcgtgattgcagacctgaagggggcggaggcagcggcatctgaacttggcgcgggtattgcgctaggtatttacgccaacgtcgccgatccggacagcaccaggcagatggctgctgctgctgtcgagcggtttggcaagatcgacgtgctggtcaacaatgccggcattttcacgggcctcagcggtgttccgatggaaggcatcacggtcgaggactgggacaaactctacgctgtcaatgtcaagggtccgtggctttgcacgagcgcagtctcggcggcgatgcgtgagggcggtggcggcaagatcatcaacatcgcctcggtcatcgcgcacgtcggcgtgcccttcatgctgcactacgtctcgagcaagggtgccgtggcagccatgacccgcgcaatggcgcgggagtttgctgccaccaaggcgggaattacggtcaacgcgatctctcccggctatacccattctgcaaacgcagtggccaatacccagcagcacgagcagttcgaaggcgtcgccgcacagatgcgcacgatcgggcggccgcaggtgcccgaggacattgccggcgcagcactctggctcgcgagcgacgaagcgtcctacgtcaacgggcagaacatcattgtggacggtggcattttcatg

SEQ ID NO: 30729 - DNA, 1938 bp, Burkholderia cepacia
atgcggctgttcttgtgcgagaagccctcccagggcaaagacattggccggattctcggcgccacgcagcgcggtgaaggctgtctcaacggttccggcgtcactgtcacctggtgcatcggccatctcgtagaagccgctgcgcccgaagcctacgacgagcagttgaagcgctggtccattgagcagttgcccatcattccccagaattggcgggtcgaggtcaaaccgaagaccgccacgcaattcaaggtcgtcaaggcgcttctggcgaaggcgacccagcttgtcatcgccaccgatgccgaccgcgaaggcgagttgatcgctcgcgagatcatcgaactgtgcggctaccgcggccccatcgagcggctatggttgtcggcactcaacgatgcgtccatccgcgccgcactgggcaagctcaggccatcggccgagacgctgccgatgtactactcggcgctggcacgatcgcgggccgactggctcgtgggaatgaacctcagccgcctgttcaccgtgctcggtcgacaagcgggctacgacggcgtgctgtcggtcggccgcgtgcagacaccgacgctcaagctcgtggtggaccgcgaccgcgaaattgcggccttcgtgtccgtaccgtactgggccatcgacgtgtccctgtccgcaagcggccagtctttcaccgcgcaatgggttccgcccgatgcctacaccgacgacacgggccgctgcctgcagcagccggtcgcacagcgggccgcgcagcagattcgcggcgcgggcagcgcgcaggtggtgtcggtcgagaccgagcgcgtgcgcgaaggcccgccgctgctgttcgacctgggcaccttgcaggaggtttgttccaagcaacttgggctggacgtgcaggaaaccctggagatcgcccaggccctgtacgagacgcacaaagccacgacgtacccgcgctcggattccggctatctgcccgaaagcatgttcgccgaggtgtccacggttctcgacagtctgctcaggaccgatccctcgctgcgcccgatcatggaccagctcgaccgctcccagcgctcgcgtgcatggaatgacggcaaggtcacggcgcaccacggcatcattccgacgctcgaaccagcgaacctctcggccatgagcgagaaggagttggcggtgtaccggctgatccgggcgcattacctcgcgcagttcctccctcaccacgagttcgatcgcaccgtggcgaacctagcctgcggccagcagaaactggcggccacgggcaagcaggtcgtggtgaagggctggcccctggtactgaccgagcctcagcccgacgaggacggcgacgctgcggcgcgcagccaggtgcttcccgcgctgcgcgagggcttggcatgtctggtggccgacgtcgatctgaaggcgctcaagacgctgccacccaggccgtacacgcagggcgaacttgtcaaatccatgaagggagtcgccaagctggtgacggacccgcgcctgaagcagaagttcagggacacggtcggcatcggcaccgaagcgacgcgagccaacatcatcagcggcctgatcgcacgcggctatatcgtgaagaaggggcgcgccatccgcgcatccgatgctgctttcacactgatcgacgccgtgcccgcggcgatcgccgaccctggcactaccgctgtctgggaacaggcgctcgacatgatcgaagctggacagcttacgctggacgtattcatcggaaagcaggctgcatggatttcgcagttgatcgcgcagtacagcatcgcgtccctgtccatcaaggttccccaagggccggcatgcccgcagtgcggcgcacccacgcgtcagcgcagcggcaagagcggcccgttttggtcgtgcagtcgttaccccgactgcaaaggc

SEQ ID NO: 30730 - DNA, 1575 bp, Burkholderia cepacia
atgaaaactgttcagcatgcagcttatgaaattcttcgccgccacggcctgaccacgatcttcggcaatcccggctcgaacgagctgccgttcctgaagcatttcccatcggattttcggtacatcctcggtttgcacgaaggtgtcgtgacgggcatggcagacggctacgcgcaggccaccggcaaccctgcattcgtgaacctgcactcggccgcgggtaccggcaacgcgatgggcgcgctcgccaacgcgtggaattcgcatacgccgctcgtcgtgacctcgggccagcaggtccgctcgaccatcgggatggaaccgctgctcgcgaacgtcgacgccgtcaacctgccgaggccactagtgaaatggagcaccgagccagccagcgccgaagacgtcccccgttccttcgcccaggcgattcacatcgcccgtacaccggccaccggccccgtatatctttcgattccctacgacgactgggaccagcccgcacccgagtacgcgcactatctggcagcacgcgaggtgcagcatgccggactgccttcggaggcgatcctgcaggcgctcgctgaccgcttacagcgcgcgacgaacccagtactggtcctcggcccggacgtcgacgcgcagcacgcgaacgagtcggccgttgccctggccgagcgcctgaagatgccggcctggatggcaccgtccgcaccgcgctgttcgttcccgacgacccatgcgtgctttcgcggcgtgctgccggcgggcatcgcaagcatctcccggctgctcgacggccacgacctgatcctcgtggtcggtgcgccggtgttccggtatcaccagtacgaaccaggcgcactactgccggccggcgcggagctggtcagcattacctgcgacgtgctcgaagcggcacgcgcaccaatgggcgatgcgatcgtcgccgacatcgcactgacgctcgaagcgctcgccgcgcgcgccgaaccagctgcgcggccgatgcccgttgccgtcgcccgccctgccgcagcagcagaaacgccgggcccgctcgcaccggaacgggtgttcgacatcgtcgacgcaatcgcgccgcgagacgccatctacgtgaacgaatcgacgtcgaccacaaacctgatgtggcagcgcctgcgcatgacgtcgcagggcagctactacttcgcggcggcaggcggtctcgggttcgcgatgccggcggcggcggggatccagctcgcgcagcccggtcggcgcgtgatcggcatcatcggcgacggctccgcgaattacggcatcaccgcgctgtggaccgccgcgcaatacagcatcccgaccatcttcatcatcatgaagaacggcacatacggcgcactgcgctggttcgccggcgtgctgggcgtcgaggacgtgccggggctctacgtgccagggatcgacttctgcgcgctcgcccgtggctacggcgtcgaggcgctgcacgctgattcgggagcttccctcactgtcgcgcttgaacgggcattgagttcctccaggccgacgctcatcgaggtcgaaaccctggcg

SEQ ID NO: 30731 - DNA, 1506 bp, Burkholderia cepacia
ctgacaacgatgattattgagtccggccatttgacattggcccaactacgtcgcattgcacacttctccgagacagtccaactttgtcccagcacctttgctgcgatcgatgcgtctgcacaggccgttgagaatatagtgagaaaaggaaagccggtgtacggcgttaatacggggttcggtcgtctcgcgagcacgcacattcccttggagcagctcgatctattgcagcgcaatctcgtgctctcgcatgctgtaggcgtgggcgaaccgatgtcgcgatctgttgtgcgtttgatgatcgtgctaaaggtgtcgagcctcgcccgtggacactcgggtattcggagggaagtaatcgccgctttggttacgcttctcaatgccgacgtcctaccggtaatccccgtcaagggatcggtcggagcatcgggcgatctcgcgcctctggcgcacatgtccgccgtgcttcttggcgtcggtgaggtgaccattggcgagcggcgtgccagcgcaaacgaaggcttgcatgctgcgggacttgagccatttaccctacgcgccaaagagggattggcgttactgaatggcacgcaagcatcgacggcactcgcgctgttcaacatgtttgccattgaggacctgttttgcaccgcactggtagccggtgcgctgtcagtggatgcggcggccgcctccgttgttccgttcgacgcccgtatccatgcgctacggggccatcaggggcaaatcgattcggcggcagcgtaccgtgccttgctggagggctccgagattaacctgtcgcactcagactgcgacaaggtgcaggatccctacagccttcgctgccagccacaagtcatgggtgcttgtttgcaccagatgcgccactcggcggaagtgcttctgtgcgaggcaaattcggtctccgacaatcctttgatcttcccggatacctgcgacgtgctttcgggtggaaatttccacgcagagcccgtcgcgttcgcggctgataacctggcgcttgctgttgccgagatcggcgcgctcgctgagcgccgcatcgcacttttgatcgacacaacgttgtccggacttcctccctttctagttcgcgatagcggcttgaactcgggattcatgatcgcccatgtgactgccgcggcgctagcatccgagaacaagacgctcgctcacccagcttccgtggactcgttgccgacctcggcaaatcaggaggaccatgtctcgatggccaccttcgccgcgcgaaagcttggcgatatggctagcaacacagcgcacattctcgcgatcgagctactcgcggccactcaaggaatagacctgcgtgagccacatcgcaccagcatgcgcttgcaatcggtcaccgaggcagttcgccgggatgtaggccactaccactcggaccgacacttttctcccgacattgctgcgatcgcagcgcaggtgctgaatggagaaatcgcgcgacacagtccg

SEQ ID NO: 30732 - DNA, 747 bp, Burkholderia cepacia; identical to SEQ ID NO: 27976

SEQ ID NO: 30733 - DNA, 1098 bp, Burkholderia cepacia; identical to SEQ ID NO: 27977

SEQ ID NO: 30734 - DNA, 1269 bp, Burkholderia cepacia; identical to SEQ ID NO: 27978

SEQ ID NO: 30735 - DNA, 1125 bp, Burkholderia cepacia; identical to SEQ ID NO: 27979

SEQ ID NO: 30736 - DNA, 981 bp, Burkholderia cepacia; identical to SEQ ID NO: 27980

SEQ ID NO: 30737 - DNA, 1752 bp, Burkholderia cepacia; identical to SEQ ID NO: 27981

SEQ ID NO: 30738 - DNA, 702 bp, Burkholderia cepacia; identical to SEQ ID NO: 27982

SEQ ID NO: 30739 - DNA, 1275 bp, Burkholderia cepacia; identical to SEQ ID NO: 27983

SEQ ID NO: 30740 - DNA, 1248 bp, Burkholderia cepacia
cgcttccactatggctggctgaccgtcgcggtggtgtttctggtgttgctggcagcggccggcacgcgcgccacgccgagcgtgatgatggtgccgctcgagcatcaattcggctggagccgcgcaacgatctcactggcgatttcggtgaatatcgcgctgtacggcctgatgggcccgttcgcggctgcggccatgcagcgtttcggcgtgcggcccacgctgctggccgcgctcggcacgatggccgcaggcgtggcgctctcctcgctgatgacgcatccgtggcaaatggtgctgatctggggcgtgatggtcggcggttcgacgggcgtcgcggcgctgtcgttgtcggcgaccgtggtgacgcgctggttcacgacgcggcgcggcctcgtcatgggcattctcacggccagttcggcgaccggccaactggtgttcctgccgatgctcgccgccatcgccgagcatgacggctggcggcaggtggtgtggaccgtcgccattgctgccgccatcgtgattccgctggtggcgtttctgttgcccgaacgtccgtccgacatgaagctgcgtccctacggcgaaccgcacgatacgcccatcaacggcacggtcaccagacagaatccgttggccatcgccttcggcacgctcgcgatggcgagcaagacccgtgacttctggctgctgtttttcagtttttttatctgtggcgcgagcaccaacggctacgtcggcacccatctgatcgcgatgtgcggcgactatggcatgacggaagtgcagggcgcttcgctgctcgccgctatgggcatcttcgatctgttcggcacgacgctctcgggctggttgtcggaccgcttcaatagccgtgtgctgctgttctggtactacggtctgcgcggtttgtcgctgatgtatctgccacacgcgttcggcatcgactttttcggtctgccgctgttcgccgtgttctacggtctcgactggatcgcgaccgtgccgcccacggtgcgcctcgctaccgacgtctacggcaaggaggcggcgccggtggtgttcggctgggtggtcgccggccaccagctcggcgcggcgttcgcggcgctcggcgcggggatgctacgggcgagcctcggcacctacacggtggcgtcgatgatttcgggcggcttgtgcctcgtggcggcggtgatcgtgttgcggatcaaccggcctgccaaggtgccggagccgcaggcg

SEQ ID NO: 30741 - DNA, 864 bp, Burkholderia cepacia; identical to SEQ ID NO: 27985

SEQ ID NO: 30742 - DNA, 2060 bp, Burkholderia cepacia
cctgcgacttcaccccgtacgctgctcgacaagctgtggcaaagccacgtcgtcgcggaaacgcccaacggcccaacgctgctttatgttgaccgccatctcgtttacgaggtgacaagcccacaagcgttcgaggcgattcgcctgtcgggccgcaaaccctggcggcctgaaacagtactcgcggtcgctgaccataacgtaccgacgatcgccgcggagcgcacgagcatggacgcgatcgctgacccactctcgcgcattcaggtcgcgcagctcgacaaaaattgcaaggagtttggtatcaagtcgtacggtatccggaacccgcagcaaggaatcatccacgtagtcggcccggaactcggggcgacgttgccgggcatgacggtcgtggcgggagactcgcacacgagtacccacggtgcgttcgccgcactggcgttcggggtgggcacgtcggaagtcgagcacgtgctggcaacccaatgcctgtcggttgggaaaatgaagtcgatgctcgtgaacgttgagggcgtactgccggtgggcgtcacggccaaggacgtgattctcgcgatcatccgcaggaccggtaccgccggcggcaccggttacgcaatggaattcgcgggcagcacgatccgcacgctgtcgatggagggtcgcatgaccctgtgcaacatggcgatcgaggcgggcgcccgggtggggctgatcggcgtcgacgatgtcacgatcgactatgtgaaggggcgtcccttcgcgcccgcagaagcacactgggatgcggcggtcgcctattggcgcacgctggtcagcgatgcggacgcccggttcgacaagatcgtcaacatcgacgcaacgcagctacggccgatggttacctggggcacgtcgcccgaaatggtggtcacggtcgacgacgctgtaccgaatccgttggacgatcccgatcccgttcgccgcgccaccatggccggcgcgcttacgtatatgggacttgagccaggtacgtcgctcaagagcatttcactcgacaagattttcatcggctcctgcacgaatgcacgcatcgaggatctgcgtgcagccgccgcgatcgtcaagggcaggcacgtcgcgccgaccgtccagcttgcgctggtggtgcccggctcgggtctcgtcaaggcacaggccgaggccgaggggctggacgccatattcaaggaggccggctttgaatggcgcgaaccgggttgttcgatgtgcctcggcatgaacgacgaccgcctgcgtccgggggagcggtgtgcgtctacatctaaccgaaattttgaaggccgtcaggggcctggtggccgcagccacctcgtcagtcctgcgatggcagccgcggcagcgattgcaggtcacttcgttgacgtttcccacggaggcttctagtgcaaccctttacgaaactggaggcgctggtggtgccgctcgaccgcgtgaatgtcgacaccgacgcgatcatccccaagcagtttatgaaatcggtgcaacgtaacggcttcggcatcaatctgttcgatgaatggcgctacttcgatcacggagagccgggacaggatccgtcgacccgtcggttgaatcccgatttcgtactcaatcaaccacgtttcgcgggtgcggagattctcctcacgcgcgacaacttcgggtgtggatcgagtcgcgagcatgcagcgtgggcgttgtgggacttcggtatccgagcgctgatcgcaccaggctttgccgacatcttctacggcaactgcttcaagaacggcatgctgccgatcaagctcgatgaacgtatcgttcagcagttgttcgatctcgttgggcgtactcccggcctgaggctagcaatcgatctggaggctcagcgcattcaaccaccagccggtgatgcgattccgttcgacgtcgagcccgagcgcaaacgccgcttgctcaatgggctggacgacgtcgctctgacattgcagcaaaccgatcagatccgtgcgtatgaacgcaatcgccgcgcccatgagccctggcttttc

SEQ ID NO: 30743 - DNA, 1062 bp, Burkholderia cepacia
ttgagccgttattggagtgacatcgttcaccgtctgacgccatatgtgcctggcgagcagcccgtggttacgcatccggtgaagctgaataccaacgagaatccgtatccgccgtcgcctcgtgtgctcgaagcgatccggcaggaactgggcgacgcagccgaatcgctgcgccgctaccccgatccgacggcgcaaaagctccgcgaaacggttgccgcgtaccacggcatccgcgccgagcaggtctttgcgggcaacggctcggacgaagtgctcgcgctcacgttccaggcactgctcaagcacgacaagccgctgctgtttccggacgtcacctacagcttctatccgacgtacgcgcggctgttcgaagtcgactaccggactatcccgctcgacgatagcttcacgatccacgtcgacgattacatgtcgccgaacggcggcatcctgttcccgaatccgaatgcgccgaccggccgcccgctgccgcttgccgatatcgagcgcctggtggcgagcagtcccgattccgtggtggtgatcgacgaagcgtacgtggatttcggcgcgcagtcggccatcggtttgatcgatcgctatccgaatctgctggtcgttcagaccgtatcgaagtcgcgttcgctggccgggatgcgcgtcggctttgcgttcggcaatccggacctgatcggcgcgctgaaccgtgtaaaggacagcttcaactcctatccgttagaccgcctcgcgcaggctgccgccgcggcggcgtacgaagacgacgcatggtttcgcgacacgtgcgccaaggtcgtggcgagccgtgaacgactggcggccgggctgacggcgctgggcttcgaggtgctgccgtcggccgcgaatctgctgttcgcacgccacgaaggctacgacgccgcaacgctcgcattgcggttgagggacaaggaaattttcgtgcgccatttcaaggctccgcgaatcgaccagcatttgcggatctcagtcgggacggacgccgaatgcgacattcttctggacgcgctgcgggacatcttc

SEQ ID NO: 30744 - DNA, 639 bp, Burkholderia cepacia
atgaagctctatagctatttccgtagctcggcgtcctatcgcgtgcgcattgcgctgaacgtgaagaatctgccgtacgagtacgtgccggtgcacctcgtgcgcgagggcggcgagcaactgaagccggaataccgcaaggtgaatgtggactgcgtcgtgcccacgctcgtcgaaggcaatgacgtgatgccgcagtcgctcgcgatcatcgagtatctggaagaaacgcatcccgagccgccgcttctgcccaaagcgccggtcgatcgtgcgtatgtgcgggcgctggcgttgcaggtggcgtgcgagatccatccgctgaacaatctgcgcgtgctgaagtatctgaagcacacgctgggtgtcgacgactatgcgaaggacgcgtggtaccggcactgggtggaagcggggttcgccacgttcgaagcgcatctggccggcgattcacgcaccggcaagctgtgtttcggcgatacgccgacaatcgccgatacctgtctgattccgcaggtgttcaacgcgcagcgcttcaaggtcgacacggcgaaatttccgacgatccagcgcatctacgatcacgcaatgcaactcgacgcgtttgcccgtgcggcgccagacgtgcagcccgacgcc

SEQ ID NO: 30745 - DNA, 1890 bp, Burkholderia cepacia
atggttgaacttgaaatagacggcaagaaagtagaggtgcctgaaggcagcatggtgatccaggctgcgcataaggtcgacacgtacattcctcacttctgctatcacaagaagctgtcgattgcggccaactgccggatgtgtctggtcgatgtcgaaaagatgccgaaagcggtgcccgcgtgcgccacgccggtatcggccggcatgatcgtgcgcaccaagtcggacaaggcggtgaagggccagcaagccgtgatggaattcctgctgatcaaccacccgctggactgcccgatctgcgaccagggcggcgagtgccagttgcaggatctggccgtgggctacggcaaatcggcgtcgcgctatagcgaagaaaagcgcgtggtgttccacaagaacgtcggcccgctgatctcgatggaagagatgtcgcgttgcatccactgcacgcgttgtgtgcggttcggccaggaagtggccggcgtgatggaactcggcatgctgggccgcggcgagcattcggaaatcacgtcgttcgtcggcaagacggtggattcggaactgtcgggcaacatgatcgatctgtgcccggtcggtgcgctgaccagcaagccgttccgctacagcgcccgcacgtgggaactgtcgcgccgcaagtcggtgagcccgcacgattccgtcggcgccaacctcgtggtgcaagtgaagaacaaccgcgtgatgcgcgttctgccgttcgaaaacgaatccatcaacgaatgctggatttcggacaaggaccgcttctcgtatgaaggcctgaacagccccgagcgtctgactcagccgatgctcaagcaaggcggcaagtgggtcgagaccgactggcaaaccgcgctcgaatatgtggtgaagggtttgaagggcatcaagggcgaccacggcgcaaatgcgctggctgcgctcggcagcgcccacagctcggtcgaagaactgtttctgttgaagcaactggcgcaagcggtcggcacgcctaacgtcgacttccgtttgcgtcagtcggatttctccgcgccggtcaacggcgcgccgtggctcggcaccgcgatcgccgatctgtcgaacgtcgacgccgcgctggtgatcggctcggatctgcgccgcgatcatccgctgttcgccgcgcgtctgcgtcaggccgcaaagggcggcgcgaagctcacgctcgtgcaggccaccaacgacgacgcgctgattccgcaagcgcaacgcgtggtagcggcgccgtccgcatggctcgacgcgctggccggtattgccggggccgtgtcggaagccggcggtgtggcgctgccggaagctttcgccggcacgcagccttcggacgccgacaaacaggtcgcgaagtcgctcgccacgggcgaacgccgcctcgtgttgctgggcaatggcgcggtccgtcatccggatttcgcggtcatccaggccgcggcgcaatggatcgcagatgcgaccggcgcgacgcagggcttcctcacggaagcggccaacacggtcggcgcgcatctcgtgaacgcgttgccgggcgagggcggtctgaacgctcgcgaagtgttcgagcaaccgcgcaagggttatgtgctgctgaatgtcgaaccggagttcgacacggccaatccggcgcaggctttggccgcgctgaagcaggctgaaatggtggtcgtgctgtcgccgttccagaccggtgccgactacgccgacgtgctgctgccgatcgcgccgttcacggaaaccgccggcacgtttgtcaacgccgaaggtacggtgcagacgttcaacggtgtcgtgcgtccgctcggcgacacgcgtccggcctggaaggtgttgcgtgtgctgggcagtctgctg

SEQ ID NO: 30746 - DNA, 462 bp, Burkholderia cepacia
atgcccgcgacgatccgtgccgccacgcccgcggataccggcgcgatcttcgcgctgacgtacgagctcgcggaattcgaaagcctcacgcatgtgttcgtcgcgaccgaagaaggcctgcacgacgcgctgttcggcgcgcggccttccatcgaggcgctggtcgcggaaaacgaaagccgcatcgtcggctatgcgctgttcttccacaactactcgagtttcgtcggcaagcgcggactgtatctcgaagacgtctatgtacaaccctcgcaacgcggcagcggtctgggcaccgcattgcttcggcgcctcgccgcactggcggtggaacggcaatgcgggcggttcgaatggaccgtgctggactggaaccggcaggccatcagcttctacgaaaagatgggcgcgaccgtcatgccggactggcgcgtggtgcgcctgacgggtaacgcgctcgaa

SEQ ID NO: 30747 - DNA, 777 bp, Burkholderia cepacia
ctcaaggacaaggtggtgttgatcacgggcggcagcaagggaatcgggctggcctgtgcccgtgcgtttgcgctcgagggcgcgaaagtcgcgatcgtctcgcgcgatcccgccaacctcgcgcgcgcctacgaacagttgaaacacgaaggcctgcacgtgcaccggacccgcgccgatctgcacgaaccgcacagcgccgccgatatcgtcgaggaagtcagcaccgcggtcggcccgatcgatgtgctgatcaacagcgccggcgccgcgcgccgctacgacccggaaacgctcgatgccgaggcgttccgcgccacgatggaagcgaaatacttcccctacatctacccgcagcaggaagtgctgcgccgcatggccgagcgggcaaaatccgggagcgggggcgagcccggcacgatcgtcaatatcatcggcatgggcggcaagatagcgagcgatatccacattgccggcggcgccgcgaatgccgcgctgatgctcgccactgtcggccttgcgcactattacgcgcgctacggcatccgcatcaacgcgatcaatcccggcgcgacgcttaccgagcgtgtcgaggaagccgtcaaactggaggcgacgcagcaaggcatcggcagtgcggaagcgctcgcgcgcggccaggccagagtgccgcttgggcgcttcgccaaaccggaggaaatcgccgatgtcgcgctgtttctggcgagccgccgtgcaagctatgtgacgggcgcgatcgtcccgatggatggaggc

SEQ ID NO: 30748 - DNA, 966 bp, Burkholderia cepacia
tcccgcgtgctgggcacgggcagttatctgccgcccaaccgcgtcaccaatcaggatctggcgaaacgtctcgccgagcagggtatcgagacaagcgacgagtggatcgtcgcccgtaccggcatccacgcgcgctacttcgcggaaccggatgtcacgaccagcgatctggcgttcatcgcttcgcagcgcgcgatcgaagccgcggatatcgacccgcaatccatcgacctgatcatcgttgcaacctccacgcccgacttcgtgtttccgagcacggcgtgcctgttgcagaacaagcttggcatcaggaaccacggcgcggcgttcgacgtgcaggccgtctgttcgggttttgcctatgcggtggcgacggcggacagcttcattcgcagcggtcagcatcgtacggcgctcgtgatcggcgcggaaaccttctcgcgcattctcgacttcaaggaccggaccacctgcgtgctgttcggcgacggcgcgggcgcggtgatcctgcaggcgtccgacgaaccgggcgtgcttgccagcgcgttgcacgcggacggcagccattcgaacattctttgcacgccgggcaacgtgaacggcggtgtggtatccggcagcgcgttcctgcatatggacgggcaggccgtgttcaagctcgccgtcaacgtgctcgaaaaagtcgcggtcgaagcgctcgagaaagccaatctgtcggctgagcagatcgactggctgattccgcatcaggcgaatatccgcatcatgcaaagcacctgccgcaagctcggtttgccgcaggaacgcatgatcgtcacagtgggcgagcacggcaacacgtcggctgcgtccattccgctcgcactcgacgtcgcggtgcgcgacggccgcatcaagcgcggccagaacgtgctgatcgaaggcgtcggcggcggcttcacgtggggcgcgtcggttatccgctac

SEQ ID NO: 30749 - DNA, 918 bp, Burkholderia cepacia
aaatttgcgttcgtttttcctgggcaaggttcgcagtcggtcggcatgctcaacgcattcgccgatcaggcggtcgtgcgtgagacggttcaggaagcctccgatgcgctcaatcaggacctcggcaagctgatcgccgaaggccctgccgaagatctgaacctcaccaccaatacccagccggtcatgctgactgcctcgtacgccatgtatcgcgcgtggctgcaggctggcggcccgaagccggcaatcgtcgcgggccacagcctgggcgaatacaccgcgctggtcgcggcgggcgcgattgcgtttcgcgatgccgtaccgctcgtgcggtttcgcgcgcaagccatgcaaacggcggtgccggtcggtgaaggcgcaatggccgcgattctcggtctcgacgacgatacggtgcgcgcggtgtgcgctgaagcgtcggttgcgggtgtcgtcgaagcggtcaatttcaatgcgccggcgcaggtcgtgatcgcgggcaacaaggctgcggtcgaaaaggcctgcgaggtcgcgaaggcgaagggcgccaagcgcgcgttgccgttgccggtctcggcgccgttccactcgtcgctgctcaagcccgcgtcggaccagttgcgcgagtacctggcgagcgtcgacgtgcaggtgccggctattccggtcatcaacaacgtggacgtcgccgtggtcaacgaaccggccgcgatcaaagacgcactggtgcgccaggcggccggcgcggtgcgctgggtcgaaagcgttcaggccatgtcggctcaaggcgtcacgcacgtgatcgaatgtggtccgggcaaggtccttgcgggtttgaccaagcgtatcgacggcaacctggtcggtgcctcgatcttcgatccggcttcgctcgaagagacgctcaaactc

SEQ ID NO: 30750 - DNA, 732 bp, Burkholderia cepacia
ctcgacaagcagatcgcaatcgtgaccggcgcttcgcgcggtattgggcgagcaatcgcattggaactggcgcgccagggcgcgacggtgatcggcacggcaaccagcgaaagcggcgcggccgccatcagcgaagcatttaacgcagccggtgcgagcggccgaggcgcagtgcttaacgtgaacgacgcggccgcagcggaagcgctgatcgacggtacggtgaaggaattcggcgcgttgcatgtgctggtgaataacgccggcatcacgcaggatcaactcgccatgcgcatgaaggacgacgattgggacgcggtgatcgacaccaacctcaaatcggtgttccgcctgtcgcgcgcagtgctgcgtcccatgatgaaggcgaagggtggccgcatcatcaacatcacatccgtggtcggttcggccggcaacccggggcaagtcaattacgccgccgcgaaagcgggtgtggcgggcatgacccgcgcgcttgcacgcgagatcggcagtcgcggcatcacggtgaattgcgtcgcgccgggtttcatcgataccgacatgaccaggaccttgccggaagaacagcaaacggcgctgaagacgcagattccgctggggcgtctcggcagcccggaagacatcgcgcacgccgtggcctttctggcgtcgccgcaagccggctacatcacgggcacgacattgcatgtgaacggcggaatgtacatg

SEQ ID NO: 30751 - DNA, 216 bp, Burkholderia cepacia
atggacaatatcgaacagcgcgtcaagaagatcgtcgcagaacaactgggcgttgcagaagctgagatcaagaacgaagcttcgttcgtgaacgacctcggcgccgactcgctcgacaccgttgaactcgtgatggccctcgaagacgaattcggcatggaaattccggatgaagaagccgagaagatcactaccgttcagcaagcgatcgactac

SEQ ID NO: 30752 - DNA, 1233 bp, Burkholderia cepacia; identical to SEQ ID NO: 27996

SEQ ID NO: 30753 - DNA, 1061 bp, Burkholderia cepacia; identical to SEQ ID NO: 27997

SEQ ID NO: 30754 - DNA, 1263 bp, Burkholderia cepacia; identical to SEQ ID NO: 27998

SEQ ID NO: 30755 - DNA, 1023 bp, Burkholderia cepacia
cgcaaagcgatcatcaccggcgtatccggacaggacggcgcctatctgaccaaactgctgctcgacaagggctaccacgtgaccggcacctaccggcgcacgagttccgtcaatttctggcgtatgcgtgagctgggtgtgctcgatcatccgaatctgcgtctggtcgaacacgatctcaccgatctcggttcgacgctgcggctgctcgaaggcgcgcaggccgacgagttgtacaacctcgccgcgcaaagcttcgtgggcgtttcgttcgaccagccggtgacgaccgccgaagtaaccggcatcggcgcgctgaatctgctcgaaggcatccgcattctcaacccgaagacgcgttactaccaggcgtccacgtcggagatgttcggcctcgtgcaggccgtgccgcaacgcgaggacacgcccttctatccccgcagcccctatggcgtggccaagctgttcgcgcattggtcgacgatcaactatcgcgaatcgtatgggctctttgcgagcagcgggattctgttcaatcacgaatcgccgctgcgtgggcgtgaattcgtcacccgcaagattaccgacaccgtcgccaagatcaagctcggcaagcaggacgtgctggagctgggcaacatgagcgcgcggcgcgactggggcttcgcgctcgaatacgtggaaggcatgtggcgcatgctgcaagccgatgagccggacaccttcgtgctcgccaccggccgcaccgaaacggtccgcgatttcgtgcgcatggcgttcgccgcggcggggtatcagctcgaatggtcgggcaaggaagagcgcgaaacgggtatcgatgtcgctaccggcaagacactggtgcgcgtgaatccgaagttctatcggccggccgaagtggatctgctgatcggctgcgcggacaaggctcacgagaagctcggctggaaaccggcaaccacgctggaacagctgtgccacatgatggttcatgcggatctggggcgcaacgagcatcacgag

SEQ ID NO: 30756 - DNA, 4182 bp, Burkholderia cepacia
atgaaagctctgctcgatctattcaagcaagtccaacagcctgaagtttttgacgcgatcaagatcggtctggcttcgccggacaagatccgttcgtggtcgttcggtgaagtgaagaagccggaaaccatcaactaccggacgttcaagccggaacgcgatggtttgttctgcgcgaagatcttcgggccgatcaaagactacgaatgtctttgcggtaagtacaagcgcctgaagcatcgtggcgtgatctgcgagaagtgcggcgtcgaagtgacgctggcgaaagtgcgtcgcgaacgcatgggccacatcgaactggcctcgccggttgcgcacatctggtttttgaagtcgctgccgtcgcgtctgggcatggtgctcgacatgacgctgcgcgatatcgaacgcgtgctgtatttcgaagcatacgtggtgatcgatccgggcatgacgccgctgaaagcgcggcagatcatgacggaagaggattactacaacaaggtcgaagaatacggtgacgaattccgtgccgagatgggcgcggaaggcgtgcgcgagctgctgcgcgcgatcaacatcgacgaacaggtcgagatgctgcgcaccgaactcaagaacacgggttcggaagcgaagatcaagaagtacgcgaagcgcctgaaggtgctcgaggctttccagcgttcgggcatcaagcctgactggatggtgctcgaagtgctgccggtgctgccgccggaactgcgtccgctggtgccgctcgacggcggccgcttcgcgacgtcggacctgaacgacctgtatcgccgcgtgatcaaccgtaacaaccggttgaagcgtctgctcgaactgaaggcgcctgaaatcatcgtccgcaacgaaaagcggatgctgcaggaagccgtcgattcgctgctcgacaacggtcgccgcggtaaggccatgaccggcgcgaacaagcgtccgctgaagtcgctcgctgacatgatcaagggtaagggcggtcgtttccgtcagaacctgcttggtaagcgcgtcgactattcgggccgttcggtgatcgtggtcggcccgacgctcaagctgcatcagtgcggtctgccgaagctgatggcgctcgaactgttcaagccgttcatcttcaacaagctcgaagtgatgggtgtcgctaccaccatcaaggccgcgaagaaggaagtcgagaaccagacgccggtggtgtgggacattctcgaagaagtcattcgtgaacatccggtcatgctgaaccgtgcgcctacgcttcaccgtctcggcattcaggctttcgagccggtgctgatcgaaggtaaggctatccagttgcatccgctcgtttgcgcggcgttcaacgccgacttcgacggtgaccagatggctgttcacgtgccgctgtcgctggaagcgcagatggaagcgcgtacgttgatgctggcgtcgaacaacattctgttcccggccaacggcgatccgtcgatcgtgccgtcgcaggatatcgtgctcggtctgtactacgcgacccgtgaagcagtgaacgccaagggcgaaggtctgacgttcaccggcgtttcggaagcgttgcgtgcgtacgagaacaaggaagtcgagctggcctcgcgcgtcaacgtgcggatcacggaaatggtccataacgaagacaagtcggacggtgcgccggcgttcgtgccgaagatctcgctgtacgcgaccaccgtcggccgcgcaatcctgtcggaaatccttccgccgggcctgccgttttcggtgctcaacaagccgctgaagaagaaggaaatctcgcgcctcatcaacaccgcattccgcaagtgcggtctgcgtgaaacggtgattttcgccgaccagttgatgcagtcgggtttccgtctggcaacgcgcgctggtatctcgatctgcgtcgacgacatgctcgtgccgccgcagaaggaaaccatcgttggcgacgccgcgaagaaggtgaaggaatacgaccgtcagtacatgtcgggtctcgtcacgtcgcaagagcgctacaacaacgtggtcgacatctggtcggcaacgtcggaagcggtcggcaaggcgatgatggaacagttgtcgacggaaccggtcacggatcgcgacggcaacgaaacgcgtcaggaatcgttcaactcgatttacatgatggcggactcgggtgctcgtggttccgcggttcagattcgtcagctggccggtatgcgtggcctgatggcgaagccggacggctcgatcatcgagacgccgattacggcgaacttccgtgaaggcctgaacgtgttgcagtacttcatctcgacccacggcgcacgtaagggtctggctgatacggcactgaagacggcgaactcgggttacctgacgcgtcgtctcgtggacgtgacgcaggatctggtggtggtcgaggacgattgcggtacgtccaacggcgttgccatgaaggcgttggtcgaaggcggtgaagtcgtcgaagcgctgcgtgaccgtattctcggtcgcgtgacggtggctgacgtcgtcaatccggaatcgcaggaaaccctgtacgaaacgggcacgttgctcgacgaagatgcggtcgaagaaatcgaacgcctcggcatcgacgaagtgcgcgtgcgtacgccgctgacttgcgagacgcgttacggtctgtgcgcagcctgctacggccgcgacctgggccgcggctcgtcggtcaacgtcggtgaagcagtcggcgtgatcgctgctcagtcgatcggtgaaccgggcacgcagcttacgatgcgtacgttccacatcggtggtgcggcatcgcgtgcggcagtggcttcgtcggttgaagcgaagtcgaacggtacggtgcgtttcaccgcaaccatgcgttacgtcaccaacgcgaagggcgagcagatcgtcatctcgcgttcgggcgaagcgatgatcaccgacgaccacggtcgcgagcgcgaacgtcacaaggtgccgtacggcgcgacgctgttgcaactggacggcgcgcagatcaaggccggcacgcaactggccacgtgggacccgatgacgcgtccgatcatcaccgagtacggtggtacggtgaagttcgaaaacgtcgaagaaggcgtgacggttgccaagcagatcgacgacgtgacgggtctgtccacgctggtcgtgatcgacgtgaagcgtcgtggttcgcaagcgtcgaagacggtgcgtccgcaggtcaagctgctcgatgcgaacggcgaagaagtcaagatcccgaacaccgagcactcggtgcagatcggcttccaggtcggcgctctgatcaccgtgaaggatggtcagcaagtgcaggtcggtgaagtgctcgcacggatcccgactgaatcgcagaagacgcgtgacattaccggcggtctgccgcgtgtggcggaactgttcgaagcacgttcgccgaaggacgcaggtatcctggcggaagtcacgggtacgacgtcgttcggtaaggacacgaagggcaagcagcgtctcgttatcacggacctcgagggcaaccagcacgagttcctgatcgcgaaggaaaagcaggttctggtgcacgatggtcaggtcgtcaacaagggcgaaatgatcgtcgacgggccggcggatccgcacgacattctgcgtttgcagggcgtcgaagcgctgtcgcgttacatcgtggacgaagtgcaggacgtgtaccgtctgcaaggcgtgaagatcaacgacaagcacattgaagtgattgttcgtcagatgctgcgccgcgtgcagattacggacaacggcgatacgcgtttcatcccgggcgaacaggtcgagcggtcggatatgctcgacgagaacgaccgtatgatcgcggaagacaagcgtccggcaacgtacgaaaacgtgctgctcggtatcacgaaggcctcgttgtcgaccgattcgttcatctcggcggcgtcgttccaggaaacgacgcgcgtgctgaccgaagcggcgatcatgggcaagcgcgacgacctgcgtggtctgaaggaaaacgtgatcgtcggccgtctgattccggccggtacgggtctcgcgttccacaaggcacgcaagagcaaggaactgtccgaccgcgagcgtttcgatcagatcgcagcggaagagtcg

SEQ ID NO: 30757 - DNA, 1575 bp, Burkholderia cepacia; identical to SEQ ID NO: 28001

SEQ ID NO: 30758 - DNA, 717 bp, Burkholderia cepacia
gtcgtggatgagggccgtctacgttatgtgacgatctgccgcgaaagccgtgccaatgcgttgtcggtcgcgatgttgggatcactcgccgatgcgattgcgtcggctggccgtgtgtccgcaatcgacgcaatcgtactccggtcgacaggtgtgaacttttgcgcgggcgctgacatgggcgaactgagaacgcatcgccggcaacaatatgacgcattgcgcacgctgatcgccgcactcgacaagcgcgcggtgccgctactgtgtgtgatgcaaggtagggcgcttggcgcggggtgcgtgttgtcagcgctcgcggatgtcgtgattgcgtccgacgaagccacgcaaggctttcccgagatgcgcttcggtatgtacccttcgctggttcatgcggtgcttgtacagaaattgcctgagccgctcgtgtatgcgctttgcgtcggcgcgcgggtgttgagcgcgcacgatgcgtggtcgctcggacttgttaccgaagtgcttcctgcggacgatttcacgaagtgcgcgcgcgaccgcgtcgagttctatgtggcgcggaccgccgcggtccgctacggccgcgagatgatggatcagtctgcgagagagatgctgctggcgcgcgtggcgaaagcggaacatatcatcgaccgtaaccttgccgatcccgaggtggaagcgatgctgtcgagctacaggaaatgacgc

SEQ ID NO: 30759 - DNA, 489 bp, Burkholderia cepacia; identical to SEQ ID NO: 28003

SEQ ID NO: 30760 - DNA, 897 bp, Burkholderia cepacia
ctgtccggcaacgccatgccccgctgcggcggcatcgcaacgatgatgcggctgccgaacgtcggctccgccgaagggttcgacgcctgcttcgtcggtgtgccgttcgatctcggcacttcgaaccgcacgggcgcgcgcttcgggccgcgccagatccgcagcgagtccgtgctgctgcgtccgtacaacatggcgacgcgcgcggcaccgttcgattcgctgcgcgtggccgatctcggcgacgtcgcgatcaacccgtacaacctgcacgattcgatcgcgcgcatcgaaaccgcgtacgacgaaattctccagcacgattgcaagccgatcacgctgggcggcgatcacaccatcgcgctgccgatcctgcgcgcgatgcatcgcaagcacggcaaggtcggcctgattcacgtggacgcgcacgccgacgtcaacgacacgatgatgggcgagaagatcgcgcacggcacgccgttccgccgcgcggtggaggagggtttgctcgattgcgggcgcgtcgtgcagatcggtttgcgcggcacgggttacgcggcggaggacttcgactggtgccgcgatcagggtttcgaagtcgtgcaggccgaggcctgctggaaccagtcgctcgcgccgctgatggcgcgtgtgcgcgagcgcatgggcgacggccccgtgtacatcacgttcgacatcgacgggatcgatccggcttttgcgccgggaacgggcaccccggaaatcgcgggtttgacggtgccgcaggcgctggaaatcattcgcggctcgcgtgggctgaatatcgtcggctgcgatctggtcgaagtcgcgccaccatacgatccgttcggcacgaccgcgctgctcggcgcgaatctcgcgttcgaattgctg

SEQ ID NO: 30761 - DNA, 952 bp, Burkholderia cepacia
tgccgaaatgttatggtggccaagccatcggaggagacgcctgtgaaccgccacactgctcgccgaggtcatgcagacggtagggttacctgctggcgctttcaacctggtgcatggcttcggcccgaactcggctggggagttcatcaccacgcatccgggcatcaatgccatcaccttcacgggcgagtcgaagacgggcaccgccatcatgcacgccgctgcggaaggcgtgaagcccgtgtcgttcgaactgggcggcaagaacgccgccatcatcttcgccgactgcgactttgacaagaccgtggcaggcatgacgcgcgcggcattcctcaatagcggccaagtctgcctgtgctccgagcgcatattcgtcgagcggccaatctatgaccgcttcgtgaaggcacttgccgaacgcgcgaaacagatcaagctcggtgaccccaccgacgaggcgacgtgcatggggcctgtcatctctgccgcccatcgcgacaaggtgctcagctactacgcgctggcgcgcgaggaaggcgcagagttcatcacaggcggcggaacaccctctttcggcaaccagctcgatggcggcttctgggttgaaccgacactactcgccggcctgcccgacgacgcacgatgcgtcacggaagagatttttgggccgattggtcacgtcacgcccttcgactcggaggcagaagttatccagcgcgcgaacgcgacgccctatggcttggccgcgacgatctggacgagcaatgtgaacaaggctcatcgcgtcgcgcagtccatgaacgtgggcgtcgcctgggtcaatgcctggttcctgcgcgacctgcgaaccccgttcggtggcagcggcctgtcgggtatcggccgtgagggggggctccactcgctgaacttctattccgagctcacgaatgtctgcatccatgtagat

SEQ ID NO: 30762 - DNA, 858 bp, Burkholderia cepacia
tggaaaggtgttttccccgctgtcacgaccaaactgaaggatgacggttcgctcgatcacgaagcgatcaaaagcggtttgaaccgcctgatcgagaacggtgtcggcggtgtggtgatgatgggcatggtcggtgaaaatgcccaactcaccgcggacgagaagcgtacggtgctgaaactggccgttgagaccgttgctggccgcgtgcccgtgatctcgggtctcgcagaaacgagcaccgcgctggctgtccagtttgttcaggacgccgaggcaatcggcgtgcagggtctcatggtgtttcccggcttgacgtaccgctcggatgaccgcgaaaccgtcgagttctatcgcacgatcgcacggtccaccaggcttggcctgatgatctacaacaatccgcgcggctacggtgtggacatgcgccccgatctgatggaccagctcaaagacgaagcgaacgtggtcgcgatcaaggaagaaacgtacgacaccacccgcgtgacggacctgttgaagcgtttcggcgatcgcttcgcggtgttctgcggcgttgacgacctcgtgctggaatcggcggcactgggtgtaacgggctgggtctcgggcatggcgaacgccatgccgaaggaatcggtcgagttgctgaacctggccgtggcgggtgatttcgtcaaggcgcgcgagctttatcgcgcgctgatcgacctgttccacctggatgtgcatgtgaagctggttcagtacatcaagctggcggaaaacatgacggccggctacccggaaaacgtcaaggcgccccgcctgaagctcgaaggcgaggagcgtcagaaagtcgtggcgatcgtcgaacag

SEQ ID NO: 30763 - DNA, 1290 bp, Burkholderia cepacia
gtcgccgacgcgatcgccgcggcgcgtcacgcattccgctcgtggtcgctgacgactccacaacagcgagccgacattctcgacgccgcgggaacccgaatccttcagcgcaaagaagagttagggacgttgctcgcgcgcgaggagggcaagcgtcttcccgaggcgatcggggaagtgggccgcgcgggcaacatcttcaagttttttgccggcgaagcgctgcgcattggtggcgaggtggtgtcgtcggtgcggccgggtatgacggtcgaagtgacacgggaaccgctcggtgtgatcggcatgattacaccgtggaatttcccgatcgccattcccgcatggaagatcgcgcccgcgcttgcttatggaaataccgttgttatcaagccggccgaggcagtgcctgcgtgcgccaccgaactggtgaagattctcgaagaatcgggtttgccggccggcgtggtcaatcttttgctcggaccggggcgcgtggtcggcgaagcgttggtcgcgtcaccggacatcgacgcaatcagcttcacagggtccgagagcacggggcgggcgatcgcggtgaagtgcgtgacgagcggcaagaaagtgcagcttgaaatgggcggcaagaatccactggtggtcatcgatgacgcggacctcgacgttgcggtagaggcggcccttgacggctcgttcttctcgacaggccagcgatgcacggcgtcgtcgcgtctgatcgtcacgtcggccattcacgggcaatttgtcgccgcgctgcagcgcaaggcgtccgaactggtggtgggacatgcgctggacaaggcgacgcagatcggaccggtgctggatgatcgtcaactgcaacagaacctgaagtatctgaagattgccgcagaagagggcggccaggtgctgggcggtgaacgggtcgagcgtccgacgcggggctacttcatgcgcccggcgctcgtcatcgggaccgacaatacgatgcgtatcaaccgggaagaagtattcggcccggtcgcatcggtcatcaaggtcgcagactacgaagaagcgctcgcagtgtccaacgatacgccgtacgggcttgccgccggcatctgcacgacgtcgctcaaatacgcgagccatttcaggcggcatgcggaagcgggaatggtgatggtcaatgcgccgaccgcgggtgtcgattatcacgtgccgttcggcggtcgcaagcgatcgagctacggtccgcgagagcagggcacgtatgcgcgggagttctacaccgtcgtcaaa

SEQ ID NO: 30764 - DNA, 708 bp, Burkholderia cepacia
cttgcgtggattgccggggtaggcgcgagcgcgggactgggcgcggcactcgcgcgccgttttgcgcgcgagggtttaaacgtcaccgtgacagggcgctcgcgcgagcggctcgatacggtggtcgccgaaattcagcacgccggcgggcaggccctggctttacccggcgacgtcacgagcgagagcgaccttgcggccattgcgcggcaactcgcggaacgaggcacgctcgaagtcgcgatcttcaacgccgcgggcgcgacgcgtgccccgacgctcgatctgagcgccgagcagttcgaggcggcatggcgcgtcacgacgctcggcggcttcctgttcgcccgggcggcgttgccgccgttgctggcggccggccgcggctcgctgctgttcacgggcgcaacggcttcgctgcgcggccgcccgccgtttgccgcgttcgcttccgcgaaggccggcctgcgctcgctcacgcagagcctcgcgcgcgagttcgggccacagaatatccatgttgcgcatgtggtggtggatggcggcatcgacggtgagcgcctgcgcacctccgcgccgcagcgggcggccgaacgcggcccggacggactgctcaatcccgacgagatcgccgactcgtactggcgtctccatcagcaggggcgcagcgcatggtcgcaggaaatcgacctgcggccgttcaacgaa

SEQ ID NO: 30765 - DNA, 894 bp, Burkholderia cepacia
gtagcggtagtgggaacgggggtgattggcgcgagctgggccgcctgttttctgtcgcgcggtctgcaggttgccgcgaccgatccttcgagcggcgcacgccagcgtctggagcacgccgtgatgcagcattggccgacgctcgtcacggccgggctcgcatccggcgcgtcgctgggcaatctcacgttccacgattcgctcgatgctgcgctggaaggtgcgcagttcgttcaggaaaatggcccggagcgcatcgacgcgaagcgtgagctgttcgccgcaatcgacgccgctacggcaagcgatgtggtaattgcatcgagctcatcgggattgctgatcagcgatgtgcaaaccgcctgccggcacccggagcgggtcgtgctcggtcatccgttcaatccaccgcatctgattccgctcgtcgaggtgatcggcggacgcttgacgtcggagaccgcgattcgcgccgcgatcgatttctatcgtgcgatcggcaagcgccccattaacccgcaaaaagaaatttccggccatatcgcgaaccggttgcaggctgcgctgtggcgggaggcgttccatctggtgtcgatcggcgctgccaccgtgcaggacatcgacgatgcgatcgcgtatgggccaggtttgcgttgggccgtgatgggaccatttgcgaatctgcatctgtcaggcggagccgagggaatgcggcacctgctcgagcatctgggcgccccgatcgagaactggtgggcgcaactgggcacgccggccatgacgcccgacttgaagcggatggtgatcgacggtgtcgatgccgcgcttgccggccgcaaggacagcgacctggctgcgcaacgcgacctgatcattctcgacgtgctacgtgcg

SEQ ID NO: 30766 - DNA, 440 bp, Burkholderia cepacia
atgctcatccagtttctcaaacagcaaactcccgccgaactcgcccgcttgcgacaaatgctgacctccatcccggtagtcgcggcggccagccgacgccagcggattgcgctgatcggccttcggggcgccggcaaatcaaccttgggcgcgctgcttgcgaaacacctcgatgtccccttcgtcgaactcgacaggatgatcgagcaggaagccggcatcgccataggcgaggtcatcacactgtatggacaggctggcatgcggcggctcgaacggcgatgcatcgagaagatcatcgaaacgcatcccgaagtggtcgtcgcaacgggcggcgggatcgtcgccgaggccgcaacctatgaactcctgcttcggaccttccgtaccatgtggctgaaagcgcggcccgagattcacttcgcgcgcgtcatggcgca

SEQ ID NO: 30767 - DNA, 1428 bp, Burkholderia cepacia; identical to SEQ ID NO: 28011

SEQ ID NO: 30768 - DNA, 756 bp, Burkholderia cepacia
atgagacttgaaaggaaacgaacattgattactgcagcggcatcgggtatgggcgctgcgggcacgcgcctgtttgctgaacacggtgcgcgcgttgccgctctcgaccgcgacggagccgccctgcaacgcgtggtcgatgacgtaaagagtcggggaggcgaagcccggggctttgtggtcgatctgacccaccggcaggcgacgctcgacacagtgcgcgaggctgtcgaatggctcggcggaattgatgttttgtggaatcacgccgggatgcctgcaccctcgaacatcgaggacttcgaattcgaacaatacgagcgctccatcaatctgaacgtgacctcggcggtggtgatatccagtgcaatcctgccgtggatgactgcgcagaagagcggctcgattatcttcacttcgtcgacgtcggggctcgttgggtcagcgttaagcccgctctactccgctttcaaatccggcattgtcggtttgacgaagggactggccgtcagatacgcggcgcagaacgtccgcgtcaatgcattgtgtccgggcccggtgtcaacgccaatgttgcacaacgacttcatcgccggcgacgccaggttcgacaaggaagaaaacctcaagcgcgtcatctcggtcgtccccatgggacgtatgggtgagccagtcgagatcgcccatgccgcgttgtggctcgcctccgatgaatcgtcgtttgtcacgggcgtcgccttgccgatcgacggtggc

SEQ ID NO: 30769 - DNA, 1305 bp, Burkholderia cepacia
gtgttgaatcctgcgaccggaaaggttgcggcgtccgcgccggcagcatcagtacaacagctggaacgcgcaattacggcagcgaaccgcgcttttgcgggctggcgggataccccgttcgctgagcggcgcgccatcgtgctcaaaattatcgacatcatcgcagcaaaccagggtgaactgtcgcgactgctgacgctcgagcaaggcaaaccactcgccgcggccgcgggagaagtctccgccacgatcgactatttccgctacttcacgaccctgtcgctcgcgccggaagtccggcaggataacgagacgcgctatgtcgaggtgcgccgcgatcctctgggtgtggtagccgcgatcattccgtggaattttccccttctgctcgccgccttcaaattgcctgcggccttgctagcgggcaacaccgtcgtgctcaagcccgctccgaccaccccgctcgcgacccttcatctcgggcgcctgattgccggagcggtacctgccggggtcgtcaatatcgtctcgggtggagacgaactgggacccgtactgacctcccatccggggattcgcaaggtcagtttcaccggctcgacggagacaggcaaaaaagtgatggcatctgctgcgacccatctggcgcgggtgaccctcgagctcggcggcaacgatccggccatcctgcttgacaaggtcgatctggagcatactgcaacggccatcttcgcatcggcgttcggcaatagcggacaggtctgccgcgcgatcaagcgcgtttacgtgccacggccaatctacgagcccttctgtgcagcgctcgcggaacgcgcccgcgcggcagtggtcggtgacggcctcaccgatggcgtgcaattcggccccgtacagaatgcagcacaatttgagcgtctcaaagagcttcatgccgacgcgcagcaacgcggcaccgtcatgcctggcggcggcccggtgaaaggacctggctacttcttccggccaaccattgtgaaggacatcgcgtctgacagtcgtctcgtcgtggaggagcagtttggacccatcctgccagttattgcctacgacgaactcgaagaagcagttgagatggcaaacaacagccaatacgggctggccgcgtcggtctggtcaactgattcacaggcggcttttgccgtcgcggaccggattgtcgcgggaactgtctggatcaacaaacacacggaccgtatgccagatcttccgatcgcgggtgcccgacagtccggcatgggcgtggaactcggcgaggaaggattacac

SEQ ID NO: 30770 - DNA, 1479 bp, Burkholderia cepacia; identical to SEQ ID NO: 28014

SEQ ID NO: 30771 - DNA, 1587 bp, Burkholderia cepacia
tttgattacatcatcgtcggcgcgggctcggcaggatgtgtgctcgctaaccggctctcggcggatccgtctgtcaaggttgccttgatcgaggcgggtccgtcggaccgcaggttcccgacgaacatcaaatcgtcgatgcctgccggtatgctgttcctgttgccacattcgaaatacaactggcagtacacgttcacgggcggaagcggtgtcaacgggcggtcgctgctgtgtccgagaggcaaactgatgggcggcaccagttcggtcaacggcatggtctacattcgcggtcaccggctcgactacgacgactgggcagcgctcggcaacgacggctggtcatatcaggaagtgctgcccttcttcaagaagcacgaaaacaacacacagggcgaagcgccgtttcatggcgtgggcggcgaagtggaagtgagtgtgccggagaatccaaacattctttcccgcacattcattgaagcagcgcgtgaagtaggtctgccgatgaacgcggatgctaacggcaccagtcaggacggcatcggcttcaatcacgtgaatcacaaatatggcaggcgttacagcagctcgcgtgcgtttctgcacccaatcctgcatcggcgcaacctgcacgtgctgacagatacgctcgtcgaacgaattctcttttccggcgaccgggcaacaggcatttctatccttcagggtgcagccccaacgacgcttaatgccacccgtgaagtgatcctgagcggcggcgcaatcaactcaccgcaactgctgatgctgtcgggaatcggcccgcacgccgaactggcacgccttggcatcgaaacgcgagtcgatttgccgggcgtgggcgagaatctgcaggatcacccgaccgtccaggtgtcacgaagcaacccctcggccgaatcttatgcgctgacgctgcgtgcgtggccgcgcgtgctgggcacgccattcgcgtatctgttcgcaaagaaaggcatgttggccacgcacggcgcggaggccggcggtttcgtgcgcacgcttcccgaactcgacaggccggacatccagctcaccttcgtcgcgacgatcaagaagtcggtgtacaagatgccgcgcacgcacggcatgatgttgatggtgcacctgatgcgcccgcgtacgcgcggccgcatcaggttgacctcgtccagcatccaagacaaacccgagttgcatcctcgctttctcgacgatcccgaagacttgcaaacgcttttgcgcggcgtgcatcaggcgaggcgtattctcggcacgaaagcgtttgcgccctatgtcggcgaagaagtgacgcctggcgcgcaatatatgagcgacgaggatctcatcaaggcgatccgcgcacaggtcggcaccgcatatcacccggtgggaacgtgcaagatgggccccgcatcggatctgatggcggtagtcgacaacgaattgcgtgtgcgaggcgtgcgaggtttacgcgtggtggatgcatccatcatgccgaacatcgtgggcggcaacacgaatgcacctgccatgatgattggcgagcgtgcagcatcgttcattctg

SEQ ID NO: 30772 - DNA, 732 bp, Burkholderia cepacia; identical to SEQ ID NO: 28016

SEQ ID NO: 30773 - DNA, 1419 bp, Burkholderia cepacia; identical to SEQ ID NO: 28017

SEQ ID NO: 30774 - DNA, 1056 bp, Burkholderia cepacia; identical to SEQ ID NO: 28018

SEQ ID NO: 30775 - DNA, 1230 bp, Burkholderia cepacia; identical to SEQ ID NO: 28019

SEQ ID NO: 30776 - DNA, 2013 bp, Burkholderia cepacia; identical to SEQ ID NO: 28020

SEQ ID NO: 30777 - DNA, 423 bp, Burkholderia cepacia; identical to SEQ ID NO: 28021

SEQ ID NO: 30778 - DNA, 1757 bp, Burkholderia cepacia
ccgatttatgaaaccaaaaaccttgttgtcgacctctacacggaaaacaacgttatacgggccgtagacgaatgctcattttcgctatttgctggagagacgctggctgtcgtaggcgaaagcggtagtggcaaaacggttatgacgctcggtccgctgggcttgctccccgaaggcatcgccgttcatatgcgcggaacggcggcaacctcgagaggcgatctccttcgcttcggcggccggcgtcgtgcatctgtcagagggaacgactttggggtggtctttcaggaccccctcagtgcgctgaacccgatgcgacggatcggccctcaactggcggaacaagcgtgccgtttcgcagggatcactgctagcggtaccaaggccgatgccgtatcgaatcttcgccgcgtcggcattgcggatccagaggaccgctactggcggtatccgcatgagttctccggaggcatgcgtcagcgcgccatgatcgcactggcattggcctccaggcctaagatacttctcgcagacgagccgaccacagcactggatgcgacggttcaggcacaaattatctctcttcttaagcagattcaagccgaggacggactggccatcctcctgatcacccacgacattggagtcgtggcaggaatggccgaccgggttgcagtcatgtacgcgggacgaatcgttgaggaaggcgcggtcacggatgtgttgaagaatcccgtgcatccctatacccaggggttgctctcatcggttcctgatctcgatacgccaattggcgagaagctcactgaaatcccgggcacccccccggacctatctcgcctggaagcaggctgtcgattcgcgccgcgttgcttcgctgcgcagccatcgtgcagtctggctcgccccaccctgtcatccgtctccataacggcacccactcataaagtcgcttgcttcgtgatgcagcctaaataccaggaggttatcgggtgaatgcttcgaacaccatcgctgtgagcgacctcatggttcactttccaacttcgcgtggcgttacagtgcgtgcagtggacggcgtgaacctgcaggttcagcagggagagttccacgggattgtgggggagtccggctgcgggaaaacctcgctcgcgcgaacgatagcagggttgcagcgaccaactggcggaagcgtacttattgacggccgcgaactgaacgattggcgcggcgaccgtcttgctttcagcagacacgtccaattcatctttcaggacccgctggcatctctaagccgtcgccagacgatccaggagtcccttgaagaacccttgagaattcacggaatcggacccgcctccgagcgccgtaggcgggttgcgcaattgctgcagctagtgagcctacccgaggcgtgccttgatcggttaccgcgagcattgtctggtgggcagcgccagcgggttgcgatcgcccgcgcgttggcacttgatccgcgcattctcatttgcgacgaaccgctgagtgcccttgacgtctcgataagagcgcaaatcctcaacctgttcgctgatttacagaagaaactcgatctttcgatcgtgctaatcgcccatgatctggctatcgttcgtctcgtttgcactcgggttagtgtgatgtacctggggaagatcgttgagaccggcccggctcatgatctctttgcacagccgcgccatccgtacaccagggcattgctggatgccgcgccttca

SEQ ID NO: 30779 - DNA, 2313 bp, Burkholderia cepacia; identical to SEQ ID NO: 28024

SEQ ID NO: 30780 - DNA, 2013 bp, Burkholderia cepacia
aagatcctgattgccaaccggggcgagattgcgtgccgcgtcgccgcgacctgcaagcggctcggcatcgcgagcgtggccgtctattccgatgcggacgccaacgcgaaacacgtggccgcctgtgacgaggcggtgcatatcggcggttcgagcgcggcggaaagttatctgcgcgtcgagcgcatcatcgaggccgcacgcgccaccggcgcgcaggcggtgcatccgggctatggctttctgtcggagaatgaagatttcgcgcaagcgtgcgaggcggccggcatcgtctttatcggaccgccggtcgaagccattgccgcaatgggatcgaaggccgccgcaaaggcgctgatgcatgcggccgccgtgccgctcgtgccgggttatcacggcgacgatcaggacgcgcaactgctgcaccgcgaggcgaatgcgatcggttatccggtgctgctcaaagccagcgccggcggtggcggcaagggcatgcgggtggtggagcgcagtgaggatttcgcggcggcgctcgcgtcgtgcaagcgcgaagccgcgagcagcttcggcaatgatcgcgtgctgatcgaaaagtacctgacgcggccgcgtcacgtggaagtgcaggtgttcgcggatcgccacggcggcgcggtctatctgttcgatcgcgattgttcggtgcagcggcgtcaccagaaagtgctggaggaagcgccggcgcccggcttgtccgctgaaatcaagcgcgaaatgggcgaggccgcggtggccgccgcgcgcgcggtgaattacgtcggtgcgggcacggtcgagttcatcatgaccagcacgggcgagttctacttcatggaaatgaacacgcgcctgcaggtcgagcatccggtcacggaaatggtgaccggccaggacctggtggaatggcaactgcgtgtggccgctgatcaaccgctgccgctcacgcaggaacagttgaagatcgacgggcacgcgatcgaagcgcgtatctacgccgagcatccggcgcgcggctttctgccgtcgacgggcacgctcaaacatctgcgcatgccggaaggcgtggaattcgcaatcgatgcgtcgggcctcggcgagccgggacgcaaggcgccggtgcgtatcgacagcggcgtgcgtgaaggcgacaccatcacgccgttttacgatccgatgatcgccaagctgatcgtgcacggcgccacgcgcgaagaggcgctcgcgcgcctgagccgcgcgctgcatgcgtgcgaggtggtcggcccgcataccaacgtcgagtttctgcagagcattgttgcgagcgagccgtttgcaacgggcgatctcgacacgggcctgatcgagcgccatcacgacgccctgttcgcgccgcgcaagaagccgtacaaggaagcgctggcgctcgcctgcgcggcgctgctcacgcgcgagggcggcacggcgcacggcgcgtcgccgtgggatgcgttgtcgcactggcgtctgaatggcggctatacgcagacgctcggctggcgcgacatagacagcggcggcgagagcgcgggcctgttcacggtcacgttcgcgcgcgacggcggcacgcaaacgctcgaacacgacggcgtgcgtgaggacttcaaatggtcggacggcagcggcccgcatgaattccgcgcaacgatcgtcgacgcgcgcgcaacgggccgcgtgttcgtcgacggcgatacgttccatgtgttctgcctcggcgaagcgctggcgttcgaatggcaaaacctgctcgcccacgccgcggacgccgaaggcggcgaaggccgtttgaccgcgccgatgccgggcaaggtgatcgcggtgctggtggagccgggtaccgtggtggagaagggcacgccgctcatcgtgatggaagcgatgaagatggagcacaccattggtgcgccggctgcgggtacggtctcggaggtactgtatgcggttggcgatcaggtggccgatggcgcgcagcttctg

SEQ ID NO: 30781 - DNA, 1242 bp, Burkholderia cepacia
ttccgccgccgtccgccgggccgcattcggaccagtcggcgcctatattcaggccggccgccaacgaactctggagacacagcaatgagcaacctgcccggtttgcaattcccgctcggcgaagaaatcgaaatgctgcgcgacagcatcgcgggattcgctgccaaagaaatcgctccgcgcgctgcggaaatcgatcgcacggatcagtttccgatggacctgtggcgcaagttcggcgatctgggcgtgctcggcatgacggtctcggaagaatacggcggcgcgaacatgggctacacggcgcacatgatcgccatggaagaaatctcgcgcgcgtccgcctcggtcggtctctcgtacggcgcgcattcgaatctgtgcgtcaaccagattcatcgcaacggcacggaagcgcagaagcagaagtacttgcccaagctggtgtcgggcgaacatgtcggcgcgcttgccatgagcgagccgaacgcgggttcggacgtggtcagcatgaagctgcgcgcggagaagaagggcgctcactatgtgctgaacggcacgaagatgtggatcaccaacggcccggattgcgacacgctggtcgtctacgccaaaaccgatcccgaagcgaattcgcgcggcattaccgcgtttatcgtcgagaagggcatgaagggtttctccgttgcgcagaaactcgacaagctcggcatgcgcggctcgcataccggcgaactggtgttccaggacgtggaagtgccggaagaaaatattctcggccagttgaacggcggtgcgaaggtgctgatgagcggcctcgactacgaacgcgccgtgctcgcgggcgggcccacgggcatcatggtcgcggtcatggacgcggtcgtgccgtatatccacgaccgcaagcagttcggccagcctatcggcgagttccagctcattcagggcaaggtcgccgatctctacaccacgttgcaggcatgccgcgcgtatctgtacgcggtgggccggcaactcgatacgctcggcaaggaacatgtgcgccaggtgcgcaaagactgcgcaggggtgattctctacacggcggaaaaagccacgtggatggcgggcgaggcgatccagattctcggcggcaatggctatatcaacgaatatccggtcggccgcttgtggcgcgacgcgaagctctatgaaatcggcgccggcacgagcgaaatccggcgcatgctgatcggccgc

SEQ ID NO: 30782 - DNA, 819 bp, Burkholderia cepacia
cgatgcacaaagacatacgactctcgtcatgcattgggcatattcggactgaataacggagagcgtcccatgtcgcgtatttttattaccggttccgccgatggcctcggtcagatggccgcgcgtctgctcgtcgacgccggacatcaggtggtgttgcacgcgcgcagcgccgcgcgcgccgagcatgcgttgcaagcggtgccgcaagccgaaacggcgctggttgccgacctgtcgagcattgccgccacggccgaactcgcgcagcaggtcaaccggctaggccgtttcgatgcggtgattcacaacgcggcggtcggttatcaggagccgcgccggatcgcgaccgtcgacggcctgtcgcatgtgttcgcggtcaacacgctggcgccgtacattctgagcgcattgatcgggaagccgaaacggctcgtctatctgagctcggcgctgcatcgcagcggcgatgcgagcctcgacgatctggcctgggagcggcgcccctggcggggcacggcggcgtactcggactcgaaactgcatgacgcgttgctggcgttcgcgctcgcgcgccgctggccgcaggtgttgtcgaacgcgctggagccgggctgggtcgcgacgaaaatgggtggaccgggcgcaccggacgatctgctggcagcgccgaaaacccaggtgtggcttgccgtcagcgacgagccggcggccaccgtcagcggcgcgtacttctaccatatgaagccgcgcgagacgcatccggcggtgcacaacgtggctgttcaggagcgtctgctcgaagcgtgcgcgggcttt

SEQ ID NO: 30783 - DNA, 1698 bp, Burkholderia cepacia
aagaaactcatcaacgaggtttccgcggtcgttccggatatgctcgacggactcgcggcgctcaatccccatctctcgctgttgcaaggcagcacgatcatcgtgcgcgcggatgccgaggccgccgccgcgcgcggagaagtcgcgctgatctcaggcggcggctcgggccacgaacccgcgcacggcggctatgtcggccccggcatgctgagcgcggcggtcgccggtgaagtcttcacgtcgccgtccaccgacgccgtgctcgatgcgatccgcgcggtggccggcgcggccggcgcgctgctgatcgtgaagaactacaccggcgaccgcttcaacttcggcctggcggcggagattgcgcgcgccgaaggcatccccacggaaatggtgatcgtcgccgacgacgtcgcactgacggcgagcggcgaccacgcgggccgtcgcgggcttgcggggaccgtgctggttcacaagattgcgggcgcggccgcggcgtcgggccgcccgctggcggaggtcgcacagatcgcgcgcgacgtggcggcctcgctcggcacgatgggcgtggcactcaccgcgtgcacggtgccggccgcgggcaaaccgggtttcgaactggccgatggcgaggtggaatggggtctcggcattcacggcgaacccggtgtggagcgcggcgcgctggagcccgccgccgcggtcgtcgacaagctgctggagaagattgtcggcgacctgtcgttgcaggccggcgagcgggtggcgttgctggtgaacaatctgggcggcacgccgtcgagcgaattgaacattgtggccggcgccgcgctgcgttatctggcggagcgcggcatcaggacggagcgcgcgtgggccggcacattcctgagcgcgctggaaatggcgggcatttcgctgtcgctgctgcgagtggacgatcaacgtctcggttggctcgatgccgccgcgcagaccagtgcgtggccggcgctcggtggacgcatcgcgcggacctccgcgcggcccgcgccggccgaaccggatcgcgcaagcggtgcgacgctgtcgcgtgaagcgacgctgcgccgcgtcatcgaagcggtctgcgcgtgtctgctgaaagccgagccgacgctgaccgacatggatcagcgcgtcggcgacggcgatctcggcatcagcctgtcgcgcggcgcgcgcgcgatcattcaggagctcgacggctatccggctgaaacgacgccgggcgctgtcctgcgcaacatgtcggcgacgctgcggcgcgtggtcggcggcacctccggcccgctttacgcggtcatgctgctgcgcgccgcgctcgcgctcgaacaatcgggcggagcgacgccgaagcagtgggcggcggccttcagcgcgggcgtcgacggcttgatggcgctaggcggtgcgcaacctggcgatcgcacgatggtcgatgcgctgaagccggccgccgatgcattgcaagccgctctcgcacgttccgatgcgctcgacgccgcgttgaaagcggccgtcgacgcggcaaccgaaggcgccgcgcaaacggcgtcgatgcatccgcggcgcgggcgttcgagctacgtcggcgagcgtgcgctcggtcacgcggatccgggcgcgcacgcggtggcgctgtggctcgcggcgatccgcgaggcgctggcggag

SEQ ID NO: 30784 - DNA, 930 bp, Burkholderia cepacia; identical to SEQ ID NO: 28029

SEQ ID NO: 30785 - DNA, 1068 bp, Burkholderia cepacia
aacccgctcggcaccgacggtttcgagttcatcgaatacaccgcaccggatccgaaggcgctcggcaagctgttcgaacagatgggcttcaccgcgatcgcgcggcatcgtcataaggacgtgacgctgtatcgccagggggaaatcaactttatcgtcaacgcggagccggattcgttcgcgcaacgcttcgcgcgtctgcacggcccgtcgatctgcgcgatcgctttccgcgttcaggacgccgccaaggcgtaccagcaggcgctggaaaaaggcgcatggggcttcgacaacaaaaccggcccgatggaattgaacattccggcgatcaaaggtattggcgactcgctgatctatttcgtcgaccgttggcgcggcaagaacggcgccgagccgaacagcgtcggcaacatcgacatttacgacgtcgacttcgagccgattcccggtgcgaacccgaatccggtgggtcatggcctgacctacatcgaccatctgacacacaacgtgcatcgcggccgcatgcaggagtgggcggagttctacgagcgcctgttcaatttccgcgaagtgcgctatttcgacattgaaggcaaagtgacgggcgtgaagtcgaaggcgatgacctcgccatgcggcaagatccgcattccgatcaacgaggaaggttcggacaccgctggccagattcaggaatatctcgacgcgtaccgcggcgaaggcattcagcacattgcgctcggcaccaacgacatctatcgcacggtggacggcttgcgcgcggcgaacatctcgctgctcgatacgatcgacacttactatgaactggtcgatcgccgcgtgccgaatcacggcgagccgctggacgagctgcgcaagcgcaagattctgatcgacggcgcgcccgaagatctgctgctgcagatcttcaccgaaaaccagatcggcccgattttcttcgagatcattcagcgcaagggcaatcagggctttggcgaaggcaacttcaaggcgctgttcgaatcgatcgagctggatcagattcgccgtggcgtggtgcaggac

SEQ ID NO: 30786 - DNA, 1299 bp, Burkholderia cepacia
agagttctgatcgctaaccgcggtgaagtggccgttcgtatcgtccgcgccgctaaatccgtaggattgcaaactgtcggaattcatactccggaggaggcgaatgccctacatgtgcgggactccgatatcgcagtagctctggcaggcgtcggaaccgccgcctacctggatattgcttcaatcattgcggcggcggttcgcacgaattgcagctttatacacccgggctacggttttctgagcgaaagtgccgcattcgcacgcgcctgtgaacaggctggggtgactttcattggcccatcaccggacacactcgacgtgttcggtgacaaagcctcgacacgtgagctcgcgatacgcctggacgtccccgttctccctgccacggcgggactcgccgacgatgcatcggcactgagtttcatgcaatcgctcgcggccccggttatcgtaaaggcggtggccggcggtggaggccggggaatgcgtatcgtcacggaccccaccgacttgcccgctgcgttgtcaaggtgccggtcagaagccgaacggggctttgggcgcgacgatgtctatgtcgagcgctacctcccgcgttcccgccacatcgaggtacaggtgatcggcgatggctcgtccgtcgtgcatctcgggacgcgcgattgcagcctccagagccgccatcaaaaggtgatcgagatcgcacctgcgccctggttgccggtcgagatcgaggaagccttgctggagcacgctctccagcttgcccgcgcggttcaataccggggagcggggacgatggaatttctgatcgacgttgacaatccctcacactactatttcatcgaggggaatccccgcttgcaggttgagcacggcattactgaactcgttaccggactggatattgtcgcgctgcaattcgcgatcgcgcgtggccggtcgctggccgacgagggcatcacccaggacaatgtcgtgacgagcggtgtggctgtcgaagcgcgagtaacgctgacaactcccggcacgattgcacggttcgttagtcccggcaagggacgcgtcgacagcggcgcgtatgacgggctcgcagtcggcagcggcttcgatccgttgcttgcgaaggtcatggtgcatgagccggattacccgcgctgcatctgtgcgctggctgattcccttggtgaactcgtcgtcgaaggtccggccactaaccgcgatggtctgctatcgctgcttgccgatcctcgcgtgcgcgcgggagacatcacgacgacgctgatcgacgatctg

SEQ ID NO: 30787 - DNA, 1497 bp, Burkholderia cepacia
gacacggtgctaacgtactcggaatgtgtcatgcgtggtgacgaattggcccgcgcctttctcggtctcgggctcgagcgcccggctcgcgttgccctcgtgttacctaatagcgccgagttcgtcatctcgctctatgcatgcgcgcgcatcggcatcacggcagtgccaataagcacctggtccaagccgtccgaactcagacggatcttgcgcgatgcccgggtcgacctggtccttgccagggacgcctttcctggacacgcaatcgccgaatccttgcaagcggcttgtgcagacgatccatcgctggatgcgctccaggtctatgaatggtcaaggggacagggggctgccagtccggtttccgaactgctttcgcatggttctcgctgcgatgatcgcagatggtcgattgagtcgggtacttccgcgcacacggacgccgacctggtcgtcttatatacgtctggcagtactggagcgccgaagggggtgatactgccgcagtcatcggtcgcgctcaacggtgtcgccatcgccgggcggatgggtttcggtggaaacgaccggatcttttcctacttcccgttgttctttagcggagggctttgcaatgcgttgaccggagcgatttcatgcggtgccgaattggtcacgcaatcccggttcgatccggccggcgccttgtctttgatccgctccagacgatgtacaggccgcaacgtatggcatgacggcctggaaccggtcgctgccgtggagggcttccggccaggcgatttcagcaggatgcggcgcggcctccatgttgatcctgaactctatcgaaggctgagcctggctgtcgatgaaggtatcaatatgtatgggatgactgagaccgcgacggcgttcacctgcggcgactggcgcgaacccgccgatgtacggcaatcgacccacggcaagccgtttgacggctccgatctgcggatctgcaatccggacgaaacttcgccgctcggggttggtgtggagggggaaatctgtgtccgaggctacaacctgatgcgaggctacaccgacgggtcgcatgtcgagcgaatcgacgacgacggattctttcataccggtgatatcggcttcgtcgatcccgccggctatttacatttcgtcggccgccgcaagacgttgatcaaggtaaaaggtctgacggtccaacccgaagaagtcgaggcgacactgctgcgccatcctgccatctcaaaagcagtcgtcgtcggcgaaggcggtggacatgagtcgaaaggcgtggtggctctgatcgtgctgcacgaaggggaccgctgggacatgcaggcacttcgaacctattgccaggaagaactgtcgtcatacaaagtgccgcggctgctggtggtcgatgcgaatcggttcccgttgtcggcgagcctcaaaatcgatcgaatcggcgcggccaccctgctcaagcagatcgcagccgaagtgggctgt

SEQ ID NO: 30788 - DNA, 1374 bp, Burkholderia cepacia; identical to SEQ ID NO: 28033

SEQ ID NO: 30789 - DNA, 1602 bp, Burkholderia cepacia
accccgatcggcgatttgctggttcgtgcagccagccgtcatcccgacagggacgcggtcgtatttcccgacgatcgctacacctatgcggaagttctcaggcgagcgatgctggtggcgcgcgggcttctgagcctcggagttcgaccgcgcgaccacgtcggcatcctctgcaccaacggcatcgagttcatcgaaggcttgttcggagtcgccctggccggggccgttgctgcgccgatcaacgccagatacaaagtgaacgaactcaaatacatcgcctcgaacgcggacctggtggctatcctgacgaccggcgacgcagacgcttacgtcgactttccagacgtatttgtccaggcctttcccgaactgtcttcgtccgaggccttggggctcgatttggaatccgctccccgattgcgcaacgtgatcctgttaagcggcagtgagcggcccgggttcatcagccgcgagcgcctcctggagcttgccgcgcgcgtgtcggaggaagacgtgcatgttgcccgcagccgcgtgcgcttgcgcgatatcggcctccttctgtacacgtccgggacgacagccaatccgaaaggctgcctgctgagtcatgaggccgtgactcgcggccccgtcgagcgggcgacgatacgcttcggcctcaaggttgcggacgtcacctggggcgccgggccgctgttccacatcggctcgctgtcgccgttcctcggctcgatcggcgcggccgggacctacgtcaccgatgcgttcttcgacgcgggccgtgcgctcgatctgttgatccgggaaaagccgacagtcatgttcccatggttcccagccatcatgcaggcgctcatgaatcacgagaaatgggaccctgcgaagctgtcgtccgttcgctccattcttctgatcggcccgcggcctttgttggataaagtgcaggcggcgcttccgcaggtggaactggtggcctcatgcggcatgaccgagacggcgggaatctatgccgtcagtgatgtttcggaaacggtcgagcaacgagcgaccggtcacggaaggccatgttcaggcatcgaggcacgcatcgttagtctttcagatggaagcgaggtgactgacagcacgccaggcgagattctcctgcgcgggtattgcgtgatggaaggttattaccgcgatcccgccaataccaggaaagcactcgatgccgagggctggctgcacaccggagatctttacagccgtactcccgatggtcgattgatgttccatgatcgcatcaaggacatgttaaaagtcggcggcgagaacgtggctccagctgaaatagaaacattcctgtgcacccatccctccgtggtcatggcgtcggtcgtgggcatcgcggacgcgcggctcgacgaggtgcctgtggcgtttgtcgaacttgccgccggcaacaccctggaagccgaatttctgatctcgttctgccggggtcagctcgccagcttcaagattcctcgccgaatacattttgttgataccggcacctggccgatgtcaacgacgaagatcgacaagcggcagttacgcgaacgggcagcaaaaatg

SEQ ID NO: 30790 - DNA, 1185 bp, Burkholderia cepacia
gtcgagagcatcattcagcacatcgaggaaaagggcgacgaggcggttcgtgaatacagccgcaagtttgataactgggatccgggcgacttccggctatcgcgcccggaaatcgagactgcgcgcaaacagctttcagcgcgcgagatcgaagacatcgctttcgcgcaaacccaggtgcgcaacttcgcacggatccaacgcgattcaatgcgcgacgtggaaaccgagacccttcccggcgtcgtgctgggccataagcacatccccatgaacgcggtgggctgctacattcctggcggcaagtatccgttgcttgcgtccgctcatatgagcgtattgacggccaaggtcgcgggcgtagcccgggttgtgtctaccgcgccgccctatcagggcaagccgcatccggcgatcgtaacggccatggacatggcgggagccgacgaaatcctcgtactcggcggcatccaggccgtggtcgcgatggcggtgggaacgcccaccgtggcgcccgtcgacatgctcgtgggcccaggcaacatgttcgtggcagaggccaagcggcaactgtacggaagggttggcatcgaccttttcgcaggtcccacggagacacttgttattgcggacgaaagtgttgacggtgaactctgcgccgtcgatctgctcggtcaggccgagcacggcgctacgtcgccgtccattttgctgaccaacagcgaaaagcttgctcgtgatacgctcgcggaaatcgaacgccagttgaagatcttgccgaccgcctcgattgccgcgcaaagctgggctgattgtggcgaagtgatcgtgtgcgacacgtacgaagagatgctgcaagtggccgacgatattgcttcggagcatgtccaggtcatgacggaagacccagacttcttcttgaacaacatgacgaactacggtgcgctgttcctcggcccgcgcaccaacgtaagcttcggtgacaaggtcattggcaccaatcacacgctcccaaccaaccgcagcgcgcgctataccggtggactctgggtcggaaagtttttaaagacctgtacctatcagcgcgtaacgaccaacgaagccagtgccattatcggcgaatattgttctcgcctctgtcacatggaaaactttgccgggcatggggaacaggcaaacatccgc

SEQ ID NO: 30791 - DNA, 729 bp, Burkholderia cepacia
ctcgccagccggcgcgcgctggttacgggcggaagtagcggaatcggacttgcggcggccgctgcactcggccgtgctggcgcacacgtgacggtagctgcgcggcgacgggcagagcttgaagtagcatgcgaagcactgcgggcgacaggcgtcgcgtgcgaagcgctcgtgctcgatgtcaccgattcggcgtccgtggatcgggaggtgaactcccgggtgccgttcgacattcttgtcaacagtgccggcatgaatcggccgaagccgctgaccgacttgaccgacgacgatatcgacgccgtgcttcggctcaacgtgaaggctgctttctatctcgcccgcgcagtatcgcggcgactggtcgacgccaacctcggcggatcgatcattaacatctcctctcaaatgggacacgtcggcagcgcgcgccgctcactttattgcgcgagcaaacatgcggtcgaaggtatgacgaaagcgctcgcatgggaacttggagcggcgcggattcgagtcaacagtctttgcccgacattcatcgagaccccaatgacggcaccgatgtttgttcaaccagggtttcgcgaatgggtttgcgagcgcattgcgctggggcgcgtgggtgaaatgcacgagatcatggggccggttgtctttctcgccagtgatgcatcgagcctgatgacaggcagcgcgctgatgctcgatgggggatggacggca

SEQ ID NO: 30792 - DNA, 1458 bp, Burkholderia cepacia
atcggcattgtcggaaccggcgcaatgggccgcggcatcgcacagatcgccgcgctggccggcctcactgtgcgtctgtacgacaccaaccctgctgcaatcggcgccgcgcgcgactacctcgccgagactttcgcgaagttgaccgctaaaggcaagctcgaccaggcgcgctctctcgccgcactcgcgaatgtcagcggcgcgcaggccatcggcgagttggccggttgcgatctggtcgtcgaggcgatcgtcgaaaaactcgacgtcaaacaggcgctgttccgcgaactggaaaccgttgtgagcggccgctgcatcctcgcgtctaacacgtcttcgctgtcgatcacggcaattgccgccggctgtagcgatccgtcgcgcgtggccggctatcacttcttcaatcccgtgccgttgatgaaagtcgtcgaagtgatcgacggtctgcgcagcgatcccgccgcgggcgacgcgctgatggatctcgcgcgccgcatgggtcacacgccggtgcgcgcgaaagatatgcccggcttcatcgtgaatcacgcgggccgcggcatgaataccgaaggcttgcgcgtggcgggtgaaggcgtggcgagtttcgccgacatcgactgcatcatgcgcgagcaggcgggctttcgtcttggcccattcgagctgctcgatctgacggcactggacgtctcgcatccggtgatggagtcgatctatcaccagttctatgaagagccgcgcttcacgccttcgcccatcaccggcacgcggctcgcgggcggactgctcggccgcaagacaggtgaaggcttttaccgctacgaagacggcaagcagcaggtacctgccgaggcgcccgcgccgaccggattgccggccagtgtgtgggtcagcaagcgttatccgcaagcgcatgacgccgtcgtgcaactcgtcgaaaaagccggcgtgacactcgacaacggcatcacgcccgaatcgaactcgctgatcgtcgtcacaccgttcggtcacgatgcaaccacggccgcggtcgacgaagcgctcgacgccacccgtgtcgtcgcgctcgacgcgcttttcccgctcgtcggcgcgcaacgccgcacgctgatgacgacgcccgccaccacgcgcgccgcgcgtgacatggcgcatgcgctctttgccgccgacggcgtgcccgtcaccgtgatccgcgactcgaccggcttcgtcgcgcaacgcgtggtggcgaccatcgtcaacatcggctgcgatattgcgcaaaaacagatcgccacgccggaggatatcgatctcgccgtgacgctcggcctcggctatccgcgcggcccgctcgccctcggcgacgcgctcggctcgaccactattctcgcgatcctgcgcaatatgttcagcgtgctcggcgacccgcgttatcgtccgtcgccctggctcgcgcgg

SEQ ID NO: 30793 - DNA, 1119 bp, Burkholderia cepacia; identical to SEQ ID NO: 28039

SEQ ID NO: 30794 - DNA, 1200 bp, Burkholderia cepacia
atgaatctggactattcccccgctgacagcgcgttccgcgccgacatccgcgcctggctcgaggcaaatctgccccgggaactgagcgacaaggtactcaatcacaagcggctttcccgcgcagacttcgcaagctggcacaagctgctcggtatgcgcggctggtcggtggtcgcgtggccgaaagaatacggcggcccggattgggacgccacccaaaggcacatctgggacgaagagtgcgcgcgcatcggcgcgccgtccgtgctgcctttcggtgtctccatggtggcgcccgtgctgatgaagtacggcaacgaggcgcagaaacgccactatctgccgcgtattctcgatggtacggactggtggtgtcagggctactccgagccgggctcgggttcggatctggcgtcgctgcgcacgcgcgcggagcgcgccggcgaccattacgtggtcaatggtcagaaaacgtggaccacgctcggccagtacgccgacatgatgttctgcctggtgcgcacggacagcggcgccaaaaagcaggagggcatctcgttcctgctgatcgacatgaaaacgccgggtatcaccgtgaggccgatcatcacgctcgacgaagatcacgaagtgaacgaagttttcttcgaagacgtaaaggtgccgatcgagaatctggtcggtgaagagaatcgtggctggacttacgcgaagtatctgctcggccacgagcgcaccggcatcgcgcgggtcggccagtccaagcgcgaactcgtcttcctgaaacgccttgcactgaatcagaaaaaaaacggcaagccgctgctgcaagatccggtgtttgccgcaaaagtcgcgaacctcgaaatcgagttgatggcgctcgaagtcaccgtgcaacgcgtggtcgccaatgaaacaggcggacgcgggccgggaccggaagcgtcgatgctgaagatcaagggcacggaagtgcagcaagcgctgactgaactgatgttcgaagcagtcgggccgctcgccgcaccgttcgacataccgttcctcgaaggagagcgcgaacatagcctcgccggcgacgacgatgccgcgcctctcgccgcgtactacttcaacttccgcaagacatcgatttacggtggctcgaacgaaattcaaaagaacatcatcgcgcagatgattctcggactttgagga

SEQ ID NO: 30795 - DNA, 1168 bp, Burkholderia cepacia; identical to SEQ ID NO: 28041
  unsure (1)..(1168): unsure at all n locations

SEQ ID NO: 30796 - DNA, 969 bp, Burkholderia cepacia
aggactggtatgaatgcgaaggcgcgtgagtcgattcccgccaccctgattccgggcgacgggatcggcccggaggtgacgcaggcgacggtcagggtgctcgaagcgctgggtgccccattcaagtgggacatccaacaggcgggcatggccggcatcgacgaatgtggcgatgcgctgccgcaagcgacgctggacagcatccgcgaaacgaagctggcgctcaaggggccgctgacgacgccgattggcgggggcttccgctccgccaatgtgcgcctgcgcgaagcgttcgaactccacgcgaacatccggccggtgcgcacgatcgtgcccggccgctacgacgatatcgatatcgtgctggtgcgcgaaaacattcaggggctctacgtcgcgcacgagcattacattccgatcggcgacgatccgcgcgccgtggccgtgctgaccggcatgaacacccgcgaagggggccgccgcattgcgcgctgcgcattcgactatgcgctcaggcacggccgcaggaagatcaccgtggtgcacaaagccaatgtactgaaggcgcttaccggcattttcctggaggcggctcgcgaggttgccgccgactacgcaggacgggtcgcgctcgacgaccgcatcgttgatgcctgtgcgatgcagttggtgctcaatccctggcagttcgacatgctgctctgcacgaacctgttcggcgacattctctccgaccagcttgccggcctggtcggcgggttggggctcgcgcccggcgccaatatcggcaaggacacggcgctgttcgaagcggtgcacggatccgctcccgatatcgccggtcgcggcatcgccaaccccgtctcacaactgctggcggcaggcctgatgctggaccacgtggggctcgacgaggacgcgaagcgcctgaggcgggcgatcgccgataccctcaacgaggacaaggtg

SEQ ID NO: 30797 - DNA, 1437 bp, Burkholderia cepacia; identical to SEQ ID NO: 28043

SEQ ID NO: 30798 - DNA, 1260 bp, Burkholderia cepacia
gttgttggtgcaacggtatttttcgatgcgtttgacgccttgagtattgcactcgtgttgccggtcctctcgacaaggtggcatctgacgtccatgtcgattggcattctcattgcatccggatatgtcgggcaagctatcggcgctttactgttcggatcggtagctgagcgcattggccgcatcaagacgatatcgctcacgattgttattttcgcattcgccagcctggcatccgcgtttgcgccgaactatgcctggctttgcgcgatgcgcgtcatcggaggtattggtctcggcggagaggggcctgcggccctcgcgtatatcagtgaaatcgcacctgtagaacgtcgcggagctttcatactttcgtttcagtttatgtacgcggccggttttgtcgccgcgtcgctcatgggcgcctggattgttccgcgattcggctggcagtctatctttatcgtcgggtcgttaccgatcattcttctccctgtcctccgtcggctgtgtccggaatctccgcgctggtttgcgtcgcgaggtcgtttggaggagagcgacgcagcgttatgggaaatagaaaaacgtgtttccaaaaacggaaaagtcacgttgtcagatgtagcgccgacggctggcccggtgttgaatcgcgactcgagcgtgagggagcttttctcaccggtttacagaaaacgtaccataaatttatggatattgtgggcagcaacctactttgtcgtgtatggaatgacgaactggctgcctacgttgcttaaaacggtctaccacctccctctccaggaaaccctgaatatcgctctgttgagtgcgacgttaggtctgtgcgggaacatagcgtgcgtagcgttgatcgaccggattggaccgaaacattggttcattggggcgtttgccggggcggcggctctattttccctttggcttgcaatgggtgacggaaagctcgttccattcctcatccttgggttggcggcgttcgttctctctgtgaccgttagcttcgggctatttctgtacaccgcggagatttatccgactcgcatgcgtggtataggcgcaggctttgccagcttctggttacgcgttgcgtcggttctggcaccgatggtcatcggttatctgttaccacggcacggaatctctggcgtctttgctgtctttgctggggtctctgcaatcggattcctggctagcctgatcgggatgatcaagacgaagggtttgcggctagag

SEQ ID NO: 30799 - DNA, 753 bp, Burkholderia cepacia
cccgtctgcgtgattacgggttcggcttccggcattggcgcggcgaccgcgctgcgcttcgcacaggcgggctggtcggtcgccatcggcaacttcgacgacagcacgcgcgacgcggcgtcgacggtcgaggcgttgtgccgcgacgcgggcgcacagacactgatcttcgacgcggacgtcggcaaggatgccgactgccggcacgcggtcgatatggtcgcgagccgctggcagcggatcgatgcgctgatcaattgcgcgggcaccacccgcgtgattccgcacaatgccttcgatcagatcgacgacttcgaattcgagcgtgtctatcgcgtgaatctgatcggcctttaccagatgacgcgggcggccgtaccgctgctgcgcgaatcagcgagcgcgacgcgcagtaccagtgtggtcaacgtgtcgtcgctggcggggttgaacggcacgggttcgtcgatcgcgtatgcggcttcgaaaggcgcggtgaacacgttgacgctgtcgctggcgcgcaatctcgcgccgcacattcgggtgaacgccctcgcacccggtatggttgatgacggcttgctgctgcgtgtgctcgacgccgccgcctacgacggcgtgctgtcccggatgacggagagcgcgccgctcaaacgcgtttcccggcccgcggaaatcgccgaactggcgtggttcctcacggcacacgccccggcaatcacggggcaggtgatcgcggcggaaaacggc

SEQ ID NO: 30800 - DNA, 1545 bp, Burkholderia cepacia; identical to SEQ ID NO: 28046

SEQ ID NO: 30801 - DNA, 1560 bp, Burkholderia cepacia; identical to SEQ ID NO: 28047

SEQ ID NO: 30802 - DNA, 1413 bp, Burkholderia cepacia
ctgttcatcgacgaaattcatacgctgatcggcgcgggcgctgcgtcgggcggcacgctggacgcgtcgaacctgctcaagccggcgttgtcgtcgggcacgctgaagtgcatcggcgcgaccacgttcacggaatatcgcggcatcttcgaaaaagacgcagccttgtcgcggcgtttccagaaggtcgacgtgaccgagccgaccgtcgaacaaacggtggcgatcctgcgtggcctgaagtcgcggttcgaagagcaccacggcgtgaagtattcgtcgggcgcgctgtcggcggcggctgagttgtcggcacgcttcatcacggatcgtcatctgccggacaaggcaatcgacgtgatcgacgaagcgggcgcggcgcaacgcatcctgccgaagtcgaaacagaagaagaccattggcaagaacgagatcgaggaaatcatctcgaagatcgcccgcgtcccgccacaaagcgtgtcgcaagacgatcgcagcaagctgcaaacgctggatcgcgatctgaagagcgtggtgttcgggcaagacccggccatcgacgcgctgtcggccgcgatcaagatggcgcgtgcgggtctcggcaagctggacaagccgatcggcgcattcctgttctccggccccacgggcgtcggcaagacggaagtggcaaagcagctggcgttcacgctgggcatcgagctgatccgcttcgacatgtcggaatacatggagcgtcatgcggtcagccggttgatcggcgcgccgccgggctatgtcggtttcgaccagggcggtctgctgaccgaggctgtcacgaagaagccgcattgcgtgctgctgctcgacgaaatcgagaaggcgcatccggacatctacaacgtgctgctgcaggtgatggaccacggcacgctgacggacaacaacggccgcaaggcggatttccgcaacgtcatcatcatcatgacgacgaacgcgggcgccgaggcaatgggcaagtcggtgatcggcttcacgaatcgtcgggaaaccggcgacgagatggtcgacatcaagcgcatgttcacgcctgagttccgtaaccgtctggatgcggtgatcagcttccgctcgctcgacgaagaaatcatcatgcgcgtggtcgacaagttcctgatgcagctggaagatcagttgcacgagaagaaggtcgatgcgctcttcaccgacgcgttgcgcaagcatctcgccaagcacggtttcgatccgctcatgggcgcgcggccgatgcagcgtctgattcaggacacgatccgtcgtgcactggccgacgaactactgttcggcaagctgatgaacggcggtcgcgtgacggtcgacgtggatgcggaagacaaggtgcaactgacgttcgacgagcatccggcgccgcgc

SEQ ID NO: 30803 - DNA, 1569 bp, Burkholderia cepacia; identical to SEQ ID NO: 28049

SEQ ID NO: 30804 - DNA, 1530 bp, Burkholderia cepacia; identical to SEQ ID NO: 28050

SEQ ID NO: 30805 - DNA, 675 bp, Burkholderia cepacia; identical to SEQ ID NO: 28051

SEQ ID NO: 30806 - DNA, 780 bp, Burkholderia cepacia; identical to SEQ ID NO: 28052

SEQ ID NO: 30807 - DNA, 1428 bp, Burkholderia cepacia
atgtccaaagaatttgacgtcgtcgtgatcggcgcaggccctggtggttatatcgccgccatccgcgcagcgcagctcggcaagaccgtcgcatgtatcgaaaaatggaagaacccggccggcgcgctgaagctcggcggcacgtgtctgaacgtgggttgcattccgtcgaaggcgctgctcgcgtcgtcggaagaatttgagaacgcgtcgcatcacctcgctgaccacggcatctccgtggaaaacgtgaaggtcgatatcgcgaagatgatggcccgcaaagaaggcatcgtcgagaagatgacgaagggcatcgaattcctgttccgcaagaacaagatcacgtggctcaagggccacggcaagttcaccggcaagacggacgccggcgtgcagatcgaagtgagcggcgagggtgaaacggaaacggtcacggcaaagaacgtgatcatcgccacgggttcgaaggcacgccatctgccgaacattccggtcgacaacaggatcgtcgccgacaacgaaggcgcgctgagcttcgaatccacgccgaaaaagctggctgtgatcggcgctggcgtgatcggtctggaactgggttcggtgtggcgccgtctgggcgcggaagtgaccgtgctcgaagcgctgccggaattcctcggcgcggccgaccaggcgctcgcgaaagaagcggccaagcagttcaagaagcagggtctggacatccacgtcggcgtgaaggtcggcgaagtgaagacgaccgacagcggcgtgacgatcgcctacacggacaaggacggcaacgcgcagacgctcgaagccgatcgcctgatcgtgtcgatcggccgcgtgccgaacaccgacaatctcggcctcgaagcgatcggcctgaaggcgaacgagcgcggcttcatcgacgtggacgagcattgcgcgacggcggtgccgaacgtgtacgcgatcggcgacgtggtgcgtggcccgatgctcgcgcacaaggcggaagacgaaggcgtactggtcgctgaaatcatcgacggtcagaagccgcatatcgactacaactgcattccgtgggtgatctacaccgaaccggaaatcgcgtgggtcggcaagacggaacagcagctgaaggctgaaggccgcgagatcaagacgggccagttcccgttcatggcgaacggccgcgcactcggcatcaacaaggcagatggtttcgtcaagatgatcgccgacgcgaagaccgacgaactgctcggcgtgcacatcatctcggcgaacgcatcggacctgatcgcggaagccgtggtggcgatggaattcaaggcggcttcggaagacatcggccgcatttgccatccgcacccgtcgctgtcggaagtcatgcgcgaggcggcactcgctgtcgacaagcgcgcgctgaacatg

SEQ ID NO: 30808 - DNA, 1281 bp, Burkholderia cepacia; identical to SEQ ID NO: 28054

SEQ ID NO: 30809 - DNA, 2859 bp, Burkholderia cepacia
atgatgaagcaattccagtcgaactcttacctgttcggcggcaatgctccgtacgtagaagaaatgtacgaagcgtatctcgataatccggcgtcagtgcccgagaactggcgcagctatttcgacgcattgcagaacgtcccggcatcggatggcagcaatgccaacgacgtggcccacggcccgatcgtcgaatcgtttgctcaacgggccaaggctaatgccttcatcccgcgcggagcaggtggcggcgaagatctcgctaccgctcgcaagcaggtttatgtgcagtccctcatcggcgcatatcgcttcctcggctcgcaatgggccaatctcgatcccctgaagcgccgcgaacgtcccgccattcccgaactcgaacccgcgttctacgacttcaccgaagccgacatggaccaggagttcagcgccacgaatctgtatttcggattcgagcgcgcttcgctgcgcgagatcgtcaaggcattgcgcgacacgtactgcggcacgatcggcgccgagtacatgtacatcagcgatccggaacagaagcgctggtggaaagagaagctcgaatcgatccgttccacgccgaacttctcgaacgaaaagaaaaagcacatcctcaatcgcctgacggccgctgaaggcctcgagcgcttcctgcacaccaagtacgtcggccagaaacgcttctcgctcgaaggcggcgaaagcttcatcgcgtcgatggacgaagtcgtgcgtcacggcggcgccaacggcgttcaggaaatcgtcatcggcatggctcaccgtggccgtctgaacgtgctggtcaatacgctcggcaagatgccggccgacctgttcgccgaattcgaaggcaagcacgtcgacgacctgccggccggcgacgtgaagtaccacaagggtttctcgtcggacgtctcgaccgaaggcggcccggttcacctgtcgctcgcgttcaacccgtcgcacctcgaaatcgtcaacccggtggtcgaaggttcggccaaggcacgtatggaccgccgcggcgacgacagcggcctgcaagtgctgccggtgcagatccacggcgacgcggccttcgcgggccagggcgtggtgatggaaacgctgaacctcgcgcaaacgcgcggttacggcacgcacggcacgctgcatatcgtcatcaacaaccagatcggcttcacgacgtcggatccgcgcgactcgcgctccacgttgtattgctcggacgtcgtcaagatgatcgaagcgccggtgctgcacgtgaacggcgacgatcctgaagcggtggtgctggctacgcagctggcaatcgacttccgcatgcagttccacaaagacgtcgtcgtcgacatcgtctgcttccgcaagctgggtcacaacgagcaggacacgccggctgtcacgcagccgctgatgtacaagaccattgcgaagcacccgggcacgcgcgcgctgtacgctgaaaagctggtgcagcaaggcgtgatcacggcggccgacgcagacgaatacgtcaaggcctaccgcaaggcgatggacgaaggccatcacacggtcgacccggtgctctcgaactacaagagcaagtacgcggtggattgggtgccgttcctgaaccgcaagtggaccgacgctgccgataccgcagtgccgctcgcggaactgaagcgccttgctgaacgcatcaccacgattccggaaaacttcaaggttcaccccctggtcgagcgcgtcatcaacgaccgtcgcgcgatgggccgtggtgaagcgaagctcgactggggcatgggcgaacacctggcattcgcgtcgctggtcgcctcgggctatgcagttcgcctgaccggccaggactcgggccgcggcacgttcacgcaccgtcacgcggtgctgcacgatcagaaccgcgaacgctggaacgacggcacgtacgtgccgctgcaaaacatcgccgaaggtcaggcgaagttcacggtgatcgactcggtgctgtcggaagaagcggtgctgggcttcgaatacggttattcgaccgctgagccgaatacgttcgttgcatgggaagcgcagttcggcgacttcgtgaacggcgcgcaagtcgtgatcgaccagttcatctcgtcgggcgaagtgaagtggggccgtgtttcgggtctcaccatgctgctgccgcacggctacgaaggccagggtccggaacactcgtccgcacgtatcgagcgtttcctgcaactgtgcgcggatcacaacatgcaggtcgttcaaccgaccacgccggcgcagattttccacctgctgcgccgtcagatgatccgcctgttccgcaagccgctgatcgtcgccacgccgaagtcgctgctgcgccacaaggaagccgtgtcggatctgtcggaactggcgaagggcgcgttccagccgatcctcggcgaaatcgacgaagccatcgacgcgaagaaggtcaagcgcgtggtcgtgtgctcgggccgcgtgtactacgacctgctcgcacatcgccgtgaatcgaagtcgaacgacgtcgcgatcatccgtatcgaacagctctatccgttcgcgcacaagcagttcgaagcggaaatgaagaagtacgacaacgcgaccgaagtggtctgggtgcaggacgagccgcagaatcagggcccgtggttctacatcgagcaccacctgaaggacggcatgaaggaagggcagaagctggcatacagcggacgtccggcttcggcctcgccggcagtcggctattacgcgaagcactacgagcagcagaaggcgctggtcgaaggcgctttcggccgcctcaagagcgcgtcgatcgctaaa

SEQ ID NO: 30810 - DNA, 2080 bp, Burkholderia cepacia
atgagaatcgacaaactcaccactaaattccaggaagcactggccgatgcccaaagtctggctgtcggccacgacaatcaatacatcgaaccggttcacgtcctgtcggcgctcgtcgcccaacaggatggctcggcgcgttcgctgctctcgcgtgccggcgtgcatgtgcaggcgctgcaaacggcgctcggcgacgccatcacgcgtctgccgcaagtgcaaggcaccgacggcaacgtgcagatcggccgcgatctgaccggcctcctgaaccaggccgacaaggaagcgcaaaaactcaacgacacgttcatcgcgagcgagatgttcctgctcgccgtcgcggacgacaaaggcgaagccggccgtctggcgcgtcagcatggcttgtcgcgcaagtcgctggaaagcgcgatcgccgcggtgcgcggcggttcgcaggtgcatagccaggacgcggaaagccagcgtgaggcgctgaagaaatacaccgtggatctgaccgagcgcgcgcgggccggcaagctcgatccggtgatcggccgcgacgacgaaatccgtcgctcgatccagatcctgcaacgccgcaccaagaacaaccctgtgctgatcggcgaaccgggcgtgggtaagaccgcgatcgtcgaaggtctggcgcagcgtatcgtcaacggcgaagtgccggagacgctcaagggcaagcgcgtgctgtcgctcgatatggcggcgttgctggccggcgccaagtatcgcggcgaattcgaagaacgcctgaaggccgtgctgaacgacatcgcgaaagacgaaggccagaccatcgtcttcatcgacgaaattcacactatggtcggtgcgggcaaggccgaaggcgcgatggacgcgggcaacatgctcaagccggcgctctcgcgcggcgagctgcattgcgtcggcgcgaccacgctcgatgaatatcgcaagtacatcgaaaaggacgccgcgctcgaacgccgcttccagaaggtgctggtcgacgaaccgacggtcgaagccaccatcgcgatcctgcgcggtctgcaggaaaagtacgagctgcaccacggcgtggatatcaccgacccggcgatcgtggcggcggctgaactgtcgcatcgctacatcacggatcggttcctgccggacaaggccatcgacctgatcgacgaagccgcttcgaagatcaagatggaaatcgattcgaagccggaagagatggatcggctcgaccgtcgtttgatccagttgaagattgagcgcgaagccgtcaagaaggaaaaagacgaagcgtcgcagaagcgtctgcaactgatcgaggaagaaatcgagcggctgaaccgcgaatattcggacctcgacgaaatctggaccgcggaaaaagccgcggtgcaaggcagcgcgcaactgaaggaagagatcgaaaaaacgcgtgcggaaatcacgcgcctgcaacgtgaaggcaagctcgagaaggtcgccgagttgcagtacggcaagctgccgggactcgaagcgcagttgaaggaagtgaccaaggccgaggcgagcgagcagaacaatccgacgcgcccgcgcctcttgcgcacgcaggtcggtgcggaagaaatcgctgaagtcgtgtcgcgcgccaccggcattcccgtgtcgcgcatgatgcagggcgagcgcgaaaagctgctgcagatcgaagagaagctgcacgcgcgcgtggtcggccaggacgaggcgatcagcgcggtggccgatgcgatccgccgctcgcgtgcgggtctgtcggatccgaaccggccgtatggttcgttcctgttcctcggcccgaccggcgtgggcaagaccgagttgtgcaaggcgctcgcgtcgttcctgttcgattcggaagatcatctgatccgtatcgacatgagcgaattcatggagaagcatagcgtcgcgcgtctgatcggtgccgccgggatacgtgctcgaaggtgaactgacgagcgtgctcaacgaagcgtactgctacgaatcgagagcgcatcgacggtacggtgtcatgctacgacgcgagaccgcgcagcta

SEQ ID NO: 30811 - DNA, 1340 bp, Burkholderia cepacia
atggaaccgatcaaagttggactgctgggcttcggcacggtaggcagcggcaccttcacggtactgcgccgcaatcaggaagaaatcaaacgccgcgcgggccgcggcatcgagatcgcgcgcattgccgtgcgcaatcccgccaaagcgacggcggtgctcggcgccgaggcaggcaccgtggcgctgaccgatgacttcaacgcggtggtcgacgacccgtcgatcgatatcgtggccgaaatgatcggcggcacgggcgtggcgcgcgacctcgtgctgcgcgcgatccgcaaccgcaagcatgtggtgaccgccaacaaggcgctgctcgcggtgcacggcacggagattttcgaagcggcgcgcgccaacggcgtgatggtgtcgttcgaggcggcggtggcgggcgggattccgatcatcaaggcgctgcgcgaagggctcacggccaatcgcatccagtacattgcgggcatcatcaacggcaccacgaactacattctctcggaaatgcgcgaccgcgggctcgacttcgcgaccgcgctgaaagcggcgcaggacctcggttatgccgaagccgacccgaccttcgacatcgaaggcgtggacgccgcgcacaaggcgaccatcatgagcgcgatcgcgttcggcgtgccggtgcagttcgacaaggcctacgtcgaaggcatcagcaagctcgcggcgatcgacatcagatatgccgaggaactcggctaccgtatcaagctgctcggcattgcgcgccgcacagataaaggcatcgaattgcgcgtgcatcccacgctgattccggaaaagcgcctgctggcgaacgtggaaggcgcgatgaacgcagtcgtcgtgcacggcgacgcggtcggcaccacgctgtactacggcaagggcgcgggcgccgagcccacggcttccgcggtggtggccgatctggtcgacgtgacgcgtctgcacacggcggacccggagcaccgcgtgccgcatctggcgttccagccggacagcctgtcgaacaccccgatcctgccgatcgacgaagtgacgagcggctactacctgcgtctgcgggtggcggacgtgaccggcgtgctggctgacatcacgcgcattctggccgataccggcatttcgatcgacgcgctgctgcagaaggaatcggagcaggtcgacgcgaacggcaagggcgaaaccgacatcatcctgattacgcacgaaacggttgagaagaacgtcaacgccgcgatcaagacgatcgaagcgctgaagaccgttgtttcgcaagtcacgaagctgcgcatggaagcgctgaactaggccgaact

SEQ ID NO: 30812 - DNA, 1020 bp, Burkholderia cepacia; identical to SEQ ID NO: 28058

SEQ ID NO: 30813 - DNA, 1197 bp, Burkholderia cepacia; identical to SEQ ID NO: 28059

SEQ ID NO: 30814 - DNA, 1173 bp, Burkholderia cepacia
atgactgacgccgtaatcgtatcgaccgctcgcacaggcctcgccaaatcgtggcgcggcggtttcaacatgacgcacggcgcgacgctcggcggccatgtgacgcaggccgccgtcgaacgcgcgaagctcgacccggcgcgcgtcgaggacgtgatcatgggctgcgccaatccggaaggcgcgacgggcatgaacatcgcgcggcagatcgcgctgcgcgccggtttgccggtcagcgtgccgggcatgacggtgaaccgtttctgttcgtcgggattgcaaactatcgcgctggccgcgcaacgcgtgatcgccggtgaaggcgacgtgtatgtggcaggcggcgtggaatcgatctcgtgcgtgcagaacgagatgaaccaccacatgctgacggaaggctggctcagcgaaaacaaaccggaaatctactggtcgatgctgcagaccgcggagaacgtcgcgaaacgctattcgatctcgaaggagcgtcaggacgagtacggcgtgcgttcgcaacagcgcgcggccgccgcgctcgaagccggcaggttcaaggacgagatcgtgccgctgacggtgctcgcgggcgtcaccgataaagcgggcgggcgtcttttcacgaaggaagtgaccgtcagcggcgacgaaggcattcgcgccgacacgacgctcgaaggcgtctcgaagattcgtaccgcattgccaggcggcgtgatcaccgcgggcaatgcgagccagttctcggacggcgcgtcggcgtgcgtggtgatgaacgcgaaggtggcggagcgcgaaggcctgcagccgctcggtattttccgcggcttcgcggtggcaggttgcgagccggacgaaatggggatcggcccggtgttcgcggtgccgaagctgctcaggcaggcaggtctgaaagtcgaggacatcgacctgtgggagttgaacgaagcgttcgcggtgcaggtgctgtattgcgccgacaagctcggtattccccaggatcgtctgaacgtgaacggcggcgcgatcgcggtcgggcatccgtatggcgtgtcgggcgcgcggctgaccgggcatgcgctgatcgaaggcaagcggcgcggcgcgaagctggttgtcgtgacgatgtgtattggcggcgggcagggcgcggcggggttgttcgaagtg

SEQ ID NO: 30815 - DNA, 570 bp, Burkholderia cepacia
atggcgcggggcaaattcatcacgtttgagggcatcgacggggcgggcaagacaacccacctcagctggtttcgggagcgcctcgaacagaaagtcgcgagcaccgggcgctcggtcgtcatgacgcgcgaaccgggcggcacgccgctcggcgagcagattcgcgaaatcgtgctgcatcagaaaatggacctcgaaaccgaggcgctgctgatgttcgcgctgcgccgccagcatctggccgaagtgatcgagccggcgctcgcgcgcggcgactgggtgctgtcggaccgtttcaccgacgcgaccttcgcctatcagggcggcggccgcggactgccgcgcgacaagctggaaaccctggagcgctgggtgcagggcggctttcaaccggacctgacggtgctgttcgacctcgatcccgaggtcgccagcgagcggcgcagcgcggcgcgcgacccggatcgtttcgagagcgaatcggaggcgttcttcagccgtacccgcgccgaatatctgcgccgtgccgaagaagcgccgtaccggttcgctatcattgactccgcgcag

SEQ ID NO: 30816 - DNA, 1374 bp, Burkholderia cepacia; identical to SEQ ID NO: 28062

SEQ ID NO: 30817 - DNA, 969 bp, Burkholderia cepacia; identical to SEQ ID NO: 28063

SEQ ID NO: 30818 - DNA, 2690 bp, Burkholderia cepacia; identical to SEQ ID NO: 28064

SEQ ID NO: 30819 - DNA, 1959 bp, Burkholderia cepacia
atccagccccttcccgatcagttgatcagtcagattgccgccggcgaagtggtcgagcggcccgcttcggtcgtcaaggagctgctggaaaatgcactcgacgcgggcgcgcagtcgctgcgcatcctgctcgacgaaggcggcgtcaaacgcatctcgatcaccgacgacggctgcggcatccccgagaacgaactcgcgctggcgctgatgcgtcacgccaccagcaaaatccgctcgctcgccgaactggaagcggtcgctacgctggggttccgcggcgaggcgctggcctcgatcgcctcggtcgcgcagatgaccatcacgagccgcacggccgacgcggcgcacgcggtgcgcgtggatgcgcaaaccggcgtgctgagtcccgcggccggcacccagggcaccacgatcgaagtccgcgagttgtacttcaatacgccggcgcgccgtaaatttctgaagagcgagcagaccgaactcggccattgtctcgaacagatccgccgcgccgcgctggcgcggccggatgtcgcgatttcggtgctgcataacggcaaggcggtcgaacactggaacgccagcgagccgcccgtgcgggtcgcgaagattctcggcgacacgtttgccaccgctcatctgccgctcgacgaatccgccggaccgcttgcggtctacggttgcgcgggtctgccgaccgcgagccgcgggcgtgccgatcagcagtatttcttcgtcaacggccgcttcgtgcgcgacaagctgctcacgcacgccgtgcgcgccgcttatgaagacgtgctgcatggcgagcgctatccgtcctacgtgctgttcctcgacctgccgcctgaagcggtcgatgtgaacgtgcatccgtcgaaaatcgaggtgcgcttccgcgattcgcgctcgattcaccagttcgtcttccacgccgtgcagcgcgcgctggcgcggcatgcgggcgcatcgccggaaacgacggcgggcgggcatgcggcgcatctggcgccttccgttagcgggccggcttcgtttggcgcgacgccactgggcggcgcgggcgtcggcggcgtcggcttcggtgctggcaacggcgctggcggcatcggtggcggcttgggtggcgcatcgggcggcggcttcggatcgtcgtcgcagcagcccggcaatacctggatgcgccaggcgcgcatgacgcaaggcacgctgccggttgcccaaccgctcgcgttttacgacgcgctcttcggccgcaaagatacgaacgcgggcacggcggaaggcgccacgcttttcgaggcgcgcgattcggccgccgaagcaccgtcaccgtacaacgcgtccgcgccgtacccggcgcccgctttccatgccgccgacgagcaaccgctcggcttcgcgctcggccagatccacggcatctatgtgctggcccagaacgcgcacggtctggtgatcgtcgacatgcacgccgcgcacgagcgcattctgtacgagcagttcaagaacgcgctggccgatcgcacgatcgccgtgcaaccgctgctgatcccgcagtccatgcaggccgatccggtcgaaatcggtacggtggaagaagagcgcgacacactcgacgcactcggcttcgatctcgccgtgctgtcgccgaccacactcgccatccgcgccgtaccggcgctgctgaaagacgccgatctgcaggcgctggcgcgcgcggtcctctccgacctgcatgcattcggcggctcgcgcgtactgaccgaacgtcagcacgaactgctcggcacgctcgcctgccatcacgcggtgcgcgcgaaccggcgtctgacgctcgacgaaatgaacgcgctgctgcgtcagatggaagccaccgagcgcgccgatcaatgcaatcacggacgtcccacgtggtatcagttgacgctgtccgatctcgatcggctgttc

SEQ ID NO: 30820 - DNA, 738 bp, Burkholderia cepacia; identical to SEQ ID NO: 28066

SEQ ID NO: 30821 - DNA, 738 bp, Burkholderia cepacia; identical to SEQ ID NO: 28067

SEQ ID NO: 30822 - DNA, 1176 bp, Burkholderia cepacia; identical to SEQ ID NO: 28068

SEQ ID NO: 30823 - DNA, 633 bp, Burkholderia cepacia
ctgacttcggaacgggttcgcgaacggatggtcgaacgcctgcgtgcgaacggtgtgaccgatcagcgcgtgttgaacgcgatgtcggtcgtgccgcgccatatgttcgtcgacccgggtctcgcggcgcaggcctacgaagatgccgcattgccgatcggtcatcaccagacgatctccaaaccctcggtcgtggcccggatgatcgaactggccgccgccggccgcgcgctgaacaacgtgctcgaaatcggcacgggctgcggttatcaggcggccgtgctgagccaggtcgcgcgcgaggtttactcgatcgagcgcatcaggccgctgtcggagcgcgccaagacaaatttgcgtccgctgcgcattccgaacatccggctgcactatggagacgggcggttgggtctgccctcggcggcaccgttcgacgcgatcgtgatcgccgcggcggggctcgacgtaccgcaagcgttacttgaacaactcgcgatcggcggccgcctggtcgcgccggtcggctcgcaggagggccaaagccaggtgctgactctggtcgagcgcctcggacccgcgcagtggcgcgagtcgcggcttgatcgcgttttctttgtacccttaaaatccgga

SEQ ID NO: 30824 - DNA, 726 bp, Burkholderia cepacia; identical to SEQ ID NO: 28069

SEQ ID NO: 30825 - DNA, 1488 bp, Burkholderia cepacia; identical to SEQ ID NO: 28070

SEQ ID NO: 30826 - DNA, 1116 bp, Burkholderia cepacia
accgacgaccagcggatgatccgcgatgcggcgcgtgacctctcgacaggacgtctggcgccttatgcggctgactgggaccgtgaaggcagtctgccagacgaggtcgtttcgcaacttggcgaacttggttttctgggcatgatcgtcccacccgagctcggcggatcctatacggattacgttgcatacgccctggcgatagaggaaattgctgcgggttgcgcgtcttgcgcaacgcttgtgagcgtgcacaactcagttggttgcggacctgttctgcaatatggaagtgaagcgcaaaaggatagatggctcggcaagctcgccagtggcgaggcgatcggtgcgttttgccttaccgaaccgcaggctggctccgaggccaataatcttcgtacgcgcgcggagctgcacaacggacggtgggtgctgaatggcagcaaacagttcgtgaccaacgccgcacgtgccggtgtggcaatcgtgttcgccgttaccgacccgactgcgggcaagcgtggtttgtctgcttttattgtcccgaccgacacgccgggttttaacgtcggcccaccggaaaaaaagctcggtattcgcgcgtctgatacctgccccgttgcgctcgagaactgcgcgattcctgaggcgaatctgctcggctcacgcggcgagggtttaaagatcgcattgtcgaatcttgagggcggacgtattggcatcgccgcgcaggcgcttggtattgcgcgcgccgcgttcgaggtggcacgctcctatgcgcacgagcgggtgcagttcggtgaacctctcgtacggcatcagagcgtggccaatctgctcgccgatatggcgacacgcctgaacgccgcccgctttctcgtccatcacgcagcccggctgcgaacgcttggcaagccgtgcctgtccgaggcatcgcaggcgaagctgtatgcgtccgagatggcggaggaagtttgctcgcacgcaatccagatccacggtggctatggttacctgaacgactatccggtcgagcgtcactatcgggacgcgcgaatcacacagatctacgagggcacgagcgaggtacagcgcatggtgatcgcgcgccagctg

SEQ ID NO: 30827 - DNA, 1611 bp, Burkholderia cepacia
gacgcgcgtgatctgctggtgcgtcaccgcaccgactatgagcgcgcatatcaggaatttgcatggccgaagctcgacaccttcaactgggcgctcgactatttcgacgaaatggcgcgtggcaacgacagcccggcgctgtggatcgtcgatgatcctgccagtgccggaacacggctcaccttcgcgcaaatggctgagcggtcctcgcgcgtggcaaatttcctccgggagcagggcgttgctcgaggcgaccgactgctgctgatgctgcccaatcgcgttgagttatgggaggtgatgctcgcagcgatgaagcttggcgcggttgtgctgcctgcgacaacgcagctgtcatccgatgacgtttgtgagcgggtcgaggtcggggccgtgcgattcgtcatcgtcgacgggagcgaggtagggaaatttgatgggatcgaagccactgtaaagcgcattgtggtcggcacacgagcggcggtgactcaaggctggatcgattttgccttggcctatgaagcgagcccggccttcaaaccggacggcccgacgaacgcctccgatccgctactgctgtacttcacatcgggcacgacgtccagaccgaaacttgtcgagcatacccatcagagctatccggtcggtcatctttcgacgatgtactggatcgggttgcggcccggcgacgtgcactggaacatcagttcccccggctgggcgaagcatgcgtggagctgtttttttgcgccgtggaatgcgggcgcatgcgtgttcgtctatgactacacgcgcttcgtaccgaaagatacgctgaatgtgctggtgcaatgtggcgtcacgacactctgcgcgccgcccacagtctggcggatgctggtgcaggaacccctcgcttcgtatccggtgaagttgcgggagattgtcggagcgggcgaaccgctcaatccggaaatcatcgagcgcgtgcgccacgcctggggtaccacgattcgcgatggttttggtcaaaccgaaaccacctgccagatcggcaactctccgggccagccggtcgtcgcgggatcgatggggcgcccgctgcccggctaccgtatcgagctcgtcgacgcggacgaccacgccgcaagcgagggagaaattgccctgtcgctcgcgcatcgtccgaccggtctgatgactggctatgccaataacccgcaggcaacggaatacgccatgcgcaacggcctttaccatacatccgacgtcgcgttgcggcgtgaggacggctacttcgtctacgtcggacgagcggacgacgtattcaagtcctccgactaccgcctgagccctttcgaactggagagcgtgctcatcgagcacgaggcgattgccgaggcggccgtcgtgccgagtgcggatgcggttcgtctgtcggtgccgaaagcattcgtcatcgtgcgccatggctaccagataggaccggaacttgcacgcgaggtttttcgcttctcacgcgagaaactcgcgccttataaacggatccggcgattgcagttcagcgatttgcccaagaccatctcgggcaagattcgccgcgttgaactgcggcgtcgcgaaatggaa

SEQ ID NO: 30828 - DNA, 903 bp, Burkholderia cepacia; identical to SEQ ID NO: 28073

SEQ ID NO: 30829 - DNA, 1587 bp, Burkholderia cepacia
ccctcctggtcctcgctgcaaacgcattacgaaaagattcgcgatgcgcacatgcgcgactggttcgcccccgagaacgatcccgcccctacccgtgccgaacgctttgcgttcgcgggcggcggtctcgcggccgatttctcgaagaaccgcatcaccgacgaaaccctgaaactgctcgtgcaactcgcgcgcgaagccggcgtcgagaaacgccgcgacgcgatgttcgcgggtgcagtcgtcaacccgaccgaaggccgcgccgcgctgcacacggccctgcgcgccaccgacccgaaagcgccgttctacgaccaggtgcaggccgagcgcgccaggatggccgcgttcgccgaccaggtgcgcagcggcgagtggaaaggctataccggcaagcggatccgctacgtggtgaacatcggcatcggcggctcggacctcgggccgaagatggtcgtgcacgcgctgcatcatctggccacgccggagatcaccacgcatttcgtgtcgaacgtcgacggcgccgatctttacaacgtgatgcagcagatcgatcccgaagaaacgctcgcaatcatcgtctccaagactttcaccacgctcgaaaccatgaccaacgcgcgctcgctgcgtgactggttcgtcgagaaaggctgcccggaaagcgcgctggcgaaacacttcgtcggcgtgtcggccaatcccgcggaagtggtcaagttcggcatcgcgaaagaaaacgtgttcgagatgtgggactgggttggcgggcgttactcgttgtggtcggcggtgggtctgtcgatcatgatcgcggtcggaccgcagcagttcggcgaactgctcgccggcgccaatgagatggaccagcatttccgcgacgcgccgctcgagaagaatctgccggtgctgctcggcatgatcggcatctggtatcgcaacttcttcggctcgcaaagctacctggtcgcgccgtattcggaagcgctgcatttcctgccgtcgtatctgcaacagctcgaaatggagagcaacggcaagtcggcgcgtctcgacggcgtaatggtcgactatccgaccgccgccgtgacgtggggcgaaccgggcacgaacggccagcatgcgttcttccagatgctgcatcagggcccgacgatcgtgccgatcgacttcatcgccgtgttgacgccggagcatccgctcgtcagtcatcatccgaagctgctcgccaactgcttcgcgcagagtgaagcgctgatgctcggccgcacgctcgaggaagcgaagaaagtggccggcgcggacaagccggagctggcgccgcacctggtgtttccggggaatcgtcccaccagcacgctgctcgtcgacgcactgaccgcgcgttcgctcggcgctttgatcgcgctgtacgagcacaaggtgctggtgcaggcgtcggtgtgggacatcaatccgttcgatcaatggggcgtggaattgggcaagattctcggcaaagtggtcgaggccgatctgacagcgccgagcgtcgatgagaagaagcatgactcgtcgacgtcagcgttgattgcccgggcacgc

SEQ ID NO: 30830 - DNA, 627 bp, Burkholderia cepacia; identical to SEQ ID NO: 28075

SEQ ID NO: 30831 - DNA, 1098 bp, Burkholderia cepacia; identical to SEQ ID NO: 28076

SEQ ID NO: 30832 - DNA, 1455 bp, Burkholderia cepacia
atgccggcgcaggcttcattccgtatcgaccggagaaagaacatgagccagtttgcgaactacatcgacggacagtgggtagacggcgcgagcgtgtcccgcaacgtcaatccgtccaatctcgacgacgtgatcggcgagttcgcccaggccgacgctgagcagacgcagcgcgcgatccgcgccgcgcgcaacgcgttcgcgcaatggtcgctgtccacgccgcagcagcgtttcgatctgctcgaccaggcgggcagcacgatcctcgcgcgtaaggccgaactgggccggcttctcgcgcgtgaagagggcaagacgctgcccgaggcgattggcgaagtgggccgcgcggggcagatcttcaagttcttcgcgggcgaagcgctgcgcattggcggcgaaatcgtgccatccgtacgacccggcatgacggtggaagtgacccgggagccgctcggcgtgatcggcctcattacgccgtggaatttccccatcgcgattccggcctggaagattgcgccggcgcttgcgtacgggaacaccgtcgtcgtcaaaccggccgacctcgttccggccagcacgtgggagcttgtcaggatcatcgccgaggcgggcgcgccggcgggcgtcatcaatctcgtcatgggacagggtgccgtggttggcgaagcgctggtttcctcaccgcaggtcgacgccgtgagcttcacgggttctgtcgcgacggggcgtgccatcggagcgaaatgcttcgcctccggcaagaagttccagctggagatgggcggcaagaacccgatggtggtgctcgatgacgccgacctcgacgtcgcggtcgaagcgtgcatcaacggtgggttttattcgacgggccagcgctgcacggcgtcgagccgcttcatcgtgaccgaagggatccacgaccgcttcatcgacgcgatgaaagcgcgcatgcaagccttgaaggtgggcgatgcgcttgccgacggcacccacatcggcccggtcgtcgacgacaagcagctccagcaggatgaacgatacatcgccatcgcgcgcgaggagggcggcacgatcttcggtggggagcggatcgagcgcgatacgcgcggctatttcctcgcgccggcgctgattaccgacaccacgccggacatgcgcatcaaccgggaagaagtgttcggcccggtagcttcggtcatcaaggtcaaggactacaacgaggcgctcgcggtcgccaatgacacggagtttgggctctccgcgggtatctgcacgacgtcgctgaagtattcgagccacttccgccgccatgtgcaggcgggcatggtgatggtgaacacggcgaccgccggcgtggattaccacgtgccgtttggcggccgcaagggttcgagctacggtccgcgcgagcaaggcagctatgcccgcgagttttacaccacggtcaag

SEQ ID NO: 30833 - DNA, 813 bp, Burkholderia cepacia
gccgagttgggcgaaggcccgctgtggcaggccggggagaacgcggtttatttcgtcgatatcaagggccgccagattcatcgtctgacggtcactaccggacaaacgcaaacgtggaaggcgcccggtcaaccgggtttcatcgcaccgcttgcgggccacggttttgtttgcgggctgccgggcggcctgtatcgcttcgatgccggcagcggacaattcagcaagctcaaggacgttgaagtgcacctgccgggcaaccgtctcaacgacggcttcgtggatgccagcgggcacttgtggttcggctcgatggacgacggcgaagagcagcccagcggcacgctgtatcgcgtcaaccatgccggcgaagcggtggcccaggacgacggctacgtgatcaccaacggacccgcctcgagcccggacgcgcgcacgctttaccacggcgacaccatgcggcgcgtggtgtatgcattcgacctgggcgaagacgggacgttgtcgcgcaaacgcatctttgccgccatttccggcgacggctaccccgatggcatggcggtcgacgccgacggattcctgtgggtcgcgcttttcggcgggtggcgtatcgagcgcttctcgcccgacggcaagcgggtcgaacaggtaccgtttccctgcgccaacgtgacgaagctcgccttcggcggcgacgatctgcagactgtttatgcgtcgaccgcatggaagggcttgtcgccggtagcgcgtcagcagcagccggatgccggcggtctgttctcgtttcgctcaccggtgcccggccagccg

SEQ ID NO: 30834 - DNA, 723 bp, Burkholderia cepacia
aaaacggttgtcatcaccggcggcggcagcggcatcggcgccgcgatggtcgaagctttcgcccggcagggcgcgcgagttttcttcctcgacgtcgctgaggacgattcgctggcgttgcagcaatcgctgagcgacgcgcctcacccgccgttgttccgccgctgcgatctgcgcagcgtcgatgcgatccacagtgcgtttgccgggatcgtcgagatcgccgggccgatcgaggtactcgtcaacaacgctggcaacgacgaccggcatgaagtcgacgccatcacgccggcctattgggacgagcgcatggccgtgaacctgcggcaccagttcttctgcgcgcaggccgcagcggccggcatgcgcaagatcgggcgcggcgtgatcctgaatcttggctcggtttcctggcacctcgcgttgccgaacctcgcgatctacatgagcgcgaaggccggtatcgaagggctgacccggggcctcgcgcgcgatctcggcgccgccggcatccgcgtgaactgcattattcccggcgcggtgcggactccccgtcagatgcagctctggcagtcgcccgagagcgaagcgaagctcgtcgccagccaatgtctgcgtttgcgtatcgaacctgagcatgtcgcgcgcatggcgttgtttcttgcgtccgacgatgcgtcgcgttgctcagggcgggattatttcgtcgacgccgggtgg

SEQ ID NO: 30835 - DNA, 2115 bp, Burkholderia cepacia; identical to SEQ ID NO: 28080

SEQ ID NO: 30836 - DNA, 1197 bp, Burkholderia cepacia
gtccactcggaggccggcagactacgcaccgtcatggtgtgtgctcccggtctcgcgcaccgccgtctcacgcccgccaattgcggcgccttattgttcgacgatgtcatctgggtcgacaaggcaatcgaggaccatcagacgttcacccgcctgctgcgcgaacggggcatcgaggtgcttgaatttcatcatctgctggccgaagtctgtctgaacacaaccgcacgcgactggattctcaaccggcgcatcgtcgaggaggaagtggggacgggtatgctgcgcgagttacggctgtggctcgaggacatgcccgcgcagcaactcgctgacgtgttgatcggcggtgtggcaaaagctgaactgccattcgatgcacgggggttgttcggcggctatctggagcgctcggagttcgtaatccagccgctcgtcaacctgatgttccagcgtgatccgagcgcctggatctatggcggcgtgaccttgcatcccatgttctggccggcccgacgtaaggaaaccctgctgctcgcggcggtgtatgcgtttcatccccgctttgcgggaaaggtcagaacgtggtggggtggccccgatacaaacttcggggtcgagacgctcgaaggcggagatgtgatgccgatcggcaatggcgtcgtactgatcggcatgggcgaacgctcgagtccccaggcggtgacccaggtggcgcgagccctgtttgccggtaacggcgcgaggcgggtgattgcctgccagcttccgaaagcgagatcgtcgatgcatctcgatacggtgttctcgtttctcgatgtcgattttgtgagcgtttatccggacgtggctgacgatatccggtgtaccagtctttatccgggagatgacctcggccagattcgctatgaacgccatgaggataagtttctcgccgtcgtgtccggagcactgggcgtcggctcgctgcgtgtgctgactacggggggcgacacctacgagaccgaacgggaacaatgggacgacggcaacaacgtgctggcgctcgaccggcgggtcgtccttgcatacgaccgcaatacctacaccaaccgcaagatgcgccaggcaggcgtcgaggtcatcgaaattcccggcggcgagctcggccggggccggggcggcagccattgcctgagttgtccgatcgaacgggat

SEQ ID NO: 30837 - DNA, 996 bp, Burkholderia cepacia; identical to SEQ ID NO: 28082

SEQ ID NO: 30838 - DNA, 771 bp, Burkholderia cepacia; identical to SEQ ID NO: 28083

SEQ ID NO: 30839 - DNA, 2061 bp, Burkholderia cepacia
aatccgctcctcgatttctccgacctgccgcgctttggccaaatccgccccgaacacgtcacgcccgccctcgatgtgctgctcgccgatgcgtccgccgccgtcgagcgcgccgcccagcccatcacgcccgcttcatgggccgacgtggtcgagccggtcgagcgcgccaccgaaccgctgtcgcgcgcatggagcgtggtcggccatctgaacgcggtggccgatacacccgagctgcgcgccgtgtatggcgagaatctgccgcgcgtcaccgaattctggtcgagcgtcggacagaacctcgcgctgtacgagaagtacaaggcattgcacgccagcagcgatttcgaatcgctgaccggcgagcgcaagaagatcctcggcaatgcgctccgcgatttccgcctgtccggcgcggaattgccggaagaccagaagccgcatttcgccgaattgcaggaacgccaggcggcgctctcgaaagcgttttcggatcacgtgctcgacgcgaccaacgcgtatgcgtatatcgtcgaagccggcgctgaagcgcaactggccggcctgcccgaagacgtgatcgaagccgccagggaagcgaccgagcgcgaaggcaagaccggctacaaattcacgctgcacttcccgtcgtatttcccggtgatgcagtactcggaaaatcgtccgatgcgcgaggcgatgtatcgcgcctatgtcacgcgcgcctcggaactcggcccgcaatacggcaatggcaagcccgagtgggacaacaccgcggtgctcgccgagcagttgaaactgcgcgccgaagaagcgcacatgctcggctacaacaacttcgccgaagtctcgctcgcgccgaaaatggccgagtcgcccgcccaggtgatgagctttctcgaagatctcgccacgcgtgcgcgtccgcatgccgagcaggactggaaggaactgcgcgaattcgccgcgaacgaactcggcatgagcgaactgcagccgtgggacatgacctttgccgcggagcgtctgcgtcagaagcgctattcgttctccgagaacgaggtcaaacagtactttccggaagacaccgtgttcaagggtcttttcaaggtcactgaaacgctgttcggcgtgcgcatccgtcgcgacaaagcggacgtgtggcatccggacgtacgctttttccgtgtcgagaatcaggacggcggcctcgtcgcgcagttctacctcgatctgtatgcgcgcgaaggcaaacgcggcggcgcctggatggacgacgcgcgcggccgccacaggcacacgcacggcggcgtgcaaacgccggtcgcgtatctgacctgcaacttctccgcgccggtcggcggcaagcccgcctgctttacgcacgacgaagtcatcacgctgttccacgagttcggccacggcctgcaccacatgctcacgcgcgtggacgagctgggcgtgtcgggcatcaacggcgtggagtgggacgcggtcgaactgccgtcgcaattcatggagaacttctgctgggagtgggacgtgctgagcgacatgacctcgcacgtcgaaacggccaggccgttgccgcgcgaactgttcgacaagatgctcgcggcgaagaacttccagagcggtctcggcacgctgcgccagatcgtcttctcgatgttcgacatgcaactgcataccgacttcgacgcgtccggcacgaagagcgtcaccgaactcgcgagcgaaatcaacgagcgcttccacgtcgtgccgcaagcaccgttctcacgctggccgaacacgttcagccatattttcgcgggcggttatgcggcgggctactacagctacaagtgggccgaagtgctgtccgccgacgcctacgcggcgttcgaagaagccgcgcaatcggctagcggcagcgtgctcgatcaggcgaccggcatgcgttaccgcaaggagattctggaggtgggcggcagccgtccggcgatggaatcgttcaaggcattccgcggccgcgagccgaatatcgacgccttgctgcggcacaacggcatg

SEQ ID NO: 30840 - DNA, 840 bp, Burkholderia cepacia
atgactgccaaactgatcgacggccttgccctttccaagaccctgcgcgccgacgtcgccgcgcgcgctgccgccctcaccgcccgcggccatcagccgggcctcgccgtggtgctggtcggcgacaatccggccagcgaagtgtacgtgcgcaacaaggtcaaggcgtgccacgacaatggcctcggctcgtcgttcgaccgctatccggccgacctgccggaagccgaactgctcgcgcgcatcgacgaactgaaccgcgatccgcgcattcacggcattctggtgcaactgccgctgccgccgcatatcgacagccacaaggtgatcgaggcgatcgctccggaaaaggacgtggacggctttcacgtcgccaacgccggcgctttgatgaccggccagccgctgttccgtccgtgcacgccgtacggcgtgatgaaaatgctcgccgcttacgagattccgctgcaaggcgcgaacgcggtggtaatcggccgctcgaacatcgtcggcaaaccgatggcgctgctgctgctcgaagccggcgcgaccgtgacgatctgccacagcaagacgcgcgatctggctgcccacactcgcaacgccgacgtggtggtggccgccaccggcttgcgcaacattctcacggcggacatggtaaagccgggcgcggccgtgatcgacgtcggcatgaatcgcgacgaagccggcaagctgtgcggcgacgtcgacttcgcgggcgtcaaggaagtggccggctacatcacgccggtgccgggcggcgtcggcccgatgaccatcaccatgctgctcgtcaatacgatcgaagccgccgagcgt

SEQ ID NO: 30841 - DNA, 858 bp, Burkholderia cepacia
atccagaaagtaggcgtcgtcggcgcgggaaccatgggcaacggcatcgcgcaggtctgtgcggtcgccggactgcaggtagcaatgatcgatatttccggcgctgccgtcaccgacggcctcgcaaccatcgaaagcagcctggaacggctggtccgcaaggacaagctatccgccgcggaccgggctgcggcactcgcccgggtgagtggtaacactgactacgctgcgctgaagggcgccgggttgatcatcgaggccgccaccgagaatcccgggatcaagctgcgcatcctgaggcaaatcgacgaagcagcggaagatgacgcgatcatcgcgaccaatacctcctcgatctccatcacgctgctcgcggccgtgctgaagcaaccggagcgtttcattggcatgcatttcttcaaccccgtgccgatgatggcgctgctcgaagtcattcgcggcttgcagacatcggacgaaacccacgcgaagaccctggcctttgcgcagacgatcggcaaaaccgcgatcacagccaggaacagccccggcttcgcggtgaaccgcatcctggtcccgatgatcaatgaggccatctttacgctgcaggagggcctggccacggccgacgacatcgacaccggcatgaggctcggctgcaatcaccctatcggacctctggcgctggccgatctgatcggtctggataccctgctcgcggttatgcaggttttctacgaagggttcaatgatccgaagtatcgccctgctccactgctgcgcgaaatggtggctgcgggccgcctcggacgcaagagcgggcggggtttccatagctatgcgtgacgagcgccgcta

SEQ ID NO: 30842 - DNA, 1140 bp, Burkholderia cepacia
atactcatgaaacgcacatgtttcgacgccgggatggaacagttccgcgactcggcccgcaagttttttgccggcgagatcgcgcctcaccgggaacgttggcgcgaggccagcgtggtggaccgcgaagcattccgcaaggccggcgagatgggctacctttgcatgtggatcgacgagtgccacggcggcctcggcctgaaggacctgcgctatgagcagatcctgatcgaggagaacatcttccacggcgaccggggcttcttcttctggctgcatagccgcctggtcgcgccgtatctggaacacttcggcaccgacgagcagaaacagcgctatttccccggcatccgcagcggcgaacagatactcgcgatcgcgatgaccgagccggacgcgggttccgacctcgcgggcatgaagacacgcgccgaggaaaccggtgactactgggtgctcaacggctcgaaaacctatatctccaacggcctgaacgccgacgtcgtgctggtggcggcccgaacgcatcccaccaaggcgcacgggctgacgctcttcctcgtggagcgaggcatggagggttttgaacgcggccgcaacctcaggaagatgggcctcaagtcgcaggacacggccgaactcttcttccacgatgtaaagattccgaagagtcatgtgctaggccaggtccacgcgggcttccagcatctgatgcgcggccttgcggaagagcggctactcgccgcgatcttcaacgtcgcgtcggcgcgccttgcgatgcacctcacttgcgatttcgtgcgcgagcgcaaggtgttcggcaagccgttgagcagtttccagaacacccgcttcaagctcgccgcactcgacacggagatcgaggtggcgcaaagctgggtcgaccggctcgtggccgaacacaacgcggaccagctcgacgcggtggatgccgcgcgcgccaaactcttcaccagcgagctcaacggtcgcatggtcgacgagggtgtgcagcagcacggcggagcgggctacatggacgaatacgagatttgccgcctgtatcaggacgagcggattcaccgcatcctcgccggcacctcggaaatcatgaaagagatcgtcgcccgctcgattctc

SEQ ID NO: 30843 - DNA, 1200 bp, Burkholderia cepacia; identical to SEQ ID NO: 28088

SEQ ID NO: 30844 - DNA, 1467 bp, Burkholderia cepacia
tccattgccgtcgtgtgcggcgaggagcgccttacgtggcgcgaactcgatatccgcaccaatcaggttgccaatgccatccgcgcgctgggtttcgacaagggcgacaagatcgccctcttcatgcccaattcactggccctgttcgagcttttctggggtgtggtgaaagccggctgcgtggtcgtgtgcctgaatacgatgctcgaaggctcggccctcgcgcgcatcacgaattcatcggacgcccgggcgatgtttgccggcggcagctcccggactctggtcgatgaagtgcgcgacaggctcgaaggcatcgcgccagaacatttctacagcgtcgattcgccaggcgacggatggaacagtgcgcagacactgttcgatgcggcgccgtccacgccgccgcaggtcacgatcctgccttccgattcaatgaccatcatctattcatccggaactaccggggttcccaagggcatcgagcacacacatttcggacgactgaattacccgcacggattcgccatgggcctcgcgatcaaccgttattcggtggccgtttgcgcgacgccgatctatgcgtcgggcacatggatcacaatgtttccgaccatgtatcgaggcggcaccgtcgttctgctgccgcaatactcgccagaggccttcatcgatgcagtccggcgggaacgcggcactcatagttttctggtgcccacgcagtacatcggactgctgcagcaaccgttgcagaactatgaccttggctcgctcaaggcgttggtcacggccggtcaatcactcctgcccgcgacttatgcagccctcctcagggccttcccccatgccggtatctacgaggtctacgggatgaccgagggcttctcgacacttgccataccagaggacgtagcgcgcggcaagaccggctcggttggcaagccctcttttctcgacgacgtccgcatcatcgacgagcagggccgcgagttaccgcctggagaaactggcgagatcgtcgcatatgggccaggaatgatgaagggctactacaaccgcccggacatgaccgaggcggcgacctggatcagccctgccggccgcacctacatgcgcagcggcgatctgggccagatggacgaggacggcttcctgtatgtcaacggccggctcaaggacatgatcaagtcgggtggcatcaacatctatgcagccgatctggaacaggtcgtgatagagcatccggccgtgcacgaagtcgctgtaatcggtgtacctcacgaaaagtggagcgagacacccgtcgccgtggtgttgctcaagccaggcgcgagcgcggaacccgacgtattgatgcgctgggtgaaccagcggctctcgaagtaccagcgactcagcctgctcctgatccgcgacgagctgccgcgcgccatctacggaaaggtacagaagcaggcccttcgggag

SEQ ID NO: 30845 - DNA, 735 bp, Burkholderia cepacia
atcgtcaccggtggtggtggcggaatcggcggggccaccgtgctgcgcctgctgcgcaccggtgcgaacgtcctcgcgatagacatcagttccagacgcctgaacggtgtgaaagaagaggccgccgccttgcctggccgcatggaggtgctcaaggcggatatcactgccgagcagccggtagaacaggcagtgaagcttgcgctggaactgttcggcgacctgcacggtgtcgctaacgtggccggcggcatgcccgactacacgggcacggacatggaccgcccactggagtcgatcagcctcgattatttccatcggatgttcgcgctcaacgtcgacagtgccttcctgatgagcaaggccgccacgccacacttcaggaagaaacagtacggcaagatcgtcaacgtcgcctctctggctgcgtttgccaaccgcccagagcttgggaatgccgcctacaacccggcgaagaaggcggtgatcggcctggccgagacgctgagtctcctgctgggaccggatggcatccgcgttaataccatcgcacccgggctggtgatgagcgataaggccaagggcgcgttgggtgacgaatacacccagcgacacctcaagcaggtgccgctgggccggcttgcgactaccagcgacctggcggaagggattgccttcttcctcgagccggcatccgacggcatcaccggcgaaacgcttcgggtggccgccggc

SEQ ID NO: 30846 - DNA, 723 bp, Burkholderia cepacia; identical to SEQ ID NO: 28090

SEQ ID NO: 30847 - DNA, 711 bp, Burkholderia cepacia
aacgaacttacagataccttgattgccattacaggtggtggttctggacttggcgaagcatgcgctgaactgctggcccctcgggtagccgaacttgcgttgatagatcgtgacccggactcgcttgccagtgtgcgggcgcggctgtcgggattatgcgagatatccgttcatgcttgcgacattgctaacagcgatgacgtctccacaacattcaatcggatcgagcgagagtctcgggtagtgagcacacttattaactgtgcaggaatgaacgtgaaagatcgacacttcggtgagcttactcccgacggatggaatcaggtcattgcagttaatctgtccgggatgtactactgctgtcaggcggtattgagtggtatgcggcgtcagcagcgcgggacaattatcaacgtgtcgtcttgggccggtcgacacgcgggattcttcactggacccgcttacaacgccagcaagaggggtgtcctggctttgacggagtcaattaacctggaagagggaataaacaacgtccgggcgacagcagtcgtacctgaagcaatggcgaccccgatgatccggaaaattccgaatccaccaagcgaagaggcgattgcgaaaatgatgcgacctctcgacgtggcgaggatgatcgacctgataatcagtttgccgcaggaaatgtgtgtaaacgaggttgtcatgagcccg

SEQ ID NO: 30848 - DNA, 1461 bp, Burkholderia cepacia
cgcatgacttatcagcaactgggtgagcgcgtggaggcacttgccgcgaggctgatacgcaccggcgtcaagcggggcgaaaaggtgggcgtcctgatgggcaatcggcccgagtgggtgatcagcgccctcgcgatcacgagtatcggcgcagtgctcgtgtcactcaattcctgggccaccgcgcgcgagctggcctatctgctttcgcactcgggctgtcgtcatctgattgccaccaggcgttatctcaagtacgactatgcggtgatgctgcgagacatggatccggccatccgcggccgccttgccacggtgatcggcgtcgacgccgatctgcccgacggttggcttccgtttgacgatgccgccgacgtggcgcgcgtggaagccggcgacgcggtacgggcggcgggcgagcaggtgggcagcgacgatatcgccttcctcctctatacgtcggggtcgacgtcggcgccgaagggagtccagcttgcgcatggcgcgttgatcgtcaatggctggcacatcggcgagcggcagcgcatcgtaccgggagaccggctgtggcttgcggtttcgctcttctgggcgctcggctgcgtgaacgccatgatgaatctgctgacgcatggcggctgcatcgtattgcaggaggccttcgacgcaggcgaggcgcttcacctgattgaagccgagcggtgtacggtgttttacggaacgcccaacatggcgcaggcgctgtacgaccatcccgagcgcgaacggcacgacctgggctcgttgcgtactggtggaacgcttggttcgccggagcagatcgcacgcgtcatcaagttgggcgtgagccgtgtgtgcaacatctatgggcttacggagacctacgggaattcgcatgtcacaagtgcggacgacgacgaggcattacggcttgtgtcctgcggccagccgctacccggagtcgagcaacggatcgtcgacgcgaacgggatcgatttgcccccaggcgagattggagaaattcgcgtgaaagggcgcgttatcgacgggtactacggaaacgaggagctgacgaaagcgtcctttgacgagcagggctacttcaggaccggagatctcggctacgtcgattcgcagggttatctctactatcgtggccgttcgaaggagatgatcaagacgggcggcatcaacgtttcgcccgccgacgtcgagtccgtgctgagcgcgcatccggcgatctatctcgcctatgtcgtcggcgtgcccgacccggtgagggacgaggagatcggggctctcgtcgtcctggagaacggcgccagcatggcttccgatgaaatcctgcaatactgcagcagaatctcgccgctacaaggttccccgcggcttcgcttcgtctccgagggcgaactcccgatgaccaccaccgggaaggtacagaagaacaggctggctgaa

SEQ ID NO: 30849 - DNA, 723 bp, Burkholderia cepacia; identical to SEQ ID NO: 28093

SEQ ID NO: 30850 - DNA, 2481 bp, Burkholderia cepacia
atgacgctgtcccgtcgcgcgtttattaagcagaccgccgcggccacggccgcttcagcggcaggggttgtgctgccgggcgtggacgccctggctgcgtcggacagcctgacctggtcaaaggctccgtgccgattttgcgggaccggctgcggtgtcagcgtgggcgtgaagaacggcaaggttgtggcaacccagggtgacccgcaggccgaggtcaatcggggcctcaactgcgtgaaaggctacttcctgtcgaagattatgtacggccaggatcgtctgaccacaccgctgctgcgcatgaaagacggcaagtatgccaaggacggcgaattcgcgccggtctcgtgggatcaggccttcgatgtaatggccgatcacttcaagcgcaccctgaaagaaaagggcccgacagcagtgggaatgtttggctcgggacagtggacggtgtgggagggctacgctgccgtcaaacttatgaaggcgggctttcgcagcaacaatctcgaccccaacgcgcgtcactgcatggcctcggccgtcaccggcttcatgcgcacgttcggtatggacgagccaatgggctgctatgacgatatcgagcaggctgataccttcgtgctgtggggctccaacatgtcggagatgcatcccatcctgtggacccgcattaccgaccgccggctcagcacgcccacgacgcgcgtggtcgtgctctcgaccttcgagcatcgcagcttcgatctggccgaccagacgattatttttacaccgcaatcagatctggcgattctgaactacatcgcgaattacatcatccgcaacggcaacgtgaatcgcgatttcgtcaacaggcatacggttttcaagcaaggcaacgccgacatcggttatggcctgcggcccgacaacccgttgcagaaaacggccaggaatgcgggcgacccaaatggttcgcagccgattacgttcgacgaatttgcgaaattcgtctcgaagtatgacgcggcctatgtgacgaagctctcaggtgtgccgcaaaacaagctcgatcaacttgcccggctgtatgctgatccgaaggtcaaggtgatgtcgttctggaccatgggcttcaaccagcacacgcgtggcacgtgggccaacaacatggtctacaacctgcatctgctgaccggcaagatcgccacgcccggcaacagtccgttttcgctgacggggcagccgtccgcatgcggtacggcgcgcgaagtggggaccttttcgcaccggctgccggccgacatggtggtcaccaacccgaagcatcgtgaggaggccgagcatatctggaaactgccggcaggcacgattccggacaaaccgggctatcacgcagtcctgcagaaccgcatgctgcgcgacggcaagctcaacgcctactgggtgcaggtgaacaacaacgtgcaggctgctgccaatatcaatggagaagcgttgccgggttatcggaatccacaagccttcgtggtggtgtcggatgtgtatcccacagtcaccgcggtggcggcagacctgatcctgccctcggcgatgtgggttgaaaaggagggcgcgtacggcaacgccgagcggcgcacccagttctggcatcaactggtcgacgcaccggccggcgcccgctccgacctgtggcaactggtcgagttttcaaagcgcttcaaggtcgaagaagtctggcctgcggatttgctcgcgaagaagccagagtacaggggcaagacgctctacgacgtgctgtatcgtaacggccaggtcgacaggtttgcccttacggaaactgattcccactatcggaacgacgaagccaaggcgtttggtttctacattcagaagggcctgttcgaggagtacgcaagcttcggccgtggccatggccatgatctcgcgccattcgacgcgtatcacaaggcgcgcggtctgcgctggccggtggtcaacggaaaggaaacgcgctggcgctataaggaaggttccgatccttacgtgaaaacaggcaccggctggcagttctacggcaatcccgatggccgcgcggtgatctatgcgctgccttacgagccacccccagaagttccggacaaggagtatccattctggctcgctaccggtcgtgtgctggaacattggcactcgggttcgatgacgcggcgcgtgcccgagctgtaccgcgcgtttccaaatgcggtgtgcttcatgcatcccgacgacgcgaaagcaatgggtgtgcggcgcggagtagaggtcaaggtaatgtcgcggcgcggctacatcctgacgcgggtcgagacgcgcggacgtgacaagccgccgcgcgggctggtcttcgtgccatggttcgattcaagccagttgatcaacaaggtgacgctggacgcaactgacccgatctcgctacagaccgactacaagaagtgcgcggtcaagatcgtcaaggta

SEQ ID NO: 30851 - DNA, 1029 bp, Burkholderia cepacia; identical to SEQ ID NO: 28095

SEQ ID NO: 30852 - DNA, 2772 bp, Burkholderia cepacia
accacctgctacatgtgcgcctgtcgttgcggtatccgtgtgcatctgcgggaaggcgaggtgcgctacatcgacggcaatccggagcatccgctcaatcagggggtgatctgcgcgaagggcgcctccggcatcatgaagcagtactcgcccgcgcgcctgacgcagccgctgatgcgcaagccggacgcggagcggggcagcgcgcagttcgagccggtgtcgtgggaatacgcgttcgacgtgctcgaaaagcgtcttggtgcgattcgcgccacggacccgaagaaattcgcgctcttcaccggccgcgatcagatgcaggcgctgaccggactcttcgccaaacagttcggtacgcctaattatgcggcgcacggcggcttttgctcggccaatatggcggccggcatgatctacacgatcggcggctcgttctgggaattcggtggcccggatctcgacagcgcgaaactcttcttcatgataggtacggcggaagaccatcattcgaatccgctgaagatcgccatttcgaagttcaagcgcgcgggcggccgcttcattgcaatcaatccggtccgcaccggctacgcggcgatcgccgacgaatgggtgccgatcaaacccggcaccgacggcgcgctgttcatggcgtttctgcacgaactgattgccgccgacgcgtgggatcacgaattcgtgcgccgctataccaacgcggcggagctggtcgacctcgacgaagcgagcgaaaacttcggcctgttcgtgcgcgaccccgagcggccggtcggcaatccgctgttcccgcagaatcatctctggtgggatgcggacgccgcgcgcgccgtgccgcatcacacaccgggcgtcaatcccgcgctagacggccgctttacgctcgacgacggcacgccggtcacgccgtcgttcgccttgctgcgcgaacgcgtggccgattgcacgcccgagtgggccgctgcgatcacgggcattgcggcggacacgatccgccgcctcgccggcgaaatgatccagacgagccgcgaccaccgcatcacgttgccgatccgctggaccgacgcgtggggcgagacgcacgagacggtcaccggcaacccggtcgcctttcatgccatgcgcggcctcgcggcgcactccaacggcttccagtcgatccgcgcgctcgctgttctgatgtcgctgctcggcacgatcgaccgcccgggcggctttcgtcacaagtcgccgtttccgcgtgcggtgccgccgtcggcgaaaccgccgaacagccccgacgccgtcaagccgaacacgccgctcgccaccggcccgctcggctggcccgcggcgcccgaggacctgttcatcgacgatcagggcggcccggtgcggatcgacaaggcgttctcgtgggaatatccgctcgccgtgcatggcgtgatgcacagcgtgattaccaacgcgtggcgcggcgacccgtatccgatcgatacgttgatgatcttcatggccaacatggcgtggaattcgtcgatgaacacgatgaaagtgcgcgagatgctcgccgacaggcacgcgaacggcgagtacaagattccgtttctggtggtgtgcgacgcgttccagtcggagatgacggcattcgccgatctgatcctgcccgacacgacctatctggaaaggcacgacgcgatgtccatgctcgaccggccgatctccgaattcgatggaccggtggattcggtgcgggtaccagtcgtgccgcccaccggtgaatgcaagccgttccaggaagtgctgatcgaactggcgtcgcgtctgaagttgccggccttcacgaccgccgatggcgagcggcgctttcgcgactatcccgactttgtcgtcaatttcacgaccacaccggattccggcgtgggtttcctgatcggctggcgcggcaaggacggtgacaaggcgctggtgggcgagcctaatccgaagcaatgggagcagtacgcgaagaacaattgcgtgttccattacccgctacccgagacgctgcaatacatgcgcaactgcaacgggccatatctcgagtgggcggtcaggaacggttttcgcaagttcggcgagccgatcctgatccagctctattccgacgtgatgcagaagttcagactcgccgcgcaagggcgcacgagcggcaggcagccgccggatcacctgcgcgcgcgcgttgaaaagtacttcgatccgctgccgttctggtacgcgccgctggaaaataccgccacggacctcgtgcgttttccgcttgccgccgtgacgcagcggccgatggcgatgtaccactcgtgggactcgcagaatgcatggctgcggcagattcatggcgagaactatctctacatgaatccattgatggcggccgaaaacggcattgccgacggcagctggatctacgccgaatcgcaatggggccgcgtgcgttgcatggcgcgcttcagcgagacagttgaaccgggcaccgtatggacgtggaacgcgattggcaaggcatcgggcgcgtggaatctcggcccgggcgcgaacgaatcgcaacgcggtttcctgctcaatcacctgatcaccgacgagttgcccggccgcgatgacgacgcggcgagccgcatgtcaaattccgatccggtgacgggccaggccgcctggtacgacgtgcgcgtgcgcatctatccggcggaagccgacgcgcggcacacgctgccgcagttcgcggcaatgccc

SEQ ID NO: 30853 - DNA, 888 bp, Burkholderia cepacia
aaagttacaaaggcagtctttccggtagcaggccttggcacgcgatttctccctgccacgaaggcgagcccaaaggagatgctgccgatcgtggataagccgctcatccaatatgcggtcgaagaggctatggccgccggcatcactgaaatgattttcgtgacgggccgcagcaagcgcgcgatcgaagaccatttcgacaagtcgtatgaggtcgaggcggaactggaagcgcgcggcaaggacaagctgctgcaattggtacgcagcatcaagccgagccatgtcgactgtttttacgtgcgccaaccggaggcgctcggcctcgggcacgcggtgctatgcgcggagaagctggtaggcgacagtccgttcgccgtgattctcgcggacgacctgctatacggcagccctcctgtcatgacgcaaatgatcgaggtgttcgatcactaccatagctcggtgatcggcgttgaggaaattccggcgcaggataccaaatcgtacggcatcgtcgacggcaaggaatgggagcagtccatcatcaagatgtcgggcatcgtggaaaagcccgagccgagcgcggctccttcaaacctcggtgttgtgggtcgatatgtgctgaagccgcgcattttcaaacatctgcgcaccatcaagcccggtgccggtggcgaactccagttgacggatgcgatcgagtcgctgcttgccgatgagcaggtactggcctacaagtaccgcggcacgcgctttgattgcggcagcaaaatcggctacctgaaggccacggtggaattcgcggtgcggcatcccgaggtaggcgtcgagtttcgtgagtaccttgaggagtatctgtctctgctgccgatgtgaacgggagtgaag

SEQ ID NO: 30854 - DNA, 1416 bp, Burkholderia cepacia
atgaagacgtacgagcaactctatatcgatggcaaatggatcgcgccgtgcggcaccggcacgatcgacgtgatcgactcgggcacggaagagatcatgggccgcattcccgagggagtcgaggccgatgccgaaagtgcgatcgccgccgcccgcgtggccttcgacgcctgggccgcgacgcccgccgccgaacgcggcgagtatctgcgcaaggtcgcggcgaacctgaaagcgcgcacggacgaactggccggtttgatcgccggcgaagtcggcatgccgctaaaactcgcgcgtgccatccaggtgggcagcccggtctataactggggcgcgtatgcgaagctcgcgagcgagttccagtatgaggaacgcgtcggcaattcgctggtggtgcgtgagccggtcggcgtggtggcggcgatcacgccgtggaactatccgctcaatcaggtcacgctgaaggtcgcggcggcactcgccgcgggttgcacggtggtgctgaagccctcggagatcgcgccgctgaccgcgttcgtgcttgccgaggcgatccacgaggccgggctgccggccggcgtgttcaacctcgtgagcggttatgggccggtggtcggcgaagtgctggcgagccatccgtcggtggatatggtgtcgttcaccggctcgactcgcgccggcaaacgggtgtccgagctggcttcggcgacggtcaagcgcgtcgcgctcgaactcggcggcaagtcggcctcggtcattctcgacgatgcggatttcgccgcggccgtgaaaggcacggtcagcgcatgctttctgaattccggacagacgtgctccgcgcatacgcgcatgctggtgcccgaggcgcgctacgacgaagcgcgcgtgctggcgaagcaggccgccgagacttacgtggccggcgatccgcgcaacgagacgagccgtctcggcccgctggcttcggccgcgcagcaggcgcgcgtgcagcaatacatcgcgaaggggatcgaggagggcgccgaactggtgacaggcggggtgggtctgcccgatgggttgtcgaagggcttcttcgtcaagcccactgtgttcggccgcgtgcatcccaaggcgacgatcgctcaggaggaaatcttcggcccggtcctgtcgattctgacctacaaggacgaagaggaagccgttcggatcgccaacgattcaccgtatggcctgggcggcgcggtatgggccggcagcgacgagcgtgccgtcggcattgcgcggcggattcgaaccggtcaggtcgatatcaacggcggcacgtggaatatggccgcgccgttcggcggtttcaagcagtcgggattcgggcgcgaaaacggcgtctacgggctcgaagagtatttcgaactgaaatccatgcaattc

SEQ ID NO: 30855 - DNA, 1059 bp, Burkholderia cepacia; identical to SEQ ID NO: 28099

SEQ ID NO: 30856 - DNA, 2412 bp, Burkholderia cepacia
aagcttggaaccacgctgtacagaagcatcgagtccgccacggccttttgcaagctgcgcggcaacccttatatcgagctcgtgcactggctgcatcagttgctgcaacaacccgactcggacctgcatcggctcgtgcggcattgcggtatcgagcgcgaaacactggatcgcgatatggcccgcgcgctggccgcgctgccggcaggcgccagttcgatcagcgatttctcgcatcacgtggaactggccgtcgagcgggcctgggtgctcgccacgctcagcttcaatgaccggcgtatccgcagcgcctggctcgtcgccgcactcgtgcagacgccggaattgcgccgcgtgctgctttccatctcgccggcgttcggcaagctatctgtcgtgggtctggacgaagcgctgccggcctatatggagaattcgcccgaagccgccgaggcgccctacgacaacagcaatttttcaaccgcggtgccgggcgaggcttctcacgcccttcccgcgcaatcgaaagggtcgccgctcgaacagttctgcaccgacctcaccgtgcgtgcgcacagcggcgaaatcgatccggtggtcggccgcgaactggaaattcgcaccatgatcgacgtgctgctgcgccggcgccagaacaatccgttgctgaccggcgaggccggcgtcggcaagaccgcggtcgtcgaagggctcgcctgcgcgatcgccaccggcaacgtgccgcccaggctggtgggcgtgcgcctcctgagcctcgacgtgggcgcgctgctcgccggcgccagcatgaagggcgaattcgagttgcgtttgagaggcgtgctggaagccgcgctgaagtcggccgtaccggtgatcctgttcgtcgacgaaatccatacgctgatcggcgcgggcggccaggccggcacgggcgacgcggccaatctgctgaaacccgcgctcgcgcgcggcgcgatccgcatgatcggcgcgaccacctgggcggaatacaaacggcacatcgaaaaagacgcggcgctcacgcggcgcttccaggtcctgcaggtgcggcagccgcaggaaccggcggcgatcgacatggtgcgcggcctcgcgaacacgttctcgcggcatcacggcgttgtcgtgcgtgaccaggcgatccgcgcggcggtgaggctgtcgcatcgctacattccctcccgccagttgccggacaaggcaatcagtcttctcgacacggcgtgcgcgcgcgtcgcgctttcgcagcatgcaccgccgcgagaattgcaggacgcgcgtcaacgcgtgctggccgcgcgcgtcgaaagcgagttgctcgtcgcggaatcgcgtatcgggctcgataccgcgagcgcattggcggcggcccgaacgcgcatcggcgaactggtcgctgtcgaagagcgcatcgaagcgcgctggaaagcacaactcgcggcggcgcaagccttgctcgccgcccgtgatgcggcgctcggggccgatcacggcgcgccgcacaccggcgcgaacagtgacgcatgcgcgtcgcccgattcgctcaaggatctggagcgcgccctcacgcaattgcagggcgatgcgccgctggtgtttcccgaggtgagcgaagcaatcgtcgccgaagtggtatcggattggaccggcattcccgtgggccgcatggtcaccgacgaagtggccgccgtgcaatcactgcccgccacgctcgaagcccgcgtgatcggccagcccgatgcattgcgtcagatcggcgagcgggtgcaaaccgcacgcgccgggctcacggatccgaagaagccgctcggcgtattcctgctcgcgggcccttccggtgtgggcaagaccgagacggcgctcgccctcgcggaggcgctctacggcggcgagcagaacctgatcaccgtcaatatgagcgagtaccaggaggcgcacacggtctccggactgaaaggcgccccgcccggctatgtcggctacggcgaaggcggtgtgctcacggaagccgtgcggcggcgcccctattccgtggtgctgctcgacgaaatcgagaaagcccatcgcgacgtgcacgaaatgttcttccaggtgttcgacaaaggctatatggaagacggcgacggccgctatatcgatttccgcaacaccacgatcctgctcacgagcaacgccggctcggagctgatcgcgagcctgtgcgcggacgcgccgctcccgcccgatgccgaaggtctgcgcgaagctctcacgcccgcgttgctcaacgcatttcccgcggcgtttctcggccgcgtcaccgtggtgccgtaccggccgctcgcgcatgaatcgcttgcgcgcatcgtgcggctgcatctggaccgcgtcgtcactcgcatggcgcag

SEQ ID NO: 30857 - DNA, 738 bp, Burkholderia cepacia; identical to SEQ ID NO: 28101

SEQ ID NO: 30858 - DNA, 978 bp, Burkholderia cepacia; identical to SEQ ID NO: 28102

SEQ ID NO: 30859 - DNA, 1245 bp, Burkholderia cepacia
gcatttgactacgtcgacggcgtgctgcatgccgaaggcgtatccgccgtttccctcgccgagcagttcggcacgccgctgtacgtgtattcgcgcgccgcgctcaccgcggcgtggaacgcttacgccggcgcttgtgccggccgccgcgcaagcgtgcacgtcgccgtcaaggccaatagcaacctcgcggtgctgaatgtgttcgcgcgcctcggcgccggcttcgacatcgtgtccggcggcgaactggcacgcgtgctggccgctggcggcaaagcggaaaacacggtgttttccggcgtcggcaagaacgcgaacgaaatgcgcgaggcgctcgccgccggcgtgaaatgcttcaacgtcgaatcgattcccgagctcgaccgcctgaatgcggtcgcggcggaaatgggcaagaaggcgcccgtctcgctgcgcgtgaatcccgacgtcgacgcaaagacgcatccgtatatctccaccggcctcaagtcgaacaagttcggcgtcgcattcgaagacgcgcgcgccacgtatcaggcggccgcgggcatggcgaatctcgaagtggtgggtatcgactgccatatcggctcgcagatcaccgaagccgccccgtatctggacgcggtcgacaaggtgctggaactggtcgaacagatcgagcaggacggcctgaagattcgccacatcgacgtaggcggcggcctcggcatcacgtacgacgacgaaacgccgccggagatcggcgagttcgtgcgcaccgtgctcgatcgcatcgaagcgcgcggtcacggccatcgtgaagtgtatttcgagccgggccgctcgctggtcggcaatgcaggcgtgctgcttacgcgcgtcgaatttctgaagccgggcgcggaaaagaatttcgccatcgtcgacgcggccatgaacgatctcgcgcgccccgccatgtatgaggcgtatcacgcaatcgatcccgtcgtgaagcgcgacgtgccggcccacgtgtacgacgtggtcggtccggtttgcgagagcggcgactggctcggccgcgaacgcctgctggcggtggaaccgggcgatctgctggcaatccgctcggccggcgcgtacggcttcgtgatgagctccaactacaacacccgtccgcgtgcggccgaggtgatggttgatggtacacaagtgcatgtggcacgcgcccgcgaagaggtcaggcaactgtttgtgggcgaaacgattttgcca

SEQ ID NO: 30860 - DNA, 495 bp, Burkholderia cepacia
aatgtattttttgtagggctcatgggggcaggaaaaaccaccgtgggccgggccattgcgcgccgtctcgatcgtcccttcttcgattccgaccatgaaatcgaggcacgcacgggcgcgcgcatccctgtgatcttcgagctggagggtgaagcgggctttcgcgagcgcgaggcgaacgtgatttccgagctcaccgcgcgcgaaaatatcgtgctcgcgaccggcggcggcgcggtgctgcggccggaaaaccgcgaggcgctgcgaaatcgcggagtcgtgatttatttgcgcgccaatccgcacgacctgtggctgcgcacccgccgcgacaagaatcgcccgcttttgcagaccgaagaccccaaagcgcgtctcgaagccctctacgaagtgcgcgacccgttatatcgggagtgcgcgcatttcgtgatcgaaactggccggccttcggtcaacggactcgtcaacatggttctgatgcagctcgag

SEQ ID NO: 30861 - DNA, 1050 bp, Burkholderia cepacia
atgattaccgtcaatgtcgaactgggcgaacgcgcctaccccatccatatcggtgccgatctgatcggccagaccgcgttgttcgcgccgcatatcgccggcagttcggtcaccatcgttaccaataccactgtcgacccgctgtacggcgacaagctgcgcgccgtgctggcgccgctcggcaagcaggtgtccacggtcgtgttgccggatggcgaggcgtacaagaacctcgaaaccctgaacctgattttcgacgcgctgctcggtgcgcgggccgatcgcaagaccacgctgatcgccctgggcggcggcgtgatcggcgacatgacgggttttgcggcggcctgctatatgcgtggcgtgcccttcatccaggtgccgaccacgttgctgtcgcaggtggattcatcggtgggcggcaagacgggcatcaatcacccgctcggcaagaacatgatcggtgcgttctaccagccgcaggccgtgattgccgatatcggcgcgctgcatacgctgccggcgcgtgaactggcggcgggcgtcgccgaagtgatcaagaccggcgccattgccgacgcgggtttcttcaactggatcgaagccaatatcgaggcattgaatcgctgcgagcccgccgcactcgccgaggcggtcaagcggtcgtgcgagatcaaggcgtcggtggttgcgcaggacgagcgtgaaggcggacttcgcgccatcctcaatttcggccacaccttcggccatgcgatcgaagccggtctcggctacggcgagtggctgcatggcgaggcggtcggctgcggcatggtgatggcggcggatctgtccgtgcgcatgggttatctcgacgaagccgcgcgcaagcgtctggtcgacgtgatcgtcgccgcccatttgccgacccgggcgcccgcgctcggcgactcgcgctatgtcgaactcatgcgggtcgacaagaaggcggaagccggcgcgatcaaattcattctgctgaagcgtttcggtgagacgctgatcacccaggcgcccgatgccgaggtg

SEQ ID NO: 30862 - DNA, 3723 bp, Burkholderia cepacia
atgcatctgttgcgcaccacgccgggcggttttgtcgacgatacgcaaggcgtgatccgcatcgatcagcagcccgccgatatcgtggtgctcagttccgccgataccacgctgtcgctgctggcgagcgtttttccgcgtctgggagagggttttccgagcgtgcggctcgcgaacgtcacgtatctgcggcaaccggcctcggtcgatttctacgtcgaagacgttttgcagcatgcgcgcgtggtggtggtcgatcatctcggcggcgaagcgtattggccttacggcatcgagcaggtggtggcgctcgccgggcgcaaacagcagatgctcgcgatgttctcgggcgatctgcaggaagatccgaacctgctcgcgcgcagcaccgccggcgccgatctgtgtcaccagctctggcgctatctgcgcgaaggcggtccgcagaatgccgaagcgttcctgcgctgtatcgcgcatcgcgcattcggctgggggcgcgagcctgcgccgccgcgcgcgttgcctgccgcgacgctctatcatcccggtcgcgacacgccgactatcgccgactggcagacgcgctggcaacagaacgcgccggttgcggcgatcctgttctacaaggcgcatctgcaggcggccaatacagcggtgttcgacgcgttgatcgacgcactggagtcgcaaggtctgaatccgctgccgatcgcgatcacctcgctcaaagatgcgctgagccgcgaagtggtgcaatcgctgtgcgctgagcacgatgtctcgctggtgctgaacacgaccgcgttcgccgcgtccgcgatcgacgaccccgagccgctcgcgctcgccggcgacgcgcccgtgttccaggtgatcctgagcggcggtaatcgcgaggattggatcaaggacaatcagggcctcaattcgcgcgatatcgccatgcatatcgcgctgccggaagtggacggccgcatcattacgcgcgcgatcagtttcaaggggctcgcataccgttgtccgcacactcaggtcgacgtggtgcgttatcagccggacgccgaacgggtggggtttcttgccgaactgagccggcgctggtgccgtctgcgttcactggataacgcggacaaaaagctcgcgctgattctcgccaactatccgatgagcgaagggcgcattggcaatggtgtgggactcgatacgccggcttcggtagtcggcattctgtcgatgctgcgcgacgaaggctatcgtctcgctgacttgcccgcgaacggcgacgcgctgctgcaaaagctcaccgaaggcgtgaccaacgatccggtagtgcgtgatctgcgtcccgccctgcaaagcctcgcgctcgacgattatctcgcgcatttcaacgctttacccgctgaggcgcggcaggcattgaacgcgcgttggggcacgcccgaacaggatcctacgctgcggcgcggccgcttcatgattgcgggttggcgttgcgggcaggtgttcgtcggcattcaaccgtcgcgttcgcgcgagcagggcgattacgccagctatcacgacgccgaactcgtgccgccgcatgcgtatctggcgttctatttctggctgcgccaccagttcggtatcgacgcaatcgtgcatgtcggcaagcacggcaatctcgaatggctgcccggcaagagtgtcgcgttgagcaacgcgtgctggcccgatctgatactcgggccgatgccgcatctgtatccgttcatcgtcaacgatccgggcgagggcagccaggcgaaacgccgcgcacaggcggtcatcatcgatcacctgatgccgccgctcacgcgcgccgaaagttatgggccgctgcaggacctggagcgtcaggtcgacgaatactatgaagcgctgatggtcgacccgcgccgctcgaagctgttgcggcgcacgattctggcgaccatcgtcgaacaccggttgcatgaggaactgagtctcgcggaaccggacggccaggacgctgaggacgcgctgctcacgcgtgtcgatgcatggctgtgcgagttgaaggaagcgcagattcgcgatggtttgcatacgttcggccaatcgcctggcggtgtgcaacggcgcgatacgctgctggcgttggggcgttttcctgtcggcgacgggcaaggcggcaaggccggcttgatcgatgcgctggcgcgcgatctgcggatggatcatctgttcgatccgttgtcggtggattggtcggcggtgtgggacggcccgcgtcccgatgtattggagcgcgtgagcgatgcgccgtggcggcactgcggcgatacgcgtgaacggctggagttgctggcggcgtcgctgttgcgcggtgtgtgcggtgatcgaccggatgcgtcggcaatgccggttgccgacggcttgccgcaaacggagcgcgtaatcgggcgattgcgtgccgacgtgctgccgcggctcgatgcctgcggcccgcaggaaatgcttcagctcaagcgtggcctcgaagggcgtttcgtgccgcctgggccgagcggttcgccctcgcgtggacggcccgacgtgctgcccaccggccgcaacttctattcggtcgacacgcgcgccattcccacgcaagccgcctggtcgctcggactgaaatccgcgcagcaactgatcgaacggcatttgcaggagaagggcgattatccgcgcgccatcggcctctccgtgtggggcaccgcgaccatgcgcacgggcggcgacgatatcgcccaggcgctcgcgctactcggcgtgcggccgaagtgggcgcccggcagtcaccgcgtgaccgatttcgaaatcatgccgatcgaggtgttcgaccggccgcgtatcgatgtcaccttgcgtgtttccggtttcttccgcgatgcgttcgccaacgtcatgcatctgttcgacgccgccgtgcaggcagtggcggaactcgacgagcccgaagacctgaacccgattcgcgcgcgcgtgctgcgtgagcgcgacgcgctcatcgcgcgcggcatggacgccgccgaagcgcgcaagcgcgccggctggcgtgtgttcagcgcgcggcccggcgcttacggcgcgggtctgcaggacatgatcgactcgcagcaatggcagaccgacgcggatctggcgaacgcctatcaggcatggggcggctacgcgtacacgcaaaagagcgcgggcgaagaagcgcgccacgcgttcggcgcgcgcctcgccgcactggacgtggtgctgcagaaccaggacaaccgcgagcacgacctgctcgattcgaacgactattaccagttccagggcggcatggtcgccgcggtgcggcatctggccggcaatcagccgagcgtgtatcacgccgatcacagcaatcccgccgcgccgcgcgtgcgcacgctacacgaggagatcgcacgcgtgatccgctcgcgcgtggtcaatccgaaatggctcgatggggtgaagcgccacggttataagggcgcggccgagatcgcggcgaccgtcgattatctgtacggttacgatgcgaccgcgcgcgtgatcgcggatcatcaatatgcgctcgtgaccgatgcgtatctgaacgacgccgacacccgcgagtttttgcagcgacacaacccacatgcgttgcattcgatttgcgagcgtctgctcgaagccatgcagcgcggattgtgg

SEQ ID NO: 30863 - DNA, 1938 bp, Burkholderia cepacia
cgcgccgtgtgcccgcacgattgccccgacacctgcgcgatgcgcgtgacggtcgaggccggtcgggcgatcaaggtcgtcgccgatcccgagcatcctccaacgcaaggcgcgctgtgcaccaaggtcagccgctacgcggagcgcgtgcatcatccgcagagactgacgcggccaatgaagcgtgtcgggcgcaaaggcgaggggcgctttgagccgatcggctgggacgaggcgttccagctcgcggcgcgtcgcctgtcggaaattgcacatcgcgcgccggaggcaatcctcccttacagctatgccggcacaatgggcttgattcagggcgacagcattgcacaacggttcttccacaagctcggcgcctcgcaactggatcgcacgatttgcgcggccgccggcacagccgggctgaagtacacctacggcgcgagcctcggcatgctcaccgagtttttcgacgaaagcgagctcatcctcatctggggctcgaatccgatcgcgtcgaacctccatttctggacgcgcgcccaacaggccaaacgccgcggtgcacggctgatcgcaatcgatccgtaccgctcgctgacggccgaaaaatgccatcagcacatcgctttgaaaccgggcaccgacagcgctttggcgctcggtatgatcaacgtgttgatcagggaaaatctgctcgatcacgcttacatcgaagctcatacgtcaggttttgaagcgctgaaagcccgcgcgcttagctacccgccgtcgcgcgctgcggaaatctgcggtattgacgaacgggtgatcgtcgatctcgcacgactttacggtggcaccagaaaggccgcgatccgcatgaactacggcctgcaacgcgtacgtggcggcggcaatgccgtgcgcgcgatcgcttgcctgccgtcgctcacgggtgcttggcgcgagagagcggggggcgtgttgctgtcgtcgggcggctgggcgccggtcgactcgtatgcgttgcagcgtccggacctgatgccgggttggccgaccaggacgagccgcgtcatcaacatgaacgggatcggcgacgcgctgctgcacaagggcgacgcggcgttcggtcccaaggtcgaagcgatcgtcgtctacaactcgaatccggtggctgtcgcgccagattcggagcgagtcgccgcgggtttcgcgcgcgaagatctgttcacaatcgtcctcgagcatttccagaccgacacagccgactacgccgatctgttgctgcccgcgacaactcaactcgagcacctcgacgtgcacaagtcgtacggccacacgcacgtcatggtcaacctgccggcaatcgcgccggtcggcgaagcgcttccgaacacggagattttccgcggcatcgcgcgtcatatgggcctcgacgagcccgcgctgttcgagagcgacgagaccgtcgcgcaggcggcgtttcgctggcaagacagaacgctcgaaggcgtagattgggagaccctcaagaagaccggctgggccaagctgaatctgcccgatgcgcctttcgccgaaggggggttccaaacgccgtccggcaaatgcgagttctacagcgagcgcctcgcgcaacggggactcgacccactgccggactatctgcctccctacgaatccgctgatggcgcgccggaacttgccgcccgttatccgctggcgatgatctcgccgcccgcccgcaacttcctgaacagcaccttcgtgaatatcgaaagtctgcgttcgaccgaaggcgagccgcatctcgacatgcatccggccgacgcgcaatcgcgggatatcgtcgacggcgatcaggtgcgcatttttaacgatcgcgggtcgatgcaggcgcgcgtccgcgttaccgataaagcacgcgaggggctcgtggtgggcctgtcgatctgg

SEQ ID NO: 30864 - DNA, 1137 bp, Burkholderia cepacia
gatctgcatacccgtatcgtgcgtgccgaggaccagctcacgccgggcttcgagtcgttctcgatgccggtcacgcgcgcttcgacggtcgtgttccccgatctcgcgaccatgcgcgcgctcgactggaaaaacgacgcgcaatggcgctacggcctgcatgccacgccgacttcgctcgcgctggcgcagcgtctggccaccatcgaaggcggcaatcatgcgttgttgcagccgtcggggttgtcgtcgatttcgaacgtgtatttcggcctcgtcaaggcgggcgacgacgtgctgattcccgataacgtctattcgccgaaccgcgatcacggcgactggctggcgcgcgacttcggcgtctccgtgcgctattacaatccgatgatcggcgcgggcattgccgatctgatccggccgaatacgcgtctcatctggctcgaagcacccggctcggtgacgatggaagtggccgacgtgcccgccattaccgcggtcgcgcgcgcgcacaacgtcgtcacggcaatcgacaatacgtggtccgcggggctcggtttccgtccattcgatcatggcgtcgatatctcggtgcaggcgttgaccaagtatcagtcgggcggcggcgacgtgctgatgggcgcgaccattaccgtcgatcgcgaactgcatctgaagctgaaggcggcgcgcatgcgcatgggcatcggcgtctcgtcggacgactgctcgctgattctgcgcagcctgccgaccatgcaactgcgcttcgagcagcatgaccgcgcggcgctcggattggccaggtggttgaagacgcggccggaaattgccaccgtgttgcacccggcgctgccggattgtccgggccatgagtttttcgagcgtgatttcacgggcgcgggcgggctcttttccgtcgtgttcgacggccgttacagcccggcgcaaatcgacacgttctgcgagtcgctcgaactgttctcgctcggctggagctggggcggcgcgcacagcctcgcaatgccgtacgacgtcgcgtcgatgcgcacggcggggcagtggccgcatcgcggcacgttggtgcggttctatatcggtctcgaaaccgaggcggatttgcgtgcggatatcgag

SEQ ID NO: 30865 - DNA, 1254 bp, Burkholderia cepacia
cgccacgacggcgaataccgctggttcgacgtccgcgtggtggcgatgcgcgacgccgaaggcaacatcagcaaatggttcggcagttgcaccgacattcattcgcaacgcgaggcgatcgaggagcgcgaacgtctgcttgcgtcggaacaggccgcgcgccagatcgccgaagaagcgaatcgcgccaaagaccgctttctggccatgctgtcgcacgaactgcgtacgccgctcacgccggtgctcgccggcgccagcgtgctggagatgattccggaactgcccgaccaggcgcgcgcgagcgtgcgcatgattcgccgtaacgtcgaactcgaggcgcggctgatcgacgacctgctcgacctgacgcgggtggcgaacggcaagctgcggctctcgctggaaactgtcgacgtgcacgacgtgatggacagcgtgctcgaactgtttcgcagcgagattcaggtcaagcagcaggacgtgcacgttcataagaacgcccggcatcattacgtgctggccgatcgcgcccggctgcagcagatgctgtggaacctgattcgcaatgccgcgaagttcaccccggacggcggccatatctatgtgcgcacccgcgacgaacgcatgcacgtgcagatagcggtcgaagatacgggcatcggcatcgagccggaccagatcggcaaactcttcaacgcgttcgagcagggcaaccagaacatgacgcggcaattcggcgggctcggtctcgggctcgccatcacgaaggcgttgaccgacgtgcatggcggcacggtgactgcgcaaagccccggcgcgcattgcggcgcgaccttcacgatcaccttgccgacggccacggcgccggaagtcacgtcacctgtcgtagtgccggaccaggtgcatccggccggtctgctgaccatcctgctgatcgaagatcacgtggataccgctgaagtcatggcgcaactgattcgcagcctcggccacgaggtgacgaccgtgggccgggtggacgacgcgctggccgccacccaatcggcggacttcgatctggtgatcagcgacgtgggtctgcccgacggcaccggcctcgacttcatcaaggtgttccgcgagcactcggacgcgcccgcggtggcattgaccggcttcggcaccgacgaagacgtgcgccgctgcctcagcgccggctttacttcgcatctgaccaagccagtcaacttcggccagctcgagacaatgatc

SEQ ID NO: 30866 - DNA, 834 bp, Burkholderia cepacia; identical to SEQ ID NO: 28109

SEQ ID NO: 30867 - DNA, 2274 bp, Burkholderia cepacia
atttccgcccacaccgccgaactcgacatcggcggcatgacttgcgcctcgtgtgcgatgcgcgtcgaaaaggcgctcgccaaagtgccgggtgtcgtgagtgcttcggtgaatctcgcgaccgaaacggcgaccgtcgacctgaacggcgcggccgccggcccggatgcgctgatcgccgccgtcaggaaagcgggctatgaagcggccctggtcgcaccaccggacacgcccgcctctgccaacgagtcggcccccgccgaccgcaagcgcgaccagacccgccgcgaactggcggccgtgctcgcctccgccgtgctgacgctgccgctcatcggcccaatggtcggcgaatggttcggtttccacgcgatgctgtcgccgtggctgcaattcgcgctcgcttcggtcgtgcagttcgtattcggcgcgcgcttctatcgcgcggcctttcgtgccgtgcgggcgggcgccggcaacatggacttgctggtggcgctcggcacgtcggcggcgtatggcatcagcgtctatgaactggcgacccatcccggcgacatgatgcatctgtacttcgaagcgtcggcggtcgtgattacgctggtgcgcttcggcaagtggctcgaagcgcgcgccaagcgccagaccacggacgccatccgcgccctcaacgcgctgcgccccgaccgtgcgcgcattcgtgtcggcgccggcgagcgggacgtgccgctcgcgcaagtacgggtcggcacgatcgtgatcgtgcgccccggcgaacgcgtgccggtcgacggtacggtgctcgaagggcgcacgcatatcgacgaatccctgatcaccggcgaaagtctgccggtgccgaagcaggtagccgacgcagtcaccgccggctcgatcaacggcgaaggcgcgattgccgtgacgaccacggcgatcggcgcggagacgacacttgcgcgcatcatccgcctcgtggaaagcgcgcaggccgagaaggcgccgatccagcgcctggtggaccgggtcagcgaaatcttcgtgccggcgatcctcgccattgccgcgctcacgctggccggctggctgatcgccggcgcggccggtgaaacggcgattctcaacgcggtcgccgtgctggtgatcgcctgcccatgcgcgctcggactggccacgccggcggccatcatggccggcaccggtgtcgccgcgcggcgcggcgtgctgatcaaggacgccgaggcattggaaaccgcgcatcgggtaacgattgtcgcgttcgacaagaccggcacgctgacgctcggccagccgtcggtgacggcgttcgagccgatcggcggcatcagccgcgacgaagcgctagcacttgccgcggcggtgcagcgcaacagcgatcatccgctggcacgcgcagtggtcaaggcgtatgaagcggaagcggcagcgacagcggcggcggccgaggctgccgacatgcctgcggcaatcggtgaagccgtggcctcgcccactcgaacgcgcgcgctgcacgccagcgccgcgcgcgccgtggcgggccggggcgtcgaagcggacgtcgacggccgcaccctcgcgttgggcagcggacgctggctcggcgaactcgggattgaattgccgcccgaattcgccgcgcgcgcccgcgagctcgaagccgccggcaacacggtttcctggctcatgcagcgcgctccgctagcgccggtcgcactggcattgatcgctttcggcgataccgtcaaacccacggcgcgcgcggccgtcgaacggctggcgcagatgggcattacgagcgtgctggtcaccggcgacaaccggggcagcgcggcgagcgtcgcccgggcgctcggcatcgacgaattccatgcggacgtgctgcccgaagacaaagcccgtgtcatccgtgacctgaaaattcgcagcgccggcatcgtggcgatggcgggcgacggcatcaacgacgctcccgccctcgctgccgccgacatcggcatcgcgatggcgaccggcaccgacgtcgccatgcacgcggccggcatcacgctgatgcgcggcgatccggcgctggtggccgacgccatcgacatctcgcgcagaacgtggcgcaagatccggcagaacctgttctgggccttcgtctacaacctgatcggcattccgctggccgccttcggcttgctgaacccgatgctcgccggcgcggcgatggccttttcgagcgtcagcgtggtgaccaacgcgctgctgctgcgc

SEQ ID NO: 30868 - DNA, 1028 bp, Burkholderia cepacia
atgcaatcccgctgctttgcacgggagttagccggaccgcagaggagacctggacgatgaaaaccgatgacgtgatcgtcagctttcgaggtgtgcgcaagacgtacgacggagaaacgctggtcgtcaaacaacttgatctggatatataccaaggcgaatttctgacgctgctcgggccgtccggatcagggaaaaccacctgtctgatgatgctggcgggttttgaatttcccaccggcggcgaaatctggctggacggcacgctgctcaacaccgtgcccccgcataagcgcaacatcggcatggtgtttcagaactatgcgctgtttccgcatctgacggttgaacagaacgttgcatatccgttgaccgtgcgcaagatttcggcgcaggaacgcgcgcatcgcaccaacaacgcgttgaagatggtgcgcatggagagctttgcaaagcgctatccggcgcaactctccggcggccagcagcagcgtatcgcgctcgcccgtgcgctggtgttcgagccgaagctcgtgctgatggacgagccgctcggcgcgctggacaaacagttgcgcgaacacatgcagtacgaacttaaatcattgcacgagaaactcggcgtgacgtttgtgtacgtcacgcacgatcagggcgaggcgctgaccatgtcggatcgcgtggccgtgttcgacaaaggcatcgtgcagcaactcgataccgtcgatcgtctgtacgaatcgccgtgcaacgagttcgtggcgaactttatcggcgacagcaacaggctgcgcggcacgatcgcgaatgtcgatggtgagtattgcgaattccggttgagcgacggcacgcgtcttactgggcgcaacatcggcggggcgcgggcgggcacgccggcggtcgcgtgtattcggcccgagcgcatgaagctcgccaacggcctgtcacggcccggcgccaatgcgctcgccggtgaggcgcgcgggctgatctatttcggcgaccacgtgcgcatgcgctgtggtttg

SEQ ID NO: 30869 - DNA, 750 bp, Burkholderia cepacia
atgcgcttcatccgttctttgcttctgctgatctacttcgttctgttcacggtgccgtacgcgactgcatgcttcatcgcatttccgttcatgcgcgccgacaagcgctactggatggccgccggctggtgtcgcgccacgctgcatacggtgcgctggctgaacggtatccgctaccggatcgagggcatggagaacctccccgacggtcccgccgtgctgctctccaagcatcaatcggcatgggaaacgctggcgtttccggcgttgatgccgcggccgctgtgctacgtgttcaagcgtgaattgctgtacgtgccgtttttcggctgggcgctcggcctgctgaagatggttcacatcgatcgcaaggaaggcaagtacgcgttcgaatccgtcattaaacaaggcaaggcgcgcatggcggaaggcgcgtgggtcatcatgtttccggaaggcacacgcacccgcaccggcacgcaaggcaagtacaaaaccggtggcgcgcgtttcgcgatagcgaccggcgcaccggtcgtgccgatcgcacacaacgcaggacgtgtgtggcctcgcaactcgtttctcaaatatgcgggtatagtcacagtgtcgatcggcaagccgatcgagacgacggggctcacgcccgatgaagtgaacacgcgcgtcgaacggtggatcgaagctgaaatgcgtcgcatcgatcctaccgcgtaccgcgcggcggaaagcagttccgccgccgca

SEQ ID NO: 30870 - DNA, 438 bp, Burkholderia cepacia; identical to SEQ ID NO: 28112

SEQ ID NO: 30871 - DNA, 2361 bp, Burkholderia cepacia
gtagttccgttcgagcagttgcggatgaccgacgtggaaattgtcggcggcaagaatgcgtcgcttggcgagatgatcagtcagctcgctgaagccggcgtgcgcgtgccgaccggtttcgccaccacggcgctggctttccgtgacttcctgcagcacaacaatctgaccgaacgcatcgccaaacgtctcgaaacgctcgacgtcgacgacgtgaagtcgcttgccgaagcgggcaaggagatccgtcaatggatcgtcgaggcgccgctgcagccgcagctcgaggctgatatccgcgcgggcttcgacaccctgcaaaacagctcgcctgaagagctgtcgttcgccgtgcgttcgtcagcaacggccgaagacctgccggacgcttcgtttgcggggcagcaggaaagctacctcaacgtggtcggcatcgacgacgtgctcgatcgcatgaagcacgtgttcgcgtcgctgtacaacgaccgcgccatctcgtatcgcgtccacaagggcttcacccacgctgaagtcgcgttgtcggcgggcgtgcagcgcatggtgcgctcggacgtcggcgcagccggcgtgatgttcacgctggacaccgaatcgggcttcaaggacgccgtcttcatcacgtcgagctacggtctcggtgaaaccgtggtgcaaggcgcggtgaatccggacgagttctacgtctacaagaccacgctcgcgcaaggcaagtacccgatcatccgccgctcgatcggctcgaagctgatcaagatggaattcaccaaggcgggcgaagaaggccgcgtgaagaccgtcgacgtgtcgcacgagcagcgcaaccgcttctcgatcacggacgaagacgtgatcgaactggcgaaatacgcggtcatcatcgaaaagcactacgagcgtccgatggacatcgagtggggcaaagacggtcgcgacggcaagatcttcattctgcaggcgcgtccggaaacggtgaagagccaggcggccggcaaggccgagcagcgcttcaagctgaagggtcaatcgaacgtgctggctaccggccgcgcaatcggtcagaagatcggcgcgggtccagtgcgcgtgattcacgatccgtcggaaatggaccgtgtgcagccgggcgacgtactggtcgccgacatgaccgacccgaactgggaaccggtcatgaagcgcgcgtcggcaatcgtcacgaaccgtggcgggcggacctgccacgcggcgatcatcgcgcgtgagctgggcgtgccggcggtggtcggctgcggtgacgcgaccgacgtgctgaaggaaggcgcgctggtcacggtatcgtgcgcggaaggcgacgaaggcaagatctacgacggcctgctcgaaaccgaaatcaccgaagtgcagcgcggcgaactgccaccgattccggtgaagatcatgatgaacgtcggcaacccgcagctggctttcgacttctcgcaactgccgaacgcaggcgtgggtctggcgcggctcgagttcatcatcaacaacaacatcggcgttcacccgaaggcgattctcgagtacccgaacatcgatcaggacctgaagaaggcggtggaaagcgtcgctcgcggtcacgcatcgccgcgcgcgttctacgtcgacaagctgaccgaaggtatcgccacgatcgcggcggcgttctatccgaagcccgtgatcgtgcgtctgtcggacttcaagtcgaacgagtacaagaagctgattggcggttcgcgctacgagccggacgaagaaaacccgatgctcggtttccgtggcgcgtcgcgctacattgccgacgacttcgccgaagcgttccagatggaatgcatcgcgctgaagaaggtgcgcgaagagatgggcctcgacaacgtcgagatcatggtgccgttcgtgcgtacgctgaagcaggcggaacgcgtggtcgggctgctggccaagtacggcctgaagcgcggcgaaaacggcctgcgcctgatcatgatgtgcgaagtgccgtcgaacgcgatcctcgctgaagaattcctgcaattcttcgacggtttctcgatcggctcgaacgacctgacgcagctcacgctcggcctcgaccgcgactccggcatggaactgctggcggtggatttcgacgaacgcgatccagcggtcaagttcctgttgaagcgcgcgatcgacacctgcctgcgactggacaagtacgtcggtatctgcggccagggcccgtcggatcatccggactttgcgcaatggctgaccgatgaaggcatcaagtcgatctcgctgaacccggacacgatcatcgagacgtggcagcaactggcgaagtcgacgaag

SEQ ID NO: 30872 - DNA, 747 bp, Burkholderia cepacia
ctgacaggcaagcgcgggctggtggttggcattgcgaacgagcacagcatcgccaccggttgcgcgacgctgtttcgcgccgccggcgcggagctggctgtcacctacctgaacgacaaggccgaaccattcgtccgtccggttgcgcagacgcttcagtcacctcttgtcatgccctgcgatgtgcgcgttccgggccaactggaagcggtcttcgagcggatcacgaaagagtgggggcggctcgacttcgtacttcattcgatcgccttcgcacccgccgacgacctgcatgcgagcctggtggactgctcggccgagggtttcgcactcgcgatggacgtgtcgtgccattcgttcatccgcatgacaaggcttgcgctgccgttgatgcccgacggcggcagcctgatgaccgtgagctttctgggcgccgagcgtgcggtcgatcactacaacgtgatgggccccgtcaaggccgcgctcgaatcgagcgtgcgctatctcgccgtcgatctggcggcacgccgcgtccatgtccatgccatttcggcgggcgcagtcaaaacacgcgccgcctccggcatcgaccatttcgacgcgctgctcgacgacgtccgctcgcatacgccggcgaagcatcttgtcacgatcgaggaaatcggccgagttgcaaccgtgctcgcgagcgaggccggcatgacactgacgggatccaccatctatgcggacgcgggcttccatatc

SEQ ID NO: 30873 - DNA, 720 bp, Burkholderia cepacia; identical to SEQ ID NO: 28115

SEQ ID NO: 30874 - DNA, 1485 bp, Burkholderia cepacia; identical to SEQ ID NO: 28116

SEQ ID NO: 30875 - DNA, 1128 bp, Burkholderia cepacia; identical to SEQ ID NO: 28117

SEQ ID NO: 30876 - DNA, 1143 bp, Burkholderia cepacia; identical to SEQ ID NO: 28118

SEQ ID NO: 30877 - DNA, 1341 bp, Burkholderia cepacia
caagacggcctgaagcgggggctcaagaatcgccacatccagctcatcgcgctgggcggcgcgatcggcacggggctctttctcggctccgccagcgtgttgcaggcagccggcccgtcgatgattctcggctacgcgatcggcggcgtcatcgccttcatgatcatgcggcagttgggcgaaatggtggcgcaggagccggtggccggttcgttcagccacttcgcgtacaagtattggggcgactttccgggctttctgtcgggctggaattactgggtgctgtatgtgctcgtgagcatggccgagctgactgctgtcggcacgtatgttcattactggtggcccggcgtgccgacgtgggtgtcggcgctggtgtgctttgccgccatcaacgcgatcaatctcgccaacgtcaaggcctatggcgaaacggagttctggttcgcgatcatcaaggttgcggcggtgatcggcatgatcgtgttcggcggctatctgctgattagcggccacggcggcccgcaagcgtcgatctccaacctctgggctcacggcggttttttcccgcacgggtttcatggtctgttcatgatgctcgcggtcatcatgttctcgttcggcgggctggagttgatcggtattacggcggcggaggccgacgagccgcagaagagcattccgaaggccgtgaatcaggtgatctaccggattctgattttctacatctgctcgctgacggtgctgctgtcgttgtacccgtggaacgaggtcgcggccggcggcagtccgttcgtgatgatcttttcgcagattggttcgacgctgaccgcgaacgtcctcaacgtggtggtgttgaccgcggcgctgtcggtgtacaacagcggcgtctatgcgaacagccgcatgctctacggtctcgcggagcagggtaacgccccgcgcgcgctgatgaaggtcgaccggcgcggcgtgccgtatatggcgatcggtttgtcggcgctcgccacgttcacgtgcgtgatcgtcaactacctgattccggccgaagcgctcggcttgctgatggcgctggtggtggcggcgctcgtgctcaactgggcgctgatcagcatcacgcatctcaagtcgcgcaaggcgatggtcgcggcaggcgagacgctcgtgttcaagtcgttctggttcccggtcagcaactggatctgcctcgcgttcatggcattgatcctcgtgattctggcaatgacgcccggtctgtccgtttcagtgtggctggtgccggcgtggctggtggtgatgtgggccggctatgtgttcaagcgccggcgcgcggccgtgcag

SEQ ID NO: 30878 - DNA, 1056 bp, Burkholderia cepacia
aaacttctgaacgatactttcctgcgcgcgctgctgcgccagccgaccgactacacgccgatctggctgatgcggcaagctggccgctacctgccggaatacaacgccacgcgcgctcgcgcgggcagcttcctgggtctggcaaaaaacccggcgttcgcaacggaagtcacgctgcaaccgctggagcgctatccgctcgacgccgcgatcctgttctccgacatcctgaccgtgcccgacgcaatgggtctgggcctcgagttcgtgactggcgagggccccaaattcgcgcgcccggtgcgcacggaagacgacgtcgcgcgcctcgcggtgccggacatcgacgccacgctgcgctacgtgaccgacgccgtgcgcgaaattcgcaccgcgcttaccgacgcgcagggccgccagcgcgtgccgctgatcggtttttcgggcagtccgtggacgctcgcgtgctacatggtcgaaggcggcggttcggcggacttccgcacggtcaagtcgatgttgtatgcgcgtccggacctcatgcatcgcattctcgacgtcaacgcgcgcgcggttgcggcctacctgaacgcgcagatcgaagccggcgcgcaagctgtgatgattttcgacacatggggtggggcgctggcggacggcgtctatcaacgcttttcgttgcactacatccagcaggtggtgagtcagctaaagcgcgaccatgacggcgaaaaagtgccggtgatcactttcaccaaaggcggcggcctgtggctcgacgagatcgccgaaaccggcgtggatgcggtcggcctcgactggaccgtgaacctgagcaaggcccgggagcgcgtgggcggcaaggtggcgctgcaaggcaatatcgatccgtcggtcctgtttgccccgccggctgcgatccgcatggaagcgcgcgccgtactggacagtttcggtaaccatccgggccatgtgttcaacctcggccacggcatttcgcagttcacgccgccggagcacgtcgccgaactggtggacgaagtgcatcgtcatagc

SEQ ID NO: 30879 - DNA, 3927 bp, Burkholderia cepacia
atggctagcaccacccttggcgtcaaggtcgacgacctcttgcgttcccggctgaaagatgccgctacccgtctcgaacgcactccgcactggctcatcaagcaggccatcttcgcgtacctcgaaaagatcgagcacggtcaattgccgcccgagctgtcgggtgtggcgggctcggccgatctgaccgagggcgccgcggtcgaacacgaggaagacggtgggtcgcacccgttcctcgatttcgcgcaaaacgtgcaaccgcaatcggtgctgcgcgccgcgatcacggccgcttaccgtcgtcctgagccggagtgtttgccgttcctgctcggtcaggcgcgtttgccggccaacctcgcgggcgacgtgcagacgatggccggcaagctcgtcgaaacgctgcgcacgaagagcaagggcggtggcgtcgaaggtctgatccacgagttctcgctgtcgagccaggaaggcgtggcgctgatgtgtctcgccgaagcgctgctgcgcattcccgaccgcgccacgcgcgacgcgctgatccgcgacaagatcagcaagggcgactggaaatcgcacatgggccaggcgccgtcgatgttcgtcaacgccgcgacctggggcttgatgatcaccggcaagctggtgacgaccaacagcgagacgagcctctcgtcggcgctcacgcgtctgatcggcaagggcggcgagccgctgatccgcaagggcgtggatatggcaatgcgcctgatgggcgagcagttcgtcacgggtgagaacatctccgaggcgctcgccaacagccgcaagtacgaagcccgcggcttccgctactcgtacgacatgctcggcgaagcggccaccaccgaagccgacgcgcagcgctactacgcgtcgtacgaacaggcgatccacgcgatcggcaaggctgccggcggccgtggcatctacgaaggcccgggcatttcgatcaagctctccgcgctgcacgcacgctactcgcgttcgcagcaggaacgcaccatgagcgaactgctgccgcgcgtgcgctcgctggcaatcctcgcgcgccgctacgacatcggcctgaacatcgacgcggaagaagccgaccgcctcgaaatctcgctcgatctgctcgaagcgctgtgcttcgatccggagctggccggctggaacggcatcggcttcgtggtgcaggcgtatcagaagcgctgcccgttcgtgatcgaatacctgatcgatctggcgcgccgcagccgtcaccgcatcatggtgcgcctcgtgaagggcgcgtactgggacaccgaaatcaagcgcgcgcaagtggacggcctcgaaggctatccggtctacacgcgcaagatctacacagacgtgtcgtatctcgcctgcgcgaagaaactgctcagcgcgcccgacgcggtctacccgcaattcgccacgcacaacgcgcacacgctgtcggcgatctatcacctcgcgggcaacaactattaccccggccagtacgagttccagtgcctgcacggcatgggcgaaccgctgtacgaagaagtcaccggccgcgacaagctgaaccgtccgtgccgggtgtacgcgccggtcggcacgcatgaaacgctgcttgcctatctcgtgcgccgtctgctggaaaacggcgcgaacacgtcgttcgtgaatcgtattgccgatgaaaccgtcgcgatcaaggacctgatcgccgatccggtcgatgaagcctcgaagatcgtcccgctcggcgcgccgcacgcgaagattccgctgccgcgcaatctgtacggttcggaacgcctcaactcgatgggtctcgacctgtcgaacgagcatcgcctggcgtcgctgtcgtcggcgttgctggcgagcgcgcatcatccgtggcgcgccgcgccgatgctcgaagacaacgagatcgccgtgggcctcgcgcgcgacgtgcgcaatccggccgatcatcgcgacctcgtcggcacggtcgtggaaacgacgccggagcacgtgagcgccgctttggcgcacgcggtggccgccgcgccgatctggcaagccacgccggtcgatgcgcgcgccgattgcctcgcgcgtgccgccgatctgctcgaagcgcagatgcatacgctgatgggcctcgtggtgcgtgaagccggcaagtcgctggccaacgccgtcgcggaaattcgcgaagcgatcgacttcctgcgttactactccacgcagattcgcgaggagttctccaacgacacgcatcgtccgctcggcccggtggtctgtatcagcccgtggaatttcccgctggcgattttcatgggccaggtggccgcggcgctcgccgccggcaacaccgtgctcgcgaagccggccgaacagacgccgctgatcgccgcgcaagccgtgcgcattctacgcgaagccggcgtgccggcgggcgcggtgcaactgctgccgggcaacggtgaaacggtcggcgccgcattggtggccgatccgcgcacccgcgcggtgatgttcaccggctcgaccgaagtcgcacgcctcatcaacaagacgctgtcgagccgactcgatccggatggcaagccgattccgctgatcgccgaaacgggcggccagaacgcgatgatcgtcgactcgtcggcgcttgccgaacaggtggtggcggacgtgctgcaatcgtcgttcgactccgccggtcaacggtgttccgcgctgcgcgttctttgtctgcaggacgatgtcgcggaccgcacgctggaaatgctgaccggcgcgatgcgcgaactggccgtgggcaatccggaccgtctgtcggtcgacgtcggcccggtgatcgacctcgacgcgaagcgcggtatcgacgcgcacgtcgcggcgatgcgcgagaagggccgcaaggtcgagcagctgccgatgccggacggttgcgcgcaaggcaccttcgtgccgccgacgttgatcgaactcgacagcatcgacgaactgaagcgtgaagtgttcggcccggtgctgcacgtggtgcgctaccgccgcagccagctggacaaactgctggagcagatccgcgcgaccggctatggcctgacgctcggcatccatacgcgtatcgacgaaacgatcgcgcatgtgatcagccgcgcgcacgtgggcaacatctacgtgaaccggaacgtgatcggcgctgtggtcggcgtgcagccgttcggtggcgaaggtttgtcgggcacgggtccgaaagcgggcggcgcgctctatctgcagcggctcctcgccacgcgtccggccggtttgccgaagtcgcttgcgcgggctttggtcgtggatgttccgcgcgcggccgaaaacggcgacaatccgtccgctgtattgacggcttaccgcgactggctgattaccgaacgcgagccgcaactggccgcgcgctgcgacggctatctgtcgcatgtgccggcgggcgccacggcggtattgtcgggaccgaccggcgagcgcaacacgtacacgctgggcgcgcgcggcacggtgctgtgtatcgcgtcgacggcgagcggtgcgcgcgtgcagtttgccgcggcgctggctacgggaaatcgcgcgttgttcgaaggcgcggctggggaacaattggtgtcgcagttgcccgcctcgctgaagtcgcacgcaagcgtgaagaagagtgccgatacgccgttcgacgccgtgctgttcgaaggcgatagcgacgaactgctggcgctggtgaaggaagtcgcgaagcgtccaggcccgatcgtgtcggtacagggcgtcgcggcacgcgcgctggaaagcggcgacgaggactacgcgctcgagcgtctgttgacggaacgctcggtcagcgtcaatacggcagctgcaggcggtaatgcgaatttgatgacgatcggt

SEQ ID NO: 30880 - DNA, 1617 bp, Burkholderia cepacia
accggcgcgcgtctcgtcgtcgatgctttgctgacgcacggtgtcgagcgtgttttctgtgtgccgggcgaaagttttctcgccgtgctcgattcgctgcacgatgaaaccgaacgcatccagaccatcgtttgtcgtcatgaagcggctgcggcgaatatggcggaagccgtcggcaaattgaccggccggccaggcgtggcgatcgtcacacgcggaccgggtgccacgcatgcgtcgatcggcgtacacaccgcgtttcaggattccacgccgatgattttgctgatcggccaatgcgcacgcgagcatctcgaccgcgaggctttccaggaaatcgactaccggcgcatgttcggtcagatggcgaagtgggtcgcgcagatcgacgatcccaaacgcattcccgaatatctgagccacgcgtttcacacggcgacatccggacggcctggacccgtcgtgctgtcgttgccggaagacgtgttgagcgacgcgtgcaacgccgtggccggcgcgcccgcgtatcagcgcgtcgcggcgtcgccttcgacggcgcagatcgagaagttgcgcgggttgctcgaaggcgcgcaacggccaatggtgatcgcgggcggcagcggctggacgcctgctgcgtgcgcggactttcaacgcttcgtcgagaactggcaactgccggttggcctcgcgttccgctttcaggacacgctcgacaacgagcatccgaactatgccggcgacgtcggccttggtatcaatccggcgctgacgcaacgtatccgcgaagccgacctgttgctcgcaatcgggcctcgcctgggcgaagcgaccaccaacggctatacgctgctcgacatcccgaaaacgaagcagacgctcgtgcatgtgcatcaaggcgcggaggaattgggacgcgtgtatgcggcggatctgccgatcgtctccggtatgccagaactggcggcaatgcttgcggagttggagccttcgtccgagcaacttgcctggtctggggccgcgagcgaggcgcatcgcgcgtatctcgactggcgcaaaccgcgtcgcattccgggcgacgtgcagatgggcgaagtgatccagcagttgcgcgcgcacctaccggatgacgcgattctcaccaacggcgcgggtaattatgcgacgtggctgcatcggcacttctcctatcgccattaccgttcgcaactcgcgccgacgagcggcgcgatgggttatggcgtgccggcggcgatcgcggcgaagtcgatgtatccgcaacgcgcggtcgtggcgctggccggcgacggctgcttcatgatgtctgcgcaagaactcgcgacggcgatgcagtacgacctgcacgtgctattcatcgtgctgaataacagccagttcgggacgatccggatgcatcaggagcggcattatccggaccgcgtgcacggcaccggactcacgaatccggacttcgcggcgttcgcgcgttcgttcggcgcgcatggtgagacggtggagcggaccgaggattttctgcctgcgctgaagcgttcgatcgaggcgaagcgtgcggcggtgatcgagatccgcatgccgcaggaagcgagcacgccg

SEQ ID NO: 30881 - DNA, 357 bp, Burkholderia cepacia
agcatcccggccgatctgaaatacaccgaatcgcacgagtgggtccgcaccgaagcggacggcacactgacggtcggcatcaccgaccacgcgcaggaagcgctcggcgatatcgtcttcttcgaagtccaggaactgggcaagaccgtgagcgcgggcgacaccgtcgccgtgatcgaatcggtcaaggccgcttccgatatctacgcgccggtttcgggcgagatcatcgaagcgaacagcgccgtggccgatacgcctgatctggtcaacagcacaccgtacgaaagctggctcttcaagatcaagccggccgcggacgccgcgctggaccgtctgatcgacgccgacgcatac

SEQ ID NO: 30882 - DNA, 2070 bp, Burkholderia cepacia
ctgaaccccgctcaaaatgaagcggtccgttatctcgacggtccgtgtctcgtgctcgccggcgcaggcagcggcaagacgcgcgtgatcacgcagaaaatcgcgcacctgatcgaggccaagggcttcgagccgcgccacatcgccgccgtcacgttcacgaacaaggccgcgctggaaatgcgcgagcgcgtgggcaagctgctggaaggcaagacgctcaccacgccaggcaaggaaggccgcaaagtgcccgtcaaccagttgacggtgtgcaccttccactcgctcggcgtgcagattctgcggcaggaggcggaacacgtcggcctgaagccgcagttctcgatcatggattcggacgactgcttcggcatgatccaggagcaggtcggctcgacggacaagggtttcatccgcaagatccagtcgatcatctcgctgtggaagaatggcatgatcatgcccgagcaggcgattgcgattgcggcgaacgaggacgagcatcaggccgcgatcgtctaccgcaattacgtggccacgctgcacgcgtaccaggcggtggatttcgacgatctgatccgcctgcccgccgagctcttcgcgaagaacgagcaggtgcgcgaccgctggcagaacaagctgcgctatctgctgatcgacgagtatcaggacaccaacgcctgccagtacgaactggtgaaactgctggccggcaagcgcgctgcgttcacggcggtgggcgacgacgatcaggccatttacggctggcgcggcgcgacgctcgaaaatctcgggcagctcagcaaggactttccgaagctgcatctgatcaagctggagcagaactaccgctcgacggtgcgcattctgaccgccgcgaacaatgtgatcgcgaacaatccgaagctgttcgaaaagaagctgtggtccgaacacggcatgggcgacacgatcaccgtcacgccctgcaacgacgaagaacacgaggcggagtccgtggtgtttcgtctgtcggcgcacaagttcgagcggcgcgcgaatttccgcgactacgcgatcctctatcgcggcaatttccaggcgcgcatcttcgaacaggtgctgcggcgtgagcggattccgtatgtgctgtccggcggccagtcgttcttcgacaaggccgaaatcaaggacatctgcgcctatctgcgcctgatcgccaacgcgaacgacgaccccgcgttcatccgcgcgatcaccacgccgcgccgcggcgtcggcaatacgacgctcgaggcgctcggctcgttcgcgggtcaggccaaggtgtcgctgttcgaagccgtgtatatgggcggcatcgaggcgcgcctgtcgccgcggcagatcgaacccatgcgcgtgttctgcgacttcatgcagcgcctcaccgatcgcgccgagaaagacgccgccggcacgctgctcgacgaactgatggacgccatccactacgaagcctacctgtacgacgcgttcgacgaacgtcaggcgcagtccaagtggcagaacgtgctggagttcatggagtggttgaaacgcaaaggcaccaaggctgagccgacgggcgccgcggcgaacgaagccaccggctacgacaccgccgatggtctcggcgacaccggcaaaagtctgctgggtctgatccagaccgtcgcgctgatgtcgatgctcgaaggccgcgaggaagatcccgacgcggtgcggctctcgacggtgcacgcgtcgaaggggctcgagtatccgcacgtgtttctggtcggagtggaagaaggcatcatgccgcatcgcggcggtcccgacgacgagccgatcgacgacgcgcgcatcgaagaagagcgccggctcatgtatgtggcgatcacgcgtgcccagcgcagtttgcatctgaactggtgcaagaagcgcaaacgcgcgcgcgaaacggtggtgtgcgagccgtcgcgcttcattcccgaaatgctgctcgacgacgctccgccgccgacgcctgaagaagcgccgatgtcgccgaaagaccggctcgcgagtttgaaggcgctgttgcag

SEQ ID NO: 30883 - DNA, 741 bp, Burkholderia cepacia
caaccgatgcaagcactcccggctgttctgtctccaggcgagacggcatttttcttcgatttcgacggcacactcgtcgaactcgctcccacgccggacggcgtgctggtgcaacctcgcgtgatcgacttgctgagcgagttgcgcagcctgacgaacggtgccgtcgcggtggtgtcggggcgtgggatcgacagcatcgacagttttctgggtattcccgatctgccgattgccggtctgcacggcgccgaacggcgtgacgcgaacggcgacacgcaacgcatcggctttcatgacgagcggctcctgcgcatggagcaggtgctcgcgcaagtggtcaacgaaaaccccggcatgctgctcgagatcaagggcgcggccgtggcgctgcactaccggaatgcgccggaccgcgagccggtggcgcgcgaggcaaccagccggctggtcgccgattacgccggcgcctacgtgttgcagccgggcaagatggtctacgaaatcaaaccgaaagatgtcgacaagggccgcgcgctgcgcgcctttctcgacgagccgcctttcgtcggccgccagccggtctttgccggcgacgatctgaccgacgagaaaggcttcgccgtcgtcaacgaacgcggcgggctgtcgatcaaggtcggcccgggcgagacgatggcgcgaacgcgcatcgactcggtcccggcgctgctcgactggctggcatcgatcgtcgcggcc

SEQ ID NO: 30884 - DNA, 1374 bp, Burkholderia cepacia
atgggccgactgatcatcgtatcgaaccgggttgcgccgatctcggagggcggcccggcggcgggtggtctggcggtcggcgtgtacgacgcactgaaggaaaccggcggcatgtggttcggctggagcggcgacgtgctcagttcgggccagccgcagatcaaggtcgaagagcgcggcccggtgaccttcgcgacgatcgcgctgatgcgccgcgattacgatcagtactaccgtggcttctcgaacgcgacgctgtggcccgcgttccactatcgcgccgacctgctgcaatacgaccggcacgacttcgagggctactggcgcgtcaatgcctggctcgcgcaacaactcgtgccgctgttgcgcgaagacgatgtgatctgggttcacgactatcacctgattccatttgcgcaggcgctgcgtgcggcgggcgtgaagaatcgcatcggcttttttctgcacattccgtttccggcttcccaggtgctgctggcagtgccgccgcatcgcgaacttgtcgaagcgctgtgttcgttcgatctgctcggcttccagactgcgccggatttgcgcgcgttctgcgactacatcgtcaatgaggcgaacggcaccgccgacccatcggcaagcggtccgctgacgatccacgcgttcggccgcacgctgcgggcggcagcttatccgatcggcgtctatccggacgagatcgccgaactcgcgaaagcgggcgagcgcggcaaaccggtgcgcacgatgaaggcgacgctgcactcgcgcaagctgatcatgagcgtggaccggctcgattactcgaaggggctggtcgagcgttttcgcgccttcgagcgtctgctcgaacactcgaccgcgcaacgcaacaaggtgtcgttcctgcagatcgcgccgccgacgcgcgccgacatgcacgcataccaggacatccgcttgcagctcgaaggggagtcggggcgcatcaacgggcgcttcgccgaactggactggacgccgattctctacatccacaagcaatacgagcgctcggtgctggccgcgctgttccgcaccgcgcatgtcggctatgtcacgccgttgcgtgacggcatgaacctcgtcgccaaggagtacgtatcggcgcaggatccggagaatcccggcgtgctcgtgctgtcacgctttgccggcgccgcgcaggaactggacggcgcgctgatcgtcaatccggtcgacatcgacggcatggccgaggcgctcgcacgggcgctcgacatgccgctcgcggagcgtcaggcgcgtcatcgcgacatgatggtgcagttgcgcgagaacaatgtgtcggtgtggcgcgataacttcatgcgcgatctgcag

SEQ ID NO: 30885 - DNA, 1428 bp, Burkholderia cepacia; identical to SEQ ID NO: 28126

SEQ ID NO: 30886 - DNA, 1701 bp, Burkholderia cepacia
ttccgtcactgggcgcagcagccctggcgcatcgtcgtcatcacggcgctggtgctgctctccgcattggccgacgtgctcacgccgatgttcgcgggacacctcgtcgacgccatcgcgtccggcgcggccagcaacgccgttgcgtggcgcgcggcggtgacggctttctgcgtgctgggcgcgctcggtctcggcgccacgctgctgcggcaaggcgtgtacttcaacatcatccggctcacgctcaggatgatgagcgaaatcgccgcgaacgcgtttcatcgcgtgcagcgtttttcgaccgactggcacgccaacagcttcgccggttccacggtgcgcaagatcacgcgcggcatgtgggcgctcgacctgctcaacgacacgctgctgatcgcgctgttcccgtcgctcgtcatgctggtcggcgccacggtcctgctcggctggcgctggccgatgatgggcgcggtcgtcggcatcggctcgctgctctatatcgcggtgacggcggctatgtcgctcggtttcgtggcgccggccgcgcggctcgcgaatgcgtgggacacgcgcatgggcggcgcgctcgccgacgcggtcagctgcaacggcgtggtcaaggcgttcggcgcggaagatcgcgaagaggcgctgctcgcgcgcgtgatcggcaagtggcggcaccgcacgcgccgcacgtggatgcgcggcacgatcaacggcggcgtccagggcggcatgctggtagcgatccaggccgcgattctcggcgcggcgctgctgttgtgggcgcgcggcgaagcgagcgtcggcgacatcacgttcgcgctgaccatgttcttcatgctgcaaggctatctgcgcgacgtgggcatgcatatccgcaacctgcaacgctcggtcaacgacatggaggaactggtgtcgctggaaagccagccgctcggtatcgaggacccgcccggcgcgggcccgatcgcgatcggcaaaggcgagatccgcttcgagcacgtcaccttccattacggaacgaacggccagccgctctacgacaacttctccgtgcgcattgcgccgggcgaacgcgttggactggtcgggcattcgggttccgggaagaccacgttcatcaagctgatccagcggctctatgacatttcggaaggccggatcacgatcgacggtcaggacatcgccaaagtgcggcaggcgtcgttgcgcagccagatcgcgatcgttcagcaggagccggtgctgtttcaccgctcgctcgccgagaacatcgcgtatgcgcggcccggcgcgagccgcgccgagatcgagcacgccgccaggctcgcgagcgcgcacgatttcatcgccgcgctgcccaatggctacgacacgctggtcggtgaacgcggcgtcaaactgtcgggcggcgaacgccaacgcgtggccatcgcgcgggcgtttctcgccgacgcgccgatcctgattctggacgaagcgacgtcgagtctcgacagcgaaagcgaagtgctgatccagcaggctatggaacggctgatgatgggccgcaccacgctggtggtcgcgcaccgtctttccaccgtgcgtgcgctggaccggttactggtgctggataaaggcaaggtgatcgaggaaggcagccacgaggcgctgatcagactcgagaacggcctctatcgccggttg

SEQ ID NO: 30887 - DNA, 762 bp, Burkholderia cepacia
gtcccggcgtttgatgacaattacatctgggtcgtttccgacggacactctgcggtagtcgtcgatccgggtgaggccgcccccgtgcaagcttatctggcgaaacggggttggcggctgagcgctattttactcacgcaccatcatcaagaccacgtcggcggggtggccgatctgctgaatggccaggcggtgcccgtctacggccccgccggtgaagcgatcgagcatctcacgcaccgcctgaaaaatggcgatcacgtgtcgatcgcggcccccgcgctcgaattgagcgtgctcgacgtgcccggccatacgagcggtcacattgcctattttcaggcggcggacccgcgcggcacgccgcacgtattttgcggcgacacgctgttcgcctgcggttgcggccggctgttcgaaggcacgccgaagcagatgctcgcctcgctggatgcgctcgccgcgctgcccggcgcaaccgaggtgcattgcgcgcacgagtacacgctgtcgaatatccgcttcgcgctcgcctgcgagccggccaacgccgaactgcaagcctggcgggataaagcaggggaattgcgcgcgcgcggcgtgccgacgctgcccaccacgatcgcccacgaacgcgcggtgaatccgtttttgcgtgccggcaatccggcagtgcaggcaagcctgcgggagcagctgcacgaaaaggtgcccgatcgattgacggccttcacgttgatgcgcgaatggaaaaaccgcttc

SEQ ID NO: 30888 - DNA, 1113 bp, Burkholderia cepacia
cccgctctgctcgcgctcgccgacggcacggtctttcgtggttactcgatcggcgcccccgggcataccatcggcgaagtcgtgttcaacaccgctatcaccggctatcaggaaatcctgactgacccgagctacgcgcgccagatcgtgaccctcacgtatccgcatatcggcaacgtcggcgtgaatgccgaagacgtcgaagcggcgaaagtccatgccgccggcctgatcattcgtgatctgccggttctcgcgtcgaacttccgcatggagcgcacgctccagcaatacctgcaggacgaaggcgtggtcgccatcgccggcctcgatacccgcatgctgacccgcgttctgcgcgacaagggcgcgcagaacggcgcgatcctcgccggttcggacgatgaagctcgcgccatcgaactcgctcgctcgttcccgggcctttcgggcatggacctcgcgaaggtcgtgtcgacgaaggagtcctatgaatggacccagaccgaatggcggctgggcagcggctacggcacgcagaatgcgccgaagtaccgcgtggtggcgttcgactacggcgtcaagtacaacatcctgcgcatgctcgccgaacgcggctgtcacgtcaccgtgctgccggcggaagcttccgccgccgacgcgctggcactcaatccggacggcgtcttcctgtcgaacggcccgggcgatccggaaccgtgcgactacgcgatccgcgccacgaaggaactgatcgaccgcggcattccgaccttcggcatctgcctcggccatcagatcatgggcctcgcggtcggcgccaaaaccatgaagatgaagaccggccaccacggcgcgaaccatccggtgaaagatctggacgacggccgcgtggtgatcacgtcgcagaaccacggcttcgcggtcgatgccgacacgctgcccgccaatgcccgcgtcacgcatgtttcgctgttcgacggcacgctgcagggcttcacgctgaccgacaagccggcgttctgcttccagggtcacccggaagcgtcgcccggtccgcatgacatcgcctatctgttcgaccgcttcacggcgttgatggacacgaagaag

SEQ ID NO: 30889 - DNA, 3249 bp, Burkholderia cepacia; identical to SEQ ID NO: 28130

SEQ ID NO: 30890 - DNA, 1897 bp, Burkholderia cepacia
aacaatatgttttcgaaagcagcagtgtggctggttatcgcactggtgctgtttacggtgttcaagcagttcgacaagccccgtgtccaggaaggcgtttcctattcgcagttcatggacgacgcaaagaacggcaaagtcaagaacgtcattgtccaggggcggaacctcacggtcactccagcagacggccagaagtaccagatcgtgtcgcccggcgacatctggatggtcggcgatctgatgaagtatggcgttcaggtgagcggcaaggctgatgacgaacccaatgcgctggtgtccgcgctgtactacctcggaccgacgatcctgatcatcggtttctggttctacatgatgcgacagatgcagggaggcgggaaaggcggtgcgttctcgttcggtaaatcccgtgcacgtctgatcgacgaaaacaacaacgcaatcaatttcaccgacgtcgccggttgcgacgaggccaaggaagaagtctccgaactggtcgacttcctgcgcgatccgcagaaatttcagaaactgggcggacgtattccgcgcggcgtgctgctggttggcccgccgggaaccggtaagacgctgttggcgcgcgccatcgctggcgaggcgaaagtgccgttcttcagcatctcgggttcggacttcgtcgaaatgttcgtcggtgttggcgcggctcgggttcgcgatatgttcgaacaggccaagaagcacgcgccgtgcatcgtgttcatcgacgaaatcgacgcggtcggccgtcatcgcggcgccggcatgggcggcggtaatgacgaacgtgaacagacgctgaaccagatgctggtcgagatggacggcttcgaagcgaactcgggtgttatcgtgatcgctgcaacgaaccgttcggacgtgctcgacaaggcgctgttgcgtccgggccgtttcgaccgtcaggtgtacgtcggtctgccggatatccgcggtcgcgaacacatcatgaaagtccatctgcgcaaggtgccgatctcgaacgacgtcgacgcagcggtgatcgcgcgcggcaccccgggtttctcgggcgccgatctcgcgaacctcgtgaacgaagcggcattgttcgcggctcgccgcggcaagcggatcgtcgaaatgacggacttcgaagacgcgaaggacaagatcttcatgggtccggagcgcaagtcggccgtgatccgcgaagaatcgaagcgtgccacggcgtaccacgagtcgggtcatgcggtgatcgccaagctgttgccgaaggccgatccggtgcacaaggtcacgatcattccgcgcggtcgtgcgctgggtgtgacgtggcagttgccggagcatgacaacgaaacgtattcgaaggactacctgctggatcggcttgcgatcctgttcggtggccgcgtggcggaagaattgttcctgaacctgatcagcaccggcgcgtcggacgacttcaacaaggcgacgcaaacggcgcgtgcaatggtggctcgctttggtatgacggacgcacttggaccgatggtctacgtcgacgacgaaaacgacgcaacgccgttcgggcgtggtttcacgcgcaccatttcggaagcgacgcagcagaaggtcgacgccgaaatccgccgcgtgctggacgagcagtacaacctcgcgaagcgcctgctggacgaaaaccgcgacaaggtcgaagcaatgaccgccgcgctgatggagtgggaaacgatcgacgccgatcagatcaacgacatcatggccggccgtccgccgcgttcgccgaagagttcgacgccgtcggcaaccgacgcctcgtcgggcggcagcccgggtaccgaggtcaagcccggtagcgcaacggcgccggcctgatcggcgaccagta

SEQ ID NO: 30891 - DNA, 909 bp, Burkholderia cepacia; identical to SEQ ID NO: 28132

SEQ ID NO: 30892 - DNA, 1050 bp, Burkholderia cepacia; identical to SEQ ID NO: 28133

SEQ ID NO: 30893 - DNA, 543 bp, Burkholderia cepacia
tggcatggagcgtcgctcatgagcgcggcgcgcggtgccgtgatatggatgacggggctctccggcgccggcaagtcgacgttggccaacgccttgcatctacggttgaaggaagcagggcaggccgcgatcgtgctcgacggcgatgtgctgcggcgtgggctgaacgccgacctaggcttcacgcccgaggaccgcactgaaaacctgcggcgggtcgcgcacgttgctgcgctcttcatgcagcagggcttcgtggtgatcgccgcggtgatttctccggagcatcggcaccggcgcgcggcgcgtgaaattgtcggcgaagggttcgtggaagtgttcgtgaatgctccgctacaggtctgcgaagcgcgcgacgccaaaggactctatgcgcgcgcgagacgcggcgaaattgcgcatttcaccggtatttccgatccgttcgaagcgccgctcgccgccgacctggtgattgaaactgatcgcatgccggtcaacgagggtgtagaccggctgctcgcgcatctggtcacgatgggg

SEQ ID NO: 30894 - DNA, 1449 bp, Burkholderia cepacia
gtaatgagcgaatccgcaactgtattcaagaacctgatcgccggagagtggaccgagagcgtcagcgggaagaccttcgcgaatatcaatccggccgatacgcgcgatgtcgtcggccagtttcaggcgtcggtggtcgcggatgcgcaggcggcgatccaggccgcgtcgtccgccttcgcgcaatggcgtcgcacgccggtcacggcgcgggccaggatcgtcaacaaggcggccgactggctggagagtcacgcagataccttcgcacaggagttgacgcgcgaagagggcaagccgctcgcgcaaagccgcgacgaaattctccggtccgcccaggtcctgcgtttttatgcggtcgaggcgcagtcattcaccggcgagacgtttccgagcgacgatccggagcagcacgtgtacacgcagcgcgagccgctgggcgtggtcacggtcatcacgccgtggaatttccccatctccatcccggcgcgcaagattgcgcccgcgctgatggccgggaacacggtgattttcaagccgtcgtccgacgcgccgctgatcggctaccggttggccgaagcatttgcacaggcgggcattcctgccggcgtgctcaacttcatcacgggccgcgcgtcggatatcggtgctgcgattacagagtcgccggtcgtgcgtgccatctcgtttaccggctcgaccgccgcaggcgaacatattcaccgctccgtgccgatcacgacgcgcacgcagatggaactcggcgggaagaatccgctgatcgtgatggacgatgcggatctcgaccgcgccgtggatctcgcggttaaaggcgggttgtcgctgagcgggcaggcttgtaccggcaccagccgaatcctggtcatggagtcggtgcgcgaaacattcacggcaaaactggtcgagcgggtaaagagcctcaagatcggcagcggcgttactcccggtatggacctcggcccgcttgccaatcgcaagcagctcgaatcggtactcggatatgttgcgtccggcaaggaacagtcgacgcatctgatcggaggcgagcagctgacgggcgagggcttcgagcacggctactacgtcacgcccgcggtgttcagcgacgttcccgagagcgcgcgcatttatcgcgaggaaattttcggacccgtgctagccatcacgtccgtgacgggctacgacgacgcgatcgcgaaggcgaacgatacggagtacggcctgtcggcggcgattgccacttcgaatccacgctacatgcaccggtttgccgacgagatcgaggcggggaccgtcaagatcaatcgcaccactaccggcaatgtgatcaatgcgccgtttggcggcctgaagcgatcgagcacgtcaacgttccgcgaatcggggcgagccggactcgagttctacacgcagatcaagaccgtctat

SEQ ID NO: 30895 - DNA, 1086 bp, Burkholderia cepacia
gagtccaatctggacatgatcggattcattcgggattacctcggggaactcggagtcgggagcgagctgttctacaacgccgggcgtaccaaggcgaatctgttcgcgaccatcggtccgcgtgagcgcggcggtatcgtgctgtccggtcacaccgacgtggtgccggtcgacggccaggcgtggaccgtcgacgccttccgccttaccgaacgcgacgggcggctctatggccgcggcacggccgacatgaagggcttcatcgcttcggtgctggcggcagtgcctgtgtttcttgagcgcgaactgaagctgccggtccatctcgccttttcgtacgacgaggaagtgggatgcctcggcgtgcggcccatgctggcggaactggagcggcgcccgcataagccggctctgtgcctgatcggcgagccgaccgaactcaagccggtgctgggtcacaagggcaagctggcgatgcgttgtcacgtgaaaggtgcggcttgccattcggcttacgcgccgtacggcgtcaatgccattcaatacgcggcgcgaatgatcggccatctggaagagattggcgagcaactggcgcggcccgagcatcacgacgagcgattcgatccgccgttctccaccgtgcagacgggtgtgatcaaaggcggccacgcgctcaacatcgtgcccgccgaatgtgaattcgacttcgaagtgcgggcgctgcccggctttgacgcccaccaggtagccgacgagttgcagacctacgccgaagccgaattgctgccgaagatgcgcgccgtgaagtccgacaccgacatccgttttcagtcgctctccgcctacccgggattggctacttcgcccgatagcgaagcggcgcgtctcgtggcgctgctcagcggttccaccgagttcggcacggttgcgttcggcaccgagggcggcctcttcgatcaggctggcattcccacggtggtttgcggaccgggcagcatggaccaggggcataagccggacgagttcgtcagcgtcgagcaattgcgccagtgcgatgcgatgctgattcgtctggcggaccatctg

SEQ ID NO: 30896 - DNA, 2265 bp, Burkholderia cepacia
gtcgtcatcatcgacgaagatttccgctccgagaacatctcgggttccggcatccgggctctggccgaagccatcgagaaagaaggcgcggaagtgctcgggttgacgagctacggcgatctgacttcgttcgcgcagcagtcgagccgcgcctcgtgcttcatcctttcgatcgacgatgacgagctgctgccgtacgtcgataacgtggtggtggaaggcgagacgccggaactggccgccgcgatcgtcgcgctgcgcgcgttcgtgaccgaagtgcgccgccgcaacgccgacattccgatcttcctgtacggcgaaacgcgcacctcgcgccacctgccgaacgacatcctgcgcgaactgcacggcttcatccacatgttcgaggacacgccggagttcgtcgcgcgccatatcatccgcgagaccaaggtgtatctggattcgctcgcaccgccgttcttcaaggaactggtgcagtacgcggaagaaggctcgtactcgtggcactgtccgggccactcgggcggcgtcgcgttcctgaagagcccgctcggccagatgttccaccagttcttcggcgagaacatgctgcgcgcggacgtgtgcaatgccgtcgacgaacttggccagttgctggaccacacgggccctgtcgcggcttccgaacgcaatgcggcgcgcatcttcagcgcggaccacgtgttcttcgtgaccaacggcacgtccacgtcgaacaagatcgtctggcacggcacggtagcgccgggcgacatcgtgctggtggaccgcaactgccacaagtcgatcctgcacgcgatcaccatgaccggcgcgattccggtgttcctcacgccgacgcgcaacaacttcggcatcatcgggccgattccgcgcagcgagttcgagccggaaaacatcaagaagaagatcctcgcgaacccgttcgcgcgcgaagcgctcgctaagaatccggacctcaagccgcgcatcctgaccatcacgcaaagcacgtacgacggcgtaatctacaacgtcgagatgatcaaggaaatgctcggcgactggctcgacacgctgcacttcgacgaagcctggctgccgcacgctgaattccacgagttctatcaggacatgcacgcaatcggcgcgggccgtccgcgtattggtgcgatggtgttcgccacgcactccacgcacaagctgctggccggcatttcgcaggcttcgcagatcgtcgtgcaggattcgaagaacagccgcttcgacaagcatcgtttcaatgaagcgtatctgatgcacacgtcgaccagcccgcagtacgcgatcatcgcctcgtgcgacgtggccgcggccatgatggaagcgccgggcggcaccgcgctcgtcgaagagtcgatcgcggaggcgttggacttccgccgcgcaatgagcaaggtcgacgccgaatacggcgacgactggttcttcaaggtgtggggcccagaccagttcgccgaagaaggcatcggctcgcgcgaagactggatgctgcgtccgaacgatccgtggcacggtttcggaccgctcgccgacggcttcaacatgctcgacccgatcaaggcgaccatcgttacgccgggtctggatatggacggcggcttcggcgagtcgggcattccggccgcgatcgtcacgaagtatctggccgagcacggcatcatcgtcgagaagaccgggctgtattcgttcttcatcatgttcacgatcggcatcaccaagggccgctggaattcgatggtcaccgaactgcagcagttcaaggacgactacgacaacaaccagccgctgtggcgcgtgctgcccgagttcgtctcgcatcatcccatgtacgaacgtgtgggtttgcgcgatctgtgcgagcagattcacagcgtctaccgcgcgaacgacattgcgcgcctgacgaccgagatgtacctgtcgagcatggaaccggccatgaagccgtccgatgcgttcgccaagctcgcgcaccgcgagatcgaccgcgtgcctatcgacgaactggaaggccgcgtcacgtcgatcctgctgacgccgtatccgccgggcattccgctgctgatcccgggcgagcgcttcaacaggaccatcgtcaactatctgcgtttcgcgcgcgagttcaacgagcgcttcccgggtttccacacggacatccacgggctggtcggcgaaacgatcaacggacgcatcgaatacttcgtcgattgcgttcgcgcc

SEQ ID NO: 30897 - DNA, 1446 bp, Burkholderia cepacia
tcgcgctggctgcaggtgttcgaccagacccgcgacgcgatcagcgtgctgcttccgctgctgttgatcggcggcatggtgtggttcatgcggcgcgaaatgcgcggcggcgcgaggcttctcgacagggcgcccgcgctgcgtttcgacgacgtgatcggcgcgtctgaagcgaaggcggcactcgcggatattcgcagctatctgtccgacccgaaacagttcacgtcgatgggcgtgcgcgcgccgtgcggcattctgatggtgggcggccccggagtcggcaagacgcgcctcgctcaggcgctggcgggcgagtgcggcgcgaacttcatttctatcacgggcagctacttcagtgcgaagtactacggcgtcggcatccagaaggtcaagcatctgttcgaactggcgcgcaagaatgcgcccacggtgattttcatcgacgaagccgacggtctcgccaaacgcacggatacgggcagcggtccggtcgaagccgagagcaaccgcatcatcaatcagctgctggcggagatggatggcttcgcttcgaacgaaggggtcatcatcgtcgcggcgaccaatcatcccgacaatctggacgaggcattgcgccggcccggccgtttcgatcgcacggtgcaggtccgtttgcccgatcgcgaagaccgcgcgaagattttccgcttctatgccgcgaagctgaagtcgaagtccgcggacatcgactatgaccagctggcgagactgaccacgggcctgtcgccggcaacggtggcgatggtggtgaatcaggcggggctcgtcgcgcgcaaatccggcgacacagaaatcgcttcgaagcatttcatggaagcgatcaagattgcgcgcatcggcgacgtgagcggcgccgagcgcgcactgagcgaagacgagcgcacgcgtatcgccgtgcacgaagcgggacatggtctcgtggccgcgctgctgggtacgggggtgctcgaagaagtcacgatcctgccgcgcggcggcgcgttgggcgtcgcgctcattacgaaagcgcaagacaagcacctgtatcgcgagagcgagatccgcaatgaaatccaggtcctgctcggcggacgcaacgcggaaattatctcgttctccgaagcatcgagcggcgctgcttccgatctgcaggaggcctcgcgcatcagcctggacatggtgtcgaaattcggctttaacgccgacggcaatctgttcagccttgcggcgctgccgtcgcaatatgcagggttgcagatgaagggtgcgatcgaacacgcgaacgtgctgctcaaggaattgaacgagtcgtgccatgcgctgctgcatgcgtacgaaccggtgctgcgcgccattgctgacgaactgctcgaacaggaaaccgtgcccggagaaaccgtgtaccggttgatccgcgaacacaaa

SEQ ID NO: 30898 - DNA, 2457 bp, Burkholderia cepacia
aagttgccgtacacgtcgcgcgtgctggcagagaacctcgtgcgccgctgcgacccggtcacgctcgttgcttcgcttaaacagatcatcgaacgcaagcgcgaactggattttccgtggttcccggcgcgcgtggtctgtcatgacattctcggccagaccgctctggtcgacctcgccggtctgcgcgacgcgattgccgcgcaaggcggcgatccggcaatggtcaaccccgtggtgccgacccaactggtggtagaccattcgctcgccgtcgagtgcggcggtttcgatccggatgcgttcgcgaagaaccgcgcgatcgaggaccgccgtaatgaagaccgcttcgacttcatcaactggaccaggcgtgcgttcaggaacgtcgacgtgattccgccgggcaacggcatcctgcatcagatcaacctcgaacgcatgagcccggtggtgcaggtgaaagacggcgtggctttccccgatacgctggtcggcaccgactcccatacgccgatggtggacgcgctcggcgtgatcgccgtcggcgtgggcggactcgaagcggaaagcgtgatgctgggccgcgcgtcgtatatgcgcctgccggatatcgtcggcgtggaactgaccggcaagccgggcgaaggcattacggcgaccgatgtcgtgctctcgttgaccgaattcctgcgcaaggagaaagtggtcggcgcgtacctcgaattctttggcgccggcacggccaacctcacgctcggcgaccgcgcgaccatcgccaacatgtcgccggaattcggcgccacggccgcgatgttctatatcgacgaacagaccatcaagtacctcaagctcaccggccgcgacgacgagctcgtcaaactggtggaaacctacgcgaaggaaaccggcctgtgggcggacagcctcaagcatgcggagtacgaacgcgtgctgaagttcgacctctccaccgtggtgcgcacgctggccggtccgtccaatccgcatcgccgtttgccggtgtcggagctggcggcgcgcggcatcagcggcaaggtggagaacgagcctggcctgatgccggacggtgcggtgatcattgccgctatcacgagctgcacgaacaccaacaatccgcgcaacatgatcgcggccggtctgctggcgcgtaacgcgaaccggcgtggactgacgcgcaagccctgggcgaagacttcgctcgcgccgggctcgaaggcggtcacgctatatctggaagaagcgggactgttgcacgatctggagcaactgggctttggcgtggtcgcgtatgcgtgcacgtcgtgcaacggcatgtccggtgcgttggacccggcgatccagaaagagatcgtcgatcgcgacctgtatgcgacggccgtgctgtcgggcaaccgcaacttcgacggccgcattcatccgtacgcgaagcaggcattcctcgcgtcgccgccgctggtggtggcttatgcgattgcgggcacgatccgcttcgacatcgagaaagacgtgctcggtatcgacgccgacggtcacgccgtcacgctgaaggacatctggccgtcggacgcggagatcgatgcgatcgtggcgtcgagcgtgaaaccggagcaattccgcaaggtgtacgagccgatgttcgcggtcacggtcgacacgggcgagaaggccagcccgctctatgactggcgccccatgagcacgtacattcgccgtccgccgtattgggaaggcgcgctcgccggtgagcgcacgctcaagggcatgcgcccgctagccgtgctcggcgacaacatcacgaccgatcacctgtcgccgtccaacgcgattctgccggacagcgcgtcgggtgaatatctggcgaagatggggctgccggaagaagacttcaattcctatgcgactcaccgcggcgaccatctgacggcacagcgcgccaccttcgcgaaccccacgctgaagaacgagatggtgctcgaagacggcaaggtgaaggcgggttcgctggcgcgcatcgagcccgagggcaaggtcacgcgcatgtgggaagcgatcgaaacctacatggaacgcaagcagccgttgatcgtgattgccggcgccgattatggccagggttcgtcgcgtgactgggcggcgaagggcgtgcgtcttgccggcacggaagcgatcgtcgcggaagggttcgagcgcattcaccgcacgaatctggtgggcatgggcgtgctgccgctggagttcaagcctggagtgaaccggctcacgctcggtatcgacggcacggaaactttcgacgtgatcggcgagcgcaagccgcgcacggatctcacgctggtgattcatcgcaaaaacggtgagcgcgtggaagtgccggtcacgtgccgcctcgataccgccgaggaggtctcgatctatgaggccggcggcgtgctgcaa

SEQ ID NO: 30899 - DNA, 1164 bp, Burkholderia cepacia; identical to SEQ ID NO: 28139

SEQ ID NO: 30900 - DNA, 1404 bp, Burkholderia cepacia
tccggtaacggggagtcgttcgaatcgatcaatccgatcgatggctcggtggcggcaacgcttgcgcaggcaagcgagtccgatgtcgacgacgccgtgcgggctgcgcgtcaggcactcgaaacgccggcgtggcgcgacatgaaggtccatgagcgaggcaagctgctgcacagattcgcggatcttatcgatcagaacgccgagacgctagcgcagatccagacccgcgacaacggcaagaccatcagcgaaagccgctttcagtcaaagtcggccgccgacatgttccgctacttcgcagcggtctgcgagacaacggagtcgtccgtcattccgtcgcgaggcaattacttctgtttttcgtcgttcgagccggttggcgtggtggcggccatcgcaccctggaactcgccgatcacgctcgaagcgcagaagctcgcgcccgcgctggcggccggcaacgcaatcgtgttgaagtcctctgaagtgacgccatgcattggccttcaatacggccgccttgccatggaagcgggttttccgcccggcatcctcaacgtggtgacgggcttcggagcgtccgtgggacgcgcacttgtggcgcatccgggcgtcgacatggtgacattcacgggcggcacgaagagcggcagggagatcgcgaaggtcgcgggcgagcgcctgattccctgcattctcgaactcggcggcaagtcgccgaatattgtcttcgacgacgccgatatcgagcaggcggtgaccggcatgctgttcggcatcttctcgaatgcggggcaatcgtgcattgcgggttcgcggatcctgatacaggaaggcatctacgacgctttcgtggcgcgtcttaccagtgcaacccgcgcgctcaaggtcggttcaccttacgatgcggatacagccgttgccccggtttcgagttttcatcatcgtgaccacatcgagcatttcgttgagcgggcgctcagccagggcgcagtcgcgctctgtggcgggagccggccgagcggcggcatactggacaagggcgcctatgtgcaaccaacgcttctcgaagtcaccgacgaacgcagcagcgtcgcccacgaggagatcttcggtccggtagcgtgcgtgatgaagttccaggatgaagaggacctctaccgcatcgcaaacaacacagcctacggcctcgcgtgcggcatctggacggcagactataaaaaggccttccgggcggcccgccgcatcaaggcaggcacggtatgggtcaacacctacaagatcgccgaggtcaacgtgccgttcggcggcttcaagcaaagcggtcttgggcgcgaatgcgggattgaaggcatgcgggaatatatgctggaaaaaagcacctatctcaacctggcggac

SEQ ID NO: 30901 - DNA, 1300 bp, Burkholderia cepacia
ggcgacgcgcacgaggctgacgaatgagctgacctatcaaacggggttcggcaacgagttctcaactgaggcaatcagcggcgcattgccgattggacagaacaatccgcaaaaacccgcattcggactgtacgcggaacaattgtcgggcacgtcatttaccacggcccgcgcgacgaatctcagaacctggatgtatcggatacgaccttcggtgctgcaagggacgtatcggcttattcgcaaggactccaacgctctggcgccgctggacgttgcaccgctgcctgaagcgcagcgatggaacccgcaaccgctgccggatacgccggtcgatttcgtagacggcttaaacacgctcgcgatcagcggcgaccccgctaccctttccggcgccgccgtgcatttgtatgcggcaaccatcgacatggaccgcaaggcgttcgtgaataccgatggcgagatgcttataatcccgcagcagggaacgctatgcctcattaccgaattaggcatgctaaccgccaaaccgcgcgagatcgcggtgatcccgcggggcctgaagttcgcggttcatttgccggacggcccaagccgcggctatgtctgtgagaatcatgggagtgctttcaggctgcctgatctcggcctgatcggcgcgagcgggctggccaaccgccgcgatttcctgactccggtcgcgcgattcgaagacagtgatgccgcacacgaactcattgccaagacaggcggccaactgtggtcgacgacgctcgatcattcgccattcgatgtggtcgcctggcatggcaacgtcgcgccttacaaatacgacctcgatcgtttccagtcgatcggctcaatctcattcgaccaccccgatccgtccatttataccgtgctgacttcgccgtccgacacgcccggcacggcgaacgcggatttctgcgcgttgacgacgcgctgggcggtggcggaacacacttttcgtccgccttattttcaccgcaacgtaatgagcgaattcatgggcctgatctgcggcgcgcacgacgccaaagcaggcgggtttgttcctggcggagcaagcatccataacgcgttcaccccgcacgggcccgacgccgaaacctaccgccgcgcgcgcgataccactctcgaacctcacaagatcacggaatcgatcgcgttcatgtttgaaacgcggctgcccctgcgcctgaccgcctgggccgtgcaaacgccacaacgacaacacgactaccagcaatgctggtcggcgctcgctaaacagttcgat

SEQ ID NO: 30902 - DNA, 1104 bp, Burkholderia cepacia
gagtcactgacgcagcaggccggcgacgtcggcgcggtcgtgatgggcccgcgctcgagtggtggcgtcgcgatggataaaccgcaggcgatcaagttcaccggcggcacgaccggatttccaaaaggcgtgatccagccgttgcgggcatggaataccaatatcgccacgcagatccatgagcttggcctgaaacctgacgaccggtatctggttgccgcgccgctgtcgcatggcacatcgacgtatctgctgccattgctgggcgttggcggtgcgttgatcatccccccggagcaggcaaaggcggccgcgctgctggacgcagccgatgctcacggagcaacgattcttttcgcgccccccacgctgatcgttgcccttgcggaagagcagcgccggtcgccgcggttgctacgacgcctccgatatcttgtgtatggcggcgcgccgatgcgcgcggaacagatccgcgacgctcagtcggtgtttggcccggtgctgtgcaccacgttcgggcaaacggaagcacctcagatcattacgtttttaccgccggccgaaatgaatggcgatacgctgacttccgtgggacggccatcgctgctcaccagggtggccatcatgaacaaggacggcgagcctgttgagacaggccagcagggagagatcgcggtgcgcggcgatctggtgatgagcggctaccttaaggccgaggacgaaacacgcaagacgcttgtcgacggctggttgcgcacgggcgatgccggggtcttcgacgaacgaggctacctttttctccgcgaccgcatccgcgatgtgatcattaccggaggctttaatgtctaccccagcgacgtggaagcggtgctatcggcgcaccccgccgtggccgactgttcggtagtgggtgtcccggatgcaaagtggggcgaagcggttcatgccgcagtgcaactgcgctcgggcatgcaagtggataccgccgatctggttgccctcgtcaggcgcgagttgggcccggtcaagacgcccaggcatgtgcatctgttcgagtcgttgccgcgcagcgccgtgggcaaggttctgaagacagaagtccgt

SEQ ID NO: 30903 - DNA, 975 bp, Burkholderia cepacia
ggtctcgataaacttgtgcgacgtgaagtgccccgtccggtaccgaaggcgggcgaaatcgtcgttgaagtcaacgcggtctcgctcaactatcgcgatgccgaagtggccgaaaacggcatgggcaacgcgctgagttttccattcacaccggcttccgacatggccggccgcatcgtcgcagtgggcgaaggcgtcacgcgcttcgcggtcggcgatcgggtcatttcggcctacattccgggttggatagatggtgtgccgctatcgtggacggtagcgccgacccaaggcggcccgatcccaggggtgctcgcgcaatatgtcgccgcgccggccgaatggtgtgtgcgtgccccgcgcaccttaagcgccgtcgaagccagcacgctgccggttgcggcgctgaccgcatggatggccctggttgaactgggcaacctgcatgcaggccagaccgtcgtcgtgcaaggcacgggcggcgtatcgctgtttgcggttcaattggctgcggctcacggcgcgcgggtgattgtcacgagcggcagcgacgagaagattgcccgggcgatcgccctcggcgcacgtcatgggatcaatcgcaacacgacgcccgactggcagcacgcggtgctcgaactgactggcgggcgcggcgccgaccatattctggaaatgaccggcggcgacaatgtcgagcgctccttgcaagccgtcgtgcaaggcggacgcatttcggtcatcggccttctggactcggaccggctcagcctgcccattctttcactacttgccagccgtgcctcgattgtcggcatcgccgtcggaccgcgccgcgcgctcgaggacctggtgcgtgccgtcgatctgctgggaatcaggccggtcatcgacgccacctatgcgtactcgcaggtgccggaagccttcgtgcatctgcgacgcggagcgttcggcaaaattgtggtgcagttg

SEQ ID NO: 30904 - DNA, 1374 bp, Burkholderia cepacia; identical to SEQ ID NO: 28144

SEQ ID NO: 30905 - DNA, 1596 bp, Burkholderia cepacia
tacgactacatcatcgtaggcgcaggctcggccggctgcgtgctggcgaatcgcctgtcggagtccccgtcgaacaaggtgttgctggtcgaggccggcgccggcgaccgacatccatacatcggcattcccaaaggcatcgcgaaactgcgcatgcatccaaagtactcatggcgcctgcccactgagccgacgctcggccgtgcgcaaggcgaattctggccacgcggccgggtgatcggcggcaccagttcgatcaacgggatgttctacatccgcgggcaacccgaagactatgacgagtgggagacgctgggcgccaaaggctggggctggaaggacatcgcgccctgcttcaggaaaatggaggatcacgaactcggcgaaacgccattgcgcggtgtcggcggcccgttgcacgtaacgctgccgtaccatgaacatccgccgctaaacgaagcgtttttgcaggctggcgagcagattggattgccgcgcaaggaggacttgaaccagggtgatcaggccggcatcggctactatccggtcaacatgtggaaaaaccggcgctggagtgcggccgacgcgcatctgcggccggcactgaagcggcccaatctgaccgtgctaaaaggcgtccatgtcgatcgcgtgctgttcgacgggcttcgcgcagtcggcattgccgcccgcatcggcgacgcacgcaaggaatttcgtagccgcggcgaaatcatcctgtcggccggcaccttgaagtcgccacaaatcctgcagttgtccggggtcgggccgggcgacgtgctgcgcgccgcaggggtgccaatagtcgcagatcgtgccgacgtgggccgcaacatgctggaacacctgagcatgacggtagtgaaccggctcgtcggtacggccggagaaaaccgcgagtaccggggctggcggctcgcgaagaacgcgctgaaatactatgtgcggcgcaacggcgtactgagttacagcacctttcccatcggcggcttcgcgcgctcgtcgcctgaactggagcgtgccgatatccagtttttccttggcggtctaagcttcgaaatgggcggcctgaaaagcgtcgcggcgcgcgtgcagaccggcaagctgccaggcctgacctgctttgcctatttcatgaagcccgaaagccggggcagcgtcgcgatcagcagcgcggatcccgacgcgccggcagtgatccggccgaactggctcgacacggagaatgaccggcaggctgcgatccgggtcgtgcgcttcatgcggcggatcgtccatgcaccagcactaaagtcgtatgtcggcgatgaggtaatgcccgggccggcgaccagcgacgacgacgacgcactacttgccgcctatacgcgtttcggtagcaccgccaaccacgcggtcggaacttgccggatgggcggcgacgcagcgtcggtggtcgacgggaggctgcgcgtacggggtgtcgagaatttacgggtggtcgactgctctgtgatccccacgccgatttccggcaacaccaacggtccggtgatggcgcttgcgtggcgcgctgcggacctgatcctgcaa

SEQ ID NO: 30906 - DNA, 1260 bp, Burkholderia cepacia
ttgctgtgcgtcatcggcttcgggctattccttgaattttttgacctgtacacgggcggcgccattgtcggcgtattgctcaaacagggatggtcgacactgcagctcaacgcgctcttcggcacgttgacgttcgcgggcttgaccgtcggagcgatgatggcggggattatcggcgaccgttacggccgccgcctggcctatcagatcaatctcgtggtgttcggcatcgcgtcgtttgcagcggcggttgcgccggacatgtactggctcagcgcaatccgcttcatgatgggtctcggtatcggcgcagaggccgttatttcgtacggcatgcttggcgagttcgtgccgccgggctttcgtggccgcatgctggcattcctgtcggtgttcggaaattccgcggtgttcgtcggttcgctggtcaatctctgggttattccccatctgggctggcgctacgtcttcgtcatcgcgggcattctcgccatcacgctgtggatcgtgcgccgctcgattccggaatcgccgcgctggctcgagacaaaagggcgtatcgacgaggcggaggtcgttctccaacggatcgagcgcagcgtcgcgcgcggcggtgaactgccttcgtatgcacacgaagtgcccgcgccaacgccgcaagtgtccattggcgtgttattcacgccgccgatacttgtgcgtacgctcgtcggttcagccattcttgtctgcatcggcttcagcatctatgggctgatcaactggctcccgacgttcttcatccagcagggcttcgatatcgtcaagtcgctgacatggacgacggttatcacgctgggcggcccggtgggctccctgctcggcgttgcggtgtcggatcgggtcggccggcgtcccgcgatcatcgcgtcgtgcgtcgttacagcggtttgcggcctgatttaccagcaggtcgactcggctttcgcgctgatgggggtgggcttcctgctggtgtgctccatctatgtgctggtggcggttggacaaggcgcttacgtacccgagctgttctcgacttcgtaccggttgcgggggacgggcgtttgcatgaccgcgggacggctcgccagcgcaggctgccaattcttcattctctggctgttcacgaagggtggcgtactgatggtggtaggctcggtcgtcgcggctcagcttttactggcgttcgccgtgtgggcgatacggatcgagacccgtggcaagcggctcgaagatctc

SEQ ID NO: 30907 - DNA, 768 bp, Burkholderia cepacia
agatttgataataaggttgtcatggtgagcggttgcggctcctcgctgccgggctggggcacgggcaaggcgatcgccgcgttgctcgcgcgccagggtgcccaggtggtgggtctcgatgtgaacgaacaggcgcttgcggacacgcgtgctgtcatcgaaggtgagggcggcaagctgaaggcgctgttatgcgacgtgaccgacccggcgagcattgaccgggtggtgcgcgagacgattgacgcgtacggccgtatcgacgtgctggtgaacaatgtcggtgtctccgcgccaggcggtgtagtcgatatgaccgaggagatatgggaccgccagttcgacatcaatctgaagagcgtattcctgatgtgcaaggcggtcttgccgctgatggacaggcaacgcggcggtaacgtcgtcaacgtgtcgtcgctttccgcgttgcgctatagcggcaaaccgcagattgcctactcggcgagcaaggcggcgctgattcaattcacccggatggcggccttgatgcacagcgaacacaatgtgcggctcaattgcgtgatcccgggcctcatcacgacgccgcttgtgcagcggctcgcgcagcagttcggcggcggcgattacgagagttatctgaagcgccgcaatgcgcaggttccgctggcgcaggagggggacgcctgggacgtcgccaatgccacggcttttctggcttccgacgaagcgcgctacatcacggcgacggaaatcctggtcgatggcggg

SEQ ID NO: 30908 - DNA, 783 bp, Burkholderia cepacia
gcaggaagattgcagggaaaggtcgcgcttgtcacgggtgccggatgcatcggcccgggttggggcaacggacgcgcgatcgccgttcgctttgccgaggaaggcgcgcatgtgattgccgttgatcgtgacctggcctcgatggacgcgacgctcgaactcgtccgcgctgcgggcgggagcgtaacgccctgcctgtgcgacgtgactgacagtgcgtcggtcgagcgcctcgtcgccgacagcgtggcacgctgcggacgcgtcgatatcctcgtgaacaatgtcggcgctccgtcgccgggcggaccggttgcgcttgacgaggcgcagtgggcgatgcaactcgaactgaatctgacgacggcattcctgatgtgcaaatacgtgctgccggtgatggaacagcagggcggcggcgcgatcgtcaatatcgcctccacctcgggcatccgctggacgggcgcggcgcaggtcggctatgccgccgcgaaggccggcatgatccagatgggccgcgtcgtggccgtcgaatatgcggcgaagaacgttcgtgtcaattcggtagtgcccggtctgctgcatacgccaatggtcgatacgaagatcgcacacaaccaggccggcggcgatgtcgagttgctgctcaggaagcgccaggcgcgcattccaatgcctttcatgggagacggccgcgacacggccaatgcggcgctctttcttgcatcggatgaagcgcgttttgttaccggcaccgaaatcgtggtcgacggcgggatgagc

SEQ ID NO: 30909 - DNA, 1776 bp, Burkholderia cepacia
agctatacggcacccatcaaggacatgctgttcgtgatgaaagaactggccggtctcgaacacatcgcgacgctgccgggcttcgaagatgcgaacctcgacaccgcgcaggccgtgctcgaagagtcggcgaaactgtgcagcgaagtgctggcgccgctgaatgtcgaaggcgatcgcaatccgagtagctggaaagacggcgtggtcaccgcaacgcctggcttcagggaagcgtttcgccagttcggcgaaggcggctggcaaggcgtgcagcatccggtccactacgaaggccagggtctgcccaagctgattgccacagcctgtatcgagatgctcaacgcgtcgaacctgtcgttcgcgctgtgcccgctgctcaccgacggcgcgatcgaggcgctcctcaccgctggcagcgaggagcagaagcagacctatgtgcccaggctgatttccggcgaatggaccggcacgatgaacctgaccgagccgcaggccggctccgatctcgcgctggtgcgcacgcgcgccgagccgcagggcgacggctcgttcaaactgttcggcacgaaaattttcatcacgtggggcgagcacgacatggcgaagaacatcgcccatctcgtgctggcgcgcacgccgaacgcacccgaaggcgtgaagggcatttcgctgttcatcgtgccgaagtttctcgtcaacgaagacggttcgctcggcgagcgcaacgacgtgcactgcgtgtcgatcgaacacaagctcggcatcaaggcgagcccgaccgcggtgctgcagttcggcgaccacggcggcgcgaccggtcatctgatcggcgaagagaatcgcggtctcgagtacatgttcatcatgatgaacgcggcgcggtttgcggtgggcatgcaaggcatcggcgtgtcggatcgtgcgtaccagaaggcggtggcatacgcgaaagaccgcgtgcaaagccgtcccgtggatggctccgcgaaacagccggtcgcgatcattcagcaccccgatgtgcgccgtatgctcgcgaccatgcgtggtctcaccgaagcatcgcgcgcgctcgcttatgtggccgcggctcattgcgatatcgcgcaccgtcacgcggacgaagccacgcgcgcccaacaccaggcgatctatgaatacctcgtgccgatcgtgaagggctggagcacggaactgtcgatcgatgtgacgagcctcggcgtgcaggtgcatggcggcatgggcttcatcgaggaaacgggcgccgcgcagtactaccgcgacgcgcgcattctgcctatctacgaaggcacgaccgcaattcaggccaacgacctgatcggccgcaagacggtgcgcgacggcggcaaggtggcgaagtcgctgctcgccggggtggctgaaacggttgaagcgctcggcgcgcagcaaggtccggcgttcgcgtcgatgaagaagtatctcgcacagggtcatcgctcgttgagcgcggtggtcgagttcgtggttgcgaatacgaagagcgatccgaatgcggtgttcgccggcagcgtgccgtatctgaagcttgccggcatcgtgctcggcggctggcagatggcgcgtgcgctgctcgtggcggcagagaagcgtgacgaagacccttcgttctacggcgccaagatcgcgaccgcgcagttctatgccgagcatgtgctgccgctggcgtcggcgctcgaagcgtcgattgtcagtgcgaagggtggcgagagcgtgctggcgctgtctgaa

SEQ ID NO: 30910 - DNA, 825 bp, Burkholderia cepacia; identical to SEQ ID NO: 28150

SEQ ID NO: 30911 - DNA, 1380 bp, Burkholderia cepacia
atgaaaatcaccattatcggcacgggctacgtgggtctcgtcactggcgcgtgtctcgccgagatcggccacgacgtcttctgtctggacgtcgatccgcgcaagatcgaaatcctcaataacggcggcgtgccgattcacgagccgggcttgcaggagatgatcgcccgcacacgcgcggcgcgccgcatcacgttttccaccgatgtcgaagccggcgtcgcgcacggcgacgtgcagttcatcgccgtcggcacgccgccggacgaagacggttcggccgatctgcaatatgtgctcgaagcggcccgcaacatcggccgcaccatgaacggcttcaaggtgatcgtcgacaaatcgacggtgccggtcggcaccgcgcagcgcgtgcgcgcggtggtcgaagaagagctggccaaacgcggacttgccggcagcgcgcaacacggcttctcggtggtgtccaatcccgaattcctgaaggaaggcgcggcggtcgacgacttcatgcgccccgaccgcatcgtgatcggcctcgacgaagacgaagccggctcgcgcgcgcgcgaactgatgaagcgtctgtacgcgccgttcaaccgcaatcacgaacgcacgctgtacatggacgtgcgctcggccgaattcacgaaatacgcggcgaatgcgatgctcgccacccgcatctcgttcatgaacgaaatgtcgaatctggcggaccgcgtcggcgcggatatcgaggcggtgcgccgcggcatcggttccgatccacggatcggctatcacttcctgtatgccggttgcggctatggcggctcgtgcttccccaaagacgtccaggcgctgatccgcacggccagcgaaagcggccacaatctgcgcattctcgaagcggtcgaagaagtgaacgacaggcagaaagacgtgctggtgcacaagatcacgagcaagctcggcaacgatctgagcggccgcacgttcgcggtgtggggtctcgcgttcaagcccaataccgacgacatgcgcgaggcgccgagccgccgcctgatcgcggaactgctggcgcgcggcgcgcatgtgcgcgcgtacgatccggtcgcggtgaccgaagcgcgccgcgtattcgccatcgacctgcatgacgcaccggagcagttcgcgcgtctcaccttcgcgaccacgcaggacgaaacgctcacgggcgccgacgccctcgtgatcgtgaccgaatggaaagaattcaagagcccggacttcgtccatctgaaatcggtgctgaaatcgccgctgattttcgacggacgcaacctgtatgaaccggacgcgatgaccgagctcggcatcgactatcactcgattggacgcccttatgcccaaccc

SEQ ID NO: 30912 - DNA, 1272 bp, Burkholderia cepacia
ttgtggcgcaagaactttctgctcggcgcggccacggcttcgtatcagatcgaaggcgcggtgaacgaagacggccgcctgccgtccatctgggacaccttctcggcaatacccggcaaggtgctggccggcgacaccggtgccgtggcctgcgatcactatcatcgctgggaagcggacgtggacatgctggccgggcttggcttcgaaggctaccggctctctattgcctggccgcgcgtgatggatacggccggcgtgccgaaccgcaaagggctcgagttctacaagcgcctgctggcacggctcaaggagaagggcatcgcgaccttcgtcacgctgtatcactgggacttgccgcagcatctggaagatcgcggcggctggctgaaccgcgataccgcataccgtttcgccgactacgccgacctcatgagccgcgaactggccggcagcgtggacggttggatgacgctgaacgaaccctggtgctcggcgtatctcggctacggcaacggccatcacgcgcctgggcttgccgacgcgcgctatgccacgcaggccatgcatcatttgctgctggcgcacggtctcgccatgccggtgctgcgcgccaacgatccggcttcgcagaagggcgttgtcgccaacattggacgcggcacggccaacagcgggagcgccgccgatcagcgcgcggcgcatctgttcgaggtgcagcacaacgcgtggattctcgatccgctgctggaaggccgctacccgcgggatctattcgaactgtggccgggtaccgagccgctggtgctggacggcgatatgcaaaccgttgccgcgccgctggacttcctcggcatcaactactatttccgcaccaatgttgcgagcgacggtgcgcatggtttcagggaagtgccgctccaaggcgtggagcgcacgcagatgggttgggaagtgtatccggacggcttgcgcgatctgctgatcggcttcaaggccacctaccggaatctgccgccgatctacatcaccgaaaacggcatggcatcggacgacaaggtgatcgacggccgggtggatgacatgcaacgcatttcgtttctgaagcgccatcttgccgcggtggatgaagcgatcaaggcaggcgtggagattcgcggctattttctgtggtcgctgatggataacttcgagtgggcgttcgggtacgagcggcgctttggtgtcgtgcacgtggattacgctacgcagaaacgcacggttaaacgcagt

SEQ ID NO: 30913 - DNA, 1482 bp, Burkholderia cepacia
attcgcattctttccgaagtcgaaaccttcctcgcacgccagcacagacagtacattgacggccaggcggtagcagcgatggacacggttgcgaccgacatcatcaacccgtcgaaccggaaggtcgtcgcgtcggtacgtcaggccacacctgcccaggttcagcacgccgtggcgagtgcgcacgaggcttttaccggcgtgtggcaacagacctcggctgcgcgccgcggcgaactgctgaaccgtcttgccgatctgatgcaggcgcatcgcgaggaactcgcacaaatcgaaagcctctcatcgggcaagctcatcggcctgtcgcgcgcgttcgagatcgactactcgattgcgttcctgcgctattacgccggctgggcgacgaagattcatggccagacaatgaacctgtcgctgccgtcctcgaacggtgaacagtatacgggcttcacgctgcgtcagccgatcggcgtggtggccggcatcgtgccatggaatttctcgatcatgattgcggtctggaagttcgggtccgctcttgcctgcggttgcacggcggttatcaagccaagcgaattcacgccgcttacgatgctgcgggtcgcagaactcgcccttgaagcggggatcccgcccggggtgctcaacatagtgaacggcaacggcaggacggtcggcaccgcgctgattgcgcaccccaaagtcgcgaaagtcacgttcacagggtcggttccgaccggggtgggcgtcggcgtggccgcgatgcaggccggactcaagcacgtcacgcttgaactcggcggcaaaaacccggcgggcttcctgcgagattttccagtcgagcgtacggtggacggcatcatcgaggcggcctacttgcaccagggcgaagtctgcgcatcggccgaacggttctatgtgcaccgctcgcgcatcgacgacgttctggaggctctacatcacacgctcgcgaccctaaaaattggctccgcgctcgatgaaagcgcgcagttcggcccgctggccaacgccgcacacttcgccaaggtgatggcgttcttcgaaaaggcgcgcgcgcaggatggagagatcgtccacggcggcacagtcgcaccaggcgacggcttcttcgttcagcccacggcaatccctgcccgttcgcaagccgacaccatcatgaccgaggaaacgttcgggccggtcgcgagctttctcgcgtacgacgacgaagaagaaatgctgcactacatgaacgacacgcacttcggcctcacggcaagcatctggactaatgacctctccaaggcattgcgctttgtgccgcgtgtggaagcgggtacggtgtgggtcaacatgcacaactatatcgatccagccatgccgttcggaggcgtcaagtcctccggtatcggccgcgagttcggcgaggcgttcatcgagtacttcacggaattgaaatcagtgatcgtccggtat

SEQ ID NO: 30914 - DNA, 1614 bp, Burkholderia cepacia; identical to SEQ ID NO: 28154

SEQ ID NO: 30915 - DNA, 876 bp, Burkholderia cepacia; identical to SEQ ID NO: 28155

SEQ ID NO: 30916 - DNA, 798 bp, Burkholderia cepacia; identical to SEQ ID NO: 28156

SEQ ID NO: 30917 - DNA, 942 bp, Burkholderia cepacia
ccaccccacacgcttgtgattgcgtcgcgagagagccgcctggccatgtggcaagcggagcatgtgcgatgtgcgctgcacaaattatatccatcttgtgacgtaaaaatcctcggaatgacaacacgtggcgatcaaattctcgatcgcactttgtcgaaggttggcggcaagggcctcttcgtcaaggaactggaagccgcgcttgccgacggccgcgccgatctcgccgtgcattcgctcaaagacgtgccgatggcattgcccgaaggctttgcgctatccaccatcatggaacgcgaagatccgcgcgacgcactggtttccaatacgtacgactcgcttgccgcgttgccggaaggcgccgtggtcggcacctccagcctgcgccgcgaggcgatgctgcgcatgcgctatccgcatctcgaagtgcggcctttgcgcggcaatctggacacgcgcctcgccaaactcgatcgcggcgattacgcggcgatcattctggcggcggccgggctgaagcgcctgggtctcggcgagcgtatccgcgcgttgctcgatcccgaagacagcttgcccgcagcggggcaaggcgcgctcggcatcgagattcgcgccgaccgcgcggaactcgcggcatggctcgcgccgctgcatcacgaacacacggccgcagccgtcgaagcggagcgcatggtctcgcgcgcgctcggcggcagttgcgaagtgccgctcgccgcctatgccacatggcatgacggcgcgctgcatctgcgcggcatcgtggcgacgccggacggccagcgcgtgctgagcgcgcaggcgtcggcgccggcaaccagcgtcgagcaggctatcgcgctcggccaggaagtcgcgggcgcgctcgagcagcaaggcgcgatggagatcgttcgcgcactcggcgccgccaacggcgcg

SEQ ID NO: 30918 - DNA, 2781 bp, Burkholderia cepacia
ctgttccaggacatccgttatctgggacgcctgctcggcgacgtgctgcgcgagcaggaaggcgacgcggtgttcgacgtggtcgaaacgatccgccagacggccgtgcgctttcgccgcgaagacgacagcgccgccgcgcagacgctcgacaagaagctgcgctcgctgagcccggaacagacggtcagcgtggtgcgcgccttcagctatttttcgcatctcgcgaacattgcggaagaccgccaccgcaatcgccgtcacaggattcacgaactggccggctcgacctcgcagccgggcacgattgcccactcgctcgaacgcctcgtcgaagccggcgcagccgccacgccggtcctgcaagagttcttcaacaacgcgctgatcgtgccggtgctcaccgcgcacccgaccgaagtgcagcgcaagagcattctcgacgcgcagcacgacgtcgcccggctgctcgcggaacgcgaccagcagttgaccgaccgcgaacgcgcgcacaacgaagcgatgctgcgcgcccgcgtcacgtcgctgtggcaaacgcgcatgctgcgcgattcgcgcctctccgtggccgacgaaatcgaaaacgcgctgtcgtactaccgcgccaccttcctcgaagaaatcccggcgctctacgccgatatcgaagaagcgctcgccgagcacggcctcgaagcgcgcctgccgccgttcttccagatgggcagctggatcggcggcgaccgcgacggcaatccgaacgtcacggccgaaacgctcgaaaacgcgatcacccgccaggccgcggtgatcttcgagcattacatggagcaggtgcacaagctgggcgccgagctgtcggtgtcgaacctgctggccggcgccagcgacgcgttgaaggaactcgcagccgtttcgcccgaccagtcgccgcatcgcacggacgagccgtatcgccgcgcgttgatcggcatgtacacgcggctcgcggcaagcgcgcgcgtgcgcctcggcgaaggcagcgtgccggtgcgcagcgcgggccgcggcgcggcgccggtgcgcgccaagccgtacgcggactccgccgaattcgtgcgcgacctgcacgtgctgatcgattcgctcgccgagcatcacggcgcgccgctcgccgcaccgcgtctgtcgccgctcgcgcgggccgctgaagtgttcggcttccatctggcgagcatcgacttgcgccagagctcggacgttcacgaggcggtgatcaccgaactgctcaggcgcgcaggcgtcgaagaaaactatgcggagctccccgaagcggacaagctcaacgtgctgctctcggaactggcgcagccgcgtccgttgcgtctgccgttcgcggagtattcggacctcgtgaagagcgagctcggcgtgctcgaagaagcgcgcgtcacgcgcgaaaagttcggcgcgcgcgcggtgcgcaactacatcatttcgcacacggagaccgtcagcgatctggtcgaagtgatgttgctgcaaaaggaaaccggcctgctgcgcggttgcctcggcaatgcgaacgatccggctcaagcgggtctgatggtgattccgctgttcgagacgattcccgacttgcgcaacgcgccgcatatcatgcgcgatctgatcgcactgccgggcgtcgatgcgctgatcgaacatcaaggcaacgagcaggaagtcatgctcggctattcggacagcaacaaggacggcggcttcctcacgtcgaactgggagttgtaccgcgccgaactcgcgctggtgtcgctgttcaacgaacgcggcgtgacgctgcgtctgtttcatggacgcggaggcaccgtgggccgtggcggcggtccgacctatcaggcgattctgtcgcagccgccgggcaccgtggacggccagatccgcttgactgagcaaggcgaagtgattgcgagcaagttcggcaatccggaaatcggccggcgcaatctggaaacggtggtcgccgcaacgctcgaagcgtcgttgctgccgcacggcatcgcgccggcgcaactgcccgcgttcgaagaaacgatgcagcagttgtccgacgcggcaatggcgtcttatcgcgcgctggtctacgaaacgcccggcttcaaggagtatttcttcgagtcgacgccgatctcggagatcgccgaattgaacatcggcagccgtccggcttcgcgcaaactgcaggatccgaagcaacgcaagatcgaagatctgcgcgcgattccgtggggtttctcgtggggccaatgccgtttgctgctgaccggctggtacggtttcggcagcgcggtcgccgcgcatctggacagcgcgccgagcgacgccgaacgcacccgccgtctcgcgctgctgaagaaaatgcacaagacgtggccgttcttcgcgaacctgctgtcgaacatggacatggtgctggccaagaccgacctcgccgtcgcctcgcgctacgccgcgctcgtgtcggacaagaagctgcgcaagcacgtgttcgagcgaatcgtcgcggaatgggagcgtacgtcgaaggtgttgtcggagatcacgggcaagagcgagcggctggcggagaatccgctgctcgcgcgttcgatcaagaatcgctttccgtatctcgatccgttgaatcacttgcaggtggagttgctcaagcgtcaccgcgcgggcgacaccaatgcgcgcgtgcggcgcgggattcatttgagcatcaacgggattgcggccggcttgcgcaatacgggc

SEQ ID NO: 30919 - DNA, 1359 bp, Burkholderia cepacia
tggtcggctcgcttctcggagccgatgtcggagctcgtcaaacgctacacgtcgtcggttttcttcgacaagcgattggcgctcgtcgatatcgaagggtcgctcgcgcacgcctccatgctggccgcgcagaagatcatcgccgccgacgacctcaccgcgatccaacgcggcatggcgcagatcaagggtgaaatcgagcgcggcgaattcgagtggcaactcgatctggaagacgtccacctgaatatcgaagcgcgcctgaccgcgctgatcggcgacgccggcaagcgcctgcacaccggccgctcgcgcaacgaccaggtcgcaacagacattcgcctgtggctgcgcggcgagatcgaccgcatcggcggcctgctcacggaactgcgcacggccctgctcgacatggcggagaagaacgccgcgactatcatgccgggcttcacgcacttgcaggtggcgcagccggtcacgttcggccatcacctgctcgcttacgtcgagatgttttcgcgcgacgccgagcgcatgatcgattgccgcaagcgcgtgaaccgcctgccgctcggcgcggccgcgctcgccggcaccagctatccgatcgaccgctacgcagtggcgaagacgctgggcttcgacggcatctgcgcgaactcgctggacgcggtgtccgaccgcgacttcgcgatcgaattcacggcggcgtcggcactcgtcatgacgcacatctcgcgcttctccgaagaactggtgctgtggatgagcccgcgcgtcggcttcatcgatctggccgaccgcttctgcaccggttcgtcgatcatgccgcagaagaagaacccggacgtgcccgaactcgcgcgcggcaagaccggccgcgtgaacggccatctgatcgcgctgctcacgctgatgaaaggccagccgctcgcgtacaacaaagacaatcaggaagacaaggaaccgctgttcgatactgtcgatacggtcgcggatacgctgcgcatcttcgctgaaatggtcgccggtatttcggtgaagccgcaagccatgcgcgacgctgcgttgcaaggcttctcgacggcaacggatctggccgactacctcgtcaagcgcggcctgccgttccgcgacgcgcacgaagcagtggcgctcgccgtgcgcgtatgcgcggatcgcggctgcgatctggcggatctgacgctcgaagaaatgcgcaaggaactgtcgaacgtcgcgcatctgattggcgaggacgtgttttcgtatctgacgctggaagggtcggtggcgagccgcaatcatccgggcggcacggcgccggagcaggtgctcgcagcggtgaaggcggcgcgc

SEQ ID NO: 30920 - DNA, 726 bp, Burkholderia cepacia
gaaaccagcaaggtcgccatcgttaccggggcctcccgggggatcggcgcctccatcgccaaacggctggcggccgacggcttgaccgtcgtcgtcaactactcgggcagcgatgccgccgccgctgcggtcgtcgaacagattgaagaagcaagcggccgcgcgcgctcggccaaggccgatatcagcgatgccgccgctgtacgccgcatgttcgaggccgccgaaaccgcctacggcggcgtcgacgtgctcgtgaacaatgccggcatcatcggcctcaaacccatcgcgtcgatggatgacgaaaccttcgaccgcatcgtcaaggtcaacctgaagggcaccttcaacacgctgcgcgaagccgccaaccggctccgtccgggcggccgcatcgtcaacttctcgaccagcgtggtcggcctctatcagccgacctatgcgatctacgcggccaccaaagccggcgtcgaagccatgacgcacgtgctgtcgaaggaactgcgcggccgcaacatcacggtcaatgccgtggcacccggcccgacggccaccgaactgttcttcgacggcaagaccccggaagtcatcgaccacctgaccagactggcgccgctcgaacgcctgggccagccggaagacatcgccaatgcggtcgcattcctcgcgggtcccgacggcgcctggatcaacggccaggtcctgcgcgccaacggcggcatc

SEQ ID NO: 30921 - DNA, 651 bp, Burkholderia cepacia; identical to SEQ ID NO: 28162

SEQ ID NO: 30922 - DNA, 873 bp, Burkholderia cepacia
gacctgagcggcaagaccatccttatcacgggtggtcactcggggatcgggcttagatccacgcgggtgctcgctgcggcgggtgcccgaatcatcgtcggtgcgcgcgacatagccaaggcgcgtaccgccctggccggcaccagggcgttgagttgctgggcctggatctgtccgatccggcttccatcacccgtttttcgacgcaggtgctgaaggttcatgaaaagatcgatgtcttgatgaataacgccggcatcatggcgctgccgaagctgatcaaggacagtcgggggtacgagttgcagttttcgaccaatcaccttggacatttccagctcacggcgctgttatgggacgcactgaaaaagccggcggtgcgcgcgtggtgacgctctcctcgtacggtcatcgttattcgcctgtggacttcgacgatccgaatttcggttcaaggcgctacgacaaatggaaggcctatggccagtccaagacggccaacgcgcctttctcagtggagctgggcaggctcgggcagccattcggcattcgcgcctttccgtgcatccgggccggactccgtcgacagccctcaagcgctcactgacgttcaaggagttgctggccatgcccttgctgttgttcagcaaggtctatgtcaagaacatccaggagggggctgcgactcaggtgtgggcagcgttgagcagtcagctcgacggcaaggacggtgtttattgcgcaggttgcgatatctcgcctgcagttacgccggacagtccgttagccaataccgtgcgcgattatgcggttgatccggatcttgcaagaaagctttgggtgttgagcgaaaagctggtgggcttcgcgtgg

SEQ ID NO: 30923 - DNA, 840 bp, Burkholderia cepacia; identical to SEQ ID NO: 28164

SEQ ID NO: 30924 - DNA, 819 bp, Burkholderia cepacia; identical to SEQ ID NO: 28165

SEQ ID NO: 30925 - DNA, 1422 bp, Burkholderia cepacia
tttatcgacggtgaataccgtgacgcggaaggcggccgcacgttcgactgcctgagtccgatcgacggcaagctgctcgccaaagtggccgacagcggcgcggccgacgtcgacgctgcggtgtcggcggcgcgccgtgcattcgactccggcgtgtggtcgggcctcaatccgcgccagcgcaaagccattctgctgcgttgggccgcgtcgatccgcgagcatatggacgagctcgcgctgctcgaaaccctcgacgcgggcaagccgatcgccgacaccaccagcgtggacgtgccgggcgcggcgtattgcgtcgagtggtttgccgaagcgatcgacaaggtgggcggcgaagtcgcgccggccgatcatcatctggtcggactcgtcacgcgcgagccgatcggcgtggtggctgcggtcgtgccgtggaatttcccgatcctgatggcgtcgtggaaattcggcccggccctggccgctggcaatagcgtggtgctcaaaccttcggagaagtcgccgctcaccgcgatccgtctcgcgcaactcgcactcgacgcaggcattcccgccggcgtattcaacgtcgtgccgggcgcgggcgagccgggcaagctgctggcattgcatcaggacgtggactgcctcgctttcacgggctcgaccaacgtcggcaagctgatcatgcagtacgccggccagtcgaatctgaaacgcgtatggctcgaactcggcggcaagtcgccgaacatcgtgatgccggattgccctgatatggaccgcgcggcgaacgcggcggccggcgcgatcttctacaacatgggcgagatgtgcacggcgggttcgcgtctgctcgtgcatcgcgacatcaaagacgtgttcctcgacaagctgatcgccgcggcacgcagctatacgccgggcaatccgctcgatccgaacacgtcgatgggcgcgatcgtcgacaaggttcagctcgaacgcgtgctcggctatatcgaagccggccgcgccgaggcaaagctgttgctgggcggcgcacgcgtgaaagaggaaacgggtggcttctatatcgagccgaccatcttcgagattccggcttcaggtgcaaaggtcgcgcgcgaggaaatcttcgggccggtgttgtcggtgatcacgttcgacacggtggaagaggcgatcaggatcgctaacgacagcgagtacggtctcgccgccgcggtctggacctcgaacctgaccatcgcgcacgaagtgtcgcgcaagctccgcgcgggcacggtatgggtcaattgctacgacgagggcggcgacatgaatttcccgttcggcggctacaagcaatcgggcaatggccgcgacaagtcgctgcacgcgctggaaaaatacaccgagctgaagtccacgctcgtgcggctg

SEQ ID NO: 30926 - DNA, 1308 bp, Burkholderia cepacia
atccacccgttttcggatatgggcgcgctcaatcgcaccggcagccgcgtgatcgtcaaggcacaaggcgtgtacctgtgggactcggacggcaacaaggtgatcgacggcatggccggcctgtggtgcgtgaacgtcgggtatggccgcaaggaactggccgacgccgcgtacaggcagatgatggagctgccctactacaacaccttcttcaagaccacgcacccgccggtgatcgaactgtcggccttgctcgcggagctcgcgcccgaaccgttcaatcacttcttctactgcaacagcggttcggaaggcaacgacacggtgctgcgtatcgtccaccattactgggcaacgcagggcaagcacgcgaagaaattcgtcatctcgcgcaagaacggctatcacggttcgacgatcgcgggcggcacgctcggcggcatgggctacatgcatgaacagatgccctcgaaagtcgagaacatcgtccatatcgaccagccgtatttcttcggcgaggcacaaggcaacctgacgccggaagagttcgcactggcgcgcgcgcagcagctggaagcgaagattctcgaaatcggcgcggacaatgtcgccgcattcattggtgagcctttccagggagcgggcggcgtgatcttccccgcttcgacgtattggccggaaatccagcgcatttgccgcaagtacgacattctgctcgtcgcggacgaagtgatcggcggtttcggccgcaccggtgaatggttcgcacaccagtacttcggattcgaaccggatctgatcacgctggccaagggcctgacgagcggttacataccgatgggcgcggtcggcctgcatgaccgcgtcgccaaagcgatcatcgaaaacggcgacttcaaccacgggctcacgtattcggggcatccggtcgccgccgccgttgcggtcgcgaacctcaagctgctgcgcgacgaaaagatcgtcgagcgcgtcaagaccgatacgggtccgtacttccagaagaagctgcgcgacacgctcggcaatcacccgatcatcggcgagatctccggcgcgggtctggtggccggcctgcaactcgcgcaagacccgaaaacacgcaagcgtttcgccaatggcggtgatgtcggcacgatctgccgcgacttctgcttcaacggcaatctcatcatgcgcgccaccggcgaccggatgctgctgtcgccgccgctggtcatcaacaagctggaaatcgacgaaatcgtttcgaaggccaaaaaagccatcgacgcgacggcacaacaactc

SEQ ID NO: 30927 - DNA, 1071 bp, Burkholderia cepacia; identical to SEQ ID NO: 28168

SEQ ID NO: 30928 - DNA, 636 bp, Burkholderia cepacia; identical to SEQ ID NO: 28169

SEQ ID NO: 30929 - DNA, 552 bp, Burkholderia cepacia; identical to SEQ ID NO: 28170

SEQ ID NO: 30930 - DNA, 735 bp, Burkholderia cepacia
aaagccgttctgatcaccggcggcagccgcggcattggccgcgcaaccgcgcgtttgctgggcgcgcgcggctggtccgtcggcgtgaattacgcgcgcaatctcgccgcggcacaggacaccgccgccgaagtggaacgcgccggcggccgcgcgctgacgatcgccggcgacgtcgccagcgaagccgacgtgctcgccatgttcgacgcgctccagcagaagttcgggcggctcgatgcgctcgtcaacaacgccggcatcgttgcgccgtccagccagcttgcggacatggacctcgcgcgcctgaagcgcatgttcgacgtcaacgtgctgggcgcgtatctctgcgcgcgcgaagccgcgcggcgcatgtcgaccgatcgcggcggcgcgggcggtgtgatcgtcaacgtttcgtcggcggcgtcacgtctcggttcgccgaacgaatatgtcgactatgccggctcgaaaggcgccgtcgatacaatgacgctcggcctcgccagagagctcggtccgcgcggcgtgcgcgtgaacgcggtgcgccctggtctcatcgacaccgaaatccacgcaagcggcggcaagcccgagcgcgccgcgcaactcggcgggaccacaccgctcggccgtcccggcacggccggcgaagtggccgaaaccatcgtctggttgctgagcgacgccgcctcgtatgtgacgggcgctttgctcgacgtgtcgggtggc

SEQ ID NO: 30931 - DNA, 864 bp, Burkholderia cepacia; identical to SEQ ID NO: 28172

SEQ ID NO: 30932 - DNA, 741 bp, Burkholderia cepacia
atgaacgcctcaatcagccagcaagtcgctatcgtcaccggcgcatcccgcggcattggcgcagcggtcgcgcaacgcctcgccaacgacggcttcgccgtcgcgatcaactacgcatccagttcgaccgaagccgatgcgctcgtcgcgaaactcacggcggccggcgccaaagccgtcgcggtgaaggccgacgtgtcgaacgccggcgacgtgcgccgcctgttcgagatcaccgaacagcagctcggcaaagtggacgtgctcgtcaacaacgccggcgtgctcaagaccacgccgctcgccgacaccagcgacgcgctgtacgaccagaccttcgacatcaacgtacgcggcaccttcaacaccttgcgcgaagcagccgcgcgcatgaacgacggcggacgcatcgtcaacttttcgagcaccacgctggcgctgaacatgccgggctacgcgatctacaacgcgaccaaggctgccgtcgaagcctttacgcatgtattcgccaaggaactgcgcggccgcaacatcaccgtcaacgccgtggcgccgggtccgatcgcgacgtcgctgttcctcgacggcaagactgaagaacagatccagaccttcgccaagatgccgccgctgcaacgtctcggccagccggacgatatcgcatccgtggtggcgttcctcgccggtccggacgcgggctgggtcaacggtcagattctgcgtgccaacggcggcctcgcc

SEQ ID NO: 30933 - DNA, 876 bp, Burkholderia cepacia; identical to SEQ ID NO: 28174

SEQ ID NO: 30934 - DNA, 1554 bp, Burkholderia cepacia; identical to SEQ ID NO: 28175

SEQ ID NO: 30935 - DNA, 1587 bp, Burkholderia cepacia
ttcgactacatcatcgtgggcgcggggacggcgggatgtgtgctggccaatcgcctgagcgaagatccggacgtgcaggtgttgctgctcgaagccggcggcaaggacgattaccactggattcacgtgccggtcggctacctctattgcatcggcaatccgcgcacggactggctttacaaaacccaggccgaagccgggctcaatggccgcgcgctttcgtatccacgcggacgcgtattgggcggcagttcgtccatcaacggcatgatctacatgcgtggtcagcgcgaagactacgatgaatgggcgcgagtcaccaacgactcatcctggtcctggaactcagtgctgcccgtcttcaggcgtagcgaagatcattacgccggcgcgagcgaatctcatggcgcgggcggcccttggcgcgtcgagaaacagcggttgaaatggaaaattctcgaagagttttcgcgtgcggcgcaagaggccggcattcccgcaaccgacgacttcaaccgtggcgacaacaccggcgtcggctacttcgacgtcaatcagaaacgcggcattcgctggaacgcgtcgaaggcattcttgcgtcccgcactcaagcgtccgaatctcacggtcatcaccggcgcgcacacgcagcgcgtcgtcttcgaaggacgccgttgcacgggcgtcgaatatcgcggcaacgacacggactatctggccaaggctcgctgcgaagtgatcctgagctcgggggccgtcaactcgccgcaattgctcgaattgtccggcatcggcaatggcgcgcgtctgcagaacctgggcatcgaggtcgtcaacgatctgcgtggcgtcggagagaatctacaagaccatttgcaattgcggatggcttataaggtcgacggcgtacgcacgctcaacaccgcgtccgcgcattggtggggcaagctgatgatcggcctgcagtacgcgctgttccaaagcggccccatgtcgatgtcgccgtcgcaacttggtgcgtttgccaggtccgatccgaacgatcgctcgctcacgcggcccgacctcgaatatcacgtccagccgctctcgctcgatcgcttcggcgaaccgctgcatcggttcaatgcgttcaccgcgtcggtgtgccagttgcggcccacttcgcgcggcagcattcacatcgaatcggccaatgcttcagcgccgccgttgatcgcgccgaactatctctccaccgattacgaccggcacgtcgccgccaacgcactgcgtctcacgcggcgcattgccgcggcgccggcgcttgcacgctatcgtccgcaagagattttgcccggcactcagtaccagacggaagaggagttgcagcaggctgccggcgcggtcggcacgaccatcttccatccggtcggcacctgccgcatgggcacgaccgacgaccccggcgcggtggtcgacaaccggctacgggttatcggtgttgacggactgcgcgtggtcgatgcatccgtcatgccgaccatcacctcgggcaataccaattcgcccacgctgatgatcgcggagcgcgccagcgacatgatc

SEQ ID NO: 30936 - DNA, 1437 bp, Burkholderia cepacia
ctgacccatttcatcaacggcaagactgtcgaaggcacgagcggccgcttcggcgacgtcttcaatcctgcgcaaggcagcgtaagcgcacgcgtgccgctcgcgagcgtcgcggaagtggatgcggccgtcgctgctgccaaagacgcgtttgccgcatggagcgaaaccgcgccgatcaagcgggcgcgcgttctgttcaggttcaaggaactgctcgatcgacaccacgacgaactcgcggaactgatcacgcgtgagcacggcaaggtgttttcggacgcgaagggcgaagtgatgcgcggcatcgaaatcgtcgaattcgcatgcggcattccgaatctgctgaagaccgacttcaccgatcagatcggcggcggcatcgacaactggaacctgcgtcagccgctcggcgtggtggccggcattacgccgttcaattttccgatgatggtgccgtgctggatgttcccggtcgcgattgcgtgcggcaatacattcgtgctgaagccgtcggagcgtgatccgtcctgttcgaaccggcttgccgaattgttgaaggaggccggcttgccggatggcgttttcaacgtcgtgcatggcgacaaggtcgcggtcgatgcgctgctcgtgcatccggacgtcagcgcgttgtcgttcgtcggttcgacgccgatcgccgaatatatctacacggaaggcacgaagcacggcaagcgtgtgcaggctttgggcggtgcgaagaatcatctggtggtgatgcccgacgcgaatctcgatcaggcggtagacgcgttgatcggcgcggcctacggctccgcgggcgaacgttgcatggcgatttcggtggccgtcgccgtcgggcatatcgccgatgaactggtcgagcggctcacaccgcgcgtgaagagcctgaagattctcaacggcatggagtcggacgccgagatggggccgttggtcacggcggtgcatcgtgagaaagtggtgggctatatcgattccggcgtcgcggcgggcgcgacgctggttgtcgatgggcgaggacatcaggtcagcggtcacgagaagggtttctttctcggcggcaccttgttcgacaatgtctcgaccgacatgaagatttatcgcgaagagattttcgggcccgtgctctgtgtcgtacgcgtgccggattttgcttcggcggtggagctcatcaacgcgaatgagtttgccaacggcgtgtcgctatttacgtccgatggcggcgtcgctcgcgcattctcgcggcagatccagatcggcatggtaggcatcaacgtaccgattcccgtgccgatggcgtggcattcgtttggcggctggaagaagtccctcttcggcgaccatcacgcgtatggcgaagagggcgtgcggttctacacccgctacaagagcatcatgcagcgctggccc

SEQ ID NO: 30937 - DNA, 1761 bp, Burkholderia cepacia
tccctcgacgttctgctcgaaaaatacgcgaaaggcgacgaacaatcggctgacgacgtattcaaacgcgtcgcgcgcggcgtcgccgaggccgaaccgccggcgctgcgcgaatcggtcgaagcgctgttcgtcgacaatctgcggcatggcgcgctcggcgccggccgcatcatgagcgcggcgggcaccggcattgcggccacgctgatcaattgcttcgtgcagccggtgggcgacgcgattcagggcgtcgacgaagaaggcctgcccggcatttacgtcgccttgctgcaagcggccgaaaccatgcgccgcggcggcggcgtcggttacaacttctcggcgatccggcccaagggcgcgcgggtccacaccaccagttcgtcggcctcaggaccgtgcagctatatggacgtgttcgacgcgtcgtgccgcaccgttgagagcgccggttcgcggcgcggcgcgcagatggccgtgctcgactgcaatcaccccgacctgctggagttcatcgaggccaagcattcgaaaggccgctggaacaacttcaacgtctcggtcggcgtgaccgacgaattcatgcgcgcggtcgaagaagatcagccctggcaactcgtgcatcgcgccgaaccgtcgccggcacagcgtgcggcagacgacgtgcggcaacgcgaagacggcctgtgggtctacagcgaacgcccggcgcgcgagatctgggaccgcatcatgcgctccacttacgacgtcgcggaacccggcatcgtgttcatctcgcgcatgaacgaggacaacaatctgcgcgcggtcgaaaccattcgcgcaaccaatccgtgcggcgaacaaccgttgccggcatacggctgctgcaacctcggcccgctgaacctcacgcgtttcgtgatcgatccgttcgcgcagatcaaaggccgcaagccgtcgttcgactgggacggcctcgcgaaacgcacgcgcacccaggtgcgctttctcgacaacgtgctcgacgtgacgctctggccgctgccgcagcagtacgaagagtcgcgcgccaagcggcgcatcggagtaggcttcaccggcctcggcgatacgctcgtcatgctcggcttgcgctacaactcgcaggaaggccgcgatttcgccgtgggcatcgcgcaactgatgcgcgacgaggcgtatcgcgcatccgtcgagctggcgcgcgaacgcggcgcgtttccgctcttcgacgccgcgcgctatctggaaaccggcacgttcgcttcgcgcctgcccgaggacatcaagcaggcgattcgccgcgacggtatccgcaacagccatctgctctccatcgcgccgaccggaaccgtgagccttgccttcgcggacaatgcgtcgaacggcatcgaaccggccttctcgtggacctacacgcgcatgaaggtgatggcggacggcagccgcgaatcgttcgatgtggaagactacgcgtatcgtctttatcgcgagctcggcggcgacgtcaaccggctgccggactatttcgtcagcgcgctggaaatgtcggcgcgcgaccatctcgacatgatggctgccgtgcagccgtatgtggacacgtcgatctcgaagaccgtgaacgtgcccgccgactatccgttcgaagcgttcgaaagcctctacctcgacgcatggaaaaacggcctcaagggtctcgccacctaccggcccaacgagacgctcggcgcggtgctcagcgtgagcccgccgcaa

SEQ ID NO: 30938 - DNA, 1251 bp, Burkholderia cepacia
gtgctcgccaacgaaaaccgcaaggtcacccaggaagaatcgcagcggcaagccgaattgctgatgcaggaaatcgaggcgcaccgcaagaccgacgccgcgcttcagcgcgcgagcgccgcggccgagtccgccaatcgtgccaagagccgctacgtgacgggcctgagtcacgaactgcgcacgccgctcaacagtattctcggttacgcacaactgctgctgcaaggcaccgacgaactgccgccggcgcggcgcaatgccgtggcgaccatctatcgcagcggcgagcatctgctggcgctggtggatggcctgctcgacgtcgcgcggatcgaggccggcaagctgcagttgaacgtgacggagatttcgctgccggacttcgtcgcgcaactcgctgccatgctcgaaccgcaggccaccgacaaaggattgcagttcgaattccagacgagcggccgcatggcggacgtggtgcgcatcgacgaaaaacgcgtgcggcagattctcatcaacctgatcggcaacgcgatccgcttcacctcgcacggttcggtgaaggtgcgtgccagctatgcgtgggaagccattacgtttgaaatcaccgataccgggcccggcatgccggccagcgaactggagcggctattcctgccattcgagcgcggcgcggcggcgcgcgaacacgatcatggcgcggggctgggactgaccatctgccgcctgctcacggaactgatgggcggcaacctggaagtgcaaagcgaggtgggcaaaggcacgcgctttatcgtgaagctgttcgcgcctgaagtgcgggcgccgcagttgctggcgagcggcccgctcaacgtgaagggttacgacgggccgcgccgcaccgtgctcgtggtggacgatctcgcggagcagcgccgcattgtcgtgcagacgctggcgccgctgggcttcaacgtggtggaagccgcgagcggaccggaggcgctgcaatggctcggcaccgcgtcggcggatctgatcgtgatggacgtgtcgatgccggacatggacggcttcgaggcgagccggctgattcgcgacaatcatctgtcggcggcgccggttctgatcctgtccgccaacgcattcgcggacgatcgcgacaaaggcgccgcagccggttgcgacgactacctcgccaagccgctctacattccgctcctgctcgacaaactggccgcactgctgcaactgcactggatcgtcgag

SEQ ID NO: 30939 - DNA, 1239 bp, Burkholderia cepacia
atggctgtcaatttcccctcgatcgatcccgctcaactccatcccgtcgccggcgtttcgctcggctgggcggaggcgaatatccgcaagccgaaccgcaaggacgtgctcgtcatttccgtgggcgaaggcgccacggtcggcggcgtgttcacgcagaaccgtttttgcgcggcgcccgtcaccgtgtgccgcgagaatctggaccgcgtgcgcgcgggcggcaagccgattcgcgcgctggtgatcaataccggcaacgcgaacgcgggcacgggcgaaccgggcctggtggcggcgcgcgaaacctgcgcggagctcgcgcgtctggcggacatcacgccggaacaggtgctgccgttttcgacgggcgtgattctggagccgctgccggtcgatcgtctgaaggctgggctgccggctgcgctggcgaatcgcaaggaagcgaactggtacgacgccgcgcaggcgatcatgaccacggacacgctgcccaaggccacctcgcgccaggtcacgatcgagggtcacacggtcacgctgaccggcatcagcaagggcgccggcatgatcaggccgaacatggcgaccatgctcggctttctcgcgttcgacgccgccgtcgcccagccggtgctcgatgcgctggtcaggcacgtggcagaccgctcgttcaactgcattacgatcgacggcgatacgtcgaccaatgattcgttcatcctgatcgcgtcgggcaaatcgagcctgccggcgatcacgtccaccgactcgcccgcttatgcagcgctgcgcgacgcggtgaccgaggtcgcccagaccctcgcacaactgatcgtgcgcgacggcgaaggcgcgaccaaattcatgaccgtgcatgtcgaaggcgggtcgagcgtcggcgaatgccgccagatcgcgtatgcgatcggccactcgccgctcgtgaagacggctttctatgcatcggacccgaatctcggccgcattctggcggccatcggctatgccggcgtggacgatctcgacgtcggcaagatcgatctgtatctcgacgacgtgctggttgcgactgccggcggccgcaatccggcctaccgtgaagaagacggccagcgcgtcatgaaaaagagcgagatcggcattcgtgtcgtactcgggcgcggcgatgcgcaagccacgatctggacttgcgacctgtcgcacgactacgtgagtatcaacgccgactatcgttcg

SEQ ID NO: 30940 - DNA, 930 bp, Burkholderia cepacia
gccgaagacatgcagcaggtcaatcgcgtcatacggcaccgccttgcgtccgacgtgatgctgatcaaccagatttcggagtacatcatcagcgccggcggcaaacgcctgcggcccgcgctgctgttgctggtggccggcgcgctgggtgaaaccacggggcaccggcacgaactggcggcggtcgtcgaattcatccatacggccacgctgctgcacgacgacgtggtcgacgaatccgacctgcggcgcggccggcagacggccaatgcgctgttcggcaacgccgcgagcgtgctggtgggcgacttcctgtactcgcgctcgttccagatgatggtcggcgtgggcaagatgcgcgtcatggaaattctgtcggaggcgaccaacatcatctccgaaggcgaagtgctgcaactcctcaacatgcacgacgccgacgtggacgaagcccgctacatgcaggtgattcgctacaagaccgccaagctgttcgaggccgcggcccaactcggcgcggtgctggccggttcggacgcgaaaaccgaagcggcggcggcggaattcggccggcgcatcggcaccgctttccagatcatggacgactggctcgactacacgggcacggccgagtcgatgggaaaaaatgccggcgacgaccttcgcgaaggcaagccaacgctcccgctgatctatctgatcgaacgcggcacgccggagcaatcggcgctggcgcgcgaagcgatcgagcaaggcggcacggatcgtttcgacaccattttcgaggcaatcacgcgttccggcgcgctggatcacacgctcgaatgcgcgaaacaggaagcccaggcggccgcggcagcaatttcttcgtttccggattccattttcaaagatagcctgctagaattatgttcttactcgacggcaaga

SEQ ID NO: 30941 - DNA, 492 bp, Burkholderia cepacia
atcgtttcggccgacgacgtcaatgcgtcgatcagcggcatggcggccgccatccgcgacgagatgagcgaggacttcccgctcgtgctgtcggtcatgggcggggcggcggtcttcaccggcatgctgttgccgcacctcgatttcccgctcgagttcgactacatccatctgacccgctaccgcaacaccaccaaaggcggcaacgagatgcaatggcgcgtggcgccggcggaatcggtgaaggatcgcgtcgtgctggtgctcgacgatattctcgacgaaggcgagacgatggccgcgatccgcgaccgcattctcgcgatgggcgcgaagcgcttcctgagcgcggtgctgtgcgagaagatcattccgaaagccaagccgctgcgcccggattactgcgggttcgaagtgccggaccgttatgtgttcggctgcggcatggatgcgaagggttactggcgtaacctgcccacgattcgcgcgctg

SEQ ID NO: 30942 - DNA, 2743 bp, Burkholderia cepacia
gtatgagggctcaccgactggccaggcctttggccaggcacaaggcgcacaagcgctcgcgccgcaagcgaccttcgccgactacaaggtgatccgtcgtaatggcagtgtcgtgtcgttcgaaccgtcgaaaatcgccatcgccgtgacgaaggcatttctggccgtcaacggtggtcaaggcgccgcgtcggcgcgcgtgcgcgaactggtcgagcaactcacgcagaacgtggtgcgcgcactcgtgcgcagccgcccgaacggcggcacgttccatatcgaagacattcaggatcaggtcgaactcgcgctgatgcgcggcggcgagcacaacgtcgcgcgtgcatacgtgctgtatcgcgagaagcgcacgcaggcgcgcggtcatgacgatcagatcgtggcgaacacgccgggtctgaacgtgaccgacaacggcgtcacgcgtccgctggacatggctgcgctgcgcggcatcatcgaactggcctgctcgaatctgggcgatgcagtgagcgccgatccgatcatcgcggaaacggtgaagaacctgtacgacggcgtgccgatgagccaggtctacgactcggcgattctggcggcccgcacgatgatcgaaaaggacccggcttatagccaggtcaccgcgcgcatcctgctgcacaccatccgccgcgagatcctcgaagaggaagtcacgcaaacggaaatgggcgagcgctacgccgaatacttcccgcagttcatcaagcgcggcgtgcaagccgaactgctcgacgacaagctgctgcagttcgacctgaagcgcctcggcgccgcgctcgacaacaaccgcgacctgcaattcggctacctcggcctgcaaacgttgtacgaccgctacttcctgcatcacgacggcgtgcgcatcgaaatgccgcaggcattctttatgcgtgtcgcaatgggtctgtcgctgaacgagatcgaccgcgaagcgcgcgcgatcgagttttacaacgtgctgtcgaccttcgacttcatgtcgtccacgcccactttgttcaactcgggcacccgccgttcgcaactgtcgtcgtgctacctgaccacggtcgacgacgacctcgacggcatctacgaagcgctgaaggaaaacgcgctgctgtcgaagttcgccggcggtctgggcaacgactggacgcgcgtgcgtgcgctcggttcgcacatcaagggcactaacggcaagtcgcaaggcgtggtgccgttcctgaaggtggtgaacgacacggcggtcgccgtgaaccagggcggcaagcgcaagggcgcggtgtgcgcgtacctggaaacgtggcacctggacatcgaggaattcctcgaactgcgcaagaacaccggcgacgaccgccgccgtacccacgacatgaacacggcgaactggattcccgacctgttcatgaagcgcgtgatggaaggcggcgactggacgctgttctcgccgtccacctgcccggacctgcatgacaagttcggcgccgagttcgaaacggcttacacggcttacgaagacaaggttgcgcgcggcgagatcaagctgttcaagaagatcccggcggcgcaactgtggcgcaagatgctgggcatgctgttcgaaaccggccacccgtggatcacgttcaaggatccgtgcaatgtgcgctcgccgcaacagcacgtcggcgtcgtccattcgtcgaacctgtgcacggaaatcacgctgaacaccagcgacgccgaaatcgccgtctgcaacctgggctccgtgaacctcgtcgcccacctgaaggaacaggccgacggcacgctcgtgctcgaccacgacaagttgaagcgcaccgtcagcgtggcgatgcgcatgctcgacaacgtgatcgacatcaactactacgcggtcgccaaggcgcgtaactcgaacctgaagcaccgtccggtcggcatgggcatcatgggcttccaggactgcctgcatctgctgcgcacgccgtacgcgtcggaagaggcggtcaggttcgccgacacgtcgatggaagcggtctgctactacgcttactacgcgtcgacggaactggcgcaggagcgcggccgctactccagctaccgcggctcgctgtgggatcgcggcatcctcccgcaagactcggtgaagctgctcgccgaagcgcgcggcggttacgtggaagtcgattcgagcgaatcgatggactggaccgaactgcgttcgcgcatcgcccagtacggcatgcgcaattcgaactgcgtcgcgatcgcgccgacggcgacgatctcgaacatcatcggcgtgtcggcctgtatcgaaccgaccttccagaacctgtacgtgaagtcgaatctgtcgggcgaattcacggtggtcaacgactacctggtgcgcgacctgaaggcacgcggcctgtgggacgaagtgatggtcgccgacctgaagtacttcgacggcacgctctcgcgcatcgaccgcatcccggccgacctgcgcgcgatctacgccaccgcgttcgaagtcgatccgaagtggctggtcgaagcggcctcgcgtcgtcagaagtggatcgaccaggcgcagtcgctgaatatctatatgggcggcgcgtcgggtaagaagctcgacgagatctacaagctcgcctgggtgcgtggcctgaagacgacctactacctccgcacgatggcggcgacccacgtcgagaaatcgacggtggcgcac

SEQ ID NO: 30943 - DNA, 1008 bp, Burkholderia cepacia
cgggtcaacgtcgccgacaagcgcatcatcaacggccagaccgacgtcaatcagttggtgccgttcaaatacaagtgggcgtgggaaaagtatctggctggttgtgccaaccactggatgccgcaagaagtgaacatgtcgcgtgacatcgccctctggaaagacccgaacggtctgaccgaagacgagcgccgcatcgtcaagcgcaacctgggcttcttcgtgacggccgattccctcgccgccaacaatatcgtgctgggcacctaccgccacatcacggcgcccgaatgccgccagttcctgctgcgccaggcgttcgaagaggcgatccacacgcacgcctaccagtacatcgtcgaatcgctgggcctcgacgaaggcgaaatcttcaacgcgtatcacgaggtctcctcgatccgcgcgaaagacgaattcctgattccgtacatccacgtgctgaccgatccggccttcaagaccggcacgctcgaagcagaccagacgctcctgcgctcgctgatcgtgttcgcctgtgtgatggaagggctgttcttctacgtcggctttacccagatcctggcgctgggtcgccagaacaagatgacgggcgcggcggaacagtaccagtacatcctgcgcgacgagtcgatgcactgtaacttcggcatcgacctgatcaaccagatcaaactcgaaaacccgcaactctggacggctgagttccgcgcggaaatccgcgagatcttccagcaggcggtcgaactcgaatatcgttacgcagaagacacgatgccgcgcggggtgctcggcctcaatgcgtcgatgttcaagagctatctgcgcttcatctgcaaccgccgttgccagcagatcggtctcgatccgctgtacccgaacgaggaaaacccgttcccgtggatgagcgagatgatcgacctgaagaaggaacgaaacttcttcgagacgcgagtgatcgaatatcagactggcggcgcgctgacctgg

SEQ ID NO: 30944 - DNA, 936 bp, Burkholderia cepacia; identical to SEQ ID NO: 28185

SEQ ID NO: 30945 - DNA, 1347 bp, Burkholderia cepacia
atgtttgaaaaaatcctcattgccaatcgtggcgagatcgcgcttcgtatccagcgcgcctgccgcgagcttggcgtcaagaccgtcgtcgtctattcggaagccgacaaggaagccaaatacgtgaagctcgccgacgaggcggtctgtatcggcccggcgccttcgaacctgagctacctgaacatgcccgcgctgatcagcgcggcggaagtgaccgacgccgaagcgatccaccccggctacggcttcctctcggaaaacgccgacttcgccgaacgtgtcgaacagtccggcttcaccttcatcggcccgcgcccggaaaccatccggatgatgggcgacaaggtcacggccaagcagaccatgatcaagaccggcgtgccgtgcgtgccgggctcggaaggcgcgttgccggaagatccgaaagagatcgtgaagattgcccgccaggtcggctatccggtcatcatcaaggccgcgggcggcggcggcggccgcggcatgcgcgtggttcacacggaagccgcgctcgtcaacgcagtcaacatgacgcgcgaagaagccggccgcgcgttcggcaacccgcaggtctacatggagaaattcttggagaacccgcggcacatcgaaattcaggtgctggccgactcgttcaagaacgcagtctggctgggcgagcgtgactgctcgatgcagcgccgtcaccagaaagtgatcgaagaagcgccggcgccgggtatcgcgcgccgcctgatcgaccgcatcggcgatcgttgcgcggacgcctgcaagaagatgggctatctcggcgcgggcacgttcgagttcctgtatgagaacggcgagttctacttcatcgagatgaacacgcgcgtgcaggtcgagcacccggtgaccgaactgatcacgggcgtcgacatcgtgcaggaacagatccgcatcgcggccggcgaaaaactcgccttccgtcagcgcgatatcgtgttcaagggtcacgcgatcgaatgccggatcaacgcggaagatccgttcaagttcattccgtcgccgggacgcctgacgtcgtggcatatgccgggcggccccggcatccgcgtcgactcgcatgcctacaatggctacttcgtgccgccgaactacgattcgatgatcggcaagctgatcgcctacggcgcgacgcgcgagcaggcgatcaagcgcatgcgcatcgcgctgtcggaaatggtggtggaaggcattcagaccaacatcccgttgcaccgcgagctgatgctggacgcgaagttcgtcgaaggcggcaccagcattcactacctcgaaaaccggttggccgcgaagcagcag

SEQ ID NO: 30946 - DNA, 432 bp, Burkholderia cepacia; identical to SEQ ID NO: 28187

SEQ ID NO: 30947 - DNA, 1641 bp, Burkholderia cepacia
tacgactatatcgttgtcgggggtggctcgtccggttgcgtggtagccacccggctggttgaagccggcttcgaggtattgctgctggaagccgggcccgtcgacaaggatatctacatccatatgcccgccggcatgagaaacgcccagaagtattcatggaattacatgagcgaagcgaaccccggctcgggcgtgcctccgatccacattcaccagggtcgtgtgctaggcggcgggagttcggtcaacggcatggtgtacgtccgcggttcggctcacgactacgacgactgggacaggatctacggctgtaccggctggagtcacaacgacgtgctgccttactttatccgctcagaaggcaacgaagtcgtgagcgggccgaagcacggtacggacgggaatctgtgggtcagcgagcaccgctaccggcatccgctgacgatggcgtatctgagggcagcgcaggaactcggctatccgtacatcaccgatatgagcggcgcgaccgagcaggagggcgtgggcttctggcagtgcacgatccacgaaggcaaacgcggtagtacggcccgggcctacctgcagcgggtcatcaaaagcgatctgctgacggtcgtgaccggagcgaccgccaggaaggtgcagatagaaaacggtcgggcctgcggggtgcgctacgctcgcaacggcaattccgttaccgatgcggttgcgacgagggaagtgattctcacggccggtgcattcgagacgcctaagctcctgatgctctccggtatcggtccggcgcagcatctgaacgagttcggcatcgggaccattgccgacagtccgcaggtcggtaagaacttccaggatcacctgatggtctccatcacggccgaaacgccgggcattcctagcttcctgcgcgaaggagagggcctgcgcaagatcgcgaatgggctggaatggctgaccttcaaccacgacggcgtggtctcttcgaacgtgctggagggcggaggctatttcgacataaacgacgatggacgaatcgatacgcagttgttcgtttttcctttctatgaaggcaagcgcgacggaaactggacgaaagccgatcagattccggacggcatggcgctcaaggtcggccacgtctatcccgagtcgcgcggagaggtgctgcttggcggaccccggcccgacgacaagatccgtctgaaaggcaattacctgtcggccgacggcgacctggacttgcaggtgaaggcgttcaagctggggctgaaatttttcgatgctccgtcgttgaagaaaattacccggaacgtggcgccgaagttctcggacgaccacgaaatagccgattacgtacgaaagaactgtacgacgatatttcatcccacttcgacttgccgtatgggaaattccccgcagagttcggtggtcgatcttacgctgcgcgtgtggggaattgccaatctccgcatcgctgatgcctccgttatgccacacatagtcagtggcaatacaaacgcaccgacgatcatgatcgcggagcgagcggcagaaatgattattcatgcgtcgtcccattcttgaaatcgtgcagcagggagcgaacgaaccgactcgcgatctgaatcgctg

SEQ ID NO: 30948 - DNA, 1422 bp, Burkholderia cepacia
gacaaactgtatatcgacgggcagtgggtcgcagcctccaccggaaaggagttttcggtcatctcgccggatacggaaagcgtctatgtccgggtcggcgaggcaagcgaggccgatattgaaaaggcagtttcggctgcccgcaaagcgttcgatcacgggccgtggcctcggctgagccatgcggagcgaggcgcttatcttcgcgcgatggcggaaaaactgcgggcgcgctcgcacgacatggccgcgatctggccgcacgagatgggcgtcacttacgcgttcgcgcagtcgttcatgccgcgcatcgcgggcatctacgacttctacgccaatctcggcgacacgttcgctttcgaagaacggcacgccaccagctcgggaatcggcaacgggctgctcgttcgcgagcccgtaggcgtggtcggcgcgatcattccatggaatgcgcccgcgatgatcatcgcgtacaagctggcgcccgcgttgatcgccggttgtaccgtgatcctcaagtcttcgccggaagcgccgggcatggcgctgataatcgcagaggtcgcggaggaagtcggtctgccgcccggagtcgtcaacgtggtcactgccgatcggcaagcgtcggacgcgctggtgcgaaacgctgcggtcgacaaaataagctttaccggttcgagcgcggtcggcaagcatatcggcagcgtgcttgcgcagcgggtggggcgatataccctcgaactgggcggcaagtcggccgctatcgtactcgacgactacgacctggagacggcggcaaaagcgcttgcgacggcagcaagccagatgacctgccaggtttgtgcgagcctgacccgcatcatcgtcaccaaaaaccgccacgaccgcctgctcgaagcgctcgcctctgcgtattcctcggtgaaggttggcagtccgttcgatcccgccacgcaaatgggacctgtggccacgctcaggcagagagagcgtgtcgagacctatatcgcgaaaggcatgcaggccggtttcacgttagccgccggcggcaagcgtccggttcacctgccgcgtgggttctatctggagccgacggtgttcggcaacgtcagtaaccgttccgaactcgctcaggaggagatattcggtccggtgctcgccgtgattcccgccgacagcgaagagcaggcagtcgagatcgcgaacgattccatctatgggttgagcggcgcggtgttcaccaacgacgttgatcgagcctattcggtcgcccgcagggtccgcaccggcagcgtggcccataacgggttccgcaacgacttcggcatcgctttcggcggcttcaaacagtccggcatcggtcgtgagggcggtgtcgaaggcttgatgccctatctcgagaccaagaccgtgctgctggaa

SEQ ID NO: 30949 - DNA, 735 bp, Burkholderia cepacia
caggttgcggtggtcagtggtggcgctcatggcatcggactgggcattgtcgagcggctgctgcaacttggcgcgaaggtcgtggcatcggacatcgacagggacggtcttgcggtgtctcgcgagcgtctcgcgaagtcgttcggcacttcgatcgcagtgcaggcagctgacctgtcgaaggagcgcggtgcacaggccctgcatcgtgcggtggccaaacggtttgggccggcgcagatcctcgtgaactgcgcaggtggtggtgtgatccgtccttttctcgagcacacgcccgagacgctcaaggcgacgatagacaggaatctgtggacggtgatctggtgcagccgcgtatttctgcctgacatgatcggcgcgaagtacggccggatcgtgaacattggtgccgattcggtccgcaacggcttgcccgcacatgcggggtacaacgcggccaaaggcgggatgcatgggctcacgacaggccttgcgcgcgagtttgcgctgaatggcattacggtcaacaccgtggcgccatgcgcggtgaacaccgaagtctgggcgaaggtgaagaagtcgaatcccaggctcgcccaggcgttcgtggacgttattccgatggggcgcgtgggtgaaatagaggaggtcgcttcaatggtgggttacctggcattgccggaggcggcctttgtcaccggccaggtgatcagcgtcaatggtggcagtgcgatg

SEQ ID NO: 30950 - DNA, 630 bp, Burkholderia cepacia
ctgatctgcgattgcgatggtgtgctgatcgacagcgaagccgtggcggcgcgcatgctggtgcgtgaactcgaaacgcgctggcccggcacggatgtcgagccggtggtgttgccgctgctcggactgcgcatcgagaaagtgctgcaaggcaccgcggcgcaactcggcaaaagcctcacgcccgacgatatcgatgcgatccgccgcgcggttgaagccgctgcgatgcaggcgccgatggtcgaagggattgaagccgcactcgctcaggtgccgctcaccaaaggttgcgcgagcaacagcttccgcccgtatgtggaatcggtgctggcgcgcacggggctcgtgaggtttttcggcgaccgtctgttctgcgcagacgcggtgccgaatccgaagcccgcgcccgatgtctatctggccgcggcgagaggcctcggactcgcgccctcgcggtgcctcgtggtggaggacagcgtcacgggcgtgacggcggcgagcgcggcgggtatgacggtgctcggtttcatcggcggcggccatgcgagcgatgcgcagatcgacaagctgcatgcagcgggcgcgcgtcacgtgttcgacgacatgcagcagttgccggaactggtc

SEQ ID NO: 30951 - DNA, 1434 bp, Burkholderia cepacia; identical to SEQ ID NO: 28193

SEQ ID NO: 30952 - DNA, 876 bp, Burkholderia cepacia; identical to SEQ ID NO: 28194

SEQ ID NO: 30953 - DNA, 450 bp, Burkholderia cepacia
gaagtcgccactctcggcggcggttgtttctggtgccttgaagcggtgtatctgggcgtcgaaggtgtgaacgcggtggagtcgggctacgcgggtggtgaggcccggcatccgacttatgaagacgtgtgcgacggcgaaacgggccacgcggaagtcgtgaaggtcgacttcgatccggcgaagatcagctatcgcgagattctcgacatcttcttcgcgatccacgatccgacgcagttgaaccggcagggcaacgacgtcggcacgcaataccgctcggtgatcttcacgcattccgacgcgcagcgggagatcgcgctgcaggcgatccgcgagattggcgaacagcagatctacgacggccagatcgtcacccaggtgttgccgctcaacgacaactactggcctgccgaggattatcaccagaactattttgcgcaccatccg

SEQ ID NO: 30954 - DNA, 1467 bp, Burkholderia cepacia; identical to SEQ ID NO: 28196

SEQ ID NO: 30955 - DNA, 315 bp, Burkholderia cepacia; identical to SEQ ID NO: 28197

SEQ ID NO: 30956 - DNA, 1620 bp, Burkholderia cepacia
atgagtgcgaaagatgtcaagttccacgacagcgcccgcagccggatcgtcaagggcgtgaacgtgctggccgatgcagtgaaagtgacgctcggcccgaaggggcgaaatgtcctgattgagcgcagcttcggcgcgccgaccatcaccaaggacggtgtgtctgtcgctaaggaaatcgagctgaaggaccgcttcgaaaacatgggcgcccaggttgtcaagcaggtcgcatcgaagaccgccgatgtcgccggcgacggtacgacgaccgccacggttctcgcccagtcgatcgtgcaggaaggcatgaagcacgtcgctgctggcatgaatccgatggacctgaagcgcggcatcgacaaggcggtggcggctgtgctcgatgaactgcacaggctgtccaagccgataaagacaagccgggaaatcgcccaggtcggcgccatctcggcgaatgcggacgaggcgatcggcaagatcattgcagacgcgatggacaaggtcggcaaggaaggggtgattacggtcgaagacggcaagtcgctcgagaacgaactggaggtcgtcgaagggatgcagttcgatcggggttatctgagtccatacttcatcaatgacccggacaaacaggttgcgcatctcgacgatccgctgatcctgctgcatgacaagaaaatttccagtatccgcgacctgctgccggtcctcgaggctgctgccaaggcaggcaagccgctcctgatcatcgccgaggatgtcgaaggcgaagcgctcacgacgctggtggtcaattcgatgcgcggtgtgctgaaggtggcggcggtgaaggccccgggctttggcgatcgccgcaaggccctgctcgaggacattgcgattctcaccggtgcaacggtcatttccgaagagactggcaagcagctcgagaaggcaacgctcgaagagctgggccgcgcgaagcgtgttgaggtgcagaaggaaaacaccatcatcatcgatggtgcaggtgaccagacgcgcatcgacgcacgcgtcaaggcgatccgcgcgcagatcgaagaagcgacgagcgactatgaccgtgaaaaactgcaggagcgcgtggcgaagcttgccggtggcgttgcggtgatcaaggtgggtgcggcgaccgaggtcgaaatgaaggaaaagaaagaccgtgtcgacgatgcgctgcatgcgacccgcgccgcagtcgaagagggcatcgtgccaggcggcggcgtggcgttgctgcgggcgcgttcggccatctcgagtctcacgggcgccaacgccgaccaggacgccggcatcaggattgtgctgcgtgcgcttgaggcgccgctgcgcgtgatcgcagccaatgcgggcgacgagccgtcggtcgtcgtcgcgaaggtgctcagcgggaaaggcaactacggctacaacgcagccacgggcgagtacggcgatctcgtcgagacaggtgtggtcgacccgacgaaggtgacgcgtacggcgctgcagaacgccgcttcgatcgccggactgatcctgaccacggacgccacggtagcggaagcgccaaaagaagaaaaagccgtgccggcacctgcaccggaactggaatac

SEQ ID NO: 30957 - DNA, 1092 bp, Burkholderia cepacia; identical to SEQ ID NO: 28199

SEQ ID NO: 30958 - DNA, 1275 bp, Burkholderia cepacia; identical to SEQ ID NO: 28200

SEQ ID NO: 30959 - DNA, 1167 bp, Burkholderia cepacia; identical to SEQ ID NO: 28201

SEQ ID NO: 30960 - DNA, 762 bp, Burkholderia cepacia
cagatcatgtcgttcctcacacttaccgacgtcacgaaatcgttcggcgatctgcacgcagtcgccgacgtgaacctgtcggtggaaaaaggcgagttcgtttcattgctcgggccgtcgggctgcggcaagaccaccaccttgcagatgatcgcgggcttcgtcgaaaccacgcgcggacgcatcacgctcgacggccgcgacatcacgcacatgaagccgaacaggcgcggcctcggcatcgtgttccagagctacgcgctgtttccgcacatgagcgtcgccgacaacgtcggcttcgggctggaaatgcgcaacatcgacaaagccgagcgcaaggagcgcattcgcgaagcgttggcgctggtgcggctcgacacgctcgcgcatcgctttccgcgcgaactctccggcggtcaacggcagcgcgtggcgattgcccgtgcgatcgtgatcgcgccgcccgtgctgctgctcgacgaaccgatgtcgaatctcgacgccaaactgcgtgaagacatgcagttcgaactgcgcggcattcaacgcaagatcggcacgaccaccatcatggtgacgcacgaccagtccgaagcgctctctatcagcgatcgcgtggtggtgatggaagccggccgcattacgcagatcgacacgccgtacgaagcatacgagcgcccggaaaatcgcttcgtctcgcagttcatcggcaaggccaacatgctgcctggcatcgtggtggcgcgcgagggcgacgcgatc

SEQ ID NO: 30961 - DNA, 768 bp, Burkholderia cepacia; identical to SEQ ID NO: 28202

SEQ ID NO: 30962 - DNA, 2238 bp, Burkholderia cepacia; identical to SEQ ID NO: 28203

SEQ ID NO: 30963 - DNA, 747 bp, Burkholderia cepacia
attcgtgacaatgtattcctgatcaccggcggtgcatcaggcctcggcgcggccaccgcgcgccttctcgtcgaaaacggcggcaaggtggtgctcgccgacctgaatgtggacgccggcgaagcgctcgcgaaagaactcggcggcgtgttcgtcaaatgcgacgtcagccgcgaagacgacgccactcaggccgtcgaagccgccacgaagctcggcacgctgcgcggcctcgtcaattgcgcgggcgttgcgcccgccatcaaaacgatcggcaaggacggcccgcatccgctcgactcgttcacgcgcaccatttcgatcaacctgatcggcaccttcaacatgatccggctcgctgccgcagccatgtcgaagaacgagccgaatgcgaacggcgagcgcggcgtgatcatcaacacggcgtccgtggcggcgtatgacggccagatcggccaggcggcttatgcggcgtccaagagcggtgtggtcggcatgacgctgcccatcgcacgcgacctgtcgcgcaacgcgatccgcgtgatgaccattgcgccgggcattttcgaaacgcccatgctgctcggcatgccccaggaagtgcaggacgcgctcggcgcgatggtgccgttcccgccgcgtctcggcaaaccggcggagtacgcaatgctggccaaacagatcttcgacaaccccatgctcaacggcgaagtgatccgtctggacggcgcgatccgcatgcagccg

SEQ ID NO: 30964 - DNA, 771 bp, Burkholderia cepacia
aggaacgacatgttgcgtgtgattaccgccaacctgaacggcatccgctcagcggcgaagaagggctttttcgactggttcggagaacagaaggccgacgtgctgtgcgtgcaagaaatcaaatgctcgcaagacgacatgaccccggaattcatggcgccgcacgatttcaccggctattttcagcacgccgtgaagaaaggctatagcggcgcgggcgtgtacacccgtcacgaaccggacgaagtggtgatcggcttcggcagcgaggaattcgatccggaagggcgctatgtcgaactgcgtttcggcaagctgtcggtgatttcggtgtacgtgccgtcgggttcgagcggcgacgagcgccagcaggccaaataccgtttcatggacgagttcatgccgcatctcgcggaactggctcaggagcgcgaagtgatcgtgtgcggcgacgtcaacatcgtccacaaggaaatcgacatcaagaactggaagagcaaccagaagaattcgggttgcctgccggaagagcgcgcgtggctcaccaaactgttcgatgaggtcggttacgtcgacgtgttccgcacgctcgaccagcggccggaacagtacacgtggtggagcaatcgcggccaggcgtatgcgaagaacgtcgggtggcggatcgattatcagatcgccacgccgggtatcgcgagcaaggcgaaacgcaccgacgtgttccgcgatatcaagttcagcgaccatgcgccgctgacggtcgactacgac

SEQ ID NO: 30965 - DNA, 846 bp, Burkholderia cepacia
aaggctgaaatcctggccgaggcgctgccctacattcgccagtatcacggcaagaccgtggtcatcaaatacggcggcaacgccatgaccgaagagcgtctgaagcagggcttcgcgcgcgacgtgatcctgctgaagctggtgggcatcaatccggtcatcgtgcacggcggcggtccgcaaatcgaccaggcgctgaagaagatcggcaaacagggcaccttcatccagggcatgcgcgtcaccgacgaagaaacgatggaagtcgtcgaatgggtgctcggcggcgaagtgcagcaggacatcgtcacgctgatcaaccacttcggcggtcacgcggtcggcctgacaggcaaagacggcggcctgatccacgcccgcaagatgctgatgccggatcgcgacaatccgggccagtatgtcgatatcggccaggtgggcgaagtcgaggcgatcaacccggcggtcgtgaaagcgctgcaggacgacgcgttcattcccgtcatctcgccgatcgggttcggcgaagacggcttgtcgtacaacatcaacgcggacctggtcgcgggcaagctggcggtggtgctgaacgccgaaaagctggtcatgatgaccaacatccccggcgtgatggataaggaaggcaatctgctcaccgatctgtccgcgcgcgaaatcgacggcctgttcgcggacggcacgatctccggcggcatgctgccgaaaatctcgtcggcgctggacgcggccaagagcggcgtgcggtcggtgcacatcatcgacggccgcatcgagcactcggtgctgctggaaattctcaccgaacagccgttcggcacgatgatc

SEQ ID NO: 30966 - DNA, 855 bp, Burkholderia cepacia
atgaaactgaaattcaccaagatgcacggcgcgggcaacgacttcgtcgtgctcgacggctacacccaaccggtcaacctgacgccggcgcaggtgcgcgcgctcgcggaccggcatttcggcgtcggcgccgaccagttgctgctggtcgaaaagcccacggtggccggtgtcgatttcagatatcgcatcttcaattgcgacggcggcgaagtggagcattgcggcaacggcgcgcgctgcttcgtcaagttcgtgcgcgagcgcggcctcaccgatcaacgcagcgtgcgcgtgcaggtgcagaagggcaccatcacgctgaccatgcaggaaaacggcgaagtgctggtcgacatgggcacgcccgtgttcgacccggagcgcgtgccgttcgccaccaaaggcctcgaaggccgccgcgagggagcggacacgctctggccgctcgacgtgagcggcacgacacggtggatttcggtggtctcgatgggcaatccgcacgccgtgcaggtcgtcggcgacgtcgaagcgttcccggtgctggccgaaggcccggtgatcgagcgtcatgcgcgttttccgcagcgggtgaacgcgggcttcatgcagatagtcggccgcaatgaaatcaggctgcgcgtgtacgagcgcggcgcgggtgaaacgctggcgtgcggcacgggcgcatgcgcggcggtcgcggccggcatccggcgcgggctgctcgactcacccgtgcgcgtgcacacgcacggcggcgacctgaccatctcgtgggacagcacgcgagaaggcgaaccgctactcatggccggaccggccgtgaccgttttcgaaggcgagatcgagctg

SEQ ID NO: 30967 - DNA, 1149 bp, Burkholderia cepacia; identical to SEQ ID NO: 28208

SEQ ID NO: 30968 - DNA, 1560 bp, Burkholderia cepacia; identical to SEQ ID NO: 28209

SEQ ID NO: 30969 - DNA, 1548 bp, Burkholderia cepacia; identical to SEQ ID NO: 28210

SEQ ID NO: 30970 - DNA, 2115 bp, Burkholderia cepacia
atgacctcaagaaatcgccgtgattttctgcgctccgccgcgcatgcagccggttccgccaccgcattgagcatgctgcctctgggcattcgcaatgcgctcgccattcccgccaacaacaagaccggcacgattcgcgacgtcgagcacatcgtcgtgctgatgcaggaaaaccgttcgttcgaccactacttcggcacgctcaaaggcgtgcgcggttttggcgacacgcgcgccatcaatctgccgaacggcaagcccgtgtggtatcagccgctcgcggcggatatcggctacgtgctgccgttccgccccagcgcgcccaacctggggctgcaattcctgcaagatctcgcgcacgactggaccagcacgcacgcggcatggaacggcggccgctacgatcaatgggtgcccgcgaaaagcgccacgacaatggcctacctcacgcgcgaggacattccgtttcactatcaactcgccgacgccttcacgatctgcgacgcgtatcactgctcgctgatgggaccgacggacccgaatcgctactacatgtggagcggctgggtaggcaatgacggcagcggcggcggtccggtgatcgacaactccgaactcggctacggctggtccacgtatcccgaagtgctacagagcgcgggcatttcgtggaagatctatcaagacatcggcacgggtctcgacgcgaatggttcgtggggctggacgcagaatccgtatatcggcaattacggcgataactcgctgctctacttcaaccagtaccgcaacgcccagcccggcaacccgctctacgacaacgcccgcaccggcacgaacgcggcgaaaggcgacggctacttcgacatcctcaagcgcgacgtacagaacaacgcgctgccgcaggtgtcgtggatcgtcgcgcccgaagcctattccgagcacccgaactggccggcgaactacggcgcgtggtacatcgaccaggtcctgcagattctcacgtccaatcccgaggtgtggagcaagacggtgcttctggtgaactacgacgagaacgacggcttcttcgaccacatggcgccgcccttcgcgccgtcgtcgagcgcgaacggtctgtccaccgtcgacaccaccaacgaaatctatacgggcgacgcgaagactccctccggcccgtatggactcggaccgcgcgtgccgatgctggtggtttcgccgtggtcgaaaggcggctatgtgtgttcggaactgttcgaccatacgtcggtgatccgctttatcgaaaagcgcttcggccacgaccacaatctcggcgaatcgaacatcacgccgtggcgccgtgcggtgtgtggcgatctgatgtccgccttcaacttcagcaatccgaacgacgccatcccggcgctgccgagcacgagcggctacgttccggcggatcagaaccgccacccggactacgtgccgctgccgccggccttgcaggccgtgccgaaacaggagcccggcgtgcgccccgcccgtgcgctgccctatgaactgttcgtgcgcgtgcacggcgaaggcgcggccaacacactcaccatgcgcttcgtcaacacgggccgcgccggcgcggtgtttctcgtctacgccgctcacagtctcgacgcaccgcgcacctatacggtggaagccggcaagcggctgcaggacccgctgccgttgaatgccgacggcagctacgactacaccgtgtacggcccgaacggctttctgcgccgcttcgcgggcaagccggtgtcgcgcagctggtggcatggctcggacatcgcgcgccctgaagttgcagaaggctacgacgtttcgaacggcaacctgcaattgcggctggagaacgtgggcagcgcgcgttgccagttcacgatcgtcaacgcatacgatccgggcaatgcgatcaagcattcggtgcgcggcggcgataccgaacagctctatctggatctgcgcaatgcacatggctggtatgacctggccatcacggtcgataccgatccgctgttcgcgcggcgctttgccggacacgtggaaaccggcaagagcagcatgagcgatcctgcgctgggcgcctgaacc

SEQ ID NO: 30971 - DNA, 1599 bp, Burkholderia cepacia
tacgaatcgctgacggcaaacttcgcgtggcagatcccggcgcgctacaacatcggcgtggacgtgtgcgataaatgggccgacggttcgggccgtctcgcgctgatctacgaagatcccgagggcactgcgacccgctatacgttcgacgagttgaaagcgctgtccgaccgcttcgccaacgcgctgctcgcagcgggtgcgcaacgcggcgaccggatcggcatcttcctgtcgcaatccgtcgaaacggctatcgcgcatctcgccgcctacaaggccggcatggtggccgtgccgctgttcgcgctgttcggcgtcgatgcgatcgaacatcggctcggcgatagtggcgccgtggcgctgattaccgatcacggcggcgtgcagaaggtcgacgaaatccgcgcggcgttgccgtcgctgcgcaatgttttcagcgtggatatcgatcgggacaacggcgatccgcatgcgccggtgcgttcgttctggcacgcgctgaagagcgcgcccgcgggtttcacacccgtcgataccggcgcggacgatcccgcggtgatcatctatacgtcgggcacgaccggcaaaccgaagggcgcgctgcatgggcaccgcgtgttgccaggccacctgccgggcgtcgagatgtcgcaacagggctttcccgcgcacgccacgctgatctggacgcccgccgactgggcatggatcggcggcctgttcgacgtgctcttgccctcctggcatcacggcgtgccggtactcgcgcgccgctttgcgaaattcgacggcgaggccgcgttcgatctgatggcgcgtcacgcggtctcgcatacgtttctgccgcccaccgcattgaagatgatgcgcggcgtcgaacgtcccgaacgctggagcctcgcgttgcgttcggtggcgagcggcggtgaatcgctcggcgaggaattgatcggctggggccgcaaagcgctgggcgtcacgatcaacgagttctatgggcagacggagtgcaacgtcgtggtgtcatcgtgcgcggcgctcttcgaaccgcgcttcggcgcgattggccgcgcggtgccggggcatcatgtcgcgattgtcgatatggacggcaacgaattgccgccgggcgcgatcggcgatatcgcggtggccgcgcccgatccggtcatgtttctcggctactggggcaacgaggcggcgacgcgcgagaaattccgcggcaagtttctggtgaccggcgacctcggcacatgcgacgcggacggcttcatccgttttgtcggccgtggcgacgacgtgatcacgagcgccggctaccgcatcgggccggcttcgatcgaagactcgctgctgcgtcatccggctgtttcgatggcggtcgtgatcggcgcgccggatcgcgagcgcaccgagatcgtgatggcgttcgtggtgctgaaccccggctttgccggcgacgcggcgctggtgcgcgagatccagcagcatgtcaaaacgcgtctcgcggcgcacgagtatccgcgcgagattcgctttgtcgacagcctgccgttgacggcgaccggcaaggtgatccgcaaagccttgcgcgag

SEQ ID NO: 30972 - DNA, 798 bp, Burkholderia cepacia
cgttcggttttccgcgaaggcctcttcgccggcaaagtcattatcgtcaccggcgcgggtagcggtttaggccgatgcaccgcgcacgaactcgcatccttaggcgcaaccctggcgctggtcggccgaagcgaggacaaactgaaagcggtgcaagccgaactggccgaagatcatcaacgcacctccgccggacacaagacctattcctgcgacatccgcaacgagcaacaggtccgcgaaacgatcgcttcgatcattgcggatctgggccgcgtagacggcctcttcaattgcgcgggcggccagttccccgcgaagctcgaaaagatttccctgaatggctgggacgcggtagtgcgcaacaatctgcacggcacgtttctgatgtcccgcgaatgctatacgcaatggatggaacatcacggcggaacgatcgtgaacatgctggcggatatctggggcggcatgcccggcatgggtcactcgggcgcggcgcgggcgggcgtgtggaacttcacggaaaccgccgcatgcgaatggggccacgcgggggtgagagtcaacgcggtcgcgccgggctggatagcgtccgcgggtatggacagctacaacgaagactaccaggcgctgttgcgcacgctcaggcataaggtcccgctgcagcgcttcggcaccgaatccgaactggccggcgcggcggtgtttctgttgtcggaggcgtcggcgttcatcaacggcacggtgatccgcgtcgacggcggcgtgccgaacgcgcgccactcgtggccgcttccg

SEQ ID NO: 30973 - DNA, 1212 bp, Burkholderia cepacia; identical to SEQ ID NO: 28214

SEQ ID NO: 30974 - DNA, 1047 bp, Burkholderia cepacia; identical to SEQ ID NO: 28215

SEQ ID NO: 30975 - DNA, 1479 bp, Burkholderia cepacia; identical to SEQ ID NO: 28217

SEQ ID NO: 30976 - DNA, 840 bp, Burkholderia cepacia; identical to SEQ ID NO: 28218

SEQ ID NO: 30977 - DNA, 756 bp, Burkholderia cepacia; identical to SEQ ID NO: 28219

SEQ ID NO: 30978 - DNA, 1299 bp, Burkholderia cepacia; identical to SEQ ID NO: 28220

SEQ ID NO: 30979 - DNA, 735 bp, Burkholderia cepacia
ttgattctgataacgggcggaggccgtggcgtgggcgcggcgactgcgcggctcgctgccgcacaaggttacgatgtcgcgataagcttcgtctccgacgagtctgccgctcttgcggtggcggccgacgtggaagcggccggacgccgggctttagccgtgcgcgcggacagcgcggatcccgagcaggtcgcccggctattcgccgcgatcgaccggacgttcggccgcatcgacgtgctggtgaataacgccgcgatcattgcaaagcagtcccgcctggaggacctcgaattcgcgcggatgcagcgtatcttcgcggtcaactcgatcggcccgatcctctgtgcgcagcaggcggtgaagcggatgtcgcatcgttacaatggccgaggcggcgtcgtgatcaacatctcctcggcatcggcccggctcggcagtccaaacgaatatgtcgactatgctgcgtcgaagggtgcgctcgagacattcactaccggttttgcaaaagaagtcgcgcgggacggaatacgcgtcaactgcattcgccccgggcacatctacaccgacatgcatgcaagcggcggagagccgggacgggtagatcgcgtcagggactcgatcccgatgggaagaggcgggcagcctgaagaggttgcgcgggcgattctatggctggcaagcgccgaggcctccttcatcaccggcacgttcctcgacgtcaccggcggcaag

SEQ ID NO: 30980 - DNA, 753 bp, Burkholderia cepacia; identical to SEQ ID NO: 28222

SEQ ID NO: 30981 - DNA, 726 bp, Burkholderia cepacia; identical to SEQ ID NO: 28223

SEQ ID NO: 30982 - DNA, 3507 bp, Burkholderia cepacia
ctgacctcgatcaaactcgctggcttcaagtcattcgtcgatcccacgcatttccaggttccgggccagctagtcggcgtggtcggaccgaacgggtgcggcaagtccaacatcatcgacgccgtgcgctgggtgctcggcgaatcgcgcgcctccgaactgcgcggcgagtcgatgcaggacgtgatcttcaatggctcgaccgcgcgcaagcccggcagccgcgccagcgtcgaactggtgttcgacaacgccgacggccgggccgcgggccagtggggccagtatgccgaaatcgccgtcaagcgcgtgctcacgcgcgacggcacctcgagctactacatcaacaatttgccggcgcgtcgccgcgacattcaggacatcttcctcggcaccggtctcgggccgcgcgcatacgcgatcatcgggcagggcatgatcgcgcgcctgatcgaggcgaagccggaagagctgcgcgtgttcctcgaagaagccgcgggtgtgtcgaagtacaaggaacgccgccgcgaaaccgaaaaccgtctgcacgacacgcgcgaaaatctgacacgggtcgaggacatcgtccgtgaactgggcgcgaacctcgagaagctggaagcgcaggccgtggtcgccacgcgttacaaggaactgcaggccgacggcgaagagaagcagcggctcttgtggctattgcgcaagaacgaagccggtggcgagcaggaacgccagcagcgcgcgatcgaacaggcccagatcgacctcgaagcgcacaccgcgaagctgcgcgaagtcgaagcgcaactcgaaacgctgcgcgtcgcgcattattccgcgagcgacgcaatgcagggcgcgcaaggcgcgctctacgaggcgaattcggaagtcagccggctcgaagccgagatcaagttcatcgtcgaatcgcgcaatcgggtgcaggcgcagatcgccgcgctgaacgcgcagcgtgagcaatggcagtcgcaggcgcaaaaagcgcaagacgatctcgcggacgccgaagaacaactggcggtggccgaagaaaaagccacactggtcgaagacgaagccgctgccaaacacgacgcgatgcccgcgctcgaagctcgctggcgcgacgcgcaaaccgaactgaacgccgagcgtggcgggatcgctcagaccgaacaggcgctcaagctcgaagccgcgcatcagcgcaatgccgatcagcaattgcagcaactgcaggcgcgtcacgagcggttgaagtcggaagcgggcggtctcgacgcacccgacgaagcgcagctcgaagacctgcgcatgcagcttgccgagcacgaggaaatcctgcacgacgcgcaaacgcgtctggccgacgcgcaggaaacgctgccgcgcctcgacggcgagcgccgcgcagcgcaggagcgcgtgcaggcggaaagctcgcagattcatcagctcgacgcgcgccttgccgcgctcaagcagttgcaggaaaacgtccagaccgaaggcaagatccagccgtggctcgaaaagcacgagctgaacggcctgccgcgtctgtggaagaaactgcatgtcgaagccggttgggaagccgcgctcgaagccgtgctgcgcgagcggctcgccgcgctcgaagtgtcgaacctcgactgggtcaaggccttcgccaccgacgcgccgcccgccaagctcgctttttacgcgccgcctgtcgccggtcagcctgccgccacgccgcctgcgctgcggccgctgctgtcgctggtgcggatcgacgacgcgggcatccgcgcggtgctgaacgactggctcggcctttcgttcgtcgccgacgatctgcagcaggcgctcgccatgcgctcgcaattgccggaaggcggctcgttcgtcgtcaaggcggggcatgtggtgacgcgcgtcggcgtccagctgtatgccgccgactccgagcaggccggcatgctggcccgtcagcaggaaatcgaaaatctcgcgcgtcaggttcgcgcccaggcgttgctcgcggacgaagcgaaagccgccgcgatccgcgccgaagccgcacacacgcaggccgcgcaggcattgaccgacgtgcgccagcaggcggagcgcgccacgcagcgcgtgcacgcgttgcaaatggacgtgctcaaactcacccaggcgcacgagcgttacacccagcgcagcacgcagattcgcgaggaacttgcagagatcaccgcgcagatcgaagagcagcgcgccatgcgcgcggagtcggaagcgaacttcgagcgtcatgacggtgagctcgccgaactgcaggcgcgtttcgaagatcatcaactggcgttcgaagcgctcgacgaagaactcaccgccgcgcgcggccaggcgcgcgatctggaccgtgccgctaccgacgcgcgctttgccgcgcgcaacatggcgaaccgcatcgacgaactgaagcgcagcattcaggtcgcgcacgagcagagcgagcgtgtcgcggcgtcgctggaagacgcgcgcgccgagctggaaaccatcaacgagcagaccgcgcacaccggcttgcaggacgcgctcgatattcgcgccgtcaaggaagaagcgctgcacgccgcgcgcctcgaactggacgatctcaccgccaagctgcgtgccgccgacgaaacgcgtctgacggccgagcgcgcgttgcagccgctgcgcgaccgcatcaatgaactgcagttgaaggaacaggcggcgcgcctgaacggcgagcagttcatcgagcaacttgccgcggccggcgtcgatgaggcgcagttgcaggccaagctcacgccggacatgaagccgtcgtatttgcagggcgaagtcacgcgcatcaacaacgccatcaccgcgctcggcccggtcaacatggccgcgctcgacgaactgaaggcggcgaccgagcgcaagtcgttcctcgacgcgcagtccaccgatctgaacagcgcgatcgaaacgctcgaagacgccatccgcaagatcgacgcggaaacgcgcacgctgctgcaaggcaccttcgatcaggtgaaccagcatttcggcgaactgttcccgcgtctgttcggcggcggccaggcgaagctgatcatgaccggcgacgaaattctcgacgccggcgtgcaggtgatggcgcagccgccgggcaagaagaattcgacgattcacctgctctcgggcggcgaaaaagcgctgaccgccaccgcgctggtgttcgcgatgttccagctgaaccccgcgccgttctgtctgctcgacgaagtggacgcgccgctcgacgacgccaacacggaacgtttcgcgaacctcgtgcgggcgatgtcggacaaaacccagttcctgttcatctcgcacaacaagatcgcgatggaaatggcgcagcaattgatcggcgtgaccatgcaggagcagggcgtgtcgcgcatcgtggccgtcgacatggaaacggccgcgggtttcgcccagaatatc

SEQ ID NO: 30983 - DNA, 1203 bp, Burkholderia cepacia; identical to SEQ ID NO: 28225

SEQ ID NO: 30984 - DNA, 234 bp, Burkholderia cepacia; identical to SEQ ID NO: 28226

SEQ ID NO: 30985 - DNA, 1418 bp, Burkholderia cepacia
tcgttcgcgtcgctcggtctgtccgcggacgtcgtctccgcgctgaccgccgctggctatcagaaccccacgccggttcagcaacgcgcgattcccgccggcatcgccggccgtgacctgatggtctcgagcccgaccggttcgggcaagaccgccgcgttcatgctgcccgccatcgaacgtttctcgcaactgcaaaagacgcaggccggccagccgcgtgagccgcgtccggccgacggcgcccgcacgcgccgtccgcaaccggttgcccgtccgaccatgctggttctgacgccgacccgcgaactcgcaatgcaggtcaccaccgccgccgccacttacggcaagcacctgaaacgcctgcgcaccgtcagcattctgggcggcgtcgcttacggccagcaattgatgctgctcgcgaagaacccggaaatcctggtcgccacgccgggccgtctgatcgaccacctggagcgcggccgcatcgatctgtcgcaactgcagatcctcgtgctcgacgaagccgaccgcatgctcgacatgggctttatcgaagacatcgaaacgatcgttgccgctacgccggctacgcgtcaaaccatgctgttctcggccacgctcgacggcaagatcacttcgctgaccggccgcctgctgaaggacccggagcgtatcgaaatcgttcagcgcatggagcagcgcaccaacatcgcgcaaaccgtccattacgtcgacgaccgcgatcacaaggaccgtctgctcgaccatctgttgcgcgactccggcctcgatcaggctatcgtcttcacggcaaccaagatcgatgccgaccagctggccggccgtctggccgatgccggtttcgaatcggccgccttgcatggcgatctgccgcagggcgcgcgtaaccgcacgatccgcgcgctgcgcgagcgccgcgtgcgcgtgctggtggcaacagacgtcgccgctcgcggtatcgacattccgggcatcacgcacgtgttcaactacgacctgccgaagttcgccgaagactacgtgcaccgcatcggccgtactggccgtgccggccgctcgggtatcgcggtgagcctcgtgcatcacgcggaacagggcgcgctgaagcgcatcgagcgcttcgtgcgcaccccgctggcagtcaatgtggtcgaaggcttcgagccgcgcaagtcggcaccgtcgggtaacggccgtcctggctttggtggccgcggccgtccgggcggcggcaacggcggtggccgtcgcttcggtagcggctcgggcaagccggccggcaacggcggcgctgcgcgcagcggcaccggtagcaacggcggcggctgggccggcaagtcggctggcggcggttcgcgtgaaggcggcttcggcggcggttcgcgcgacggcgg

SEQ ID NO: 30986 - DNA, 962 bp, Burkholderia cepacia; identical to SEQ ID NO: 28228

SEQ ID NO: 30987 - DNA, 1218 bp, Burkholderia cepacia
atcatgccgatcgtattcatcacgtacagcctcgcctatctggatcgcgcgaacttcgggttcgcgtccgccgccggcatcaaccaggatctcggcatcagcaaggggctgtcgtcgctgatcggcgcgctgttcttcctcggctatttcttcttccagattcccggcgcgatctacgcggaacgccgcagcgtcaagaagctcgtgttctggagcctggttctgtggggcggttgcgcggcgctgaccggcatggtcagcaacattccgtcgctgatggtgatccgcttcgtgctcggcgtggtcgaggccgcggtcatgccggccatgctgattttcatcagcaactggttcaccaagagcgagcgctcgcgcgccaacacgttcctgattctcggcaatccggtgacggtgctgtggatgtcggtggtgtcgggctatctggtgcattcgttcggctggcgtcacatgttcatcgccgaaggcgcgcccgcgatcatctgggcggtgatctggtggttcatcgtgcaggacaagccgcagcaggtgtcgtggctcacgcagcagcagaaggacgacctcgccgaaacgctgcgcgccgagcaggccgcgatcaagccggtgcgcaactacagcgaggccttcaaaacgcccgcggtgatcaagctgtgcgcgcaatatttctgctggagcatcggcgtgtatggcttcgtgctgtggttgccgtcgatcctgaagaacggttcgacgctcggcatggtcgaaaccggctggctctcggcgctgccgtatctcgccgcgaccatcgcgatgcttgcagcttcgtgggcatcggataaactcaaccgccgtaaagtcttcgtgtggccgttcctgctggtcggcgcggtggcgttcgcggcttcgtacgcgctcggctccacgcatttctggctttcatatgcattgctggtgatcgccggcgccgcgatgtacgcgccgtatggcccgttcttcgcgatcgtgccggaactgctgccgaagaacgtcgcgggcggcgcaatggcgctgatcaacagcatgggggcgctcggttcgttcgtcggctcgtatgtggtcggttatctgaatggcgccaccggttcgcccgccgcgtcgtacgcgttcatgagcgtggcgctcgtcgccgccgtgattctgacgctggtcgtcaaaccgcagccgcaagcgctgaacaat

SEQ ID NO: 30988 - DNA, 1383 bp, Burkholderia cepacia
cgcgagaccatcggcgccacgcaggtgctgaccgatccgcacgacaccgccccttacctgaccgactggcgccgccgctacaccggcgcggcgtgcgcggtgctctgcccggccacgcctgacgaagtcgcggcgctcgtgaaactcgccgtcgagcatcgtatcgcgctggtcccgcaaggcggcaacacgggtctcgccggcggcgcgacgccggacgcaagcggcgcgcaggcagtcatcagcttgcggcgtctgaaccgggtccgtgacattgatccgcacaacaatacgattaccgtggaagccggcgtcatcctcgccgaagtgcagaagcacgccgaagaggcgggccgactgttcccgctgagcctcgctgccgaaggcagttgcacgatcggcggcaatctcgccaccaacgcgggtggcaccggcgtgctgcgctatggcaacacgcgcgagctgtgcctcggcctcgaagtggtcacgccgcaaggcgaactgtgggacggcctgcgcggactgcgcaaggacaacaccggttacgatctgcgcgacctctttatcggcgcggaaggcacgctcggcatcatcaccgccgccgtgctcaagttgcatccgcaaccggccgcgcgcgtcacggcgctcgccgcactcgcatcgccgcacgccgcgctcgattttctgtcgctcacgcagcgcgtcgccgggccgctgctgaccggtttcgaattgatgtcggatttttgcctgcgtctggtcggccggcacttcgagcagatgcgctatccgttcgccgagccgcacgcgcaggtcgtgctgctcgaactgtcggacagcgagagcgaggagcacgcgcgcgaactgttcgaacgtctgatggaaacggcgctcgagggcggcctggtgcaggacgccgtggtcgcggaaaatctcggccagtcgcgggcgttctggaatctgcgcgaacacattccgctcgcccaggccgaagaagggctgaacatcaagcacgatatcgcggtgccgatctcgcgcatcggccacttcatcgaggaaaccgacgcggcaatcgcgcaggccgtgcccggcgcgcgcatggtgacgttcggccatctcggcgacggcaatctgcactacaacgtgcaggcgcccgagggcgtcggcgccaaggcgttcctccagcagtaccaggccgcgatcaatcagatcgtctacgacagcgtgcaccggcatcgcggcagcatcagcgcggaacacgggctcggccagttgaaaatcgacgaggcgatgcactacaagcaggacgtcgaggtgcagttgatgcgcgccgtcaaacgcgcgctcgatccgctgaacctgatgaatccgggcaaggtgcta

SEQ ID NO: 30989 - DNA, 1266 bp, Burkholderia cepacia
ttcgacacgcttgcgctgcacgccggcgctgctcccgacccgaccaccggcgcgcgcgccacgccgatttaccagactacctcgttttcgttccgcgattccgaccacgccgcggcgctcttcaatatggagcgcgccggtcatgtttattcgcgcatttcgaacccgaccgtggccgtgttcgaggaacgcgtggccgcgctggaaaacggcgcgggcgcgatcggcacggcaagcggccaggcggccctgcatctggccattgccacgctgatgggcgcgggttcgcatatcgtcgcctccagcgcgctgtacggcggctcgcacaatctgctgcactacacgttgcggcgcttcggcatcgagacgactttcgtcaaacccggcgacctggacgcgtggcgcgccgcgctgcgcccaaacacgcggctgctgttcggcgagacgctcggcaatccggggctcgacgtgctcgatatcgccgccgtcgcgcagatcgcgcatgagcaccgcgtgccgctgctggtcgactcgaccttcaccacaccttacctgctcaaaccgttcgaacatggcgcggacttcgtctatcactcggccaccaaattcctcggcggccacggcacgacgatcggcggcgtgctggtggacggcggcacgttcgacttcgacgcctcggggcgcttccccgaattcaccgaaccttacgacggctttcacggcatggtgttcgccgaggagagcaccgtcgcgccgtttctgctgcgagcacgccgcgaggggctgcgcgacttcggcgcatgcctgcatccgcaagccgcatggcaactgctgcaaggcatcgagacgctgccgttgcgaatggaacggcacgttgccaacacgcgccgggtggtcgagttcctcgccggtcacgccgcggtcggggccgtcgcctatccggaactgcccacgcaccccgaccacgcgctcgcgaagcggctgctgccgcgcggcgccggtgccgtgttcagcttcgatctgcgcggcgaccgcgccgccggacgcagctttatcgaagcgctctcgctgttctcgcatctcgcgaacgtgggcgacgcgcgctcgctcgtgatccatcccgcctcgaccacccactttcgcatggacgccgctgcccttgccgcggccggtatcgccgaaggcacgatccgcctctcgatcggcctcgaagatcccgacgatctgatcgacgatctcaagcgcgcgctaaaggccgcacagaaa

SEQ ID NO: 30990 - DNA, 1059 bp, Burkholderia cepacia
tccggcaacacgctcggtacgcttttcactgtcacgaccttcggcgaatcgcacggtcccgctatcggctgcgtgatcgacggctgcccgccgggcctggcgctcaacgaagccgacatccagctggagctcgaccgccgcaagcccggcacgtcgcgccacgtcacgcagcgtcaggaagaagacaaggtcgagatcctctcgggcgtgttcgaaggccagaccaccggcgcgcccatcgcgctcctgatccgcaacacggaccagcgcagcaaggattacggcaacattgccgacacgttccgtccgggccacgccgactacacctactggcagaaatacggcattcgcgactatcgcggcggcggccgttcgtcggcccgtctcacggcgccgacggtggccgcgggcgcggttgcgaagaagtggctgcgcgagaagttcggcacggagattcgcggctatatggccgcgctcggtgaaatcgacgtgccgttcgtcgactgggcgcacgtgcgcgaaaacccgttcttcgtgcccaaccagcagatcgtgccgcaactggaagcgtatatggacgcgctgcgcaaggaaggcgactcgatcggcgcgcgcatcaacgtggtggcctccggcgtgccggtcggcctcggcgagccgctgttcgaccggctcgacgcggacattgcgcatgccatgatgggcatcaacgcggtgaagggcgtcgaaatcggcgcgggctttgcgagcgtcgcgcaacgcggttcggtgcacggcgacgaattgacgccggagggcttcgtcggcaatcacgcgggcggtgtgctcggcggtatttcgaccggacaggacatcacggtgtcgatcgcgatcaagccgacttcgagcattcgcacgccgcgccgctccatcgacaaggcggggcaaccggccgtcgtcgaaacgtttgggcggcatgacccgtgcgtcggcattcgcgccacgccgatcgccgaatcgatgctcgcgctggtgctcatcgaccacgcgctgcgccatcgcgcgcaatgcggcgacgtg

SEQ ID NO: 30991 - DNA, 759 bp, Burkholderia cepacia
aatctggaaggcaaggttgcgctgattacgggcgcttcgagcgggttgggaaagcgctttgcgcaagtgctgtcgcaggcgggcgccaaggtcgtgctggcgagccggcggaccgagcgtctgaaggaattgcgcgccgagatcgaggcgtccggcggtgcggcgcacgtcgtatcgctcgacgtcacagattatcagagcatcaagtcggccgtcgcccatgcggaaaccgaggccggcacgatcgacattctggtgaacaactcgggcgtgtcgaccacccagaaactctccgaggtcacgcccgctgacttcgaatacgtgttcgataccaacacgcgcggcgcgttcttcgtcgcccaggaagtcgccaagcgcatgatcatgcgcggcaacaacgcgcagaatccgtcgtaccggatcatcaatatcgcgtcgatggcgggcttgcgggtgctgccgcagatcggcctttactcgatcagcaaggcggccgtcgtgcatatgacgaaggcgatggcgctggagtggggcaagcacggcatcaacgtcaacgcgatctgcccgggctatatcgacaccgagatcaaccatcatcactggtcgacggagcaagggcagaagctcgtgtccatgttgccgcgccaccgcgtcggcaaaccggacgacctggacgggctgctgctgctgctggcagccgacgaatcgcagttcatcaacggctcggtgattgcggcggacgacggattcgggctctcc

SEQ ID NO: 30992 - DNA, 993 bp, Burkholderia cepacia
attgtcgccgacgcgcaaaaagccttcgcagaagccaccgacgtcaccaccctcgagaacgagaaagctcgctttctcggcaaatcgggtgcgctgaccgagctgttgaagggccttggcaaactcgatcccgaaacgcgcaagaccgaaggcgctcggatcaacctcgtcaagcaacaagtggaagccgcgttgacggcccgccgtcaggcgttggccgaggcgttgctgaaccagcgcctcgccgctgaagccatcgacgtcacgctgcccggccgcggcaccggcgcaggcagcctgcacccggtaatgcgcacgtgggagcgcgtcgaacagattttccgtacgatcggattcgacgtggccgacggccccgaaatcgaaaccgactggtacaacttcacctcgttgaacagcccggagaatcatccggcgcggtccatgcaggacactttttacgtcgacggcaaagatgccgacggccgccagctgctgctgcgcacgcacaccagcccgatgcaggttcgctacgcgcgcaccaacacgccgcccatcaaggtgatcgtgccgggccgcacgtaccgtgtggacagcgacgcaactcactcgcccatgttcaaccaggtcgaaggcctgtggatcgacgagaacatcagcttcgcggacctgaagggcgtctacaccgacttcctcgagaaattcttcgagcgcgacgatattcaggtgcgcttccgtccgtcgtactttccgttcaccgaaccgtcggcggagatcgacatgttgttcgaaacgggcaagaacgccggcaagtggctcgaaatttcgggctcgggccaggttcaccccacggtgatccgcaatatgggcctcgacccggagcgttacatcggctttgctttcggcagtggcctcgagcggctcaccatgttgcgttacggcgtgcaggacctgcgtctgttcttcgaaaacgacctgcgtttcctgcgtcaattc

SEQ ID NO: 30993 - DNA, 1548 bp, Burkholderia cepacia
aacctcattgatctcatccagtcggcggcgcgccgcacacccgatgcggaatcgctcgtctgcggcgatgtccgcctcacctaccgccaactgctgcaaagcagccgtgcgttcggacaggtattgtcttccctcggtgtggctccgggcggacgcgtcgccatctttctcgacaagcgaatggagactgtcgtgtcgatgctcggcgcctgtgctgcaggatgcgttttcgttccggttaatccgctcctgaaaccggaacaggtggcccacgtgcttcgcgacagcggcgcccggtgcctcgtgaccaccgcattgcgtgtccgcgccctggccgcggagggcgttgcgccggtaaccgacctgatcctcgtagacgaaccggaccaggttactcctgatcagccgaccgcggtcagggttcaccgctggccagactgcatctccagccccgacgacgcgctggtgccggccccggccgtaacatgcattgacaccgaccttgccgccctcctctatacatccggctcgacgggattggccaagggcgtgatgctcagccaccggaacctgctcgaaggcgcctggagcgtcgccgagtatcttcggcttgatccgtctgaccgagtccttgccgtcctgcccctgagcttcgatgcgggcctcagccagctaacctcggcgtggtcggcaggcgccacagcagtgctgctgaactatctcacggctcatgatgctgtcctcgcgtgcgagcgcgaacatatcactgcgatcacgggtgtcccgccattgtggatgcaactcaccggcgcaacctggtcagacgcggcgcgcaatactttgcgctacttcgcgaacacgggagggcgtcttccgctgcctgttctgcagaagctgagggcgctgtttccgcacgctacgcccttcctgatgtacgggctgaccgaggcgttccgctccaccttcctcgaccctgccgaggttgaccgtcgacccgactcgatcggcaaggccgtgcccaatgcgcgggtactcgtcgttcgcgaggatggcacaccgtgcaacccggacgaagccggcgaactggtgcatgtcggcgcatgcgtcaccctcggctactggaacgacgccgtgcgcaccgcgcaacgctaccgcccttcgcccgaggcgaaacccggtggcgcgccgcgtgacatggcggtgtggtccggggacctcgtgcggtgcgacagcgaaggttttctctatttcatcgcccgcaacgacgcccagatcaagagctccggctaccggatcagcccggaagagatcgaggaaacagtccattcgagcggccttgtcgtggaagccgtcgcgctgggcgtcccggacgatgagctcggcgaagcggttgtgctgctcgtcgtcctcgccggtgattcagatatcgatgagctacgcaactggtgcacgcagcgcctgccgcgttacatggttcctcgccatatcgccagttatccggatattccacgcaacgccaacggtaaattcgacagggcggccctgcgt

SEQ ID NO: 30994 - DNA, 903 bp, Burkholderia cepacia; identical to SEQ ID NO: 28237

SEQ ID NO: 30995 - DNA, 1239 bp, Burkholderia cepacia
cagcgaaaaaataatgcgactccccgcggagtcggcgtgatgtgtccgttttacgccgatacggcgctgaacgcagagctctgggacgtcgaggggcgccgctatattgactttgccgcgggcatcgccgtgctcaatacgggtcatcgtcaccccaaggtcatggctgccgtgcgcgaacagcttgaccgctttactcacacctgctggcaggtcgtaccctacccgtcgtacgtcgaactcgccgaacaactgaaccggcttgcaccgggcgattttcagaaaaaggcgtcgcttttcagcacaggtgccgaagcagtcgaaaacgccatcaagattgcgcgagcgttcaccggccgagctgcggtgatcgccttcagcggcagctttcacgggcgcaccatgatgggcatggcgctgaccggcaaggttgccccgtacaaagtcggcttcggcccgttccccggcgaggtctaccacgcgccttacccgaacacgctgcatggggtcaccacgaccaatgcgctcgattcggtgcgggcgctgttcaaaaccgacgtcgatccgctgcgcgtggcggcgatcatattcgaacctgtgcagggagaaggcggcttctacgaagctccggccgacttcgtcaaagggcttcgggacatctgtgaccagcacggcattctgttgatcgccgacgaggtgcagaccggctttgcccgcaccggcaagctgttcgccatgcagcaccatgcggtcgccgcggatctcacgaccgtcgccaaaagtctggcgggcgggctccccttgtccggcgtgatcggccgtgccgatgtcatggatgcggcggcgcccggtggtctcggcggtacctatgcgggcaacccactttccgtggccgccgcgcttgccgtgctcgacgtgatcgaaagcgagaatctgtgcgagcgggccacgcaactcgggaaccggctgaaaagccacctgacgtcgatgcgcgaaagtcttccgcacatcgcggaaatccgcggaccgggggccatgattgcagcggaatttttcgaacccggcacgctcatccccgatgcggacttcgcaaagcgattccaggcgcgagcgctggagctcggcttgattctgctggtgtgcggtgtccattcgaatgtgattcgtttcctgtttccgctcacgatcgaggaagcggttttcgaagaagcgctggtgctgatagaaacggcgatgaaa

SEQ ID NO: 30996 - DNA, 1425 bp, Burkholderia cepacia
tccctctttcgtcaggaatgctacattgccggcgaatggattgaatccgatccgatggcccggatcgacgtcgtcaatccggccaacggcttgaagatcggtacagtgccgcgcgccacgcttgccgatgtgcgaacctgcatcgacgccgccgaacgcgcgctgcccgcgtggtccggaaagacgggcaaggaacgcgcagcgatcctgcggcgctggtacgaactgatgctgcaacatcaggaagaccttgcggtcatcatgacctgcgagcagggcaagcctttagccgaaagccgcggcgaaatcgtgtacgcggcgtcgttcctggaatggttcgccgaggaagcgaagcgtgtgtacggcgatacgatcccgacgccggcatccgaccggcgcattgtcgtgctgaaacagccaatcggtgtgtgcgccgccattacgccgtggaatttccccgcagccatgctcacgcggaagatcggccccgcactcgccgccggttgcacgatggtcctcaagcccgcgagccagactcccttctccgcgctggcgctgtgcgtgctggccgagcgtgccggcgtgcccgctggtgtgctgtcctgtgtgacaggaaaggcctcgatgatcggcgacgagttctgccggaacccggcagtgcgcaagctctccttcaccggctcgaccgaaataggcaagctgctgcttcagcaatgcgccagcacggtgaaaaaaacgtccatggaactgggcggcaatgcgcccttcatcgtattcgacgatgccgatctcgacgcagccgtcgtaggcgccatcgcggccaagttccgcaatgccgggcaaacctgcgtctgcgtgaaccgctttcttgttcaggacactgtccacgatgctttcgtcgagaagctgtccacggcgatcgcggcgctgaaggtgggagacggcctcgatgccggcacacggatcggtccgctcatcgacagcaaagcggttgagaaggcgcgcgagcacgtcgatgacgccatcgcaaggggcgcaacggtggtgacgggaggctcgggtcacgcgctcggaggcaattattttgaacccacgttgctaaccggcgcttcgaaggacatgaagatcttccgcgaagagaccttcggccccgtggcgcccgtgttccgcttcagaaccgaggaagaagcgatccagctcgccaacgataccgagttcggtctcgcctcctatttctacggacgcgacatcggcagagtgtggcgcgtggccgaggcgctcgaatacggcatggtcggcatcaacgaagggctgatctccacagaagtagcgccctttggcggcgtaaaggaaagcggtcttgggcgggaaggttcaaagtacggcattgaagactatctggaagtcaaatatctctgtatgggc

SEQ ID NO: 30997 - DNA, 1455 bp, Burkholderia cepacia
atggcagatcaagtcgaagttttctcgatgtatatcgacggcgagttcgtacaggccgaaggcggccgcacgctcgacagcatcaacccctggagcgggagcgtctgggcgaaggttcccgatgcgacggctgccgacgtcaatcgcgcggtcgaagccgcgcaccgcgcgttcacgagcggtccgtggccgaagatgacgccgaccgagcgcgcggtactgctgcaaaagctcgccgacaagctcgtcgaacacaaggaacgcctcggctacgtcgaaacgcaggacaccggcaagctgctgaaggagaccacctggcaggccggacacacggcccgcgcgtacacgtatttcgcggggctggccgataagctgcaaggcgatattccaccgtcgggcgccagcatgctgaatctggtcctgcacgaaccggtcggcgtcgtggcagctatcattccgtggaattcacaactgcaactgtcggcctacaagattgcgccggcactcgccacgggcaatacgatcgtcgtcaaagcgtccgaagacgcatctacaccgctgctcacgcttgcaaagctcgttcacgaagtgggcttcccgccgggcgtcatcaacttcgtatcgggcggcgccaatccgtgcgcgatcacgctgacgagccaccctctcgtccggcgcatcgcctttacgggcggcgcagatactgcgcggcgcctcatccccaactcggcgcacaacatcgcgaagctgtcgctcgaactcggcggcaagtcgccggtcatcgtgttcgacgacgcggatctcgacagttgtgtgaacggtatcgtggcgggcattttcggcgccagcggacagagttgtgcggcgggctcgcgtctgcttgcacacgaatcgattcacgacgttctcgttgaacggcttgtcgagcgttgcaaaacgatccgcgttggtgatccgtttgatgcggccaccaacatggggccgcttgccaccgcacgccaggtggaccggatcgagacgctgctggccagctcggtggaacagggtgcgcgtgttgtcagcggcggaaagcgtattggcgggttaccgttcaaccaatgcttcgagcccactattgcattgtgtgatcgtagcgactatccgatcgtgcaggaagaactgttcggccccgtgttgagcgtgctcaaattccgcgacgacgacgaagcggtcgccctcgccaacgacagcaagtacgcattcgccggcggcattttcagccgcgactttgcccgcgccatgcgcacggcgcgcgtggtcaacgcggggcgtctctggatcaacacgtaccgcgttaccggcgtcaacgttcctttcggcggattcaagcaaagcggctacggacgcgaagcaggtatcgatgcgctcaaggactacactgagacgaaggccgtcatgatcgaggtcggcggcgaa

SEQ ID NO: 30998 - DNA, 1623 bp, Burkholderia cepacia
tacgactacgtcgtcgtaggcgcaggctccgcgggctgcgccgtggccgcgcgactggcggaggacctgtcggtcacggtcgctctgctcgaagcgggcccgcatgaccaccacatgagcgtatgggtgccgataggtctggcatcgaccgtgcaaaaagccggtccacgcaactatgcgtactacacggaacgccagcccggccttgacggacgcccttcctttcagccacgcggacgcggcctgggcggcagctcgtcgatcaacggcatggtctacattcgcggacatcgcaacgattacgacgaatgggccggcatgggttgtacgggttggggcttcgatgacgtactgccctacttccgccgcagcgaatgcaaccagcgccacgccggacgcaccgacgacccgtggcacggcggcgacggcccgctgcatgtcagcgacctgcgttcgcccaacccgttctctcatcgtttcgtgaacgccgccctgcaagccggattgccgctgaatacggacttcaacggcgcggagcaggaaggcgccggcctttatcaggtcacgcaattcaacggcgaacgctggaatgccgcgcgtgcctacctgcacaacggcaatgcgaaagatgcgaacctgaacggcggccgcccgaacctcgatgttcttccggacacccaggtactgcgcctcgtcgtcgaggacaaacgcgcgcgcggcgtgcgcgtggtgcgtgcaggcatcgagcagacagtgcgggcccggcgcgaagtcgtgctcagttgcggcgccttcaattcgccgcaactgctgatggcttcgggcatcggtccggccgggcatctgcgcagccacggtatcgaggtcatacaggacctgcccggagtgggcgaaaatctgcaggatcacctcgacgtgatcgtcaacaaacaggtcaagtccaacgacctctacggctactcggcgggcggctttctgcggctcgcatccggcatatggcgttaccggcgcgatcgcagcggcatggtcagttccaacttcgcggaggcgggcgcctttgtgaagacccgccccgacctggccgtcccggacgtgcagctcgccttcgttctcgctctgctcggcaatcgcactgtggcgaaacgtagcaagctcgggcacggctactcctgccatgcttatattctgcgtccgcaaagccgcggtcatgtgcgtctgcgtagcgcggacatgcgcgacgcaccgtcgatcgatccgcgctttctgtcagcagaggccgacatggacgcgctggtcgccggcgtcagaatcgttcgccgtatctttgcgcagccggcgctggccgaagcgggcggacaggaactgctgacggacgacttcggaccggacgattcgaacgaagaggcgatccgggcgttcgtgcgcagtcgcgccgacagcgtttttcatccggtcggcacatgcaagatgggcatcgactcaatggccgtggtcgacccgagcctgcgcgtgcgcggcatcgaaggtctgcgcgtggccgacgcgtcgatcatgccgacgctgatcggcggcaacacgaatgcgcccgccatcatgatcggcgagaaagccgccgatctgatc
